United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 61

SEQ ID NO: 2168999 - RNA, 23 nt, Streptococcus pneumoniae R6
cuucacuuucccuuuccaagaau

SEQ ID NO: 2169000 - RNA, 18 nt, Streptococcus pneumoniae R6
cuucaucucuuacaguuu

SEQ ID NO: 2169001 - RNA, 15 nt, Streptococcus pneumoniae R6
cuucaucugguguga

SEQ ID NO: 2169002 - RNA, 22 nt, Streptococcus pneumoniae R6
cuucaucgcccaauuuauguaa

SEQ ID NO: 2169003 - RNA, 11 nt, Streptococcus pneumoniae R6
cuucauuuuuu

SEQ ID NO: 2169004 - RNA, 19 nt, Streptococcus pneumoniae R6
cuucauuaagucauagcca

SEQ ID NO: 2169005 - RNA, 14 nt, Streptococcus pneumoniae R6
cuucauguuuuccu

SEQ ID NO: 2169006 - RNA, 16 nt, Streptococcus pneumoniae R6
cuucaugaaauuauuu

SEQ ID NO: 2169007 - RNA, 17 nt, Streptococcus pneumoniae R6
cuucaugaaauuauuuc

SEQ ID NO: 2169008 - RNA, 19 nt, Streptococcus pneumoniae R6
cuucaugaaauuauuucac

SEQ ID NO: 2169009 - RNA, 14 nt, Streptococcus pneumoniae R6
cuucaugcuggcag

SEQ ID NO: 2169010 - RNA, 16 nt, Streptococcus pneumoniae R6
cuucauggaucauuuc

SEQ ID NO: 2169011 - RNA, 19 nt, Streptococcus pneumoniae R6
cuucauggaucauuucuuc

SEQ ID NO: 2169012 - RNA, 23 nt, Streptococcus pneumoniae R6
cuucaauagcauugucacaaagg

SEQ ID NO: 2169013 - RNA, 15 nt, Streptococcus pneumoniae R6
cuucaauaauuucuu

SEQ ID NO: 2169014 - RNA, 15 nt, Streptococcus pneumoniae R6
cuucaagguuuuaua

SEQ ID NO: 2169015 - RNA, 15 nt, Streptococcus pneumoniae R6
cuucaagguuuuucu

SEQ ID NO: 2169016 - RNA, 13 nt, Streptococcus pneumoniae R6
cuucaaauuguuu

SEQ ID NO: 2169017 - RNA, 14 nt, Streptococcus pneumoniae R6
cuucaaauuuuuca

SEQ ID NO: 2169018 - RNA, 20 nt, Streptococcus pneumoniae R6
cuucaacauucuccaguaga

SEQ ID NO: 2169019 - RNA, 14 nt, Streptococcus pneumoniae R6
cuuauuccaauuga

SEQ ID NO: 2169020 - RNA, 22 nt, Streptococcus pneumoniae R6
cuuauucuggaagugaaaaagc

SEQ ID NO: 2169021 - RNA, 23 nt, Streptococcus pneumoniae R6
cuuauugaugauguuuaaaaucu

SEQ ID NO: 2169022 - RNA, 15 nt, Streptococcus pneumoniae R6
cuucaaauccugcau

SEQ ID NO: 2169023 - RNA, 18 nt, Streptococcus pneumoniae R6
cuucaaauccugcauugu

SEQ ID NO: 2169024 - RNA, 21 nt, Streptococcus pneumoniae R6
cuucaaauccuuuauuuucaa

SEQ ID NO: 2169025 - RNA, 21 nt, Streptococcus pneumoniae R6
cuucacaucacuuucugcaau

SEQ ID NO: 2169026 - RNA, 15 nt, Streptococcus pneumoniae R6
cuucaauuucuaaug

SEQ ID NO: 2169027 - RNA, 15 nt, Streptococcus pneumoniae R6
cuucacucuucaaau

SEQ ID NO: 2169028 - RNA, 12 nt, Streptococcus pneumoniae R6
cuuccaagaccu

SEQ ID NO: 2169029 - RNA, 23 nt, Streptococcus pneumoniae R6
cuuccaauaauagaaaacagaca

SEQ ID NO: 2169030 - RNA, 12 nt, Streptococcus pneumoniae R6
cuuccaaucuca

SEQ ID NO: 2169031 - RNA, 14 nt, Streptococcus pneumoniae R6
aaacuuagcgaaau

SEQ ID NO: 2169032 - RNA, 14 nt, Streptococcus pneumoniae R6
aaacuuaggaagca

SEQ ID NO: 2169033 - RNA, 16 nt, Streptococcus pneumoniae R6
cuuccaauuucuuuuc

SEQ ID NO: 2169034 - RNA, 20 nt, Streptococcus pneumoniae R6
cuuccaauuucuuuucauuc

SEQ ID NO: 2169035 - RNA, 19 nt, Streptococcus pneumoniae R6
cuuccgaauagcucaaaag

SEQ ID NO: 2169036 - RNA, 20 nt, Streptococcus pneumoniae R6
cuucccaaguaguaguuuca

SEQ ID NO: 2169037 - RNA, 21 nt, Streptococcus pneumoniae R6
cuucccaaguaguaguuucag

SEQ ID NO: 2169038 - RNA, 15 nt, Streptococcus pneumoniae R6
cuuccauuucuuuug

SEQ ID NO: 2169039 - RNA, 16 nt, Streptococcus pneumoniae R6
cuucccacaauaaaaa

SEQ ID NO: 2169040 - RNA, 18 nt, Streptococcus pneumoniae R6
cuucccaccauccuccac

SEQ ID NO: 2169041 - RNA, 19 nt, Streptococcus pneumoniae R6
cuucccacccauauuuuuc

SEQ ID NO: 2169042 - RNA, 13 nt, Streptococcus pneumoniae R6
cuucccacuugug

SEQ ID NO: 2169043 - RNA, 20 nt, Streptococcus pneumoniae R6
cuuccauauagucuuucaaa

SEQ ID NO: 2169044 - RNA, 17 nt, Streptococcus pneumoniae R6
cuuccgccaucuuguuu

SEQ ID NO: 2169045 - RNA, 14 nt, Streptococcus pneumoniae R6
cuuccgcaauccac

SEQ ID NO: 2169046 - RNA, 21 nt, Streptococcus pneumoniae R6
cuuccgcaauccacccccaag

SEQ ID NO: 2169047 - RNA, 18 nt, Streptococcus pneumoniae R6
cuuccgaggucaucauua

SEQ ID NO: 2169048 - RNA, 15 nt, Streptococcus pneumoniae R6
cuuccuuuucuacug

SEQ ID NO: 2169049 - RNA, 18 nt, Streptococcus pneumoniae R6
cuucgaaaaucucuucaa

SEQ ID NO: 2169050 - RNA, 23 nt, Streptococcus pneumoniae R6
cuucgaaaaucucuucaaaccac

SEQ ID NO: 2169051 - RNA, 14 nt, Streptococcus pneumoniae R6
cugguugaaaaccu

SEQ ID NO: 2169052 - RNA, 12 nt, Streptococcus pneumoniae R6
cugguuacgacg

SEQ ID NO: 2169053 - RNA, 23 nt, Streptococcus pneumoniae R6
cugguucagcagagaagcacaug

SEQ ID NO: 2169054 - RNA, 18 nt, Streptococcus pneumoniae R6
cuggugcuagggcaagga

SEQ ID NO: 2169055 - RNA, 22 nt, Streptococcus pneumoniae R6
cuggugccccaguucuucagaa

SEQ ID NO: 2169056 - RNA, 18 nt, Streptococcus pneumoniae R6
cugguguguauggaggaa

SEQ ID NO: 2169057 - RNA, 17 nt, Streptococcus pneumoniae R6
cuguaagucauuuucuu

SEQ ID NO: 2169058 - RNA, 18 nt, Streptococcus pneumoniae R6
cuguaauaguuauaaagg

SEQ ID NO: 2169059 - RNA, 23 nt, Streptococcus pneumoniae R6
cuguaauaugaacaaaaccuggu

SEQ ID NO: 2169060 - RNA, 14 nt, Streptococcus pneumoniae R6
cuguaagaacuuuu

SEQ ID NO: 2169061 - RNA, 18 nt, Streptococcus pneumoniae R6
cuguaagaacuuuuuaaa

SEQ ID NO: 2169062 - RNA, 21 nt, Streptococcus pneumoniae R6
cuguaagaacuuuuuaaagua

SEQ ID NO: 2169063 - RNA, 17 nt, Streptococcus pneumoniae R6
cuguaaagacauuauaa

SEQ ID NO: 2169064 - RNA, 21 nt, Streptococcus pneumoniae R6
cuguaaaaagugaaaggaaga

SEQ ID NO: 2169065 - RNA, 14 nt, Streptococcus pneumoniae R6
cuguacaaauccca

SEQ ID NO: 2169066 - RNA, 16 nt, Streptococcus pneumoniae R6
cuguaaugaaauacug

SEQ ID NO: 2169067 - RNA, 19 nt, Streptococcus pneumoniae R6
cuguaaugaaauacugaug

SEQ ID NO: 2169068 - RNA, 14 nt, Streptococcus pneumoniae R6
cuguaaucaugaug

SEQ ID NO: 2169069 - RNA, 23 nt, Streptococcus pneumoniae R6
cuguaaucccaaucauggcuggg

SEQ ID NO: 2169070 - RNA, 15 nt, Streptococcus pneumoniae R6
cuguaccgaccuugu

SEQ ID NO: 2169071 - RNA, 14 nt, Streptococcus pneumoniae R6
cuggucuuauuuca

SEQ ID NO: 2169072 - RNA, 15 nt, Streptococcus pneumoniae R6
cuggucuuauuucau

SEQ ID NO: 2169073 - RNA, 21 nt, Streptococcus pneumoniae R6
cuggucuuauuucauuucacu

SEQ ID NO: 2169074 - RNA, 15 nt, Streptococcus pneumoniae R6
cuggucgagaaggac

SEQ ID NO: 2169075 - RNA, 11 nt, Streptococcus pneumoniae R6
cugguccagag

SEQ ID NO: 2169076 - RNA, 23 nt, Streptococcus pneumoniae R6
cuggucacgaccagaaaaucauu

SEQ ID NO: 2169077 - RNA, 20 nt, Streptococcus pneumoniae R6
cuggucaugaggcauagaac

SEQ ID NO: 2169078 - RNA, 18 nt, Streptococcus pneumoniae R6
cugguaugaucuauuccu

SEQ ID NO: 2169079 - RNA, 15 nt, Streptococcus pneumoniae R6
cugguauuuuuucaa

SEQ ID NO: 2169080 - RNA, 18 nt, Streptococcus pneumoniae R6
cugguauuuuuucaaucg

SEQ ID NO: 2169081 - RNA, 15 nt, Streptococcus pneumoniae R6
cugguaaaagagcaa

SEQ ID NO: 2169082 - RNA, 16 nt, Streptococcus pneumoniae R6
cugguaaaagagcaag

SEQ ID NO: 2169083 - RNA, 16 nt, Streptococcus pneumoniae R6
cugguaaagacucuug

SEQ ID NO: 2169084 - RNA, 16 nt, Streptococcus pneumoniae R6
cuggguacucuuuuuu

SEQ ID NO: 2169085 - RNA, 21 nt, Streptococcus pneumoniae R6
cugggcuaauucucuggcaga

SEQ ID NO: 2169086 - RNA, 19 nt, Streptococcus pneumoniae R6
cugugauuuuuuuugguaa

SEQ ID NO: 2169087 - RNA, 21 nt, Streptococcus pneumoniae R6
cugugacccacggauuaagag

SEQ ID NO: 2169088 - RNA, 20 nt, Streptococcus pneumoniae R6
cugugagauaguaucaaaug

SEQ ID NO: 2169089 - RNA, 15 nt, Streptococcus pneumoniae R6
cugugcuuuuucaau

SEQ ID NO: 2169090 - RNA, 19 nt, Streptococcus pneumoniae R6
cuguggauacuugcuugua

SEQ ID NO: 2169091 - RNA, 15 nt, Streptococcus pneumoniae R6
cugugcuugugauca

SEQ ID NO: 2169092 - RNA, 19 nt, Streptococcus pneumoniae R6
cugucuauuugcuuuucuu

SEQ ID NO: 2169093 - RNA, 17 nt, Streptococcus pneumoniae R6
cugucucaggucuagca

SEQ ID NO: 2169094 - RNA, 12 nt, Streptococcus pneumoniae R6
cugucuuuauua

SEQ ID NO: 2169095 - RNA, 20 nt, Streptococcus pneumoniae R6
cugucuuuucaaaguuaacu

SEQ ID NO: 2169096 - RNA, 21 nt, Streptococcus pneumoniae R6
cugucuuuucaaaguuaacuu

SEQ ID NO: 2169097 - RNA, 19 nt, Streptococcus pneumoniae R6
cugucugcugacugauuua

SEQ ID NO: 2169098 - RNA, 15 nt, Streptococcus pneumoniae R6
cugucuuauccaaac

SEQ ID NO: 2169099 - RNA, 16 nt, Streptococcus pneumoniae R6
cugucuuauccaaacu

SEQ ID NO: 2169100 - RNA, 18 nt, Streptococcus pneumoniae R6
cuguccucaaaaugaaaa

SEQ ID NO: 2169101 - RNA, 20 nt, Streptococcus pneumoniae R6
cuguccuucuuuuacuucuu

SEQ ID NO: 2169102 - RNA, 13 nt, Streptococcus pneumoniae R6
cugucauuuuuuc

SEQ ID NO: 2169103 - RNA, 16 nt, Streptococcus pneumoniae R6
cugucauuuuuuccaa

SEQ ID NO: 2169104 - RNA, 20 nt, Streptococcus pneumoniae R6
cugucauuuuuuccaauucu

SEQ ID NO: 2169105 - RNA, 22 nt, Streptococcus pneumoniae R6
cugucccaucauuucuucaaca

SEQ ID NO: 2169106 - RNA, 16 nt, Streptococcus pneumoniae R6
cugucacccuaggcaa

SEQ ID NO: 2169107 - RNA, 19 nt, Streptococcus pneumoniae R6
aaacugcgaagaaaucauu

SEQ ID NO: 2169108 - RNA, 23 nt, Streptococcus pneumoniae R6
cugucaagucuugcucuucauug

SEQ ID NO: 2169109 - RNA, 12 nt, Streptococcus pneumoniae R6
aaacugaacaag

SEQ ID NO: 2169110 - RNA, 13 nt, Streptococcus pneumoniae R6
aaacugacguggu

SEQ ID NO: 2169111 - RNA, 22 nt, Streptococcus pneumoniae R6
aaacugacgugguuuaaaaaga

SEQ ID NO: 2169112 - RNA, 16 nt, Streptococcus pneumoniae R6
cugucagcaauuccuu

SEQ ID NO: 2169113 - RNA, 15 nt, Streptococcus pneumoniae R6
cugucauaucauaac

SEQ ID NO: 2169114 - RNA, 14 nt, Streptococcus pneumoniae R6
aaacucuaaacaaa

SEQ ID NO: 2169115 - RNA, 16 nt, Streptococcus pneumoniae R6
cugucaagaccauggc

SEQ ID NO: 2169116 - RNA, 21 nt, Streptococcus pneumoniae R6
aaacucuccugggaaauucca

SEQ ID NO: 2169117 - RNA, 20 nt, Streptococcus pneumoniae R6
cuguauuugcgacacuagca

SEQ ID NO: 2169118 - RNA, 17 nt, Streptococcus pneumoniae R6
cuguauugguaacaaaa

SEQ ID NO: 2169119 - RNA, 22 nt, Streptococcus pneumoniae R6
cuguauuggugccgaaacuuca

SEQ ID NO: 2169120 - RNA, 18 nt, Streptococcus pneumoniae R6
cuguauacuuugcaacug

SEQ ID NO: 2169121 - RNA, 12 nt, Streptococcus pneumoniae R6
cuguauacuuuu

SEQ ID NO: 2169122 - RNA, 15 nt, Streptococcus pneumoniae R6
cuguauacuuuuuca

SEQ ID NO: 2169123 - RNA, 16 nt, Streptococcus pneumoniae R6
cuguauacuuuuucag

SEQ ID NO: 2169124 - RNA, 16 nt, Streptococcus pneumoniae R6
cuguaucaagauagug

SEQ ID NO: 2169125 - RNA, 22 nt, Streptococcus pneumoniae R6
cuguauaggucuggcuauuuuu

SEQ ID NO: 2169126 - RNA, 12 nt, Streptococcus pneumoniae R6
cuguaugagaaa

SEQ ID NO: 2169127 - RNA, 21 nt, Streptococcus pneumoniae R6
cuguaugagaaacagcuccug

SEQ ID NO: 2169128 - RNA, 23 nt, Streptococcus pneumoniae R6
cuguaugaugggcucuuuuuuug

SEQ ID NO: 2169129 - RNA, 22 nt, Streptococcus pneumoniae R6
cuguaugggcaucaacagcucc

SEQ ID NO: 2169130 - RNA, 23 nt, Streptococcus pneumoniae R6
cuguaugggcaucaacagcucca

SEQ ID NO: 2169131 - RNA, 16 nt, Streptococcus pneumoniae R6
cuguaucuguuuuuuc

SEQ ID NO: 2169132 - RNA, 19 nt, Streptococcus pneumoniae R6
cuguagaauugcugucaaa

SEQ ID NO: 2169133 - RNA, 15 nt, Streptococcus pneumoniae R6
cuguacguuuuauca

SEQ ID NO: 2169134 - RNA, 15 nt, Streptococcus pneumoniae R6
cuguacgucaucaga

SEQ ID NO: 2169135 - RNA, 17 nt, Streptococcus pneumoniae R6
cuguaguuaugaaacua

SEQ ID NO: 2169136 - RNA, 15 nt, Streptococcus pneumoniae R6
cuguaguggguugaa

SEQ ID NO: 2169137 - RNA, 18 nt, Streptococcus pneumoniae R6
cuguaguggguugaaaaa

SEQ ID NO: 2169138 - RNA, 17 nt, Streptococcus pneumoniae R6
gaacuuuuuaaaguauu

SEQ ID NO: 2169139 - RNA, 13 nt, Streptococcus pneumoniae R6
gaacuuuuucuaa

SEQ ID NO: 2169140 - RNA, 14 nt, Streptococcus pneumoniae R6
gaacuuucuuuuuu

SEQ ID NO: 2169141 - RNA, 21 nt, Streptococcus pneumoniae R6
gaacuugugcaacuuccaugu

SEQ ID NO: 2169142 - RNA, 22 nt, Streptococcus pneumoniae R6
gaacuucaauaauuucuuuuug

SEQ ID NO: 2169143 - RNA, 18 nt, Streptococcus pneumoniae R6
gaacuucacguucuucca

SEQ ID NO: 2169144 - RNA, 14 nt, Streptococcus pneumoniae R6
gaacuuccacuucc

SEQ ID NO: 2169145 - RNA, 21 nt, Streptococcus pneumoniae R6
gaagaaagcgaagaucuagaa

SEQ ID NO: 2169146 - RNA, 15 nt, Streptococcus pneumoniae R6
gaagaacauuuggaa

SEQ ID NO: 2169147 - RNA, 19 nt, Streptococcus pneumoniae R6
gaagaacaauccaaauaag

SEQ ID NO: 2169148 - RNA, 23 nt, Streptococcus pneumoniae R6
aaagagggauucuuauauuaaaa

SEQ ID NO: 2169149 - RNA, 15 nt, Streptococcus pneumoniae R6
aaagagggauuuugu

SEQ ID NO: 2169150 - RNA, 14 nt, Streptococcus pneumoniae R6
gaagacugucaagu

SEQ ID NO: 2169151 - RNA, 18 nt, Streptococcus pneumoniae R6
aaagaguacagucuuugc

SEQ ID NO: 2169152 - RNA, 15 nt, Streptococcus pneumoniae R6
aaagaguuuucugau

SEQ ID NO: 2169153 - RNA, 17 nt, Streptococcus pneumoniae R6
aaagaguuucaugaguu

SEQ ID NO: 2169154 - RNA, 20 nt, Streptococcus pneumoniae R6
aaagaguuucgaaaagaauu

SEQ ID NO: 2169155 - RNA, 19 nt, Streptococcus pneumoniae R6
gaagaguugggucuggaua

SEQ ID NO: 2169156 - RNA, 22 nt, Streptococcus pneumoniae R6
gaagauaaucgcaagguagaga

SEQ ID NO: 2169157 - RNA, 21 nt, Streptococcus pneumoniae R6
gaagagggcuucuucaacagc

SEQ ID NO: 2169158 - RNA, 22 nt, Streptococcus pneumoniae R6
gaagagggcuucuucaacagcu

SEQ ID NO: 2169159 - RNA, 23 nt, Streptococcus pneumoniae R6
gaagagguaucuguagaguuuug

SEQ ID NO: 2169160 - RNA, 15 nt, Streptococcus pneumoniae R6
gaagaguauaaaauu

SEQ ID NO: 2169161 - RNA, 21 nt, Streptococcus pneumoniae R6
gaagcacaugccuucuucgau

SEQ ID NO: 2169162 - RNA, 21 nt, Streptococcus pneumoniae R6
gaagcacacaaaucuucugua

SEQ ID NO: 2169163 - RNA, 18 nt, Streptococcus pneumoniae R6
gaagcagaaaaauuucau

SEQ ID NO: 2169164 - RNA, 23 nt, Streptococcus pneumoniae R6
gaagccauccuugguaacaacac

SEQ ID NO: 2169165 - RNA, 12 nt, Streptococcus pneumoniae R6
gaaguaaaucuu

SEQ ID NO: 2169166 - RNA, 18 nt, Streptococcus pneumoniae R6
gaaguaaaucuucccaua

SEQ ID NO: 2169167 - RNA, 18 nt, Streptococcus pneumoniae R6
gaaguaaaugugagcuuu

SEQ ID NO: 2169168 - RNA, 18 nt, Streptococcus pneumoniae R6
gaaggaacuaacucauca

SEQ ID NO: 2169169 - RNA, 15 nt, Streptococcus pneumoniae R6
gaagcuuccaauaau

SEQ ID NO: 2169170 - RNA, 22 nt, Streptococcus pneumoniae R6
gaagcuuccaauaauagaaaac

SEQ ID NO: 2169171 - RNA, 18 nt, Streptococcus pneumoniae R6
gaagcuugcuuccaaaaa

SEQ ID NO: 2169172 - RNA, 16 nt, Streptococcus pneumoniae R6
gaaggagccagcugaa

SEQ ID NO: 2169173 - RNA, 20 nt, Streptococcus pneumoniae R6
gaaggagccagcugaaaaaa

SEQ ID NO: 2169174 - RNA, 22 nt, Streptococcus pneumoniae R6
aaagauaucgguuuaucuccca

SEQ ID NO: 2169175 - RNA, 14 nt, Streptococcus pneumoniae R6
gaagugaaaaagca

SEQ ID NO: 2169176 - RNA, 23 nt, Streptococcus pneumoniae R6
gaagugaaaggagcgauugaaga

SEQ ID NO: 2169177 - RNA, 20 nt, Streptococcus pneumoniae R6
gaagugacagucgcaaagag

SEQ ID NO: 2169178 - RNA, 17 nt, Streptococcus pneumoniae R6
gaagucuauuauauaua

SEQ ID NO: 2169179 - RNA, 16 nt, Streptococcus pneumoniae R6
gaagucucagugggcu

SEQ ID NO: 2169180 - RNA, 21 nt, Streptococcus pneumoniae R6
gaaguaggccaaacuugaaau

SEQ ID NO: 2169181 - RNA, 23 nt, Streptococcus pneumoniae R6
gaaguaggccaaacuugaaauga

SEQ ID NO: 2169182 - RNA, 21 nt, Streptococcus pneumoniae R6
gaaguccuuguuugagcucuu

SEQ ID NO: 2169183 - RNA, 18 nt, Streptococcus pneumoniae R6
gaagucgaaaauaaacuu

SEQ ID NO: 2169184 - RNA, 20 nt, Streptococcus pneumoniae R6
gaaguucauuuucuuuacuu

SEQ ID NO: 2169185 - RNA, 23 nt, Streptococcus pneumoniae R6
gaaguucauuuucuuuacuucug

SEQ ID NO: 2169186 - RNA, 22 nt, Streptococcus pneumoniae R6
aaagaucaguucauuuuuccuu

SEQ ID NO: 2169187 - RNA, 17 nt, Streptococcus pneumoniae R6
gaaguuuuuucucuguu

SEQ ID NO: 2169188 - RNA, 14 nt, Streptococcus pneumoniae R6
gaaguuuucaaagu

SEQ ID NO: 2169189 - RNA, 15 nt, Streptococcus pneumoniae R6
gaauaccauacagaa

SEQ ID NO: 2169190 - RNA, 21 nt, Streptococcus pneumoniae R6
gaauaauacacuucuacuaua

SEQ ID NO: 2169191 - RNA, 17 nt, Streptococcus pneumoniae R6
aaagauguuagaaaaag

SEQ ID NO: 2169192 - RNA, 18 nt, Streptococcus pneumoniae R6
aaagauguucaaagauuu

SEQ ID NO: 2169193 - RNA, 16 nt, Streptococcus pneumoniae R6
gaauagcucaaaagcu

SEQ ID NO: 2169194 - RNA, 13 nt, Streptococcus pneumoniae R6
gaauagaguucua

SEQ ID NO: 2169195 - RNA, 14 nt, Streptococcus pneumoniae R6
gaauagauacaaaa

SEQ ID NO: 2169196 - RNA, 15 nt, Streptococcus pneumoniae R6
gaaucaacauaucca

SEQ ID NO: 2169197 - RNA, 13 nt, Streptococcus pneumoniae R6
gaaucaaaaauga

SEQ ID NO: 2169198 - RNA, 17 nt, Streptococcus pneumoniae R6
gaauagugaagauacuu

SEQ ID NO: 2169199 - RNA, 17 nt, Streptococcus pneumoniae R6
gaauccugccaaugguc

SEQ ID NO: 2169200 - RNA, 13 nt, Streptococcus pneumoniae R6
gaauccaauucaa

SEQ ID NO: 2169201 - RNA, 18 nt, Streptococcus pneumoniae R6
gaaucauuuuguuuuuga

SEQ ID NO: 2169202 - RNA, 16 nt, Streptococcus pneumoniae R6
gaaucaauacagaaga

SEQ ID NO: 2169203 - RNA, 15 nt, Streptococcus pneumoniae R6
gaaucaauuucuuca

SEQ ID NO: 2169204 - RNA, 18 nt, Streptococcus pneumoniae R6
gaaucaaucuucaaaauc

SEQ ID NO: 2169205 - RNA, 19 nt, Streptococcus pneumoniae R6
gaaugacagcaucgacaaa

SEQ ID NO: 2169206 - RNA, 17 nt, Streptococcus pneumoniae R6
gaaugacuaacccuucu

SEQ ID NO: 2169207 - RNA, 21 nt, Streptococcus pneumoniae R6
gaaucuucccguagguuuucu

SEQ ID NO: 2169208 - RNA, 11 nt, Streptococcus pneumoniae R6
gaauguaguua

SEQ ID NO: 2169209 - RNA, 13 nt, Streptococcus pneumoniae R6
gaaugucuuccaa

SEQ ID NO: 2169210 - RNA, 17 nt, Streptococcus pneumoniae R6
gaaugccuccaagaaag

SEQ ID NO: 2169211 - RNA, 13 nt, Streptococcus pneumoniae R6
gaaugagcuucca

SEQ ID NO: 2169212 - RNA, 15 nt, Streptococcus pneumoniae R6
gaauuauaguagagu

SEQ ID NO: 2169213 - RNA, 17 nt, Streptococcus pneumoniae R6
gaauuaucauaguacaa

SEQ ID NO: 2169214 - RNA, 12 nt, Streptococcus pneumoniae R6
gaauuagugaag

SEQ ID NO: 2169215 - RNA, 22 nt, Streptococcus pneumoniae R6
gaauuagguugaccauuucaau

SEQ ID NO: 2169216 - RNA, 17 nt, Streptococcus pneumoniae R6
gaauuaggaaaacauga

SEQ ID NO: 2169217 - RNA, 14 nt, Streptococcus pneumoniae R6
gaauuaggcucuuu

SEQ ID NO: 2169218 - RNA, 13 nt, Streptococcus pneumoniae R6
gaauuaagugacc

SEQ ID NO: 2169219 - RNA, 18 nt, Streptococcus pneumoniae R6
gaauugguggguuuucug

SEQ ID NO: 2169220 - RNA, 16 nt, Streptococcus pneumoniae R6
gacaaaacuaacccua

SEQ ID NO: 2169221 - RNA, 23 nt, Streptococcus pneumoniae R6
gacaaaacuaacccuagaaaacc

SEQ ID NO: 2169222 - RNA, 18 nt, Streptococcus pneumoniae R6
gacaaaacuuuuuaaaaa

SEQ ID NO: 2169223 - RNA, 21 nt, Streptococcus pneumoniae R6
gacaacgcacaccagagauug

SEQ ID NO: 2169224 - RNA, 16 nt, Streptococcus pneumoniae R6
gacaagucaugggcga

SEQ ID NO: 2169225 - RNA, 15 nt, Streptococcus pneumoniae R6
gacaagugaaagugg

SEQ ID NO: 2169226 - RNA, 22 nt, Streptococcus pneumoniae R6
gacaaggcugcggcuacaccgu

SEQ ID NO: 2169227 - RNA, 22 nt, Streptococcus pneumoniae R6
gacaacauaaggcagugacuac

SEQ ID NO: 2169228 - RNA, 16 nt, Streptococcus pneumoniae R6
gacaaaauugauaaua

SEQ ID NO: 2169229 - RNA, 18 nt, Streptococcus pneumoniae R6
gacaauuuaaccaaacca

SEQ ID NO: 2169230 - RNA, 19 nt, Streptococcus pneumoniae R6
gacaauuauauaaaccaaa

SEQ ID NO: 2169231 - RNA, 15 nt, Streptococcus pneumoniae R6
gacaauaaagauaag

SEQ ID NO: 2169232 - RNA, 16 nt, Streptococcus pneumoniae R6
gacaccaaaaagugca

SEQ ID NO: 2169233 - RNA, 21 nt, Streptococcus pneumoniae R6
gacaccacuuuuggucagagg

SEQ ID NO: 2169234 - RNA, 14 nt, Streptococcus pneumoniae R6
gacuagcaaucaaa

SEQ ID NO: 2169235 - RNA, 14 nt, Streptococcus pneumoniae R6
gacuauuugaguaa

SEQ ID NO: 2169236 - RNA, 18 nt, Streptococcus pneumoniae R6
gacuaugaucagcauuuc

SEQ ID NO: 2169237 - RNA, 22 nt, Streptococcus pneumoniae R6
gacuaucugcuaacugcuggau

SEQ ID NO: 2169238 - RNA, 13 nt, Streptococcus pneumoniae R6
gacuauauuucuu

SEQ ID NO: 2169239 - RNA, 14 nt, Streptococcus pneumoniae R6
gacuauauuucuua

SEQ ID NO: 2169240 - RNA, 14 nt, Streptococcus pneumoniae R6
gacuauaguagguu

SEQ ID NO: 2169241 - RNA, 14 nt, Streptococcus pneumoniae R6
gacuauagcagauu

SEQ ID NO: 2169242 - RNA, 16 nt, Streptococcus pneumoniae R6
gacgugguuuaaaaag

SEQ ID NO: 2169243 - RNA, 21 nt, Streptococcus pneumoniae R6
gacuaaguccuuuuaguuuua

SEQ ID NO: 2169244 - RNA, 13 nt, Streptococcus pneumoniae R6
gacuaaggagagu

SEQ ID NO: 2169245 - RNA, 18 nt, Streptococcus pneumoniae R6
gacuaacccuucuuuuua

SEQ ID NO: 2169246 - RNA, 19 nt, Streptococcus pneumoniae R6
gacuaaauacaaaaacaaa

SEQ ID NO: 2169247 - RNA, 20 nt, Streptococcus pneumoniae R6
gacgauaaauugcuggagaa

SEQ ID NO: 2169248 - RNA, 14 nt, Streptococcus pneumoniae R6
gacgagaaauagcg

SEQ ID NO: 2169249 - RNA, 23 nt, Streptococcus pneumoniae R6
gacgauaaggacgguagcaggga

SEQ ID NO: 2169250 - RNA, 20 nt, Streptococcus pneumoniae R6
gacgaguuaaaacaaagaaa

SEQ ID NO: 2169251 - RNA, 21 nt, Streptococcus pneumoniae R6
gacgaguuaaaacaaagaaaa

SEQ ID NO: 2169252 - RNA, 14 nt, Streptococcus pneumoniae R6
gacgagugaagaau

SEQ ID NO: 2169253 - RNA, 14 nt, Streptococcus pneumoniae R6
gacgcccuuaguaa

SEQ ID NO: 2169254 - RNA, 14 nt, Streptococcus pneumoniae R6
gaccuugguggcua

SEQ ID NO: 2169255 - RNA, 19 nt, Streptococcus pneumoniae R6
gacgaagucagucacauau

SEQ ID NO: 2169256 - RNA, 17 nt, Streptococcus pneumoniae R6
gacgaagcugacaugau

SEQ ID NO: 2169257 - RNA, 13 nt, Streptococcus pneumoniae R6
gaccuuugaaaac

SEQ ID NO: 2169258 - RNA, 21 nt, Streptococcus pneumoniae R6
gaccuuugaaaacugaacaag

SEQ ID NO: 2169259 - RNA, 23 nt, Streptococcus pneumoniae R6
gaccuuucauaaaguuuucugag

SEQ ID NO: 2169260 - RNA, 16 nt, Streptococcus pneumoniae R6
gaccuuuauuggcugc

SEQ ID NO: 2169261 - RNA, 23 nt, Streptococcus pneumoniae R6
gaccuguauucauugaaaaaaua

SEQ ID NO: 2169262 - RNA, 15 nt, Streptococcus pneumoniae R6
gaccuugagcucuuu

SEQ ID NO: 2169263 - RNA, 15 nt, Streptococcus pneumoniae R6
gaccggauugcuccg

SEQ ID NO: 2169264 - RNA, 20 nt, Streptococcus pneumoniae R6
gaccugccaugcugacgaug

SEQ ID NO: 2169265 - RNA, 21 nt, Streptococcus pneumoniae R6
gaccaugcggaugcaugccau

SEQ ID NO: 2169266 - RNA, 15 nt, Streptococcus pneumoniae R6
gacccaggcaaagag

SEQ ID NO: 2169267 - RNA, 14 nt, Streptococcus pneumoniae R6
gaccacgaugauga

SEQ ID NO: 2169268 - RNA, 18 nt, Streptococcus pneumoniae R6
gaccacggaaauccucua

SEQ ID NO: 2169269 - RNA, 15 nt, Streptococcus pneumoniae R6
gaccgacuauuuuuu

SEQ ID NO: 2169270 - RNA, 13 nt, Streptococcus pneumoniae R6
gaccgacacacca

SEQ ID NO: 2169271 - RNA, 19 nt, Streptococcus pneumoniae R6
gaccgacaaacauugacuu

SEQ ID NO: 2169272 - RNA, 15 nt, Streptococcus pneumoniae R6
gaccaaagcaucaau

SEQ ID NO: 2169273 - RNA, 17 nt, Streptococcus pneumoniae R6
gaccaaagcaucaauca

SEQ ID NO: 2169274 - RNA, 19 nt, Streptococcus pneumoniae R6
gacaucauccguacucaug

SEQ ID NO: 2169275 - RNA, 21 nt, Streptococcus pneumoniae R6
gacagugaaaucauacugcca

SEQ ID NO: 2169276 - RNA, 13 nt, Streptococcus pneumoniae R6
gacagucaaaucg

SEQ ID NO: 2169277 - RNA, 20 nt, Streptococcus pneumoniae R6
gacagucaaaucgauuucua

SEQ ID NO: 2169278 - RNA, 23 nt, Streptococcus pneumoniae R6
gacagggccuuagcagacuucuu

SEQ ID NO: 2169279 - RNA, 20 nt, Streptococcus pneumoniae R6
gacagcaguuaugauauauu

SEQ ID NO: 2169280 - RNA, 14 nt, Streptococcus pneumoniae R6
gacaccguaagaua

SEQ ID NO: 2169281 - RNA, 15 nt, Streptococcus pneumoniae R6
gaaaguaaaauuaau

SEQ ID NO: 2169282 - RNA, 22 nt, Streptococcus pneumoniae R6
gaaaguaaaauuaauuucuaua

SEQ ID NO: 2169283 - RNA, 17 nt, Streptococcus pneumoniae R6
gaaagguuuuaaagaca

SEQ ID NO: 2169284 - RNA, 22 nt, Streptococcus pneumoniae R6
gaaauaaaauuugaacaaauua

SEQ ID NO: 2169285 - RNA, 19 nt, Streptococcus pneumoniae R6
gaaauaacucauaauaguc

SEQ ID NO: 2169286 - RNA, 22 nt, Streptococcus pneumoniae R6
gaaauaacucauaauagucucu

SEQ ID NO: 2169287 - RNA, 15 nt, Streptococcus pneumoniae R6
gaaauaaucuuucac

SEQ ID NO: 2169288 - RNA, 17 nt, Streptococcus pneumoniae R6
gaaauaagauaugaaca

SEQ ID NO: 2169289 - RNA, 18 nt, Streptococcus pneumoniae R6
gaaauaagauaugaacaa

SEQ ID NO: 2169290 - RNA, 19 nt, Streptococcus pneumoniae R6
gaaauaagauaugaacaaa

SEQ ID NO: 2169291 - RNA, 22 nt, Streptococcus pneumoniae R6
gaaauaagaugcgaacaaauca

SEQ ID NO: 2169292 - RNA, 22 nt, Streptococcus pneumoniae R6
gaaauaauagacccuuguuucu

SEQ ID NO: 2169293 - RNA, 13 nt, Streptococcus pneumoniae R6
gaaaucagaaaaa

SEQ ID NO: 2169294 - RNA, 16 nt, Streptococcus pneumoniae R6
gaaaucacgcuuuucu

SEQ ID NO: 2169295 - RNA, 16 nt, Streptococcus pneumoniae R6
gaaauccucuacauga

SEQ ID NO: 2169296 - RNA, 20 nt, Streptococcus pneumoniae R6
gaaauccucuacaugagcca

SEQ ID NO: 2169297 - RNA, 23 nt, Streptococcus pneumoniae R6
gaaaucaacugcuguuuucaugu

SEQ ID NO: 2169298 - RNA, 23 nt, Streptococcus pneumoniae R6
gaaaucacagugggcuauuccau

SEQ ID NO: 2169299 - RNA, 22 nt, Streptococcus pneumoniae R6
gaaauauuuuuuacuuuugcac

SEQ ID NO: 2169300 - RNA, 20 nt, Streptococcus pneumoniae R6
gaaauacuaaaaaaaaaaag

SEQ ID NO: 2169301 - RNA, 22 nt, Streptococcus pneumoniae R6
gaaauacuaaaaaaaaaaagua

SEQ ID NO: 2169302 - RNA, 14 nt, Streptococcus pneumoniae R6
gaaauagaauauga

SEQ ID NO: 2169303 - RNA, 20 nt, Streptococcus pneumoniae R6
gaaauagcuaaaccuuauuu

SEQ ID NO: 2169304 - RNA, 21 nt, Streptococcus pneumoniae R6
gaaauagagguguacuauucu

SEQ ID NO: 2169305 - RNA, 22 nt, Streptococcus pneumoniae R6
gaaaaucuccucuaccugccuu

SEQ ID NO: 2169306 - RNA, 14 nt, Streptococcus pneumoniae R6
gaaaaugaggaaaa

SEQ ID NO: 2169307 - RNA, 14 nt, Streptococcus pneumoniae R6
gaaaaugaaacccu

SEQ ID NO: 2169308 - RNA, 13 nt, Streptococcus pneumoniae R6
gaaaaugaaagag

SEQ ID NO: 2169309 - RNA, 15 nt, Streptococcus pneumoniae R6
gaaaaugaaagagca

SEQ ID NO: 2169310 - RNA, 11 nt, Streptococcus pneumoniae R6
gaaaaugaauu

SEQ ID NO: 2169311 - RNA, 20 nt, Streptococcus pneumoniae R6
gaaaaugaauuugaaacaau

SEQ ID NO: 2169312 - RNA, 22 nt, Streptococcus pneumoniae R6
gaaaaugaauuugaaacaauga

SEQ ID NO: 2169313 - RNA, 20 nt, Streptococcus pneumoniae R6
gaaaauccuaguggaaaaga

SEQ ID NO: 2169314 - RNA, 14 nt, Streptococcus pneumoniae R6
gaaaaucguacugu

SEQ ID NO: 2169315 - RNA, 18 nt, Streptococcus pneumoniae R6
gaaaaucgcaaguuuuuc

SEQ ID NO: 2169316 - RNA, 13 nt, Streptococcus pneumoniae R6
gaaaaucucuuca

SEQ ID NO: 2169317 - RNA, 17 nt, Streptococcus pneumoniae R6
gaaaaucucuucaaacu

SEQ ID NO: 2169318 - RNA, 20 nt, Streptococcus pneumoniae R6
gaaacuagaauaauacacuu

SEQ ID NO: 2169319 - RNA, 16 nt, Streptococcus pneumoniae R6
gaaacuagcauccauc

SEQ ID NO: 2169320 - RNA, 14 nt, Streptococcus pneumoniae R6
gaaacuagcugcag

SEQ ID NO: 2169321 - RNA, 22 nt, Streptococcus pneumoniae R6
gaaacuaugaugugcuauucua

SEQ ID NO: 2169322 - RNA, 15 nt, Streptococcus pneumoniae R6
gaaacgugggcugau

SEQ ID NO: 2169323 - RNA, 13 nt, Streptococcus pneumoniae R6
gaaaauggaguaa

SEQ ID NO: 2169324 - RNA, 22 nt, Streptococcus pneumoniae R6
gaaacuguggaaaauagaaaaa

SEQ ID NO: 2169325 - RNA, 20 nt, Streptococcus pneumoniae R6
gaaacuccauaaaaucacau

SEQ ID NO: 2169326 - RNA, 22 nt, Streptococcus pneumoniae R6
gaaacuccuuggcuacuugcuu

SEQ ID NO: 2169327 - RNA, 15 nt, Streptococcus pneumoniae R6
gaaacucaggaugua

SEQ ID NO: 2169328 - RNA, 19 nt, Streptococcus pneumoniae R6
gaaagauuugcuggauagu

SEQ ID NO: 2169329 - RNA, 13 nt, Streptococcus pneumoniae R6
gaaagauuauagg

SEQ ID NO: 2169330 - RNA, 15 nt, Streptococcus pneumoniae R6
gaaagcauaggggcu

SEQ ID NO: 2169331 - RNA, 16 nt, Streptococcus pneumoniae R6
gaaagcagcuuaucuc

SEQ ID NO: 2169332 - RNA, 19 nt, Streptococcus pneumoniae R6
gaaagcagcuuaucucgua

SEQ ID NO: 2169333 - RNA, 22 nt, Streptococcus pneumoniae R6
gaaauucgcuuuuuuaaaugcu

SEQ ID NO: 2169334 - RNA, 17 nt, Streptococcus pneumoniae R6
gaaauuccuuaaacucu

SEQ ID NO: 2169335 - RNA, 14 nt, Streptococcus pneumoniae R6
aaagagcaagaacu

SEQ ID NO: 2169336 - RNA, 13 nt, Streptococcus pneumoniae R6
gaaauuauuucac

SEQ ID NO: 2169337 - RNA, 21 nt, Streptococcus pneumoniae R6
gaaauucaaaugaauuucuac

SEQ ID NO: 2169338 - RNA, 15 nt, Streptococcus pneumoniae R6
gaaauucaagaauga

SEQ ID NO: 2169339 - RNA, 20 nt, Streptococcus pneumoniae R6
gaaauucaagaaugacacgu

SEQ ID NO: 2169340 - RNA, 18 nt, Streptococcus pneumoniae R6
gaaauuuucuuuuuccua

SEQ ID NO: 2169341 - RNA, 21 nt, Streptococcus pneumoniae R6
gaaauuuuuacuuuauuuucu

SEQ ID NO: 2169342 - RNA, 13 nt, Streptococcus pneumoniae R6
aaagagaagaaau

SEQ ID NO: 2169343 - RNA, 17 nt, Streptococcus pneumoniae R6
gaaaugaggacuuucuu

SEQ ID NO: 2169344 - RNA, 18 nt, Streptococcus pneumoniae R6
gaaaugagguaauuauga

SEQ ID NO: 2169345 - RNA, 17 nt, Streptococcus pneumoniae R6
gaaauuuuucugcuucu

SEQ ID NO: 2169346 - RNA, 19 nt, Streptococcus pneumoniae R6
gaacaagucagcucaaagc

SEQ ID NO: 2169347 - RNA, 22 nt, Streptococcus pneumoniae R6
gaacaauaaaacgcauaauauc

SEQ ID NO: 2169348 - RNA, 12 nt, Streptococcus pneumoniae R6
gaacaccugauu

SEQ ID NO: 2169349 - RNA, 23 nt, Streptococcus pneumoniae R6
gaacaaugacucccauaaaaaua

SEQ ID NO: 2169350 - RNA, 17 nt, Streptococcus pneumoniae R6
gaacaguuucggcuguu

SEQ ID NO: 2169351 - RNA, 15 nt, Streptococcus pneumoniae R6
gaacuaacgaacaaa

SEQ ID NO: 2169352 - RNA, 13 nt, Streptococcus pneumoniae R6
gaacuaacucauc

SEQ ID NO: 2169353 - RNA, 20 nt, Streptococcus pneumoniae R6
gaacguguucaauagcaccu

SEQ ID NO: 2169354 - RNA, 23 nt, Streptococcus pneumoniae R6
gaacgugguccacauuaaagaua

SEQ ID NO: 2169355 - RNA, 16 nt, Streptococcus pneumoniae R6
gaacggguucuuccaa

SEQ ID NO: 2169356 - RNA, 15 nt, Streptococcus pneumoniae R6
gaacgcugaaggagg

SEQ ID NO: 2169357 - RNA, 14 nt, Streptococcus pneumoniae R6
gaacgauaaacaag

SEQ ID NO: 2169358 - RNA, 20 nt, Streptococcus pneumoniae R6
gaacgauguuugcagcacca

SEQ ID NO: 2169359 - RNA, 14 nt, Streptococcus pneumoniae R6
gaacuagagaagcc

SEQ ID NO: 2169360 - RNA, 15 nt, Streptococcus pneumoniae R6
gaacuagagaagcca

SEQ ID NO: 2169361 - RNA, 18 nt, Streptococcus pneumoniae R6
gaacuagagaagccaaga

SEQ ID NO: 2169362 - RNA, 22 nt, Streptococcus pneumoniae R6
gaacuagagaagccaagaguag

SEQ ID NO: 2169363 - RNA, 17 nt, Streptococcus pneumoniae R6
gaacuauaaaaucugaa

SEQ ID NO: 2169364 - RNA, 18 nt, Streptococcus pneumoniae R6
gaacuauaaaaucugaag

SEQ ID NO: 2169365 - RNA, 20 nt, Streptococcus pneumoniae R6
gaacuauaaaaucugaagaa

SEQ ID NO: 2169366 - RNA, 21 nt, Streptococcus pneumoniae R6
gaacuaugggagcuaacucaa

SEQ ID NO: 2169367 - RNA, 20 nt, Streptococcus pneumoniae R6
gaacucacuucccugagacu

SEQ ID NO: 2169368 - RNA, 14 nt, Streptococcus pneumoniae R6
gaacuccagugaaa

SEQ ID NO: 2169369 - RNA, 18 nt, Streptococcus pneumoniae R6
gaacucucggucuuguuu

SEQ ID NO: 2169370 - RNA, 19 nt, Streptococcus pneumoniae R6
gaacugacgaagucagcuc

SEQ ID NO: 2169371 - RNA, 19 nt, Streptococcus pneumoniae R6
gaacucuagcuuuuuaauu

SEQ ID NO: 2169372 - RNA, 20 nt, Streptococcus pneumoniae R6
gaacugcgacguuuucuccu

SEQ ID NO: 2169373 - RNA, 20 nt, Streptococcus pneumoniae R6
gaacuggcguuuuauuuuuu

SEQ ID NO: 2169374 - RNA, 19 nt, Streptococcus pneumoniae R6
gaaccaaaccaaacagucu

SEQ ID NO: 2169375 - RNA, 17 nt, Streptococcus pneumoniae R6
gaaccacaacaaaaaag

SEQ ID NO: 2169376 - RNA, 22 nt, Streptococcus pneumoniae R6
gaaccacaacaaaaaaggucau

SEQ ID NO: 2169377 - RNA, 22 nt, Streptococcus pneumoniae R6
gaacauuugaaacgauaauauc

SEQ ID NO: 2169378 - RNA, 15 nt, Streptococcus pneumoniae R6
gaacccccaugacuu

SEQ ID NO: 2169379 - RNA, 12 nt, Streptococcus pneumoniae R6
gaaccaucuuca

SEQ ID NO: 2169380 - RNA, 15 nt, Streptococcus pneumoniae R6
gaaccaucuucauuu

SEQ ID NO: 2169381 - RNA, 17 nt, Streptococcus pneumoniae R6
gaaccauguccuggaua

SEQ ID NO: 2169382 - RNA, 16 nt, Streptococcus pneumoniae R6
gaaccaguacuuucaa

SEQ ID NO: 2169383 - RNA, 17 nt, Streptococcus pneumoniae R6
gaaccaggaaaccagcu

SEQ ID NO: 2169384 - RNA, 18 nt, Streptococcus pneumoniae R6
gaaccgccguaugccgaa

SEQ ID NO: 2169385 - RNA, 15 nt, Streptococcus pneumoniae R6
gaaccucuucauuca

SEQ ID NO: 2169386 - RNA, 19 nt, Streptococcus pneumoniae R6
gaaccucuucauucaaaga

SEQ ID NO: 2169387 - RNA, 18 nt, Streptococcus pneumoniae R6
gaacgacaugcguuaaaa

SEQ ID NO: 2169388 - RNA, 15 nt, Streptococcus pneumoniae R6
gaacgacucacuuua

SEQ ID NO: 2169389 - RNA, 17 nt, Streptococcus pneumoniae R6
gaacgaacuccacugaa

SEQ ID NO: 2169390 - RNA, 15 nt, Streptococcus pneumoniae R6
gaaccuuaaaaugaa

SEQ ID NO: 2169391 - RNA, 14 nt, Streptococcus pneumoniae R6
gaaccugugaccca

SEQ ID NO: 2169392 - RNA, 19 nt, Streptococcus pneumoniae R6
aaagacuggugagauaaaa

SEQ ID NO: 2169393 - RNA, 17 nt, Streptococcus pneumoniae R6
aaagacucuugcccuug

SEQ ID NO: 2169394 - RNA, 21 nt, Streptococcus pneumoniae R6
aaagacuugaccggagaaaga

SEQ ID NO: 2169395 - RNA, 20 nt, Streptococcus pneumoniae R6
aaagacuucuugagcuaggg

SEQ ID NO: 2169396 - RNA, 22 nt, Streptococcus pneumoniae R6
cuuuucuugaggcacuuuuguc

SEQ ID NO: 2169397 - RNA, 19 nt, Streptococcus pneumoniae R6
cuuuugcacgacccugcgc

SEQ ID NO: 2169398 - RNA, 12 nt, Streptococcus pneumoniae R6
cuuuugcagcac

SEQ ID NO: 2169399 - RNA, 14 nt, Streptococcus pneumoniae R6
cuuuugucuugcuu

SEQ ID NO: 2169400 - RNA, 20 nt, Streptococcus pneumoniae R6
cuuuugucuuguucuuguuu

SEQ ID NO: 2169401 - RNA, 16 nt, Streptococcus pneumoniae R6
cuuuugugauuuuaaa

SEQ ID NO: 2169402 - RNA, 20 nt, Streptococcus pneumoniae R6
cuuuugugauuuuaaauuua

SEQ ID NO: 2169403 - RNA, 18 nt, Streptococcus pneumoniae R6
cuuuugugccaauucuua

SEQ ID NO: 2169404 - RNA, 18 nt, Streptococcus pneumoniae R6
cuuuucuauaggauuuau

SEQ ID NO: 2169405 - RNA, 15 nt, Streptococcus pneumoniae R6
cuuuucuacugaaau

SEQ ID NO: 2169406 - RNA, 22 nt, Streptococcus pneumoniae R6
cuuuucgccuacccacuacacu

SEQ ID NO: 2169407 - RNA, 20 nt, Streptococcus pneumoniae R6
cuuuucuguugauauuucca

SEQ ID NO: 2169408 - RNA, 11 nt, Streptococcus pneumoniae R6
cuuuucugcua

SEQ ID NO: 2169409 - RNA, 17 nt, Streptococcus pneumoniae R6
cuuuucugacgggagaa

SEQ ID NO: 2169410 - RNA, 14 nt, Streptococcus pneumoniae R6
aaagaccuuugaaa

SEQ ID NO: 2169411 - RNA, 18 nt, Streptococcus pneumoniae R6
cuuuucuucaacauucuc

SEQ ID NO: 2169412 - RNA, 22 nt, Streptococcus pneumoniae R6
cuuuucaucuaguugaacuuua

SEQ ID NO: 2169413 - RNA, 15 nt, Streptococcus pneumoniae R6
cuuuuccaaacauac

SEQ ID NO: 2169414 - RNA, 19 nt, Streptococcus pneumoniae R6
cuuuucaaaguaauuugag

SEQ ID NO: 2169415 - RNA, 21 nt, Streptococcus pneumoniae R6
cuuuucaagaacugcuaccaa

SEQ ID NO: 2169416 - RNA, 20 nt, Streptococcus pneumoniae R6
cuuuucaauacggucaauca

SEQ ID NO: 2169417 - RNA, 15 nt, Streptococcus pneumoniae R6
cuuuucaccugcuuu

SEQ ID NO: 2169418 - RNA, 15 nt, Streptococcus pneumoniae R6
cuuuuccauuguuuu

SEQ ID NO: 2169419 - RNA, 20 nt, Streptococcus pneumoniae R6
cuuuuccaauagauaauuua

SEQ ID NO: 2169420 - RNA, 19 nt, Streptococcus pneumoniae R6
cuuuuccaguaauuuccca

SEQ ID NO: 2169421 - RNA, 21 nt, Streptococcus pneumoniae R6
cuuuucgaaacucuuuuuaaa

SEQ ID NO: 2169422 - RNA, 17 nt, Streptococcus pneumoniae R6
cuuuuccuugaccuuau

SEQ ID NO: 2169423 - RNA, 19 nt, Streptococcus pneumoniae R6
cuuuuccuuaacaaucuua

SEQ ID NO: 2169424 - RNA, 17 nt, Streptococcus pneumoniae R6
cuuuuccuucauuucca

SEQ ID NO: 2169425 - RNA, 19 nt, Streptococcus pneumoniae R6
cuuuuccgauaaugcuuug

SEQ ID NO: 2169426 - RNA, 15 nt, Streptococcus pneumoniae R6
cuuuuauuuuuauaa

SEQ ID NO: 2169427 - RNA, 18 nt, Streptococcus pneumoniae R6
cuuuuauuuuuauaacaa

SEQ ID NO: 2169428 - RNA, 20 nt, Streptococcus pneumoniae R6
cuuuuaugaggugcuuuuug

SEQ ID NO: 2169429 - RNA, 10 nt, Streptococcus pneumoniae R6
cuuuuaaaau

SEQ ID NO: 2169430 - RNA, 23 nt, Streptococcus pneumoniae R6
cuuuuaaauaguuuaaaacauuu

SEQ ID NO: 2169431 - RNA, 19 nt, Streptococcus pneumoniae R6
cuuuuaaccagacauagag

SEQ ID NO: 2169432 - RNA, 21 nt, Streptococcus pneumoniae R6
cuuuuacaauguugucaauuu

SEQ ID NO: 2169433 - RNA, 15 nt, Streptococcus pneumoniae R6
cuuuuacacucaauu

SEQ ID NO: 2169434 - RNA, 16 nt, Streptococcus pneumoniae R6
cuuuuacacucaauuu

SEQ ID NO: 2169435 - RNA, 16 nt, Streptococcus pneumoniae R6
gaaaacaacuuauaaa

SEQ ID NO: 2169436 - RNA, 14 nt, Streptococcus pneumoniae R6
gaaaaauuucauuu

SEQ ID NO: 2169437 - RNA, 16 nt, Streptococcus pneumoniae R6
gaaaaagucaauaaua

SEQ ID NO: 2169438 - RNA, 17 nt, Streptococcus pneumoniae R6
gaaaaagucaauaauau

SEQ ID NO: 2169439 - RNA, 21 nt, Streptococcus pneumoniae R6
gaaaaaguucucuuucuaaaa

SEQ ID NO: 2169440 - RNA, 18 nt, Streptococcus pneumoniae R6
gaaaaagauuuuuuaaaa

SEQ ID NO: 2169441 - RNA, 22 nt, Streptococcus pneumoniae R6
gaaaaagaggugcgagccucuu

SEQ ID NO: 2169442 - RNA, 19 nt, Streptococcus pneumoniae R6
cuuuuuuugcuuaaauaaa

SEQ ID NO: 2169443 - RNA, 12 nt, Streptococcus pneumoniae R6
gaaaaaaacugg

SEQ ID NO: 2169444 - RNA, 16 nt, Streptococcus pneumoniae R6
gaaaaaaaguuuaaaa

SEQ ID NO: 2169445 - RNA, 14 nt, Streptococcus pneumoniae R6
gaaaaaaaguaaau

SEQ ID NO: 2169446 - RNA, 15 nt, Streptococcus pneumoniae R6
cuuuuugaaaaacua

SEQ ID NO: 2169447 - RNA, 15 nt, Streptococcus pneumoniae R6
cuuuuucuucuuauc

SEQ ID NO: 2169448 - RNA, 23 nt, Streptococcus pneumoniae R6
cuuuuucuucuucgucaaaucca

SEQ ID NO: 2169449 - RNA, 12 nt, Streptococcus pneumoniae R6
cuuuuucuuuca

SEQ ID NO: 2169450 - RNA, 14 nt, Streptococcus pneumoniae R6
cuuuuuguguuaaa

SEQ ID NO: 2169451 - RNA, 13 nt, Streptococcus pneumoniae R6
cuuuuuguuuaau

SEQ ID NO: 2169452 - RNA, 17 nt, Streptococcus pneumoniae R6
cuuuuuuauccucaaaa

SEQ ID NO: 2169453 - RNA, 12 nt, Streptococcus pneumoniae R6
cuuuuuuaccug

SEQ ID NO: 2169454 - RNA, 13 nt, Streptococcus pneumoniae R6
cuuuuuguuucca

SEQ ID NO: 2169455 - RNA, 17 nt, Streptococcus pneumoniae R6
cuuuuucucucugaaua

SEQ ID NO: 2169456 - RNA, 10 nt, Streptococcus pneumoniae R6
cuuuuuaaaa

SEQ ID NO: 2169457 - RNA, 17 nt, Streptococcus pneumoniae R6
cuuuuuaaaaaaucuuu

SEQ ID NO: 2169458 - RNA, 14 nt, Streptococcus pneumoniae R6
gaaaagauggagug

SEQ ID NO: 2169459 - RNA, 22 nt, Streptococcus pneumoniae R6
gaaaagauggaguguucuaaaa

SEQ ID NO: 2169460 - RNA, 20 nt, Streptococcus pneumoniae R6
gaaaacugaugaagucaagu

SEQ ID NO: 2169461 - RNA, 21 nt, Streptococcus pneumoniae R6
gaaaacugaugaagucaaguc

SEQ ID NO: 2169462 - RNA, 13 nt, Streptococcus pneumoniae R6
gaaaaucacucca

SEQ ID NO: 2169463 - RNA, 19 nt, Streptococcus pneumoniae R6
gaaaaucauagagcaaacu

SEQ ID NO: 2169464 - RNA, 16 nt, Streptococcus pneumoniae R6
gaaaauaccaaguuca

SEQ ID NO: 2169465 - RNA, 17 nt, Streptococcus pneumoniae R6
gaaaauacugauaaaaa

SEQ ID NO: 2169466 - RNA, 13 nt, Streptococcus pneumoniae R6
gaaaauagaaaaa

SEQ ID NO: 2169467 - RNA, 14 nt, Streptococcus pneumoniae R6
gaaaauagaaaaaa

SEQ ID NO: 2169468 - RNA, 18 nt, Streptococcus pneumoniae R6
gaaaauaaaguaaaaauu

SEQ ID NO: 2169469 - RNA, 15 nt, Streptococcus pneumoniae R6
gaaaacgguaacaaa

SEQ ID NO: 2169470 - RNA, 14 nt, Streptococcus pneumoniae R6
gaaaacgauaauag

SEQ ID NO: 2169471 - RNA, 23 nt, Streptococcus pneumoniae R6
gaaaacgauaauagcgauugaau

SEQ ID NO: 2169472 - RNA, 17 nt, Streptococcus pneumoniae R6
gaaaaccuuguuuuaaa

SEQ ID NO: 2169473 - RNA, 11 nt, Streptococcus pneumoniae R6
gaaaaccaaga

SEQ ID NO: 2169474 - RNA, 17 nt, Streptococcus pneumoniae R6
gaaaacccaccugaauu

SEQ ID NO: 2169475 - RNA, 21 nt, Streptococcus pneumoniae R6
gaaaacaauauuuuugagccu

SEQ ID NO: 2169476 - RNA, 15 nt, Streptococcus pneumoniae R6
gaaaacagacaaaac

SEQ ID NO: 2169477 - RNA, 16 nt, Streptococcus pneumoniae R6
gaaaacagacaaaacu

SEQ ID NO: 2169478 - RNA, 14 nt, Streptococcus pneumoniae R6
gaaaacagaaaaau

SEQ ID NO: 2169479 - RNA, 14 nt, Streptococcus pneumoniae R6
cuuuaccauccuga

SEQ ID NO: 2169480 - RNA, 22 nt, Streptococcus pneumoniae R6
cuuuaccagggauauagauacc

SEQ ID NO: 2169481 - RNA, 24 nt, Streptococcus pneumoniae R6
cuuuaccauucgauuuaucuguuu

SEQ ID NO: 2169482 - RNA, 20 nt, Streptococcus pneumoniae R6
cuuuagaaaacuaguuuaaa

SEQ ID NO: 2169483 - RNA, 17 nt, Streptococcus pneumoniae R6
cuuuagaaagguuuuaa

SEQ ID NO: 2169484 - RNA, 22 nt, Streptococcus pneumoniae R6
cuuuagaaagguuuuaaagaca

SEQ ID NO: 2169485 - RNA, 13 nt, Streptococcus pneumoniae R6
cuuuaaucuugac

SEQ ID NO: 2169486 - RNA, 18 nt, Streptococcus pneumoniae R6
cuuuaaucuugacuauau

SEQ ID NO: 2169487 - RNA, 16 nt, Streptococcus pneumoniae R6
cuuuaacaucagaaaa

SEQ ID NO: 2169488 - RNA, 13 nt, Streptococcus pneumoniae R6
cuuuaacaaagaa

SEQ ID NO: 2169489 - RNA, 16 nt, Streptococcus pneumoniae R6
cuucgcuuucuucauu

SEQ ID NO: 2169490 - RNA, 18 nt, Streptococcus pneumoniae R6
cuucgcuuucuucauuuu

SEQ ID NO: 2169491 - RNA, 15 nt, Streptococcus pneumoniae R6
cuucgcuuccaaucu

SEQ ID NO: 2169492 - RNA, 18 nt, Streptococcus pneumoniae R6
cuuuauugucucuaaaaa

SEQ ID NO: 2169493 - RNA, 22 nt, Streptococcus pneumoniae R6
cuuucaacuucgucacauuccc

SEQ ID NO: 2169494 - RNA, 18 nt, Streptococcus pneumoniae R6
cuuucaauuguuuauaaa

SEQ ID NO: 2169495 - RNA, 19 nt, Streptococcus pneumoniae R6
cuuucaauuguuuauaaaa

SEQ ID NO: 2169496 - RNA, 16 nt, Streptococcus pneumoniae R6
cuuucaacuccuuacu

SEQ ID NO: 2169497 - RNA, 16 nt, Streptococcus pneumoniae R6
cuuucacaaauuugaa

SEQ ID NO: 2169498 - RNA, 12 nt, Streptococcus pneumoniae R6
cuuucauagcaa

SEQ ID NO: 2169499 - RNA, 16 nt, Streptococcus pneumoniae R6
cuuucaccgccugcuc

SEQ ID NO: 2169500 - RNA, 13 nt, Streptococcus pneumoniae R6
cuuuauauaaaaa

SEQ ID NO: 2169501 - RNA, 15 nt, Streptococcus pneumoniae R6
cuuuauauaaaaaga

SEQ ID NO: 2169502 - RNA, 20 nt, Streptococcus pneumoniae R6
cuuuagauuguccucaauga

SEQ ID NO: 2169503 - RNA, 15 nt, Streptococcus pneumoniae R6
cuuuagcagcuuuca

SEQ ID NO: 2169504 - RNA, 17 nt, Streptococcus pneumoniae R6
cuuuagcaaucuuaucc

SEQ ID NO: 2169505 - RNA, 18 nt, Streptococcus pneumoniae R6
cuuuaucaagcaaaucaa

SEQ ID NO: 2169506 - RNA, 18 nt, Streptococcus pneumoniae R6
cuuugcugacuugccuuc

SEQ ID NO: 2169507 - RNA, 22 nt, Streptococcus pneumoniae R6
cuuugcugacuugccuucaaca

SEQ ID NO: 2169508 - RNA, 17 nt, Streptococcus pneumoniae R6
cuuugauuuuaaagaaa

SEQ ID NO: 2169509 - RNA, 14 nt, Streptococcus pneumoniae R6
cuuugauuuugaga

SEQ ID NO: 2169510 - RNA, 18 nt, Streptococcus pneumoniae R6
cuuugacaccgauaauau

SEQ ID NO: 2169511 - RNA, 17 nt, Streptococcus pneumoniae R6
cuuugacauccuuuucu

SEQ ID NO: 2169512 - RNA, 21 nt, Streptococcus pneumoniae R6
cuuugacagcgccuguugcuu

SEQ ID NO: 2169513 - RNA, 13 nt, Streptococcus pneumoniae R6
cuuugauucagau

SEQ ID NO: 2169514 - RNA, 13 nt, Streptococcus pneumoniae R6
cuuuguauggaaa

SEQ ID NO: 2169515 - RNA, 18 nt, Streptococcus pneumoniae R6
cuuuguaggcuucuucuc

SEQ ID NO: 2169516 - RNA, 17 nt, Streptococcus pneumoniae R6
cuuugcugcuuuccuuc

SEQ ID NO: 2169517 - RNA, 20 nt, Streptococcus pneumoniae R6
cuuugcugcuuuccuucaua

SEQ ID NO: 2169518 - RNA, 13 nt, Streptococcus pneumoniae R6
cuuuguggucuug

SEQ ID NO: 2169519 - RNA, 19 nt, Streptococcus pneumoniae R6
cuuugucuuuagucuuauc

SEQ ID NO: 2169520 - RNA, 13 nt, Streptococcus pneumoniae R6
cuuuguucacuuu

SEQ ID NO: 2169521 - RNA, 14 nt, Streptococcus pneumoniae R6
cuuucucgagcuua

SEQ ID NO: 2169522 - RNA, 22 nt, Streptococcus pneumoniae R6
cuuucucgagcuuagcuuuucu

SEQ ID NO: 2169523 - RNA, 19 nt, Streptococcus pneumoniae R6
cuuucucgagguuaacucc

SEQ ID NO: 2169524 - RNA, 22 nt, Streptococcus pneumoniae R6
cuuucuuuuuugauguucagag

SEQ ID NO: 2169525 - RNA, 16 nt, Streptococcus pneumoniae R6
cuuucuuuuuauacuc

SEQ ID NO: 2169526 - RNA, 19 nt, Streptococcus pneumoniae R6
cuuugacaagguuuccugc

SEQ ID NO: 2169527 - RNA, 21 nt, Streptococcus pneumoniae R6
cuuugacaagguuuccugcau

SEQ ID NO: 2169528 - RNA, 16 nt, Streptococcus pneumoniae R6
cuuucuucguuuuuac

SEQ ID NO: 2169529 - RNA, 14 nt, Streptococcus pneumoniae R6
cuuucugauagauu

SEQ ID NO: 2169530 - RNA, 16 nt, Streptococcus pneumoniae R6
cuuucuucgaaauucc

SEQ ID NO: 2169531 - RNA, 18 nt, Streptococcus pneumoniae R6
cuuuccauucaaauuuag

SEQ ID NO: 2169532 - RNA, 15 nt, Streptococcus pneumoniae R6
cuuucguuccagacu

SEQ ID NO: 2169533 - RNA, 16 nt, Streptococcus pneumoniae R6
cuuucguuccagacuc

SEQ ID NO: 2169534 - RNA, 17 nt, Streptococcus pneumoniae R6
cuuucuaauuuuugagc

SEQ ID NO: 2169535 - RNA, 19 nt, Streptococcus pneumoniae R6
cuuucuaguuugcuuuuug

SEQ ID NO: 2169536 - RNA, 20 nt, Streptococcus pneumoniae R6
gauaucuuccaguuuauaac

SEQ ID NO: 2169537 - RNA, 17 nt, Streptococcus pneumoniae R6
gauaucuggauuuucaa

SEQ ID NO: 2169538 - RNA, 13 nt, Streptococcus pneumoniae R6
gauaucugguugc

SEQ ID NO: 2169539 - RNA, 20 nt, Streptococcus pneumoniae R6
gauaugagcccauguuuucu

SEQ ID NO: 2169540 - RNA, 21 nt, Streptococcus pneumoniae R6
gauaugaugcguuuuauaauu

SEQ ID NO: 2169541 - RNA, 19 nt, Streptococcus pneumoniae R6
gauaugaggagaaagaaga

SEQ ID NO: 2169542 - RNA, 19 nt, Streptococcus pneumoniae R6
gauagugguguuucaaguc

SEQ ID NO: 2169543 - RNA, 15 nt, Streptococcus pneumoniae R6
gauauacguuuucuu

SEQ ID NO: 2169544 - RNA, 21 nt, Streptococcus pneumoniae R6
gauauacuuaccgagaauccc

SEQ ID NO: 2169545 - RNA, 21 nt, Streptococcus pneumoniae R6
gauauagccuguaaaaaguga

SEQ ID NO: 2169546 - RNA, 14 nt, Streptococcus pneumoniae R6
gauauaguuaaaaa

SEQ ID NO: 2169547 - RNA, 16 nt, Streptococcus pneumoniae R6
gauauauaaaugaaaa

SEQ ID NO: 2169548 - RNA, 15 nt, Streptococcus pneumoniae R6
gauaucugauagagu

SEQ ID NO: 2169549 - RNA, 15 nt, Streptococcus pneumoniae R6
gauagugacuuuaug

SEQ ID NO: 2169550 - RNA, 16 nt, Streptococcus pneumoniae R6
gauaguaucaaaugac

SEQ ID NO: 2169551 - RNA, 23 nt, Streptococcus pneumoniae R6
gauagguggguggguauaaaaga

SEQ ID NO: 2169552 - RNA, 15 nt, Streptococcus pneumoniae R6
gauaggauugacaaa

SEQ ID NO: 2169553 - RNA, 15 nt, Streptococcus pneumoniae R6
gauagauuuuucaag

SEQ ID NO: 2169554 - RNA, 21 nt, Streptococcus pneumoniae R6
gauagaugcuacuauauucua

SEQ ID NO: 2169555 - RNA, 14 nt, Streptococcus pneumoniae R6
gauagaucuuuacu

SEQ ID NO: 2169556 - RNA, 14 nt, Streptococcus pneumoniae R6
gauagauccccuau

SEQ ID NO: 2169557 - RNA, 19 nt, Streptococcus pneumoniae R6
gauagauccuucaaauccu

SEQ ID NO: 2169558 - RNA, 23 nt, Streptococcus pneumoniae R6
gauaccuucuuuaucauuaaaga

SEQ ID NO: 2169559 - RNA, 22 nt, Streptococcus pneumoniae R6
gauaccuugaucaaucauguua

SEQ ID NO: 2169560 - RNA, 17 nt, Streptococcus pneumoniae R6
gauaccuuuuccuucau

SEQ ID NO: 2169561 - RNA, 16 nt, Streptococcus pneumoniae R6
gauacgaugaccaaga

SEQ ID NO: 2169562 - RNA, 23 nt, Streptococcus pneumoniae R6
gauaagaauuggcacaaaagcga

SEQ ID NO: 2169563 - RNA, 20 nt, Streptococcus pneumoniae R6
gauaagaccaaaagucgagu

SEQ ID NO: 2169564 - RNA, 19 nt, Streptococcus pneumoniae R6
gauaagaauaucaagauaa

SEQ ID NO: 2169565 - RNA, 14 nt, Streptococcus pneumoniae R6
gauaacugaaauug

SEQ ID NO: 2169566 - RNA, 11 nt, Streptococcus pneumoniae R6
gauaacugcua

SEQ ID NO: 2169567 - RNA, 14 nt, Streptococcus pneumoniae R6
gauaacugcuagaa

SEQ ID NO: 2169568 - RNA, 21 nt, Streptococcus pneumoniae R6
gauaagaugacaucuaaauaa

SEQ ID NO: 2169569 - RNA, 21 nt, Streptococcus pneumoniae R6
gauaagcaccuaguacaaaga

SEQ ID NO: 2169570 - RNA, 15 nt, Streptococcus pneumoniae R6
gauaagacugacgaa

SEQ ID NO: 2169571 - RNA, 21 nt, Streptococcus pneumoniae R6
gauaagacugacgaagucagc

SEQ ID NO: 2169572 - RNA, 14 nt, Streptococcus pneumoniae R6
gauaagagcaacaa

SEQ ID NO: 2169573 - RNA, 20 nt, Streptococcus pneumoniae R6
gauagaccuguuuggucaga

SEQ ID NO: 2169574 - RNA, 15 nt, Streptococcus pneumoniae R6
gauagagaaagaaaa

SEQ ID NO: 2169575 - RNA, 17 nt, Streptococcus pneumoniae R6
gauagagauuauagugg

SEQ ID NO: 2169576 - RNA, 20 nt, Streptococcus pneumoniae R6
gauagagcuaacuuuuccuu

SEQ ID NO: 2169577 - RNA, 17 nt, Streptococcus pneumoniae R6
gauagaaucauggccac

SEQ ID NO: 2169578 - RNA, 15 nt, Streptococcus pneumoniae R6
gauagaaucguuucu

SEQ ID NO: 2169579 - RNA, 12 nt, Streptococcus pneumoniae R6
gauagaaagcaa

SEQ ID NO: 2169580 - RNA, 20 nt, Streptococcus pneumoniae R6
gauagaagagucagcucuuu

SEQ ID NO: 2169581 - RNA, 22 nt, Streptococcus pneumoniae R6
gauagaagguaaauucugucac

SEQ ID NO: 2169582 - RNA, 20 nt, Streptococcus pneumoniae R6
gauagaaggucaagagaaaa

SEQ ID NO: 2169583 - RNA, 15 nt, Streptococcus pneumoniae R6
gauacuccauaaaaa

SEQ ID NO: 2169584 - RNA, 18 nt, Streptococcus pneumoniae R6
gauacugccgccaccucc

SEQ ID NO: 2169585 - RNA, 18 nt, Streptococcus pneumoniae R6
gauacuguuauagaagua

SEQ ID NO: 2169586 - RNA, 23 nt, Streptococcus pneumoniae R6
gauacuuaacuuuguauaauagg

SEQ ID NO: 2169587 - RNA, 18 nt, Streptococcus pneumoniae R6
gauauggugcguuuuuug

SEQ ID NO: 2169588 - RNA, 14 nt, Streptococcus pneumoniae R6
gauaugguaauguu

SEQ ID NO: 2169589 - RNA, 18 nt, Streptococcus pneumoniae R6
gauaugguaauguucuuc

SEQ ID NO: 2169590 - RNA, 13 nt, Streptococcus pneumoniae R6
gaucaaccaguug

SEQ ID NO: 2169591 - RNA, 22 nt, Streptococcus pneumoniae R6
gaucaagcguuuuucuucugua

SEQ ID NO: 2169592 - RNA, 18 nt, Streptococcus pneumoniae R6
gaucagaguagucuuuuu

SEQ ID NO: 2169593 - RNA, 15 nt, Streptococcus pneumoniae R6
gaucagaccaguuuc

SEQ ID NO: 2169594 - RNA, 14 nt, Streptococcus pneumoniae R6
gaucauauuuucug

SEQ ID NO: 2169595 - RNA, 23 nt, Streptococcus pneumoniae R6
gaucaugagugggcucauguaaa

SEQ ID NO: 2169596 - RNA, 23 nt, Streptococcus pneumoniae R6
gaucgaguuauuaacaaaagagc

SEQ ID NO: 2169597 - RNA, 21 nt, Streptococcus pneumoniae R6
gaucgagcagauuucuuuuaa

SEQ ID NO: 2169598 - RNA, 13 nt, Streptococcus pneumoniae R6
gauccuucauucg

SEQ ID NO: 2169599 - RNA, 18 nt, Streptococcus pneumoniae R6
gauccuucaaauccugca

SEQ ID NO: 2169600 - RNA, 20 nt, Streptococcus pneumoniae R6
aaagccacuauaauaauuua

SEQ ID NO: 2169601 - RNA, 14 nt, Streptococcus pneumoniae R6
gaucccauggugca

SEQ ID NO: 2169602 - RNA, 19 nt, Streptococcus pneumoniae R6
gaucccauggugcaaguac

SEQ ID NO: 2169603 - RNA, 23 nt, Streptococcus pneumoniae R6
gaucccaacuccuccuucauauu

SEQ ID NO: 2169604 - RNA, 23 nt, Streptococcus pneumoniae R6
gaucuagauuuggaaacucagga

SEQ ID NO: 2169605 - RNA, 21 nt, Streptococcus pneumoniae R6
gaucuagcucucucugauuuc

SEQ ID NO: 2169606 - RNA, 23 nt, Streptococcus pneumoniae R6
gaucuagcugagacagggaauug

SEQ ID NO: 2169607 - RNA, 14 nt, Streptococcus pneumoniae R6
gaucuggcaggcug

SEQ ID NO: 2169608 - RNA, 11 nt, Streptococcus pneumoniae R6
gaucugacuuc

SEQ ID NO: 2169609 - RNA, 14 nt, Streptococcus pneumoniae R6
gaggagaaaaagcg

SEQ ID NO: 2169610 - RNA, 11 nt, Streptococcus pneumoniae R6
gagcugacuuc

SEQ ID NO: 2169611 - RNA, 18 nt, Streptococcus pneumoniae R6
gagcugacuucgucaguu

SEQ ID NO: 2169612 - RNA, 13 nt, Streptococcus pneumoniae R6
gagcugaggaaau

SEQ ID NO: 2169613 - RNA, 23 nt, Streptococcus pneumoniae R6
gaggaaaucccucggcuuuuuua

SEQ ID NO: 2169614 - RNA, 14 nt, Streptococcus pneumoniae R6
gaggcgaugaucuc

SEQ ID NO: 2169615 - RNA, 19 nt, Streptococcus pneumoniae R6
gaggccuauuuaccaugga

SEQ ID NO: 2169616 - RNA, 23 nt, Streptococcus pneumoniae R6
gaggggugauuuuauauaaaaua

SEQ ID NO: 2169617 - RNA, 19 nt, Streptococcus pneumoniae R6
gaggguccaaaccaacaua

SEQ ID NO: 2169618 - RNA, 20 nt, Streptococcus pneumoniae R6
gagguaaaucccaaguaaau

SEQ ID NO: 2169619 - RNA, 15 nt, Streptococcus pneumoniae R6
gaggguggaaagacu

SEQ ID NO: 2169620 - RNA, 13 nt, Streptococcus pneumoniae R6
gaguaaacuagaa

SEQ ID NO: 2169621 - RNA, 18 nt, Streptococcus pneumoniae R6
gaguaaaagauaaucauc

SEQ ID NO: 2169622 - RNA, 15 nt, Streptococcus pneumoniae R6
gaguaacuaugaauc

SEQ ID NO: 2169623 - RNA, 18 nt, Streptococcus pneumoniae R6
gaguaacaucaauaacca

SEQ ID NO: 2169624 - RNA, 19 nt, Streptococcus pneumoniae R6
gaguaacaucaauaaccau

SEQ ID NO: 2169625 - RNA, 20 nt, Streptococcus pneumoniae R6
gaguaacaucaauaaccauc

SEQ ID NO: 2169626 - RNA, 21 nt, Streptococcus pneumoniae R6
gaguaaugggcgcauuuuccu

SEQ ID NO: 2169627 - RNA, 21 nt, Streptococcus pneumoniae R6
gaguugguccagcuucaaauc

SEQ ID NO: 2169628 - RNA, 14 nt, Streptococcus pneumoniae R6
gaguucuucaacaa

SEQ ID NO: 2169629 - RNA, 19 nt, Streptococcus pneumoniae R6
gauaaaaggcuuagccagu

SEQ ID NO: 2169630 - RNA, 13 nt, Streptococcus pneumoniae R6
gauaaaacuauug

SEQ ID NO: 2169631 - RNA, 20 nt, Streptococcus pneumoniae R6
gauaaaagauagagaaagaa

SEQ ID NO: 2169632 - RNA, 21 nt, Streptococcus pneumoniae R6
gauaaaagauagagaaagaaa

SEQ ID NO: 2169633 - RNA, 19 nt, Streptococcus pneumoniae R6
gauaaaagauagcuaugaa

SEQ ID NO: 2169634 - RNA, 20 nt, Streptococcus pneumoniae R6
gauaaaauuuaaaaauagau

SEQ ID NO: 2169635 - RNA, 21 nt, Streptococcus pneumoniae R6
gauaaaauguaauuguuccau

SEQ ID NO: 2169636 - RNA, 16 nt, Streptococcus pneumoniae R6
gauaaaauugauaaua

SEQ ID NO: 2169637 - RNA, 19 nt, Streptococcus pneumoniae R6
gaguuugauuucuggauga

SEQ ID NO: 2169638 - RNA, 18 nt, Streptococcus pneumoniae R6
gauaaaacguugguaaaa

SEQ ID NO: 2169639 - RNA, 13 nt, Streptococcus pneumoniae R6
gaguuuguaucgc

SEQ ID NO: 2169640 - RNA, 15 nt, Streptococcus pneumoniae R6
gauaacgaauccaac

SEQ ID NO: 2169641 - RNA, 19 nt, Streptococcus pneumoniae R6
gauaaccuuaaucaaauua

SEQ ID NO: 2169642 - RNA, 21 nt, Streptococcus pneumoniae R6
gaguggauuggcucaaucaau

SEQ ID NO: 2169643 - RNA, 18 nt, Streptococcus pneumoniae R6
gagugagcaccaucuaua

SEQ ID NO: 2169644 - RNA, 21 nt, Streptococcus pneumoniae R6
gaguguaaaaagaaaguccuc

SEQ ID NO: 2169645 - RNA, 17 nt, Streptococcus pneumoniae R6
gaguagagagaaaggag

SEQ ID NO: 2169646 - RNA, 17 nt, Streptococcus pneumoniae R6
gaguagcaccauauuug

SEQ ID NO: 2169647 - RNA, 15 nt, Streptococcus pneumoniae R6
gaguagcauccccag

SEQ ID NO: 2169648 - RNA, 19 nt, Streptococcus pneumoniae R6
gaguacggaugcaaaacca

SEQ ID NO: 2169649 - RNA, 20 nt, Streptococcus pneumoniae R6
gaguauuagagguuugcuua

SEQ ID NO: 2169650 - RNA, 14 nt, Streptococcus pneumoniae R6
gaguauuaaacaaa

SEQ ID NO: 2169651 - RNA, 21 nt, Streptococcus pneumoniae R6
gaguauuacaaucauagauuc

SEQ ID NO: 2169652 - RNA, 19 nt, Streptococcus pneumoniae R6
gaguauuuuauaguaauuc

SEQ ID NO: 2169653 - RNA, 16 nt, Streptococcus pneumoniae R6
gagucaagauaacagu

SEQ ID NO: 2169654 - RNA, 13 nt, Streptococcus pneumoniae R6
gagucaaaaaagg

SEQ ID NO: 2169655 - RNA, 19 nt, Streptococcus pneumoniae R6
gagucaaaauucuuugaaa

SEQ ID NO: 2169656 - RNA, 12 nt, Streptococcus pneumoniae R6
gagcuccaaaga

SEQ ID NO: 2169657 - RNA, 20 nt, Streptococcus pneumoniae R6
gagcuccaaagaagauaauc

SEQ ID NO: 2169658 - RNA, 20 nt, Streptococcus pneumoniae R6
gagcucauccuuugcaucca

SEQ ID NO: 2169659 - RNA, 17 nt, Streptococcus pneumoniae R6
gagcgacuuuuucugau

SEQ ID NO: 2169660 - RNA, 18 nt, Streptococcus pneumoniae R6
gagcgcaggaagaaagag

SEQ ID NO: 2169661 - RNA, 13 nt, Streptococcus pneumoniae R6
gagcaacaaauau

SEQ ID NO: 2169662 - RNA, 15 nt, Streptococcus pneumoniae R6
gagcaagaauucaau

SEQ ID NO: 2169663 - RNA, 19 nt, Streptococcus pneumoniae R6
aaagcacggagaacaauau

SEQ ID NO: 2169664 - RNA, 21 nt, Streptococcus pneumoniae R6
aaagcacugauuugagguugu

SEQ ID NO: 2169665 - RNA, 21 nt, Streptococcus pneumoniae R6
aaagcacugccauuaauuccu

SEQ ID NO: 2169666 - RNA, 18 nt, Streptococcus pneumoniae R6
aaagcacuugcuuuugau

SEQ ID NO: 2169667 - RNA, 20 nt, Streptococcus pneumoniae R6
aaagcacuugcuuuugaugg

SEQ ID NO: 2169668 - RNA, 22 nt, Streptococcus pneumoniae R6
gagcauucuuuuguucaucauu

SEQ ID NO: 2169669 - RNA, 13 nt, Streptococcus pneumoniae R6
gagccaaaaaaga

SEQ ID NO: 2169670 - RNA, 15 nt, Streptococcus pneumoniae R6
gacucagcuucugcu

SEQ ID NO: 2169671 - RNA, 16 nt, Streptococcus pneumoniae R6
gacucaucuguagguu

SEQ ID NO: 2169672 - RNA, 21 nt, Streptococcus pneumoniae R6
gacuccaccauaguguuucuc

SEQ ID NO: 2169673 - RNA, 20 nt, Streptococcus pneumoniae R6
gagauuauagugguguuuca

SEQ ID NO: 2169674 - RNA, 18 nt, Streptococcus pneumoniae R6
gagauuacugauaaaacu

SEQ ID NO: 2169675 - RNA, 21 nt, Streptococcus pneumoniae R6
gagauuugaaggacugagcca

SEQ ID NO: 2169676 - RNA, 15 nt, Streptococcus pneumoniae R6
gagauuuucaaagag

SEQ ID NO: 2169677 - RNA, 14 nt, Streptococcus pneumoniae R6
gagauuuuggaaga

SEQ ID NO: 2169678 - RNA, 16 nt, Streptococcus pneumoniae R6
gagauuuuggaagagu

SEQ ID NO: 2169679 - RNA, 13 nt, Streptococcus pneumoniae R6
gagauugaagcuc

SEQ ID NO: 2169680 - RNA, 18 nt, Streptococcus pneumoniae R6
gagauuggauuuucugaa

SEQ ID NO: 2169681 - RNA, 12 nt, Streptococcus pneumoniae R6
gaugauaccauc

SEQ ID NO: 2169682 - RNA, 17 nt, Streptococcus pneumoniae R6
gaugaguaaguuuuugu

SEQ ID NO: 2169683 - RNA, 19 nt, Streptococcus pneumoniae R6
gaugaguguaaaaagaaag

SEQ ID NO: 2169684 - RNA, 19 nt, Streptococcus pneumoniae R6
gaugaguguuugcaaagau

SEQ ID NO: 2169685 - RNA, 20 nt, Streptococcus pneumoniae R6
gaugauauugcaguauaucu

SEQ ID NO: 2169686 - RNA, 16 nt, Streptococcus pneumoniae R6
gaugaucuaaauguau

SEQ ID NO: 2169687 - RNA, 23 nt, Streptococcus pneumoniae R6
gaugaccaugucguuuccuucca

SEQ ID NO: 2169688 - RNA, 22 nt, Streptococcus pneumoniae R6
gaugagauuauugguggcuucc

SEQ ID NO: 2169689 - RNA, 13 nt, Streptococcus pneumoniae R6
gaugacuucagcu

SEQ ID NO: 2169690 - RNA, 17 nt, Streptococcus pneumoniae R6
gaugacuucagcuccac

SEQ ID NO: 2169691 - RNA, 18 nt, Streptococcus pneumoniae R6
gaugacuucuuaaucaau

SEQ ID NO: 2169692 - RNA, 17 nt, Streptococcus pneumoniae R6
gaugagggccaguucga

SEQ ID NO: 2169693 - RNA, 17 nt, Streptococcus pneumoniae R6
gaugagggucaacuugu

SEQ ID NO: 2169694 - RNA, 22 nt, Streptococcus pneumoniae R6
gaucuuuuuauacucaaugaaa

SEQ ID NO: 2169695 - RNA, 23 nt, Streptococcus pneumoniae R6
gaucuugaggaagagcuuugcuu

SEQ ID NO: 2169696 - RNA, 18 nt, Streptococcus pneumoniae R6
gaucuuauuagucaagag

SEQ ID NO: 2169697 - RNA, 23 nt, Streptococcus pneumoniae R6
gaucuucaucuugucuucaaagg

SEQ ID NO: 2169698 - RNA, 19 nt, Streptococcus pneumoniae R6
gaugaauuacaugaaacug

SEQ ID NO: 2169699 - RNA, 14 nt, Streptococcus pneumoniae R6
gaugacaaaaauag

SEQ ID NO: 2169700 - RNA, 19 nt, Streptococcus pneumoniae R6
gaugacaaaacguucccaa

SEQ ID NO: 2169701 - RNA, 22 nt, Streptococcus pneumoniae R6
gaugaaucugaaucaaaauuau

SEQ ID NO: 2169702 - RNA, 21 nt, Streptococcus pneumoniae R6
gaugaaccugcuuuagauugu

SEQ ID NO: 2169703 - RNA, 20 nt, Streptococcus pneumoniae R6
gaugaaccuucaucaaauga

SEQ ID NO: 2169704 - RNA, 21 nt, Streptococcus pneumoniae R6
gaugaaaccccaagaaacaac

SEQ ID NO: 2169705 - RNA, 15 nt, Streptococcus pneumoniae R6
gaugaaacugacgaa

SEQ ID NO: 2169706 - RNA, 23 nt, Streptococcus pneumoniae R6
gaugccuuuuauaauagaaagau

SEQ ID NO: 2169707 - RNA, 22 nt, Streptococcus pneumoniae R6
aaagccuuugccggcauauccu

SEQ ID NO: 2169708 - RNA, 19 nt, Streptococcus pneumoniae R6
aaagcgaaaggagaaaaaa

SEQ ID NO: 2169709 - RNA, 19 nt, Streptococcus pneumoniae R6
gaugauuuaauuagaaaaa

SEQ ID NO: 2169710 - RNA, 23 nt, Streptococcus pneumoniae R6
gaugauuggaaugacgaaacgaa

SEQ ID NO: 2169711 - RNA, 16 nt, Streptococcus pneumoniae R6
gaugauguuaucaaau

SEQ ID NO: 2169712 - RNA, 14 nt, Streptococcus pneumoniae R6
gaugauguucauaa

SEQ ID NO: 2169713 - RNA, 14 nt, Streptococcus pneumoniae R6
gaugauuuucaaau

SEQ ID NO: 2169714 - RNA, 19 nt, Streptococcus pneumoniae R6
gaugcccguacuuaccaag

SEQ ID NO: 2169715 - RNA, 19 nt, Streptococcus pneumoniae R6
gauggaaauauaggccaag

SEQ ID NO: 2169716 - RNA, 22 nt, Streptococcus pneumoniae R6
gaugcuggcuuuucagcuucua

SEQ ID NO: 2169717 - RNA, 16 nt, Streptococcus pneumoniae R6
gauggacaacaaugag

SEQ ID NO: 2169718 - RNA, 14 nt, Streptococcus pneumoniae R6
gauggaagcugacg

SEQ ID NO: 2169719 - RNA, 12 nt, Streptococcus pneumoniae R6
gauggaacugac

SEQ ID NO: 2169720 - RNA, 15 nt, Streptococcus pneumoniae R6
gauggaacugacgaa

SEQ ID NO: 2169721 - RNA, 13 nt, Streptococcus pneumoniae R6
gauggaagacuga

SEQ ID NO: 2169722 - RNA, 16 nt, Streptococcus pneumoniae R6
gauggaguuccuccau

SEQ ID NO: 2169723 - RNA, 14 nt, Streptococcus pneumoniae R6
gauggaguuuucaa

SEQ ID NO: 2169724 - RNA, 19 nt, Streptococcus pneumoniae R6
gauggauacuuaacuuugu

SEQ ID NO: 2169725 - RNA, 22 nt, Streptococcus pneumoniae R6
gauggcuaggaggcggucaagg

SEQ ID NO: 2169726 - RNA, 17 nt, Streptococcus pneumoniae R6
gaugguaguuuacccca

SEQ ID NO: 2169727 - RNA, 23 nt, Streptococcus pneumoniae R6
gauggugacgaugucuugguaua

SEQ ID NO: 2169728 - RNA, 12 nt, Streptococcus pneumoniae R6
gauuaccgccuu

SEQ ID NO: 2169729 - RNA, 18 nt, Streptococcus pneumoniae R6
gauuacugauaaaacuga

SEQ ID NO: 2169730 - RNA, 12 nt, Streptococcus pneumoniae R6
gauuagauaaga

SEQ ID NO: 2169731 - RNA, 22 nt, Streptococcus pneumoniae R6
gauuaauaauucggagauacug

SEQ ID NO: 2169732 - RNA, 13 nt, Streptococcus pneumoniae R6
gauuaaucaaaug

SEQ ID NO: 2169733 - RNA, 16 nt, Streptococcus pneumoniae R6
gauuaaucaaaugagc

SEQ ID NO: 2169734 - RNA, 18 nt, Streptococcus pneumoniae R6
gauuaccaacuacuccuc

SEQ ID NO: 2169735 - RNA, 18 nt, Streptococcus pneumoniae R6
gauuacaagacagguuuu

SEQ ID NO: 2169736 - RNA, 18 nt, Streptococcus pneumoniae R6
gauuacaaaaaaaacuac

SEQ ID NO: 2169737 - RNA, 16 nt, Streptococcus pneumoniae R6
gauuaggggggcuauu

SEQ ID NO: 2169738 - RNA, 18 nt, Streptococcus pneumoniae R6
gauuaggggggcuauucu

SEQ ID NO: 2169739 - RNA, 23 nt, Streptococcus pneumoniae R6
gauuaggaaaggaaaauugauuu

SEQ ID NO: 2169740 - RNA, 19 nt, Streptococcus pneumoniae R6
gauuaggaaauucaaauga

SEQ ID NO: 2169741 - RNA, 21 nt, Streptococcus pneumoniae R6
gauuauaugcuaaaauguagu

SEQ ID NO: 2169742 - RNA, 19 nt, Streptococcus pneumoniae R6
gauuauccuuuacuuguuu

SEQ ID NO: 2169743 - RNA, 22 nt, Streptococcus pneumoniae R6
gauuaucuaacaauaagauauc

SEQ ID NO: 2169744 - RNA, 23 nt, Streptococcus pneumoniae R6
gauuauuacaacaauaagagaau

SEQ ID NO: 2169745 - RNA, 17 nt, Streptococcus pneumoniae R6
gauuaugauuuaaacua

SEQ ID NO: 2169746 - RNA, 16 nt, Streptococcus pneumoniae R6
gauuauugguggcuuc

SEQ ID NO: 2169747 - RNA, 22 nt, Streptococcus pneumoniae R6
gauuauugcagccaauuucuuu

SEQ ID NO: 2169748 - RNA, 14 nt, Streptococcus pneumoniae R6
gauuauuuuuucuc

SEQ ID NO: 2169749 - RNA, 17 nt, Streptococcus pneumoniae R6
gaugugacuguuucaga

SEQ ID NO: 2169750 - RNA, 12 nt, Streptococcus pneumoniae R6
gauguuaaaaug

SEQ ID NO: 2169751 - RNA, 19 nt, Streptococcus pneumoniae R6
gauguuaaaaugagucuau

SEQ ID NO: 2169752 - RNA, 16 nt, Streptococcus pneumoniae R6
gauguuauugaaacag

SEQ ID NO: 2169753 - RNA, 20 nt, Streptococcus pneumoniae R6
gauguuauuuacuguuuuag

SEQ ID NO: 2169754 - RNA, 17 nt, Streptococcus pneumoniae R6
gauguuaagugcuucuu

SEQ ID NO: 2169755 - RNA, 19 nt, Streptococcus pneumoniae R6
gauguuucuuuaaaucgcu

SEQ ID NO: 2169756 - RNA, 21 nt, Streptococcus pneumoniae R6
gauguuuaagucuugcuucca

SEQ ID NO: 2169757 - RNA, 18 nt, Streptococcus pneumoniae R6
gauuaaaaguaagagaaa

SEQ ID NO: 2169758 - RNA, 19 nt, Streptococcus pneumoniae R6
gauguuacuucugaaucug

SEQ ID NO: 2169759 - RNA, 13 nt, Streptococcus pneumoniae R6
gauguucaaagau

SEQ ID NO: 2169760 - RNA, 16 nt, Streptococcus pneumoniae R6
gauguuuaaaaucugg

SEQ ID NO: 2169761 - RNA, 17 nt, Streptococcus pneumoniae R6
gauguugacuuaaugaa

SEQ ID NO: 2169762 - RNA, 16 nt, Streptococcus pneumoniae R6
gauguugcuagagaua

SEQ ID NO: 2169763 - RNA, 12 nt, Streptococcus pneumoniae R6
gauuaagugauu

SEQ ID NO: 2169764 - RNA, 18 nt, Streptococcus pneumoniae R6
gauuaaauaguucuucca

SEQ ID NO: 2169765 - RNA, 19 nt, Streptococcus pneumoniae R6
gauuaaauaguucuuccaa

SEQ ID NO: 2169766 - RNA, 21 nt, Streptococcus pneumoniae R6
gauuaaaccuuccaagagacc

SEQ ID NO: 2169767 - RNA, 17 nt, Streptococcus pneumoniae R6
gauugagaaacuagaag

SEQ ID NO: 2169768 - RNA, 18 nt, Streptococcus pneumoniae R6
gauugagaaaguuaaaaa

SEQ ID NO: 2169769 - RNA, 21 nt, Streptococcus pneumoniae R6
gauugagaaaguuaaaaaaac

SEQ ID NO: 2169770 - RNA, 14 nt, Streptococcus pneumoniae R6
gauugaaacuagaa

SEQ ID NO: 2169771 - RNA, 15 nt, Streptococcus pneumoniae R6
gauucuuucuaauga

SEQ ID NO: 2169772 - RNA, 22 nt, Streptococcus pneumoniae R6
gauugaaauaagauaugaacaa

SEQ ID NO: 2169773 - RNA, 13 nt, Streptococcus pneumoniae R6
gauucucagguuu

SEQ ID NO: 2169774 - RNA, 21 nt, Streptococcus pneumoniae R6
gauucuuauauuaaaaaaagg

SEQ ID NO: 2169775 - RNA, 21 nt, Streptococcus pneumoniae R6
gauucugaaauaacucauaau

SEQ ID NO: 2169776 - RNA, 14 nt, Streptococcus pneumoniae R6
gauuggauaaaauc

SEQ ID NO: 2169777 - RNA, 19 nt, Streptococcus pneumoniae R6
gauuggauaguuuuucccg

SEQ ID NO: 2169778 - RNA, 22 nt, Streptococcus pneumoniae R6
gauuggcgagauaaugcccaag

SEQ ID NO: 2169779 - RNA, 22 nt, Streptococcus pneumoniae R6
gauuggccgcaagcagcuaaaa

SEQ ID NO: 2169780 - RNA, 21 nt, Streptococcus pneumoniae R6
gauuggcucaaucaauugguu

SEQ ID NO: 2169781 - RNA, 16 nt, Streptococcus pneumoniae R6
gauugcuacaauccag

SEQ ID NO: 2169782 - RNA, 17 nt, Streptococcus pneumoniae R6
gauugauaucuggauuu

SEQ ID NO: 2169783 - RNA, 13 nt, Streptococcus pneumoniae R6
gauugauaaaauu

SEQ ID NO: 2169784 - RNA, 14 nt, Streptococcus pneumoniae R6
gauuccuuuuugca

SEQ ID NO: 2169785 - RNA, 15 nt, Streptococcus pneumoniae R6
gauucccguaucuuu

SEQ ID NO: 2169786 - RNA, 13 nt, Streptococcus pneumoniae R6
gauucccugauuu

SEQ ID NO: 2169787 - RNA, 13 nt, Streptococcus pneumoniae R6
gauuccugaaaua

SEQ ID NO: 2169788 - RNA, 14 nt, Streptococcus pneumoniae R6
gauucgccacguuc

SEQ ID NO: 2169789 - RNA, 16 nt, Streptococcus pneumoniae R6
gauucgcuauucuucu

SEQ ID NO: 2169790 - RNA, 17 nt, Streptococcus pneumoniae R6
gauucgucauuuguuuu

SEQ ID NO: 2169791 - RNA, 15 nt, Streptococcus pneumoniae R6
gauucagcuaaaaug

SEQ ID NO: 2169792 - RNA, 14 nt, Streptococcus pneumoniae R6
gauuccagcuucuu

SEQ ID NO: 2169793 - RNA, 19 nt, Streptococcus pneumoniae R6
gauucaugacaucuuccaa

SEQ ID NO: 2169794 - RNA, 13 nt, Streptococcus pneumoniae R6
gauucauucugcu

SEQ ID NO: 2169795 - RNA, 15 nt, Streptococcus pneumoniae R6
gauugugaauaggug

SEQ ID NO: 2169796 - RNA, 19 nt, Streptococcus pneumoniae R6
gauugugauagcaguaguu

SEQ ID NO: 2169797 - RNA, 19 nt, Streptococcus pneumoniae R6
gauugucacauugagaaag

SEQ ID NO: 2169798 - RNA, 18 nt, Streptococcus pneumoniae R6
gauugucaucaucuugcu

SEQ ID NO: 2169799 - RNA, 18 nt, Streptococcus pneumoniae R6
gauuggucaaucuuaucu

SEQ ID NO: 2169800 - RNA, 23 nt, Streptococcus pneumoniae R6
gauuuaacaaucuaucuuuuaau

SEQ ID NO: 2169801 - RNA, 21 nt, Streptococcus pneumoniae R6
gauuuaaacuaguuuucuaaa

SEQ ID NO: 2169802 - RNA, 17 nt, Streptococcus pneumoniae R6
gauuuaaauguuuucuc

SEQ ID NO: 2169803 - RNA, 14 nt, Streptococcus pneumoniae R6
gauuuaaaacugug

SEQ ID NO: 2169804 - RNA, 23 nt, Streptococcus pneumoniae R6
gauuuaaaaucguagucuuucac

SEQ ID NO: 2169805 - RNA, 11 nt, Streptococcus pneumoniae R6
gauuuaaaaua

SEQ ID NO: 2169806 - RNA, 14 nt, Streptococcus pneumoniae R6
gauuuaauuagaaa

SEQ ID NO: 2169807 - RNA, 18 nt, Streptococcus pneumoniae R6
gauuuaauuagaaaaaaa

SEQ ID NO: 2169808 - RNA, 18 nt, Streptococcus pneumoniae R6
gauuuacaucuucucugg

SEQ ID NO: 2169809 - RNA, 20 nt, Streptococcus pneumoniae R6
gauuuaccauuuucguccaa

SEQ ID NO: 2169810 - RNA, 20 nt, Streptococcus pneumoniae R6
gauuuaccuuccucaacaaa

SEQ ID NO: 2169811 - RNA, 15 nt, Streptococcus pneumoniae R6
gauuuacuuccuuuu

SEQ ID NO: 2169812 - RNA, 16 nt, Streptococcus pneumoniae R6
gauuuacuuccuuuuc

SEQ ID NO: 2169813 - RNA, 20 nt, Streptococcus pneumoniae R6
gauuuacuucuuuuucuccu

SEQ ID NO: 2169814 - RNA, 16 nt, Streptococcus pneumoniae R6
gauuuaguagcaucau

SEQ ID NO: 2169815 - RNA, 15 nt, Streptococcus pneumoniae R6
gauuuagaaccaaga

SEQ ID NO: 2169816 - RNA, 12 nt, Streptococcus pneumoniae R6
gauuuagaggcc

SEQ ID NO: 2169817 - RNA, 23 nt, Streptococcus pneumoniae R6
gauuuaucaguauauugaaauga

SEQ ID NO: 2169818 - RNA, 13 nt, Streptococcus pneumoniae R6
gauuuauccaacu

SEQ ID NO: 2169819 - RNA, 12 nt, Streptococcus pneumoniae R6
gauuuaguucug

SEQ ID NO: 2169820 - RNA, 16 nt, Streptococcus pneumoniae R6
gauuuaguucuguacu

SEQ ID NO: 2169821 - RNA, 23 nt, Streptococcus pneumoniae R6
gauuucaaguaaaaucaggauuu

SEQ ID NO: 2169822 - RNA, 22 nt, Streptococcus pneumoniae R6
gauuucaagaccauuuccaucu

SEQ ID NO: 2169823 - RNA, 23 nt, Streptococcus pneumoniae R6
gauuuccauuggaguaugcucgu

SEQ ID NO: 2169824 - RNA, 13 nt, Streptococcus pneumoniae R6
gauuuccauuucu

SEQ ID NO: 2169825 - RNA, 14 nt, Streptococcus pneumoniae R6
gauuuccucugcgc

SEQ ID NO: 2169826 - RNA, 20 nt, Streptococcus pneumoniae R6
gauuuccuucacuacagaau

SEQ ID NO: 2169827 - RNA, 12 nt, Streptococcus pneumoniae R6
gauuucagaaau

SEQ ID NO: 2169828 - RNA, 17 nt, Streptococcus pneumoniae R6
gauuucagcguuuucua

SEQ ID NO: 2169829 - RNA, 18 nt, Streptococcus pneumoniae R6
gauuuccaaucuucucca

SEQ ID NO: 2169830 - RNA, 12 nt, Streptococcus pneumoniae R6
gauuugagugaa

SEQ ID NO: 2169831 - RNA, 12 nt, Streptococcus pneumoniae R6
gauuugauaaga

SEQ ID NO: 2169832 - RNA, 12 nt, Streptococcus pneumoniae R6
gauuugaaacua

SEQ ID NO: 2169833 - RNA, 14 nt, Streptococcus pneumoniae R6
gauuuguaaauccg

SEQ ID NO: 2169834 - RNA, 22 nt, Streptococcus pneumoniae R6
gauuucuucacggcuaauacca

SEQ ID NO: 2169835 - RNA, 13 nt, Streptococcus pneumoniae R6
gauuucuucuugg

SEQ ID NO: 2169836 - RNA, 17 nt, Streptococcus pneumoniae R6
gauuucuguaaaaauac

SEQ ID NO: 2169837 - RNA, 17 nt, Streptococcus pneumoniae R6
gauuucuauugaaauga

SEQ ID NO: 2169838 - RNA, 22 nt, Streptococcus pneumoniae R6
gauuucuccauagauuucuugg

SEQ ID NO: 2169839 - RNA, 16 nt, Streptococcus pneumoniae R6
gauuucuaccauagau

SEQ ID NO: 2169840 - RNA, 23 nt, Streptococcus pneumoniae R6
gauuucuaacaauauuuuagaag

SEQ ID NO: 2169841 - RNA, 21 nt, Streptococcus pneumoniae R6
gauuuuaaauuuacuuaaaau

SEQ ID NO: 2169842 - RNA, 13 nt, Streptococcus pneumoniae R6
gauuuuaauaauu

SEQ ID NO: 2169843 - RNA, 15 nt, Streptococcus pneumoniae R6
gauuuuaaagaaaua

SEQ ID NO: 2169844 - RNA, 13 nt, Streptococcus pneumoniae R6
gauuuguuuuugg

SEQ ID NO: 2169845 - RNA, 17 nt, Streptococcus pneumoniae R6
gauuugugaaucaucac

SEQ ID NO: 2169846 - RNA, 23 nt, Streptococcus pneumoniae R6
gauuuguccuauucuuauuucau

SEQ ID NO: 2169847 - RNA, 23 nt, Streptococcus pneumoniae R6
gauuuguccuguucuuauuucau

SEQ ID NO: 2169848 - RNA, 23 nt, Streptococcus pneumoniae R6
gauuuguccaucuguaauaugaa

SEQ ID NO: 2169849 - RNA, 16 nt, Streptococcus pneumoniae R6
gauuuguucagguguu

SEQ ID NO: 2169850 - RNA, 19 nt, Streptococcus pneumoniae R6
gauuuguucagguguuucu

SEQ ID NO: 2169851 - RNA, 18 nt, Streptococcus pneumoniae R6
gauuuguucauaucuuau

SEQ ID NO: 2169852 - RNA, 20 nt, Streptococcus pneumoniae R6
gauuuucuuuaaaaaauuuu

SEQ ID NO: 2169853 - RNA, 12 nt, Streptococcus pneumoniae R6
gauuuugaaaau

SEQ ID NO: 2169854 - RNA, 21 nt, Streptococcus pneumoniae R6
gauuuucucccguugucuucu

SEQ ID NO: 2169855 - RNA, 22 nt, Streptococcus pneumoniae R6
gauuuucauugaguaugaaaua

SEQ ID NO: 2169856 - RNA, 12 nt, Streptococcus pneumoniae R6
gauuuuauccaa

SEQ ID NO: 2169857 - RNA, 16 nt, Streptococcus pneumoniae R6
gauuuuccuaaucaau

SEQ ID NO: 2169858 - RNA, 17 nt, Streptococcus pneumoniae R6
gauuuucgaaaauucuu

SEQ ID NO: 2169859 - RNA, 22 nt, Streptococcus pneumoniae R6
gauuuucccuuuuguauuccac

SEQ ID NO: 2169860 - RNA, 22 nt, Streptococcus pneumoniae R6
gauuuucagccucuauacuuac

SEQ ID NO: 2169861 - RNA, 15 nt, Streptococcus pneumoniae R6
gauuuucaucaucac

SEQ ID NO: 2169862 - RNA, 15 nt, Streptococcus pneumoniae R6
gauuuuuaaauucuu

SEQ ID NO: 2169863 - RNA, 18 nt, Streptococcus pneumoniae R6
gauuuuuaaauucuucca

SEQ ID NO: 2169864 - RNA, 16 nt, Streptococcus pneumoniae R6
gauuuuguaaaaauag

SEQ ID NO: 2169865 - RNA, 15 nt, Streptococcus pneumoniae R6
gauuuuugaagagua

SEQ ID NO: 2169866 - RNA, 19 nt, Streptococcus pneumoniae R6
gauuuuuguguuuuuucuu

SEQ ID NO: 2169867 - RNA, 16 nt, Streptococcus pneumoniae R6
gauuuuuuugauuucu

SEQ ID NO: 2169868 - RNA, 15 nt, Streptococcus pneumoniae R6
gauuuuuucuuuguu

SEQ ID NO: 2169869 - RNA, 20 nt, Streptococcus pneumoniae R6
gauuuuuucaccaaaaccaa

SEQ ID NO: 2169870 - RNA, 21 nt, Streptococcus pneumoniae R6
gcaaaaagacuuagcaaauca

SEQ ID NO: 2169871 - RNA, 14 nt, Streptococcus pneumoniae R6
gcaaaaacaauugc

SEQ ID NO: 2169872 - RNA, 21 nt, Streptococcus pneumoniae R6
gcaaaaacaauugcccaaagc

SEQ ID NO: 2169873 - RNA, 18 nt, Streptococcus pneumoniae R6
gcaaaaaauugagaaaga

SEQ ID NO: 2169874 - RNA, 22 nt, Streptococcus pneumoniae R6
gcaaaagccgauaccuaucgag

SEQ ID NO: 2169875 - RNA, 21 nt, Streptococcus pneumoniae R6
gcaaaaucauaaacuauccag

SEQ ID NO: 2169876 - RNA, 18 nt, Streptococcus pneumoniae R6
gcaaaaccaucaucagca

SEQ ID NO: 2169877 - RNA, 18 nt, Streptococcus pneumoniae R6
gcaaaacggaugcagacu

SEQ ID NO: 2169878 - RNA, 20 nt, Streptococcus pneumoniae R6
gcaaaagaacaaguaaagag

SEQ ID NO: 2169879 - RNA, 22 nt, Streptococcus pneumoniae R6
gcaaaagcagcgacauugacug

SEQ ID NO: 2169880 - RNA, 15 nt, Streptococcus pneumoniae R6
gcaaacuaggaaacc

SEQ ID NO: 2169881 - RNA, 13 nt, Streptococcus pneumoniae R6
gcaaagaggaaga

SEQ ID NO: 2169882 - RNA, 18 nt, Streptococcus pneumoniae R6
gcaaagaggaagaggaca

SEQ ID NO: 2169883 - RNA, 22 nt, Streptococcus pneumoniae R6
gcaaagagucccuuagaaaaac

SEQ ID NO: 2169884 - RNA, 12 nt, Streptococcus pneumoniae R6
gcaaagcaaucu

SEQ ID NO: 2169885 - RNA, 14 nt, Streptococcus pneumoniae R6
gcaaagcaaucuaa

SEQ ID NO: 2169886 - RNA, 15 nt, Streptococcus pneumoniae R6
gcaaacuuggucgcu

SEQ ID NO: 2169887 - RNA, 22 nt, Streptococcus pneumoniae R6
gcaaacuuuccaauauguucua

SEQ ID NO: 2169888 - RNA, 18 nt, Streptococcus pneumoniae R6
gcaaagcagaugcaaaag

SEQ ID NO: 2169889 - RNA, 14 nt, Streptococcus pneumoniae R6
gcaaaggcaugggc

SEQ ID NO: 2169890 - RNA, 20 nt, Streptococcus pneumoniae R6
gcaaaggcaugggccccagc

SEQ ID NO: 2169891 - RNA, 15 nt, Streptococcus pneumoniae R6
gcaaagcuaaauccu

SEQ ID NO: 2169892 - RNA, 21 nt, Streptococcus pneumoniae R6
gcaaaucaacuggcaucccca

SEQ ID NO: 2169893 - RNA, 22 nt, Streptococcus pneumoniae R6
gcaaauaaaaagcuuuaagaca

SEQ ID NO: 2169894 - RNA, 15 nt, Streptococcus pneumoniae R6
gcaaauaagaaaucu

SEQ ID NO: 2169895 - RNA, 20 nt, Streptococcus pneumoniae R6
gcaaaguccuuacucaaaua

SEQ ID NO: 2169896 - RNA, 23 nt, Streptococcus pneumoniae R6
gcaaaguccuuacucaaauaaaa

SEQ ID NO: 2169897 - RNA, 16 nt, Streptococcus pneumoniae R6
gcaaauccgaaaauca

SEQ ID NO: 2169898 - RNA, 13 nt, Streptococcus pneumoniae R6
gcaaauucuguca

SEQ ID NO: 2169899 - RNA, 21 nt, Streptococcus pneumoniae R6
gcaaauuauuuacagaaagaa

SEQ ID NO: 2169900 - RNA, 23 nt, Streptococcus pneumoniae R6
gcaaauuauuuacagaaagaaca

SEQ ID NO: 2169901 - RNA, 18 nt, Streptococcus pneumoniae R6
gcaacaaaguaaccaucu

SEQ ID NO: 2169902 - RNA, 22 nt, Streptococcus pneumoniae R6
gcaacaaaguaaccaucuguac

SEQ ID NO: 2169903 - RNA, 21 nt, Streptococcus pneumoniae R6
gcaaauuucaugacagauuca

SEQ ID NO: 2169904 - RNA, 20 nt, Streptococcus pneumoniae R6
gcaacaaaaacgauaaaagc

SEQ ID NO: 2169905 - RNA, 18 nt, Streptococcus pneumoniae R6
gcaaauuguuuucaaggu

SEQ ID NO: 2169906 - RNA, 20 nt, Streptococcus pneumoniae R6
gcaacagcuggaaucacauu

SEQ ID NO: 2169907 - RNA, 13 nt, Streptococcus pneumoniae R6
gcccauguuuucu

SEQ ID NO: 2169908 - RNA, 18 nt, Streptococcus pneumoniae R6
gcccgaaaaauuucucug

SEQ ID NO: 2169909 - RNA, 13 nt, Streptococcus pneumoniae R6
gccccuucaaggu

SEQ ID NO: 2169910 - RNA, 16 nt, Streptococcus pneumoniae R6
gcccgagcucaaauca

SEQ ID NO: 2169911 - RNA, 16 nt, Streptococcus pneumoniae R6
gcccauacgcccucca

SEQ ID NO: 2169912 - RNA, 15 nt, Streptococcus pneumoniae R6
gcccaucauuccuga

SEQ ID NO: 2169913 - RNA, 19 nt, Streptococcus pneumoniae R6
gcccauggccauaaucucu

SEQ ID NO: 2169914 - RNA, 14 nt, Streptococcus pneumoniae R6
gcccacuaaaaaua

SEQ ID NO: 2169915 - RNA, 15 nt, Streptococcus pneumoniae R6
gcccacuaaaaauau

SEQ ID NO: 2169916 - RNA, 15 nt, Streptococcus pneumoniae R6
gcccaauucuugagc

SEQ ID NO: 2169917 - RNA, 21 nt, Streptococcus pneumoniae R6
gcccaaccacuucgucuugua

SEQ ID NO: 2169918 - RNA, 21 nt, Streptococcus pneumoniae R6
gccauuggacaccgagaaagg

SEQ ID NO: 2169919 - RNA, 22 nt, Streptococcus pneumoniae R6
gccauuguauccugaaaagcca

SEQ ID NO: 2169920 - RNA, 15 nt, Streptococcus pneumoniae R6
gccauuaaucagaua

SEQ ID NO: 2169921 - RNA, 21 nt, Streptococcus pneumoniae R6
gccaucuugagcgaggucgcu

SEQ ID NO: 2169922 - RNA, 14 nt, Streptococcus pneumoniae R6
gccaucauccaccu

SEQ ID NO: 2169923 - RNA, 18 nt, Streptococcus pneumoniae R6
aaagcuccauacacugga

SEQ ID NO: 2169924 - RNA, 13 nt, Streptococcus pneumoniae R6
aaagcucuucuaa

SEQ ID NO: 2169925 - RNA, 21 nt, Streptococcus pneumoniae R6
aaagcugaauucuaauguaca

SEQ ID NO: 2169926 - RNA, 22 nt, Streptococcus pneumoniae R6
aaagcugacgcgguuugaagag

SEQ ID NO: 2169927 - RNA, 23 nt, Streptococcus pneumoniae R6
gccgcaaacuuggucgcugagua

SEQ ID NO: 2169928 - RNA, 11 nt, Streptococcus pneumoniae R6
gcccugucuuu

SEQ ID NO: 2169929 - RNA, 23 nt, Streptococcus pneumoniae R6
gccaccuccgccuccagagaagc

SEQ ID NO: 2169930 - RNA, 20 nt, Streptococcus pneumoniae R6
gccaaaucaucauaaaaaua

SEQ ID NO: 2169931 - RNA, 23 nt, Streptococcus pneumoniae R6
gccaaauccuauucggacuuugg

SEQ ID NO: 2169932 - RNA, 14 nt, Streptococcus pneumoniae R6
gccacaauacccac

SEQ ID NO: 2169933 - RNA, 16 nt, Streptococcus pneumoniae R6
gccaccaacugcacca

SEQ ID NO: 2169934 - RNA, 13 nt, Streptococcus pneumoniae R6
gccagaaaaaguc

SEQ ID NO: 2169935 - RNA, 20 nt, Streptococcus pneumoniae R6
gccagaacuuccacuuccag

SEQ ID NO: 2169936 - RNA, 22 nt, Streptococcus pneumoniae R6
gccagaauaauuaaaucauaaa

SEQ ID NO: 2169937 - RNA, 15 nt, Streptococcus pneumoniae R6
gccagacugggcagu

SEQ ID NO: 2169938 - RNA, 12 nt, Streptococcus pneumoniae R6
gccagagcacca

SEQ ID NO: 2169939 - RNA, 15 nt, Streptococcus pneumoniae R6
gccagagcaccaacc

SEQ ID NO: 2169940 - RNA, 19 nt, Streptococcus pneumoniae R6
gccagauguuccacggaga

SEQ ID NO: 2169941 - RNA, 23 nt, Streptococcus pneumoniae R6
gccagccauaagcuacauagaga

SEQ ID NO: 2169942 - RNA, 19 nt, Streptococcus pneumoniae R6
gccagcgccuaaagacgcu

SEQ ID NO: 2169943 - RNA, 14 nt, Streptococcus pneumoniae R6
gcauuuguaaaucu

SEQ ID NO: 2169944 - RNA, 22 nt, Streptococcus pneumoniae R6
gcauuucccauugcaaucccaa

SEQ ID NO: 2169945 - RNA, 17 nt, Streptococcus pneumoniae R6
gcauuucaucuucuacu

SEQ ID NO: 2169946 - RNA, 16 nt, Streptococcus pneumoniae R6
gcauuuuaauuucaau

SEQ ID NO: 2169947 - RNA, 22 nt, Streptococcus pneumoniae R6
gccaaagaaauuauucuuaucu

SEQ ID NO: 2169948 - RNA, 18 nt, Streptococcus pneumoniae R6
gcauucuaguccaucucc

SEQ ID NO: 2169949 - RNA, 14 nt, Streptococcus pneumoniae R6
gcauucguuucuuu

SEQ ID NO: 2169950 - RNA, 19 nt, Streptococcus pneumoniae R6
gcauugcgcuugauaaguu

SEQ ID NO: 2169951 - RNA, 18 nt, Streptococcus pneumoniae R6
gcauuccagacagcuuca

SEQ ID NO: 2169952 - RNA, 22 nt, Streptococcus pneumoniae R6
gcaucuuuguaaguuucuucuu

SEQ ID NO: 2169953 - RNA, 14 nt, Streptococcus pneumoniae R6
gcaucuuauuucaa

SEQ ID NO: 2169954 - RNA, 14 nt, Streptococcus pneumoniae R6
gcaucuugucaaag

SEQ ID NO: 2169955 - RNA, 13 nt, Streptococcus pneumoniae R6
gcauggaaagcau

SEQ ID NO: 2169956 - RNA, 16 nt, Streptococcus pneumoniae R6
gcauagaugacaaagu

SEQ ID NO: 2169957 - RNA, 11 nt, Streptococcus pneumoniae R6
gcauaaauacu

SEQ ID NO: 2169958 - RNA, 14 nt, Streptococcus pneumoniae R6
gcauaauagcagaa

SEQ ID NO: 2169959 - RNA, 20 nt, Streptococcus pneumoniae R6
gcauaauagcagaaaaauga

SEQ ID NO: 2169960 - RNA, 20 nt, Streptococcus pneumoniae R6
gcauaauaucaaguuuucac

SEQ ID NO: 2169961 - RNA, 12 nt, Streptococcus pneumoniae R6
gcauaaugaggu

SEQ ID NO: 2169962 - RNA, 20 nt, Streptococcus pneumoniae R6
gcaucaaauccuucagcuuu

SEQ ID NO: 2169963 - RNA, 16 nt, Streptococcus pneumoniae R6
gcaucaacagcuccau

SEQ ID NO: 2169964 - RNA, 11 nt, Streptococcus pneumoniae R6
gcaucuagguc

SEQ ID NO: 2169965 - RNA, 19 nt, Streptococcus pneumoniae R6
gcaucuaaaugauccaagu

SEQ ID NO: 2169966 - RNA, 22 nt, Streptococcus pneumoniae R6
gcaucuaagcauuuaauccaaa

SEQ ID NO: 2169967 - RNA, 15 nt, Streptococcus pneumoniae R6
gcaucgcccauggcc

SEQ ID NO: 2169968 - RNA, 18 nt, Streptococcus pneumoniae R6
gcauccaccuucaucucu

SEQ ID NO: 2169969 - RNA, 21 nt, Streptococcus pneumoniae R6
gcauccaccuucaucucucua

SEQ ID NO: 2169970 - RNA, 17 nt, Streptococcus pneumoniae R6
gcaucgacuacuaaaac

SEQ ID NO: 2169971 - RNA, 15 nt, Streptococcus pneumoniae R6
gcaggaguuuucccu

SEQ ID NO: 2169972 - RNA, 15 nt, Streptococcus pneumoniae R6
gcaggaccagaaaga

SEQ ID NO: 2169973 - RNA, 15 nt, Streptococcus pneumoniae R6
gcaggacucuuguuc

SEQ ID NO: 2169974 - RNA, 17 nt, Streptococcus pneumoniae R6
gcaggcugauuccagcu

SEQ ID NO: 2169975 - RNA, 15 nt, Streptococcus pneumoniae R6
gcaggcugcucaaaa

SEQ ID NO: 2169976 - RNA, 17 nt, Streptococcus pneumoniae R6
gcaggcugcucaaaaca

SEQ ID NO: 2169977 - RNA, 13 nt, Streptococcus pneumoniae R6
gcagcuuguucuu

SEQ ID NO: 2169978 - RNA, 13 nt, Streptococcus pneumoniae R6
gcaggaauaucca

SEQ ID NO: 2169979 - RNA, 13 nt, Streptococcus pneumoniae R6
gcaggaagaaaga

SEQ ID NO: 2169980 - RNA, 20 nt, Streptococcus pneumoniae R6
gcagcuuguuguuaaacaag

SEQ ID NO: 2169981 - RNA, 13 nt, Streptococcus pneumoniae R6
gcauaaaaucagg

SEQ ID NO: 2169982 - RNA, 14 nt, Streptococcus pneumoniae R6
gcauaaaaucugaa

SEQ ID NO: 2169983 - RNA, 21 nt, Streptococcus pneumoniae R6
gcaguuucucuacuaacucaa

SEQ ID NO: 2169984 - RNA, 20 nt, Streptococcus pneumoniae R6
gcaguucuugcucaaucaau

SEQ ID NO: 2169985 - RNA, 18 nt, Streptococcus pneumoniae R6
gcaguucauauucaacac

SEQ ID NO: 2169986 - RNA, 20 nt, Streptococcus pneumoniae R6
gcagugguuuagaagucuca

SEQ ID NO: 2169987 - RNA, 17 nt, Streptococcus pneumoniae R6
gcagucaagauggacug

SEQ ID NO: 2169988 - RNA, 14 nt, Streptococcus pneumoniae R6
gcaguaucaaucau

SEQ ID NO: 2169989 - RNA, 22 nt, Streptococcus pneumoniae R6
gcaguaacuucugucuauuugc

SEQ ID NO: 2169990 - RNA, 12 nt, Streptococcus pneumoniae R6
gcaguaaaucuu

SEQ ID NO: 2169991 - RNA, 14 nt, Streptococcus pneumoniae R6
gcagucuucaauac

SEQ ID NO: 2169992 - RNA, 21 nt, Streptococcus pneumoniae R6
gcagucagugguucacuggca

SEQ ID NO: 2169993 - RNA, 20 nt, Streptococcus pneumoniae R6
gcgccaguuacccgaccuaa

SEQ ID NO: 2169994 - RNA, 17 nt, Streptococcus pneumoniae R6
gcgcccuuguucuccaa

SEQ ID NO: 2169995 - RNA, 15 nt, Streptococcus pneumoniae R6
gcgcccuugagagaa

SEQ ID NO: 2169996 - RNA, 19 nt, Streptococcus pneumoniae R6
gcgcccugcaaucauugca

SEQ ID NO: 2169997 - RNA, 17 nt, Streptococcus pneumoniae R6
gcggcuuuuucuuucaa

SEQ ID NO: 2169998 - RNA, 19 nt, Streptococcus pneumoniae R6
gcgcaacacacuguuuuga

SEQ ID NO: 2169999 - RNA, 20 nt, Streptococcus pneumoniae R6
gcgcaaauccgaaaaucacu

SEQ ID NO: 2170000 - RNA, 14 nt, Streptococcus pneumoniae R6
gcgauuuucccuuu

SEQ ID NO: 2170001 - RNA, 22 nt, Streptococcus pneumoniae R6
gcgauuucuucacggcuaauac

SEQ ID NO: 2170002 - RNA, 21 nt, Streptococcus pneumoniae R6
gcgauuuuuguguuuuuucuu

SEQ ID NO: 2170003 - RNA, 21 nt, Streptococcus pneumoniae R6
gcgauugauuucggccaauuc

SEQ ID NO: 2170004 - RNA, 23 nt, Streptococcus pneumoniae R6
gcgaaguagcgugugauaucaau

SEQ ID NO: 2170005 - RNA, 13 nt, Streptococcus pneumoniae R6
gcgacucccucuu

SEQ ID NO: 2170006 - RNA, 23 nt, Streptococcus pneumoniae R6
gcgaguugcauagcgaagaacaa

SEQ ID NO: 2170007 - RNA, 23 nt, Streptococcus pneumoniae R6
gcgaucaaccgauuuaagauaag

SEQ ID NO: 2170008 - RNA, 23 nt, Streptococcus pneumoniae R6
gcgccagagcaaugauagacauu

SEQ ID NO: 2170009 - RNA, 21 nt, Streptococcus pneumoniae R6
gccuaucguagcuuuucuuau

SEQ ID NO: 2170010 - RNA, 20 nt, Streptococcus pneumoniae R6
gccucacuaucgaaaaauau

SEQ ID NO: 2170011 - RNA, 17 nt, Streptococcus pneumoniae R6
gccucauaucugucuug

SEQ ID NO: 2170012 - RNA, 17 nt, Streptococcus pneumoniae R6
gccucucuaaaguaagu

SEQ ID NO: 2170013 - RNA, 13 nt, Streptococcus pneumoniae R6
gccuucaacaccg

SEQ ID NO: 2170014 - RNA, 14 nt, Streptococcus pneumoniae R6
gccuuuuugaacug

SEQ ID NO: 2170015 - RNA, 14 nt, Streptococcus pneumoniae R6
gcgaaacggcagcu

SEQ ID NO: 2170016 - RNA, 14 nt, Streptococcus pneumoniae R6
gcgaacaucuccaa

SEQ ID NO: 2170017 - RNA, 19 nt, Streptococcus pneumoniae R6
gccuuugauaaccacagac

SEQ ID NO: 2170018 - RNA, 16 nt, Streptococcus pneumoniae R6
gccuucuacuuccugc

SEQ ID NO: 2170019 - RNA, 12 nt, Streptococcus pneumoniae R6
gccuugaccaau

SEQ ID NO: 2170020 - RNA, 18 nt, Streptococcus pneumoniae R6
gccuugaccagaaauaaa

SEQ ID NO: 2170021 - RNA, 20 nt, Streptococcus pneumoniae R6
aaauacuuuuuccugguaau

SEQ ID NO: 2170022 - RNA, 20 nt, Streptococcus pneumoniae R6
aaauaccaaguucauuuuuu

SEQ ID NO: 2170023 - RNA, 21 nt, Streptococcus pneumoniae R6
aaauaccaaguucauuuuuua

SEQ ID NO: 2170024 - RNA, 14 nt, Streptococcus pneumoniae R6
ggcgauuuuaggau

SEQ ID NO: 2170025 - RNA, 19 nt, Streptococcus pneumoniae R6
aaauaauuaguucagaauu

SEQ ID NO: 2170026 - RNA, 22 nt, Streptococcus pneumoniae R6
aaauaauuaguucagaauuuuc

SEQ ID NO: 2170027 - RNA, 22 nt, Streptococcus pneumoniae R6
aaauaauuuauccaaaggauuu

SEQ ID NO: 2170028 - RNA, 15 nt, Streptococcus pneumoniae R6
aaauacaaaccaaac

SEQ ID NO: 2170029 - RNA, 14 nt, Streptococcus pneumoniae R6
aaauacaaaaauag

SEQ ID NO: 2170030 - RNA, 12 nt, Streptococcus pneumoniae R6
aaauaauuuuuu

SEQ ID NO: 2170031 - RNA, 12 nt, Streptococcus pneumoniae R6
aaauacaaaaac

SEQ ID NO: 2170032 - RNA, 16 nt, Streptococcus pneumoniae R6
aaauacaaaaacaaag

SEQ ID NO: 2170033 - RNA, 12 nt, Streptococcus pneumoniae R6
ggcgaugaagac

SEQ ID NO: 2170034 - RNA, 14 nt, Streptococcus pneumoniae R6
ggcgaugaagacca

SEQ ID NO: 2170035 - RNA, 22 nt, Streptococcus pneumoniae R6
aaauaauuaaaaugugauuucu

SEQ ID NO: 2170036 - RNA, 19 nt, Streptococcus pneumoniae R6
aaauaaucucugaacuuuc

SEQ ID NO: 2170037 - RNA, 15 nt, Streptococcus pneumoniae R6
aaauaaucggaagca

SEQ ID NO: 2170038 - RNA, 14 nt, Streptococcus pneumoniae R6
aaauaaucaaaacu

SEQ ID NO: 2170039 - RNA, 13 nt, Streptococcus pneumoniae R6
aaauaaucaaaau

SEQ ID NO: 2170040 - RNA, 18 nt, Streptococcus pneumoniae R6
aaauaaucaaaauauguu

SEQ ID NO: 2170041 - RNA, 20 nt, Streptococcus pneumoniae R6
aaauaagccgaagccaauca

SEQ ID NO: 2170042 - RNA, 16 nt, Streptococcus pneumoniae R6
aaauaagaugagaaca

SEQ ID NO: 2170043 - RNA, 22 nt, Streptococcus pneumoniae R6
aaauaauagacuuccugcaaaa

SEQ ID NO: 2170044 - RNA, 15 nt, Streptococcus pneumoniae R6
aaauaauaagcuuug

SEQ ID NO: 2170045 - RNA, 23 nt, Streptococcus pneumoniae R6
aaauaaggggauagagauagaag

SEQ ID NO: 2170046 - RNA, 14 nt, Streptococcus pneumoniae R6
aaauaacucauaau

SEQ ID NO: 2170047 - RNA, 16 nt, Streptococcus pneumoniae R6
aaauaacucauaauag

SEQ ID NO: 2170048 - RNA, 21 nt, Streptococcus pneumoniae R6
aaauaacucauaauagucucu

SEQ ID NO: 2170049 - RNA, 14 nt, Streptococcus pneumoniae R6
aaauaacucuguaa

SEQ ID NO: 2170050 - RNA, 14 nt, Streptococcus pneumoniae R6
aaauaagaaauagu

SEQ ID NO: 2170051 - RNA, 15 nt, Streptococcus pneumoniae R6
aaauaagaaauaguu

SEQ ID NO: 2170052 - RNA, 14 nt, Streptococcus pneumoniae R6
aaauaagauaugaa

SEQ ID NO: 2170053 - RNA, 16 nt, Streptococcus pneumoniae R6
ggcuucuucaacagcu

SEQ ID NO: 2170054 - RNA, 17 nt, Streptococcus pneumoniae R6
ggcuugguucuucacua

SEQ ID NO: 2170055 - RNA, 22 nt, Streptococcus pneumoniae R6
ggcuugguucuucacuauugau

SEQ ID NO: 2170056 - RNA, 24 nt, Streptococcus pneumoniae R6
ggcuuguaauucgccuaguaagau

SEQ ID NO: 2170057 - RNA, 12 nt, Streptococcus pneumoniae R6
ggcuuguguucu

SEQ ID NO: 2170058 - RNA, 18 nt, Streptococcus pneumoniae R6
ggcuuacaucaaaaacau

SEQ ID NO: 2170059 - RNA, 22 nt, Streptococcus pneumoniae R6
ggcuuaucugacuagcaucuug

SEQ ID NO: 2170060 - RNA, 17 nt, Streptococcus pneumoniae R6
ggcuguuucaaaugaaa

SEQ ID NO: 2170061 - RNA, 14 nt, Streptococcus pneumoniae R6
ggcuuccugugcua

SEQ ID NO: 2170062 - RNA, 21 nt, Streptococcus pneumoniae R6
ggcuuccaguuuggcguugga

SEQ ID NO: 2170063 - RNA, 20 nt, Streptococcus pneumoniae R6
ggcuucauuaugaguggcag

SEQ ID NO: 2170064 - RNA, 22 nt, Streptococcus pneumoniae R6
ggcugcuaguguggacaugagu

SEQ ID NO: 2170065 - RNA, 14 nt, Streptococcus pneumoniae R6
ggcugcucaaaaca

SEQ ID NO: 2170066 - RNA, 18 nt, Streptococcus pneumoniae R6
ggcugcucaaaacacugu

SEQ ID NO: 2170067 - RNA, 17 nt, Streptococcus pneumoniae R6
ggcuggacguucuucaa

SEQ ID NO: 2170068 - RNA, 11 nt, Streptococcus pneumoniae R6
ggcuguaaugc

SEQ ID NO: 2170069 - RNA, 17 nt, Streptococcus pneumoniae R6
ggcuggggcgaccacua

SEQ ID NO: 2170070 - RNA, 15 nt, Streptococcus pneumoniae R6
ggcucauguaaauca

SEQ ID NO: 2170071 - RNA, 14 nt, Streptococcus pneumoniae R6
ggcguaguaaauca

SEQ ID NO: 2170072 - RNA, 21 nt, Streptococcus pneumoniae R6
ggcugauuuugaaaaugaauu

SEQ ID NO: 2170073 - RNA, 19 nt, Streptococcus pneumoniae R6
ggcugacaauaaagauaag

SEQ ID NO: 2170074 - RNA, 22 nt, Streptococcus pneumoniae R6
ggcugaaggaaugccaaagaca

SEQ ID NO: 2170075 - RNA, 18 nt, Streptococcus pneumoniae R6
gggauccucauauucuuu

SEQ ID NO: 2170076 - RNA, 13 nt, Streptococcus pneumoniae R6
gggagguaaagau

SEQ ID NO: 2170077 - RNA, 17 nt, Streptococcus pneumoniae R6
gggcaaaaaagaaacca

SEQ ID NO: 2170078 - RNA, 17 nt, Streptococcus pneumoniae R6
gggcagacgaguuaaaa

SEQ ID NO: 2170079 - RNA, 19 nt, Streptococcus pneumoniae R6
gggcacgacgggcuuggaa

SEQ ID NO: 2170080 - RNA, 16 nt, Streptococcus pneumoniae R6
gggcaccugucuugac

SEQ ID NO: 2170081 - RNA, 21 nt, Streptococcus pneumoniae R6
gggcaagggcaccaaacuuag

SEQ ID NO: 2170082 - RNA, 14 nt, Streptococcus pneumoniae R6
gggcaagcugucaa

SEQ ID NO: 2170083 - RNA, 22 nt, Streptococcus pneumoniae R6
gggaaaugaaagaaacucuaaa

SEQ ID NO: 2170084 - RNA, 15 nt, Streptococcus pneumoniae R6
gggaacacuuguaaa

SEQ ID NO: 2170085 - RNA, 13 nt, Streptococcus pneumoniae R6
ggcuuuucuauca

SEQ ID NO: 2170086 - RNA, 19 nt, Streptococcus pneumoniae R6
ggcuuuuuguuuucuauuu

SEQ ID NO: 2170087 - RNA, 12 nt, Streptococcus pneumoniae R6
ggcuuucuucac

SEQ ID NO: 2170088 - RNA, 14 nt, Streptococcus pneumoniae R6
ggcuuuauucuuaa

SEQ ID NO: 2170089 - RNA, 12 nt, Streptococcus pneumoniae R6
ggcuuguuuaaa

SEQ ID NO: 2170090 - RNA, 12 nt, Streptococcus pneumoniae R6
gggaaugaugac

SEQ ID NO: 2170091 - RNA, 15 nt, Streptococcus pneumoniae R6
gggacauaaaaaaau

SEQ ID NO: 2170092 - RNA, 16 nt, Streptococcus pneumoniae R6
gggagaaaugagagau

SEQ ID NO: 2170093 - RNA, 15 nt, Streptococcus pneumoniae R6
gggagcuaacucaag

SEQ ID NO: 2170094 - RNA, 13 nt, Streptococcus pneumoniae R6
gggagaaaaguca

SEQ ID NO: 2170095 - RNA, 15 nt, Streptococcus pneumoniae R6
gggagaaaagucacu

SEQ ID NO: 2170096 - RNA, 13 nt, Streptococcus pneumoniae R6
ggggucggcagaa

SEQ ID NO: 2170097 - RNA, 11 nt, Streptococcus pneumoniae R6
gggggcucuuu

SEQ ID NO: 2170098 - RNA, 18 nt, Streptococcus pneumoniae R6
gggguuuccaacgacuuc

SEQ ID NO: 2170099 - RNA, 15 nt, Streptococcus pneumoniae R6
ggguaucuuuaucaa

SEQ ID NO: 2170100 - RNA, 22 nt, Streptococcus pneumoniae R6
gggucaugccuuuuucaaucaa

SEQ ID NO: 2170101 - RNA, 16 nt, Streptococcus pneumoniae R6
gggggcaaaaaggggg

SEQ ID NO: 2170102 - RNA, 22 nt, Streptococcus pneumoniae R6
ggggcuauauaguuuaaucaaa

SEQ ID NO: 2170103 - RNA, 17 nt, Streptococcus pneumoniae R6
gggcuuuucuaucacuc

SEQ ID NO: 2170104 - RNA, 12 nt, Streptococcus pneumoniae R6
ggggauagagau

SEQ ID NO: 2170105 - RNA, 21 nt, Streptococcus pneumoniae R6
ggggacaagguguuuuaguua

SEQ ID NO: 2170106 - RNA, 13 nt, Streptococcus pneumoniae R6
gggccaaaucauc

SEQ ID NO: 2170107 - RNA, 20 nt, Streptococcus pneumoniae R6
gggcaugucguauaucugag

SEQ ID NO: 2170108 - RNA, 18 nt, Streptococcus pneumoniae R6
gggcaucaacagcuccau

SEQ ID NO: 2170109 - RNA, 14 nt, Streptococcus pneumoniae R6
gggcuaauucucug

SEQ ID NO: 2170110 - RNA, 16 nt, Streptococcus pneumoniae R6
gggcugagaaggcugg

SEQ ID NO: 2170111 - RNA, 15 nt, Streptococcus pneumoniae R6
gggcgguacccacaa

SEQ ID NO: 2170112 - RNA, 18 nt, Streptococcus pneumoniae R6
gggccuuagcagacuucu

SEQ ID NO: 2170113 - RNA, 21 nt, Streptococcus pneumoniae R6
ggguuuuaaagccgacccagg

SEQ ID NO: 2170114 - RNA, 14 nt, Streptococcus pneumoniae R6
gguaacaaaacuaa

SEQ ID NO: 2170115 - RNA, 11 nt, Streptococcus pneumoniae R6
gguaaaggaaa

SEQ ID NO: 2170116 - RNA, 20 nt, Streptococcus pneumoniae R6
gguaaccgaugacaaaaaua

SEQ ID NO: 2170117 - RNA, 17 nt, Streptococcus pneumoniae R6
gguaacggauuugggca

SEQ ID NO: 2170118 - RNA, 15 nt, Streptococcus pneumoniae R6
gguaauuaugaaauu

SEQ ID NO: 2170119 - RNA, 19 nt, Streptococcus pneumoniae R6
gggugucaaaucaaaauca

SEQ ID NO: 2170120 - RNA, 12 nt, Streptococcus pneumoniae R6
ggguucaucucu

SEQ ID NO: 2170121 - RNA, 22 nt, Streptococcus pneumoniae R6
ggguuaguugguuaucuuuaaa

SEQ ID NO: 2170122 - RNA, 12 nt, Streptococcus pneumoniae R6
ggguucuuugcc

SEQ ID NO: 2170123 - RNA, 13 nt, Streptococcus pneumoniae R6
gguagaaaggagc

SEQ ID NO: 2170124 - RNA, 20 nt, Streptococcus pneumoniae R6
gguacaguugggauuccaua

SEQ ID NO: 2170125 - RNA, 16 nt, Streptococcus pneumoniae R6
gguaccacggcagaca

SEQ ID NO: 2170126 - RNA, 17 nt, Streptococcus pneumoniae R6
gguaugaucuauuccua

SEQ ID NO: 2170127 - RNA, 15 nt, Streptococcus pneumoniae R6
gguaucugcuaaaac

SEQ ID NO: 2170128 - RNA, 16 nt, Streptococcus pneumoniae R6
gguauuuaagauaacg

SEQ ID NO: 2170129 - RNA, 20 nt, Streptococcus pneumoniae R6
gguauucuucgugaaagaca

SEQ ID NO: 2170130 - RNA, 21 nt, Streptococcus pneumoniae R6
gguauucauuaagucaacauc

SEQ ID NO: 2170131 - RNA, 16 nt, Streptococcus pneumoniae R6
gguauuuucauagagg

SEQ ID NO: 2170132 - RNA, 22 nt, Streptococcus pneumoniae R6
gguaggcauaaacaggcucggc

SEQ ID NO: 2170133 - RNA, 22 nt, Streptococcus pneumoniae R6
ggucaucagcagagaaagaaaa

SEQ ID NO: 2170134 - RNA, 11 nt, Streptococcus pneumoniae R6
ggucaucauca

SEQ ID NO: 2170135 - RNA, 14 nt, Streptococcus pneumoniae R6
ggucaguugcaaga

SEQ ID NO: 2170136 - RNA, 19 nt, Streptococcus pneumoniae R6
ggucaucaagcuuucacua

SEQ ID NO: 2170137 - RNA, 15 nt, Streptococcus pneumoniae R6
ggucaugcgaaacag

SEQ ID NO: 2170138 - RNA, 14 nt, Streptococcus pneumoniae R6
ggucauuuucuucg

SEQ ID NO: 2170139 - RNA, 19 nt, Streptococcus pneumoniae R6
gguccgaaccacaacaaaa

SEQ ID NO: 2170140 - RNA, 20 nt, Streptococcus pneumoniae R6
gguccgaaccacaacaaaaa

SEQ ID NO: 2170141 - RNA, 22 nt, Streptococcus pneumoniae R6
ggucaaucuugucuaaaaauag

SEQ ID NO: 2170142 - RNA, 14 nt, Streptococcus pneumoniae R6
ggucaauggcaaaa

SEQ ID NO: 2170143 - RNA, 17 nt, Streptococcus pneumoniae R6
ggucacauugaaaaugu

SEQ ID NO: 2170144 - RNA, 18 nt, Streptococcus pneumoniae R6
ggucacgacggugaacaa

SEQ ID NO: 2170145 - RNA, 14 nt, Streptococcus pneumoniae R6
ggucagauuguaaa

SEQ ID NO: 2170146 - RNA, 17 nt, Streptococcus pneumoniae R6
ggucguaucugguguga

SEQ ID NO: 2170147 - RNA, 13 nt, Streptococcus pneumoniae R6
ggucuagcaagag

SEQ ID NO: 2170148 - RNA, 19 nt, Streptococcus pneumoniae R6
ggucucccaggauaggaag

SEQ ID NO: 2170149 - RNA, 19 nt, Streptococcus pneumoniae R6
ggucucagucugaccacca

SEQ ID NO: 2170150 - RNA, 15 nt, Streptococcus pneumoniae R6
ggucuuuguucugaa

SEQ ID NO: 2170151 - RNA, 21 nt, Streptococcus pneumoniae R6
ggucuuuaaugucuaguaauu

SEQ ID NO: 2170152 - RNA, 18 nt, Streptococcus pneumoniae R6
ggaacucuagcuuuuuaa

SEQ ID NO: 2170153 - RNA, 17 nt, Streptococcus pneumoniae R6
ggaagcgaugauaagaa

SEQ ID NO: 2170154 - RNA, 13 nt, Streptococcus pneumoniae R6
ggaaguaccaagg

SEQ ID NO: 2170155 - RNA, 18 nt, Streptococcus pneumoniae R6
ggaaguaccaaggaagaa

SEQ ID NO: 2170156 - RNA, 18 nt, Streptococcus pneumoniae R6
ggaacaagucagcucaaa

SEQ ID NO: 2170157 - RNA, 20 nt, Streptococcus pneumoniae R6
ggaacaagucagcucaaagc

SEQ ID NO: 2170158 - RNA, 21 nt, Streptococcus pneumoniae R6
ggaacacguaaauuauacucu

SEQ ID NO: 2170159 - RNA, 21 nt, Streptococcus pneumoniae R6
ggaauaaugcccaugaaaaga

SEQ ID NO: 2170160 - RNA, 23 nt, Streptococcus pneumoniae R6
ggaauaaggcagcuuaagugcgu

SEQ ID NO: 2170161 - RNA, 18 nt, Streptococcus pneumoniae R6
ggaaguugagcggauauu

SEQ ID NO: 2170162 - RNA, 14 nt, Streptococcus pneumoniae R6
ggaagugaaaaagc

SEQ ID NO: 2170163 - RNA, 15 nt, Streptococcus pneumoniae R6
ggaagugaaacagca

SEQ ID NO: 2170164 - RNA, 18 nt, Streptococcus pneumoniae R6
ggaauuaauggcagugcu

SEQ ID NO: 2170165 - RNA, 12 nt, Streptococcus pneumoniae R6
ggaauuuuauuu

SEQ ID NO: 2170166 - RNA, 13 nt, Streptococcus pneumoniae R6
ggaauuuguaaag

SEQ ID NO: 2170167 - RNA, 21 nt, Streptococcus pneumoniae R6
ggacaaaacuguaaaguagca

SEQ ID NO: 2170168 - RNA, 19 nt, Streptococcus pneumoniae R6
ggacaaaacuuuuuaaaaa

SEQ ID NO: 2170169 - RNA, 16 nt, Streptococcus pneumoniae R6
ggacaccucuuucuuu

SEQ ID NO: 2170170 - RNA, 20 nt, Streptococcus pneumoniae R6
ggacaccgagaaaggcgaca

SEQ ID NO: 2170171 - RNA, 20 nt, Streptococcus pneumoniae R6
ggacagaaaugcccaauucu

SEQ ID NO: 2170172 - RNA, 19 nt, Streptococcus pneumoniae R6
aaaggcuuugcgcuugaua

SEQ ID NO: 2170173 - RNA, 20 nt, Streptococcus pneumoniae R6
aaaggcuugcguuuuugccu

SEQ ID NO: 2170174 - RNA, 14 nt, Streptococcus pneumoniae R6
aaaggcuuuuucuu

SEQ ID NO: 2170175 - RNA, 16 nt, Streptococcus pneumoniae R6
aaaggcuuuuucuucu

SEQ ID NO: 2170176 - RNA, 17 nt, Streptococcus pneumoniae R6
aaagggaaaucugaaaa

SEQ ID NO: 2170177 - RNA, 21 nt, Streptococcus pneumoniae R6
aaaggggcucuuugucaacug

SEQ ID NO: 2170178 - RNA, 22 nt, Streptococcus pneumoniae R6
aaaggggcucuuugucaacugu

SEQ ID NO: 2170179 - RNA, 20 nt, Streptococcus pneumoniae R6
aaagggggaacguuuuuaaa

SEQ ID NO: 2170180 - RNA, 13 nt, Streptococcus pneumoniae R6
ggacugguuucgu

SEQ ID NO: 2170181 - RNA, 20 nt, Streptococcus pneumoniae R6
aaagguucuuuuauccuguu

SEQ ID NO: 2170182 - RNA, 13 nt, Streptococcus pneumoniae R6
aaaguaaccaucu

SEQ ID NO: 2170183 - RNA, 13 nt, Streptococcus pneumoniae R6
aaaguaagagaaa

SEQ ID NO: 2170184 - RNA, 22 nt, Streptococcus pneumoniae R6
aaaggucaucagcagagaaaga

SEQ ID NO: 2170185 - RNA, 22 nt, Streptococcus pneumoniae R6
aaagguguucaauccaauugua

SEQ ID NO: 2170186 - RNA, 21 nt, Streptococcus pneumoniae R6
aaagguaauccaauugaggaa

SEQ ID NO: 2170187 - RNA, 18 nt, Streptococcus pneumoniae R6
aaaggguucuacaaaucc

SEQ ID NO: 2170188 - RNA, 20 nt, Streptococcus pneumoniae R6
aaaggucaaaauuccuaaaa

SEQ ID NO: 2170189 - RNA, 14 nt, Streptococcus pneumoniae R6
ggagcaagcuccua

SEQ ID NO: 2170190 - RNA, 16 nt, Streptococcus pneumoniae R6
ggagacggacuagaau

SEQ ID NO: 2170191 - RNA, 17 nt, Streptococcus pneumoniae R6
aaaguaagaaucugcau

SEQ ID NO: 2170192 - RNA, 18 nt, Streptococcus pneumoniae R6
aaaguaagaauguugcuu

SEQ ID NO: 2170193 - RNA, 14 nt, Streptococcus pneumoniae R6
ggagaaaaagaagu

SEQ ID NO: 2170194 - RNA, 21 nt, Streptococcus pneumoniae R6
ggauaauagcaaggaugaggg

SEQ ID NO: 2170195 - RNA, 20 nt, Streptococcus pneumoniae R6
ggauaccaccagacauaucu

SEQ ID NO: 2170196 - RNA, 15 nt, Streptococcus pneumoniae R6
ggauaauuucuuuaa

SEQ ID NO: 2170197 - RNA, 18 nt, Streptococcus pneumoniae R6
ggauaugaggagaaagaa

SEQ ID NO: 2170198 - RNA, 20 nt, Streptococcus pneumoniae R6
ggauauucaauucuuuaaca

SEQ ID NO: 2170199 - RNA, 13 nt, Streptococcus pneumoniae R6
ggauacuugcaaa

SEQ ID NO: 2170200 - RNA, 13 nt, Streptococcus pneumoniae R6
ggauaaaagagaa

SEQ ID NO: 2170201 - RNA, 15 nt, Streptococcus pneumoniae R6
ggauaaaagagaaua

SEQ ID NO: 2170202 - RNA, 15 nt, Streptococcus pneumoniae R6
ggauaaauuuuauug

SEQ ID NO: 2170203 - RNA, 18 nt, Streptococcus pneumoniae R6
ggaguuacuccgacagca

SEQ ID NO: 2170204 - RNA, 18 nt, Streptococcus pneumoniae R6
ggaguugagccugaaagu

SEQ ID NO: 2170205 - RNA, 22 nt, Streptococcus pneumoniae R6
ggaguugagccugaaagugaga

SEQ ID NO: 2170206 - RNA, 15 nt, Streptococcus pneumoniae R6
ggaugagugacgaga

SEQ ID NO: 2170207 - RNA, 19 nt, Streptococcus pneumoniae R6
ggaugauguuaucaaaucg

SEQ ID NO: 2170208 - RNA, 23 nt, Streptococcus pneumoniae R6
ggaugauuuaauuagaaaaaaau

SEQ ID NO: 2170209 - RNA, 15 nt, Streptococcus pneumoniae R6
ggaugaaacugacga

SEQ ID NO: 2170210 - RNA, 21 nt, Streptococcus pneumoniae R6
ggaucauugauauaaagagca

SEQ ID NO: 2170211 - RNA, 17 nt, Streptococcus pneumoniae R6
ggaucauuucuucugga

SEQ ID NO: 2170212 - RNA, 23 nt, Streptococcus pneumoniae R6
ggaucaugagccacaacuuuuaa

SEQ ID NO: 2170213 - RNA, 15 nt, Streptococcus pneumoniae R6
ggaucgguuagacca

SEQ ID NO: 2170214 - RNA, 14 nt, Streptococcus pneumoniae R6
ggauggcgugggca

SEQ ID NO: 2170215 - RNA, 19 nt, Streptococcus pneumoniae R6
aaaguaagaguugauagau

SEQ ID NO: 2170216 - RNA, 15 nt, Streptococcus pneumoniae R6
aaaguaauuugagua

SEQ ID NO: 2170217 - RNA, 22 nt, Streptococcus pneumoniae R6
aaaguaauuugaguaaaagaca

SEQ ID NO: 2170218 - RNA, 17 nt, Streptococcus pneumoniae R6
aaaguacagauuugaaa

SEQ ID NO: 2170219 - RNA, 21 nt, Streptococcus pneumoniae R6
aaaguacagauuugaaaacug

SEQ ID NO: 2170220 - RNA, 21 nt, Streptococcus pneumoniae R6
aaaguacugccuugagguuuu

SEQ ID NO: 2170221 - RNA, 14 nt, Streptococcus pneumoniae R6
aaaguacugcuuug

SEQ ID NO: 2170222 - RNA, 21 nt, Streptococcus pneumoniae R6
aaaguacugcuuugagguugu

SEQ ID NO: 2170223 - RNA, 18 nt, Streptococcus pneumoniae R6
ggaugcccguacuuacca

SEQ ID NO: 2170224 - RNA, 19 nt, Streptococcus pneumoniae R6
ggauuaccuuugaaaaaau

SEQ ID NO: 2170225 - RNA, 12 nt, Streptococcus pneumoniae R6
ggauuaauaauu

SEQ ID NO: 2170226 - RNA, 23 nt, Streptococcus pneumoniae R6
ggauuauuugccuaugaaaugag

SEQ ID NO: 2170227 - RNA, 23 nt, Streptococcus pneumoniae R6
ggauuucuaguuuugguuuuucu

SEQ ID NO: 2170228 - RNA, 14 nt, Streptococcus pneumoniae R6
ggauuuuuuggcua

SEQ ID NO: 2170229 - RNA, 12 nt, Streptococcus pneumoniae R6
ggauuuucuccc

SEQ ID NO: 2170230 - RNA, 17 nt, Streptococcus pneumoniae R6
ggauuuuuccaugcuuc

SEQ ID NO: 2170231 - RNA, 16 nt, Streptococcus pneumoniae R6
ggauuuuguucuuuuu

SEQ ID NO: 2170232 - RNA, 17 nt, Streptococcus pneumoniae R6
ggcaagagcuguuccac

SEQ ID NO: 2170233 - RNA, 20 nt, Streptococcus pneumoniae R6
aaagugauguaauuucugaa

SEQ ID NO: 2170234 - RNA, 15 nt, Streptococcus pneumoniae R6
aaagugaaaaaguaa

SEQ ID NO: 2170235 - RNA, 15 nt, Streptococcus pneumoniae R6
aaagugaaaggaaga

SEQ ID NO: 2170236 - RNA, 14 nt, Streptococcus pneumoniae R6
aaagucuugacaaa

SEQ ID NO: 2170237 - RNA, 19 nt, Streptococcus pneumoniae R6
aaagucuugacaaagaaaa

SEQ ID NO: 2170238 - RNA, 16 nt, Streptococcus pneumoniae R6
aaagucuuggaaaaug

SEQ ID NO: 2170239 - RNA, 15 nt, Streptococcus pneumoniae R6
aaagucuuauaauau

SEQ ID NO: 2170240 - RNA, 20 nt, Streptococcus pneumoniae R6
aaagucuucggagaagaaaa

SEQ ID NO: 2170241 - RNA, 16 nt, Streptococcus pneumoniae R6
aaagucugaaucaaaa

SEQ ID NO: 2170242 - RNA, 20 nt, Streptococcus pneumoniae R6
aaagucugaaucaaaaauga

SEQ ID NO: 2170243 - RNA, 17 nt, Streptococcus pneumoniae R6
aaagucugggaaaaauu

SEQ ID NO: 2170244 - RNA, 12 nt, Streptococcus pneumoniae R6
ggcagagaaucg

SEQ ID NO: 2170245 - RNA, 17 nt, Streptococcus pneumoniae R6
ggcagacagagaaaaug

SEQ ID NO: 2170246 - RNA, 14 nt, Streptococcus pneumoniae R6
ggcagacauaucca

SEQ ID NO: 2170247 - RNA, 22 nt, Streptococcus pneumoniae R6
ggcaagggcaccaaacuuagga

SEQ ID NO: 2170248 - RNA, 16 nt, Streptococcus pneumoniae R6
ggcagccucuuucuug

SEQ ID NO: 2170249 - RNA, 21 nt, Streptococcus pneumoniae R6
aaaguagagauaaguggcaaa

SEQ ID NO: 2170250 - RNA, 17 nt, Streptococcus pneumoniae R6
aaaguagaguccaaaga

SEQ ID NO: 2170251 - RNA, 19 nt, Streptococcus pneumoniae R6
aaaguagaguccaaagacc

SEQ ID NO: 2170252 - RNA, 20 nt, Streptococcus pneumoniae R6
aaaguagaguccaaagacca

SEQ ID NO: 2170253 - RNA, 21 nt, Streptococcus pneumoniae R6
aaaguauacucuaauugaaaa

SEQ ID NO: 2170254 - RNA, 21 nt, Streptococcus pneumoniae R6
aaaguagucauuuuguucucc

SEQ ID NO: 2170255 - RNA, 21 nt, Streptococcus pneumoniae R6
aaaguagugaaugauucugaa

SEQ ID NO: 2170256 - RNA, 22 nt, Streptococcus pneumoniae R6
aaaguaggucccaucauagccg

SEQ ID NO: 2170257 - RNA, 18 nt, Streptococcus pneumoniae R6
aaaguaggacgauaaaaa

SEQ ID NO: 2170258 - RNA, 20 nt, Streptococcus pneumoniae R6
aaaguaggacgauaaaaacg

SEQ ID NO: 2170259 - RNA, 13 nt, Streptococcus pneumoniae R6
aaaguagcaaaac

SEQ ID NO: 2170260 - RNA, 16 nt, Streptococcus pneumoniae R6
aaaguagcaaaacacu

SEQ ID NO: 2170261 - RNA, 18 nt, Streptococcus pneumoniae R6
aaaguagcaaaacacuac

SEQ ID NO: 2170262 - RNA, 15 nt, Streptococcus pneumoniae R6
aaaguauauuuagua

SEQ ID NO: 2170263 - RNA, 19 nt, Streptococcus pneumoniae R6
ggcaggaaggaaauagcug

SEQ ID NO: 2170264 - RNA, 18 nt, Streptococcus pneumoniae R6
ggcaggaaaggcauucca

SEQ ID NO: 2170265 - RNA, 11 nt, Streptococcus pneumoniae R6
ggcaggcuggu

SEQ ID NO: 2170266 - RNA, 13 nt, Streptococcus pneumoniae R6
aaagucaaacaau

SEQ ID NO: 2170267 - RNA, 15 nt, Streptococcus pneumoniae R6
aaagucaaacaaugu

SEQ ID NO: 2170268 - RNA, 13 nt, Streptococcus pneumoniae R6
aaagucaauuucu

SEQ ID NO: 2170269 - RNA, 23 nt, Streptococcus pneumoniae R6
aaagucaauuucucuacaaauaa

SEQ ID NO: 2170270 - RNA, 21 nt, Streptococcus pneumoniae R6
aaagucaggccugcacuaagg

SEQ ID NO: 2170271 - RNA, 16 nt, Streptococcus pneumoniae R6
aaaguccaaagaugag

SEQ ID NO: 2170272 - RNA, 16 nt, Streptococcus pneumoniae R6
aaagucauacuuucuc

SEQ ID NO: 2170273 - RNA, 19 nt, Streptococcus pneumoniae R6
aaaguccauauuagggcaa

SEQ ID NO: 2170274 - RNA, 18 nt, Streptococcus pneumoniae R6
aaaguauuauaauauaau

SEQ ID NO: 2170275 - RNA, 16 nt, Streptococcus pneumoniae R6
aaaguauuaaaauaag

SEQ ID NO: 2170276 - RNA, 14 nt, Streptococcus pneumoniae R6
ggcauauaaauaca

SEQ ID NO: 2170277 - RNA, 17 nt, Streptococcus pneumoniae R6
ggcaguaauuagacauc

SEQ ID NO: 2170278 - RNA, 19 nt, Streptococcus pneumoniae R6
ggcauugauaugguaaugu

SEQ ID NO: 2170279 - RNA, 17 nt, Streptococcus pneumoniae R6
ggccaauucuucuucug

SEQ ID NO: 2170280 - RNA, 23 nt, Streptococcus pneumoniae R6
ggccagaacucccuguuccaaag

SEQ ID NO: 2170281 - RNA, 14 nt, Streptococcus pneumoniae R6
aaaggaaccaaaug

SEQ ID NO: 2170282 - RNA, 23 nt, Streptococcus pneumoniae R6
gcuggucacgaccagaaaaucau

SEQ ID NO: 2170283 - RNA, 16 nt, Streptococcus pneumoniae R6
aaaggauaugaggaga

SEQ ID NO: 2170284 - RNA, 22 nt, Streptococcus pneumoniae R6
aaaggauaugaggagaaagaag

SEQ ID NO: 2170285 - RNA, 22 nt, Streptococcus pneumoniae R6
aaaggaaucugcguuauaugcu

SEQ ID NO: 2170286 - RNA, 21 nt, Streptococcus pneumoniae R6
aaaggacuaugaucagcauuu

SEQ ID NO: 2170287 - RNA, 22 nt, Streptococcus pneumoniae R6
aaaggacuuuaaagcggucuuu

SEQ ID NO: 2170288 - RNA, 15 nt, Streptococcus pneumoniae R6
aaaggagaaaaaaua

SEQ ID NO: 2170289 - RNA, 13 nt, Streptococcus pneumoniae R6
aaaggaguaacua

SEQ ID NO: 2170290 - RNA, 15 nt, Streptococcus pneumoniae R6
aaaggaguagaaaau

SEQ ID NO: 2170291 - RNA, 21 nt, Streptococcus pneumoniae R6
aaaggaguagaaaaugaaauu

SEQ ID NO: 2170292 - RNA, 23 nt, Streptococcus pneumoniae R6
aaaggaguagaaaaugaaauuuu

SEQ ID NO: 2170293 - RNA, 19 nt, Streptococcus pneumoniae R6
aaaggagaagauuucagaa

SEQ ID NO: 2170294 - RNA, 18 nt, Streptococcus pneumoniae R6
aaaggagaggagaauuuu

SEQ ID NO: 2170295 - RNA, 21 nt, Streptococcus pneumoniae R6
aaaggagauaguaucccauuc

SEQ ID NO: 2170296 - RNA, 14 nt, Streptococcus pneumoniae R6
gcugucagcaauuc

SEQ ID NO: 2170297 - RNA, 23 nt, Streptococcus pneumoniae R6
gcugucaagaaauuacaguuauu

SEQ ID NO: 2170298 - RNA, 12 nt, Streptococcus pneumoniae R6
gcuguuucuaua

SEQ ID NO: 2170299 - RNA, 15 nt, Streptococcus pneumoniae R6
gcuguuuauuuuuua

SEQ ID NO: 2170300 - RNA, 16 nt, Streptococcus pneumoniae R6
gcuguuuauuuuuuaa

SEQ ID NO: 2170301 - RNA, 14 nt, Streptococcus pneumoniae R6
gcuguuucaaauga

SEQ ID NO: 2170302 - RNA, 17 nt, Streptococcus pneumoniae R6
gcuuaaaauaauuuuuu

SEQ ID NO: 2170303 - RNA, 21 nt, Streptococcus pneumoniae R6
gcuguucuuuuuuguuucuug

SEQ ID NO: 2170304 - RNA, 20 nt, Streptococcus pneumoniae R6
gcuguuagaagacuuuuguu

SEQ ID NO: 2170305 - RNA, 14 nt, Streptococcus pneumoniae R6
gcuucaaaaaaguc

SEQ ID NO: 2170306 - RNA, 14 nt, Streptococcus pneumoniae R6
gcuucaaaucccau

SEQ ID NO: 2170307 - RNA, 12 nt, Streptococcus pneumoniae R6
gcuucacauugc

SEQ ID NO: 2170308 - RNA, 13 nt, Streptococcus pneumoniae R6
gcuuagcuuuucu

SEQ ID NO: 2170309 - RNA, 23 nt, Streptococcus pneumoniae R6
gcuuauaaucuggcgucuuaccu

SEQ ID NO: 2170310 - RNA, 13 nt, Streptococcus pneumoniae R6
gcuucaucuuuca

SEQ ID NO: 2170311 - RNA, 14 nt, Streptococcus pneumoniae R6
gcuucaucuuucau

SEQ ID NO: 2170312 - RNA, 14 nt, Streptococcus pneumoniae R6
gcuuccaauuuuug

SEQ ID NO: 2170313 - RNA, 15 nt, Streptococcus pneumoniae R6
gcuuccaaaaauucu

SEQ ID NO: 2170314 - RNA, 20 nt, Streptococcus pneumoniae R6
gcuuccaauaauagaaaaca

SEQ ID NO: 2170315 - RNA, 20 nt, Streptococcus pneumoniae R6
gcuucaucaacccccauacc

SEQ ID NO: 2170316 - RNA, 16 nt, Streptococcus pneumoniae R6
gcuucgggaacaugga

SEQ ID NO: 2170317 - RNA, 17 nt, Streptococcus pneumoniae R6
gcuucguagucgccauc

SEQ ID NO: 2170318 - RNA, 19 nt, Streptococcus pneumoniae R6
gcuucguaaucauaagcaa

SEQ ID NO: 2170319 - RNA, 16 nt, Streptococcus pneumoniae R6
gcuucuaagaucuggu

SEQ ID NO: 2170320 - RNA, 23 nt, Streptococcus pneumoniae R6
gcuucuaagaucugguuaaaauu

SEQ ID NO: 2170321 - RNA, 19 nt, Streptococcus pneumoniae R6
gcuucucggacuuuuucca

SEQ ID NO: 2170322 - RNA, 19 nt, Streptococcus pneumoniae R6
gcuucuugcauucguucuu

SEQ ID NO: 2170323 - RNA, 22 nt, Streptococcus pneumoniae R6
gcuucuuuuuuuacuaaaauaa

SEQ ID NO: 2170324 - RNA, 13 nt, Streptococcus pneumoniae R6
gcuugaaacaaau

SEQ ID NO: 2170325 - RNA, 14 nt, Streptococcus pneumoniae R6
gcuugaaacaaaua

SEQ ID NO: 2170326 - RNA, 20 nt, Streptococcus pneumoniae R6
gcuugaaacaaauaaaucau

SEQ ID NO: 2170327 - RNA, 19 nt, Streptococcus pneumoniae R6
gcuucuuuuggauuuucaa

SEQ ID NO: 2170328 - RNA, 19 nt, Streptococcus pneumoniae R6
gcuugaaugauaaaacaua

SEQ ID NO: 2170329 - RNA, 13 nt, Streptococcus pneumoniae R6
gcuugagcaaucc

SEQ ID NO: 2170330 - RNA, 18 nt, Streptococcus pneumoniae R6
gcuugaguggaaaaaccu

SEQ ID NO: 2170331 - RNA, 15 nt, Streptococcus pneumoniae R6
gcuugauagccuugu

SEQ ID NO: 2170332 - RNA, 15 nt, Streptococcus pneumoniae R6
gcuugauaaccuuaa

SEQ ID NO: 2170333 - RNA, 19 nt, Streptococcus pneumoniae R6
gcuugcguuuuugccucaa

SEQ ID NO: 2170334 - RNA, 19 nt, Streptococcus pneumoniae R6
gcuugcuagauauuguucu

SEQ ID NO: 2170335 - RNA, 13 nt, Streptococcus pneumoniae R6
gcuugcauuuuuu

SEQ ID NO: 2170336 - RNA, 14 nt, Streptococcus pneumoniae R6
gcuugcaauucuuu

SEQ ID NO: 2170337 - RNA, 21 nt, Streptococcus pneumoniae R6
gcuugcaauucuuuagcagau

SEQ ID NO: 2170338 - RNA, 17 nt, Streptococcus pneumoniae R6
gcuugcaauucuuuucc

SEQ ID NO: 2170339 - RNA, 19 nt, Streptococcus pneumoniae R6
gcuuggaaaucuucugugu

SEQ ID NO: 2170340 - RNA, 18 nt, Streptococcus pneumoniae R6
gcuuggauccauugcugg

SEQ ID NO: 2170341 - RNA, 16 nt, Streptococcus pneumoniae R6
gcuuggauuuaaaaac

SEQ ID NO: 2170342 - RNA, 14 nt, Streptococcus pneumoniae R6
gcuuggauuuucaa

SEQ ID NO: 2170343 - RNA, 20 nt, Streptococcus pneumoniae R6
aaaggcauugcguuugauaa

SEQ ID NO: 2170344 - RNA, 18 nt, Streptococcus pneumoniae R6
aaaggccaaguccagagg

SEQ ID NO: 2170345 - RNA, 16 nt, Streptococcus pneumoniae R6
aaaggauuucugcuuu

SEQ ID NO: 2170346 - RNA, 14 nt, Streptococcus pneumoniae R6
gcuugggaaaccaa

SEQ ID NO: 2170347 - RNA, 23 nt, Streptococcus pneumoniae R6
gcuuggcguuuugaguuaacuau

SEQ ID NO: 2170348 - RNA, 16 nt, Streptococcus pneumoniae R6
gcuugguucuucacua

SEQ ID NO: 2170349 - RNA, 21 nt, Streptococcus pneumoniae R6
aaaggcgauugaaacaugagg

SEQ ID NO: 2170350 - RNA, 20 nt, Streptococcus pneumoniae R6
aaaggccuuggccuuaucaa

SEQ ID NO: 2170351 - RNA, 15 nt, Streptococcus pneumoniae R6
gcuugucaucuucca

SEQ ID NO: 2170352 - RNA, 17 nt, Streptococcus pneumoniae R6
gcuugucaucuuccaag

SEQ ID NO: 2170353 - RNA, 22 nt, Streptococcus pneumoniae R6
gcuugucaucuuccaagaccug

SEQ ID NO: 2170354 - RNA, 19 nt, Streptococcus pneumoniae R6
gcuuuauugucucuaaaaa

SEQ ID NO: 2170355 - RNA, 18 nt, Streptococcus pneumoniae R6
gcuuuaucugcaaccuca

SEQ ID NO: 2170356 - RNA, 18 nt, Streptococcus pneumoniae R6
gcuuuaucaagcaaauca

SEQ ID NO: 2170357 - RNA, 19 nt, Streptococcus pneumoniae R6
gcuuucaauuguuuauaaa

SEQ ID NO: 2170358 - RNA, 20 nt, Streptococcus pneumoniae R6
gcuuucagcagcuucuucaa

SEQ ID NO: 2170359 - RNA, 23 nt, Streptococcus pneumoniae R6
gcuuuccauuaauucgauuucug

SEQ ID NO: 2170360 - RNA, 13 nt, Streptococcus pneumoniae R6
gcuuguuccaauu

SEQ ID NO: 2170361 - RNA, 16 nt, Streptococcus pneumoniae R6
gcuuguuuaaaccuug

SEQ ID NO: 2170362 - RNA, 18 nt, Streptococcus pneumoniae R6
gcuuuacuaguucucaaa

SEQ ID NO: 2170363 - RNA, 20 nt, Streptococcus pneumoniae R6
gcuuuagcaaucuuauccac

SEQ ID NO: 2170364 - RNA, 19 nt, Streptococcus pneumoniae R6
gcuuuaguaccagcucguu

SEQ ID NO: 2170365 - RNA, 14 nt, Streptococcus pneumoniae R6
gcucaucaucugaa

SEQ ID NO: 2170366 - RNA, 17 nt, Streptococcus pneumoniae R6
gcucaucugcaauaaca

SEQ ID NO: 2170367 - RNA, 18 nt, Streptococcus pneumoniae R6
gcucauccccucaaccug

SEQ ID NO: 2170368 - RNA, 14 nt, Streptococcus pneumoniae R6
gcuccuaaaucaac

SEQ ID NO: 2170369 - RNA, 15 nt, Streptococcus pneumoniae R6
gcuccuaaaucaacu

SEQ ID NO: 2170370 - RNA, 22 nt, Streptococcus pneumoniae R6
gcuccguuaggugcgagacaaa

SEQ ID NO: 2170371 - RNA, 17 nt, Streptococcus pneumoniae R6
gcuccguacgcuccuga

SEQ ID NO: 2170372 - RNA, 14 nt, Streptococcus pneumoniae R6
gcucccuucuuuag

SEQ ID NO: 2170373 - RNA, 15 nt, Streptococcus pneumoniae R6
gcuccauuuuuuaaa

SEQ ID NO: 2170374 - RNA, 16 nt, Streptococcus pneumoniae R6
gcuccauuuuuuaaaa

SEQ ID NO: 2170375 - RNA, 20 nt, Streptococcus pneumoniae R6
gcucgugauguuaaaaugag

SEQ ID NO: 2170376 - RNA, 12 nt, Streptococcus pneumoniae R6
gcucgcuggaga

SEQ ID NO: 2170377 - RNA, 24 nt, Streptococcus pneumoniae R6
gcuccugaauuagcaaucacucua

SEQ ID NO: 2170378 - RNA, 22 nt, Streptococcus pneumoniae R6
gcuggacaaaaacucaauuuca

SEQ ID NO: 2170379 - RNA, 13 nt, Streptococcus pneumoniae R6
gcugcucaaaaca

SEQ ID NO: 2170380 - RNA, 20 nt, Streptococcus pneumoniae R6
gcugccuaguuugaucuuug

SEQ ID NO: 2170381 - RNA, 19 nt, Streptococcus pneumoniae R6
gcugcaggcugcucaaaac

SEQ ID NO: 2170382 - RNA, 13 nt, Streptococcus pneumoniae R6
gcugcagcugagg

SEQ ID NO: 2170383 - RNA, 22 nt, Streptococcus pneumoniae R6
gcugcaauaaucuaacccuaag

SEQ ID NO: 2170384 - RNA, 15 nt, Streptococcus pneumoniae R6
gcugaacgacucacu

SEQ ID NO: 2170385 - RNA, 18 nt, Streptococcus pneumoniae R6
gcugaaggaaugccaaag

SEQ ID NO: 2170386 - RNA, 18 nt, Streptococcus pneumoniae R6
gcugaauauauucuccag

SEQ ID NO: 2170387 - RNA, 15 nt, Streptococcus pneumoniae R6
gcugacaaccacaua

SEQ ID NO: 2170388 - RNA, 17 nt, Streptococcus pneumoniae R6
gcugagacuaucugcua

SEQ ID NO: 2170389 - RNA, 19 nt, Streptococcus pneumoniae R6
uaaacugcgaagaaaucau

SEQ ID NO: 2170390 - RNA, 23 nt, Streptococcus pneumoniae R6
uaaacugcgaagaaaucauugga

SEQ ID NO: 2170391 - RNA, 18 nt, Streptococcus pneumoniae R6
uaaacucuugauuuucau

SEQ ID NO: 2170392 - RNA, 23 nt, Streptococcus pneumoniae R6
uaaacucuugauuuucauugacu

SEQ ID NO: 2170393 - RNA, 17 nt, Streptococcus pneumoniae R6
uaaagaauuugaaaaaa

SEQ ID NO: 2170394 - RNA, 18 nt, Streptococcus pneumoniae R6
uaaagaauuugaaaaaaa

SEQ ID NO: 2170395 - RNA, 19 nt, Streptococcus pneumoniae R6
uaaagaauuugaaaaaaau

SEQ ID NO: 2170396 - RNA, 13 nt, Streptococcus pneumoniae R6
uaaagaguuucau

SEQ ID NO: 2170397 - RNA, 12 nt, Streptococcus pneumoniae R6
uaaagacaaugu

SEQ ID NO: 2170398 - RNA, 20 nt, Streptococcus pneumoniae R6
uaaagacaauguucuuuucu

SEQ ID NO: 2170399 - RNA, 14 nt, Streptococcus pneumoniae R6
uaaagaccaaagaa

SEQ ID NO: 2170400 - RNA, 16 nt, Streptococcus pneumoniae R6
uaaagacagucugaaa

SEQ ID NO: 2170401 - RNA, 21 nt, Streptococcus pneumoniae R6
uaaacuauuaagccuucucca

SEQ ID NO: 2170402 - RNA, 23 nt, Streptococcus pneumoniae R6
uaaacuauuucuuauuucaauuu

SEQ ID NO: 2170403 - RNA, 17 nt, Streptococcus pneumoniae R6
uaaacuauccagagcau

SEQ ID NO: 2170404 - RNA, 17 nt, Streptococcus pneumoniae R6
uaaacuaguuuucuaaa

SEQ ID NO: 2170405 - RNA, 17 nt, Streptococcus pneumoniae R6
uaaacggacaaaacugu

SEQ ID NO: 2170406 - RNA, 13 nt, Streptococcus pneumoniae R6
uaaacacuucacu

SEQ ID NO: 2170407 - RNA, 20 nt, Streptococcus pneumoniae R6
uaaacacuucacuaauucac

SEQ ID NO: 2170408 - RNA, 22 nt, Streptococcus pneumoniae R6
uaaacacuucacuaauucaccu

SEQ ID NO: 2170409 - RNA, 13 nt, Streptococcus pneumoniae R6
uaaacaaggcaga

SEQ ID NO: 2170410 - RNA, 12 nt, Streptococcus pneumoniae R6
uaaacauuugau

SEQ ID NO: 2170411 - RNA, 15 nt, Streptococcus pneumoniae R6
uaaaccaauuuuaag

SEQ ID NO: 2170412 - RNA, 19 nt, Streptococcus pneumoniae R6
uaaaccaaaggaagcugag

SEQ ID NO: 2170413 - RNA, 15 nt, Streptococcus pneumoniae R6
guuuuucaaaccuuc

SEQ ID NO: 2170414 - RNA, 21 nt, Streptococcus pneumoniae R6
guuuuggguucgccauagaau

SEQ ID NO: 2170415 - RNA, 22 nt, Streptococcus pneumoniae R6
guuuuggcuaguaaauaucauu

SEQ ID NO: 2170416 - RNA, 19 nt, Streptococcus pneumoniae R6
guuuuggauaauauccaca

SEQ ID NO: 2170417 - RNA, 17 nt, Streptococcus pneumoniae R6
guuuuucccagccuuca

SEQ ID NO: 2170418 - RNA, 16 nt, Streptococcus pneumoniae R6
uaaacaaacuccucuc

SEQ ID NO: 2170419 - RNA, 21 nt, Streptococcus pneumoniae R6
uaaacaaaggaguuaaccucg

SEQ ID NO: 2170420 - RNA, 14 nt, Streptococcus pneumoniae R6
uaaacaaagucuga

SEQ ID NO: 2170421 - RNA, 16 nt, Streptococcus pneumoniae R6
uaaacaaagucugaaa

SEQ ID NO: 2170422 - RNA, 16 nt, Streptococcus pneumoniae R6
uaaacaaagagguuuu

SEQ ID NO: 2170423 - RNA, 20 nt, Streptococcus pneumoniae R6
uaaacaaaugacuuucuaau

SEQ ID NO: 2170424 - RNA, 17 nt, Streptococcus pneumoniae R6
uaaagcuagauuuaaaa

SEQ ID NO: 2170425 - RNA, 19 nt, Streptococcus pneumoniae R6
uaaaggaaaccuaaucaua

SEQ ID NO: 2170426 - RNA, 19 nt, Streptococcus pneumoniae R6
uaaagcuuuuuguuagauu

SEQ ID NO: 2170427 - RNA, 14 nt, Streptococcus pneumoniae R6
uaaagcugauuuuu

SEQ ID NO: 2170428 - RNA, 16 nt, Streptococcus pneumoniae R6
uaaagauauagccugu

SEQ ID NO: 2170429 - RNA, 20 nt, Streptococcus pneumoniae R6
uaaagaugaugguuaggaua

SEQ ID NO: 2170430 - RNA, 23 nt, Streptococcus pneumoniae R6
uaaagucuucggagaagaaaaca

SEQ ID NO: 2170431 - RNA, 20 nt, Streptococcus pneumoniae R6
uaaaguuaauugaauuucaa

SEQ ID NO: 2170432 - RNA, 23 nt, Streptococcus pneumoniae R6
uaaagugucucccuuuuuggauu

SEQ ID NO: 2170433 - RNA, 16 nt, Streptococcus pneumoniae R6
uaaaguuguacaagaa

SEQ ID NO: 2170434 - RNA, 17 nt, Streptococcus pneumoniae R6
uaaaguuaugaaaaaga

SEQ ID NO: 2170435 - RNA, 18 nt, Streptococcus pneumoniae R6
uaaaguuaugaaaaagau

SEQ ID NO: 2170436 - RNA, 15 nt, Streptococcus pneumoniae R6
uaaaguuacucuauu

SEQ ID NO: 2170437 - RNA, 17 nt, Streptococcus pneumoniae R6
uaaaguuacucuauugu

SEQ ID NO: 2170438 - RNA, 20 nt, Streptococcus pneumoniae R6
uaaaguugaaaugaccugca

SEQ ID NO: 2170439 - RNA, 15 nt, Streptococcus pneumoniae R6
uaaauauaguaaaau

SEQ ID NO: 2170440 - RNA, 20 nt, Streptococcus pneumoniae R6
uaaauaguuauagaguguua

SEQ ID NO: 2170441 - RNA, 15 nt, Streptococcus pneumoniae R6
uaaauaguucuucca

SEQ ID NO: 2170442 - RNA, 16 nt, Streptococcus pneumoniae R6
uaaauaguucuuccaa

SEQ ID NO: 2170443 - RNA, 16 nt, Streptococcus pneumoniae R6
uaaauaauauuauucu

SEQ ID NO: 2170444 - RNA, 17 nt, Streptococcus pneumoniae R6
uaaauaauauuauucua

SEQ ID NO: 2170445 - RNA, 13 nt, Streptococcus pneumoniae R6
uaaauaaaacaaa

SEQ ID NO: 2170446 - RNA, 14 nt, Streptococcus pneumoniae R6
uaaauaaaacaaaa

SEQ ID NO: 2170447 - RNA, 16 nt, Streptococcus pneumoniae R6
uaaauaaaacaaaaaa

SEQ ID NO: 2170448 - RNA, 21 nt, Streptococcus pneumoniae R6
uaaauaaggggauagagauag

SEQ ID NO: 2170449 - RNA, 17 nt, Streptococcus pneumoniae R6
uaaauaagguuuagcaa

SEQ ID NO: 2170450 - RNA, 18 nt, Streptococcus pneumoniae R6
uaaauaugaacaaaucaa

SEQ ID NO: 2170451 - RNA, 23 nt, Streptococcus pneumoniae R6
uaaauaugaacaaaucaauugcu

SEQ ID NO: 2170452 - RNA, 16 nt, Streptococcus pneumoniae R6
uaaaucauccauauaa

SEQ ID NO: 2170453 - RNA, 19 nt, Streptococcus pneumoniae R6
uaaaucauacgauugaaag

SEQ ID NO: 2170454 - RNA, 21 nt, Streptococcus pneumoniae R6
uaacacgagaaacaauaaaau

SEQ ID NO: 2170455 - RNA, 22 nt, Streptococcus pneumoniae R6
uaacacgagaaacaauaaaauc

SEQ ID NO: 2170456 - RNA, 16 nt, Streptococcus pneumoniae R6
uaacacuuuucaaaaa

SEQ ID NO: 2170457 - RNA, 14 nt, Streptococcus pneumoniae R6
uaacaucuuuugau

SEQ ID NO: 2170458 - RNA, 22 nt, Streptococcus pneumoniae R6
uaaccagaucuuagaagcaguu

SEQ ID NO: 2170459 - RNA, 14 nt, Streptococcus pneumoniae R6
uaacccuagaaaac

SEQ ID NO: 2170460 - RNA, 12 nt, Streptococcus pneumoniae R6
uaaccaucugua

SEQ ID NO: 2170461 - RNA, 21 nt, Streptococcus pneumoniae R6
uaacggcuuccugugcuacga

SEQ ID NO: 2170462 - RNA, 18 nt, Streptococcus pneumoniae R6
uaacggcuuucaguuuca

SEQ ID NO: 2170463 - RNA, 15 nt, Streptococcus pneumoniae R6
uaacaaaccaagaau

SEQ ID NO: 2170464 - RNA, 19 nt, Streptococcus pneumoniae R6
uaacaaaaauuugaucauc

SEQ ID NO: 2170465 - RNA, 12 nt, Streptococcus pneumoniae R6
uaacaaaauuau

SEQ ID NO: 2170466 - RNA, 16 nt, Streptococcus pneumoniae R6
uaacaaaauuauuaaa

SEQ ID NO: 2170467 - RNA, 18 nt, Streptococcus pneumoniae R6
uaaauuuuucugcaaaaa

SEQ ID NO: 2170468 - RNA, 17 nt, Streptococcus pneumoniae R6
uaaauuuuuuucucaau

SEQ ID NO: 2170469 - RNA, 15 nt, Streptococcus pneumoniae R6
uaacaauaaucuaug

SEQ ID NO: 2170470 - RNA, 12 nt, Streptococcus pneumoniae R6
uaacaccucuuc

SEQ ID NO: 2170471 - RNA, 17 nt, Streptococcus pneumoniae R6
uaacaccuuuauuauua

SEQ ID NO: 2170472 - RNA, 16 nt, Streptococcus pneumoniae R6
uaaaucgcuaagauau

SEQ ID NO: 2170473 - RNA, 14 nt, Streptococcus pneumoniae R6
uaaaucgaucauau

SEQ ID NO: 2170474 - RNA, 15 nt, Streptococcus pneumoniae R6
uaaaucgauuauauu

SEQ ID NO: 2170475 - RNA, 16 nt, Streptococcus pneumoniae R6
uaaaucgauuauauuu

SEQ ID NO: 2170476 - RNA, 18 nt, Streptococcus pneumoniae R6
uaaauccugcaaagauag

SEQ ID NO: 2170477 - RNA, 16 nt, Streptococcus pneumoniae R6
uaaauccgauauaucu

SEQ ID NO: 2170478 - RNA, 17 nt, Streptococcus pneumoniae R6
uaaaucccaaguaaauu

SEQ ID NO: 2170479 - RNA, 19 nt, Streptococcus pneumoniae R6
uaaauccaccuaauuauag

SEQ ID NO: 2170480 - RNA, 23 nt, Streptococcus pneumoniae R6
uaaauccacguuuacgaaucucu

SEQ ID NO: 2170481 - RNA, 23 nt, Streptococcus pneumoniae R6
uaaauccacauuuacgaaucucu

SEQ ID NO: 2170482 - RNA, 13 nt, Streptococcus pneumoniae R6
uaaauuauuucuu

SEQ ID NO: 2170483 - RNA, 15 nt, Streptococcus pneumoniae R6
uaaauuauuaaaauc

SEQ ID NO: 2170484 - RNA, 17 nt, Streptococcus pneumoniae R6
uaaauuauuaaaauccc

SEQ ID NO: 2170485 - RNA, 20 nt, Streptococcus pneumoniae R6
uaaauguuuucucauagcca

SEQ ID NO: 2170486 - RNA, 20 nt, Streptococcus pneumoniae R6
uaaauuccaaauuagaaaaa

SEQ ID NO: 2170487 - RNA, 22 nt, Streptococcus pneumoniae R6
uaaauuccaaauuagaaaaaga

SEQ ID NO: 2170488 - RNA, 23 nt, Streptococcus pneumoniae R6
uaaauuccaaauuagaaaaagac

SEQ ID NO: 2170489 - RNA, 14 nt, Streptococcus pneumoniae R6
uaaauucauuuacu

SEQ ID NO: 2170490 - RNA, 20 nt, Streptococcus pneumoniae R6
uaauaaaaagagaagaaaua

SEQ ID NO: 2170491 - RNA, 23 nt, Streptococcus pneumoniae R6
uaaguuuuuugauuucuucugga

SEQ ID NO: 2170492 - RNA, 16 nt, Streptococcus pneumoniae R6
uaauaaaaugaaauaa

SEQ ID NO: 2170493 - RNA, 20 nt, Streptococcus pneumoniae R6
uaaguuccuguuguaauuuu

SEQ ID NO: 2170494 - RNA, 22 nt, Streptococcus pneumoniae R6
uaaguucaacaaaucagaaaag

SEQ ID NO: 2170495 - RNA, 14 nt, Streptococcus pneumoniae R6
uaaguuucuucuuu

SEQ ID NO: 2170496 - RNA, 13 nt, Streptococcus pneumoniae R6
uaagugauuuaaa

SEQ ID NO: 2170497 - RNA, 16 nt, Streptococcus pneumoniae R6
uaagugauuuaaaugu

SEQ ID NO: 2170498 - RNA, 21 nt, Streptococcus pneumoniae R6
uaagugaccuugaugaucuaa

SEQ ID NO: 2170499 - RNA, 19 nt, Streptococcus pneumoniae R6
uaaguguuaugaauaacuu

SEQ ID NO: 2170500 - RNA, 21 nt, Streptococcus pneumoniae R6
uaaguguugaccgacuauuuu

SEQ ID NO: 2170501 - RNA, 15 nt, Streptococcus pneumoniae R6
uaaguagaaaguuaa

SEQ ID NO: 2170502 - RNA, 16 nt, Streptococcus pneumoniae R6
uaaguauccaucacag

SEQ ID NO: 2170503 - RNA, 18 nt, Streptococcus pneumoniae R6
uaaguccuuuuaguuuua

SEQ ID NO: 2170504 - RNA, 18 nt, Streptococcus pneumoniae R6
uaagucugcuuuauagug

SEQ ID NO: 2170505 - RNA, 20 nt, Streptococcus pneumoniae R6
uaagucuuugauuuugagac

SEQ ID NO: 2170506 - RNA, 14 nt, Streptococcus pneumoniae R6
uaaguccgaaaaau

SEQ ID NO: 2170507 - RNA, 21 nt, Streptococcus pneumoniae R6
uaaguccgaaaaauuucucug

SEQ ID NO: 2170508 - RNA, 14 nt, Streptococcus pneumoniae R6
uaagucauuuucuu

SEQ ID NO: 2170509 - RNA, 20 nt, Streptococcus pneumoniae R6
uaagucaaauaagaaagacc

SEQ ID NO: 2170510 - RNA, 21 nt, Streptococcus pneumoniae R6
uaagucaaauaagaaagacca

SEQ ID NO: 2170511 - RNA, 17 nt, Streptococcus pneumoniae R6
uaagucaagucuucuug

SEQ ID NO: 2170512 - RNA, 15 nt, Streptococcus pneumoniae R6
uaagucauaacauuc

SEQ ID NO: 2170513 - RNA, 16 nt, Streptococcus pneumoniae R6
uaagucauaacauucu

SEQ ID NO: 2170514 - RNA, 19 nt, Streptococcus pneumoniae R6
uaaguaaguacaugcaaag

SEQ ID NO: 2170515 - RNA, 22 nt, Streptococcus pneumoniae R6
uaaguaaucucugauaauauuu

SEQ ID NO: 2170516 - RNA, 19 nt, Streptococcus pneumoniae R6
uaagguuucaaaacgagga

SEQ ID NO: 2170517 - RNA, 14 nt, Streptococcus pneumoniae R6
uaagguucauuaga

SEQ ID NO: 2170518 - RNA, 17 nt, Streptococcus pneumoniae R6
uaagguuagcugcacca

SEQ ID NO: 2170519 - RNA, 16 nt, Streptococcus pneumoniae R6
uaagguauauucaaaa

SEQ ID NO: 2170520 - RNA, 15 nt, Streptococcus pneumoniae R6
uaagccuuuuugaau

SEQ ID NO: 2170521 - RNA, 16 nt, Streptococcus pneumoniae R6
uaagccuauucccuga

SEQ ID NO: 2170522 - RNA, 14 nt, Streptococcus pneumoniae R6
uaagccucuuuauc

SEQ ID NO: 2170523 - RNA, 14 nt, Streptococcus pneumoniae R6
uaagccucuuucau

SEQ ID NO: 2170524 - RNA, 15 nt, Streptococcus pneumoniae R6
uaagccggcuugucu

SEQ ID NO: 2170525 - RNA, 17 nt, Streptococcus pneumoniae R6
uaagccggcuugucuuu

SEQ ID NO: 2170526 - RNA, 15 nt, Streptococcus pneumoniae R6
uaagcccaaagauaa

SEQ ID NO: 2170527 - RNA, 16 nt, Streptococcus pneumoniae R6
uaagcccaaaucauca

SEQ ID NO: 2170528 - RNA, 16 nt, Streptococcus pneumoniae R6
uaagcaauuuuuuaua

SEQ ID NO: 2170529 - RNA, 23 nt, Streptococcus pneumoniae R6
uaagcaauuuuuuauagacauug

SEQ ID NO: 2170530 - RNA, 19 nt, Streptococcus pneumoniae R6
uaagcaacuuuacgaaauu

SEQ ID NO: 2170531 - RNA, 12 nt, Streptococcus pneumoniae R6
uaagauuuuugg

SEQ ID NO: 2170532 - RNA, 23 nt, Streptococcus pneumoniae R6
uaagauuuaaaaucguagucuuu

SEQ ID NO: 2170533 - RNA, 13 nt, Streptococcus pneumoniae R6
uaagauuuguuuu

SEQ ID NO: 2170534 - RNA, 17 nt, Streptococcus pneumoniae R6
uaagauuuguuuuucaa

SEQ ID NO: 2170535 - RNA, 18 nt, Streptococcus pneumoniae R6
uaagauuuguuuuucaaa

SEQ ID NO: 2170536 - RNA, 19 nt, Streptococcus pneumoniae R6
uaagcaccuaguacaaaga

SEQ ID NO: 2170537 - RNA, 20 nt, Streptococcus pneumoniae R6
uaagcaccuaguacaaagaa

SEQ ID NO: 2170538 - RNA, 15 nt, Streptococcus pneumoniae R6
uaaggauagaucccc

SEQ ID NO: 2170539 - RNA, 13 nt, Streptococcus pneumoniae R6
uaaggagcgaauu

SEQ ID NO: 2170540 - RNA, 19 nt, Streptococcus pneumoniae R6
uaaggaggcaaagaaaaaa

SEQ ID NO: 2170541 - RNA, 14 nt, Streptococcus pneumoniae R6
uaaggacuuugcuu

SEQ ID NO: 2170542 - RNA, 14 nt, Streptococcus pneumoniae R6
uaaggaaaacauua

SEQ ID NO: 2170543 - RNA, 18 nt, Streptococcus pneumoniae R6
uaaggcaucuuaacauuc

SEQ ID NO: 2170544 - RNA, 22 nt, Streptococcus pneumoniae R6
uaaggcaucuuaacauucuccc

SEQ ID NO: 2170545 - RNA, 22 nt, Streptococcus pneumoniae R6
uaaggcauucucgugaaauuuu

SEQ ID NO: 2170546 - RNA, 22 nt, Streptococcus pneumoniae R6
uaaggcagugacuaccaaucgu

SEQ ID NO: 2170547 - RNA, 21 nt, Streptococcus pneumoniae R6
uaagcugaucaauauucuccg

SEQ ID NO: 2170548 - RNA, 22 nt, Streptococcus pneumoniae R6
uaagcucgauaaaggacaaaau

SEQ ID NO: 2170549 - RNA, 15 nt, Streptococcus pneumoniae R6
uaagcucuuaaaagc

SEQ ID NO: 2170550 - RNA, 16 nt, Streptococcus pneumoniae R6
uaagcuugugaaagcu

SEQ ID NO: 2170551 - RNA, 18 nt, Streptococcus pneumoniae R6
uaagaacuccuuaaauuu

SEQ ID NO: 2170552 - RNA, 19 nt, Streptococcus pneumoniae R6
uaagaacaggacaaaucga

SEQ ID NO: 2170553 - RNA, 19 nt, Streptococcus pneumoniae R6
uaagaaaggauauaaaucu

SEQ ID NO: 2170554 - RNA, 16 nt, Streptococcus pneumoniae R6
uaagaaauaaaauaau

SEQ ID NO: 2170555 - RNA, 12 nt, Streptococcus pneumoniae R6
uaagaaaucaua

SEQ ID NO: 2170556 - RNA, 20 nt, Streptococcus pneumoniae R6
uaagaaagcaacuaaaauca

SEQ ID NO: 2170557 - RNA, 21 nt, Streptococcus pneumoniae R6
uaagaaagcaacuaaaaucau

SEQ ID NO: 2170558 - RNA, 13 nt, Streptococcus pneumoniae R6
uaagaaagcagcu

SEQ ID NO: 2170559 - RNA, 19 nt, Streptococcus pneumoniae R6
uaagaaagcagcuuaucuc

SEQ ID NO: 2170560 - RNA, 21 nt, Streptococcus pneumoniae R6
uaagaaagaccauagcaaagg

SEQ ID NO: 2170561 - RNA, 18 nt, Streptococcus pneumoniae R6
uaagaaucccucuuuuua

SEQ ID NO: 2170562 - RNA, 19 nt, Streptococcus pneumoniae R6
uaagaaucccucuuuuuac

SEQ ID NO: 2170563 - RNA, 13 nt, Streptococcus pneumoniae R6
uaagaaucugcau

SEQ ID NO: 2170564 - RNA, 15 nt, Streptococcus pneumoniae R6
uaagaaucuuuucua

SEQ ID NO: 2170565 - RNA, 15 nt, Streptococcus pneumoniae R6
uaagaaguagaggug

SEQ ID NO: 2170566 - RNA, 18 nt, Streptococcus pneumoniae R6
uaagaauagcgauuuaau

SEQ ID NO: 2170567 - RNA, 21 nt, Streptococcus pneumoniae R6
uaagaauagcgauuuaaucau

SEQ ID NO: 2170568 - RNA, 17 nt, Streptococcus pneumoniae R6
uaagaauaucaagauaa

SEQ ID NO: 2170569 - RNA, 14 nt, Streptococcus pneumoniae R6
uaacuuuaccaaaa

SEQ ID NO: 2170570 - RNA, 19 nt, Streptococcus pneumoniae R6
uaacuuuaccaaaaccuuc

SEQ ID NO: 2170571 - RNA, 22 nt, Streptococcus pneumoniae R6
uaacuuuaccaaaaccuucuuu

SEQ ID NO: 2170572 - RNA, 18 nt, Streptococcus pneumoniae R6
uaacuucugucuauuugc

SEQ ID NO: 2170573 - RNA, 19 nt, Streptococcus pneumoniae R6
uaacuucugucuauuugcu

SEQ ID NO: 2170574 - RNA, 18 nt, Streptococcus pneumoniae R6
uaacuugccugcuuuuuc

SEQ ID NO: 2170575 - RNA, 14 nt, Streptococcus pneumoniae R6
uaacuuuguauaau

SEQ ID NO: 2170576 - RNA, 16 nt, Streptococcus pneumoniae R6
uaacuuuuccuuaaca

SEQ ID NO: 2170577 - RNA, 17 nt, Streptococcus pneumoniae R6
uaagaguaguauuuacu

SEQ ID NO: 2170578 - RNA, 16 nt, Streptococcus pneumoniae R6
uaagaguauaaaaccu

SEQ ID NO: 2170579 - RNA, 12 nt, Streptococcus pneumoniae R6
uaagaguugaaa

SEQ ID NO: 2170580 - RNA, 19 nt, Streptococcus pneumoniae R6
uaagauaaaacuaaaagga

SEQ ID NO: 2170581 - RNA, 22 nt, Streptococcus pneumoniae R6
uaagauaaaacuaaaaggacuu

SEQ ID NO: 2170582 - RNA, 14 nt, Streptococcus pneumoniae R6
uaagagcuucuuuu

SEQ ID NO: 2170583 - RNA, 17 nt, Streptococcus pneumoniae R6
uaagagaguuacggguu

SEQ ID NO: 2170584 - RNA, 15 nt, Streptococcus pneumoniae R6
uaagaggauuuuaaa

SEQ ID NO: 2170585 - RNA, 15 nt, Streptococcus pneumoniae R6
uaagagguuuuacua

SEQ ID NO: 2170586 - RNA, 18 nt, Streptococcus pneumoniae R6
uaagagaaauuucugaaa

SEQ ID NO: 2170587 - RNA, 11 nt, Streptococcus pneumoniae R6
uaagagacuuc

SEQ ID NO: 2170588 - RNA, 15 nt, Streptococcus pneumoniae R6
uaagacagaugacaa

SEQ ID NO: 2170589 - RNA, 19 nt, Streptococcus pneumoniae R6
uaagacagaugacaaaucu

SEQ ID NO: 2170590 - RNA, 21 nt, Streptococcus pneumoniae R6
uaagacagaugacaaaucuaa

SEQ ID NO: 2170591 - RNA, 17 nt, Streptococcus pneumoniae R6
uaagacugacgaaguca

SEQ ID NO: 2170592 - RNA, 19 nt, Streptococcus pneumoniae R6
uaagacugacgaagucagc

SEQ ID NO: 2170593 - RNA, 22 nt, Streptococcus pneumoniae R6
uaagacuuuuccuguuguauuu

SEQ ID NO: 2170594 - RNA, 16 nt, Streptococcus pneumoniae R6
uaagauaaggcaucuu

SEQ ID NO: 2170595 - RNA, 22 nt, Streptococcus pneumoniae R6
uaagauaaggcaucuuaacauu

SEQ ID NO: 2170596 - RNA, 18 nt, Streptococcus pneumoniae R6
uaagauaaguuccaucug

SEQ ID NO: 2170597 - RNA, 16 nt, Streptococcus pneumoniae R6
uaagauaauaaauagu

SEQ ID NO: 2170598 - RNA, 19 nt, Streptococcus pneumoniae R6
uaagauagucgauaaaaag

SEQ ID NO: 2170599 - RNA, 20 nt, Streptococcus pneumoniae R6
uaagauagagagauuugaag

SEQ ID NO: 2170600 - RNA, 15 nt, Streptococcus pneumoniae R6
uaagauauuaagaau

SEQ ID NO: 2170601 - RNA, 20 nt, Streptococcus pneumoniae R6
uaagauauuauuucaaagaa

SEQ ID NO: 2170602 - RNA, 15 nt, Streptococcus pneumoniae R6
uaagauauacuaaaa

SEQ ID NO: 2170603 - RNA, 20 nt, Streptococcus pneumoniae R6
uaagauaugaacaaaucgau

SEQ ID NO: 2170604 - RNA, 21 nt, Streptococcus pneumoniae R6
uaagauaugaacaaaucgauu

SEQ ID NO: 2170605 - RNA, 20 nt, Streptococcus pneumoniae R6
uaagaugugaacaacucuau

SEQ ID NO: 2170606 - RNA, 15 nt, Streptococcus pneumoniae R6
uaagauguucaaucu

SEQ ID NO: 2170607 - RNA, 23 nt, Streptococcus pneumoniae R6
uaagauucuucugguuuggcaaa

SEQ ID NO: 2170608 - RNA, 21 nt, Streptococcus pneumoniae R6
uaagauuacugucauaucaua

SEQ ID NO: 2170609 - RNA, 12 nt, Streptococcus pneumoniae R6
uaagauuagaau

SEQ ID NO: 2170610 - RNA, 14 nt, Streptococcus pneumoniae R6
uaagauuaauuuca

SEQ ID NO: 2170611 - RNA, 15 nt, Streptococcus pneumoniae R6
uaagauuaauuucag

SEQ ID NO: 2170612 - RNA, 23 nt, Streptococcus pneumoniae R6
uaagauuacgacguuuuaggaca

SEQ ID NO: 2170613 - RNA, 19 nt, Streptococcus pneumoniae R6
uaagaucugguuaaaauug

SEQ ID NO: 2170614 - RNA, 16 nt, Streptococcus pneumoniae R6
uaacucuuuuuugguc

SEQ ID NO: 2170615 - RNA, 22 nt, Streptococcus pneumoniae R6
aaauccauaauuaccaccaaca

SEQ ID NO: 2170616 - RNA, 14 nt, Streptococcus pneumoniae R6
aaaucccuagcuca

SEQ ID NO: 2170617 - RNA, 20 nt, Streptococcus pneumoniae R6
aaauccgcuugggaaaccaa

SEQ ID NO: 2170618 - RNA, 21 nt, Streptococcus pneumoniae R6
aaauccgcuugggaaaccaaa

SEQ ID NO: 2170619 - RNA, 23 nt, Streptococcus pneumoniae R6
aaaucccuuguuuaguaaacaaa

SEQ ID NO: 2170620 - RNA, 21 nt, Streptococcus pneumoniae R6
aaauccgaagaaggccaaaua

SEQ ID NO: 2170621 - RNA, 15 nt, Streptococcus pneumoniae R6
uaacuucaauagacu

SEQ ID NO: 2170622 - RNA, 19 nt, Streptococcus pneumoniae R6
uaacuucacuaguauucau

SEQ ID NO: 2170623 - RNA, 22 nt, Streptococcus pneumoniae R6
uaacuucagauuaguaauucaa

SEQ ID NO: 2170624 - RNA, 16 nt, Streptococcus pneumoniae R6
uaacuucauuauagac

SEQ ID NO: 2170625 - RNA, 22 nt, Streptococcus pneumoniae R6
uaacugcuuugagaucuuuuuc

SEQ ID NO: 2170626 - RNA, 13 nt, Streptococcus pneumoniae R6
uaacuggaaagau

SEQ ID NO: 2170627 - RNA, 20 nt, Streptococcus pneumoniae R6
uaacuggaaagauaacugcu

SEQ ID NO: 2170628 - RNA, 13 nt, Streptococcus pneumoniae R6
uaacugcuucacu

SEQ ID NO: 2170629 - RNA, 15 nt, Streptococcus pneumoniae R6
uaacugcuucacuag

SEQ ID NO: 2170630 - RNA, 17 nt, Streptococcus pneumoniae R6
uaacugcuucacuaguc

SEQ ID NO: 2170631 - RNA, 15 nt, Streptococcus pneumoniae R6
uaacucuaagcuacc

SEQ ID NO: 2170632 - RNA, 23 nt, Streptococcus pneumoniae R6
uaacuaggcuagcaaauuuaaua

SEQ ID NO: 2170633 - RNA, 15 nt, Streptococcus pneumoniae R6
uaacucauaauaguc

SEQ ID NO: 2170634 - RNA, 23 nt, Streptococcus pneumoniae R6
uaacucaucaaaggucucuucuu

SEQ ID NO: 2170635 - RNA, 11 nt, Streptococcus pneumoniae R6
uaauagaaaac

SEQ ID NO: 2170636 - RNA, 17 nt, Streptococcus pneumoniae R6
uaauagaaaacagacaa

SEQ ID NO: 2170637 - RNA, 19 nt, Streptococcus pneumoniae R6
uaauagaaaacagacaaaa

SEQ ID NO: 2170638 - RNA, 22 nt, Streptococcus pneumoniae R6
uaauacuugaacuauuguagau

SEQ ID NO: 2170639 - RNA, 16 nt, Streptococcus pneumoniae R6
uaauagacuuccugca

SEQ ID NO: 2170640 - RNA, 19 nt, Streptococcus pneumoniae R6
uaauagagcugaggaaauu

SEQ ID NO: 2170641 - RNA, 14 nt, Streptococcus pneumoniae R6
uaauagcacuuaaa

SEQ ID NO: 2170642 - RNA, 16 nt, Streptococcus pneumoniae R6
uaauagcacuuaaaaa

SEQ ID NO: 2170643 - RNA, 21 nt, Streptococcus pneumoniae R6
uaauagauauaauuguaaaca

SEQ ID NO: 2170644 - RNA, 16 nt, Streptococcus pneumoniae R6
uaauacgaccaaucuu

SEQ ID NO: 2170645 - RNA, 21 nt, Streptococcus pneumoniae R6
uaauacgaccaaucuuuucca

SEQ ID NO: 2170646 - RNA, 18 nt, Streptococcus pneumoniae R6
uaauacucaaugaaaauc

SEQ ID NO: 2170647 - RNA, 13 nt, Streptococcus pneumoniae R6
uaauauaauaucu

SEQ ID NO: 2170648 - RNA, 18 nt, Streptococcus pneumoniae R6
uaauauaacuaguuaaua

SEQ ID NO: 2170649 - RNA, 17 nt, Streptococcus pneumoniae R6
uaauagguacaaaaaua

SEQ ID NO: 2170650 - RNA, 21 nt, Streptococcus pneumoniae R6
uaauaauugacgaagaaacca

SEQ ID NO: 2170651 - RNA, 13 nt, Streptococcus pneumoniae R6
uaauacaaaaaau

SEQ ID NO: 2170652 - RNA, 13 nt, Streptococcus pneumoniae R6
uaauaauuuuuca

SEQ ID NO: 2170653 - RNA, 20 nt, Streptococcus pneumoniae R6
uaauaauuuuucauuuaaua

SEQ ID NO: 2170654 - RNA, 18 nt, Streptococcus pneumoniae R6
uaauacaugcaaguagaa

SEQ ID NO: 2170655 - RNA, 19 nt, Streptococcus pneumoniae R6
uaauacauuuuguaaaaaa

SEQ ID NO: 2170656 - RNA, 19 nt, Streptococcus pneumoniae R6
uaauacacuucuacuauac

SEQ ID NO: 2170657 - RNA, 13 nt, Streptococcus pneumoniae R6
uaauaauacaaaa

SEQ ID NO: 2170658 - RNA, 15 nt, Streptococcus pneumoniae R6
uaauaaucaauauag

SEQ ID NO: 2170659 - RNA, 18 nt, Streptococcus pneumoniae R6
uaauaaucaauauagucu

SEQ ID NO: 2170660 - RNA, 22 nt, Streptococcus pneumoniae R6
uaauaacucgaucaacaaacau

SEQ ID NO: 2170661 - RNA, 23 nt, Streptococcus pneumoniae R6
uaauaacucucaucuaucuauuu

SEQ ID NO: 2170662 - RNA, 18 nt, Streptococcus pneumoniae R6
uaaucauagugagauugu

SEQ ID NO: 2170663 - RNA, 21 nt, Streptococcus pneumoniae R6
uaaucagaauggguuaaaauu

SEQ ID NO: 2170664 - RNA, 14 nt, Streptococcus pneumoniae R6
uaaucacugcagca

SEQ ID NO: 2170665 - RNA, 23 nt, Streptococcus pneumoniae R6
uaaucaccuaguccaagacguuc

SEQ ID NO: 2170666 - RNA, 19 nt, Streptococcus pneumoniae R6
uaaucccaaucauggcugg

SEQ ID NO: 2170667 - RNA, 20 nt, Streptococcus pneumoniae R6
uaauccauggaauaccaaua

SEQ ID NO: 2170668 - RNA, 14 nt, Streptococcus pneumoniae R6
uaauccaggaauca

SEQ ID NO: 2170669 - RNA, 15 nt, Streptococcus pneumoniae R6
uaauccacucagaca

SEQ ID NO: 2170670 - RNA, 15 nt, Streptococcus pneumoniae R6
uaaucauuuaauaau

SEQ ID NO: 2170671 - RNA, 18 nt, Streptococcus pneumoniae R6
uaaucauuuaauaaugaa

SEQ ID NO: 2170672 - RNA, 20 nt, Streptococcus pneumoniae R6
uaaucauuuaauaaugaaga

SEQ ID NO: 2170673 - RNA, 18 nt, Streptococcus pneumoniae R6
uaauccacuauaauaaaa

SEQ ID NO: 2170674 - RNA, 13 nt, Streptococcus pneumoniae R6
uaaucaucuggau

SEQ ID NO: 2170675 - RNA, 13 nt, Streptococcus pneumoniae R6
uaaucauuaucca

SEQ ID NO: 2170676 - RNA, 13 nt, Streptococcus pneumoniae R6
uaaucauucccug

SEQ ID NO: 2170677 - RNA, 14 nt, Streptococcus pneumoniae R6
uaaucauguuuuua

SEQ ID NO: 2170678 - RNA, 17 nt, Streptococcus pneumoniae R6
uaaucauuaaaauaacu

SEQ ID NO: 2170679 - RNA, 19 nt, Streptococcus pneumoniae R6
uaaucauuaaaauaacuca

SEQ ID NO: 2170680 - RNA, 12 nt, Streptococcus pneumoniae R6
uaauauuuucuu

SEQ ID NO: 2170681 - RNA, 13 nt, Streptococcus pneumoniae R6
uaaucaaaaggac

SEQ ID NO: 2170682 - RNA, 20 nt, Streptococcus pneumoniae R6
uaaucaaaauauguuuucuu

SEQ ID NO: 2170683 - RNA, 12 nt, Streptococcus pneumoniae R6
uaaucaaauuau

SEQ ID NO: 2170684 - RNA, 22 nt, Streptococcus pneumoniae R6
uaauauuuaauuguauacguuu

SEQ ID NO: 2170685 - RNA, 22 nt, Streptococcus pneumoniae R6
uaauauuaccaccacguauaau

SEQ ID NO: 2170686 - RNA, 14 nt, Streptococcus pneumoniae R6
uaauaucagccaga

SEQ ID NO: 2170687 - RNA, 21 nt, Streptococcus pneumoniae R6
uaauaucagccagagcaccaa

SEQ ID NO: 2170688 - RNA, 15 nt, Streptococcus pneumoniae R6
uaauaucauaaugag

SEQ ID NO: 2170689 - RNA, 19 nt, Streptococcus pneumoniae R6
uaauauauaaaaaauauag

SEQ ID NO: 2170690 - RNA, 19 nt, Streptococcus pneumoniae R6
uaauauacuugauauaguu

SEQ ID NO: 2170691 - RNA, 14 nt, Streptococcus pneumoniae R6
uaauauaggucaga

SEQ ID NO: 2170692 - RNA, 14 nt, Streptococcus pneumoniae R6
uaauaucuccagau

SEQ ID NO: 2170693 - RNA, 20 nt, Streptococcus pneumoniae R6
uaauauguauuuauaguauu

SEQ ID NO: 2170694 - RNA, 22 nt, Streptococcus pneumoniae R6
uaaucgcaagguagagacagaa

SEQ ID NO: 2170695 - RNA, 16 nt, Streptococcus pneumoniae R6
uaaucgacaagauacc

SEQ ID NO: 2170696 - RNA, 22 nt, Streptococcus pneumoniae R6
uaaugagguugcugucguaguc

SEQ ID NO: 2170697 - RNA, 12 nt, Streptococcus pneumoniae R6
uaaugauauggu

SEQ ID NO: 2170698 - RNA, 17 nt, Streptococcus pneumoniae R6
uaaugauagcuugaauu

SEQ ID NO: 2170699 - RNA, 16 nt, Streptococcus pneumoniae R6
uaaugauugauagcca

SEQ ID NO: 2170700 - RNA, 21 nt, Streptococcus pneumoniae R6
uaauguccaugcuugauucaa

SEQ ID NO: 2170701 - RNA, 13 nt, Streptococcus pneumoniae R6
uaaugucuaguaa

SEQ ID NO: 2170702 - RNA, 15 nt, Streptococcus pneumoniae R6
uaaugcuccaauaca

SEQ ID NO: 2170703 - RNA, 16 nt, Streptococcus pneumoniae R6
uaaugcuccaauacaa

SEQ ID NO: 2170704 - RNA, 23 nt, Streptococcus pneumoniae R6
uaauguaaggugcaaaaaccuug

SEQ ID NO: 2170705 - RNA, 18 nt, Streptococcus pneumoniae R6
uaaugccgugauuuccaa

SEQ ID NO: 2170706 - RNA, 23 nt, Streptococcus pneumoniae R6
uaauuaaaaguuuccccugccaa

SEQ ID NO: 2170707 - RNA, 23 nt, Streptococcus pneumoniae R6
uaauuaaaguuaauagaagaaca

SEQ ID NO: 2170708 - RNA, 21 nt, Streptococcus pneumoniae R6
uaauuaauuuauuuaaucauu

SEQ ID NO: 2170709 - RNA, 13 nt, Streptococcus pneumoniae R6
uaauuauuucaau

SEQ ID NO: 2170710 - RNA, 15 nt, Streptococcus pneumoniae R6
uaauuauuucaauua

SEQ ID NO: 2170711 - RNA, 18 nt, Streptococcus pneumoniae R6
uaauuagaaaaaaauuuu

SEQ ID NO: 2170712 - RNA, 20 nt, Streptococcus pneumoniae R6
uaauuagaaagucauuuguu

SEQ ID NO: 2170713 - RNA, 21 nt, Streptococcus pneumoniae R6
uaauuagaaagucauuuguuu

SEQ ID NO: 2170714 - RNA, 19 nt, Streptococcus pneumoniae R6
uaauuaugaaauuuaaaaa

SEQ ID NO: 2170715 - RNA, 22 nt, Streptococcus pneumoniae R6
uaauuaugaaauuuaaaaagaa

SEQ ID NO: 2170716 - RNA, 15 nt, Streptococcus pneumoniae R6
uaauuccacacagaa

SEQ ID NO: 2170717 - RNA, 15 nt, Streptococcus pneumoniae R6
uaauucccuuaaagu

SEQ ID NO: 2170718 - RNA, 17 nt, Streptococcus pneumoniae R6
uaauuccccaucuucaa

SEQ ID NO: 2170719 - RNA, 17 nt, Streptococcus pneumoniae R6
uacaacuuuaaccaauu

SEQ ID NO: 2170720 - RNA, 16 nt, Streptococcus pneumoniae R6
uacaacuuaaaaagag

SEQ ID NO: 2170721 - RNA, 18 nt, Streptococcus pneumoniae R6
uacaagcugccaaagcau

SEQ ID NO: 2170722 - RNA, 19 nt, Streptococcus pneumoniae R6
uacaacaggaaaagucuua

SEQ ID NO: 2170723 - RNA, 12 nt, Streptococcus pneumoniae R6
uacaaauugauu

SEQ ID NO: 2170724 - RNA, 20 nt, Streptococcus pneumoniae R6
uacaaauuguaaggauuuac

SEQ ID NO: 2170725 - RNA, 22 nt, Streptococcus pneumoniae R6
uacaaauuguaaggauuuacuu

SEQ ID NO: 2170726 - RNA, 17 nt, Streptococcus pneumoniae R6
uacaaauuuauacuaau

SEQ ID NO: 2170727 - RNA, 22 nt, Streptococcus pneumoniae R6
uacaaauauucaccacaugaca

SEQ ID NO: 2170728 - RNA, 13 nt, Streptococcus pneumoniae R6
uacaaaucccaug

SEQ ID NO: 2170729 - RNA, 16 nt, Streptococcus pneumoniae R6
uacaaaucccaugaca

SEQ ID NO: 2170730 - RNA, 18 nt, Streptococcus pneumoniae R6
uacaaauaaacggacaaa

SEQ ID NO: 2170731 - RNA, 14 nt, Streptococcus pneumoniae R6
uacaaaguuaagua

SEQ ID NO: 2170732 - RNA, 22 nt, Streptococcus pneumoniae R6
uacaaaguuccacccauggcaa

SEQ ID NO: 2170733 - RNA, 23 nt, Streptococcus pneumoniae R6
uacaaagggaugauguuaucaaa

SEQ ID NO: 2170734 - RNA, 13 nt, Streptococcus pneumoniae R6
uacaaacucucau

SEQ ID NO: 2170735 - RNA, 22 nt, Streptococcus pneumoniae R6
uacaaacucucauuaaaacgga

SEQ ID NO: 2170736 - RNA, 16 nt, Streptococcus pneumoniae R6
uacaaagaauaaaaua

SEQ ID NO: 2170737 - RNA, 16 nt, Streptococcus pneumoniae R6
uacaaaccuuguacua

SEQ ID NO: 2170738 - RNA, 21 nt, Streptococcus pneumoniae R6
uaauuuucuggcagauagaga

SEQ ID NO: 2170739 - RNA, 12 nt, Streptococcus pneumoniae R6
uaauuuuccuua

SEQ ID NO: 2170740 - RNA, 22 nt, Streptococcus pneumoniae R6
uaauuuugauucagauucauca

SEQ ID NO: 2170741 - RNA, 17 nt, Streptococcus pneumoniae R6
uaauuuugccaguuuug

SEQ ID NO: 2170742 - RNA, 18 nt, Streptococcus pneumoniae R6
uaauuuugccaguuuugu

SEQ ID NO: 2170743 - RNA, 20 nt, Streptococcus pneumoniae R6
uaauuuugugauaaaaugua

SEQ ID NO: 2170744 - RNA, 23 nt, Streptococcus pneumoniae R6
uacaaaaauauaauggucuggau

SEQ ID NO: 2170745 - RNA, 18 nt, Streptococcus pneumoniae R6
uaauuuuuuucauagaaa

SEQ ID NO: 2170746 - RNA, 22 nt, Streptococcus pneumoniae R6
uaauuuuuuucauagaaaucaa

SEQ ID NO: 2170747 - RNA, 12 nt, Streptococcus pneumoniae R6
uaauuuuucuuu

SEQ ID NO: 2170748 - RNA, 21 nt, Streptococcus pneumoniae R6
uaauuucaaaggcuuuuucuu

SEQ ID NO: 2170749 - RNA, 13 nt, Streptococcus pneumoniae R6
uaauuuauuuaau

SEQ ID NO: 2170750 - RNA, 21 nt, Streptococcus pneumoniae R6
uaauuuauuuaaucauuuaau

SEQ ID NO: 2170751 - RNA, 14 nt, Streptococcus pneumoniae R6
uaauuuauccaaag

SEQ ID NO: 2170752 - RNA, 20 nt, Streptococcus pneumoniae R6
uaauuuauccgaagauuuag

SEQ ID NO: 2170753 - RNA, 17 nt, Streptococcus pneumoniae R6
uaauugcaaauuuagca

SEQ ID NO: 2170754 - RNA, 24 nt, Streptococcus pneumoniae R6
uaauuucuuuuuguguuaaaucau

SEQ ID NO: 2170755 - RNA, 23 nt, Streptococcus pneumoniae R6
uaauuucagaaaucuucucuuga

SEQ ID NO: 2170756 - RNA, 14 nt, Streptococcus pneumoniae R6
uaauuuggaaauaa

SEQ ID NO: 2170757 - RNA, 13 nt, Streptococcus pneumoniae R6
uacaguauuuaua

SEQ ID NO: 2170758 - RNA, 14 nt, Streptococcus pneumoniae R6
uacaguauuuauaa

SEQ ID NO: 2170759 - RNA, 18 nt, Streptococcus pneumoniae R6
uacaguauuuauaaacuu

SEQ ID NO: 2170760 - RNA, 19 nt, Streptococcus pneumoniae R6
uacaauugcucuucugaaa

SEQ ID NO: 2170761 - RNA, 15 nt, Streptococcus pneumoniae R6
uacaauuggaaauaa

SEQ ID NO: 2170762 - RNA, 15 nt, Streptococcus pneumoniae R6
uacaauuguaaaaag

SEQ ID NO: 2170763 - RNA, 16 nt, Streptococcus pneumoniae R6
uacaauuguaaaaaga

SEQ ID NO: 2170764 - RNA, 20 nt, Streptococcus pneumoniae R6
uacaagucuugccuucaacc

SEQ ID NO: 2170765 - RNA, 23 nt, Streptococcus pneumoniae R6
uacaaggaagccuucuuuuccac

SEQ ID NO: 2170766 - RNA, 15 nt, Streptococcus pneumoniae R6
uacauccaguaccau

SEQ ID NO: 2170767 - RNA, 14 nt, Streptococcus pneumoniae R6
uacaucauugucaa

SEQ ID NO: 2170768 - RNA, 15 nt, Streptococcus pneumoniae R6
uacaucauugucaaa

SEQ ID NO: 2170769 - RNA, 15 nt, Streptococcus pneumoniae R6
uacauaauuuaaaau

SEQ ID NO: 2170770 - RNA, 18 nt, Streptococcus pneumoniae R6
uacauacccaugcuuuuc

SEQ ID NO: 2170771 - RNA, 22 nt, Streptococcus pneumoniae R6
uacauacccaugcuuuucuauu

SEQ ID NO: 2170772 - RNA, 17 nt, Streptococcus pneumoniae R6
uacaucaaaaucacaga

SEQ ID NO: 2170773 - RNA, 19 nt, Streptococcus pneumoniae R6
uacaucaaaaucacagacc

SEQ ID NO: 2170774 - RNA, 16 nt, Streptococcus pneumoniae R6
uacauagacuucccag

SEQ ID NO: 2170775 - RNA, 18 nt, Streptococcus pneumoniae R6
uacauagacuucccagcc

SEQ ID NO: 2170776 - RNA, 16 nt, Streptococcus pneumoniae R6
uaccaaccaguugcca

SEQ ID NO: 2170777 - RNA, 18 nt, Streptococcus pneumoniae R6
uaccaaccaguugccaua

SEQ ID NO: 2170778 - RNA, 21 nt, Streptococcus pneumoniae R6
uaccaaccaguugccauagcu

SEQ ID NO: 2170779 - RNA, 17 nt, Streptococcus pneumoniae R6
uaccaacgcccucacac

SEQ ID NO: 2170780 - RNA, 15 nt, Streptococcus pneumoniae R6
uaccaauuuuuccuu

SEQ ID NO: 2170781 - RNA, 15 nt, Streptococcus pneumoniae R6
uaccacacuaaauuu

SEQ ID NO: 2170782 - RNA, 15 nt, Streptococcus pneumoniae R6
uacauucccaaacaa

SEQ ID NO: 2170783 - RNA, 16 nt, Streptococcus pneumoniae R6
uacauucccaaacaaa

SEQ ID NO: 2170784 - RNA, 14 nt, Streptococcus pneumoniae R6
uacaucuaucucac

SEQ ID NO: 2170785 - RNA, 22 nt, Streptococcus pneumoniae R6
uacaucucuuguaacccaaaca

SEQ ID NO: 2170786 - RNA, 20 nt, Streptococcus pneumoniae R6
uaccagaagccuuguuucca

SEQ ID NO: 2170787 - RNA, 16 nt, Streptococcus pneumoniae R6
uaccagccaauguauu

SEQ ID NO: 2170788 - RNA, 22 nt, Streptococcus pneumoniae R6
uaccauuuucguccaagucaac

SEQ ID NO: 2170789 - RNA, 15 nt, Streptococcus pneumoniae R6
uacccaaaacacaaa

SEQ ID NO: 2170790 - RNA, 20 nt, Streptococcus pneumoniae R6
uaccccaaauuccuggcaua

SEQ ID NO: 2170791 - RNA, 23 nt, Streptococcus pneumoniae R6
uacccccuuaaaaccauguuuuu

SEQ ID NO: 2170792 - RNA, 15 nt, Streptococcus pneumoniae R6
uacccauguucggau

SEQ ID NO: 2170793 - RNA, 18 nt, Streptococcus pneumoniae R6
uacccauuuauggaaaaa

SEQ ID NO: 2170794 - RNA, 21 nt, Streptococcus pneumoniae R6
uacccauagauuuuuauuauu

SEQ ID NO: 2170795 - RNA, 21 nt, Streptococcus pneumoniae R6
uaccaucuaacucauagcaga

SEQ ID NO: 2170796 - RNA, 17 nt, Streptococcus pneumoniae R6
uaccaucauaggcuuua

SEQ ID NO: 2170797 - RNA, 20 nt, Streptococcus pneumoniae R6
uaccagguaauccagaaaug

SEQ ID NO: 2170798 - RNA, 19 nt, Streptococcus pneumoniae R6
uaccaguuaccauugacuu

SEQ ID NO: 2170799 - RNA, 15 nt, Streptococcus pneumoniae R6
uaccgaaaaauuaag

SEQ ID NO: 2170800 - RNA, 13 nt, Streptococcus pneumoniae R6
uacccucuaucaa

SEQ ID NO: 2170801 - RNA, 19 nt, Streptococcus pneumoniae R6
uaccgaugauguucauaac

SEQ ID NO: 2170802 - RNA, 17 nt, Streptococcus pneumoniae R6
uaccgcacuuaugaaga

SEQ ID NO: 2170803 - RNA, 19 nt, Streptococcus pneumoniae R6
uaccgaccuugucucccca

SEQ ID NO: 2170804 - RNA, 16 nt, Streptococcus pneumoniae R6
uacugcucgguaaaac

SEQ ID NO: 2170805 - RNA, 14 nt, Streptococcus pneumoniae R6
uacugcuuugaggu

SEQ ID NO: 2170806 - RNA, 23 nt, Streptococcus pneumoniae R6
uacuggauaaaguuaugaaaaag

SEQ ID NO: 2170807 - RNA, 18 nt, Streptococcus pneumoniae R6
uacuugaaggucaagaau

SEQ ID NO: 2170808 - RNA, 12 nt, Streptococcus pneumoniae R6
uacuucuuuuuc

SEQ ID NO: 2170809 - RNA, 11 nt, Streptococcus pneumoniae R6
uacuucuuugu

SEQ ID NO: 2170810 - RNA, 20 nt, Streptococcus pneumoniae R6
uacuugagacuguuugagau

SEQ ID NO: 2170811 - RNA, 17 nt, Streptococcus pneumoniae R6
uacuugcguuucuucuu

SEQ ID NO: 2170812 - RNA, 21 nt, Streptococcus pneumoniae R6
uacuugcauuuagauaguacc

SEQ ID NO: 2170813 - RNA, 14 nt, Streptococcus pneumoniae R6
uacuugcaaacuuu

SEQ ID NO: 2170814 - RNA, 17 nt, Streptococcus pneumoniae R6
uacuuauccuuuuuuac

SEQ ID NO: 2170815 - RNA, 14 nt, Streptococcus pneumoniae R6
uacuucacuucugu

SEQ ID NO: 2170816 - RNA, 12 nt, Streptococcus pneumoniae R6
uacuaggcagga

SEQ ID NO: 2170817 - RNA, 14 nt, Streptococcus pneumoniae R6
uacuacuggaacau

SEQ ID NO: 2170818 - RNA, 16 nt, Streptococcus pneumoniae R6
uacuagucuuucuucg

SEQ ID NO: 2170819 - RNA, 18 nt, Streptococcus pneumoniae R6
uacucgugaagaaaucau

SEQ ID NO: 2170820 - RNA, 16 nt, Streptococcus pneumoniae R6
uacucucuaggaagcg

SEQ ID NO: 2170821 - RNA, 18 nt, Streptococcus pneumoniae R6
uacucugccuuccuuguc

SEQ ID NO: 2170822 - RNA, 18 nt, Streptococcus pneumoniae R6
uacucuucgaaaaucucu

SEQ ID NO: 2170823 - RNA, 14 nt, Streptococcus pneumoniae R6
uacucuguuuucac

SEQ ID NO: 2170824 - RNA, 14 nt, Streptococcus pneumoniae R6
uacucuucaaaaau

SEQ ID NO: 2170825 - RNA, 17 nt, Streptococcus pneumoniae R6
uacucuuuacuuugcuu

SEQ ID NO: 2170826 - RNA, 14 nt, Streptococcus pneumoniae R6
uacugauaaaacug

SEQ ID NO: 2170827 - RNA, 15 nt, Streptococcus pneumoniae R6
uacucuuuuuucaug

SEQ ID NO: 2170828 - RNA, 11 nt, Streptococcus pneumoniae R6
uacugaaucaa

SEQ ID NO: 2170829 - RNA, 17 nt, Streptococcus pneumoniae R6
uacucuuugauuuucau

SEQ ID NO: 2170830 - RNA, 20 nt, Streptococcus pneumoniae R6
uacucuuugauuuucauuga

SEQ ID NO: 2170831 - RNA, 16 nt, Streptococcus pneumoniae R6
uacugacuucgucagu

SEQ ID NO: 2170832 - RNA, 23 nt, Streptococcus pneumoniae R6
uacuacacagcuugguaaugcuc

SEQ ID NO: 2170833 - RNA, 23 nt, Streptococcus pneumoniae R6
uacuaaugcccuuuuuuguuuca

SEQ ID NO: 2170834 - RNA, 15 nt, Streptococcus pneumoniae R6
uacuaaucuuugcca

SEQ ID NO: 2170835 - RNA, 15 nt, Streptococcus pneumoniae R6
uacuaaguuccuguu

SEQ ID NO: 2170836 - RNA, 16 nt, Streptococcus pneumoniae R6
uacguccaccacaaaa

SEQ ID NO: 2170837 - RNA, 23 nt, Streptococcus pneumoniae R6
uacguccaccacaaaagagaaag

SEQ ID NO: 2170838 - RNA, 13 nt, Streptococcus pneumoniae R6
uacuaaaauuaug

SEQ ID NO: 2170839 - RNA, 20 nt, Streptococcus pneumoniae R6
uacuaaauacuagucuuucu

SEQ ID NO: 2170840 - RNA, 19 nt, Streptococcus pneumoniae R6
uaccgucaacgucaagaac

SEQ ID NO: 2170841 - RNA, 18 nt, Streptococcus pneumoniae R6
uacgauugguucugcucc

SEQ ID NO: 2170842 - RNA, 19 nt, Streptococcus pneumoniae R6
uacgauugguucugcucca

SEQ ID NO: 2170843 - RNA, 23 nt, Streptococcus pneumoniae R6
uacgcaucgacuacuaaaacauu

SEQ ID NO: 2170844 - RNA, 17 nt, Streptococcus pneumoniae R6
gucaucuuccaagaccu

SEQ ID NO: 2170845 - RNA, 13 nt, Streptococcus pneumoniae R6
gucauggccucua

SEQ ID NO: 2170846 - RNA, 14 nt, Streptococcus pneumoniae R6
gucauuuuuuccaa

SEQ ID NO: 2170847 - RNA, 17 nt, Streptococcus pneumoniae R6
gucauguuagaaaaaug

SEQ ID NO: 2170848 - RNA, 22 nt, Streptococcus pneumoniae R6
gucauguagcgcuugaaacuca

SEQ ID NO: 2170849 - RNA, 16 nt, Streptococcus pneumoniae R6
gucaucagcagagaaa

SEQ ID NO: 2170850 - RNA, 14 nt, Streptococcus pneumoniae R6
gucaucagaaaaaa

SEQ ID NO: 2170851 - RNA, 17 nt, Streptococcus pneumoniae R6
gucaucagaaaaaaggc

SEQ ID NO: 2170852 - RNA, 12 nt, Streptococcus pneumoniae R6
gucauauuucuu

SEQ ID NO: 2170853 - RNA, 19 nt, Streptococcus pneumoniae R6
gucaucaaaaauagaaaua

SEQ ID NO: 2170854 - RNA, 17 nt, Streptococcus pneumoniae R6
guccaagucaacaccug

SEQ ID NO: 2170855 - RNA, 19 nt, Streptococcus pneumoniae R6
guccaagauucaacaucac

SEQ ID NO: 2170856 - RNA, 12 nt, Streptococcus pneumoniae R6
guccaaggcuga

SEQ ID NO: 2170857 - RNA, 21 nt, Streptococcus pneumoniae R6
guccaccacaaaagagaaaga

SEQ ID NO: 2170858 - RNA, 11 nt, Streptococcus pneumoniae R6
gucaacuguag

SEQ ID NO: 2170859 - RNA, 21 nt, Streptococcus pneumoniae R6
gucaacuguaguggguugaag

SEQ ID NO: 2170860 - RNA, 13 nt, Streptococcus pneumoniae R6
gucaacuuguaaa

SEQ ID NO: 2170861 - RNA, 19 nt, Streptococcus pneumoniae R6
gucaacuuuuguauuuuga

SEQ ID NO: 2170862 - RNA, 14 nt, Streptococcus pneumoniae R6
gucaagaagagggc

SEQ ID NO: 2170863 - RNA, 22 nt, Streptococcus pneumoniae R6
gucaagaauccgccguuaucca

SEQ ID NO: 2170864 - RNA, 14 nt, Streptococcus pneumoniae R6
gucaagacuaggug

SEQ ID NO: 2170865 - RNA, 11 nt, Streptococcus pneumoniae R6
gucaagagaaa

SEQ ID NO: 2170866 - RNA, 18 nt, Streptococcus pneumoniae R6
gucaauccgaguuuuuca

SEQ ID NO: 2170867 - RNA, 19 nt, Streptococcus pneumoniae R6
gucaauccgaguuuuucag

SEQ ID NO: 2170868 - RNA, 15 nt, Streptococcus pneumoniae R6
gucaauugaaacaag

SEQ ID NO: 2170869 - RNA, 21 nt, Streptococcus pneumoniae R6
gucaaucuugucuaaaaauag

SEQ ID NO: 2170870 - RNA, 22 nt, Streptococcus pneumoniae R6
gucaccgauagcggcaacuagg

SEQ ID NO: 2170871 - RNA, 16 nt, Streptococcus pneumoniae R6
gucacggaguuucuug

SEQ ID NO: 2170872 - RNA, 16 nt, Streptococcus pneumoniae R6
gucacuacuuccaucu

SEQ ID NO: 2170873 - RNA, 17 nt, Streptococcus pneumoniae R6
gucagggaaaaaacucg

SEQ ID NO: 2170874 - RNA, 21 nt, Streptococcus pneumoniae R6
gucagcccuauccgcaaccuc

SEQ ID NO: 2170875 - RNA, 22 nt, Streptococcus pneumoniae R6
gucagcccuauccgcaaccuca

SEQ ID NO: 2170876 - RNA, 23 nt, Streptococcus pneumoniae R6
guccgcugcucugccagcugagc

SEQ ID NO: 2170877 - RNA, 14 nt, Streptococcus pneumoniae R6
gucccaguuuucuu

SEQ ID NO: 2170878 - RNA, 16 nt, Streptococcus pneumoniae R6
gucccaguuuucuucg

SEQ ID NO: 2170879 - RNA, 22 nt, Streptococcus pneumoniae R6
gucccgaaccguguuguaugaa

SEQ ID NO: 2170880 - RNA, 17 nt, Streptococcus pneumoniae R6
guccuaaaacuagugaa

SEQ ID NO: 2170881 - RNA, 13 nt, Streptococcus pneumoniae R6
guccuuucuuuuu

SEQ ID NO: 2170882 - RNA, 16 nt, Streptococcus pneumoniae R6
guccuuucuuuuuuga

SEQ ID NO: 2170883 - RNA, 19 nt, Streptococcus pneumoniae R6
guccuuucuuuuuugauau

SEQ ID NO: 2170884 - RNA, 14 nt, Streptococcus pneumoniae R6
guccuuguuugagc

SEQ ID NO: 2170885 - RNA, 12 nt, Streptococcus pneumoniae R6
guccuuuagaaa

SEQ ID NO: 2170886 - RNA, 21 nt, Streptococcus pneumoniae R6
gucgguuuuauuaaguagaau

SEQ ID NO: 2170887 - RNA, 16 nt, Streptococcus pneumoniae R6
gucguaaccuucuucu

SEQ ID NO: 2170888 - RNA, 17 nt, Streptococcus pneumoniae R6
gucgcuuuugugccaau

SEQ ID NO: 2170889 - RNA, 19 nt, Streptococcus pneumoniae R6
gucggaacaucuuuuccau

SEQ ID NO: 2170890 - RNA, 13 nt, Streptococcus pneumoniae R6
gucggcaggcugg

SEQ ID NO: 2170891 - RNA, 13 nt, Streptococcus pneumoniae R6
gucugguucccag

SEQ ID NO: 2170892 - RNA, 13 nt, Streptococcus pneumoniae R6
gucugggugcuga

SEQ ID NO: 2170893 - RNA, 20 nt, Streptococcus pneumoniae R6
gucuggcucguggcagacca

SEQ ID NO: 2170894 - RNA, 19 nt, Streptococcus pneumoniae R6
gucugggaaaaauuuucaa

SEQ ID NO: 2170895 - RNA, 16 nt, Streptococcus pneumoniae R6
gucugaguuuucuugu

SEQ ID NO: 2170896 - RNA, 23 nt, Streptococcus pneumoniae R6
gucugacgcuggaaauaagaauc

SEQ ID NO: 2170897 - RNA, 20 nt, Streptococcus pneumoniae R6
gucugagcauucuuuuaucu

SEQ ID NO: 2170898 - RNA, 24 nt, Streptococcus pneumoniae R6
gucugaagacuggaguucaccagu

SEQ ID NO: 2170899 - RNA, 15 nt, Streptococcus pneumoniae R6
gucugaauauauaau

SEQ ID NO: 2170900 - RNA, 13 nt, Streptococcus pneumoniae R6
gucucaugaaagg

SEQ ID NO: 2170901 - RNA, 14 nt, Streptococcus pneumoniae R6
gucuccccaugagu

SEQ ID NO: 2170902 - RNA, 12 nt, Streptococcus pneumoniae R6
gucguuaaaagc

SEQ ID NO: 2170903 - RNA, 15 nt, Streptococcus pneumoniae R6
gucguuagcacacca

SEQ ID NO: 2170904 - RNA, 12 nt, Streptococcus pneumoniae R6
gucucuaaauaa

SEQ ID NO: 2170905 - RNA, 21 nt, Streptococcus pneumoniae R6
gucucuaaaaauaaaaaagag

SEQ ID NO: 2170906 - RNA, 22 nt, Streptococcus pneumoniae R6
gucucuaaaaauaaaaaagaga

SEQ ID NO: 2170907 - RNA, 20 nt, Streptococcus pneumoniae R6
gucucuccagcgagcaaacg

SEQ ID NO: 2170908 - RNA, 22 nt, Streptococcus pneumoniae R6
gucucugucccaucauuucuuc

SEQ ID NO: 2170909 - RNA, 16 nt, Streptococcus pneumoniae R6
gucuccugugcuccau

SEQ ID NO: 2170910 - RNA, 23 nt, Streptococcus pneumoniae R6
gucuccugugcuccauuuuuuaa

SEQ ID NO: 2170911 - RNA, 21 nt, Streptococcus pneumoniae R6
gucuucuugaguaguuccagu

SEQ ID NO: 2170912 - RNA, 17 nt, Streptococcus pneumoniae R6
gucuugcauuuuaauuu

SEQ ID NO: 2170913 - RNA, 18 nt, Streptococcus pneumoniae R6
gucuucuccuaaaauuga

SEQ ID NO: 2170914 - RNA, 16 nt, Streptococcus pneumoniae R6
gucuuccauuucuuug

SEQ ID NO: 2170915 - RNA, 17 nt, Streptococcus pneumoniae R6
gucuuccauuucuuugu

SEQ ID NO: 2170916 - RNA, 18 nt, Streptococcus pneumoniae R6
gucuuccgaauaacucaa

SEQ ID NO: 2170917 - RNA, 16 nt, Streptococcus pneumoniae R6
gucuucaugacggcuc

SEQ ID NO: 2170918 - RNA, 19 nt, Streptococcus pneumoniae R6
gucuucaauacgaacaccg

SEQ ID NO: 2170919 - RNA, 12 nt, Streptococcus pneumoniae R6
gucuucacaauc

SEQ ID NO: 2170920 - RNA, 20 nt, Streptococcus pneumoniae R6
gucuuagacuuucucacgaa

SEQ ID NO: 2170921 - RNA, 21 nt, Streptococcus pneumoniae R6
gucuuacuugcguuucuucuu

SEQ ID NO: 2170922 - RNA, 13 nt, Streptococcus pneumoniae R6
gucuuauccuugu

SEQ ID NO: 2170923 - RNA, 12 nt, Streptococcus pneumoniae R6
gucuuauuucau

SEQ ID NO: 2170924 - RNA, 19 nt, Streptococcus pneumoniae R6
gucuuaucugcaaccucaa

SEQ ID NO: 2170925 - RNA, 21 nt, Streptococcus pneumoniae R6
gucugucaccuuaucacgaau

SEQ ID NO: 2170926 - RNA, 22 nt, Streptococcus pneumoniae R6
gucugucaccuuaucacgaauu

SEQ ID NO: 2170927 - RNA, 19 nt, Streptococcus pneumoniae R6
gucuuucuucguuuuuacu

SEQ ID NO: 2170928 - RNA, 20 nt, Streptococcus pneumoniae R6
gucuuugauuuugagacuaa

SEQ ID NO: 2170929 - RNA, 21 nt, Streptococcus pneumoniae R6
gucuuugcccccaucuccuug

SEQ ID NO: 2170930 - RNA, 18 nt, Streptococcus pneumoniae R6
gucuugugaauagcucaa

SEQ ID NO: 2170931 - RNA, 12 nt, Streptococcus pneumoniae R6
gucuuuaaaauu

SEQ ID NO: 2170932 - RNA, 20 nt, Streptococcus pneumoniae R6
gucuuuacguccaccacaaa

SEQ ID NO: 2170933 - RNA, 23 nt, Streptococcus pneumoniae R6
gugaaaaucauagagcaaacuag

SEQ ID NO: 2170934 - RNA, 18 nt, Streptococcus pneumoniae R6
gugaaacuaaugagccuu

SEQ ID NO: 2170935 - RNA, 17 nt, Streptococcus pneumoniae R6
gugaaaggaagagagcu

SEQ ID NO: 2170936 - RNA, 14 nt, Streptococcus pneumoniae R6
aaauagcccauaaa

SEQ ID NO: 2170937 - RNA, 21 nt, Streptococcus pneumoniae R6
aaauagcccauaaagagaggu

SEQ ID NO: 2170938 - RNA, 20 nt, Streptococcus pneumoniae R6
aaauagccccuagauauuuu

SEQ ID NO: 2170939 - RNA, 16 nt, Streptococcus pneumoniae R6
aaauagccaagaccaa

SEQ ID NO: 2170940 - RNA, 15 nt, Streptococcus pneumoniae R6
aaauagcauccacca

SEQ ID NO: 2170941 - RNA, 21 nt, Streptococcus pneumoniae R6
aaauagcagagacauuagaaa

SEQ ID NO: 2170942 - RNA, 21 nt, Streptococcus pneumoniae R6
gugaacaaugguaacagucuu

SEQ ID NO: 2170943 - RNA, 21 nt, Streptococcus pneumoniae R6
gugcaauccaaguuuggcaga

SEQ ID NO: 2170944 - RNA, 15 nt, Streptococcus pneumoniae R6
gugauaaguaaagcu

SEQ ID NO: 2170945 - RNA, 20 nt, Streptococcus pneumoniae R6
gugauuauagguuccuucug

SEQ ID NO: 2170946 - RNA, 17 nt, Streptococcus pneumoniae R6
gugauuucuguaaaaau

SEQ ID NO: 2170947 - RNA, 18 nt, Streptococcus pneumoniae R6
gugauuucuguaaaaaua

SEQ ID NO: 2170948 - RNA, 14 nt, Streptococcus pneumoniae R6
gugauuuaaauguu

SEQ ID NO: 2170949 - RNA, 16 nt, Streptococcus pneumoniae R6
gugauugugaauaggu

SEQ ID NO: 2170950 - RNA, 13 nt, Streptococcus pneumoniae R6
gugauuguguccu

SEQ ID NO: 2170951 - RNA, 16 nt, Streptococcus pneumoniae R6
gugagauaguaucaaa

SEQ ID NO: 2170952 - RNA, 16 nt, Streptococcus pneumoniae R6
gugagaagagggagaa

SEQ ID NO: 2170953 - RNA, 20 nt, Streptococcus pneumoniae R6
gugagcuuugguuucagcua

SEQ ID NO: 2170954 - RNA, 17 nt, Streptococcus pneumoniae R6
gugauaaucauaaagcc

SEQ ID NO: 2170955 - RNA, 15 nt, Streptococcus pneumoniae R6
aaauagggauuaaua

SEQ ID NO: 2170956 - RNA, 19 nt, Streptococcus pneumoniae R6
aaauaggccucuucaaaga

SEQ ID NO: 2170957 - RNA, 16 nt, Streptococcus pneumoniae R6
aaauaggaagcuaguc

SEQ ID NO: 2170958 - RNA, 22 nt, Streptococcus pneumoniae R6
aaauaggaaucaaccaacuuuu

SEQ ID NO: 2170959 - RNA, 14 nt, Streptococcus pneumoniae R6
aaauaguucuucca

SEQ ID NO: 2170960 - RNA, 21 nt, Streptococcus pneumoniae R6
aaauaguuuagauaaaacuau

SEQ ID NO: 2170961 - RNA, 15 nt, Streptococcus pneumoniae R6
gugacaguaaaaaau

SEQ ID NO: 2170962 - RNA, 22 nt, Streptococcus pneumoniae R6
gugacauaugauugucuccuuu

SEQ ID NO: 2170963 - RNA, 21 nt, Streptococcus pneumoniae R6
gugacauggacacauaguagu

SEQ ID NO: 2170964 - RNA, 17 nt, Streptococcus pneumoniae R6
gugaaucaucacuagua

SEQ ID NO: 2170965 - RNA, 22 nt, Streptococcus pneumoniae R6
gugacaaagaccuuugaaaacu

SEQ ID NO: 2170966 - RNA, 12 nt, Streptococcus pneumoniae R6
gugaauuuucaa

SEQ ID NO: 2170967 - RNA, 13 nt, Streptococcus pneumoniae R6
gugaauuauagua

SEQ ID NO: 2170968 - RNA, 17 nt, Streptococcus pneumoniae R6
gugaauuucauuaaaug

SEQ ID NO: 2170969 - RNA, 14 nt, Streptococcus pneumoniae R6
gugaauagcucaaa

SEQ ID NO: 2170970 - RNA, 17 nt, Streptococcus pneumoniae R6
gugaauaggcauaauac

SEQ ID NO: 2170971 - RNA, 15 nt, Streptococcus pneumoniae R6
gugaaguugaaagau

SEQ ID NO: 2170972 - RNA, 15 nt, Streptococcus pneumoniae R6
gugaaggcuuuaaau

SEQ ID NO: 2170973 - RNA, 21 nt, Streptococcus pneumoniae R6
aaauagcuccuuuaacauuug

SEQ ID NO: 2170974 - RNA, 14 nt, Streptococcus pneumoniae R6
aaauagcuguuuca

SEQ ID NO: 2170975 - RNA, 21 nt, Streptococcus pneumoniae R6
aaauagcccuucggauaaaau

SEQ ID NO: 2170976 - RNA, 17 nt, Streptococcus pneumoniae R6
guuuccaacgacuucca

SEQ ID NO: 2170977 - RNA, 22 nt, Streptococcus pneumoniae R6
guuucccuaauaauacaaaaaa

SEQ ID NO: 2170978 - RNA, 20 nt, Streptococcus pneumoniae R6
aaauauuucuagaaauuaau

SEQ ID NO: 2170979 - RNA, 20 nt, Streptococcus pneumoniae R6
aaauauuucuaugauaaaac

SEQ ID NO: 2170980 - RNA, 22 nt, Streptococcus pneumoniae R6
aaauauuucuaugauaaaacgc

SEQ ID NO: 2170981 - RNA, 13 nt, Streptococcus pneumoniae R6
aaauauuucgcuu

SEQ ID NO: 2170982 - RNA, 20 nt, Streptococcus pneumoniae R6
aaauauuguuuuaauauaau

SEQ ID NO: 2170983 - RNA, 23 nt, Streptococcus pneumoniae R6
aaauauuguuuuaauauaauauc

SEQ ID NO: 2170984 - RNA, 13 nt, Streptococcus pneumoniae R6
aaauauuuacuuc

SEQ ID NO: 2170985 - RNA, 15 nt, Streptococcus pneumoniae R6
aaauauuuuaaacgu

SEQ ID NO: 2170986 - RNA, 15 nt, Streptococcus pneumoniae R6
aaaucaaagugcaaa

SEQ ID NO: 2170987 - RNA, 14 nt, Streptococcus pneumoniae R6
aaaucaaaaaaauu

SEQ ID NO: 2170988 - RNA, 14 nt, Streptococcus pneumoniae R6
aaaucaaaaagcaa

SEQ ID NO: 2170989 - RNA, 14 nt, Streptococcus pneumoniae R6
aaaucaaauuuauu

SEQ ID NO: 2170990 - RNA, 20 nt, Streptococcus pneumoniae R6
aaaucacagugggcuauucc

SEQ ID NO: 2170991 - RNA, 17 nt, Streptococcus pneumoniae R6
aaaucaauuuuucguau

SEQ ID NO: 2170992 - RNA, 24 nt, Streptococcus pneumoniae R6
aaaucacaaaaacgcauaauguaa

SEQ ID NO: 2170993 - RNA, 19 nt, Streptococcus pneumoniae R6
guuucuauuucauuuuacu

SEQ ID NO: 2170994 - RNA, 12 nt, Streptococcus pneumoniae R6
guuucuaauaau

SEQ ID NO: 2170995 - RNA, 13 nt, Streptococcus pneumoniae R6
guuucuaaaacau

SEQ ID NO: 2170996 - RNA, 21 nt, Streptococcus pneumoniae R6
guuucguguggguucauccag

SEQ ID NO: 2170997 - RNA, 23 nt, Streptococcus pneumoniae R6
guuucggcuguucuuuuuuguuu

SEQ ID NO: 2170998 - RNA, 14 nt, Streptococcus pneumoniae R6
guuucgcuaucucu

SEQ ID NO: 2170999 - RNA, 15 nt, Streptococcus pneumoniae R6
guuucgcuaucucua

SEQ ID NO: 2171000 - RNA, 23 nt, Streptococcus pneumoniae R6
aaaucaauuucuagcaaaguuuu

SEQ ID NO: 2171001 - RNA, 15 nt, Streptococcus pneumoniae R6
aaaucaauuagaaaa

SEQ ID NO: 2171002 - RNA, 15 nt, Streptococcus pneumoniae R6
aaaucaauuuuuaac

SEQ ID NO: 2171003 - RNA, 13 nt, Streptococcus pneumoniae R6
aaaucaauuuuuc

SEQ ID NO: 2171004 - RNA, 23 nt, Streptococcus pneumoniae R6
aaaucaagguuuuugaacaccug

SEQ ID NO: 2171005 - RNA, 13 nt, Streptococcus pneumoniae R6
aaaucaagggaaa

SEQ ID NO: 2171006 - RNA, 17 nt, Streptococcus pneumoniae R6
aaaucaacugcuguuuu

SEQ ID NO: 2171007 - RNA, 21 nt, Streptococcus pneumoniae R6
guuuuacuaugggaagauuua

SEQ ID NO: 2171008 - RNA, 13 nt, Streptococcus pneumoniae R6
guuuuagaauauc

SEQ ID NO: 2171009 - RNA, 15 nt, Streptococcus pneumoniae R6
guuuuagaauaucug

SEQ ID NO: 2171010 - RNA, 22 nt, Streptococcus pneumoniae R6
guuuuagcaaucgcaaucuacu

SEQ ID NO: 2171011 - RNA, 19 nt, Streptococcus pneumoniae R6
guuuuagcuucuguauaga

SEQ ID NO: 2171012 - RNA, 15 nt, Streptococcus pneumoniae R6
guuuuaggacauaaa

SEQ ID NO: 2171013 - RNA, 19 nt, Streptococcus pneumoniae R6
guuugcgcaggacuaaauc

SEQ ID NO: 2171014 - RNA, 14 nt, Streptococcus pneumoniae R6
guuugcuuagaaac

SEQ ID NO: 2171015 - RNA, 17 nt, Streptococcus pneumoniae R6
guuugcuucauuuuuuc

SEQ ID NO: 2171016 - RNA, 14 nt, Streptococcus pneumoniae R6
guuucuucuagcuu

SEQ ID NO: 2171017 - RNA, 20 nt, Streptococcus pneumoniae R6
guuugagaugauuugcucaa

SEQ ID NO: 2171018 - RNA, 21 nt, Streptococcus pneumoniae R6
guuugaucaauugucugaagu

SEQ ID NO: 2171019 - RNA, 20 nt, Streptococcus pneumoniae R6
guuucuggauuuucucccgu

SEQ ID NO: 2171020 - RNA, 15 nt, Streptococcus pneumoniae R6
guuuugagaauccaa

SEQ ID NO: 2171021 - RNA, 19 nt, Streptococcus pneumoniae R6
guuuugaauucuccauuuu

SEQ ID NO: 2171022 - RNA, 12 nt, Streptococcus pneumoniae R6
guuuugagcuga

SEQ ID NO: 2171023 - RNA, 13 nt, Streptococcus pneumoniae R6
guuuugagguugc

SEQ ID NO: 2171024 - RNA, 14 nt, Streptococcus pneumoniae R6
guuuucacuuccuu

SEQ ID NO: 2171025 - RNA, 20 nt, Streptococcus pneumoniae R6
guuuucaaaguuccuaaaac

SEQ ID NO: 2171026 - RNA, 16 nt, Streptococcus pneumoniae R6
guuuucaaaaauucug

SEQ ID NO: 2171027 - RNA, 16 nt, Streptococcus pneumoniae R6
guuuucacccuugauu

SEQ ID NO: 2171028 - RNA, 21 nt, Streptococcus pneumoniae R6
guuuucacaauuucauuucuu

SEQ ID NO: 2171029 - RNA, 19 nt, Streptococcus pneumoniae R6
guuuucacuggaguucuuu

SEQ ID NO: 2171030 - RNA, 19 nt, Streptococcus pneumoniae R6
guuuuauuguuccuaaaac

SEQ ID NO: 2171031 - RNA, 21 nt, Streptococcus pneumoniae R6
guuuuauuguuccuaaaacag

SEQ ID NO: 2171032 - RNA, 13 nt, Streptococcus pneumoniae R6
aaaucauuuucuu

SEQ ID NO: 2171033 - RNA, 18 nt, Streptococcus pneumoniae R6
aaauccaaucuucuagcu

SEQ ID NO: 2171034 - RNA, 15 nt, Streptococcus pneumoniae R6
aaaucauugaguugg

SEQ ID NO: 2171035 - RNA, 16 nt, Streptococcus pneumoniae R6
aaaucauugauaguaa

SEQ ID NO: 2171036 - RNA, 19 nt, Streptococcus pneumoniae R6
aaaucauugauaguaacac

SEQ ID NO: 2171037 - RNA, 23 nt, Streptococcus pneumoniae R6
aaaucauuugaaucaaaaauugg

SEQ ID NO: 2171038 - RNA, 19 nt, Streptococcus pneumoniae R6
aaaucauuauagaaggcaa

SEQ ID NO: 2171039 - RNA, 21 nt, Streptococcus pneumoniae R6
aaaucaucauaaaaauaaaga

SEQ ID NO: 2171040 - RNA, 20 nt, Streptococcus pneumoniae R6
aaaucauaauccaacaccaa

SEQ ID NO: 2171041 - RNA, 21 nt, Streptococcus pneumoniae R6
aaaucauacaccucuucugau

SEQ ID NO: 2171042 - RNA, 16 nt, Streptococcus pneumoniae R6
aaaucauagaaaaaag

SEQ ID NO: 2171043 - RNA, 22 nt, Streptococcus pneumoniae R6
aaaucaucaaauugaaauaaga

SEQ ID NO: 2171044 - RNA, 13 nt, Streptococcus pneumoniae R6
aaaucauaaacac

SEQ ID NO: 2171045 - RNA, 13 nt, Streptococcus pneumoniae R6
aaaucacuuaguu

SEQ ID NO: 2171046 - RNA, 13 nt, Streptococcus pneumoniae R6
aaaucagaaaaaa

SEQ ID NO: 2171047 - RNA, 23 nt, Streptococcus pneumoniae R6
aaaucagaaccuuugagaaaaau

SEQ ID NO: 2171048 - RNA, 18 nt, Streptococcus pneumoniae R6
guuuuauacucuuagaaa

SEQ ID NO: 2171049 - RNA, 21 nt, Streptococcus pneumoniae R6
guuuuaguauaguaaacugaa

SEQ ID NO: 2171050 - RNA, 19 nt, Streptococcus pneumoniae R6
aaauauggcacaaaagguu

SEQ ID NO: 2171051 - RNA, 16 nt, Streptococcus pneumoniae R6
aaauauguuuucuuug

SEQ ID NO: 2171052 - RNA, 15 nt, Streptococcus pneumoniae R6
guuuccaccuucuuu

SEQ ID NO: 2171053 - RNA, 21 nt, Streptococcus pneumoniae R6
guuucaucuacaaccucaaaa

SEQ ID NO: 2171054 - RNA, 22 nt, Streptococcus pneumoniae R6
guuucauguaagaguucuuccc

SEQ ID NO: 2171055 - RNA, 21 nt, Streptococcus pneumoniae R6
guuucauccacaaccucaaaa

SEQ ID NO: 2171056 - RNA, 21 nt, Streptococcus pneumoniae R6
aaauaucgaugcccucuucuu

SEQ ID NO: 2171057 - RNA, 22 nt, Streptococcus pneumoniae R6
aaauaucgaugcccucuucuuu

SEQ ID NO: 2171058 - RNA, 18 nt, Streptococcus pneumoniae R6
guuucaggaaguuuuuuc

SEQ ID NO: 2171059 - RNA, 20 nt, Streptococcus pneumoniae R6
guuucagccacuauuuuauc

SEQ ID NO: 2171060 - RNA, 14 nt, Streptococcus pneumoniae R6
aaauaugaacaaau

SEQ ID NO: 2171061 - RNA, 17 nt, Streptococcus pneumoniae R6
aaauaugaucgauuuau

SEQ ID NO: 2171062 - RNA, 18 nt, Streptococcus pneumoniae R6
aaauaugcauaauuucca

SEQ ID NO: 2171063 - RNA, 23 nt, Streptococcus pneumoniae R6
aaauaugcuauugaaaggaaaau

SEQ ID NO: 2171064 - RNA, 19 nt, Streptococcus pneumoniae R6
aaauaugauggaagacuga

SEQ ID NO: 2171065 - RNA, 21 nt, Streptococcus pneumoniae R6
aaauaucugcacucucauuca

SEQ ID NO: 2171066 - RNA, 19 nt, Streptococcus pneumoniae R6
guuucaaucguuucuggca

SEQ ID NO: 2171067 - RNA, 14 nt, Streptococcus pneumoniae R6
guuucaaaugaaau

SEQ ID NO: 2171068 - RNA, 18 nt, Streptococcus pneumoniae R6
guuucaaaugaaauauuu

SEQ ID NO: 2171069 - RNA, 20 nt, Streptococcus pneumoniae R6
guuucaaaugaaauauuuuu

SEQ ID NO: 2171070 - RNA, 17 nt, Streptococcus pneumoniae R6
guuuaucccagagcuau

SEQ ID NO: 2171071 - RNA, 18 nt, Streptococcus pneumoniae R6
guuuaucuagaauuucuu

SEQ ID NO: 2171072 - RNA, 17 nt, Streptococcus pneumoniae R6
guugucgcuugagagaa

SEQ ID NO: 2171073 - RNA, 23 nt, Streptococcus pneumoniae R6
guuuaauccauggaauaccaaua

SEQ ID NO: 2171074 - RNA, 15 nt, Streptococcus pneumoniae R6
guuuaaucaaaauaa

SEQ ID NO: 2171075 - RNA, 14 nt, Streptococcus pneumoniae R6
guugcuucaucucc

SEQ ID NO: 2171076 - RNA, 21 nt, Streptococcus pneumoniae R6
guugcugucguagucuaggau

SEQ ID NO: 2171077 - RNA, 13 nt, Streptococcus pneumoniae R6
guugcucuuaucu

SEQ ID NO: 2171078 - RNA, 15 nt, Streptococcus pneumoniae R6
guugcuuuucuucaa

SEQ ID NO: 2171079 - RNA, 16 nt, Streptococcus pneumoniae R6
guuggaaguagugaaa

SEQ ID NO: 2171080 - RNA, 13 nt, Streptococcus pneumoniae R6
guuggucucccaa

SEQ ID NO: 2171081 - RNA, 16 nt, Streptococcus pneumoniae R6
guugucaaaccacaac

SEQ ID NO: 2171082 - RNA, 15 nt, Streptococcus pneumoniae R6
guugguuaaaaguug

SEQ ID NO: 2171083 - RNA, 12 nt, Streptococcus pneumoniae R6
guucuaaauuca

SEQ ID NO: 2171084 - RNA, 18 nt, Streptococcus pneumoniae R6
guucuaagguuucaaaac

SEQ ID NO: 2171085 - RNA, 23 nt, Streptococcus pneumoniae R6
guucuacaaaucccaugacaauc

SEQ ID NO: 2171086 - RNA, 21 nt, Streptococcus pneumoniae R6
guucucaucuuauuucaaucu

SEQ ID NO: 2171087 - RNA, 13 nt, Streptococcus pneumoniae R6
guucuaugaguau

SEQ ID NO: 2171088 - RNA, 18 nt, Streptococcus pneumoniae R6
guucuauggcuuguucaa

SEQ ID NO: 2171089 - RNA, 15 nt, Streptococcus pneumoniae R6
guucuauaaaauaua

SEQ ID NO: 2171090 - RNA, 21 nt, Streptococcus pneumoniae R6
guucuauaaaauauaguagau

SEQ ID NO: 2171091 - RNA, 16 nt, Streptococcus pneumoniae R6
guucuauagcagccuc

SEQ ID NO: 2171092 - RNA, 19 nt, Streptococcus pneumoniae R6
guucuauccacaaccucaa

SEQ ID NO: 2171093 - RNA, 20 nt, Streptococcus pneumoniae R6
guucuauccacaaccucaaa

SEQ ID NO: 2171094 - RNA, 21 nt, Streptococcus pneumoniae R6
guucuauccacaaccucaaaa

SEQ ID NO: 2171095 - RNA, 16 nt, Streptococcus pneumoniae R6
guucuaucugcaaccu

SEQ ID NO: 2171096 - RNA, 19 nt, Streptococcus pneumoniae R6
guucuaucugcaaccucaa

SEQ ID NO: 2171097 - RNA, 21 nt, Streptococcus pneumoniae R6
guucuaucugcaaccucaaaa

SEQ ID NO: 2171098 - RNA, 19 nt, Streptococcus pneumoniae R6
guucuaucugcaaccuuaa

SEQ ID NO: 2171099 - RNA, 20 nt, Streptococcus pneumoniae R6
guucuaucugccaccucaaa

SEQ ID NO: 2171100 - RNA, 17 nt, Streptococcus pneumoniae R6
guugagcauacugcccu

SEQ ID NO: 2171101 - RNA, 17 nt, Streptococcus pneumoniae R6
guucuccggcuuucaca

SEQ ID NO: 2171102 - RNA, 19 nt, Streptococcus pneumoniae R6
guugagcgaaaucugucua

SEQ ID NO: 2171103 - RNA, 16 nt, Streptococcus pneumoniae R6
guugcaaguuuuagau

SEQ ID NO: 2171104 - RNA, 16 nt, Streptococcus pneumoniae R6
guugcaccaagucaua

SEQ ID NO: 2171105 - RNA, 16 nt, Streptococcus pneumoniae R6
guugauaaucuuaucu

SEQ ID NO: 2171106 - RNA, 18 nt, Streptococcus pneumoniae R6
guugccuaaaacuccaac

SEQ ID NO: 2171107 - RNA, 14 nt, Streptococcus pneumoniae R6
guuaaucucuccuu

SEQ ID NO: 2171108 - RNA, 14 nt, Streptococcus pneumoniae R6
guuaacuuuuccag

SEQ ID NO: 2171109 - RNA, 21 nt, Streptococcus pneumoniae R6
guuaaaaucaguucuuuaaag

SEQ ID NO: 2171110 - RNA, 20 nt, Streptococcus pneumoniae R6
guuaaaaucuuuuacuucug

SEQ ID NO: 2171111 - RNA, 18 nt, Streptococcus pneumoniae R6
guuaaaacaaagaaaaag

SEQ ID NO: 2171112 - RNA, 11 nt, Streptococcus pneumoniae R6
guuaaaaaaac

SEQ ID NO: 2171113 - RNA, 17 nt, Streptococcus pneumoniae R6
guguugacaagugaaag

SEQ ID NO: 2171114 - RNA, 20 nt, Streptococcus pneumoniae R6
guuaugcaacuuuuuuaaaa

SEQ ID NO: 2171115 - RNA, 18 nt, Streptococcus pneumoniae R6
guuaugaaacuauguacg

SEQ ID NO: 2171116 - RNA, 16 nt, Streptococcus pneumoniae R6
guuaugaauaacuuca

SEQ ID NO: 2171117 - RNA, 19 nt, Streptococcus pneumoniae R6
guuaugaauaacuucaaua

SEQ ID NO: 2171118 - RNA, 17 nt, Streptococcus pneumoniae R6
guuauagaguguuaucu

SEQ ID NO: 2171119 - RNA, 14 nt, Streptococcus pneumoniae R6
guuagucaaaaaga

SEQ ID NO: 2171120 - RNA, 18 nt, Streptococcus pneumoniae R6
guuauaccaaaaaaacuc

SEQ ID NO: 2171121 - RNA, 18 nt, Streptococcus pneumoniae R6
guuaggugaauuagugaa

SEQ ID NO: 2171122 - RNA, 16 nt, Streptococcus pneumoniae R6
guuagucauucccucc

SEQ ID NO: 2171123 - RNA, 19 nt, Streptococcus pneumoniae R6
guuauaucugcuacagaua

SEQ ID NO: 2171124 - RNA, 22 nt, Streptococcus pneumoniae R6
guuauagauucaacgaacuaua

SEQ ID NO: 2171125 - RNA, 19 nt, Streptococcus pneumoniae R6
guuauagauucaauauauu

SEQ ID NO: 2171126 - RNA, 15 nt, Streptococcus pneumoniae R6
guuauauugacagaa

SEQ ID NO: 2171127 - RNA, 19 nt, Streptococcus pneumoniae R6
guuaucaaaucgaucuguu

SEQ ID NO: 2171128 - RNA, 24 nt, Streptococcus pneumoniae R6
guuacucuauuguagaguggcuuu

SEQ ID NO: 2171129 - RNA, 22 nt, Streptococcus pneumoniae R6
guuagaaaaaguucaauuucac

SEQ ID NO: 2171130 - RNA, 14 nt, Streptococcus pneumoniae R6
guuagaaaaaugca

SEQ ID NO: 2171131 - RNA, 22 nt, Streptococcus pneumoniae R6
guuagaagcguagagguauuua

SEQ ID NO: 2171132 - RNA, 12 nt, Streptococcus pneumoniae R6
guuacugacuuc

SEQ ID NO: 2171133 - RNA, 15 nt, Streptococcus pneumoniae R6
guuaggcauauaaug

SEQ ID NO: 2171134 - RNA, 19 nt, Streptococcus pneumoniae R6
guuaggauguaggauuguu

SEQ ID NO: 2171135 - RNA, 22 nt, Streptococcus pneumoniae R6
guuaggaacgauguuugcagca

SEQ ID NO: 2171136 - RNA, 14 nt, Streptococcus pneumoniae R6
guuagcugauuuuu

SEQ ID NO: 2171137 - RNA, 21 nt, Streptococcus pneumoniae R6
guuagaauaaggaaaacauua

SEQ ID NO: 2171138 - RNA, 20 nt, Streptococcus pneumoniae R6
guucacguaaauugcccuug

SEQ ID NO: 2171139 - RNA, 16 nt, Streptococcus pneumoniae R6
guucaccaauguucaa

SEQ ID NO: 2171140 - RNA, 21 nt, Streptococcus pneumoniae R6
guucaccaauguucaagacau

SEQ ID NO: 2171141 - RNA, 15 nt, Streptococcus pneumoniae R6
guucaucuucaaaau

SEQ ID NO: 2171142 - RNA, 19 nt, Streptococcus pneumoniae R6
guucaucuucaaaaucaaa

SEQ ID NO: 2171143 - RNA, 18 nt, Streptococcus pneumoniae R6
guucauccagcaggagaa

SEQ ID NO: 2171144 - RNA, 18 nt, Streptococcus pneumoniae R6
guucagggguaacgucuu

SEQ ID NO: 2171145 - RNA, 14 nt, Streptococcus pneumoniae R6
guucaucauuaaca

SEQ ID NO: 2171146 - RNA, 23 nt, Streptococcus pneumoniae R6
guuccagucccaaguuccaaacu

SEQ ID NO: 2171147 - RNA, 18 nt, Streptococcus pneumoniae R6
guucuaaaacuccuauuc

SEQ ID NO: 2171148 - RNA, 13 nt, Streptococcus pneumoniae R6
guucgggauaaaa

SEQ ID NO: 2171149 - RNA, 16 nt, Streptococcus pneumoniae R6
guucgggauaaaauag

SEQ ID NO: 2171150 - RNA, 22 nt, Streptococcus pneumoniae R6
guucgggcacuucuuuuuguuc

SEQ ID NO: 2171151 - RNA, 17 nt, Streptococcus pneumoniae R6
guucgcaucuuauuuca

SEQ ID NO: 2171152 - RNA, 19 nt, Streptococcus pneumoniae R6
guucgcaucuuauuucaau

SEQ ID NO: 2171153 - RNA, 17 nt, Streptococcus pneumoniae R6
guuccuuauucugaaag

SEQ ID NO: 2171154 - RNA, 14 nt, Streptococcus pneumoniae R6
guuccugucuuauu

SEQ ID NO: 2171155 - RNA, 19 nt, Streptococcus pneumoniae R6
guuccgcuaacguuuuugu

SEQ ID NO: 2171156 - RNA, 21 nt, Streptococcus pneumoniae R6
guuccgcuaacguuuuuguuu

SEQ ID NO: 2171157 - RNA, 20 nt, Streptococcus pneumoniae R6
guuccauaccaucaaagacc

SEQ ID NO: 2171158 - RNA, 12 nt, Streptococcus pneumoniae R6
guuccaguuugg

SEQ ID NO: 2171159 - RNA, 20 nt, Streptococcus pneumoniae R6
guuccauccacaaccuuaaa

SEQ ID NO: 2171160 - RNA, 22 nt, Streptococcus pneumoniae R6
guuccauccacaaccuuaaaac

SEQ ID NO: 2171161 - RNA, 14 nt, Streptococcus pneumoniae R6
guuccauuuaacaa

SEQ ID NO: 2171162 - RNA, 20 nt, Streptococcus pneumoniae R6
guguacuauucuaguuucaa

SEQ ID NO: 2171163 - RNA, 19 nt, Streptococcus pneumoniae R6
guguacucaacagaagaau

SEQ ID NO: 2171164 - RNA, 13 nt, Streptococcus pneumoniae R6
gugggucaucaag

SEQ ID NO: 2171165 - RNA, 16 nt, Streptococcus pneumoniae R6
gugugaaauuugugau

SEQ ID NO: 2171166 - RNA, 14 nt, Streptococcus pneumoniae R6
gugugacagguuug

SEQ ID NO: 2171167 - RNA, 16 nt, Streptococcus pneumoniae R6
gugugcgucgaagguu

SEQ ID NO: 2171168 - RNA, 16 nt, Streptococcus pneumoniae R6
gugugacccaagauag

SEQ ID NO: 2171169 - RNA, 24 nt, Streptococcus pneumoniae R6
aaauaucauuaaguaaucucugau

SEQ ID NO: 2171170 - RNA, 12 nt, Streptococcus pneumoniae R6
guguuaaaucau

SEQ ID NO: 2171171 - RNA, 11 nt, Streptococcus pneumoniae R6
guguucaaaaa

SEQ ID NO: 2171172 - RNA, 14 nt, Streptococcus pneumoniae R6
guguucaaaaaccu

SEQ ID NO: 2171173 - RNA, 16 nt, Streptococcus pneumoniae R6
guguucacgaaagcaa

SEQ ID NO: 2171174 - RNA, 14 nt, Streptococcus pneumoniae R6
guguucuaaaauaa

SEQ ID NO: 2171175 - RNA, 20 nt, Streptococcus pneumoniae R6
guguucuaaaauaaguucug

SEQ ID NO: 2171176 - RNA, 13 nt, Streptococcus pneumoniae R6
guguucugucaug

SEQ ID NO: 2171177 - RNA, 20 nt, Streptococcus pneumoniae R6
guguucugucuuguaaaaaa

SEQ ID NO: 2171178 - RNA, 14 nt, Streptococcus pneumoniae R6
aaauauaaucgauu

SEQ ID NO: 2171179 - RNA, 15 nt, Streptococcus pneumoniae R6
gugcuggcauguccu

SEQ ID NO: 2171180 - RNA, 17 nt, Streptococcus pneumoniae R6
gugcuguagagagauaa

SEQ ID NO: 2171181 - RNA, 11 nt, Streptococcus pneumoniae R6
guggagaaagu

SEQ ID NO: 2171182 - RNA, 13 nt, Streptococcus pneumoniae R6
gugggaauguuug

SEQ ID NO: 2171183 - RNA, 18 nt, Streptococcus pneumoniae R6
gugggcuuuuuucuaucc

SEQ ID NO: 2171184 - RNA, 13 nt, Streptococcus pneumoniae R6
ucagcauggcccg

SEQ ID NO: 2171185 - RNA, 15 nt, Streptococcus pneumoniae R6
ucagcauauuuccca

SEQ ID NO: 2171186 - RNA, 21 nt, Streptococcus pneumoniae R6
ucagcaguaaucacugcagca

SEQ ID NO: 2171187 - RNA, 17 nt, Streptococcus pneumoniae R6
ucagcagucguuccuuu

SEQ ID NO: 2171188 - RNA, 18 nt, Streptococcus pneumoniae R6
ucagcguaauagucuaau

SEQ ID NO: 2171189 - RNA, 17 nt, Streptococcus pneumoniae R6
ucagcgauuucuucacg

SEQ ID NO: 2171190 - RNA, 21 nt, Streptococcus pneumoniae R6
ucagccgacuauacuccguua

SEQ ID NO: 2171191 - RNA, 15 nt, Streptococcus pneumoniae R6
ucaggacgaacgcug

SEQ ID NO: 2171192 - RNA, 23 nt, Streptococcus pneumoniae R6
ucaggagcacuugaugaaaaaaa

SEQ ID NO: 2171193 - RNA, 19 nt, Streptococcus pneumoniae R6
ucagcucucugauuuucag

SEQ ID NO: 2171194 - RNA, 18 nt, Streptococcus pneumoniae R6
aaaucuagucaucagaaa

SEQ ID NO: 2171195 - RNA, 19 nt, Streptococcus pneumoniae R6
aaaucuagucaucagaaaa

SEQ ID NO: 2171196 - RNA, 22 nt, Streptococcus pneumoniae R6
aaaucuacuaucucuacauucc

SEQ ID NO: 2171197 - RNA, 16 nt, Streptococcus pneumoniae R6
aaaucucauuugauga

SEQ ID NO: 2171198 - RNA, 17 nt, Streptococcus pneumoniae R6
aaaucucugcaaaccac

SEQ ID NO: 2171199 - RNA, 23 nt, Streptococcus pneumoniae R6
ucaggccuacaauuggaaauaac

SEQ ID NO: 2171200 - RNA, 20 nt, Streptococcus pneumoniae R6
ucagguauugaaaaaacuug

SEQ ID NO: 2171201 - RNA, 20 nt, Streptococcus pneumoniae R6
ucagucugaccaccauuuuu

SEQ ID NO: 2171202 - RNA, 22 nt, Streptococcus pneumoniae R6
ucaguaugcuauaucuuauuuu

SEQ ID NO: 2171203 - RNA, 15 nt, Streptococcus pneumoniae R6
ucaguauauugaaau

SEQ ID NO: 2171204 - RNA, 14 nt, Streptococcus pneumoniae R6
ucagugacuugugu

SEQ ID NO: 2171205 - RNA, 19 nt, Streptococcus pneumoniae R6
ucagugggcuauuccagcu

SEQ ID NO: 2171206 - RNA, 22 nt, Streptococcus pneumoniae R6
ucagcaaaacgcugcucaaaau

SEQ ID NO: 2171207 - RNA, 17 nt, Streptococcus pneumoniae R6
aaaucuaaucauucuga

SEQ ID NO: 2171208 - RNA, 17 nt, Streptococcus pneumoniae R6
aaaucguaaaaaagucu

SEQ ID NO: 2171209 - RNA, 14 nt, Streptococcus pneumoniae R6
aaaucguucaggac

SEQ ID NO: 2171210 - RNA, 16 nt, Streptococcus pneumoniae R6
ucagauagguuuuucg

SEQ ID NO: 2171211 - RNA, 12 nt, Streptococcus pneumoniae R6
ucagaugacugg

SEQ ID NO: 2171212 - RNA, 22 nt, Streptococcus pneumoniae R6
ucagaugacuggaaacuuuuuu

SEQ ID NO: 2171213 - RNA, 23 nt, Streptococcus pneumoniae R6
ucagaugaugagcuggaagaauu

SEQ ID NO: 2171214 - RNA, 12 nt, Streptococcus pneumoniae R6
ucagauuguccu

SEQ ID NO: 2171215 - RNA, 13 nt, Streptococcus pneumoniae R6
ucagauucugaca

SEQ ID NO: 2171216 - RNA, 15 nt, Streptococcus pneumoniae R6
ucagauucaucauuu

SEQ ID NO: 2171217 - RNA, 17 nt, Streptococcus pneumoniae R6
ucagauucaucauuuau

SEQ ID NO: 2171218 - RNA, 14 nt, Streptococcus pneumoniae R6
ucagauuacaucuc

SEQ ID NO: 2171219 - RNA, 16 nt, Streptococcus pneumoniae R6
ucagaauaagagguug

SEQ ID NO: 2171220 - RNA, 17 nt, Streptococcus pneumoniae R6
ucagaauccuuauuuuc

SEQ ID NO: 2171221 - RNA, 13 nt, Streptococcus pneumoniae R6
ucagaauuuucuu

SEQ ID NO: 2171222 - RNA, 14 nt, Streptococcus pneumoniae R6
ucagacacaccacu

SEQ ID NO: 2171223 - RNA, 16 nt, Streptococcus pneumoniae R6
ucagagcgauaaaaau

SEQ ID NO: 2171224 - RNA, 18 nt, Streptococcus pneumoniae R6
ucagagggcuuuuucauu

SEQ ID NO: 2171225 - RNA, 15 nt, Streptococcus pneumoniae R6
ucagaguuuugaaaa

SEQ ID NO: 2171226 - RNA, 19 nt, Streptococcus pneumoniae R6
ucagaaaaacgcauaaaau

SEQ ID NO: 2171227 - RNA, 12 nt, Streptococcus pneumoniae R6
ucagaaaaaagg

SEQ ID NO: 2171228 - RNA, 15 nt, Streptococcus pneumoniae R6
ucagaaaauaaaauu

SEQ ID NO: 2171229 - RNA, 17 nt, Streptococcus pneumoniae R6
ucacuuuuuguuuaaua

SEQ ID NO: 2171230 - RNA, 13 nt, Streptococcus pneumoniae R6
ucagaacacuucc

SEQ ID NO: 2171231 - RNA, 20 nt, Streptococcus pneumoniae R6
ucagaacacuuccaauaaug

SEQ ID NO: 2171232 - RNA, 22 nt, Streptococcus pneumoniae R6
ucagaacauuacccauagauuu

SEQ ID NO: 2171233 - RNA, 13 nt, Streptococcus pneumoniae R6
ucacuuggaaaaa

SEQ ID NO: 2171234 - RNA, 14 nt, Streptococcus pneumoniae R6
ucacuuggaaaaau

SEQ ID NO: 2171235 - RNA, 17 nt, Streptococcus pneumoniae R6
ucacuugaccuguuuuc

SEQ ID NO: 2171236 - RNA, 19 nt, Streptococcus pneumoniae R6
ucacuuuauaguuuucacu

SEQ ID NO: 2171237 - RNA, 19 nt, Streptococcus pneumoniae R6
ucacuuguauccuccucua

SEQ ID NO: 2171238 - RNA, 15 nt, Streptococcus pneumoniae R6
ucacuaucgaaaaau

SEQ ID NO: 2171239 - RNA, 17 nt, Streptococcus pneumoniae R6
ucacuaucgaaaaauau

SEQ ID NO: 2171240 - RNA, 23 nt, Streptococcus pneumoniae R6
ucacuggaaacauugauaauagg

SEQ ID NO: 2171241 - RNA, 14 nt, Streptococcus pneumoniae R6
ucacuggucacauu

SEQ ID NO: 2171242 - RNA, 13 nt, Streptococcus pneumoniae R6
ucacuagaaaaug

SEQ ID NO: 2171243 - RNA, 21 nt, Streptococcus pneumoniae R6
ucacuaguauucaucuuauca

SEQ ID NO: 2171244 - RNA, 23 nt, Streptococcus pneumoniae R6
ucacuaguuuuaggacauaaaua

SEQ ID NO: 2171245 - RNA, 15 nt, Streptococcus pneumoniae R6
ucacggcuaauacca

SEQ ID NO: 2171246 - RNA, 13 nt, Streptococcus pneumoniae R6
ucacgcuuuucuu

SEQ ID NO: 2171247 - RNA, 15 nt, Streptococcus pneumoniae R6
ucacgcauaagcaau

SEQ ID NO: 2171248 - RNA, 15 nt, Streptococcus pneumoniae R6
ucaaagcgauaaaaa

SEQ ID NO: 2171249 - RNA, 16 nt, Streptococcus pneumoniae R6
ucaaagcgauaaaaau

SEQ ID NO: 2171250 - RNA, 17 nt, Streptococcus pneumoniae R6
ucaaagcgauaaaaauc

SEQ ID NO: 2171251 - RNA, 17 nt, Streptococcus pneumoniae R6
ucaaagcgggauuuaaa

SEQ ID NO: 2171252 - RNA, 18 nt, Streptococcus pneumoniae R6
ucaaagcgggauuuaaaa

SEQ ID NO: 2171253 - RNA, 20 nt, Streptococcus pneumoniae R6
ucaaagcauuugccagaaaa

SEQ ID NO: 2171254 - RNA, 22 nt, Streptococcus pneumoniae R6
ucaaagccaaucaaaaaaucuc

SEQ ID NO: 2171255 - RNA, 13 nt, Streptococcus pneumoniae R6
ucaaaucaaaaua

SEQ ID NO: 2171256 - RNA, 16 nt, Streptococcus pneumoniae R6
ucaaaucaaaauauag

SEQ ID NO: 2171257 - RNA, 15 nt, Streptococcus pneumoniae R6
ucaaagcuacuuuuu

SEQ ID NO: 2171258 - RNA, 19 nt, Streptococcus pneumoniae R6
ucaaagcuacuuuuuuacc

SEQ ID NO: 2171259 - RNA, 20 nt, Streptococcus pneumoniae R6
ucaaauuaauuuauagaaaa

SEQ ID NO: 2171260 - RNA, 21 nt, Streptococcus pneumoniae R6
ucaaauuaauuuauagaaaaa

SEQ ID NO: 2171261 - RNA, 22 nt, Streptococcus pneumoniae R6
ucaaauuaauuuauagaaaaau

SEQ ID NO: 2171262 - RNA, 14 nt, Streptococcus pneumoniae R6
ucaaauucauucgu

SEQ ID NO: 2171263 - RNA, 17 nt, Streptococcus pneumoniae R6
ucaaauucauucguaau

SEQ ID NO: 2171264 - RNA, 19 nt, Streptococcus pneumoniae R6
ucaaauguauuugaaaggg

SEQ ID NO: 2171265 - RNA, 15 nt, Streptococcus pneumoniae R6
ucaaaugucuuggca

SEQ ID NO: 2171266 - RNA, 23 nt, Streptococcus pneumoniae R6
ucaaaugagauuugcaucaaucu

SEQ ID NO: 2171267 - RNA, 23 nt, Streptococcus pneumoniae R6
ucaaaugacuaagcccaaagaua

SEQ ID NO: 2171268 - RNA, 14 nt, Streptococcus pneumoniae R6
ucaaauuucccauc

SEQ ID NO: 2171269 - RNA, 11 nt, Streptococcus pneumoniae R6
ucaaauugaua

SEQ ID NO: 2171270 - RNA, 20 nt, Streptococcus pneumoniae R6
ucaaauugaaaauucacaaa

SEQ ID NO: 2171271 - RNA, 22 nt, Streptococcus pneumoniae R6
ucaaauugaaaauucacaaaau

SEQ ID NO: 2171272 - RNA, 14 nt, Streptococcus pneumoniae R6
ucaaauugaaauaa

SEQ ID NO: 2171273 - RNA, 15 nt, Streptococcus pneumoniae R6
ucaaauugaaauaag

SEQ ID NO: 2171274 - RNA, 16 nt, Streptococcus pneumoniae R6
ucaaauugaaauaaga

SEQ ID NO: 2171275 - RNA, 20 nt, Streptococcus pneumoniae R6
ucaaauuuagcuguaucauu

SEQ ID NO: 2171276 - RNA, 22 nt, Streptococcus pneumoniae R6
ucaaauuuagcuguaucauucu

SEQ ID NO: 2171277 - RNA, 12 nt, Streptococcus pneumoniae R6
ucaaacaaaagc

SEQ ID NO: 2171278 - RNA, 18 nt, Streptococcus pneumoniae R6
ucaaacaagaccucaaua

SEQ ID NO: 2171279 - RNA, 12 nt, Streptococcus pneumoniae R6
ucaaacaaugug

SEQ ID NO: 2171280 - RNA, 13 nt, Streptococcus pneumoniae R6
ucaaacaaugugc

SEQ ID NO: 2171281 - RNA, 14 nt, Streptococcus pneumoniae R6
ucaaacaauugacu

SEQ ID NO: 2171282 - RNA, 11 nt, Streptococcus pneumoniae R6
ucaaaccacaa

SEQ ID NO: 2171283 - RNA, 21 nt, Streptococcus pneumoniae R6
ucaaaccagcaccagacauuu

SEQ ID NO: 2171284 - RNA, 10 nt, Streptococcus pneumoniae R6
ucaaacauug

SEQ ID NO: 2171285 - RNA, 13 nt, Streptococcus pneumoniae R6
ucaaacauuguga

SEQ ID NO: 2171286 - RNA, 15 nt, Streptococcus pneumoniae R6
ucaaacauugugagg

SEQ ID NO: 2171287 - RNA, 21 nt, Streptococcus pneumoniae R6
ucaaaccaugagguaagagaa

SEQ ID NO: 2171288 - RNA, 22 nt, Streptococcus pneumoniae R6
ucaaacuacgucagcuuccauc

SEQ ID NO: 2171289 - RNA, 16 nt, Streptococcus pneumoniae R6
ucaaacucaaauuuac

SEQ ID NO: 2171290 - RNA, 18 nt, Streptococcus pneumoniae R6
ucaaacucaauuuaauac

SEQ ID NO: 2171291 - RNA, 21 nt, Streptococcus pneumoniae R6
ucaaacguuuaacuguuccuu

SEQ ID NO: 2171292 - RNA, 22 nt, Streptococcus pneumoniae R6
ucaaaaucuucuggcacagaaa

SEQ ID NO: 2171293 - RNA, 20 nt, Streptococcus pneumoniae R6
ucaaaaugacaauuuuucca

SEQ ID NO: 2171294 - RNA, 14 nt, Streptococcus pneumoniae R6
ucaaaauucugucu

SEQ ID NO: 2171295 - RNA, 21 nt, Streptococcus pneumoniae R6
ucaaaauucuuugaaaucaga

SEQ ID NO: 2171296 - RNA, 17 nt, Streptococcus pneumoniae R6
ucaaaagaaagcauaga

SEQ ID NO: 2171297 - RNA, 18 nt, Streptococcus pneumoniae R6
ucaaaagcuuguuuaaaa

SEQ ID NO: 2171298 - RNA, 19 nt, Streptococcus pneumoniae R6
ucaaaagcuuguuuaaaau

SEQ ID NO: 2171299 - RNA, 22 nt, Streptococcus pneumoniae R6
ucaaaagcuuguuuaaaaucuc

SEQ ID NO: 2171300 - RNA, 20 nt, Streptococcus pneumoniae R6
ucaaaagauguuagaaaaag

SEQ ID NO: 2171301 - RNA, 18 nt, Streptococcus pneumoniae R6
uauuuaauguuuucccuu

SEQ ID NO: 2171302 - RNA, 18 nt, Streptococcus pneumoniae R6
uauuuaaucauuuaauaa

SEQ ID NO: 2171303 - RNA, 15 nt, Streptococcus pneumoniae R6
ucaacccacuacagu

SEQ ID NO: 2171304 - RNA, 22 nt, Streptococcus pneumoniae R6
ucaacccacuacaguugacaaa

SEQ ID NO: 2171305 - RNA, 23 nt, Streptococcus pneumoniae R6
ucaacccacuacaguugacaaag

SEQ ID NO: 2171306 - RNA, 21 nt, Streptococcus pneumoniae R6
ucaaccuuaccgaugauguuc

SEQ ID NO: 2171307 - RNA, 14 nt, Streptococcus pneumoniae R6
ucaaccuuccacuu

SEQ ID NO: 2171308 - RNA, 18 nt, Streptococcus pneumoniae R6
ucaaccugaaucuccuca

SEQ ID NO: 2171309 - RNA, 20 nt, Streptococcus pneumoniae R6
ucaaccucgauaugaauaau

SEQ ID NO: 2171310 - RNA, 13 nt, Streptococcus pneumoniae R6
ucaacuccuuacu

SEQ ID NO: 2171311 - RNA, 18 nt, Streptococcus pneumoniae R6
ucaacucagcauuuucuu

SEQ ID NO: 2171312 - RNA, 14 nt, Streptococcus pneumoniae R6
ucaacucaagaauu

SEQ ID NO: 2171313 - RNA, 20 nt, Streptococcus pneumoniae R6
ucaacagcuccuucaaguuc

SEQ ID NO: 2171314 - RNA, 17 nt, Streptococcus pneumoniae R6
ucaacauuaaagacaau

SEQ ID NO: 2171315 - RNA, 21 nt, Streptococcus pneumoniae R6
ucaacaugaccaccaggaaaa

SEQ ID NO: 2171316 - RNA, 17 nt, Streptococcus pneumoniae R6
ucaacaugagaauacaa

SEQ ID NO: 2171317 - RNA, 16 nt, Streptococcus pneumoniae R6
ucaaccacuuaacaac

SEQ ID NO: 2171318 - RNA, 13 nt, Streptococcus pneumoniae R6
ucaaccacaaaaa

SEQ ID NO: 2171319 - RNA, 16 nt, Streptococcus pneumoniae R6
ucaaccaacuuuuccu

SEQ ID NO: 2171320 - RNA, 16 nt, Streptococcus pneumoniae R6
ucaacaccgacuuggu

SEQ ID NO: 2171321 - RNA, 17 nt, Streptococcus pneumoniae R6
ucaacaaaccuuguucu

SEQ ID NO: 2171322 - RNA, 12 nt, Streptococcus pneumoniae R6
ucaauuucacua

SEQ ID NO: 2171323 - RNA, 16 nt, Streptococcus pneumoniae R6
ucaauuucaggagaaa

SEQ ID NO: 2171324 - RNA, 17 nt, Streptococcus pneumoniae R6
ucacaaagaacaugaaa

SEQ ID NO: 2171325 - RNA, 17 nt, Streptococcus pneumoniae R6
ucacagaguauuaaauu

SEQ ID NO: 2171326 - RNA, 15 nt, Streptococcus pneumoniae R6
aaaucgauagccaac

SEQ ID NO: 2171327 - RNA, 14 nt, Streptococcus pneumoniae R6
aaaucgaucaggac

SEQ ID NO: 2171328 - RNA, 16 nt, Streptococcus pneumoniae R6
aaaucgaucauauuua

SEQ ID NO: 2171329 - RNA, 16 nt, Streptococcus pneumoniae R6
aaaucgauaaagaaga

SEQ ID NO: 2171330 - RNA, 16 nt, Streptococcus pneumoniae R6
aaaucgaucuguucuu

SEQ ID NO: 2171331 - RNA, 16 nt, Streptococcus pneumoniae R6
aaaucgauuucuaaca

SEQ ID NO: 2171332 - RNA, 20 nt, Streptococcus pneumoniae R6
aaaucgauuucuaacaaugu

SEQ ID NO: 2171333 - RNA, 23 nt, Streptococcus pneumoniae R6
aaaucgauuucuaacaauguuuu

SEQ ID NO: 2171334 - RNA, 15 nt, Streptococcus pneumoniae R6
aaaucgauuugacug

SEQ ID NO: 2171335 - RNA, 18 nt, Streptococcus pneumoniae R6
aaaucgcuauaaauaagg

SEQ ID NO: 2171336 - RNA, 12 nt, Streptococcus pneumoniae R6
ucaccaucaagg

SEQ ID NO: 2171337 - RNA, 23 nt, Streptococcus pneumoniae R6
ucaccaucuaagguauauucaaa

SEQ ID NO: 2171338 - RNA, 21 nt, Streptococcus pneumoniae R6
ucaccaggcauuauuucacuu

SEQ ID NO: 2171339 - RNA, 14 nt, Streptococcus pneumoniae R6
ucaccaggagccaa

SEQ ID NO: 2171340 - RNA, 12 nt, Streptococcus pneumoniae R6
ucacaucugcua

SEQ ID NO: 2171341 - RNA, 22 nt, Streptococcus pneumoniae R6
ucacaucuuauuucaauucacu

SEQ ID NO: 2171342 - RNA, 20 nt, Streptococcus pneumoniae R6
ucacaucuucagacacacca

SEQ ID NO: 2171343 - RNA, 14 nt, Streptococcus pneumoniae R6
ucacauccucuaca

SEQ ID NO: 2171344 - RNA, 16 nt, Streptococcus pneumoniae R6
ucacauccucuacaua

SEQ ID NO: 2171345 - RNA, 21 nt, Streptococcus pneumoniae R6
ucaaugagucagggaaaaaac

SEQ ID NO: 2171346 - RNA, 15 nt, Streptococcus pneumoniae R6
ucaaugauuugaaca

SEQ ID NO: 2171347 - RNA, 18 nt, Streptococcus pneumoniae R6
ucaaugaauccgaaaaau

SEQ ID NO: 2171348 - RNA, 16 nt, Streptococcus pneumoniae R6
ucaaucaugagaauau

SEQ ID NO: 2171349 - RNA, 14 nt, Streptococcus pneumoniae R6
ucaauaucuuuauu

SEQ ID NO: 2171350 - RNA, 19 nt, Streptococcus pneumoniae R6
ucaaucauaagauuaauuu

SEQ ID NO: 2171351 - RNA, 17 nt, Streptococcus pneumoniae R6
ucaaucagauagguuuu

SEQ ID NO: 2171352 - RNA, 16 nt, Streptococcus pneumoniae R6
ucaaugugaccaguga

SEQ ID NO: 2171353 - RNA, 12 nt, Streptococcus pneumoniae R6
ucaauucacuau

SEQ ID NO: 2171354 - RNA, 11 nt, Streptococcus pneumoniae R6
ucaauuguaua

SEQ ID NO: 2171355 - RNA, 16 nt, Streptococcus pneumoniae R6
ucaauugguuaaaagc

SEQ ID NO: 2171356 - RNA, 15 nt, Streptococcus pneumoniae R6
ucaauuuacuauacu

SEQ ID NO: 2171357 - RNA, 14 nt, Streptococcus pneumoniae R6
ucaauugacuauau

SEQ ID NO: 2171358 - RNA, 19 nt, Streptococcus pneumoniae R6
ucaauucuuuaacaaaauc

SEQ ID NO: 2171359 - RNA, 16 nt, Streptococcus pneumoniae R6
ucaauugcaggagaaa

SEQ ID NO: 2171360 - RNA, 13 nt, Streptococcus pneumoniae R6
ucaauugauuuga

SEQ ID NO: 2171361 - RNA, 19 nt, Streptococcus pneumoniae R6
ucaauaacacgagaaacaa

SEQ ID NO: 2171362 - RNA, 16 nt, Streptococcus pneumoniae R6
ucaauaaccaucauuu

SEQ ID NO: 2171363 - RNA, 21 nt, Streptococcus pneumoniae R6
ucaauaauuucuuuuuguguu

SEQ ID NO: 2171364 - RNA, 18 nt, Streptococcus pneumoniae R6
ucaauaaguccgaaaaau

SEQ ID NO: 2171365 - RNA, 23 nt, Streptococcus pneumoniae R6
ucaaguuguuugacgucuguaau

SEQ ID NO: 2171366 - RNA, 22 nt, Streptococcus pneumoniae R6
ucaauagugagacaagcaaucu

SEQ ID NO: 2171367 - RNA, 16 nt, Streptococcus pneumoniae R6
ucaauaucuucugcuu

SEQ ID NO: 2171368 - RNA, 16 nt, Streptococcus pneumoniae R6
ucaauauagaaguagu

SEQ ID NO: 2171369 - RNA, 17 nt, Streptococcus pneumoniae R6
ucaauauagucuauaau

SEQ ID NO: 2171370 - RNA, 24 nt, Streptococcus pneumoniae R6
ucaauacgaaucaauacagaagaa

SEQ ID NO: 2171371 - RNA, 12 nt, Streptococcus pneumoniae R6
ucaauaccaggu

SEQ ID NO: 2171372 - RNA, 14 nt, Streptococcus pneumoniae R6
ucaauacagaagaa

SEQ ID NO: 2171373 - RNA, 13 nt, Streptococcus pneumoniae R6
ucaauaccaaaga

SEQ ID NO: 2171374 - RNA, 16 nt, Streptococcus pneumoniae R6
ucaauaccaaagaagu

SEQ ID NO: 2171375 - RNA, 14 nt, Streptococcus pneumoniae R6
uauuaacaauaauc

SEQ ID NO: 2171376 - RNA, 14 nt, Streptococcus pneumoniae R6
uauuaacagcaaaa

SEQ ID NO: 2171377 - RNA, 20 nt, Streptococcus pneumoniae R6
uauuaacagcuaaagcaccu

SEQ ID NO: 2171378 - RNA, 13 nt, Streptococcus pneumoniae R6
uauuaagaaaaau

SEQ ID NO: 2171379 - RNA, 16 nt, Streptococcus pneumoniae R6
uauuaagaacucuuuc

SEQ ID NO: 2171380 - RNA, 14 nt, Streptococcus pneumoniae R6
uauuaauauauaaa

SEQ ID NO: 2171381 - RNA, 15 nt, Streptococcus pneumoniae R6
uauuaauauauaaaa

SEQ ID NO: 2171382 - RNA, 16 nt, Streptococcus pneumoniae R6
uauuaauauauaaaau

SEQ ID NO: 2171383 - RNA, 16 nt, Streptococcus pneumoniae R6
uauuaaucacuaauua

SEQ ID NO: 2171384 - RNA, 14 nt, Streptococcus pneumoniae R6
uauuacaaucauag

SEQ ID NO: 2171385 - RNA, 20 nt, Streptococcus pneumoniae R6
uauuacaacaauaagagaau

SEQ ID NO: 2171386 - RNA, 14 nt, Streptococcus pneumoniae R6
uauuacauccacca

SEQ ID NO: 2171387 - RNA, 17 nt, Streptococcus pneumoniae R6
uauuauaagacuuuucc

SEQ ID NO: 2171388 - RNA, 18 nt, Streptococcus pneumoniae R6
uauuaugaaaaccaagaa

SEQ ID NO: 2171389 - RNA, 14 nt, Streptococcus pneumoniae R6
uauuaguuacauaa

SEQ ID NO: 2171390 - RNA, 20 nt, Streptococcus pneumoniae R6
uauuagggcaaauaaaaagc

SEQ ID NO: 2171391 - RNA, 15 nt, Streptococcus pneumoniae R6
uauuaguaauuucca

SEQ ID NO: 2171392 - RNA, 15 nt, Streptococcus pneumoniae R6
uauguugcgucagga

SEQ ID NO: 2171393 - RNA, 15 nt, Streptococcus pneumoniae R6
uauguuacugacuuc

SEQ ID NO: 2171394 - RNA, 23 nt, Streptococcus pneumoniae R6
uauguguuaccgguuacauauag

SEQ ID NO: 2171395 - RNA, 17 nt, Streptococcus pneumoniae R6
uauuaaaauaaguucaa

SEQ ID NO: 2171396 - RNA, 23 nt, Streptococcus pneumoniae R6
uauuaaaauaaguucaacaaauc

SEQ ID NO: 2171397 - RNA, 14 nt, Streptococcus pneumoniae R6
uauguuuuaaauaa

SEQ ID NO: 2171398 - RNA, 15 nt, Streptococcus pneumoniae R6
uauguuuuaaauaaa

SEQ ID NO: 2171399 - RNA, 18 nt, Streptococcus pneumoniae R6
uauguuuuaaauaaacuu

SEQ ID NO: 2171400 - RNA, 15 nt, Streptococcus pneumoniae R6
uaugugacugacuuc

SEQ ID NO: 2171401 - RNA, 18 nt, Streptococcus pneumoniae R6
uaugucugaauauauaau

SEQ ID NO: 2171402 - RNA, 18 nt, Streptococcus pneumoniae R6
uauguccuucaugaaauu

SEQ ID NO: 2171403 - RNA, 17 nt, Streptococcus pneumoniae R6
uaugucuagccaguauu

SEQ ID NO: 2171404 - RNA, 20 nt, Streptococcus pneumoniae R6
uaugucuagccaguauuuuu

SEQ ID NO: 2171405 - RNA, 14 nt, Streptococcus pneumoniae R6
uaugucggcuucac

SEQ ID NO: 2171406 - RNA, 18 nt, Streptococcus pneumoniae R6
uauguaaacaguaauaaa

SEQ ID NO: 2171407 - RNA, 18 nt, Streptococcus pneumoniae R6
uaugguucuggagaagca

SEQ ID NO: 2171408 - RNA, 19 nt, Streptococcus pneumoniae R6
uauguaagaagauuuuuua

SEQ ID NO: 2171409 - RNA, 20 nt, Streptococcus pneumoniae R6
uauguaugguuacugacuuc

SEQ ID NO: 2171410 - RNA, 12 nt, Streptococcus pneumoniae R6
uauguauuuaua

SEQ ID NO: 2171411 - RNA, 21 nt, Streptococcus pneumoniae R6
uauuggcuacgacugcuucug

SEQ ID NO: 2171412 - RNA, 21 nt, Streptococcus pneumoniae R6
uauuggcugccacaccaccug

SEQ ID NO: 2171413 - RNA, 14 nt, Streptococcus pneumoniae R6
uauuggaugaguuu

SEQ ID NO: 2171414 - RNA, 16 nt, Streptococcus pneumoniae R6
uauuguuuuaauauaa

SEQ ID NO: 2171415 - RNA, 17 nt, Streptococcus pneumoniae R6
uauuguugcauuaaaaa

SEQ ID NO: 2171416 - RNA, 17 nt, Streptococcus pneumoniae R6
uauuguuccuaaaacag

SEQ ID NO: 2171417 - RNA, 17 nt, Streptococcus pneumoniae R6
uauuguucuaguuuuuu

SEQ ID NO: 2171418 - RNA, 14 nt, Streptococcus pneumoniae R6
uauugaaaugaaau

SEQ ID NO: 2171419 - RNA, 18 nt, Streptococcus pneumoniae R6
aaauccgguguaagggaa

SEQ ID NO: 2171420 - RNA, 22 nt, Streptococcus pneumoniae R6
aaauccguuuuuuaaaauuguu

SEQ ID NO: 2171421 - RNA, 22 nt, Streptococcus pneumoniae R6
aaauccuagauacagugaaggc

SEQ ID NO: 2171422 - RNA, 16 nt, Streptococcus pneumoniae R6
aaauccucugaguauu

SEQ ID NO: 2171423 - RNA, 20 nt, Streptococcus pneumoniae R6
aaauccucugucacaaagag

SEQ ID NO: 2171424 - RNA, 23 nt, Streptococcus pneumoniae R6
aaauccucuacaugagccaguuu

SEQ ID NO: 2171425 - RNA, 17 nt, Streptococcus pneumoniae R6
aaauccuccaguuuugu

SEQ ID NO: 2171426 - RNA, 14 nt, Streptococcus pneumoniae R6
aaauccuauaccaa

SEQ ID NO: 2171427 - RNA, 13 nt, Streptococcus pneumoniae R6
uauugcaagagaa

SEQ ID NO: 2171428 - RNA, 15 nt, Streptococcus pneumoniae R6
uauugcaagagaaau

SEQ ID NO: 2171429 - RNA, 21 nt, Streptococcus pneumoniae R6
uauugcagccaauuucuuuag

SEQ ID NO: 2171430 - RNA, 14 nt, Streptococcus pneumoniae R6
aaauccugcaaaga

SEQ ID NO: 2171431 - RNA, 21 nt, Streptococcus pneumoniae R6
uauugaaaggaaaaugauuuu

SEQ ID NO: 2171432 - RNA, 14 nt, Streptococcus pneumoniae R6
uauucuuuuuaaau

SEQ ID NO: 2171433 - RNA, 12 nt, Streptococcus pneumoniae R6
uauucuugauuu

SEQ ID NO: 2171434 - RNA, 14 nt, Streptococcus pneumoniae R6
uauucuuauuucau

SEQ ID NO: 2171435 - RNA, 18 nt, Streptococcus pneumoniae R6
uauucuaacuuauuuuaa

SEQ ID NO: 2171436 - RNA, 20 nt, Streptococcus pneumoniae R6
uauucuaacuuauuuuaacu

SEQ ID NO: 2171437 - RNA, 18 nt, Streptococcus pneumoniae R6
uauucuguagaauugcug

SEQ ID NO: 2171438 - RNA, 12 nt, Streptococcus pneumoniae R6
uauucuaggaaa

SEQ ID NO: 2171439 - RNA, 18 nt, Streptococcus pneumoniae R6
uauucuagugaaaaauug

SEQ ID NO: 2171440 - RNA, 14 nt, Streptococcus pneumoniae R6
uauucuaguuucaa

SEQ ID NO: 2171441 - RNA, 22 nt, Streptococcus pneumoniae R6
uauucuaguuucaauauauuau

SEQ ID NO: 2171442 - RNA, 16 nt, Streptococcus pneumoniae R6
uauucuaguuucaauu

SEQ ID NO: 2171443 - RNA, 13 nt, Streptococcus pneumoniae R6
uauucguuaucac

SEQ ID NO: 2171444 - RNA, 14 nt, Streptococcus pneumoniae R6
uauucguccaucca

SEQ ID NO: 2171445 - RNA, 15 nt, Streptococcus pneumoniae R6
uauuccauuggaagu

SEQ ID NO: 2171446 - RNA, 19 nt, Streptococcus pneumoniae R6
uauucaaaauacaaaaguu

SEQ ID NO: 2171447 - RNA, 18 nt, Streptococcus pneumoniae R6
uauucaacacuugauacu

SEQ ID NO: 2171448 - RNA, 16 nt, Streptococcus pneumoniae R6
uauucaacgaaaauaa

SEQ ID NO: 2171449 - RNA, 21 nt, Streptococcus pneumoniae R6
uauuaugguauacgaaaaauc

SEQ ID NO: 2171450 - RNA, 23 nt, Streptococcus pneumoniae R6
uauuaugguauacgaaaaaucca

SEQ ID NO: 2171451 - RNA, 21 nt, Streptococcus pneumoniae R6
uauuauuaauauauaaaauuu

SEQ ID NO: 2171452 - RNA, 21 nt, Streptococcus pneumoniae R6
uauuauuaaugcuuaaaucgc

SEQ ID NO: 2171453 - RNA, 14 nt, Streptococcus pneumoniae R6
uauuaugcguuuua

SEQ ID NO: 2171454 - RNA, 15 nt, Streptococcus pneumoniae R6
uauuaugcguuuuuu

SEQ ID NO: 2171455 - RNA, 18 nt, Streptococcus pneumoniae R6
uauuaugcguuuuuucug

SEQ ID NO: 2171456 - RNA, 16 nt, Streptococcus pneumoniae R6
uaucuuuccuucgcuu

SEQ ID NO: 2171457 - RNA, 21 nt, Streptococcus pneumoniae R6
uaucuuugaaauaaucaaaau

SEQ ID NO: 2171458 - RNA, 14 nt, Streptococcus pneumoniae R6
uaucuuugauuuua

SEQ ID NO: 2171459 - RNA, 16 nt, Streptococcus pneumoniae R6
uaucuuugauuuuacu

SEQ ID NO: 2171460 - RNA, 18 nt, Streptococcus pneumoniae R6
uaugaaaaagauuuuuua

SEQ ID NO: 2171461 - RNA, 15 nt, Streptococcus pneumoniae R6
uaugaacugguuuuc

SEQ ID NO: 2171462 - RNA, 16 nt, Streptococcus pneumoniae R6
uaugaaggaguuucac

SEQ ID NO: 2171463 - RNA, 15 nt, Streptococcus pneumoniae R6
uaugaacaaaucgau

SEQ ID NO: 2171464 - RNA, 14 nt, Streptococcus pneumoniae R6
uaugaaauuuaaaa

SEQ ID NO: 2171465 - RNA, 17 nt, Streptococcus pneumoniae R6
uaugaaauuuaaaaaga

SEQ ID NO: 2171466 - RNA, 14 nt, Streptococcus pneumoniae R6
uaugaaaugagaaa

SEQ ID NO: 2171467 - RNA, 24 nt, Streptococcus pneumoniae R6
uaucuucauuuugcacaauauagc

SEQ ID NO: 2171468 - RNA, 15 nt, Streptococcus pneumoniae R6
uaucuugauuuucuu

SEQ ID NO: 2171469 - RNA, 19 nt, Streptococcus pneumoniae R6
uaucuugaauauuuuucuu

SEQ ID NO: 2171470 - RNA, 22 nt, Streptococcus pneumoniae R6
uaucuuguugaaugagcuucca

SEQ ID NO: 2171471 - RNA, 17 nt, Streptococcus pneumoniae R6
uaucuuuaaacuuuucu

SEQ ID NO: 2171472 - RNA, 19 nt, Streptococcus pneumoniae R6
uaucugucuuaccacaaac

SEQ ID NO: 2171473 - RNA, 20 nt, Streptococcus pneumoniae R6
uaucugucuuaccacaaaca

SEQ ID NO: 2171474 - RNA, 16 nt, Streptococcus pneumoniae R6
uaucuuaucacccaaa

SEQ ID NO: 2171475 - RNA, 19 nt, Streptococcus pneumoniae R6
uaucuuacuguccuucuuu

SEQ ID NO: 2171476 - RNA, 18 nt, Streptococcus pneumoniae R6
uaucuuauugauuuuucu

SEQ ID NO: 2171477 - RNA, 15 nt, Streptococcus pneumoniae R6
uaucuuauuuuucua

SEQ ID NO: 2171478 - RNA, 18 nt, Streptococcus pneumoniae R6
uaucucuuugaaggugau

SEQ ID NO: 2171479 - RNA, 18 nt, Streptococcus pneumoniae R6
uaucucuacauucccaaa

SEQ ID NO: 2171480 - RNA, 23 nt, Streptococcus pneumoniae R6
uaucucuaggaauaucaaaguuu

SEQ ID NO: 2171481 - RNA, 14 nt, Streptococcus pneumoniae R6
uaucucccauacca

SEQ ID NO: 2171482 - RNA, 15 nt, Streptococcus pneumoniae R6
uaucuccucauauuu

SEQ ID NO: 2171483 - RNA, 14 nt, Streptococcus pneumoniae R6
uaucugccaccuca

SEQ ID NO: 2171484 - RNA, 20 nt, Streptococcus pneumoniae R6
uaucugcaaccuuaaaacag

SEQ ID NO: 2171485 - RNA, 23 nt, Streptococcus pneumoniae R6
uaucugcaaccuuaaaacagugu

SEQ ID NO: 2171486 - RNA, 16 nt, Streptococcus pneumoniae R6
uaucugcacucucauu

SEQ ID NO: 2171487 - RNA, 14 nt, Streptococcus pneumoniae R6
uaucuggcauuccu

SEQ ID NO: 2171488 - RNA, 13 nt, Streptococcus pneumoniae R6
uaucugguugcca

SEQ ID NO: 2171489 - RNA, 15 nt, Streptococcus pneumoniae R6
uaucugcuaaaacaa

SEQ ID NO: 2171490 - RNA, 18 nt, Streptococcus pneumoniae R6
uaucugcuaaaacaaaau

SEQ ID NO: 2171491 - RNA, 16 nt, Streptococcus pneumoniae R6
uaucuaacaauaagau

SEQ ID NO: 2171492 - RNA, 12 nt, Streptococcus pneumoniae R6
uaucuaauaauu

SEQ ID NO: 2171493 - RNA, 13 nt, Streptococcus pneumoniae R6
uaucuaauaccaa

SEQ ID NO: 2171494 - RNA, 18 nt, Streptococcus pneumoniae R6
uaucuaaacuauuucuua

SEQ ID NO: 2171495 - RNA, 20 nt, Streptococcus pneumoniae R6
uaucuaaacuauuucuuauu

SEQ ID NO: 2171496 - RNA, 19 nt, Streptococcus pneumoniae R6
uaucuaaaauagaaggagu

SEQ ID NO: 2171497 - RNA, 13 nt, Streptococcus pneumoniae R6
uaucuaaaaaaau

SEQ ID NO: 2171498 - RNA, 13 nt, Streptococcus pneumoniae R6
uaucguuuuccua

SEQ ID NO: 2171499 - RNA, 14 nt, Streptococcus pneumoniae R6
uaucuagguaaaaa

SEQ ID NO: 2171500 - RNA, 19 nt, Streptococcus pneumoniae R6
uaucuauaaacaaaggagu

SEQ ID NO: 2171501 - RNA, 22 nt, Streptococcus pneumoniae R6
uaucuauccuaucuucuagaau

SEQ ID NO: 2171502 - RNA, 13 nt, Streptococcus pneumoniae R6
uaugauaaaacgu

SEQ ID NO: 2171503 - RNA, 18 nt, Streptococcus pneumoniae R6
uaugaggagaaagaagag

SEQ ID NO: 2171504 - RNA, 18 nt, Streptococcus pneumoniae R6
uaugacuauaccacucuu

SEQ ID NO: 2171505 - RNA, 12 nt, Streptococcus pneumoniae R6
uaugacaucuug

SEQ ID NO: 2171506 - RNA, 19 nt, Streptococcus pneumoniae R6
uaugcacagacauaugaaa

SEQ ID NO: 2171507 - RNA, 18 nt, Streptococcus pneumoniae R6
uaugauuacuuauuugaa

SEQ ID NO: 2171508 - RNA, 13 nt, Streptococcus pneumoniae R6
uaugauugucucc

SEQ ID NO: 2171509 - RNA, 23 nt, Streptococcus pneumoniae R6
uaugauuuaaacuaguuuucuaa

SEQ ID NO: 2171510 - RNA, 20 nt, Streptococcus pneumoniae R6
uaugaugcguuuuauaauuu

SEQ ID NO: 2171511 - RNA, 16 nt, Streptococcus pneumoniae R6
uaugaucuuaaauuuu

SEQ ID NO: 2171512 - RNA, 18 nt, Streptococcus pneumoniae R6
uauggcaucuaguaaauc

SEQ ID NO: 2171513 - RNA, 11 nt, Streptococcus pneumoniae R6
uauggaaacuc

SEQ ID NO: 2171514 - RNA, 13 nt, Streptococcus pneumoniae R6
uauggaaacucaa

SEQ ID NO: 2171515 - RNA, 19 nt, Streptococcus pneumoniae R6
uaugcuuuuuucuaugauu

SEQ ID NO: 2171516 - RNA, 13 nt, Streptococcus pneumoniae R6
uaugcuuggugag

SEQ ID NO: 2171517 - RNA, 19 nt, Streptococcus pneumoniae R6
uauggaaaaaaugaaauua

SEQ ID NO: 2171518 - RNA, 22 nt, Streptococcus pneumoniae R6
uaugcgacuauuaaccuugucu

SEQ ID NO: 2171519 - RNA, 13 nt, Streptococcus pneumoniae R6
uaugcguuuuauu

SEQ ID NO: 2171520 - RNA, 17 nt, Streptococcus pneumoniae R6
uaugcguuuuugugauu

SEQ ID NO: 2171521 - RNA, 22 nt, Streptococcus pneumoniae R6
uaugcguuuuuucugauuucaa

SEQ ID NO: 2171522 - RNA, 19 nt, Streptococcus pneumoniae R6
uaugcucugaaccaacaua

SEQ ID NO: 2171523 - RNA, 23 nt, Streptococcus pneumoniae R6
uaugcuauaucuuauuuuucuau

SEQ ID NO: 2171524 - RNA, 19 nt, Streptococcus pneumoniae R6
uaucagcuuaucaaauccu

SEQ ID NO: 2171525 - RNA, 15 nt, Streptococcus pneumoniae R6
uaucaggaauaaauc

SEQ ID NO: 2171526 - RNA, 20 nt, Streptococcus pneumoniae R6
uaucauagaaauauuuacuu

SEQ ID NO: 2171527 - RNA, 15 nt, Streptococcus pneumoniae R6
uaucauauaaauaua

SEQ ID NO: 2171528 - RNA, 16 nt, Streptococcus pneumoniae R6
uaucauauaaauauag

SEQ ID NO: 2171529 - RNA, 20 nt, Streptococcus pneumoniae R6
uaucauauaaauauagaaac

SEQ ID NO: 2171530 - RNA, 17 nt, Streptococcus pneumoniae R6
uaucauauagauaaaaa

SEQ ID NO: 2171531 - RNA, 19 nt, Streptococcus pneumoniae R6
uaucauauagauaaaaaac

SEQ ID NO: 2171532 - RNA, 15 nt, Streptococcus pneumoniae R6
uaucaucaaucaaga

SEQ ID NO: 2171533 - RNA, 18 nt, Streptococcus pneumoniae R6
uauccagccuucauaaaa

SEQ ID NO: 2171534 - RNA, 12 nt, Streptococcus pneumoniae R6
uauccuauucuu

SEQ ID NO: 2171535 - RNA, 15 nt, Streptococcus pneumoniae R6
uauccuauuucacuc

SEQ ID NO: 2171536 - RNA, 19 nt, Streptococcus pneumoniae R6
uauccgugaguucucuagu

SEQ ID NO: 2171537 - RNA, 19 nt, Streptococcus pneumoniae R6
uauccgucgcauauuucau

SEQ ID NO: 2171538 - RNA, 17 nt, Streptococcus pneumoniae R6
uauccuuaucgucauca

SEQ ID NO: 2171539 - RNA, 15 nt, Streptococcus pneumoniae R6
uauccuuauuuugca

SEQ ID NO: 2171540 - RNA, 11 nt, Streptococcus pneumoniae R6
uauccugcccc

SEQ ID NO: 2171541 - RNA, 15 nt, Streptococcus pneumoniae R6
uauccuguucuuguu

SEQ ID NO: 2171542 - RNA, 22 nt, Streptococcus pneumoniae R6
uauccuguucuuguuucaauug

SEQ ID NO: 2171543 - RNA, 16 nt, Streptococcus pneumoniae R6
uaucguagcuuuucuu

SEQ ID NO: 2171544 - RNA, 15 nt, Streptococcus pneumoniae R6
uaucguaucuuugga

SEQ ID NO: 2171545 - RNA, 22 nt, Streptococcus pneumoniae R6
uaucgggaucaccgagggaagu

SEQ ID NO: 2171546 - RNA, 15 nt, Streptococcus pneumoniae R6
uaucaagguuuuucu

SEQ ID NO: 2171547 - RNA, 18 nt, Streptococcus pneumoniae R6
uaucaagguuuuucugua

SEQ ID NO: 2171548 - RNA, 17 nt, Streptococcus pneumoniae R6
uaucaaguucacucaaa

SEQ ID NO: 2171549 - RNA, 15 nt, Streptococcus pneumoniae R6
uaucaaguuuucaca

SEQ ID NO: 2171550 - RNA, 12 nt, Streptococcus pneumoniae R6
uaucaauaaaau

SEQ ID NO: 2171551 - RNA, 18 nt, Streptococcus pneumoniae R6
uaucaagagucuccucaa

SEQ ID NO: 2171552 - RNA, 13 nt, Streptococcus pneumoniae R6
uaucaacugccug

SEQ ID NO: 2171553 - RNA, 19 nt, Streptococcus pneumoniae R6
uaucaaccacuuaacaacu

SEQ ID NO: 2171554 - RNA, 17 nt, Streptococcus pneumoniae R6
uaucaaccuuucucaga

SEQ ID NO: 2171555 - RNA, 18 nt, Streptococcus pneumoniae R6
uaucaccuccuucuccaa

SEQ ID NO: 2171556 - RNA, 22 nt, Streptococcus pneumoniae R6
uaucaccuccuucuccaauccu

SEQ ID NO: 2171557 - RNA, 12 nt, Streptococcus pneumoniae R6
uauauuucuuaa

SEQ ID NO: 2171558 - RNA, 13 nt, Streptococcus pneumoniae R6
uauauuuauuaua

SEQ ID NO: 2171559 - RNA, 14 nt, Streptococcus pneumoniae R6
uauauuuaguauca

SEQ ID NO: 2171560 - RNA, 15 nt, Streptococcus pneumoniae R6
uauauuauauaucug

SEQ ID NO: 2171561 - RNA, 14 nt, Streptococcus pneumoniae R6
uauauuauaaauuu

SEQ ID NO: 2171562 - RNA, 16 nt, Streptococcus pneumoniae R6
uauauuaaaaaaaggg

SEQ ID NO: 2171563 - RNA, 16 nt, Streptococcus pneumoniae R6
uauauggaugauuuaa

SEQ ID NO: 2171564 - RNA, 22 nt, Streptococcus pneumoniae R6
uauaugcaauuucuuuauauaa

SEQ ID NO: 2171565 - RNA, 13 nt, Streptococcus pneumoniae R6
uauaugauuucaa

SEQ ID NO: 2171566 - RNA, 14 nt, Streptococcus pneumoniae R6
uauaauuuuaaaga

SEQ ID NO: 2171567 - RNA, 14 nt, Streptococcus pneumoniae R6
uauacacuaaacaa

SEQ ID NO: 2171568 - RNA, 23 nt, Streptococcus pneumoniae R6
uauacaaauaaacggacaaaacu

SEQ ID NO: 2171569 - RNA, 13 nt, Streptococcus pneumoniae R6
uauaguaaaauga

SEQ ID NO: 2171570 - RNA, 14 nt, Streptococcus pneumoniae R6
uauaguaaacugaa

SEQ ID NO: 2171571 - RNA, 13 nt, Streptococcus pneumoniae R6
uauaggcuaguca

SEQ ID NO: 2171572 - RNA, 14 nt, Streptococcus pneumoniae R6
uauaguaauuccac

SEQ ID NO: 2171573 - RNA, 16 nt, Streptococcus pneumoniae R6
uauaguaauuccacac

SEQ ID NO: 2171574 - RNA, 14 nt, Streptococcus pneumoniae R6
uauaguagaagugu

SEQ ID NO: 2171575 - RNA, 22 nt, Streptococcus pneumoniae R6
uauaguagaaguguauuauucu

SEQ ID NO: 2171576 - RNA, 14 nt, Streptococcus pneumoniae R6
uauaguuugucuuu

SEQ ID NO: 2171577 - RNA, 18 nt, Streptococcus pneumoniae R6
uauaguucguugaaucua

SEQ ID NO: 2171578 - RNA, 16 nt, Streptococcus pneumoniae R6
uauauaguagccaaaa

SEQ ID NO: 2171579 - RNA, 20 nt, Streptococcus pneumoniae R6
uauauagugacuauggacau

SEQ ID NO: 2171580 - RNA, 20 nt, Streptococcus pneumoniae R6
uauauaguuuaaucaaaaua

SEQ ID NO: 2171581 - RNA, 17 nt, Streptococcus pneumoniae R6
uauauauccauucuuaa

SEQ ID NO: 2171582 - RNA, 18 nt, Streptococcus pneumoniae R6
uauauauccauucuuaaa

SEQ ID NO: 2171583 - RNA, 21 nt, Streptococcus pneumoniae R6
uauauaucugcagaauacucu

SEQ ID NO: 2171584 - RNA, 21 nt, Streptococcus pneumoniae R6
uauauaugcacauauacacuu

SEQ ID NO: 2171585 - RNA, 11 nt, Streptococcus pneumoniae R6
uauauaaaaua

SEQ ID NO: 2171586 - RNA, 23 nt, Streptococcus pneumoniae R6
uauauaaaugaaaaccuuagcug

SEQ ID NO: 2171587 - RNA, 17 nt, Streptococcus pneumoniae R6
uauauagcggauaaggu

SEQ ID NO: 2171588 - RNA, 22 nt, Streptococcus pneumoniae R6
uauaucuuauuuuucuauuuaa

SEQ ID NO: 2171589 - RNA, 19 nt, Streptococcus pneumoniae R6
uauauccauucuuaaaauu

SEQ ID NO: 2171590 - RNA, 21 nt, Streptococcus pneumoniae R6
uauaaguuguuuucuauagaa

SEQ ID NO: 2171591 - RNA, 22 nt, Streptococcus pneumoniae R6
uauaagguaggagugaaaaacu

SEQ ID NO: 2171592 - RNA, 15 nt, Streptococcus pneumoniae R6
uauaagcuuaguuua

SEQ ID NO: 2171593 - RNA, 12 nt, Streptococcus pneumoniae R6
uauaauaaaaug

SEQ ID NO: 2171594 - RNA, 13 nt, Streptococcus pneumoniae R6
uauaauaaauugu

SEQ ID NO: 2171595 - RNA, 11 nt, Streptococcus pneumoniae R6
uauaauaucac

SEQ ID NO: 2171596 - RNA, 12 nt, Streptococcus pneumoniae R6
uauaauaucaga

SEQ ID NO: 2171597 - RNA, 14 nt, Streptococcus pneumoniae R6
uauaauauguauuu

SEQ ID NO: 2171598 - RNA, 16 nt, Streptococcus pneumoniae R6
uauaauuauucugcaa

SEQ ID NO: 2171599 - RNA, 17 nt, Streptococcus pneumoniae R6
uauaauucuaacaccuu

SEQ ID NO: 2171600 - RNA, 22 nt, Streptococcus pneumoniae R6
uauaauucuaacaccuuuauua

SEQ ID NO: 2171601 - RNA, 19 nt, Streptococcus pneumoniae R6
uauaauuguaaacaaaaau

SEQ ID NO: 2171602 - RNA, 18 nt, Streptococcus pneumoniae R6
uauaauggauugaaauaa

SEQ ID NO: 2171603 - RNA, 22 nt, Streptococcus pneumoniae R6
uauaauggcuuauuccaauuga

SEQ ID NO: 2171604 - RNA, 18 nt, Streptococcus pneumoniae R6
uauaaucguuuaaaacac

SEQ ID NO: 2171605 - RNA, 17 nt, Streptococcus pneumoniae R6
uauaaucaauauagaag

SEQ ID NO: 2171606 - RNA, 20 nt, Streptococcus pneumoniae R6
uauaaauauaguaaaaugaa

SEQ ID NO: 2171607 - RNA, 15 nt, Streptococcus pneumoniae R6
uauaaaucaauuuuc

SEQ ID NO: 2171608 - RNA, 17 nt, Streptococcus pneumoniae R6
uauaaaucaauuuuccu

SEQ ID NO: 2171609 - RNA, 20 nt, Streptococcus pneumoniae R6
uauaacaucugcuauaauag

SEQ ID NO: 2171610 - RNA, 21 nt, Streptococcus pneumoniae R6
uauaacaucugcuauaauagu

SEQ ID NO: 2171611 - RNA, 18 nt, Streptococcus pneumoniae R6
uauaaaucucagaaaaac

SEQ ID NO: 2171612 - RNA, 17 nt, Streptococcus pneumoniae R6
uauaaaauaauuaaaau

SEQ ID NO: 2171613 - RNA, 12 nt, Streptococcus pneumoniae R6
uauaaaauaacg

SEQ ID NO: 2171614 - RNA, 17 nt, Streptococcus pneumoniae R6
uaguugcauuaaaauca

SEQ ID NO: 2171615 - RNA, 22 nt, Streptococcus pneumoniae R6
uaguucuuuaagguuagcugca

SEQ ID NO: 2171616 - RNA, 15 nt, Streptococcus pneumoniae R6
uaguugaacuuuaga

SEQ ID NO: 2171617 - RNA, 15 nt, Streptococcus pneumoniae R6
uaguucuugaaauga

SEQ ID NO: 2171618 - RNA, 12 nt, Streptococcus pneumoniae R6
uaguugacaaag

SEQ ID NO: 2171619 - RNA, 12 nt, Streptococcus pneumoniae R6
uauaaagauacg

SEQ ID NO: 2171620 - RNA, 13 nt, Streptococcus pneumoniae R6
uauaaaauuuaau

SEQ ID NO: 2171621 - RNA, 14 nt, Streptococcus pneumoniae R6
uauaaaauuuugac

SEQ ID NO: 2171622 - RNA, 14 nt, Streptococcus pneumoniae R6
uaguacauugaaau

SEQ ID NO: 2171623 - RNA, 16 nt, Streptococcus pneumoniae R6
uaguacacuucuacuu

SEQ ID NO: 2171624 - RNA, 20 nt, Streptococcus pneumoniae R6
uaguacacuucugcuucuaa

SEQ ID NO: 2171625 - RNA, 21 nt, Streptococcus pneumoniae R6
uagucaauugaaacaagaaca

SEQ ID NO: 2171626 - RNA, 15 nt, Streptococcus pneumoniae R6
uaguacgaaacaauu

SEQ ID NO: 2171627 - RNA, 23 nt, Streptococcus pneumoniae R6
uaguaaucaauauagucuacaau

SEQ ID NO: 2171628 - RNA, 16 nt, Streptococcus pneumoniae R6
uaguaaucuggucuua

SEQ ID NO: 2171629 - RNA, 18 nt, Streptococcus pneumoniae R6
uaguaaugacuuguguuu

SEQ ID NO: 2171630 - RNA, 21 nt, Streptococcus pneumoniae R6
uaguaauucaauuaaguuuua

SEQ ID NO: 2171631 - RNA, 21 nt, Streptococcus pneumoniae R6
uaguaauucccuuccuaucaa

SEQ ID NO: 2171632 - RNA, 15 nt, Streptococcus pneumoniae R6
uaguacacaacugcu

SEQ ID NO: 2171633 - RNA, 12 nt, Streptococcus pneumoniae R6
uaguacaaagaa

SEQ ID NO: 2171634 - RNA, 17 nt, Streptococcus pneumoniae R6
uaguaauuuccauaucu

SEQ ID NO: 2171635 - RNA, 20 nt, Streptococcus pneumoniae R6
uaguaauuuucgauaaagua

SEQ ID NO: 2171636 - RNA, 13 nt, Streptococcus pneumoniae R6
uagucagcugucu

SEQ ID NO: 2171637 - RNA, 22 nt, Streptococcus pneumoniae R6
uaguccucccuucuuucucaaa

SEQ ID NO: 2171638 - RNA, 17 nt, Streptococcus pneumoniae R6
uagucgaagcuuccaau

SEQ ID NO: 2171639 - RNA, 12 nt, Streptococcus pneumoniae R6
uagucaucagaa

SEQ ID NO: 2171640 - RNA, 17 nt, Streptococcus pneumoniae R6
uagucaucagaaaaaag

SEQ ID NO: 2171641 - RNA, 16 nt, Streptococcus pneumoniae R6
uagucaucaauauuag

SEQ ID NO: 2171642 - RNA, 17 nt, Streptococcus pneumoniae R6
uagucaucaauauuaga

SEQ ID NO: 2171643 - RNA, 13 nt, Streptococcus pneumoniae R6
uaguaacuuuuuc

SEQ ID NO: 2171644 - RNA, 19 nt, Streptococcus pneumoniae R6
uaguaacgagucaaaaaag

SEQ ID NO: 2171645 - RNA, 16 nt, Streptococcus pneumoniae R6
uaguaagaguugaaaa

SEQ ID NO: 2171646 - RNA, 16 nt, Streptococcus pneumoniae R6
uagguucgguuuccau

SEQ ID NO: 2171647 - RNA, 14 nt, Streptococcus pneumoniae R6
uaguaaccaccuac

SEQ ID NO: 2171648 - RNA, 13 nt, Streptococcus pneumoniae R6
uacuuuauuuucu

SEQ ID NO: 2171649 - RNA, 16 nt, Streptococcus pneumoniae R6
uacuuuauuuucucau

SEQ ID NO: 2171650 - RNA, 16 nt, Streptococcus pneumoniae R6
uacuuucaacuccuua

SEQ ID NO: 2171651 - RNA, 21 nt, Streptococcus pneumoniae R6
uaggugagcaucaggaaagac

SEQ ID NO: 2171652 - RNA, 16 nt, Streptococcus pneumoniae R6
uaggugcgagacaaaa

SEQ ID NO: 2171653 - RNA, 19 nt, Streptococcus pneumoniae R6
uaggugcgagacaaaaaaa

SEQ ID NO: 2171654 - RNA, 17 nt, Streptococcus pneumoniae R6
uaguuaguguauaaggu

SEQ ID NO: 2171655 - RNA, 21 nt, Streptococcus pneumoniae R6
uaguuauaaaggcuugaggau

SEQ ID NO: 2171656 - RNA, 17 nt, Streptococcus pneumoniae R6
uaguuaauugauaaggu

SEQ ID NO: 2171657 - RNA, 17 nt, Streptococcus pneumoniae R6
uaguuacuccuuuuuug

SEQ ID NO: 2171658 - RNA, 14 nt, Streptococcus pneumoniae R6
uaguuacuuagauu

SEQ ID NO: 2171659 - RNA, 11 nt, Streptococcus pneumoniae R6
uaguucuucca

SEQ ID NO: 2171660 - RNA, 12 nt, Streptococcus pneumoniae R6
uaguuaugaaac

SEQ ID NO: 2171661 - RNA, 16 nt, Streptococcus pneumoniae R6
uaguuaugaaacuaug

SEQ ID NO: 2171662 - RNA, 18 nt, Streptococcus pneumoniae R6
uaguuauccuuuccucga

SEQ ID NO: 2171663 - RNA, 21 nt, Streptococcus pneumoniae R6
uaguggaaagaggacuuuuug

SEQ ID NO: 2171664 - RNA, 13 nt, Streptococcus pneumoniae R6
uagugauaucuug

SEQ ID NO: 2171665 - RNA, 22 nt, Streptococcus pneumoniae R6
uagugggccagauuuauggucu

SEQ ID NO: 2171666 - RNA, 16 nt, Streptococcus pneumoniae R6
uaguggguugaaguca

SEQ ID NO: 2171667 - RNA, 21 nt, Streptococcus pneumoniae R6
uaguggguugaagucagcuaa

SEQ ID NO: 2171668 - RNA, 20 nt, Streptococcus pneumoniae R6
uagucuauaauggcuuguuc

SEQ ID NO: 2171669 - RNA, 21 nt, Streptococcus pneumoniae R6
uagucucaaaaucaaagacuu

SEQ ID NO: 2171670 - RNA, 18 nt, Streptococcus pneumoniae R6
uagucuacaauuucucgu

SEQ ID NO: 2171671 - RNA, 22 nt, Streptococcus pneumoniae R6
uagucguuuaaggaaguugagu

SEQ ID NO: 2171672 - RNA, 19 nt, Streptococcus pneumoniae R6
uagucucagcuugcucaaa

SEQ ID NO: 2171673 - RNA, 23 nt, Streptococcus pneumoniae R6
uagucguaaauaauauuauucua

SEQ ID NO: 2171674 - RNA, 19 nt, Streptococcus pneumoniae R6
uagugaauggauuuaucag

SEQ ID NO: 2171675 - RNA, 14 nt, Streptococcus pneumoniae R6
uagugacuuuaugu

SEQ ID NO: 2171676 - RNA, 19 nt, Streptococcus pneumoniae R6
uagugaaauuaacaaaaag

SEQ ID NO: 2171677 - RNA, 22 nt, Streptococcus pneumoniae R6
uagugaaauugaacuuuuucua

SEQ ID NO: 2171678 - RNA, 15 nt, Streptococcus pneumoniae R6
uagugaacugaaucu

SEQ ID NO: 2171679 - RNA, 17 nt, Streptococcus pneumoniae R6
uagucuguucuauaaaa

SEQ ID NO: 2171680 - RNA, 15 nt, Streptococcus pneumoniae R6
uagucuucuuuucuu

SEQ ID NO: 2171681 - RNA, 19 nt, Streptococcus pneumoniae R6
uccuucgcacuuauuuuau

SEQ ID NO: 2171682 - RNA, 14 nt, Streptococcus pneumoniae R6
uccuucguuuucac

SEQ ID NO: 2171683 - RNA, 22 nt, Streptococcus pneumoniae R6
uccuugauaacagcugcgauuu

SEQ ID NO: 2171684 - RNA, 20 nt, Streptococcus pneumoniae R6
uccuugaccuuaucaguuac

SEQ ID NO: 2171685 - RNA, 19 nt, Streptococcus pneumoniae R6
uccuugaccaaguccucaa

SEQ ID NO: 2171686 - RNA, 18 nt, Streptococcus pneumoniae R6
uccuugaccaucccagua

SEQ ID NO: 2171687 - RNA, 12 nt, Streptococcus pneumoniae R6
uccuucuucuug

SEQ ID NO: 2171688 - RNA, 11 nt, Streptococcus pneumoniae R6
uccuuuaaaaa

SEQ ID NO: 2171689 - RNA, 12 nt, Streptococcus pneumoniae R6
uccuuuaaaaac

SEQ ID NO: 2171690 - RNA, 20 nt, Streptococcus pneumoniae R6
uccuuuagaaagguuuuaaa

SEQ ID NO: 2171691 - RNA, 20 nt, Streptococcus pneumoniae R6
uccuuuagugauaucuugaa

SEQ ID NO: 2171692 - RNA, 18 nt, Streptococcus pneumoniae R6
uccuugccuaauuuuuca

SEQ ID NO: 2171693 - RNA, 19 nt, Streptococcus pneumoniae R6
uccuugccuaauuuuucaa

SEQ ID NO: 2171694 - RNA, 16 nt, Streptococcus pneumoniae R6
uccuugccuucaaucu

SEQ ID NO: 2171695 - RNA, 19 nt, Streptococcus pneumoniae R6
uccuugccuucaaucuuuu

SEQ ID NO: 2171696 - RNA, 19 nt, Streptococcus pneumoniae R6
uccuuuuuuugaaguuuuc

SEQ ID NO: 2171697 - RNA, 13 nt, Streptococcus pneumoniae R6
uccuuuuuucuuu

SEQ ID NO: 2171698 - RNA, 17 nt, Streptococcus pneumoniae R6
uccuuuuuucuuuacuc

SEQ ID NO: 2171699 - RNA, 17 nt, Streptococcus pneumoniae R6
ucgaaaaccaaaggcau

SEQ ID NO: 2171700 - RNA, 15 nt, Streptococcus pneumoniae R6
uccuuuuugauaaga

SEQ ID NO: 2171701 - RNA, 18 nt, Streptococcus pneumoniae R6
uccuuuuugcuguuaaua

SEQ ID NO: 2171702 - RNA, 20 nt, Streptococcus pneumoniae R6
uccuuuuugcuguuaauaac

SEQ ID NO: 2171703 - RNA, 13 nt, Streptococcus pneumoniae R6
uccuuuuuuacuu

SEQ ID NO: 2171704 - RNA, 22 nt, Streptococcus pneumoniae R6
uccuuuuuaaauccgauaauau

SEQ ID NO: 2171705 - RNA, 17 nt, Streptococcus pneumoniae R6
uccuuugagguuaauca

SEQ ID NO: 2171706 - RNA, 21 nt, Streptococcus pneumoniae R6
uccuuugagguuaaucaaucg

SEQ ID NO: 2171707 - RNA, 15 nt, Streptococcus pneumoniae R6
uccuuugaguaagag

SEQ ID NO: 2171708 - RNA, 23 nt, Streptococcus pneumoniae R6
uccuuugcgugacauagaugcuu

SEQ ID NO: 2171709 - RNA, 16 nt, Streptococcus pneumoniae R6
uccuuucuuuuuugau

SEQ ID NO: 2171710 - RNA, 17 nt, Streptococcus pneumoniae R6
uccuuucuuuuuugaua

SEQ ID NO: 2171711 - RNA, 16 nt, Streptococcus pneumoniae R6
uccuuuuaguuuuacc

SEQ ID NO: 2171712 - RNA, 17 nt, Streptococcus pneumoniae R6
uccuuuuauuaucuuuc

SEQ ID NO: 2171713 - RNA, 16 nt, Streptococcus pneumoniae R6
uccuuuguuuacuaaa

SEQ ID NO: 2171714 - RNA, 20 nt, Streptococcus pneumoniae R6
uccuuuucugaggauuaggg

SEQ ID NO: 2171715 - RNA, 15 nt, Streptococcus pneumoniae R6
uccuuuucuguacuu

SEQ ID NO: 2171716 - RNA, 17 nt, Streptococcus pneumoniae R6
ucgaaauuccauaccua

SEQ ID NO: 2171717 - RNA, 19 nt, Streptococcus pneumoniae R6
ucgaaauuccauaccuaaa

SEQ ID NO: 2171718 - RNA, 18 nt, Streptococcus pneumoniae R6
ucgaaaaucucuucaaac

SEQ ID NO: 2171719 - RNA, 17 nt, Streptococcus pneumoniae R6
ucgaaacauucaaaucc

SEQ ID NO: 2171720 - RNA, 15 nt, Streptococcus pneumoniae R6
ucgaagguuauacca

SEQ ID NO: 2171721 - RNA, 21 nt, Streptococcus pneumoniae R6
ucgaagguuauaccaaaaaaa

SEQ ID NO: 2171722 - RNA, 22 nt, Streptococcus pneumoniae R6
ucgaagguuauaccaaaaaaac

SEQ ID NO: 2171723 - RNA, 23 nt, Streptococcus pneumoniae R6
ucgaagguuauaccaaaaaaacu

SEQ ID NO: 2171724 - RNA, 20 nt, Streptococcus pneumoniae R6
ucgacaagauacccacaaaa

SEQ ID NO: 2171725 - RNA, 22 nt, Streptococcus pneumoniae R6
ucgaaugauauuuucaaaaaaa

SEQ ID NO: 2171726 - RNA, 16 nt, Streptococcus pneumoniae R6
ucgaaugauuucucuu

SEQ ID NO: 2171727 - RNA, 21 nt, Streptococcus pneumoniae R6
ucgaccaagccagcauuuuca

SEQ ID NO: 2171728 - RNA, 16 nt, Streptococcus pneumoniae R6
ucgacuacuaaaacau

SEQ ID NO: 2171729 - RNA, 15 nt, Streptococcus pneumoniae R6
ucgacugugauuuuu

SEQ ID NO: 2171730 - RNA, 17 nt, Streptococcus pneumoniae R6
ucgacugguaaagaaug

SEQ ID NO: 2171731 - RNA, 19 nt, Streptococcus pneumoniae R6
ucgagaaaggacaaauuuc

SEQ ID NO: 2171732 - RNA, 23 nt, Streptococcus pneumoniae R6
ucgagcuuagcuuuucuucaacc

SEQ ID NO: 2171733 - RNA, 14 nt, Streptococcus pneumoniae R6
ucgagcaguuccau

SEQ ID NO: 2171734 - RNA, 16 nt, Streptococcus pneumoniae R6
ucgaggucuaaaucua

SEQ ID NO: 2171735 - RNA, 22 nt, Streptococcus pneumoniae R6
ucgauaucuugguacaaaguuc

SEQ ID NO: 2171736 - RNA, 20 nt, Streptococcus pneumoniae R6
ucgauaccugggaagaugaa

SEQ ID NO: 2171737 - RNA, 16 nt, Streptococcus pneumoniae R6
ucgauaccuucagcca

SEQ ID NO: 2171738 - RNA, 16 nt, Streptococcus pneumoniae R6
ucgauagauuuuucaa

SEQ ID NO: 2171739 - RNA, 19 nt, Streptococcus pneumoniae R6
ucgauagauuuuucaaggu

SEQ ID NO: 2171740 - RNA, 13 nt, Streptococcus pneumoniae R6
ucgaucaggacag

SEQ ID NO: 2171741 - RNA, 20 nt, Streptococcus pneumoniae R6
ucgaucaggacagucaaauc

SEQ ID NO: 2171742 - RNA, 21 nt, Streptococcus pneumoniae R6
ucgaucaggacagucaaaucg

SEQ ID NO: 2171743 - RNA, 15 nt, Streptococcus pneumoniae R6
ucgaucuaaggaaga

SEQ ID NO: 2171744 - RNA, 18 nt, Streptococcus pneumoniae R6
ucgaucugauauauuuuc

SEQ ID NO: 2171745 - RNA, 21 nt, Streptococcus pneumoniae R6
ucgaucugauauauuuucgau

SEQ ID NO: 2171746 - RNA, 18 nt, Streptococcus pneumoniae R6
ucgaugaaucauuuccuu

SEQ ID NO: 2171747 - RNA, 18 nt, Streptococcus pneumoniae R6
ucgauuuguucauaucuu

SEQ ID NO: 2171748 - RNA, 19 nt, Streptococcus pneumoniae R6
ucgauuuguucuguucuua

SEQ ID NO: 2171749 - RNA, 20 nt, Streptococcus pneumoniae R6
ucgauuucuaacaauauuuu

SEQ ID NO: 2171750 - RNA, 19 nt, Streptococcus pneumoniae R6
ucgauugggaaaguaaaau

SEQ ID NO: 2171751 - RNA, 19 nt, Streptococcus pneumoniae R6
ucgaugucaccaaacaaau

SEQ ID NO: 2171752 - RNA, 16 nt, Streptococcus pneumoniae R6
ucgcaaagaggaagag

SEQ ID NO: 2171753 - RNA, 20 nt, Streptococcus pneumoniae R6
ucgcaacugucuuauccaaa

SEQ ID NO: 2171754 - RNA, 15 nt, Streptococcus pneumoniae R6
ucgcaaguuuuuccc

SEQ ID NO: 2171755 - RNA, 18 nt, Streptococcus pneumoniae R6
ucgcaccugacuccauag

SEQ ID NO: 2171756 - RNA, 13 nt, Streptococcus pneumoniae R6
ucgcauauuucau

SEQ ID NO: 2171757 - RNA, 15 nt, Streptococcus pneumoniae R6
uccgcuugggaaacc

SEQ ID NO: 2171758 - RNA, 16 nt, Streptococcus pneumoniae R6
uccgcuugggaaacca

SEQ ID NO: 2171759 - RNA, 18 nt, Streptococcus pneumoniae R6
uccgcuugggaaaccaaa

SEQ ID NO: 2171760 - RNA, 14 nt, Streptococcus pneumoniae R6
uccggcuuucacaa

SEQ ID NO: 2171761 - RNA, 18 nt, Streptococcus pneumoniae R6
uccgguaaaguugaaaug

SEQ ID NO: 2171762 - RNA, 18 nt, Streptococcus pneumoniae R6
uccgugauuguuuuuaaa

SEQ ID NO: 2171763 - RNA, 17 nt, Streptococcus pneumoniae R6
uccgugaagugaaagga

SEQ ID NO: 2171764 - RNA, 15 nt, Streptococcus pneumoniae R6
uccguuggucaaggg

SEQ ID NO: 2171765 - RNA, 20 nt, Streptococcus pneumoniae R6
uccguucugagauagguggg

SEQ ID NO: 2171766 - RNA, 18 nt, Streptococcus pneumoniae R6
uccguuuuuugaaguuuu

SEQ ID NO: 2171767 - RNA, 18 nt, Streptococcus pneumoniae R6
uccuaaaacuagugaagc

SEQ ID NO: 2171768 - RNA, 17 nt, Streptococcus pneumoniae R6
uccguuuuucuccucua

SEQ ID NO: 2171769 - RNA, 13 nt, Streptococcus pneumoniae R6
uccguuuuuuaaa

SEQ ID NO: 2171770 - RNA, 13 nt, Streptococcus pneumoniae R6
uccguaaaagaca

SEQ ID NO: 2171771 - RNA, 21 nt, Streptococcus pneumoniae R6
uccgguuccuuauucugaaag

SEQ ID NO: 2171772 - RNA, 14 nt, Streptococcus pneumoniae R6
uccucaaaaugaaa

SEQ ID NO: 2171773 - RNA, 22 nt, Streptococcus pneumoniae R6
uccucaccaguauagaccaaga

SEQ ID NO: 2171774 - RNA, 21 nt, Streptococcus pneumoniae R6
uccucaaugaauccgaaaaau

SEQ ID NO: 2171775 - RNA, 22 nt, Streptococcus pneumoniae R6
uccucaaugaauccgaaaaauu

SEQ ID NO: 2171776 - RNA, 16 nt, Streptococcus pneumoniae R6
uccucaauguuuuauu

SEQ ID NO: 2171777 - RNA, 21 nt, Streptococcus pneumoniae R6
uccucaauaagcccgaaaaau

SEQ ID NO: 2171778 - RNA, 17 nt, Streptococcus pneumoniae R6
uccuagucuacaaauuc

SEQ ID NO: 2171779 - RNA, 22 nt, Streptococcus pneumoniae R6
uccuaguuggugacugacuaaa

SEQ ID NO: 2171780 - RNA, 20 nt, Streptococcus pneumoniae R6
uccuaguuugcucuuugauu

SEQ ID NO: 2171781 - RNA, 23 nt, Streptococcus pneumoniae R6
uccuagccuauuuuuuauuucaa

SEQ ID NO: 2171782 - RNA, 21 nt, Streptococcus pneumoniae R6
uccuaggaagauuuauacucu

SEQ ID NO: 2171783 - RNA, 19 nt, Streptococcus pneumoniae R6
uccuauuacuaucaagaag

SEQ ID NO: 2171784 - RNA, 12 nt, Streptococcus pneumoniae R6
uccuauucuuau

SEQ ID NO: 2171785 - RNA, 23 nt, Streptococcus pneumoniae R6
uccuaaucuggagauuucuuauu

SEQ ID NO: 2171786 - RNA, 11 nt, Streptococcus pneumoniae R6
uccuaauuugc

SEQ ID NO: 2171787 - RNA, 13 nt, Streptococcus pneumoniae R6
uccuaaagaaaaa

SEQ ID NO: 2171788 - RNA, 14 nt, Streptococcus pneumoniae R6
uccuaaagaaaaag

SEQ ID NO: 2171789 - RNA, 14 nt, Streptococcus pneumoniae R6
uccuaaauccucua

SEQ ID NO: 2171790 - RNA, 19 nt, Streptococcus pneumoniae R6
uccuaaauccucuaucaug

SEQ ID NO: 2171791 - RNA, 13 nt, Streptococcus pneumoniae R6
uccuaacuuaaaa

SEQ ID NO: 2171792 - RNA, 20 nt, Streptococcus pneumoniae R6
uccuagaauaugaacauuuu

SEQ ID NO: 2171793 - RNA, 14 nt, Streptococcus pneumoniae R6
uccuacuugcuucc

SEQ ID NO: 2171794 - RNA, 14 nt, Streptococcus pneumoniae R6
uccuacuucaaauc

SEQ ID NO: 2171795 - RNA, 20 nt, Streptococcus pneumoniae R6
uccuacuucaaauccuuuau

SEQ ID NO: 2171796 - RNA, 16 nt, Streptococcus pneumoniae R6
uccuacugauaucuuu

SEQ ID NO: 2171797 - RNA, 14 nt, Streptococcus pneumoniae R6
uccuacgaacaaga

SEQ ID NO: 2171798 - RNA, 23 nt, Streptococcus pneumoniae R6
uccugauaaaagauagagaaaga

SEQ ID NO: 2171799 - RNA, 17 nt, Streptococcus pneumoniae R6
uccugauuaaaaucaua

SEQ ID NO: 2171800 - RNA, 13 nt, Streptococcus pneumoniae R6
uccugaucgauuu

SEQ ID NO: 2171801 - RNA, 21 nt, Streptococcus pneumoniae R6
uccucugguagcaacuaucug

SEQ ID NO: 2171802 - RNA, 19 nt, Streptococcus pneumoniae R6
uccucuugauuuuuuuuaa

SEQ ID NO: 2171803 - RNA, 12 nt, Streptococcus pneumoniae R6
uccugaaaagcc

SEQ ID NO: 2171804 - RNA, 15 nt, Streptococcus pneumoniae R6
uccugaaaagccacg

SEQ ID NO: 2171805 - RNA, 17 nt, Streptococcus pneumoniae R6
uccugaaaaucaucugc

SEQ ID NO: 2171806 - RNA, 18 nt, Streptococcus pneumoniae R6
uccucuuuuuguaucaau

SEQ ID NO: 2171807 - RNA, 15 nt, Streptococcus pneumoniae R6
uccugaagaauggga

SEQ ID NO: 2171808 - RNA, 20 nt, Streptococcus pneumoniae R6
uccucuacauacccaugcuu

SEQ ID NO: 2171809 - RNA, 22 nt, Streptococcus pneumoniae R6
uccucguagcggauuuucaaaa

SEQ ID NO: 2171810 - RNA, 16 nt, Streptococcus pneumoniae R6
uccucgagcaguucca

SEQ ID NO: 2171811 - RNA, 22 nt, Streptococcus pneumoniae R6
uccucccugcgacaaaauugau

SEQ ID NO: 2171812 - RNA, 16 nt, Streptococcus pneumoniae R6
uccuccauaaaaagac

SEQ ID NO: 2171813 - RNA, 14 nt, Streptococcus pneumoniae R6
uccucccauauuug

SEQ ID NO: 2171814 - RNA, 17 nt, Streptococcus pneumoniae R6
uccucccauauuuggca

SEQ ID NO: 2171815 - RNA, 14 nt, Streptococcus pneumoniae R6
uccucauauucuuu

SEQ ID NO: 2171816 - RNA, 19 nt, Streptococcus pneumoniae R6
uccucauauucuuuuacac

SEQ ID NO: 2171817 - RNA, 13 nt, Streptococcus pneumoniae R6
uccucauuucaau

SEQ ID NO: 2171818 - RNA, 19 nt, Streptococcus pneumoniae R6
uccucauuagauaguuuug

SEQ ID NO: 2171819 - RNA, 23 nt, Streptococcus pneumoniae R6
uccuggaaucagaacacuuccaa

SEQ ID NO: 2171820 - RNA, 14 nt, Streptococcus pneumoniae R6
uccuggcguaguaa

SEQ ID NO: 2171821 - RNA, 14 nt, Streptococcus pneumoniae R6
uccugcaaggcaua

SEQ ID NO: 2171822 - RNA, 14 nt, Streptococcus pneumoniae R6
uccugcaaguuuau

SEQ ID NO: 2171823 - RNA, 20 nt, Streptococcus pneumoniae R6
uccugcaaguuuaugccuug

SEQ ID NO: 2171824 - RNA, 18 nt, Streptococcus pneumoniae R6
uccuucaagggcagacau

SEQ ID NO: 2171825 - RNA, 19 nt, Streptococcus pneumoniae R6
uccuucaaauccugcauug

SEQ ID NO: 2171826 - RNA, 14 nt, Streptococcus pneumoniae R6
uccuuauucugaaa

SEQ ID NO: 2171827 - RNA, 22 nt, Streptococcus pneumoniae R6
uccuuauucuggaagugaaaaa

SEQ ID NO: 2171828 - RNA, 22 nt, Streptococcus pneumoniae R6
uccuuauugaugauguuuaaaa

SEQ ID NO: 2171829 - RNA, 13 nt, Streptococcus pneumoniae R6
uccuuauuuugca

SEQ ID NO: 2171830 - RNA, 19 nt, Streptococcus pneumoniae R6
uccuuauuuugcagacgac

SEQ ID NO: 2171831 - RNA, 16 nt, Streptococcus pneumoniae R6
uccuguuguauuuaua

SEQ ID NO: 2171832 - RNA, 14 nt, Streptococcus pneumoniae R6
uccuuacuuuuuau

SEQ ID NO: 2171833 - RNA, 16 nt, Streptococcus pneumoniae R6
uccuuacucaaauaaa

SEQ ID NO: 2171834 - RNA, 15 nt, Streptococcus pneumoniae R6
uccuuacggucaaag

SEQ ID NO: 2171835 - RNA, 21 nt, Streptococcus pneumoniae R6
uccuuaaauuuuauacaaauu

SEQ ID NO: 2171836 - RNA, 15 nt, Streptococcus pneumoniae R6
uccuguuucaaagua

SEQ ID NO: 2171837 - RNA, 14 nt, Streptococcus pneumoniae R6
uccuguucuuguuu

SEQ ID NO: 2171838 - RNA, 22 nt, Streptococcus pneumoniae R6
uccuggucuuuuuuagcucuug

SEQ ID NO: 2171839 - RNA, 21 nt, Streptococcus pneumoniae R6
uccuguaagaacuuuuuaaag

SEQ ID NO: 2171840 - RNA, 15 nt, Streptococcus pneumoniae R6
uccugggaaauucca

SEQ ID NO: 2171841 - RNA, 16 nt, Streptococcus pneumoniae R6
uccugggaaauuccag

SEQ ID NO: 2171842 - RNA, 14 nt, Streptococcus pneumoniae R6
ucccauaguagucu

SEQ ID NO: 2171843 - RNA, 12 nt, Streptococcus pneumoniae R6
ucccauauuugg

SEQ ID NO: 2171844 - RNA, 18 nt, Streptococcus pneumoniae R6
ucccauauuuggcauauu

SEQ ID NO: 2171845 - RNA, 13 nt, Streptococcus pneumoniae R6
ucccauaaaaaua

SEQ ID NO: 2171846 - RNA, 15 nt, Streptococcus pneumoniae R6
ucccauaaaaauaau

SEQ ID NO: 2171847 - RNA, 22 nt, Streptococcus pneumoniae R6
ucccaugacaaucauuucaguu

SEQ ID NO: 2171848 - RNA, 17 nt, Streptococcus pneumoniae R6
ucccaugcuuccagcuu

SEQ ID NO: 2171849 - RNA, 22 nt, Streptococcus pneumoniae R6
ucccaucugucuuuauuaauga

SEQ ID NO: 2171850 - RNA, 18 nt, Streptococcus pneumoniae R6
ucccaucgcgaccaagag

SEQ ID NO: 2171851 - RNA, 11 nt, Streptococcus pneumoniae R6
ucccaucauuc

SEQ ID NO: 2171852 - RNA, 17 nt, Streptococcus pneumoniae R6
ucccagagcuauaagcc

SEQ ID NO: 2171853 - RNA, 21 nt, Streptococcus pneumoniae R6
uccccauuugcuucaucauuu

SEQ ID NO: 2171854 - RNA, 14 nt, Streptococcus pneumoniae R6
uccccaucuucaac

SEQ ID NO: 2171855 - RNA, 17 nt, Streptococcus pneumoniae R6
uccccaugaguuuucaa

SEQ ID NO: 2171856 - RNA, 20 nt, Streptococcus pneumoniae R6
ucccaugucuuuuaaauauu

SEQ ID NO: 2171857 - RNA, 17 nt, Streptococcus pneumoniae R6
ucccauugagaaaauau

SEQ ID NO: 2171858 - RNA, 16 nt, Streptococcus pneumoniae R6
ucccauuuguaaacug

SEQ ID NO: 2171859 - RNA, 18 nt, Streptococcus pneumoniae R6
ucccauuuuuugcaucaa

SEQ ID NO: 2171860 - RNA, 21 nt, Streptococcus pneumoniae R6
ucccggagcuuucagagcugc

SEQ ID NO: 2171861 - RNA, 14 nt, Streptococcus pneumoniae R6
ucccgucaacaguu

SEQ ID NO: 2171862 - RNA, 19 nt, Streptococcus pneumoniae R6
uccccugccaacuuaucag

SEQ ID NO: 2171863 - RNA, 15 nt, Streptococcus pneumoniae R6
ucccccuuuuuuuaa

SEQ ID NO: 2171864 - RNA, 14 nt, Streptococcus pneumoniae R6
uccccucaaccuga

SEQ ID NO: 2171865 - RNA, 15 nt, Streptococcus pneumoniae R6
uccccuauauucuuu

SEQ ID NO: 2171866 - RNA, 17 nt, Streptococcus pneumoniae R6
ucccuagcuuuuuccuc

SEQ ID NO: 2171867 - RNA, 13 nt, Streptococcus pneumoniae R6
ucccuaauaauac

SEQ ID NO: 2171868 - RNA, 22 nt, Streptococcus pneumoniae R6
ucccuaauaauacaaaaaauag

SEQ ID NO: 2171869 - RNA, 20 nt, Streptococcus pneumoniae R6
ucccuaccucauaucugucu

SEQ ID NO: 2171870 - RNA, 15 nt, Streptococcus pneumoniae R6
ucccucagaguaaga

SEQ ID NO: 2171871 - RNA, 23 nt, Streptococcus pneumoniae R6
ucccuccauuucauagcuaauca

SEQ ID NO: 2171872 - RNA, 15 nt, Streptococcus pneumoniae R6
ucccuccuaaggagu

SEQ ID NO: 2171873 - RNA, 16 nt, Streptococcus pneumoniae R6
ucccuccuaaggagua

SEQ ID NO: 2171874 - RNA, 14 nt, Streptococcus pneumoniae R6
ucccuuccuaucaa

SEQ ID NO: 2171875 - RNA, 22 nt, Streptococcus pneumoniae R6
ucccuucuuucucaaacauugu

SEQ ID NO: 2171876 - RNA, 22 nt, Streptococcus pneumoniae R6
ucccuguaaucaugaugauaga

SEQ ID NO: 2171877 - RNA, 24 nt, Streptococcus pneumoniae R6
ucccuguagggggcauauaaauac

SEQ ID NO: 2171878 - RNA, 15 nt, Streptococcus pneumoniae R6
ucccugcauuucuuu

SEQ ID NO: 2171879 - RNA, 14 nt, Streptococcus pneumoniae R6
aaaucuuaaaaauu

SEQ ID NO: 2171880 - RNA, 22 nt, Streptococcus pneumoniae R6
aaaucugcucaaucuuaucaau

SEQ ID NO: 2171881 - RNA, 13 nt, Streptococcus pneumoniae R6
aaaucugucuacc

SEQ ID NO: 2171882 - RNA, 20 nt, Streptococcus pneumoniae R6
aaaucuggacauuagggucu

SEQ ID NO: 2171883 - RNA, 22 nt, Streptococcus pneumoniae R6
aaaucugaagaaagcaauuuua

SEQ ID NO: 2171884 - RNA, 19 nt, Streptococcus pneumoniae R6
aaaucucuuugaggucugu

SEQ ID NO: 2171885 - RNA, 18 nt, Streptococcus pneumoniae R6
uccgaauaacucaaaagc

SEQ ID NO: 2171886 - RNA, 19 nt, Streptococcus pneumoniae R6
uccgaacuuguggggccag

SEQ ID NO: 2171887 - RNA, 19 nt, Streptococcus pneumoniae R6
uccgaagacuuuaaaaauu

SEQ ID NO: 2171888 - RNA, 20 nt, Streptococcus pneumoniae R6
uccgaaccacaacaaaaaag

SEQ ID NO: 2171889 - RNA, 13 nt, Streptococcus pneumoniae R6
uccgauagcauca

SEQ ID NO: 2171890 - RNA, 14 nt, Streptococcus pneumoniae R6
uccgaguuuuucag

SEQ ID NO: 2171891 - RNA, 12 nt, Streptococcus pneumoniae R6
uccgagugcaag

SEQ ID NO: 2171892 - RNA, 13 nt, Streptococcus pneumoniae R6
uccgagugcaaga

SEQ ID NO: 2171893 - RNA, 15 nt, Streptococcus pneumoniae R6
uccgaguguuuccuu

SEQ ID NO: 2171894 - RNA, 21 nt, Streptococcus pneumoniae R6
uccgauuaacgauggacuuua

SEQ ID NO: 2171895 - RNA, 18 nt, Streptococcus pneumoniae R6
uccgauuuuauuucauuc

SEQ ID NO: 2171896 - RNA, 18 nt, Streptococcus pneumoniae R6
uccgcaucucggaaagau

SEQ ID NO: 2171897 - RNA, 14 nt, Streptococcus pneumoniae R6
uccauuauacaucu

SEQ ID NO: 2171898 - RNA, 17 nt, Streptococcus pneumoniae R6
uccauguuaugauucuc

SEQ ID NO: 2171899 - RNA, 16 nt, Streptococcus pneumoniae R6
uccaugauaaugguau

SEQ ID NO: 2171900 - RNA, 15 nt, Streptococcus pneumoniae R6
uccauggaauaccaa

SEQ ID NO: 2171901 - RNA, 16 nt, Streptococcus pneumoniae R6
uccaugcuaccagucg

SEQ ID NO: 2171902 - RNA, 22 nt, Streptococcus pneumoniae R6
uccaugcuugauucaaagucau

SEQ ID NO: 2171903 - RNA, 17 nt, Streptococcus pneumoniae R6
uccaugguaucaaaggc

SEQ ID NO: 2171904 - RNA, 15 nt, Streptococcus pneumoniae R6
uccaucguuccuguc

SEQ ID NO: 2171905 - RNA, 17 nt, Streptococcus pneumoniae R6
uccaucuacaaccuuaa

SEQ ID NO: 2171906 - RNA, 15 nt, Streptococcus pneumoniae R6
uccaucuccaacugc

SEQ ID NO: 2171907 - RNA, 19 nt, Streptococcus pneumoniae R6
uccaucuccaacugcuguu

SEQ ID NO: 2171908 - RNA, 19 nt, Streptococcus pneumoniae R6
uccaucuccgauuaacgau

SEQ ID NO: 2171909 - RNA, 18 nt, Streptococcus pneumoniae R6
uccaucuuuuauuugagu

SEQ ID NO: 2171910 - RNA, 23 nt, Streptococcus pneumoniae R6
uccaucuuuuauuugaguaagga

SEQ ID NO: 2171911 - RNA, 22 nt, Streptococcus pneumoniae R6
uccaucuuggcgaauauagaca

SEQ ID NO: 2171912 - RNA, 16 nt, Streptococcus pneumoniae R6
uccaucuguaauauga

SEQ ID NO: 2171913 - RNA, 13 nt, Streptococcus pneumoniae R6
uccaucugcagcc

SEQ ID NO: 2171914 - RNA, 14 nt, Streptococcus pneumoniae R6
uccaucugcucucc

SEQ ID NO: 2171915 - RNA, 17 nt, Streptococcus pneumoniae R6
uccaugaccgaaugaag

SEQ ID NO: 2171916 - RNA, 14 nt, Streptococcus pneumoniae R6
uccaucauaaaaau

SEQ ID NO: 2171917 - RNA, 17 nt, Streptococcus pneumoniae R6
uccauccacaaccuuaa

SEQ ID NO: 2171918 - RNA, 23 nt, Streptococcus pneumoniae R6
uccauccacaaccuuaaaacagu

SEQ ID NO: 2171919 - RNA, 15 nt, Streptococcus pneumoniae R6
uccauccucaccagu

SEQ ID NO: 2171920 - RNA, 15 nt, Streptococcus pneumoniae R6
uccauuuacagaagc

SEQ ID NO: 2171921 - RNA, 13 nt, Streptococcus pneumoniae R6
uccauuucuuuug

SEQ ID NO: 2171922 - RNA, 14 nt, Streptococcus pneumoniae R6
uccauuuuccauga

SEQ ID NO: 2171923 - RNA, 21 nt, Streptococcus pneumoniae R6
uccauuuggcaccgaauuuuu

SEQ ID NO: 2171924 - RNA, 16 nt, Streptococcus pneumoniae R6
uccauuuguuuaaaga

SEQ ID NO: 2171925 - RNA, 16 nt, Streptococcus pneumoniae R6
uccauuuuucaaauca

SEQ ID NO: 2171926 - RNA, 17 nt, Streptococcus pneumoniae R6
uccauuuuucaaaucaa

SEQ ID NO: 2171927 - RNA, 18 nt, Streptococcus pneumoniae R6
uccauuuuuuaaaaaggc

SEQ ID NO: 2171928 - RNA, 11 nt, Streptococcus pneumoniae R6
uccauuccucc

SEQ ID NO: 2171929 - RNA, 20 nt, Streptococcus pneumoniae R6
uccauucgauucguuuuccu

SEQ ID NO: 2171930 - RNA, 18 nt, Streptococcus pneumoniae R6
uccauucacaacaucuuc

SEQ ID NO: 2171931 - RNA, 20 nt, Streptococcus pneumoniae R6
uccauugcaagagccuuuuu

SEQ ID NO: 2171932 - RNA, 15 nt, Streptococcus pneumoniae R6
uccauucuuuuacuu

SEQ ID NO: 2171933 - RNA, 14 nt, Streptococcus pneumoniae R6
uccauucuugaccg

SEQ ID NO: 2171934 - RNA, 13 nt, Streptococcus pneumoniae R6
ucccaaacaucug

SEQ ID NO: 2171935 - RNA, 18 nt, Streptococcus pneumoniae R6
ucccaaucgauuuguucu

SEQ ID NO: 2171936 - RNA, 16 nt, Streptococcus pneumoniae R6
ucccaagguuuugcca

SEQ ID NO: 2171937 - RNA, 22 nt, Streptococcus pneumoniae R6
ucccaagguuuugccagccagu

SEQ ID NO: 2171938 - RNA, 23 nt, Streptococcus pneumoniae R6
ucccacgacggauaacagucagu

SEQ ID NO: 2171939 - RNA, 20 nt, Streptococcus pneumoniae R6
ucccacccauauuuuuccuu

SEQ ID NO: 2171940 - RNA, 19 nt, Streptococcus pneumoniae R6
ucccaccaaacuuucccuu

SEQ ID NO: 2171941 - RNA, 20 nt, Streptococcus pneumoniae R6
ucccaccaaacuuucccuuc

SEQ ID NO: 2171942 - RNA, 15 nt, Streptococcus pneumoniae R6
ucccacaauaaaaag

SEQ ID NO: 2171943 - RNA, 22 nt, Streptococcus pneumoniae R6
uccaggacugguuuugauauag

SEQ ID NO: 2171944 - RNA, 16 nt, Streptococcus pneumoniae R6
uccacuugggaaacca

SEQ ID NO: 2171945 - RNA, 17 nt, Streptococcus pneumoniae R6
uccagaagccuucaucc

SEQ ID NO: 2171946 - RNA, 15 nt, Streptococcus pneumoniae R6
uccaguaacuuuacc

SEQ ID NO: 2171947 - RNA, 18 nt, Streptococcus pneumoniae R6
uccaguaaaaacuguugg

SEQ ID NO: 2171948 - RNA, 17 nt, Streptococcus pneumoniae R6
uccauaguaaacuucuu

SEQ ID NO: 2171949 - RNA, 18 nt, Streptococcus pneumoniae R6
uccauaguaaacuucuuc

SEQ ID NO: 2171950 - RNA, 21 nt, Streptococcus pneumoniae R6
uccauaguaaacuucuucuuc

SEQ ID NO: 2171951 - RNA, 19 nt, Streptococcus pneumoniae R6
uccauagcgucaaagaagg

SEQ ID NO: 2171952 - RNA, 21 nt, Streptococcus pneumoniae R6
uccaucaaguuuaccauucaa

SEQ ID NO: 2171953 - RNA, 19 nt, Streptococcus pneumoniae R6
uccauauuagggcaaauaa

SEQ ID NO: 2171954 - RNA, 14 nt, Streptococcus pneumoniae R6
uccauaugauucuu

SEQ ID NO: 2171955 - RNA, 19 nt, Streptococcus pneumoniae R6
uccauaugauucuuucuaa

SEQ ID NO: 2171956 - RNA, 20 nt, Streptococcus pneumoniae R6
uccauaugauucuuucuaau

SEQ ID NO: 2171957 - RNA, 14 nt, Streptococcus pneumoniae R6
uccaguuaucugca

SEQ ID NO: 2171958 - RNA, 15 nt, Streptococcus pneumoniae R6
uccaguuauucuuaa

SEQ ID NO: 2171959 - RNA, 16 nt, Streptococcus pneumoniae R6
uccaagauucaacauc

SEQ ID NO: 2171960 - RNA, 17 nt, Streptococcus pneumoniae R6
uccaagauucaacauca

SEQ ID NO: 2171961 - RNA, 15 nt, Streptococcus pneumoniae R6
uccaagaaagagaau

SEQ ID NO: 2171962 - RNA, 19 nt, Streptococcus pneumoniae R6
uccaacucuggguguuucu

SEQ ID NO: 2171963 - RNA, 15 nt, Streptococcus pneumoniae R6
uccaacauuguuugu

SEQ ID NO: 2171964 - RNA, 15 nt, Streptococcus pneumoniae R6
uccaaccaucaaaau

SEQ ID NO: 2171965 - RNA, 15 nt, Streptococcus pneumoniae R6
uccaacgacuuccag

SEQ ID NO: 2171966 - RNA, 17 nt, Streptococcus pneumoniae R6
uccaaguuccucuuuca

SEQ ID NO: 2171967 - RNA, 17 nt, Streptococcus pneumoniae R6
uccaauaauagaaaaca

SEQ ID NO: 2171968 - RNA, 22 nt, Streptococcus pneumoniae R6
uccaauaauagaaaacagacaa

SEQ ID NO: 2171969 - RNA, 22 nt, Streptococcus pneumoniae R6
uccaagcauaacagcauuucca

SEQ ID NO: 2171970 - RNA, 19 nt, Streptococcus pneumoniae R6
uccaagucguaagucuucg

SEQ ID NO: 2171971 - RNA, 19 nt, Streptococcus pneumoniae R6
uccaaggaaaguucuuccc

SEQ ID NO: 2171972 - RNA, 12 nt, Streptococcus pneumoniae R6
uccaaggcauuc

SEQ ID NO: 2171973 - RNA, 15 nt, Streptococcus pneumoniae R6
uccaaggcugaaauu

SEQ ID NO: 2171974 - RNA, 19 nt, Streptococcus pneumoniae R6
uccaaggcugaaauuggcu

SEQ ID NO: 2171975 - RNA, 22 nt, Streptococcus pneumoniae R6
uccaauccuuguaugacaucuu

SEQ ID NO: 2171976 - RNA, 19 nt, Streptococcus pneumoniae R6
uccaaucagaugacuggaa

SEQ ID NO: 2171977 - RNA, 17 nt, Streptococcus pneumoniae R6
uccaaucaucaucgugg

SEQ ID NO: 2171978 - RNA, 14 nt, Streptococcus pneumoniae R6
uccaauccuaaauc

SEQ ID NO: 2171979 - RNA, 16 nt, Streptococcus pneumoniae R6
uccaauauguucuaaa

SEQ ID NO: 2171980 - RNA, 15 nt, Streptococcus pneumoniae R6
uccaauagucauucc

SEQ ID NO: 2171981 - RNA, 18 nt, Streptococcus pneumoniae R6
uccacguuucuaauaauu

SEQ ID NO: 2171982 - RNA, 14 nt, Streptococcus pneumoniae R6
uccacuuccagaag

SEQ ID NO: 2171983 - RNA, 18 nt, Streptococcus pneumoniae R6
uccacgcgcacgaagggc

SEQ ID NO: 2171984 - RNA, 19 nt, Streptococcus pneumoniae R6
uccacgauauuguuguuuu

SEQ ID NO: 2171985 - RNA, 13 nt, Streptococcus pneumoniae R6
uccaauucaaagu

SEQ ID NO: 2171986 - RNA, 16 nt, Streptococcus pneumoniae R6
uccaccauucuuuccg

SEQ ID NO: 2171987 - RNA, 19 nt, Streptococcus pneumoniae R6
ucauuuaaaauuaaaaaga

SEQ ID NO: 2171988 - RNA, 15 nt, Streptococcus pneumoniae R6
ucauuuaauauauuu

SEQ ID NO: 2171989 - RNA, 17 nt, Streptococcus pneumoniae R6
ucauuuaauauauuuau

SEQ ID NO: 2171990 - RNA, 20 nt, Streptococcus pneumoniae R6
ucauuucuuuggcaccuuug

SEQ ID NO: 2171991 - RNA, 13 nt, Streptococcus pneumoniae R6
ucauuugauuuuc

SEQ ID NO: 2171992 - RNA, 15 nt, Streptococcus pneumoniae R6
ucauuugauuuuccu

SEQ ID NO: 2171993 - RNA, 22 nt, Streptococcus pneumoniae R6
ucauuugauuuuccuaaucaau

SEQ ID NO: 2171994 - RNA, 14 nt, Streptococcus pneumoniae R6
ucauuugaugagaa

SEQ ID NO: 2171995 - RNA, 16 nt, Streptococcus pneumoniae R6
ucauuuggcuauaaaa

SEQ ID NO: 2171996 - RNA, 18 nt, Streptococcus pneumoniae R6
ucauuuggcuauaaaaaa

SEQ ID NO: 2171997 - RNA, 21 nt, Streptococcus pneumoniae R6
uccaacagagaaaauucuaaa

SEQ ID NO: 2171998 - RNA, 23 nt, Streptococcus pneumoniae R6
uccaaagaaauggucggcauucu

SEQ ID NO: 2171999 - RNA, 21 nt, Streptococcus pneumoniae R6
uccaaagaccaugaggaaacg

SEQ ID NO: 2172000 - RNA, 19 nt, Streptococcus pneumoniae R6
uccaaagauagaauccauu

SEQ ID NO: 2172001 - RNA, 20 nt, Streptococcus pneumoniae R6
uccaaagaugagaggagaaa

SEQ ID NO: 2172002 - RNA, 20 nt, Streptococcus pneumoniae R6
uccaaacgaauguuguuacu

SEQ ID NO: 2172003 - RNA, 23 nt, Streptococcus pneumoniae R6
uccaaacgauuaucuaacaauaa

SEQ ID NO: 2172004 - RNA, 18 nt, Streptococcus pneumoniae R6
ucauuuucuacuaaaauu

SEQ ID NO: 2172005 - RNA, 19 nt, Streptococcus pneumoniae R6
ucauuuucuacuaaaauua

SEQ ID NO: 2172006 - RNA, 23 nt, Streptococcus pneumoniae R6
ucauuuucuugauuuguucucuu

SEQ ID NO: 2172007 - RNA, 13 nt, Streptococcus pneumoniae R6
ucauuuucuuaaa

SEQ ID NO: 2172008 - RNA, 20 nt, Streptococcus pneumoniae R6
ucauuuucuuuacuucugag

SEQ ID NO: 2172009 - RNA, 22 nt, Streptococcus pneumoniae R6
ucauuuucuuuuaccugaaaua

SEQ ID NO: 2172010 - RNA, 14 nt, Streptococcus pneumoniae R6
ucauuuugaaaucu

SEQ ID NO: 2172011 - RNA, 16 nt, Streptococcus pneumoniae R6
ucauuccaaucaucau

SEQ ID NO: 2172012 - RNA, 17 nt, Streptococcus pneumoniae R6
ucauugaguaugaaaua

SEQ ID NO: 2172013 - RNA, 22 nt, Streptococcus pneumoniae R6
ucauugacagaaccuuggaaau

SEQ ID NO: 2172014 - RNA, 19 nt, Streptococcus pneumoniae R6
ucauucgaaugauuucucu

SEQ ID NO: 2172015 - RNA, 17 nt, Streptococcus pneumoniae R6
ucauuccgacucugaag

SEQ ID NO: 2172016 - RNA, 19 nt, Streptococcus pneumoniae R6
ucauuccaucauaaaaaua

SEQ ID NO: 2172017 - RNA, 14 nt, Streptococcus pneumoniae R6
ucauuccaugaaaa

SEQ ID NO: 2172018 - RNA, 21 nt, Streptococcus pneumoniae R6
ucauuccauggcugacaacaa

SEQ ID NO: 2172019 - RNA, 15 nt, Streptococcus pneumoniae R6
ucauucccuccuuuu

SEQ ID NO: 2172020 - RNA, 16 nt, Streptococcus pneumoniae R6
ucauucccuguaauca

SEQ ID NO: 2172021 - RNA, 16 nt, Streptococcus pneumoniae R6
ucaguucuaucugcaa

SEQ ID NO: 2172022 - RNA, 19 nt, Streptococcus pneumoniae R6
ucaguuucauccacaaccu

SEQ ID NO: 2172023 - RNA, 20 nt, Streptococcus pneumoniae R6
ucaguuucaucuacaaccuc

SEQ ID NO: 2172024 - RNA, 12 nt, Streptococcus pneumoniae R6
ucaguuucuauu

SEQ ID NO: 2172025 - RNA, 13 nt, Streptococcus pneumoniae R6
ucauguuuuuaag

SEQ ID NO: 2172026 - RNA, 18 nt, Streptococcus pneumoniae R6
ucauguuucaacauguca

SEQ ID NO: 2172027 - RNA, 14 nt, Streptococcus pneumoniae R6
ucauuaaaacggag

SEQ ID NO: 2172028 - RNA, 15 nt, Streptococcus pneumoniae R6
ucauuacuaucaaaa

SEQ ID NO: 2172029 - RNA, 15 nt, Streptococcus pneumoniae R6
ucauguuagaaaaau

SEQ ID NO: 2172030 - RNA, 22 nt, Streptococcus pneumoniae R6
ugaugauaacgaauccaacucu

SEQ ID NO: 2172031 - RNA, 18 nt, Streptococcus pneumoniae R6
ugaugagggcgauuuucc

SEQ ID NO: 2172032 - RNA, 16 nt, Streptococcus pneumoniae R6
ugaugagagaucuaga

SEQ ID NO: 2172033 - RNA, 21 nt, Streptococcus pneumoniae R6
ugaugagauuauugguggcuu

SEQ ID NO: 2172034 - RNA, 18 nt, Streptococcus pneumoniae R6
ugaugagcaaaggauugu

SEQ ID NO: 2172035 - RNA, 18 nt, Streptococcus pneumoniae R6
ugaugacuucagcuccac

SEQ ID NO: 2172036 - RNA, 13 nt, Streptococcus pneumoniae R6
ugauuuaaauguu

SEQ ID NO: 2172037 - RNA, 14 nt, Streptococcus pneumoniae R6
ugauuguuuuuaaa

SEQ ID NO: 2172038 - RNA, 14 nt, Streptococcus pneumoniae R6
ugauuuuaauaauu

SEQ ID NO: 2172039 - RNA, 22 nt, Streptococcus pneumoniae R6
ugauuuuaaaugaguaugaaaa

SEQ ID NO: 2172040 - RNA, 12 nt, Streptococcus pneumoniae R6
ugauuuuaaaga

SEQ ID NO: 2172041 - RNA, 14 nt, Streptococcus pneumoniae R6
ugauuuuaaagaaa

SEQ ID NO: 2172042 - RNA, 15 nt, Streptococcus pneumoniae R6
ugauuuuaaagacuu

SEQ ID NO: 2172043 - RNA, 17 nt, Streptococcus pneumoniae R6
ugauucgcuauucuucu

SEQ ID NO: 2172044 - RNA, 18 nt, Streptococcus pneumoniae R6
ugauucgcucuucaaucu

SEQ ID NO: 2172045 - RNA, 19 nt, Streptococcus pneumoniae R6
ugauugcaaagcaaucuaa

SEQ ID NO: 2172046 - RNA, 21 nt, Streptococcus pneumoniae R6
ugauugccaugcugagacuca

SEQ ID NO: 2172047 - RNA, 13 nt, Streptococcus pneumoniae R6
ugcaaaagucagg

SEQ ID NO: 2172048 - RNA, 19 nt, Streptococcus pneumoniae R6
ugcaaacggaucaagccac

SEQ ID NO: 2172049 - RNA, 17 nt, Streptococcus pneumoniae R6
ugcaaauaagaaaucuc

SEQ ID NO: 2172050 - RNA, 17 nt, Streptococcus pneumoniae R6
ugcaaaguaaaguaagg

SEQ ID NO: 2172051 - RNA, 24 nt, Streptococcus pneumoniae R6
ugcaaaguauuccaccauucuuuc

SEQ ID NO: 2172052 - RNA, 16 nt, Streptococcus pneumoniae R6
ugcaaaguuuucuuug

SEQ ID NO: 2172053 - RNA, 12 nt, Streptococcus pneumoniae R6
ugcaaagaguuu

SEQ ID NO: 2172054 - RNA, 15 nt, Streptococcus pneumoniae R6
ugcaaagcaaucuaa

SEQ ID NO: 2172055 - RNA, 17 nt, Streptococcus pneumoniae R6
ugcaaagacagggccuu

SEQ ID NO: 2172056 - RNA, 21 nt, Streptococcus pneumoniae R6
ugcaaagacagggccuuagca

SEQ ID NO: 2172057 - RNA, 19 nt, Streptococcus pneumoniae R6
ugauuuuuucauagcacua

SEQ ID NO: 2172058 - RNA, 13 nt, Streptococcus pneumoniae R6
ugauuuuuuacug

SEQ ID NO: 2172059 - RNA, 15 nt, Streptococcus pneumoniae R6
ugcaaaaaaaaugaa

SEQ ID NO: 2172060 - RNA, 17 nt, Streptococcus pneumoniae R6
ugcaaaaaaaaugaaaa

SEQ ID NO: 2172061 - RNA, 18 nt, Streptococcus pneumoniae R6
ugcaaaaaaaaugaaaaa

SEQ ID NO: 2172062 - RNA, 18 nt, Streptococcus pneumoniae R6
ugauuuugugcucuuaaa

SEQ ID NO: 2172063 - RNA, 21 nt, Streptococcus pneumoniae R6
ugauuuugaaaauuuuuccca

SEQ ID NO: 2172064 - RNA, 15 nt, Streptococcus pneumoniae R6
ugauuuucauugagu

SEQ ID NO: 2172065 - RNA, 17 nt, Streptococcus pneumoniae R6
ugcaaguagaacgcuga

SEQ ID NO: 2172066 - RNA, 21 nt, Streptococcus pneumoniae R6
ugcaaguucuucucuuuucuu

SEQ ID NO: 2172067 - RNA, 22 nt, Streptococcus pneumoniae R6
ugcaaguucuucucuuuucuua

SEQ ID NO: 2172068 - RNA, 23 nt, Streptococcus pneumoniae R6
ugcaaucucuguuaagaaauaaa

SEQ ID NO: 2172069 - RNA, 14 nt, Streptococcus pneumoniae R6
ugcaaucccaagcc

SEQ ID NO: 2172070 - RNA, 23 nt, Streptococcus pneumoniae R6
ugcaaucccaagcccugcaaacu

SEQ ID NO: 2172071 - RNA, 15 nt, Streptococcus pneumoniae R6
ugcaaucauugcaaa

SEQ ID NO: 2172072 - RNA, 19 nt, Streptococcus pneumoniae R6
ugcaaucauuucaaagccu

SEQ ID NO: 2172073 - RNA, 16 nt, Streptococcus pneumoniae R6
ugcaaugagccaagga

SEQ ID NO: 2172074 - RNA, 14 nt, Streptococcus pneumoniae R6
ugcaauugaauucu

SEQ ID NO: 2172075 - RNA, 20 nt, Streptococcus pneumoniae R6
ugcaacuuguuuuuccugau

SEQ ID NO: 2172076 - RNA, 16 nt, Streptococcus pneumoniae R6
ugcaagcccuuauuuc

SEQ ID NO: 2172077 - RNA, 11 nt, Streptococcus pneumoniae R6
ugcaagacaca

SEQ ID NO: 2172078 - RNA, 20 nt, Streptococcus pneumoniae R6
ugcaagagcgguuaauuuaa

SEQ ID NO: 2172079 - RNA, 19 nt, Streptococcus pneumoniae R6
ugcaagagggcuucaaucu

SEQ ID NO: 2172080 - RNA, 14 nt, Streptococcus pneumoniae R6
ugcaagauauucau

SEQ ID NO: 2172081 - RNA, 16 nt, Streptococcus pneumoniae R6
ugcaaggcaagacuga

SEQ ID NO: 2172082 - RNA, 17 nt, Streptococcus pneumoniae R6
ugcaaggcaagacugac

SEQ ID NO: 2172083 - RNA, 17 nt, Streptococcus pneumoniae R6
ugcaaauuuauaaaucu

SEQ ID NO: 2172084 - RNA, 22 nt, Streptococcus pneumoniae R6
ugcaaauuuauaaaucuucuaa

SEQ ID NO: 2172085 - RNA, 22 nt, Streptococcus pneumoniae R6
ugcaaauuauuuacagaaagaa

SEQ ID NO: 2172086 - RNA, 16 nt, Streptococcus pneumoniae R6
ugcaaccucaaaacag

SEQ ID NO: 2172087 - RNA, 17 nt, Streptococcus pneumoniae R6
ugcaaccucaaaacagu

SEQ ID NO: 2172088 - RNA, 22 nt, Streptococcus pneumoniae R6
ugcagcaacgucuucaauacca

SEQ ID NO: 2172089 - RNA, 21 nt, Streptococcus pneumoniae R6
ugcacacucagaacccuuauu

SEQ ID NO: 2172090 - RNA, 16 nt, Streptococcus pneumoniae R6
ugcacacgaaucugau

SEQ ID NO: 2172091 - RNA, 13 nt, Streptococcus pneumoniae R6
ugcaguuuucauu

SEQ ID NO: 2172092 - RNA, 14 nt, Streptococcus pneumoniae R6
ugcaguuuucauuc

SEQ ID NO: 2172093 - RNA, 18 nt, Streptococcus pneumoniae R6
ugcaguuuucauucuacu

SEQ ID NO: 2172094 - RNA, 12 nt, Streptococcus pneumoniae R6
ugcaguucccac

SEQ ID NO: 2172095 - RNA, 19 nt, Streptococcus pneumoniae R6
ugcaucaacuauucuuuuu

SEQ ID NO: 2172096 - RNA, 14 nt, Streptococcus pneumoniae R6
ugcauuuagauagu

SEQ ID NO: 2172097 - RNA, 19 nt, Streptococcus pneumoniae R6
ugcauuuagauaguaccaa

SEQ ID NO: 2172098 - RNA, 18 nt, Streptococcus pneumoniae R6
ugcauuuuaauuucaaug

SEQ ID NO: 2172099 - RNA, 17 nt, Streptococcus pneumoniae R6
ugccaaucgacccugga

SEQ ID NO: 2172100 - RNA, 15 nt, Streptococcus pneumoniae R6
ugccaauugcucaac

SEQ ID NO: 2172101 - RNA, 20 nt, Streptococcus pneumoniae R6
ugccaauugcucaacuucuu

SEQ ID NO: 2172102 - RNA, 18 nt, Streptococcus pneumoniae R6
ugcauccaacaauucuug

SEQ ID NO: 2172103 - RNA, 19 nt, Streptococcus pneumoniae R6
ugcauccaccuucaucucu

SEQ ID NO: 2172104 - RNA, 17 nt, Streptococcus pneumoniae R6
ugcaucguucaauggaa

SEQ ID NO: 2172105 - RNA, 19 nt, Streptococcus pneumoniae R6
ugcaucugccagaaauucc

SEQ ID NO: 2172106 - RNA, 18 nt, Streptococcus pneumoniae R6
ugcaucguggaucauggu

SEQ ID NO: 2172107 - RNA, 20 nt, Streptococcus pneumoniae R6
ugcauucgaaacgugggcug

SEQ ID NO: 2172108 - RNA, 22 nt, Streptococcus pneumoniae R6
ugagauuucacgguaauuguuu

SEQ ID NO: 2172109 - RNA, 16 nt, Streptococcus pneumoniae R6
ugagauuuuggaagag

SEQ ID NO: 2172110 - RNA, 21 nt, Streptococcus pneumoniae R6
ugagauaguaucaaaugacua

SEQ ID NO: 2172111 - RNA, 12 nt, Streptococcus pneumoniae R6
ugagauacucca

SEQ ID NO: 2172112 - RNA, 20 nt, Streptococcus pneumoniae R6
ugagauacuccaaaacaucu

SEQ ID NO: 2172113 - RNA, 15 nt, Streptococcus pneumoniae R6
ugagauaaggacugc

SEQ ID NO: 2172114 - RNA, 15 nt, Streptococcus pneumoniae R6
ugagauaauacaauu

SEQ ID NO: 2172115 - RNA, 19 nt, Streptococcus pneumoniae R6
ugagauauuucuucuuuuc

SEQ ID NO: 2172116 - RNA, 18 nt, Streptococcus pneumoniae R6
ugagcaagucucuccagc

SEQ ID NO: 2172117 - RNA, 14 nt, Streptococcus pneumoniae R6
ugagcaauuccuuc

SEQ ID NO: 2172118 - RNA, 14 nt, Streptococcus pneumoniae R6
ugagcuauuagaug

SEQ ID NO: 2172119 - RNA, 13 nt, Streptococcus pneumoniae R6
ugagcgguuuuag

SEQ ID NO: 2172120 - RNA, 15 nt, Streptococcus pneumoniae R6
ugagcucuuuuggga

SEQ ID NO: 2172121 - RNA, 14 nt, Streptococcus pneumoniae R6
ugaggagauuggaa

SEQ ID NO: 2172122 - RNA, 16 nt, Streptococcus pneumoniae R6
ugaggagcgaggccgc

SEQ ID NO: 2172123 - RNA, 20 nt, Streptococcus pneumoniae R6
ugaggaccgacaccaguauu

SEQ ID NO: 2172124 - RNA, 21 nt, Streptococcus pneumoniae R6
ugaggaaguaccaaggaagaa

SEQ ID NO: 2172125 - RNA, 23 nt, Streptococcus pneumoniae R6
ugaggacaauagcgaguaggcug

SEQ ID NO: 2172126 - RNA, 17 nt, Streptococcus pneumoniae R6
ugagggcuagacggcug

SEQ ID NO: 2172127 - RNA, 13 nt, Streptococcus pneumoniae R6
ugagguaauuaug

SEQ ID NO: 2172128 - RNA, 23 nt, Streptococcus pneumoniae R6
ugaguggaaaaaccuucaagcuu

SEQ ID NO: 2172129 - RNA, 23 nt, Streptococcus pneumoniae R6
ugaguuuuugaagaauguuuuca

SEQ ID NO: 2172130 - RNA, 15 nt, Streptococcus pneumoniae R6
ugaguuuucuugugu

SEQ ID NO: 2172131 - RNA, 22 nt, Streptococcus pneumoniae R6
ugaguuuucuuguguuuaaaua

SEQ ID NO: 2172132 - RNA, 23 nt, Streptococcus pneumoniae R6
ugaguuuugcccauucuuuagca

SEQ ID NO: 2172133 - RNA, 19 nt, Streptococcus pneumoniae R6
ugaguuuuucccagccuuc

SEQ ID NO: 2172134 - RNA, 19 nt, Streptococcus pneumoniae R6
ugauaaaacgcauaaaauc

SEQ ID NO: 2172135 - RNA, 16 nt, Streptococcus pneumoniae R6
ugauaagauaaagugg

SEQ ID NO: 2172136 - RNA, 16 nt, Streptococcus pneumoniae R6
ugauaagauaaggcau

SEQ ID NO: 2172137 - RNA, 18 nt, Streptococcus pneumoniae R6
ugauaaaauuuaaaaaua

SEQ ID NO: 2172138 - RNA, 20 nt, Streptococcus pneumoniae R6
ugaguguaaaaagaaagucc

SEQ ID NO: 2172139 - RNA, 20 nt, Streptococcus pneumoniae R6
ugaguguaaacugacaacuu

SEQ ID NO: 2172140 - RNA, 14 nt, Streptococcus pneumoniae R6
ugauacgaaaucau

SEQ ID NO: 2172141 - RNA, 22 nt, Streptococcus pneumoniae R6
ugauagagauuauagugguguu

SEQ ID NO: 2172142 - RNA, 16 nt, Streptococcus pneumoniae R6
ugauagagcugauagu

SEQ ID NO: 2172143 - RNA, 18 nt, Streptococcus pneumoniae R6
ugauagaaucguuucuga

SEQ ID NO: 2172144 - RNA, 13 nt, Streptococcus pneumoniae R6
ugauagaguagug

SEQ ID NO: 2172145 - RNA, 18 nt, Streptococcus pneumoniae R6
ugauagaguucguaguaa

SEQ ID NO: 2172146 - RNA, 23 nt, Streptococcus pneumoniae R6
ugauagaaaagcccuucaucagu

SEQ ID NO: 2172147 - RNA, 14 nt, Streptococcus pneumoniae R6
ugauaagguacaga

SEQ ID NO: 2172148 - RNA, 15 nt, Streptococcus pneumoniae R6
ugauaagguacagac

SEQ ID NO: 2172149 - RNA, 19 nt, Streptococcus pneumoniae R6
ugauaagauuuuuggaaaa

SEQ ID NO: 2172150 - RNA, 12 nt, Streptococcus pneumoniae R6
ugauaccagagc

SEQ ID NO: 2172151 - RNA, 22 nt, Streptococcus pneumoniae R6
ugauagccauucccaucaauau

SEQ ID NO: 2172152 - RNA, 17 nt, Streptococcus pneumoniae R6
ugauagccuuguauuca

SEQ ID NO: 2172153 - RNA, 19 nt, Streptococcus pneumoniae R6
ugauagcguucguucauau

SEQ ID NO: 2172154 - RNA, 23 nt, Streptococcus pneumoniae R6
ugauauagucuauugaaguuaga

SEQ ID NO: 2172155 - RNA, 14 nt, Streptococcus pneumoniae R6
ugauauauaaauga

SEQ ID NO: 2172156 - RNA, 15 nt, Streptococcus pneumoniae R6
ugauauauaaaugaa

SEQ ID NO: 2172157 - RNA, 20 nt, Streptococcus pneumoniae R6
ugauauaaugguuauaucug

SEQ ID NO: 2172158 - RNA, 20 nt, Streptococcus pneumoniae R6
ugauauacacacuuaaauug

SEQ ID NO: 2172159 - RNA, 16 nt, Streptococcus pneumoniae R6
ugauauaauaaaaaga

SEQ ID NO: 2172160 - RNA, 17 nt, Streptococcus pneumoniae R6
ugauauaauaaaaagag

SEQ ID NO: 2172161 - RNA, 15 nt, Streptococcus pneumoniae R6
ugauauauuuaucca

SEQ ID NO: 2172162 - RNA, 13 nt, Streptococcus pneumoniae R6
ugauaucuaucaa

SEQ ID NO: 2172163 - RNA, 21 nt, Streptococcus pneumoniae R6
ugaucgagcagauuucuuuua

SEQ ID NO: 2172164 - RNA, 16 nt, Streptococcus pneumoniae R6
ugauaucuggauuuuc

SEQ ID NO: 2172165 - RNA, 20 nt, Streptococcus pneumoniae R6
ugauaucuggauuuucaacu

SEQ ID NO: 2172166 - RNA, 19 nt, Streptococcus pneumoniae R6
ugauaucugguauauuuug

SEQ ID NO: 2172167 - RNA, 14 nt, Streptococcus pneumoniae R6
ugauaucugguugc

SEQ ID NO: 2172168 - RNA, 13 nt, Streptococcus pneumoniae R6
ugauaucuuuaga

SEQ ID NO: 2172169 - RNA, 14 nt, Streptococcus pneumoniae R6
ugauaucuuuagaa

SEQ ID NO: 2172170 - RNA, 17 nt, Streptococcus pneumoniae R6
ugauaucuuugauuuua

SEQ ID NO: 2172171 - RNA, 19 nt, Streptococcus pneumoniae R6
ugauaugagagauuucucc

SEQ ID NO: 2172172 - RNA, 22 nt, Streptococcus pneumoniae R6
ugaucccuccauuucauagcua

SEQ ID NO: 2172173 - RNA, 19 nt, Streptococcus pneumoniae R6
ugacgcuucccucucagau

SEQ ID NO: 2172174 - RNA, 19 nt, Streptococcus pneumoniae R6
ugacgcuggaaauaagaau

SEQ ID NO: 2172175 - RNA, 19 nt, Streptococcus pneumoniae R6
ugacguggguguagaugga

SEQ ID NO: 2172176 - RNA, 13 nt, Streptococcus pneumoniae R6
ugacgucguaacc

SEQ ID NO: 2172177 - RNA, 15 nt, Streptococcus pneumoniae R6
ugacgucguaaccag

SEQ ID NO: 2172178 - RNA, 20 nt, Streptococcus pneumoniae R6
ugacgugguuugaagagauu

SEQ ID NO: 2172179 - RNA, 16 nt, Streptococcus pneumoniae R6
ugacguucuucugcag

SEQ ID NO: 2172180 - RNA, 14 nt, Streptococcus pneumoniae R6
ugacuauauuucua

SEQ ID NO: 2172181 - RNA, 23 nt, Streptococcus pneumoniae R6
ugacuauauuucuauacuuuuuc

SEQ ID NO: 2172182 - RNA, 13 nt, Streptococcus pneumoniae R6
ugacuagugaagc

SEQ ID NO: 2172183 - RNA, 21 nt, Streptococcus pneumoniae R6
ugacuauagcguuuugaaacu

SEQ ID NO: 2172184 - RNA, 20 nt, Streptococcus pneumoniae R6
ugacuagcaaucaaaauugu

SEQ ID NO: 2172185 - RNA, 18 nt, Streptococcus pneumoniae R6
ugacuaacccuucuuuuu

SEQ ID NO: 2172186 - RNA, 21 nt, Streptococcus pneumoniae R6
ugacuaacccuucuuuuuaua

SEQ ID NO: 2172187 - RNA, 23 nt, Streptococcus pneumoniae R6
ugacuuagccauguuuuucuccu

SEQ ID NO: 2172188 - RNA, 17 nt, Streptococcus pneumoniae R6
ugacugacuucgucagu

SEQ ID NO: 2172189 - RNA, 12 nt, Streptococcus pneumoniae R6
ugacugagagcu

SEQ ID NO: 2172190 - RNA, 12 nt, Streptococcus pneumoniae R6
ugacuucgucag

SEQ ID NO: 2172191 - RNA, 23 nt, Streptococcus pneumoniae R6
ugacuucauuauuaugaaaacca

SEQ ID NO: 2172192 - RNA, 22 nt, Streptococcus pneumoniae R6
ugacuucgucaguuccauccac

SEQ ID NO: 2172193 - RNA, 22 nt, Streptococcus pneumoniae R6
ugacuucgucaguucuauccac

SEQ ID NO: 2172194 - RNA, 20 nt, Streptococcus pneumoniae R6
ugacuucgucaguucuaucu

SEQ ID NO: 2172195 - RNA, 15 nt, Streptococcus pneumoniae R6
ugacuucgucaguuu

SEQ ID NO: 2172196 - RNA, 17 nt, Streptococcus pneumoniae R6
ugacuucgucaguuuca

SEQ ID NO: 2172197 - RNA, 22 nt, Streptococcus pneumoniae R6
ugacuucgucaguuucaucuac

SEQ ID NO: 2172198 - RNA, 23 nt, Streptococcus pneumoniae R6
ugacuucuuaaucaauuaucauu

SEQ ID NO: 2172199 - RNA, 19 nt, Streptococcus pneumoniae R6
ugacucggccuucuuuuua

SEQ ID NO: 2172200 - RNA, 17 nt, Streptococcus pneumoniae R6
ugacuccccauuuacca

SEQ ID NO: 2172201 - RNA, 22 nt, Streptococcus pneumoniae R6
ugacugaaaguuuuccaaagga

SEQ ID NO: 2172202 - RNA, 18 nt, Streptococcus pneumoniae R6
ugagaagagcuucuuuca

SEQ ID NO: 2172203 - RNA, 13 nt, Streptococcus pneumoniae R6
ugagaagaacauu

SEQ ID NO: 2172204 - RNA, 14 nt, Streptococcus pneumoniae R6
ugagaacuuucuuu

SEQ ID NO: 2172205 - RNA, 17 nt, Streptococcus pneumoniae R6
ugagaagccaaaaucau

SEQ ID NO: 2172206 - RNA, 20 nt, Streptococcus pneumoniae R6
ugagaagcccaguacuagac

SEQ ID NO: 2172207 - RNA, 20 nt, Streptococcus pneumoniae R6
ugagaagcccauaucuccag

SEQ ID NO: 2172208 - RNA, 18 nt, Streptococcus pneumoniae R6
ugagaaaucguuucuaau

SEQ ID NO: 2172209 - RNA, 20 nt, Streptococcus pneumoniae R6
ugagaaaguuaaaaaaacua

SEQ ID NO: 2172210 - RNA, 18 nt, Streptococcus pneumoniae R6
ugagacuugcaagaaagu

SEQ ID NO: 2172211 - RNA, 20 nt, Streptococcus pneumoniae R6
ugagaggaggugaaacuaau

SEQ ID NO: 2172212 - RNA, 16 nt, Streptococcus pneumoniae R6
ugagagcgacuuuuuc

SEQ ID NO: 2172213 - RNA, 22 nt, Streptococcus pneumoniae R6
ugagagcuuauuuuugcaagug

SEQ ID NO: 2172214 - RNA, 19 nt, Streptococcus pneumoniae R6
ugacgauuuucucuuuauc

SEQ ID NO: 2172215 - RNA, 22 nt, Streptococcus pneumoniae R6
ugacgcacaaacuucaucccag

SEQ ID NO: 2172216 - RNA, 19 nt, Streptococcus pneumoniae R6
ugacgcauaguugcauuaa

SEQ ID NO: 2172217 - RNA, 16 nt, Streptococcus pneumoniae R6
ugacgcgguuugaaga

SEQ ID NO: 2172218 - RNA, 20 nt, Streptococcus pneumoniae R6
ugaccguccucauauucaag

SEQ ID NO: 2172219 - RNA, 13 nt, Streptococcus pneumoniae R6
ugaccggcuuccu

SEQ ID NO: 2172220 - RNA, 21 nt, Streptococcus pneumoniae R6
ugacgauaaauugcuggagaa

SEQ ID NO: 2172221 - RNA, 14 nt, Streptococcus pneumoniae R6
ugacgagugaagaa

SEQ ID NO: 2172222 - RNA, 15 nt, Streptococcus pneumoniae R6
ugacgagugaagaau

SEQ ID NO: 2172223 - RNA, 20 nt, Streptococcus pneumoniae R6
ugacgagagugauaacauaa

SEQ ID NO: 2172224 - RNA, 18 nt, Streptococcus pneumoniae R6
ugacgaagucagcucaaa

SEQ ID NO: 2172225 - RNA, 22 nt, Streptococcus pneumoniae R6
ugacgaagucagcucaaaacac

SEQ ID NO: 2172226 - RNA, 22 nt, Streptococcus pneumoniae R6
ugacgaagucagcucaaaacau

SEQ ID NO: 2172227 - RNA, 15 nt, Streptococcus pneumoniae R6
ugaccaccauuuuua

SEQ ID NO: 2172228 - RNA, 15 nt, Streptococcus pneumoniae R6
ugaccacucugcgac

SEQ ID NO: 2172229 - RNA, 16 nt, Streptococcus pneumoniae R6
ugacaugcuccucugu

SEQ ID NO: 2172230 - RNA, 21 nt, Streptococcus pneumoniae R6
ugacaucugugauuucaguug

SEQ ID NO: 2172231 - RNA, 14 nt, Streptococcus pneumoniae R6
ugaccaaguccuca

SEQ ID NO: 2172232 - RNA, 12 nt, Streptococcus pneumoniae R6
ugacauuccugu

SEQ ID NO: 2172233 - RNA, 19 nt, Streptococcus pneumoniae R6
ucugauagugguguuucaa

SEQ ID NO: 2172234 - RNA, 13 nt, Streptococcus pneumoniae R6
ucugacuuuucca

SEQ ID NO: 2172235 - RNA, 21 nt, Streptococcus pneumoniae R6
ucugacuuugggagaauuuca

SEQ ID NO: 2172236 - RNA, 16 nt, Streptococcus pneumoniae R6
ucugacuagcaucuug

SEQ ID NO: 2172237 - RNA, 15 nt, Streptococcus pneumoniae R6
ucugaauagaaggcu

SEQ ID NO: 2172238 - RNA, 18 nt, Streptococcus pneumoniae R6
ucugaauagcuuaaaauc

SEQ ID NO: 2172239 - RNA, 13 nt, Streptococcus pneumoniae R6
ucucuuucuaaaa

SEQ ID NO: 2172240 - RNA, 17 nt, Streptococcus pneumoniae R6
aaaugcugguuuuuacu

SEQ ID NO: 2172241 - RNA, 10 nt, Streptococcus pneumoniae R6
ucugaaaaag

SEQ ID NO: 2172242 - RNA, 10 nt, Streptococcus pneumoniae R6
ucugaaaaau

SEQ ID NO: 2172243 - RNA, 14 nt, Streptococcus pneumoniae R6
ucucuuuguucuuu

SEQ ID NO: 2172244 - RNA, 20 nt, Streptococcus pneumoniae R6
ucucuuugaaugccuguucc

SEQ ID NO: 2172245 - RNA, 24 nt, Streptococcus pneumoniae R6
ucugaaguuggccgaugaugguaa

SEQ ID NO: 2172246 - RNA, 14 nt, Streptococcus pneumoniae R6
ucugaagaaagcaa

SEQ ID NO: 2172247 - RNA, 17 nt, Streptococcus pneumoniae R6
ucugaagacaaaucauu

SEQ ID NO: 2172248 - RNA, 22 nt, Streptococcus pneumoniae R6
ucucuucaaaccacgucagcuu

SEQ ID NO: 2172249 - RNA, 19 nt, Streptococcus pneumoniae R6
ucucuuauuguauaguaga

SEQ ID NO: 2172250 - RNA, 22 nt, Streptococcus pneumoniae R6
ucucuucaaauuugacuaaaaa

SEQ ID NO: 2172251 - RNA, 13 nt, Streptococcus pneumoniae R6
ucucuuagaucua

SEQ ID NO: 2172252 - RNA, 19 nt, Streptococcus pneumoniae R6
ucucuagaaaucucuuuuu

SEQ ID NO: 2172253 - RNA, 15 nt, Streptococcus pneumoniae R6
ucucuaggaauauca

SEQ ID NO: 2172254 - RNA, 21 nt, Streptococcus pneumoniae R6
ucucuaggaauaucaaaguuu

SEQ ID NO: 2172255 - RNA, 15 nt, Streptococcus pneumoniae R6
ucucuacaaauaaga

SEQ ID NO: 2172256 - RNA, 23 nt, Streptococcus pneumoniae R6
ucucuacauucccaaacaaaaaa

SEQ ID NO: 2172257 - RNA, 23 nt, Streptococcus pneumoniae R6
ucucuagucuggagauuuuucaa

SEQ ID NO: 2172258 - RNA, 18 nt, Streptococcus pneumoniae R6
ucucuagguuaaagguuu

SEQ ID NO: 2172259 - RNA, 16 nt, Streptococcus pneumoniae R6
ucucuauaauaacucc

SEQ ID NO: 2172260 - RNA, 17 nt, Streptococcus pneumoniae R6
ucucguaaacaaagagg

SEQ ID NO: 2172261 - RNA, 14 nt, Streptococcus pneumoniae R6
ucugcuaacugcug

SEQ ID NO: 2172262 - RNA, 15 nt, Streptococcus pneumoniae R6
ucugcuaacugcugg

SEQ ID NO: 2172263 - RNA, 21 nt, Streptococcus pneumoniae R6
ucugcuaacugcuggauagag

SEQ ID NO: 2172264 - RNA, 17 nt, Streptococcus pneumoniae R6
ucugcggauaaaaccug

SEQ ID NO: 2172265 - RNA, 14 nt, Streptococcus pneumoniae R6
ucugcugacugauu

SEQ ID NO: 2172266 - RNA, 14 nt, Streptococcus pneumoniae R6
ucugcuauuucuaa

SEQ ID NO: 2172267 - RNA, 19 nt, Streptococcus pneumoniae R6
ucugcuagacuaacuucuu

SEQ ID NO: 2172268 - RNA, 16 nt, Streptococcus pneumoniae R6
ucugcucgcuggagau

SEQ ID NO: 2172269 - RNA, 19 nt, Streptococcus pneumoniae R6
ucuggaagugaaaaagcaa

SEQ ID NO: 2172270 - RNA, 18 nt, Streptococcus pneumoniae R6
ucuggagaagcaccaguu

SEQ ID NO: 2172271 - RNA, 18 nt, Streptococcus pneumoniae R6
ucuggauaacugaaauug

SEQ ID NO: 2172272 - RNA, 20 nt, Streptococcus pneumoniae R6
ucuggaguagcauccccagu

SEQ ID NO: 2172273 - RNA, 15 nt, Streptococcus pneumoniae R6
ucuggauauccuuuu

SEQ ID NO: 2172274 - RNA, 14 nt, Streptococcus pneumoniae R6
ucugggcuaauucu

SEQ ID NO: 2172275 - RNA, 13 nt, Streptococcus pneumoniae R6
ucugggugcugaa

SEQ ID NO: 2172276 - RNA, 23 nt, Streptococcus pneumoniae R6
ucugcaaaaaauauuuauaguaa

SEQ ID NO: 2172277 - RNA, 22 nt, Streptococcus pneumoniae R6
ucugaugcacuauuuuccaaaa

SEQ ID NO: 2172278 - RNA, 18 nt, Streptococcus pneumoniae R6
ucugaugccaucuucgua

SEQ ID NO: 2172279 - RNA, 21 nt, Streptococcus pneumoniae R6
ucugccgccauacuuucucug

SEQ ID NO: 2172280 - RNA, 15 nt, Streptococcus pneumoniae R6
ucugcccaaagacag

SEQ ID NO: 2172281 - RNA, 16 nt, Streptococcus pneumoniae R6
ucugccauaucaucgu

SEQ ID NO: 2172282 - RNA, 16 nt, Streptococcus pneumoniae R6
ucugcaacaacagcug

SEQ ID NO: 2172283 - RNA, 19 nt, Streptococcus pneumoniae R6
ucugccuuuuuauccaaaa

SEQ ID NO: 2172284 - RNA, 15 nt, Streptococcus pneumoniae R6
ucugccuuccuuguc

SEQ ID NO: 2172285 - RNA, 16 nt, Streptococcus pneumoniae R6
ucugccuuccuugucu

SEQ ID NO: 2172286 - RNA, 14 nt, Streptococcus pneumoniae R6
ucuuaaaagcaaaa

SEQ ID NO: 2172287 - RNA, 22 nt, Streptococcus pneumoniae R6
ucuuaaccucuugaaguucauu

SEQ ID NO: 2172288 - RNA, 17 nt, Streptococcus pneumoniae R6
ucuguuuggcaagugcc

SEQ ID NO: 2172289 - RNA, 18 nt, Streptococcus pneumoniae R6
ucuguuuuugaagaaaag

SEQ ID NO: 2172290 - RNA, 23 nt, Streptococcus pneumoniae R6
ucuuaauaucagccagagcacca

SEQ ID NO: 2172291 - RNA, 21 nt, Streptococcus pneumoniae R6
ucuuaaugucagucugguucc

SEQ ID NO: 2172292 - RNA, 23 nt, Streptococcus pneumoniae R6
ucuuaauucucuuauuguuguaa

SEQ ID NO: 2172293 - RNA, 17 nt, Streptococcus pneumoniae R6
ucuuauuucaaucugcu

SEQ ID NO: 2172294 - RNA, 18 nt, Streptococcus pneumoniae R6
ucuuauuucauuucacua

SEQ ID NO: 2172295 - RNA, 21 nt, Streptococcus pneumoniae R6
ucuuauuucauuuuacuauau

SEQ ID NO: 2172296 - RNA, 14 nt, Streptococcus pneumoniae R6
ucuuauuauucucu

SEQ ID NO: 2172297 - RNA, 12 nt, Streptococcus pneumoniae R6
ucuuagcaaaac

SEQ ID NO: 2172298 - RNA, 12 nt, Streptococcus pneumoniae R6
ucuuagcaaaga

SEQ ID NO: 2172299 - RNA, 22 nt, Streptococcus pneumoniae R6
ucuuacuguccuucuuuuacuu

SEQ ID NO: 2172300 - RNA, 17 nt, Streptococcus pneumoniae R6
ucuucccguagguuuuc

SEQ ID NO: 2172301 - RNA, 19 nt, Streptococcus pneumoniae R6
ucuucccguagguuuucuc

SEQ ID NO: 2172302 - RNA, 20 nt, Streptococcus pneumoniae R6
ucuucccguagguuuucucc

SEQ ID NO: 2172303 - RNA, 20 nt, Streptococcus pneumoniae R6
ucuuccgaauaacucaaaag

SEQ ID NO: 2172304 - RNA, 23 nt, Streptococcus pneumoniae R6
ucuuccgaauaacucaaaagcuu

SEQ ID NO: 2172305 - RNA, 23 nt, Streptococcus pneumoniae R6
ucuucauucaaagaaccugcagu

SEQ ID NO: 2172306 - RNA, 19 nt, Streptococcus pneumoniae R6
ucuuauuucaaaaaaugua

SEQ ID NO: 2172307 - RNA, 15 nt, Streptococcus pneumoniae R6
ucuuauuuuucuauu

SEQ ID NO: 2172308 - RNA, 15 nt, Streptococcus pneumoniae R6
ucuucaaaaaagugu

SEQ ID NO: 2172309 - RNA, 19 nt, Streptococcus pneumoniae R6
ucuucaaaaaucucuucaa

SEQ ID NO: 2172310 - RNA, 16 nt, Streptococcus pneumoniae R6
ucuucaaagaagucca

SEQ ID NO: 2172311 - RNA, 20 nt, Streptococcus pneumoniae R6
ucuucaaaccacgucagcuu

SEQ ID NO: 2172312 - RNA, 19 nt, Streptococcus pneumoniae R6
ucuucaaaccgcgucagcu

SEQ ID NO: 2172313 - RNA, 23 nt, Streptococcus pneumoniae R6
ucuucaaacuacgucagcuucca

SEQ ID NO: 2172314 - RNA, 17 nt, Streptococcus pneumoniae R6
ucuucagccuuauauuu

SEQ ID NO: 2172315 - RNA, 18 nt, Streptococcus pneumoniae R6
ucuucagccuuauauuuu

SEQ ID NO: 2172316 - RNA, 17 nt, Streptococcus pneumoniae R6
ucuucagcagcuaaaaa

SEQ ID NO: 2172317 - RNA, 13 nt, Streptococcus pneumoniae R6
ucuucagcaaaac

SEQ ID NO: 2172318 - RNA, 16 nt, Streptococcus pneumoniae R6
ucuucaguauaaacug

SEQ ID NO: 2172319 - RNA, 17 nt, Streptococcus pneumoniae R6
ucuucugguuuggcaaa

SEQ ID NO: 2172320 - RNA, 15 nt, Streptococcus pneumoniae R6
ucuucuguaccaaua

SEQ ID NO: 2172321 - RNA, 23 nt, Streptococcus pneumoniae R6
ucuucuguaccaauacuacaaua

SEQ ID NO: 2172322 - RNA, 16 nt, Streptococcus pneumoniae R6
ucuucucuuuucuuau

SEQ ID NO: 2172323 - RNA, 15 nt, Streptococcus pneumoniae R6
ucuucuugauacuga

SEQ ID NO: 2172324 - RNA, 15 nt, Streptococcus pneumoniae R6
ucuucuucugaagca

SEQ ID NO: 2172325 - RNA, 19 nt, Streptococcus pneumoniae R6
ucuucuucgcuuucuucau

SEQ ID NO: 2172326 - RNA, 11 nt, Streptococcus pneumoniae R6
ucuucuuccau

SEQ ID NO: 2172327 - RNA, 21 nt, Streptococcus pneumoniae R6
ucuucuaguugguuuccuugg

SEQ ID NO: 2172328 - RNA, 20 nt, Streptococcus pneumoniae R6
ucuucuccaaaccauuuuug

SEQ ID NO: 2172329 - RNA, 13 nt, Streptococcus pneumoniae R6
ucuucuccaguuu

SEQ ID NO: 2172330 - RNA, 15 nt, Streptococcus pneumoniae R6
ucuucuccgaagacu

SEQ ID NO: 2172331 - RNA, 20 nt, Streptococcus pneumoniae R6
ucuucuccgaagacuuuaaa

SEQ ID NO: 2172332 - RNA, 12 nt, Streptococcus pneumoniae R6
ucuucucaggcu

SEQ ID NO: 2172333 - RNA, 22 nt, Streptococcus pneumoniae R6
ucuucgaaauuccauaccuaaa

SEQ ID NO: 2172334 - RNA, 17 nt, Streptococcus pneumoniae R6
ucuucgacaguaaaaua

SEQ ID NO: 2172335 - RNA, 21 nt, Streptococcus pneumoniae R6
ucuugaggaagagcuuugcuu

SEQ ID NO: 2172336 - RNA, 17 nt, Streptococcus pneumoniae R6
ucuugagcgauuuuaau

SEQ ID NO: 2172337 - RNA, 23 nt, Streptococcus pneumoniae R6
ucuugagcgauuuuaaugaccag

SEQ ID NO: 2172338 - RNA, 14 nt, Streptococcus pneumoniae R6
ucuugagacgauga

SEQ ID NO: 2172339 - RNA, 18 nt, Streptococcus pneumoniae R6
ucuugacgauaggugaua

SEQ ID NO: 2172340 - RNA, 21 nt, Streptococcus pneumoniae R6
ucuugaauuuacguccuugga

SEQ ID NO: 2172341 - RNA, 19 nt, Streptococcus pneumoniae R6
ucuugaacugcauuuuuuc

SEQ ID NO: 2172342 - RNA, 15 nt, Streptococcus pneumoniae R6
ucuugaaguccuucu

SEQ ID NO: 2172343 - RNA, 19 nt, Streptococcus pneumoniae R6
ucuugaaguucauuuucuu

SEQ ID NO: 2172344 - RNA, 19 nt, Streptococcus pneumoniae R6
ucuugaagacuuuuuaaag

SEQ ID NO: 2172345 - RNA, 23 nt, Streptococcus pneumoniae R6
ucuugacauacaacuuaaaaaga

SEQ ID NO: 2172346 - RNA, 16 nt, Streptococcus pneumoniae R6
ucuugaaaaugaaaga

SEQ ID NO: 2172347 - RNA, 13 nt, Streptococcus pneumoniae R6
ucuugaugaaaga

SEQ ID NO: 2172348 - RNA, 21 nt, Streptococcus pneumoniae R6
ucuugauggacaacaaugaga

SEQ ID NO: 2172349 - RNA, 22 nt, Streptococcus pneumoniae R6
ucuugauggacaacaaugagaa

SEQ ID NO: 2172350 - RNA, 20 nt, Streptococcus pneumoniae R6
ucuugauuuaggguacuuuc

SEQ ID NO: 2172351 - RNA, 14 nt, Streptococcus pneumoniae R6
ucuugauuuucauu

SEQ ID NO: 2172352 - RNA, 18 nt, Streptococcus pneumoniae R6
ucuugauuuucuuuaaaa

SEQ ID NO: 2172353 - RNA, 18 nt, Streptococcus pneumoniae R6
ucuugauuuuuuuuaaaa

SEQ ID NO: 2172354 - RNA, 16 nt, Streptococcus pneumoniae R6
ucuugcgcucaagcac

SEQ ID NO: 2172355 - RNA, 20 nt, Streptococcus pneumoniae R6
ucuugcauucguucuuggua

SEQ ID NO: 2172356 - RNA, 19 nt, Streptococcus pneumoniae R6
ucuugcauuuuaauuucaa

SEQ ID NO: 2172357 - RNA, 12 nt, Streptococcus pneumoniae R6
ucuugcccugug

SEQ ID NO: 2172358 - RNA, 22 nt, Streptococcus pneumoniae R6
ucuuuacguccaccacaaaaga

SEQ ID NO: 2172359 - RNA, 23 nt, Streptococcus pneumoniae R6
ucuuuacguccaccacaaaagag

SEQ ID NO: 2172360 - RNA, 23 nt, Streptococcus pneumoniae R6
ucuuuacaugcgcaaaauaauuu

SEQ ID NO: 2172361 - RNA, 19 nt, Streptococcus pneumoniae R6
ucuuuagcagaugcuugca

SEQ ID NO: 2172362 - RNA, 20 nt, Streptococcus pneumoniae R6
ucuuuagggaaauuauuuau

SEQ ID NO: 2172363 - RNA, 22 nt, Streptococcus pneumoniae R6
ucuuuagaaaacuaguuuaaau

SEQ ID NO: 2172364 - RNA, 19 nt, Streptococcus pneumoniae R6
ucuuuagaaagauuaccaa

SEQ ID NO: 2172365 - RNA, 15 nt, Streptococcus pneumoniae R6
ucuuuagaaagguuu

SEQ ID NO: 2172366 - RNA, 13 nt, Streptococcus pneumoniae R6
ucuuucaaagccu

SEQ ID NO: 2172367 - RNA, 14 nt, Streptococcus pneumoniae R6
ucuuucaaagccug

SEQ ID NO: 2172368 - RNA, 16 nt, Streptococcus pneumoniae R6
ucuuuauuaguaaucu

SEQ ID NO: 2172369 - RNA, 13 nt, Streptococcus pneumoniae R6
ucuuuauucgucu

SEQ ID NO: 2172370 - RNA, 16 nt, Streptococcus pneumoniae R6
ucuuuauauaaaaaga

SEQ ID NO: 2172371 - RNA, 14 nt, Streptococcus pneumoniae R6
ucuuguguuuaaau

SEQ ID NO: 2172372 - RNA, 21 nt, Streptococcus pneumoniae R6
ucuugugaauagcucaaaagc

SEQ ID NO: 2172373 - RNA, 18 nt, Streptococcus pneumoniae R6
ucuugugagaauauuuac

SEQ ID NO: 2172374 - RNA, 21 nt, Streptococcus pneumoniae R6
ucuuguuaagagguuuuacua

SEQ ID NO: 2172375 - RNA, 13 nt, Streptococcus pneumoniae R6
ucuuguucugccu

SEQ ID NO: 2172376 - RNA, 13 nt, Streptococcus pneumoniae R6
ucuuguugaugua

SEQ ID NO: 2172377 - RNA, 22 nt, Streptococcus pneumoniae R6
ucuuguugaaugagcuuccagu

SEQ ID NO: 2172378 - RNA, 14 nt, Streptococcus pneumoniae R6
ucuuuaacaaaauc

SEQ ID NO: 2172379 - RNA, 15 nt, Streptococcus pneumoniae R6
ucuuuaaaaaauuuu

SEQ ID NO: 2172380 - RNA, 17 nt, Streptococcus pneumoniae R6
ucuuuaaaauuauaaaa

SEQ ID NO: 2172381 - RNA, 13 nt, Streptococcus pneumoniae R6
ucuuuaaaaucug

SEQ ID NO: 2172382 - RNA, 14 nt, Streptococcus pneumoniae R6
ucuuuaaaaucuga

SEQ ID NO: 2172383 - RNA, 17 nt, Streptococcus pneumoniae R6
ucuuuaaaaucugaaaa

SEQ ID NO: 2172384 - RNA, 18 nt, Streptococcus pneumoniae R6
ucuugucgauguuuuggu

SEQ ID NO: 2172385 - RNA, 16 nt, Streptococcus pneumoniae R6
ucuuguccuaaauaga

SEQ ID NO: 2172386 - RNA, 20 nt, Streptococcus pneumoniae R6
ucuuguccuaaauagaagau

SEQ ID NO: 2172387 - RNA, 21 nt, Streptococcus pneumoniae R6
ucuuguauucgcuuacauaaa

SEQ ID NO: 2172388 - RNA, 13 nt, Streptococcus pneumoniae R6
ucuuguaagaaag

SEQ ID NO: 2172389 - RNA, 16 nt, Streptococcus pneumoniae R6
ucuuggguuucuucua

SEQ ID NO: 2172390 - RNA, 23 nt, Streptococcus pneumoniae R6
ucuugggcuggacguucuucaag

SEQ ID NO: 2172391 - RNA, 18 nt, Streptococcus pneumoniae R6
ucuuggcagaaagguaag

SEQ ID NO: 2172392 - RNA, 18 nt, Streptococcus pneumoniae R6
ucuuggcgaauauagaca

SEQ ID NO: 2172393 - RNA, 23 nt, Streptococcus pneumoniae R6
ucuuggcuaauuucaagaaguug

SEQ ID NO: 2172394 - RNA, 16 nt, Streptococcus pneumoniae R6
ucuuggaagaaaucca

SEQ ID NO: 2172395 - RNA, 22 nt, Streptococcus pneumoniae R6
ucuugcucgaccaagccagcau

SEQ ID NO: 2172396 - RNA, 12 nt, Streptococcus pneumoniae R6
ucuuugacaccg

SEQ ID NO: 2172397 - RNA, 15 nt, Streptococcus pneumoniae R6
ucuuugauaagauaa

SEQ ID NO: 2172398 - RNA, 17 nt, Streptococcus pneumoniae R6
ucuuucuuauccguuuu

SEQ ID NO: 2172399 - RNA, 19 nt, Streptococcus pneumoniae R6
ucuuucuucguuuuuacua

SEQ ID NO: 2172400 - RNA, 17 nt, Streptococcus pneumoniae R6
ucuuugauuuacuauua

SEQ ID NO: 2172401 - RNA, 14 nt, Streptococcus pneumoniae R6
ucuuugauuucuug

SEQ ID NO: 2172402 - RNA, 14 nt, Streptococcus pneumoniae R6
ucuuugauuuuaau

SEQ ID NO: 2172403 - RNA, 18 nt, Streptococcus pneumoniae R6
ucuuugauuuuaaugcua

SEQ ID NO: 2172404 - RNA, 19 nt, Streptococcus pneumoniae R6
ucuuugcauuaucuaauac

SEQ ID NO: 2172405 - RNA, 19 nt, Streptococcus pneumoniae R6
ucuuuggacauagccaaua

SEQ ID NO: 2172406 - RNA, 19 nt, Streptococcus pneumoniae R6
ucuuuggucaauccgaguu

SEQ ID NO: 2172407 - RNA, 13 nt, Streptococcus pneumoniae R6
ucuuucucaaaca

SEQ ID NO: 2172408 - RNA, 16 nt, Streptococcus pneumoniae R6
ucuuucucaaacauug

SEQ ID NO: 2172409 - RNA, 12 nt, Streptococcus pneumoniae R6
ucuuucuaaaau

SEQ ID NO: 2172410 - RNA, 17 nt, Streptococcus pneumoniae R6
ucuuucauagcaaaaua

SEQ ID NO: 2172411 - RNA, 14 nt, Streptococcus pneumoniae R6
ucuuucaguuucau

SEQ ID NO: 2172412 - RNA, 21 nt, Streptococcus pneumoniae R6
ucuuucacuucacgaaugaca

SEQ ID NO: 2172413 - RNA, 14 nt, Streptococcus pneumoniae R6
ucuuuccauucaaa

SEQ ID NO: 2172414 - RNA, 16 nt, Streptococcus pneumoniae R6
ucuuuuauccuguucu

SEQ ID NO: 2172415 - RNA, 13 nt, Streptococcus pneumoniae R6
ucuuuuacuucug

SEQ ID NO: 2172416 - RNA, 15 nt, Streptococcus pneumoniae R6
ucuuuuacuucuuug

SEQ ID NO: 2172417 - RNA, 14 nt, Streptococcus pneumoniae R6
ucuuuuaacuaauu

SEQ ID NO: 2172418 - RNA, 14 nt, Streptococcus pneumoniae R6
ucuuuuaaauauuu

SEQ ID NO: 2172419 - RNA, 23 nt, Streptococcus pneumoniae R6
ucuuuuaaacuaguuuugagaau

SEQ ID NO: 2172420 - RNA, 17 nt, Streptococcus pneumoniae R6
ucuuuguucugaaagug

SEQ ID NO: 2172421 - RNA, 24 nt, Streptococcus pneumoniae R6
ucuuuuguaaaggguucuacaaau

SEQ ID NO: 2172422 - RNA, 21 nt, Streptococcus pneumoniae R6
ucuuuugggacagaaaugccc

SEQ ID NO: 2172423 - RNA, 16 nt, Streptococcus pneumoniae R6
ucuuuuuaaauaaauc

SEQ ID NO: 2172424 - RNA, 20 nt, Streptococcus pneumoniae R6
ucuuuuuaaauaaaucucug

SEQ ID NO: 2172425 - RNA, 12 nt, Streptococcus pneumoniae R6
ucuuuugauaga

SEQ ID NO: 2172426 - RNA, 23 nt, Streptococcus pneumoniae R6
ucuuuugauugauggauucuaaa

SEQ ID NO: 2172427 - RNA, 20 nt, Streptococcus pneumoniae R6
ucuuuucucuagcuuuuaua

SEQ ID NO: 2172428 - RNA, 13 nt, Streptococcus pneumoniae R6
ucuuuuuguauca

SEQ ID NO: 2172429 - RNA, 17 nt, Streptococcus pneumoniae R6
ucuuuuuguaucaauuu

SEQ ID NO: 2172430 - RNA, 18 nt, Streptococcus pneumoniae R6
ucuuuuuguauuucuucu

SEQ ID NO: 2172431 - RNA, 11 nt, Streptococcus pneumoniae R6
ucuuuuucgcu

SEQ ID NO: 2172432 - RNA, 21 nt, Streptococcus pneumoniae R6
ucuuuuuauacucaaugaaaa

SEQ ID NO: 2172433 - RNA, 19 nt, Streptococcus pneumoniae R6
ucuuuuuauaggcucuuug

SEQ ID NO: 2172434 - RNA, 12 nt, Streptococcus pneumoniae R6
ucuuuuucaaau

SEQ ID NO: 2172435 - RNA, 19 nt, Streptococcus pneumoniae R6
ugaaccucuucauucaaag

SEQ ID NO: 2172436 - RNA, 17 nt, Streptococcus pneumoniae R6
ugaacagcuugagauuu

SEQ ID NO: 2172437 - RNA, 22 nt, Streptococcus pneumoniae R6
ugaaaugaccugcauacguuca

SEQ ID NO: 2172438 - RNA, 12 nt, Streptococcus pneumoniae R6
ugaaaugaaaua

SEQ ID NO: 2172439 - RNA, 13 nt, Streptococcus pneumoniae R6
ugaaaugaaauaa

SEQ ID NO: 2172440 - RNA, 17 nt, Streptococcus pneumoniae R6
ugaaaugaaauaaaauu

SEQ ID NO: 2172441 - RNA, 18 nt, Streptococcus pneumoniae R6
ugaaaucuuuuugauaca

SEQ ID NO: 2172442 - RNA, 17 nt, Streptococcus pneumoniae R6
ugaacgucuaaacugua

SEQ ID NO: 2172443 - RNA, 23 nt, Streptococcus pneumoniae R6
ugaaccugauuggccgcaagcag

SEQ ID NO: 2172444 - RNA, 13 nt, Streptococcus pneumoniae R6
ugaaccugcuuua

SEQ ID NO: 2172445 - RNA, 20 nt, Streptococcus pneumoniae R6
ugaacggagauaguaccauu

SEQ ID NO: 2172446 - RNA, 23 nt, Streptococcus pneumoniae R6
ugaacucagguccuuucuuuuuu

SEQ ID NO: 2172447 - RNA, 18 nt, Streptococcus pneumoniae R6
ugaacugcauuuuuucau

SEQ ID NO: 2172448 - RNA, 20 nt, Streptococcus pneumoniae R6
ugaacugcauuuuuucauug

SEQ ID NO: 2172449 - RNA, 23 nt, Streptococcus pneumoniae R6
ugaacugccccccaaaaguuaga

SEQ ID NO: 2172450 - RNA, 18 nt, Streptococcus pneumoniae R6
ugaacugcuugagcugcu

SEQ ID NO: 2172451 - RNA, 17 nt, Streptococcus pneumoniae R6
ugaagucguguuuuuuc

SEQ ID NO: 2172452 - RNA, 19 nt, Streptococcus pneumoniae R6
ugaagucacuacuuccauc

SEQ ID NO: 2172453 - RNA, 16 nt, Streptococcus pneumoniae R6
ugaaguuuucaaaguu

SEQ ID NO: 2172454 - RNA, 21 nt, Streptococcus pneumoniae R6
ugaaggaacuaacucaucaaa

SEQ ID NO: 2172455 - RNA, 22 nt, Streptococcus pneumoniae R6
ugaagaccacgaugaugauugg

SEQ ID NO: 2172456 - RNA, 14 nt, Streptococcus pneumoniae R6
ugaagcaaacauuc

SEQ ID NO: 2172457 - RNA, 19 nt, Streptococcus pneumoniae R6
ugaagcaaacauucccaca

SEQ ID NO: 2172458 - RNA, 12 nt, Streptococcus pneumoniae R6
ugaaaaaaugga

SEQ ID NO: 2172459 - RNA, 22 nt, Streptococcus pneumoniae R6
ugaaaaacuagaauagaaacaa

SEQ ID NO: 2172460 - RNA, 12 nt, Streptococcus pneumoniae R6
ucuuuuuuaauu

SEQ ID NO: 2172461 - RNA, 18 nt, Streptococcus pneumoniae R6
ucuuuuuuguuucuugaa

SEQ ID NO: 2172462 - RNA, 19 nt, Streptococcus pneumoniae R6
ucuuuuuugauaucuuccu

SEQ ID NO: 2172463 - RNA, 19 nt, Streptococcus pneumoniae R6
ugaaaaaaauuuuauuuaa

SEQ ID NO: 2172464 - RNA, 13 nt, Streptococcus pneumoniae R6
ugaaaaaaaguuu

SEQ ID NO: 2172465 - RNA, 21 nt, Streptococcus pneumoniae R6
ugaaaaaaaugucauaauuga

SEQ ID NO: 2172466 - RNA, 13 nt, Streptococcus pneumoniae R6
ucuuuuuuugaua

SEQ ID NO: 2172467 - RNA, 13 nt, Streptococcus pneumoniae R6
ucuuuuuuuacua

SEQ ID NO: 2172468 - RNA, 20 nt, Streptococcus pneumoniae R6
ucuuuuuuuagucucuaaau

SEQ ID NO: 2172469 - RNA, 19 nt, Streptococcus pneumoniae R6
ugaaaaaaacaauaaaucu

SEQ ID NO: 2172470 - RNA, 20 nt, Streptococcus pneumoniae R6
ugaaaacaggaguucuuuua

SEQ ID NO: 2172471 - RNA, 20 nt, Streptococcus pneumoniae R6
ugaaaacgguaacaaaacua

SEQ ID NO: 2172472 - RNA, 16 nt, Streptococcus pneumoniae R6
ugaaagcagaugagug

SEQ ID NO: 2172473 - RNA, 20 nt, Streptococcus pneumoniae R6
ugaaacugacgaagucagcu

SEQ ID NO: 2172474 - RNA, 19 nt, Streptococcus pneumoniae R6
ugaaacugacgaagucagu

SEQ ID NO: 2172475 - RNA, 15 nt, Streptococcus pneumoniae R6
ugaaagcucuucuaa

SEQ ID NO: 2172476 - RNA, 14 nt, Streptococcus pneumoniae R6
ugaaaggaaaauga

SEQ ID NO: 2172477 - RNA, 13 nt, Streptococcus pneumoniae R6
ugaaaggaaauaa

SEQ ID NO: 2172478 - RNA, 14 nt, Streptococcus pneumoniae R6
ugaaaggaagagag

SEQ ID NO: 2172479 - RNA, 15 nt, Streptococcus pneumoniae R6
ugaaaggagcgauug

SEQ ID NO: 2172480 - RNA, 15 nt, Streptococcus pneumoniae R6
ugaaauaaaaugcug

SEQ ID NO: 2172481 - RNA, 21 nt, Streptococcus pneumoniae R6
ugaaauaaaauuugaacaaau

SEQ ID NO: 2172482 - RNA, 20 nt, Streptococcus pneumoniae R6
ugaaauaagggcaaagaaaa

SEQ ID NO: 2172483 - RNA, 21 nt, Streptococcus pneumoniae R6
ugaaauaauaacaggacaaau

SEQ ID NO: 2172484 - RNA, 19 nt, Streptococcus pneumoniae R6
ugaaauaacccaccaaguc

SEQ ID NO: 2172485 - RNA, 23 nt, Streptococcus pneumoniae R6
ugaaauaacucauaauagucucu

SEQ ID NO: 2172486 - RNA, 13 nt, Streptococcus pneumoniae R6
ugaaauaagauau

SEQ ID NO: 2172487 - RNA, 21 nt, Streptococcus pneumoniae R6
ugaaauaagauaugaacaaau

SEQ ID NO: 2172488 - RNA, 19 nt, Streptococcus pneumoniae R6
ugaaauaagaugagaacaa

SEQ ID NO: 2172489 - RNA, 15 nt, Streptococcus pneumoniae R6
ugaaauaagauguga

SEQ ID NO: 2172490 - RNA, 21 nt, Streptococcus pneumoniae R6
ugaaauaagaugugaacaucu

SEQ ID NO: 2172491 - RNA, 14 nt, Streptococcus pneumoniae R6
ugaaauaauacuca

SEQ ID NO: 2172492 - RNA, 14 nt, Streptococcus pneumoniae R6
ugaaaucagaaaaa

SEQ ID NO: 2172493 - RNA, 15 nt, Streptococcus pneumoniae R6
ugaaauacuaaaaaa

SEQ ID NO: 2172494 - RNA, 20 nt, Streptococcus pneumoniae R6
ugaaaauaccaaguucauuu

SEQ ID NO: 2172495 - RNA, 22 nt, Streptococcus pneumoniae R6
ugaaaaucauagagcaaacuag

SEQ ID NO: 2172496 - RNA, 22 nt, Streptococcus pneumoniae R6
ugaaaauauuucgcuuauaaac

SEQ ID NO: 2172497 - RNA, 15 nt, Streptococcus pneumoniae R6
ugaaaauuuccauug

SEQ ID NO: 2172498 - RNA, 13 nt, Streptococcus pneumoniae R6
ugaaaaucuuuaa

SEQ ID NO: 2172499 - RNA, 20 nt, Streptococcus pneumoniae R6
ugaaacuaauagguacaaaa

SEQ ID NO: 2172500 - RNA, 22 nt, Streptococcus pneumoniae R6
ugaaacuaauagguacaaaaau

SEQ ID NO: 2172501 - RNA, 15 nt, Streptococcus pneumoniae R6
ugaaacaagaacaag

SEQ ID NO: 2172502 - RNA, 16 nt, Streptococcus pneumoniae R6
ugaaacaagaacaaga

SEQ ID NO: 2172503 - RNA, 20 nt, Streptococcus pneumoniae R6
ugaaacaagaacaagacaaa

SEQ ID NO: 2172504 - RNA, 16 nt, Streptococcus pneumoniae R6
ugaaacacccuagccu

SEQ ID NO: 2172505 - RNA, 13 nt, Streptococcus pneumoniae R6
ugaaacagaggug

SEQ ID NO: 2172506 - RNA, 22 nt, Streptococcus pneumoniae R6
ugaaacagcaagagcugauagu

SEQ ID NO: 2172507 - RNA, 13 nt, Streptococcus pneumoniae R6
ugaaacagcugcg

SEQ ID NO: 2172508 - RNA, 24 nt, Streptococcus pneumoniae R6
ugcucgugauguuaaaaugagucu

SEQ ID NO: 2172509 - RNA, 19 nt, Streptococcus pneumoniae R6
ugcucuuugaaacggagga

SEQ ID NO: 2172510 - RNA, 18 nt, Streptococcus pneumoniae R6
ugcucuuugauuuucauu

SEQ ID NO: 2172511 - RNA, 19 nt, Streptococcus pneumoniae R6
ugcucuuugauuuucauug

SEQ ID NO: 2172512 - RNA, 20 nt, Streptococcus pneumoniae R6
ugcucuuugauuuucauuga

SEQ ID NO: 2172513 - RNA, 19 nt, Streptococcus pneumoniae R6
ugcucuuugauuuuuauug

SEQ ID NO: 2172514 - RNA, 19 nt, Streptococcus pneumoniae R6
ugcucugccagcugagcua

SEQ ID NO: 2172515 - RNA, 23 nt, Streptococcus pneumoniae R6
ugcucuucauuggacaaguuagc

SEQ ID NO: 2172516 - RNA, 20 nt, Streptococcus pneumoniae R6
ugcucggcauugugaugaag

SEQ ID NO: 2172517 - RNA, 21 nt, Streptococcus pneumoniae R6
ugcucgccccauuucuucagu

SEQ ID NO: 2172518 - RNA, 19 nt, Streptococcus pneumoniae R6
ugcugacuugccuucaaca

SEQ ID NO: 2172519 - RNA, 15 nt, Streptococcus pneumoniae R6
ugcugacugauuuac

SEQ ID NO: 2172520 - RNA, 18 nt, Streptococcus pneumoniae R6
ugcugacugauuuacaaa

SEQ ID NO: 2172521 - RNA, 15 nt, Streptococcus pneumoniae R6
ugcugacaagucauc

SEQ ID NO: 2172522 - RNA, 15 nt, Streptococcus pneumoniae R6
ugcugacaaagagau

SEQ ID NO: 2172523 - RNA, 18 nt, Streptococcus pneumoniae R6
ugcugccaauugcucaac

SEQ ID NO: 2172524 - RNA, 13 nt, Streptococcus pneumoniae R6
aaauguaguuaau

SEQ ID NO: 2172525 - RNA, 21 nt, Streptococcus pneumoniae R6
ugcuggcggaaguuggucucc

SEQ ID NO: 2172526 - RNA, 20 nt, Streptococcus pneumoniae R6
ugcuggagaaucaucaugaa

SEQ ID NO: 2172527 - RNA, 20 nt, Streptococcus pneumoniae R6
ugcuggagcuggggcuacug

SEQ ID NO: 2172528 - RNA, 16 nt, Streptococcus pneumoniae R6
ugcuggcagaaacugu

SEQ ID NO: 2172529 - RNA, 21 nt, Streptococcus pneumoniae R6
ugcuggcagaaacuguccgag

SEQ ID NO: 2172530 - RNA, 19 nt, Streptococcus pneumoniae R6
ugcugguuuuuacugucuu

SEQ ID NO: 2172531 - RNA, 21 nt, Streptococcus pneumoniae R6
ugcuguuaauaacucucaucu

SEQ ID NO: 2172532 - RNA, 15 nt, Streptococcus pneumoniae R6
ugcuguuuauaucua

SEQ ID NO: 2172533 - RNA, 23 nt, Streptococcus pneumoniae R6
ugcuuaaauaaaauuuuuuucaa

SEQ ID NO: 2172534 - RNA, 18 nt, Streptococcus pneumoniae R6
ugcuuaaauaggccucuu

SEQ ID NO: 2172535 - RNA, 16 nt, Streptococcus pneumoniae R6
ugcuucuuuuuuuacu

SEQ ID NO: 2172536 - RNA, 12 nt, Streptococcus pneumoniae R6
ugcuugaaaacu

SEQ ID NO: 2172537 - RNA, 15 nt, Streptococcus pneumoniae R6
ugcuugaauucccuu

SEQ ID NO: 2172538 - RNA, 18 nt, Streptococcus pneumoniae R6
ugcuugagcuugaaucuc

SEQ ID NO: 2172539 - RNA, 22 nt, Streptococcus pneumoniae R6
ugcuucgauaacaagguuaguc

SEQ ID NO: 2172540 - RNA, 14 nt, Streptococcus pneumoniae R6
ugcuucuaaaacau

SEQ ID NO: 2172541 - RNA, 16 nt, Streptococcus pneumoniae R6
ugcuuccaaaaauucu

SEQ ID NO: 2172542 - RNA, 20 nt, Streptococcus pneumoniae R6
ugcuuccaaaaauucuuacu

SEQ ID NO: 2172543 - RNA, 14 nt, Streptococcus pneumoniae R6
ugcuuccauuucca

SEQ ID NO: 2172544 - RNA, 16 nt, Streptococcus pneumoniae R6
ugcuucccauuuaggc

SEQ ID NO: 2172545 - RNA, 14 nt, Streptococcus pneumoniae R6
ugcuugucaucuuc

SEQ ID NO: 2172546 - RNA, 15 nt, Streptococcus pneumoniae R6
ugcuugucaucuucc

SEQ ID NO: 2172547 - RNA, 16 nt, Streptococcus pneumoniae R6
ugcuugauuaagggca

SEQ ID NO: 2172548 - RNA, 18 nt, Streptococcus pneumoniae R6
ugcuuucaaaaagcauuc

SEQ ID NO: 2172549 - RNA, 19 nt, Streptococcus pneumoniae R6
ugcuuucaaaaagcauucu

SEQ ID NO: 2172550 - RNA, 18 nt, Streptococcus pneumoniae R6
ugcuuuuacaauaucucc

SEQ ID NO: 2172551 - RNA, 15 nt, Streptococcus pneumoniae R6
ugcuuuccuuucaaa

SEQ ID NO: 2172552 - RNA, 22 nt, Streptococcus pneumoniae R6
ugcuuucgcgauugauuuccaa

SEQ ID NO: 2172553 - RNA, 14 nt, Streptococcus pneumoniae R6
ugcuuucuucagau

SEQ ID NO: 2172554 - RNA, 21 nt, Streptococcus pneumoniae R6
ugcuuugagaucuuuuucgcu

SEQ ID NO: 2172555 - RNA, 17 nt, Streptococcus pneumoniae R6
ugcuuugagcaaccugc

SEQ ID NO: 2172556 - RNA, 16 nt, Streptococcus pneumoniae R6
ugcuuugaacaaaugu

SEQ ID NO: 2172557 - RNA, 15 nt, Streptococcus pneumoniae R6
ugcuuuuucaaucag

SEQ ID NO: 2172558 - RNA, 20 nt, Streptococcus pneumoniae R6
ugcuuuuucaaugcccuuga

SEQ ID NO: 2172559 - RNA, 15 nt, Streptococcus pneumoniae R6
ugcuuuuucuuuuua

SEQ ID NO: 2172560 - RNA, 16 nt, Streptococcus pneumoniae R6
ugcuuuugugauuuua

SEQ ID NO: 2172561 - RNA, 14 nt, Streptococcus pneumoniae R6
ugcuuuucuauuaa

SEQ ID NO: 2172562 - RNA, 22 nt, Streptococcus pneumoniae R6
ugcuuuucguacauaguuucau

SEQ ID NO: 2172563 - RNA, 13 nt, Streptococcus pneumoniae R6
ugcuuuuauucag

SEQ ID NO: 2172564 - RNA, 17 nt, Streptococcus pneumoniae R6
uggaaaagcaagagcug

SEQ ID NO: 2172565 - RNA, 15 nt, Streptococcus pneumoniae R6
uggaaaaaagucuuu

SEQ ID NO: 2172566 - RNA, 16 nt, Streptococcus pneumoniae R6
uggaaaaaauaaaaaa

SEQ ID NO: 2172567 - RNA, 13 nt, Streptococcus pneumoniae R6
uggaaaaaaugaa

SEQ ID NO: 2172568 - RNA, 23 nt, Streptococcus pneumoniae R6
uggaaaggauaugaggagaaaga

SEQ ID NO: 2172569 - RNA, 22 nt, Streptococcus pneumoniae R6
uggaaagcaucuccauccucac

SEQ ID NO: 2172570 - RNA, 23 nt, Streptococcus pneumoniae R6
uggaaacucucguaaacaaagag

SEQ ID NO: 2172571 - RNA, 14 nt, Streptococcus pneumoniae R6
uggaaauaaucuuu

SEQ ID NO: 2172572 - RNA, 17 nt, Streptococcus pneumoniae R6
uggaaauuauaaaacca

SEQ ID NO: 2172573 - RNA, 20 nt, Streptococcus pneumoniae R6
uggaaaugauaauugauuaa

SEQ ID NO: 2172574 - RNA, 14 nt, Streptococcus pneumoniae R6
uggaagaaugagug

SEQ ID NO: 2172575 - RNA, 19 nt, Streptococcus pneumoniae R6
uggaacugacgaagucagc

SEQ ID NO: 2172576 - RNA, 13 nt, Streptococcus pneumoniae R6
uggacaccgagaa

SEQ ID NO: 2172577 - RNA, 18 nt, Streptococcus pneumoniae R6
uggacaacaaugagaaau

SEQ ID NO: 2172578 - RNA, 13 nt, Streptococcus pneumoniae R6
uggacaugagucc

SEQ ID NO: 2172579 - RNA, 23 nt, Streptococcus pneumoniae R6
uggacaggguugguuaaaaguug

SEQ ID NO: 2172580 - RNA, 12 nt, Streptococcus pneumoniae R6
uggacgagcagc

SEQ ID NO: 2172581 - RNA, 22 nt, Streptococcus pneumoniae R6
uggaauaagguaauugaagagc

SEQ ID NO: 2172582 - RNA, 18 nt, Streptococcus pneumoniae R6
uggaaucagaacacuucc

SEQ ID NO: 2172583 - RNA, 17 nt, Streptococcus pneumoniae R6
uggaauauuuacuaauu

SEQ ID NO: 2172584 - RNA, 21 nt, Streptococcus pneumoniae R6
uggaauauuuacuaauuaauu

SEQ ID NO: 2172585 - RNA, 19 nt, Streptococcus pneumoniae R6
uggaauaguugaaaucaag

SEQ ID NO: 2172586 - RNA, 20 nt, Streptococcus pneumoniae R6
uggaaguucuacgauuucag

SEQ ID NO: 2172587 - RNA, 20 nt, Streptococcus pneumoniae R6
uggaaugacgaaacgaagaa

SEQ ID NO: 2172588 - RNA, 18 nt, Streptococcus pneumoniae R6
uggaauccacacuuccaa

SEQ ID NO: 2172589 - RNA, 19 nt, Streptococcus pneumoniae R6
uggaaugauuugggcaagg

SEQ ID NO: 2172590 - RNA, 16 nt, Streptococcus pneumoniae R6
ugcguuuuauuguggg

SEQ ID NO: 2172591 - RNA, 20 nt, Streptococcus pneumoniae R6
ugcguuucagcauauuuccc

SEQ ID NO: 2172592 - RNA, 18 nt, Streptococcus pneumoniae R6
ugcgcuugauaaccuuaa

SEQ ID NO: 2172593 - RNA, 22 nt, Streptococcus pneumoniae R6
ugcggcugcagcugcggcuuuu

SEQ ID NO: 2172594 - RNA, 19 nt, Streptococcus pneumoniae R6
ugcggcggaaacaaaauua

SEQ ID NO: 2172595 - RNA, 18 nt, Streptococcus pneumoniae R6
ugcuaaaagauuucuaua

SEQ ID NO: 2172596 - RNA, 21 nt, Streptococcus pneumoniae R6
ugcguuuuuucugauuucaaa

SEQ ID NO: 2172597 - RNA, 22 nt, Streptococcus pneumoniae R6
ugcguuuuuuugauuuuaaaga

SEQ ID NO: 2172598 - RNA, 19 nt, Streptococcus pneumoniae R6
ugcguuuuugccucaauau

SEQ ID NO: 2172599 - RNA, 18 nt, Streptococcus pneumoniae R6
ugcguuuuugugauuuua

SEQ ID NO: 2172600 - RNA, 23 nt, Streptococcus pneumoniae R6
ugcuacgacacuauuuacaagug

SEQ ID NO: 2172601 - RNA, 17 nt, Streptococcus pneumoniae R6
ugcuaccguugaaauca

SEQ ID NO: 2172602 - RNA, 18 nt, Streptococcus pneumoniae R6
ugcuacugcauccaacaa

SEQ ID NO: 2172603 - RNA, 22 nt, Streptococcus pneumoniae R6
ugcuagacgaccauugucacaa

SEQ ID NO: 2172604 - RNA, 17 nt, Streptococcus pneumoniae R6
ugcuaauucuuugacaa

SEQ ID NO: 2172605 - RNA, 11 nt, Streptococcus pneumoniae R6
ugcuaauuuag

SEQ ID NO: 2172606 - RNA, 20 nt, Streptococcus pneumoniae R6
ugcuauaucaaaaccagucc

SEQ ID NO: 2172607 - RNA, 22 nt, Streptococcus pneumoniae R6
ugcuauaucuuauuuuucuauu

SEQ ID NO: 2172608 - RNA, 14 nt, Streptococcus pneumoniae R6
ugcuagcaaugguu

SEQ ID NO: 2172609 - RNA, 13 nt, Streptococcus pneumoniae R6
ugcuagcaucauc

SEQ ID NO: 2172610 - RNA, 11 nt, Streptococcus pneumoniae R6
ugcuauuucua

SEQ ID NO: 2172611 - RNA, 12 nt, Streptococcus pneumoniae R6
ugcucaaaacac

SEQ ID NO: 2172612 - RNA, 13 nt, Streptococcus pneumoniae R6
ugcucaaaacacu

SEQ ID NO: 2172613 - RNA, 17 nt, Streptococcus pneumoniae R6
ugcucaaaacacuguuu

SEQ ID NO: 2172614 - RNA, 20 nt, Streptococcus pneumoniae R6
ugcucaaaacacuguuuuaa

SEQ ID NO: 2172615 - RNA, 19 nt, Streptococcus pneumoniae R6
ugcucaaaacacuguuuug

SEQ ID NO: 2172616 - RNA, 13 nt, Streptococcus pneumoniae R6
ugcucaaaguacu

SEQ ID NO: 2172617 - RNA, 18 nt, Streptococcus pneumoniae R6
ugcuauugcuuuuagaga

SEQ ID NO: 2172618 - RNA, 20 nt, Streptococcus pneumoniae R6
ugcuauugcuuuuagagauu

SEQ ID NO: 2172619 - RNA, 14 nt, Streptococcus pneumoniae R6
ugcuauucuaaauu

SEQ ID NO: 2172620 - RNA, 18 nt, Streptococcus pneumoniae R6
ugcuauguugcaaauuua

SEQ ID NO: 2172621 - RNA, 23 nt, Streptococcus pneumoniae R6
ugcucagcauucucaaugauuug

SEQ ID NO: 2172622 - RNA, 16 nt, Streptococcus pneumoniae R6
ugcucaaucuuaucaa

SEQ ID NO: 2172623 - RNA, 22 nt, Streptococcus pneumoniae R6
ugcucaaucuuaucaaucaaac

SEQ ID NO: 2172624 - RNA, 13 nt, Streptococcus pneumoniae R6
ugcucaacuucuu

SEQ ID NO: 2172625 - RNA, 18 nt, Streptococcus pneumoniae R6
ugcuccaauacaaauugu

SEQ ID NO: 2172626 - RNA, 16 nt, Streptococcus pneumoniae R6
ugcuccauaggcagcu

SEQ ID NO: 2172627 - RNA, 17 nt, Streptococcus pneumoniae R6
ugcuccauuuuuuaaaa

SEQ ID NO: 2172628 - RNA, 22 nt, Streptococcus pneumoniae R6
ugcgaacaaaucaauuagaaaa

SEQ ID NO: 2172629 - RNA, 23 nt, Streptococcus pneumoniae R6
ugcgaaagcgagguuuuuaaagg

SEQ ID NO: 2172630 - RNA, 21 nt, Streptococcus pneumoniae R6
ugccuuuuucaaucaauguca

SEQ ID NO: 2172631 - RNA, 18 nt, Streptococcus pneumoniae R6
ugcgaaguuuuggacgaa

SEQ ID NO: 2172632 - RNA, 16 nt, Streptococcus pneumoniae R6
ugcgacaaaaagaggc

SEQ ID NO: 2172633 - RNA, 21 nt, Streptococcus pneumoniae R6
ugcgauacgaucugaaauaaa

SEQ ID NO: 2172634 - RNA, 22 nt, Streptococcus pneumoniae R6
ugcgaguugcauagcgaagaac

SEQ ID NO: 2172635 - RNA, 20 nt, Streptococcus pneumoniae R6
ugcgaguugugaauuucauu

SEQ ID NO: 2172636 - RNA, 20 nt, Streptococcus pneumoniae R6
ugcgcaagguuguuagauua

SEQ ID NO: 2172637 - RNA, 19 nt, Streptococcus pneumoniae R6
ugccguccuuguaaagacu

SEQ ID NO: 2172638 - RNA, 21 nt, Streptococcus pneumoniae R6
ugccguccuuguaaagacuag

SEQ ID NO: 2172639 - RNA, 15 nt, Streptococcus pneumoniae R6
ugccaccucaaaacg

SEQ ID NO: 2172640 - RNA, 14 nt, Streptococcus pneumoniae R6
ugccucucuucugu

SEQ ID NO: 2172641 - RNA, 18 nt, Streptococcus pneumoniae R6
ugccuugaccaaucaauc

SEQ ID NO: 2172642 - RNA, 22 nt, Streptococcus pneumoniae R6
ugccuuagcaacuguuuuuuca

SEQ ID NO: 2172643 - RNA, 17 nt, Streptococcus pneumoniae R6
uguaaagcgaaaggaga

SEQ ID NO: 2172644 - RNA, 21 nt, Streptococcus pneumoniae R6
uguaaagcgaaaggagaaaaa

SEQ ID NO: 2172645 - RNA, 16 nt, Streptococcus pneumoniae R6
uguaaacgaauacuuu

SEQ ID NO: 2172646 - RNA, 15 nt, Streptococcus pneumoniae R6
ugguuugaaaaugua

SEQ ID NO: 2172647 - RNA, 19 nt, Streptococcus pneumoniae R6
uguaaaguuaauugaauuu

SEQ ID NO: 2172648 - RNA, 19 nt, Streptococcus pneumoniae R6
uguaaaggaugacaauagc

SEQ ID NO: 2172649 - RNA, 15 nt, Streptococcus pneumoniae R6
ugguuugaagagauu

SEQ ID NO: 2172650 - RNA, 16 nt, Streptococcus pneumoniae R6
ugguuuaaaaagaguu

SEQ ID NO: 2172651 - RNA, 17 nt, Streptococcus pneumoniae R6
ugguuucuggcuauuaa

SEQ ID NO: 2172652 - RNA, 14 nt, Streptococcus pneumoniae R6
ugguugucaaacca

SEQ ID NO: 2172653 - RNA, 12 nt, Streptococcus pneumoniae R6
ugguugauuuac

SEQ ID NO: 2172654 - RNA, 16 nt, Streptococcus pneumoniae R6
ugguuccacgacggac

SEQ ID NO: 2172655 - RNA, 20 nt, Streptococcus pneumoniae R6
ugguuccauuuaacaaacca

SEQ ID NO: 2172656 - RNA, 16 nt, Streptococcus pneumoniae R6
ugguuccaauagucau

SEQ ID NO: 2172657 - RNA, 17 nt, Streptococcus pneumoniae R6
ugguugacuggaccaga

SEQ ID NO: 2172658 - RNA, 12 nt, Streptococcus pneumoniae R6
ugguucucucuu

SEQ ID NO: 2172659 - RNA, 18 nt, Streptococcus pneumoniae R6
ugguucucucuuuuugau

SEQ ID NO: 2172660 - RNA, 13 nt, Streptococcus pneumoniae R6
uguaauucucaag

SEQ ID NO: 2172661 - RNA, 15 nt, Streptococcus pneumoniae R6
uguacagaagacuag

SEQ ID NO: 2172662 - RNA, 20 nt, Streptococcus pneumoniae R6
uguacgguaaucaagugagu

SEQ ID NO: 2172663 - RNA, 18 nt, Streptococcus pneumoniae R6
uguacuaugcguuuuauu

SEQ ID NO: 2172664 - RNA, 22 nt, Streptococcus pneumoniae R6
uguacgcccccacccugguagg

SEQ ID NO: 2172665 - RNA, 17 nt, Streptococcus pneumoniae R6
uguaagcuagcaacaga

SEQ ID NO: 2172666 - RNA, 17 nt, Streptococcus pneumoniae R6
uguaagauagagagauu

SEQ ID NO: 2172667 - RNA, 23 nt, Streptococcus pneumoniae R6
uguaagccauauuggaugaguuu

SEQ ID NO: 2172668 - RNA, 16 nt, Streptococcus pneumoniae R6
uguaaggugcaaaaac

SEQ ID NO: 2172669 - RNA, 23 nt, Streptococcus pneumoniae R6
uguaaggagcagggcauagacug

SEQ ID NO: 2172670 - RNA, 21 nt, Streptococcus pneumoniae R6
uguaagaacuuuuuaaaguau

SEQ ID NO: 2172671 - RNA, 16 nt, Streptococcus pneumoniae R6
uguaagaauuugauua

SEQ ID NO: 2172672 - RNA, 19 nt, Streptococcus pneumoniae R6
uguaagucauuuucuuuua

SEQ ID NO: 2172673 - RNA, 14 nt, Streptococcus pneumoniae R6
uguaagucugcuuu

SEQ ID NO: 2172674 - RNA, 15 nt, Streptococcus pneumoniae R6
ugguguaauaaacug

SEQ ID NO: 2172675 - RNA, 16 nt, Streptococcus pneumoniae R6
ugguuauggaaaauga

SEQ ID NO: 2172676 - RNA, 18 nt, Streptococcus pneumoniae R6
ugguuauggaaaaugaua

SEQ ID NO: 2172677 - RNA, 14 nt, Streptococcus pneumoniae R6
ugguuaucuuuaaa

SEQ ID NO: 2172678 - RNA, 14 nt, Streptococcus pneumoniae R6
ugguuacugacuuc

SEQ ID NO: 2172679 - RNA, 23 nt, Streptococcus pneumoniae R6
ugguuaggugaauuagugaagug

SEQ ID NO: 2172680 - RNA, 13 nt, Streptococcus pneumoniae R6
ugguuauacauag

SEQ ID NO: 2172681 - RNA, 21 nt, Streptococcus pneumoniae R6
ugguuaauguugguaagagaa

SEQ ID NO: 2172682 - RNA, 19 nt, Streptococcus pneumoniae R6
ugguuaccucauaucucuu

SEQ ID NO: 2172683 - RNA, 21 nt, Streptococcus pneumoniae R6
ugguuaaaauugcuuucuuca

SEQ ID NO: 2172684 - RNA, 13 nt, Streptococcus pneumoniae R6
ugguuaaaaguug

SEQ ID NO: 2172685 - RNA, 13 nt, Streptococcus pneumoniae R6
ugguuaaaggcug

SEQ ID NO: 2172686 - RNA, 22 nt, Streptococcus pneumoniae R6
ugguguuggauuaugauuuaaa

SEQ ID NO: 2172687 - RNA, 14 nt, Streptococcus pneumoniae R6
uggugagaagaggg

SEQ ID NO: 2172688 - RNA, 15 nt, Streptococcus pneumoniae R6
uggugagauaaaacg

SEQ ID NO: 2172689 - RNA, 12 nt, Streptococcus pneumoniae R6
uggugagaaagu

SEQ ID NO: 2172690 - RNA, 14 nt, Streptococcus pneumoniae R6
uggucuagcaagag

SEQ ID NO: 2172691 - RNA, 19 nt, Streptococcus pneumoniae R6
uggucuagcuauuucuugc

SEQ ID NO: 2172692 - RNA, 14 nt, Streptococcus pneumoniae R6
ugggucucagucug

SEQ ID NO: 2172693 - RNA, 22 nt, Streptococcus pneumoniae R6
uggucguaucuggugugaugau

SEQ ID NO: 2172694 - RNA, 16 nt, Streptococcus pneumoniae R6
uggucugauuuucauu

SEQ ID NO: 2172695 - RNA, 22 nt, Streptococcus pneumoniae R6
uggguagcauagucgaaggcuu

SEQ ID NO: 2172696 - RNA, 16 nt, Streptococcus pneumoniae R6
uggguacucuuuuuuc

SEQ ID NO: 2172697 - RNA, 14 nt, Streptococcus pneumoniae R6
uggguaucuuuauc

SEQ ID NO: 2172698 - RNA, 13 nt, Streptococcus pneumoniae R6
uguauuuauagua

SEQ ID NO: 2172699 - RNA, 22 nt, Streptococcus pneumoniae R6
uguauuucuucuucugaagcau

SEQ ID NO: 2172700 - RNA, 14 nt, Streptococcus pneumoniae R6
ugucaauuuccauu

SEQ ID NO: 2172701 - RNA, 15 nt, Streptococcus pneumoniae R6
ugucaauuuccauuu

SEQ ID NO: 2172702 - RNA, 14 nt, Streptococcus pneumoniae R6
ugucaccaaacaaa

SEQ ID NO: 2172703 - RNA, 16 nt, Streptococcus pneumoniae R6
ugucacauugagaaag

SEQ ID NO: 2172704 - RNA, 13 nt, Streptococcus pneumoniae R6
ugucacacaaaaa

SEQ ID NO: 2172705 - RNA, 17 nt, Streptococcus pneumoniae R6
uguauugguaacaaaaa

SEQ ID NO: 2172706 - RNA, 15 nt, Streptococcus pneumoniae R6
uguauuguuuuauuu

SEQ ID NO: 2172707 - RNA, 15 nt, Streptococcus pneumoniae R6
uguauuuagacucuu

SEQ ID NO: 2172708 - RNA, 17 nt, Streptococcus pneumoniae R6
uguauuguacuuuccaa

SEQ ID NO: 2172709 - RNA, 17 nt, Streptococcus pneumoniae R6
uguaucgaaacauucaa

SEQ ID NO: 2172710 - RNA, 14 nt, Streptococcus pneumoniae R6
uguauccuccucua

SEQ ID NO: 2172711 - RNA, 12 nt, Streptococcus pneumoniae R6
uguaucuuccuu

SEQ ID NO: 2172712 - RNA, 15 nt, Streptococcus pneumoniae R6
uguaucugucguuag

SEQ ID NO: 2172713 - RNA, 19 nt, Streptococcus pneumoniae R6
uguagauguucuuugaaau

SEQ ID NO: 2172714 - RNA, 23 nt, Streptococcus pneumoniae R6
uguagcacuuuuccauuguuuua

SEQ ID NO: 2172715 - RNA, 21 nt, Streptococcus pneumoniae R6
uguacugccccccaaaaaagu

SEQ ID NO: 2172716 - RNA, 21 nt, Streptococcus pneumoniae R6
uguacugccccccaaaaguua

SEQ ID NO: 2172717 - RNA, 18 nt, Streptococcus pneumoniae R6
uguagccagugagaagaa

SEQ ID NO: 2172718 - RNA, 15 nt, Streptococcus pneumoniae R6
ugucaguaaaaaaaa

SEQ ID NO: 2172719 - RNA, 14 nt, Streptococcus pneumoniae R6
uguccauuaugaua

SEQ ID NO: 2172720 - RNA, 19 nt, Streptococcus pneumoniae R6
ugucccaucauuucuucaa

SEQ ID NO: 2172721 - RNA, 15 nt, Streptococcus pneumoniae R6
ugucccugggacauc

SEQ ID NO: 2172722 - RNA, 13 nt, Streptococcus pneumoniae R6
uguccugauuggu

SEQ ID NO: 2172723 - RNA, 20 nt, Streptococcus pneumoniae R6
uguccuggucuuauuucauu

SEQ ID NO: 2172724 - RNA, 19 nt, Streptococcus pneumoniae R6
uguccuguguaagugacaa

SEQ ID NO: 2172725 - RNA, 17 nt, Streptococcus pneumoniae R6
uguccuggauagacauc

SEQ ID NO: 2172726 - RNA, 17 nt, Streptococcus pneumoniae R6
uguccuaaauagaagau

SEQ ID NO: 2172727 - RNA, 15 nt, Streptococcus pneumoniae R6
uguccuaggucuaga

SEQ ID NO: 2172728 - RNA, 21 nt, Streptococcus pneumoniae R6
uguccuaguuggugacugacu

SEQ ID NO: 2172729 - RNA, 14 nt, Streptococcus pneumoniae R6
uguccuauucuugu

SEQ ID NO: 2172730 - RNA, 22 nt, Streptococcus pneumoniae R6
uguccucaauaagcccgaaaaa

SEQ ID NO: 2172731 - RNA, 22 nt, Streptococcus pneumoniae R6
uguccucaauaaguccgaaaaa

SEQ ID NO: 2172732 - RNA, 22 nt, Streptococcus pneumoniae R6
uguccucaaugaauccgaaaaa

SEQ ID NO: 2172733 - RNA, 22 nt, Streptococcus pneumoniae R6
uguccgccagauaaggagcgaa

SEQ ID NO: 2172734 - RNA, 14 nt, Streptococcus pneumoniae R6
uguccguuuucauc

SEQ ID NO: 2172735 - RNA, 19 nt, Streptococcus pneumoniae R6
ugucgauguuuugguuuuu

SEQ ID NO: 2172736 - RNA, 16 nt, Streptococcus pneumoniae R6
ugucgauugugauagc

SEQ ID NO: 2172737 - RNA, 20 nt, Streptococcus pneumoniae R6
ugucgauugugauagcagua

SEQ ID NO: 2172738 - RNA, 17 nt, Streptococcus pneumoniae R6
uguccuuuuauuaucuu

SEQ ID NO: 2172739 - RNA, 21 nt, Streptococcus pneumoniae R6
uguccuuuagaaagguuuuaa

SEQ ID NO: 2172740 - RNA, 20 nt, Streptococcus pneumoniae R6
uguccuuucucgagcuuagc

SEQ ID NO: 2172741 - RNA, 15 nt, Streptococcus pneumoniae R6
ugucucgauuucucu

SEQ ID NO: 2172742 - RNA, 23 nt, Streptococcus pneumoniae R6
ugucucugaaaacaaguucuuuu

SEQ ID NO: 2172743 - RNA, 20 nt, Streptococcus pneumoniae R6
ugucucgcuccguuaggugc

SEQ ID NO: 2172744 - RNA, 16 nt, Streptococcus pneumoniae R6
ugucugaauauauaau

SEQ ID NO: 2172745 - RNA, 17 nt, Streptococcus pneumoniae R6
ugucuaaaaauuuaaaa

SEQ ID NO: 2172746 - RNA, 12 nt, Streptococcus pneumoniae R6
ugucguuuccuu

SEQ ID NO: 2172747 - RNA, 14 nt, Streptococcus pneumoniae R6
ugucguuuccuucc

SEQ ID NO: 2172748 - RNA, 15 nt, Streptococcus pneumoniae R6
ugucuccaacaauua

SEQ ID NO: 2172749 - RNA, 22 nt, Streptococcus pneumoniae R6
ugucuaaaauuucauccucagg

SEQ ID NO: 2172750 - RNA, 13 nt, Streptococcus pneumoniae R6
ugucuaacuuuug

SEQ ID NO: 2172751 - RNA, 14 nt, Streptococcus pneumoniae R6
ugucguugaaugaa

SEQ ID NO: 2172752 - RNA, 17 nt, Streptococcus pneumoniae R6
ugucguugaaugaaaug

SEQ ID NO: 2172753 - RNA, 14 nt, Streptococcus pneumoniae R6
ugucuuuuaaauau

SEQ ID NO: 2172754 - RNA, 14 nt, Streptococcus pneumoniae R6
ugucuuuucaaagu

SEQ ID NO: 2172755 - RNA, 15 nt, Streptococcus pneumoniae R6
ugucuuuaguagucu

SEQ ID NO: 2172756 - RNA, 15 nt, Streptococcus pneumoniae R6
ugucuugguauaucu

SEQ ID NO: 2172757 - RNA, 17 nt, Streptococcus pneumoniae R6
ugucuugcauuuuaauu

SEQ ID NO: 2172758 - RNA, 19 nt, Streptococcus pneumoniae R6
ugucuugcauuuuaauuuc

SEQ ID NO: 2172759 - RNA, 14 nt, Streptococcus pneumoniae R6
ugucuugacugcau

SEQ ID NO: 2172760 - RNA, 20 nt, Streptococcus pneumoniae R6
ugugauauaauaaaaagaga

SEQ ID NO: 2172761 - RNA, 21 nt, Streptococcus pneumoniae R6
ugugauauaauaaaaagagaa

SEQ ID NO: 2172762 - RNA, 17 nt, Streptococcus pneumoniae R6
ugugauacgugaacaag

SEQ ID NO: 2172763 - RNA, 19 nt, Streptococcus pneumoniae R6
ugugaaagcucuucuaaaa

SEQ ID NO: 2172764 - RNA, 18 nt, Streptococcus pneumoniae R6
ugugaacaucucuaucag

SEQ ID NO: 2172765 - RNA, 23 nt, Streptococcus pneumoniae R6
ugugaacaucucuaucaggaaag

SEQ ID NO: 2172766 - RNA, 16 nt, Streptococcus pneumoniae R6
ugugaaauuugugaua

SEQ ID NO: 2172767 - RNA, 23 nt, Streptococcus pneumoniae R6
ugugaaaaucgcaaguuuuuccc

SEQ ID NO: 2172768 - RNA, 19 nt, Streptococcus pneumoniae R6
ugugccauuguuucguuuc

SEQ ID NO: 2172769 - RNA, 12 nt, Streptococcus pneumoniae R6
ugugccccugau

SEQ ID NO: 2172770 - RNA, 18 nt, Streptococcus pneumoniae R6
ugugauuucuaaaacauu

SEQ ID NO: 2172771 - RNA, 15 nt, Streptococcus pneumoniae R6
ugugauuuuaaauuu

SEQ ID NO: 2172772 - RNA, 12 nt, Streptococcus pneumoniae R6
ugugauuuuccu

SEQ ID NO: 2172773 - RNA, 20 nt, Streptococcus pneumoniae R6
ugugauuuucgaaaauucuu

SEQ ID NO: 2172774 - RNA, 14 nt, Streptococcus pneumoniae R6
uggguaaaggaaag

SEQ ID NO: 2172775 - RNA, 14 nt, Streptococcus pneumoniae R6
ugggcuuacaucaa

SEQ ID NO: 2172776 - RNA, 22 nt, Streptococcus pneumoniae R6
ugggagaauuucauuuuauuau

SEQ ID NO: 2172777 - RNA, 22 nt, Streptococcus pneumoniae R6
uggcugcgaaaaaugcuggcgg

SEQ ID NO: 2172778 - RNA, 14 nt, Streptococcus pneumoniae R6
ugggaagaugaaga

SEQ ID NO: 2172779 - RNA, 19 nt, Streptococcus pneumoniae R6
ugggaagaguugcuuguca

SEQ ID NO: 2172780 - RNA, 17 nt, Streptococcus pneumoniae R6
ugggaauugguuuuuua

SEQ ID NO: 2172781 - RNA, 15 nt, Streptococcus pneumoniae R6
ugggacgauuuucaa

SEQ ID NO: 2172782 - RNA, 23 nt, Streptococcus pneumoniae R6
ugggacgauuuucaaaaagaagu

SEQ ID NO: 2172783 - RNA, 23 nt, Streptococcus pneumoniae R6
ugggacuaaagauugagaaacua

SEQ ID NO: 2172784 - RNA, 16 nt, Streptococcus pneumoniae R6
ugggaaauucuaauua

SEQ ID NO: 2172785 - RNA, 16 nt, Streptococcus pneumoniae R6
ugggaaaccaaacgga

SEQ ID NO: 2172786 - RNA, 13 nt, Streptococcus pneumoniae R6
ugggaaaguaaaa

SEQ ID NO: 2172787 - RNA, 17 nt, Streptococcus pneumoniae R6
uggcuaggcgcuucacu

SEQ ID NO: 2172788 - RNA, 18 nt, Streptococcus pneumoniae R6
uggcuaggcgcuucacua

SEQ ID NO: 2172789 - RNA, 20 nt, Streptococcus pneumoniae R6
uggcuaggcgcuucacuagu

SEQ ID NO: 2172790 - RNA, 13 nt, Streptococcus pneumoniae R6
uggcuaauaauuc

SEQ ID NO: 2172791 - RNA, 18 nt, Streptococcus pneumoniae R6
uggcucaucugcaauaac

SEQ ID NO: 2172792 - RNA, 15 nt, Streptococcus pneumoniae R6
uggcuauuuuuauug

SEQ ID NO: 2172793 - RNA, 22 nt, Streptococcus pneumoniae R6
uggcguaguaaaucaguccagu

SEQ ID NO: 2172794 - RNA, 13 nt, Streptococcus pneumoniae R6
uggcguuuuauuu

SEQ ID NO: 2172795 - RNA, 18 nt, Streptococcus pneumoniae R6
uggcccgcuucgcuucca

SEQ ID NO: 2172796 - RNA, 20 nt, Streptococcus pneumoniae R6
uggacguucuucaagagcuu

SEQ ID NO: 2172797 - RNA, 20 nt, Streptococcus pneumoniae R6
uggacucacuaaaauucuau

SEQ ID NO: 2172798 - RNA, 14 nt, Streptococcus pneumoniae R6
uggacgucuucacg

SEQ ID NO: 2172799 - RNA, 21 nt, Streptococcus pneumoniae R6
uggacuuuaucaccuccuucu

SEQ ID NO: 2172800 - RNA, 17 nt, Streptococcus pneumoniae R6
uggacugaccaccugua

SEQ ID NO: 2172801 - RNA, 17 nt, Streptococcus pneumoniae R6
uggagacagcaccaacu

SEQ ID NO: 2172802 - RNA, 15 nt, Streptococcus pneumoniae R6
uggaguaaaaaaaga

SEQ ID NO: 2172803 - RNA, 19 nt, Streptococcus pneumoniae R6
uggagguguucuaucacau

SEQ ID NO: 2172804 - RNA, 17 nt, Streptococcus pneumoniae R6
uggaguagcauccccag

SEQ ID NO: 2172805 - RNA, 18 nt, Streptococcus pneumoniae R6
uggaguagcauccccagu

SEQ ID NO: 2172806 - RNA, 15 nt, Streptococcus pneumoniae R6
uggaguacuucuuug

SEQ ID NO: 2172807 - RNA, 20 nt, Streptococcus pneumoniae R6
uggagcuucaucaguuccag

SEQ ID NO: 2172808 - RNA, 20 nt, Streptococcus pneumoniae R6
uggaggcaauacguuuucaa

SEQ ID NO: 2172809 - RNA, 16 nt, Streptococcus pneumoniae R6
uggaggcaauggccug

SEQ ID NO: 2172810 - RNA, 19 nt, Streptococcus pneumoniae R6
uggagcaagugguucucca

SEQ ID NO: 2172811 - RNA, 18 nt, Streptococcus pneumoniae R6
uggagauuuuucaauaga

SEQ ID NO: 2172812 - RNA, 24 nt, Streptococcus pneumoniae R6
uggagaguucacggauucucucag

SEQ ID NO: 2172813 - RNA, 18 nt, Streptococcus pneumoniae R6
uggaucuagauaguacca

SEQ ID NO: 2172814 - RNA, 16 nt, Streptococcus pneumoniae R6
uggaucuacuuuuuuc

SEQ ID NO: 2172815 - RNA, 19 nt, Streptococcus pneumoniae R6
uggaugcccguacuuacca

SEQ ID NO: 2172816 - RNA, 14 nt, Streptococcus pneumoniae R6
uggaugcaauuuuu

SEQ ID NO: 2172817 - RNA, 13 nt, Streptococcus pneumoniae R6
uggaugauucuuu

SEQ ID NO: 2172818 - RNA, 15 nt, Streptococcus pneumoniae R6
uggaugauucuuuuc

SEQ ID NO: 2172819 - RNA, 22 nt, Streptococcus pneumoniae R6
uggaugauuuaauuagaaaaaa

SEQ ID NO: 2172820 - RNA, 12 nt, Streptococcus pneumoniae R6
uggaucaugacu

SEQ ID NO: 2172821 - RNA, 17 nt, Streptococcus pneumoniae R6
uggaucagcuuuuucag

SEQ ID NO: 2172822 - RNA, 14 nt, Streptococcus pneumoniae R6
uggauaauuucuuu

SEQ ID NO: 2172823 - RNA, 14 nt, Streptococcus pneumoniae R6
uggauaccuuuaga

SEQ ID NO: 2172824 - RNA, 13 nt, Streptococcus pneumoniae R6
uggauaguccaga

SEQ ID NO: 2172825 - RNA, 18 nt, Streptococcus pneumoniae R6
uggauauaacaacucccu

SEQ ID NO: 2172826 - RNA, 20 nt, Streptococcus pneumoniae R6
uggagugauggguucagaau

SEQ ID NO: 2172827 - RNA, 15 nt, Streptococcus pneumoniae R6
uggauaacugaaauu

SEQ ID NO: 2172828 - RNA, 21 nt, Streptococcus pneumoniae R6
uggauaaaguuaugaaaaaga

SEQ ID NO: 2172829 - RNA, 22 nt, Streptococcus pneumoniae R6
uggauaaaguuaugaaaaagau

SEQ ID NO: 2172830 - RNA, 21 nt, Streptococcus pneumoniae R6
uggaguucuuuucauuguuuu

SEQ ID NO: 2172831 - RNA, 12 nt, Streptococcus pneumoniae R6
uggcaagagcug

SEQ ID NO: 2172832 - RNA, 21 nt, Streptococcus pneumoniae R6
uggcaagaucaaguucaagau

SEQ ID NO: 2172833 - RNA, 22 nt, Streptococcus pneumoniae R6
uggcaaggaguaccguucauau

SEQ ID NO: 2172834 - RNA, 16 nt, Streptococcus pneumoniae R6
uggcagagcuaaaaac

SEQ ID NO: 2172835 - RNA, 23 nt, Streptococcus pneumoniae R6
uggcagaggaggagcaguaugca

SEQ ID NO: 2172836 - RNA, 15 nt, Streptococcus pneumoniae R6
uggauuaugauuuaa

SEQ ID NO: 2172837 - RNA, 23 nt, Streptococcus pneumoniae R6
uggauuaauccccauuugcuuca

SEQ ID NO: 2172838 - RNA, 16 nt, Streptococcus pneumoniae R6
uggauuuuaagcucca

SEQ ID NO: 2172839 - RNA, 13 nt, Streptococcus pneumoniae R6
uggauuuuucuua

SEQ ID NO: 2172840 - RNA, 16 nt, Streptococcus pneumoniae R6
uggauuuuugauucag

SEQ ID NO: 2172841 - RNA, 15 nt, Streptococcus pneumoniae R6
uggauuuuguuucuu

SEQ ID NO: 2172842 - RNA, 22 nt, Streptococcus pneumoniae R6
uggauuuucagccucuauacuu

SEQ ID NO: 2172843 - RNA, 19 nt, Streptococcus pneumoniae R6
uggcaaaaaauugagaaag

SEQ ID NO: 2172844 - RNA, 15 nt, Streptococcus pneumoniae R6
uggcaacgacaggag

SEQ ID NO: 2172845 - RNA, 15 nt, Streptococcus pneumoniae R6
uggccacuucccaag

SEQ ID NO: 2172846 - RNA, 13 nt, Streptococcus pneumoniae R6
uggcauggaaagc

SEQ ID NO: 2172847 - RNA, 13 nt, Streptococcus pneumoniae R6
uggcauugcuuca

SEQ ID NO: 2172848 - RNA, 18 nt, Streptococcus pneumoniae R6
uggcaucugguuuuuccc

SEQ ID NO: 2172849 - RNA, 21 nt, Streptococcus pneumoniae R6
uuaagaagucaucuaucaaaa

SEQ ID NO: 2172850 - RNA, 23 nt, Streptococcus pneumoniae R6
uuaagccucuuucauagcaaaau

SEQ ID NO: 2172851 - RNA, 13 nt, Streptococcus pneumoniae R6
uuaagaguuaaug

SEQ ID NO: 2172852 - RNA, 12 nt, Streptococcus pneumoniae R6
uuaagagaguua

SEQ ID NO: 2172853 - RNA, 20 nt, Streptococcus pneumoniae R6
uuaagacuaaguuagaauaa

SEQ ID NO: 2172854 - RNA, 22 nt, Streptococcus pneumoniae R6
uuaagacuuguuagcugauuuu

SEQ ID NO: 2172855 - RNA, 20 nt, Streptococcus pneumoniae R6
uuaagacacuuuuauuaugg

SEQ ID NO: 2172856 - RNA, 15 nt, Streptococcus pneumoniae R6
uuaaucaaaugagca

SEQ ID NO: 2172857 - RNA, 16 nt, Streptococcus pneumoniae R6
uuaaucaauuaucauu

SEQ ID NO: 2172858 - RNA, 23 nt, Streptococcus pneumoniae R6
uuaaucgauuauuuuuucucaag

SEQ ID NO: 2172859 - RNA, 21 nt, Streptococcus pneumoniae R6
uuaagugguugauaaauuuca

SEQ ID NO: 2172860 - RNA, 16 nt, Streptococcus pneumoniae R6
uuaagugugaagucgu

SEQ ID NO: 2172861 - RNA, 23 nt, Streptococcus pneumoniae R6
uuaaguuauuucuccuaaagaaa

SEQ ID NO: 2172862 - RNA, 15 nt, Streptococcus pneumoniae R6
uuaauacucaaugaa

SEQ ID NO: 2172863 - RNA, 15 nt, Streptococcus pneumoniae R6
uuaauaacucucauc

SEQ ID NO: 2172864 - RNA, 15 nt, Streptococcus pneumoniae R6
uuaauugauaagguu

SEQ ID NO: 2172865 - RNA, 17 nt, Streptococcus pneumoniae R6
uuaauucucuuauuguu

SEQ ID NO: 2172866 - RNA, 13 nt, Streptococcus pneumoniae R6
uuaauuauuuuca

SEQ ID NO: 2172867 - RNA, 14 nt, Streptococcus pneumoniae R6
uuaauuauuuucaa

SEQ ID NO: 2172868 - RNA, 23 nt, Streptococcus pneumoniae R6
uuaauguuuucccuuugauagca

SEQ ID NO: 2172869 - RNA, 14 nt, Streptococcus pneumoniae R6
uuaauuagaaaaaa

SEQ ID NO: 2172870 - RNA, 16 nt, Streptococcus pneumoniae R6
uuaauuagaaaaaaau

SEQ ID NO: 2172871 - RNA, 20 nt, Streptococcus pneumoniae R6
uuaaugugggaagauuuacu

SEQ ID NO: 2172872 - RNA, 22 nt, Streptococcus pneumoniae R6
uuacaggcaggacaaaagauaa

SEQ ID NO: 2172873 - RNA, 21 nt, Streptococcus pneumoniae R6
uuacaauucauaaagugcugu

SEQ ID NO: 2172874 - RNA, 17 nt, Streptococcus pneumoniae R6
uuacaauuguaaaaaga

SEQ ID NO: 2172875 - RNA, 13 nt, Streptococcus pneumoniae R6
uuaauuuuacuuu

SEQ ID NO: 2172876 - RNA, 11 nt, Streptococcus pneumoniae R6
uuaauuucuau

SEQ ID NO: 2172877 - RNA, 12 nt, Streptococcus pneumoniae R6
uuaauuucuaua

SEQ ID NO: 2172878 - RNA, 21 nt, Streptococcus pneumoniae R6
uuacccauagauuuuuauuau

SEQ ID NO: 2172879 - RNA, 12 nt, Streptococcus pneumoniae R6
uuacccgaccua

SEQ ID NO: 2172880 - RNA, 16 nt, Streptococcus pneumoniae R6
uuaccaauuuuuccuu

SEQ ID NO: 2172881 - RNA, 17 nt, Streptococcus pneumoniae R6
uuaccaauuuuuccuuu

SEQ ID NO: 2172882 - RNA, 15 nt, Streptococcus pneumoniae R6
uuaccaaccucagaa

SEQ ID NO: 2172883 - RNA, 18 nt, Streptococcus pneumoniae R6
uuaccaaguccaagccuu

SEQ ID NO: 2172884 - RNA, 16 nt, Streptococcus pneumoniae R6
uuaccaauacaggaaa

SEQ ID NO: 2172885 - RNA, 14 nt, Streptococcus pneumoniae R6
uuaccaaaaccuuc

SEQ ID NO: 2172886 - RNA, 18 nt, Streptococcus pneumoniae R6
uuacauuugaguuucucu

SEQ ID NO: 2172887 - RNA, 22 nt, Streptococcus pneumoniae R6
uuacauuugaguuucucuuacu

SEQ ID NO: 2172888 - RNA, 17 nt, Streptococcus pneumoniae R6
uuacauuaugcguuuuu

SEQ ID NO: 2172889 - RNA, 13 nt, Streptococcus pneumoniae R6
uuacaguauuuau

SEQ ID NO: 2172890 - RNA, 21 nt, Streptococcus pneumoniae R6
uuacaguuauuuuaguaaaaa

SEQ ID NO: 2172891 - RNA, 20 nt, Streptococcus pneumoniae R6
uuaguagaaaaugaaauaca

SEQ ID NO: 2172892 - RNA, 14 nt, Streptococcus pneumoniae R6
uuagucaaaaagaa

SEQ ID NO: 2172893 - RNA, 17 nt, Streptococcus pneumoniae R6
uuagucaaaaagaagga

SEQ ID NO: 2172894 - RNA, 19 nt, Streptococcus pneumoniae R6
uuagucauuagauauagaa

SEQ ID NO: 2172895 - RNA, 17 nt, Streptococcus pneumoniae R6
uuaguaaaaacguuuuu

SEQ ID NO: 2172896 - RNA, 20 nt, Streptococcus pneumoniae R6
uuaguaaaaacguuuuucaa

SEQ ID NO: 2172897 - RNA, 14 nt, Streptococcus pneumoniae R6
uuaguaaauacuac

SEQ ID NO: 2172898 - RNA, 12 nt, Streptococcus pneumoniae R6
uuauaaaauaac

SEQ ID NO: 2172899 - RNA, 21 nt, Streptococcus pneumoniae R6
uuaguuuuggcuaguaaauau

SEQ ID NO: 2172900 - RNA, 14 nt, Streptococcus pneumoniae R6
uuauaaaaaacaca

SEQ ID NO: 2172901 - RNA, 16 nt, Streptococcus pneumoniae R6
uuauaaaaaacacaaa

SEQ ID NO: 2172902 - RNA, 21 nt, Streptococcus pneumoniae R6
uuauaaaaaacacaaaaggag

SEQ ID NO: 2172903 - RNA, 13 nt, Streptococcus pneumoniae R6
uuaguuuaaaauu

SEQ ID NO: 2172904 - RNA, 19 nt, Streptococcus pneumoniae R6
uuaguuggccaacuucuuu

SEQ ID NO: 2172905 - RNA, 20 nt, Streptococcus pneumoniae R6
uuagucuucuuuucuuuuag

SEQ ID NO: 2172906 - RNA, 17 nt, Streptococcus pneumoniae R6
uuaguucagaauuuucu

SEQ ID NO: 2172907 - RNA, 21 nt, Streptococcus pneumoniae R6
uuaguuaaaauaaguuagaau

SEQ ID NO: 2172908 - RNA, 13 nt, Streptococcus pneumoniae R6
uuauaaauuauuu

SEQ ID NO: 2172909 - RNA, 15 nt, Streptococcus pneumoniae R6
uuauaaauuauuucu

SEQ ID NO: 2172910 - RNA, 13 nt, Streptococcus pneumoniae R6
uuauaacaguaua

SEQ ID NO: 2172911 - RNA, 12 nt, Streptococcus pneumoniae R6
uuauaaauauag

SEQ ID NO: 2172912 - RNA, 22 nt, Streptococcus pneumoniae R6
uuauaaauauaguaaaaugaaa

SEQ ID NO: 2172913 - RNA, 16 nt, Streptococcus pneumoniae R6
uuauaaaauuuaauaa

SEQ ID NO: 2172914 - RNA, 18 nt, Streptococcus pneumoniae R6
uuauaauuuccaugucaa

SEQ ID NO: 2172915 - RNA, 15 nt, Streptococcus pneumoniae R6
uuauacaaacuacua

SEQ ID NO: 2172916 - RNA, 20 nt, Streptococcus pneumoniae R6
uuauaauaaaaugaaauaag

SEQ ID NO: 2172917 - RNA, 21 nt, Streptococcus pneumoniae R6
uuauaauauguauuuauagua

SEQ ID NO: 2172918 - RNA, 18 nt, Streptococcus pneumoniae R6
uuauaauauaaacuuuuu

SEQ ID NO: 2172919 - RNA, 20 nt, Streptococcus pneumoniae R6
uuauaauguauugaaucuag

SEQ ID NO: 2172920 - RNA, 17 nt, Streptococcus pneumoniae R6
uuauaaucauuaaaaua

SEQ ID NO: 2172921 - RNA, 16 nt, Streptococcus pneumoniae R6
uuauaaucguuuaaaa

SEQ ID NO: 2172922 - RNA, 15 nt, Streptococcus pneumoniae R6
uuauagaaaugaggu

SEQ ID NO: 2172923 - RNA, 16 nt, Streptococcus pneumoniae R6
uuauagaaaauuaacu

SEQ ID NO: 2172924 - RNA, 13 nt, Streptococcus pneumoniae R6
uuauagacauugu

SEQ ID NO: 2172925 - RNA, 18 nt, Streptococcus pneumoniae R6
uuauagauaaauguugaa

SEQ ID NO: 2172926 - RNA, 14 nt, Streptococcus pneumoniae R6
uuauacucaucugc

SEQ ID NO: 2172927 - RNA, 15 nt, Streptococcus pneumoniae R6
uuauacucuuagaaa

SEQ ID NO: 2172928 - RNA, 15 nt, Streptococcus pneumoniae R6
uuauacuuuuaauau

SEQ ID NO: 2172929 - RNA, 12 nt, Streptococcus pneumoniae R6
uuauaauuucaa

SEQ ID NO: 2172930 - RNA, 14 nt, Streptococcus pneumoniae R6
uuauaccaaaaaaa

SEQ ID NO: 2172931 - RNA, 16 nt, Streptococcus pneumoniae R6
uuacucaggauaaaac

SEQ ID NO: 2172932 - RNA, 19 nt, Streptococcus pneumoniae R6
uuacucaaggacuaaguuc

SEQ ID NO: 2172933 - RNA, 14 nt, Streptococcus pneumoniae R6
uuacuaauuaauua

SEQ ID NO: 2172934 - RNA, 14 nt, Streptococcus pneumoniae R6
uuacuaaauacuag

SEQ ID NO: 2172935 - RNA, 21 nt, Streptococcus pneumoniae R6
uuacuaaauacuagucuuucu

SEQ ID NO: 2172936 - RNA, 13 nt, Streptococcus pneumoniae R6
uuaccgagaaucc

SEQ ID NO: 2172937 - RNA, 12 nt, Streptococcus pneumoniae R6
uuacuuugcuug

SEQ ID NO: 2172938 - RNA, 13 nt, Streptococcus pneumoniae R6
uuacugauaaaac

SEQ ID NO: 2172939 - RNA, 15 nt, Streptococcus pneumoniae R6
uuaggaaauucaaau

SEQ ID NO: 2172940 - RNA, 21 nt, Streptococcus pneumoniae R6
uuaggaacacguaaauuauac

SEQ ID NO: 2172941 - RNA, 23 nt, Streptococcus pneumoniae R6
uuagcugauuuuuuacaauccug

SEQ ID NO: 2172942 - RNA, 15 nt, Streptococcus pneumoniae R6
uuaggaaacucuuac

SEQ ID NO: 2172943 - RNA, 18 nt, Streptococcus pneumoniae R6
uuaggaaacucuuacaaa

SEQ ID NO: 2172944 - RNA, 14 nt, Streptococcus pneumoniae R6
uuaggaaaggaaaa

SEQ ID NO: 2172945 - RNA, 15 nt, Streptococcus pneumoniae R6
uuagggucuuuaaug

SEQ ID NO: 2172946 - RNA, 16 nt, Streptococcus pneumoniae R6
uuagcuuuucuucaac

SEQ ID NO: 2172947 - RNA, 21 nt, Streptococcus pneumoniae R6
uuagcauggaaccaaaguucc

SEQ ID NO: 2172948 - RNA, 22 nt, Streptococcus pneumoniae R6
uuagcauggucaaaguagucau

SEQ ID NO: 2172949 - RNA, 16 nt, Streptococcus pneumoniae R6
uuagccacugcaucug

SEQ ID NO: 2172950 - RNA, 17 nt, Streptococcus pneumoniae R6
uuagagaaugaaauaua

SEQ ID NO: 2172951 - RNA, 15 nt, Streptococcus pneumoniae R6
uuagaauaaggaaaa

SEQ ID NO: 2172952 - RNA, 18 nt, Streptococcus pneumoniae R6
uuagaauaaggaaaacau

SEQ ID NO: 2172953 - RNA, 20 nt, Streptococcus pneumoniae R6
uuagaagcaguuguguacua

SEQ ID NO: 2172954 - RNA, 16 nt, Streptococcus pneumoniae R6
uuagaagcuucuugga

SEQ ID NO: 2172955 - RNA, 22 nt, Streptococcus pneumoniae R6
uuagaaccgaaaaucuccucua

SEQ ID NO: 2172956 - RNA, 12 nt, Streptococcus pneumoniae R6
uuagaagacuuu

SEQ ID NO: 2172957 - RNA, 22 nt, Streptococcus pneumoniae R6
uuagaacuugcuccaaaggaga

SEQ ID NO: 2172958 - RNA, 14 nt, Streptococcus pneumoniae R6
uuagcagacuucuu

SEQ ID NO: 2172959 - RNA, 22 nt, Streptococcus pneumoniae R6
uuagcagacuucuuuuuuacuu

SEQ ID NO: 2172960 - RNA, 23 nt, Streptococcus pneumoniae R6
uuagcagacuucuuuuuuacuuc

SEQ ID NO: 2172961 - RNA, 20 nt, Streptococcus pneumoniae R6
uuagagguuugcuuagaaac

SEQ ID NO: 2172962 - RNA, 14 nt, Streptococcus pneumoniae R6
uucaauaaaauaua

SEQ ID NO: 2172963 - RNA, 12 nt, Streptococcus pneumoniae R6
uucaauaccaaa

SEQ ID NO: 2172964 - RNA, 17 nt, Streptococcus pneumoniae R6
uucaauaccaaagaagu

SEQ ID NO: 2172965 - RNA, 17 nt, Streptococcus pneumoniae R6
uucaauaauuucuuuuu

SEQ ID NO: 2172966 - RNA, 17 nt, Streptococcus pneumoniae R6
uucaaaccaauuucuaa

SEQ ID NO: 2172967 - RNA, 19 nt, Streptococcus pneumoniae R6
uucaaaccgccaccaaaca

SEQ ID NO: 2172968 - RNA, 16 nt, Streptococcus pneumoniae R6
uucaacauuaaagaca

SEQ ID NO: 2172969 - RNA, 14 nt, Streptococcus pneumoniae R6
uucaacaugucagc

SEQ ID NO: 2172970 - RNA, 17 nt, Streptococcus pneumoniae R6
uucaacgaaaauaauua

SEQ ID NO: 2172971 - RNA, 22 nt, Streptococcus pneumoniae R6
uucaacgaaaauaauuaguuca

SEQ ID NO: 2172972 - RNA, 23 nt, Streptococcus pneumoniae R6
uucaacgaacuauaaaaucugaa

SEQ ID NO: 2172973 - RNA, 16 nt, Streptococcus pneumoniae R6
uucaaaaucagaaaaa

SEQ ID NO: 2172974 - RNA, 15 nt, Streptococcus pneumoniae R6
uucaaaagcuaauag

SEQ ID NO: 2172975 - RNA, 14 nt, Streptococcus pneumoniae R6
uuauuuuuuaggau

SEQ ID NO: 2172976 - RNA, 22 nt, Streptococcus pneumoniae R6
uucaaaaaucauuauauuucuc

SEQ ID NO: 2172977 - RNA, 12 nt, Streptococcus pneumoniae R6
uuauuucucaag

SEQ ID NO: 2172978 - RNA, 23 nt, Streptococcus pneumoniae R6
uuauuugccuaugaaaugagaaa

SEQ ID NO: 2172979 - RNA, 21 nt, Streptococcus pneumoniae R6
uuauugugggaagauguauaa

SEQ ID NO: 2172980 - RNA, 21 nt, Streptococcus pneumoniae R6
uuauuucuccuaaagaaaaag

SEQ ID NO: 2172981 - RNA, 19 nt, Streptococcus pneumoniae R6
uuauuauaaaauuuaauaa

SEQ ID NO: 2172982 - RNA, 23 nt, Streptococcus pneumoniae R6
uuauucuuggcguccucuaguaa

SEQ ID NO: 2172983 - RNA, 22 nt, Streptococcus pneumoniae R6
uuauucuggaagugaaaaagca

SEQ ID NO: 2172984 - RNA, 14 nt, Streptococcus pneumoniae R6
uuauucuuaaauga

SEQ ID NO: 2172985 - RNA, 13 nt, Streptococcus pneumoniae R6
uuauucucuauau

SEQ ID NO: 2172986 - RNA, 23 nt, Streptococcus pneumoniae R6
uuauugucauuuuucugcuauua

SEQ ID NO: 2172987 - RNA, 18 nt, Streptococcus pneumoniae R6
uuauugucucuaaaaaua

SEQ ID NO: 2172988 - RNA, 14 nt, Streptococcus pneumoniae R6
uuauugagcgcagg

SEQ ID NO: 2172989 - RNA, 14 nt, Streptococcus pneumoniae R6
uuauucuuuuucaa

SEQ ID NO: 2172990 - RNA, 14 nt, Streptococcus pneumoniae R6
uuauuguuguaaua

SEQ ID NO: 2172991 - RNA, 14 nt, Streptococcus pneumoniae R6
uucaauccacuugu

SEQ ID NO: 2172992 - RNA, 11 nt, Streptococcus pneumoniae R6
uucaaucaaag

SEQ ID NO: 2172993 - RNA, 19 nt, Streptococcus pneumoniae R6
uucaaucagcuaaaaauaa

SEQ ID NO: 2172994 - RNA, 15 nt, Streptococcus pneumoniae R6
uucaaucaagacaga

SEQ ID NO: 2172995 - RNA, 20 nt, Streptococcus pneumoniae R6
uucaauagacuauaucauau

SEQ ID NO: 2172996 - RNA, 15 nt, Streptococcus pneumoniae R6
uucaauagcucucag

SEQ ID NO: 2172997 - RNA, 16 nt, Streptococcus pneumoniae R6
uucaccuaaccaaaua

SEQ ID NO: 2172998 - RNA, 21 nt, Streptococcus pneumoniae R6
uucaccuaaccaaauaauaga

SEQ ID NO: 2172999 - RNA, 13 nt, Streptococcus pneumoniae R6
uucacgaacauga

SEQ ID NO: 2173000 - RNA, 16 nt, Streptococcus pneumoniae R6
uucaccuugccaucug

SEQ ID NO: 2173001 - RNA, 18 nt, Streptococcus pneumoniae R6
uucacaucuuauuucaau

SEQ ID NO: 2173002 - RNA, 17 nt, Streptococcus pneumoniae R6
uucagagcgauaaaaau

SEQ ID NO: 2173003 - RNA, 23 nt, Streptococcus pneumoniae R6
uucagagacagcuuguugcuuuu

SEQ ID NO: 2173004 - RNA, 22 nt, Streptococcus pneumoniae R6
uucacucaaaucauauucacuu

SEQ ID NO: 2173005 - RNA, 21 nt, Streptococcus pneumoniae R6
uucacuaguauucaucuuauc

SEQ ID NO: 2173006 - RNA, 22 nt, Streptococcus pneumoniae R6
uucacuauugaugaacugcuug

SEQ ID NO: 2173007 - RNA, 19 nt, Streptococcus pneumoniae R6
uucacuauugaugaaguaa

SEQ ID NO: 2173008 - RNA, 22 nt, Streptococcus pneumoniae R6
uucagcuggcuccuucuuuuuu

SEQ ID NO: 2173009 - RNA, 17 nt, Streptococcus pneumoniae R6
uucagcuuuggcaacug

SEQ ID NO: 2173010 - RNA, 15 nt, Streptococcus pneumoniae R6
uucagccucuauacu

SEQ ID NO: 2173011 - RNA, 16 nt, Streptococcus pneumoniae R6
uuauguccuaaaacua

SEQ ID NO: 2173012 - RNA, 22 nt, Streptococcus pneumoniae R6
uuaugggaauuaggcucuuugu

SEQ ID NO: 2173013 - RNA, 22 nt, Streptococcus pneumoniae R6
uuaugggagcaagcuccuaaau

SEQ ID NO: 2173014 - RNA, 14 nt, Streptococcus pneumoniae R6
uuauggaugacuaa

SEQ ID NO: 2173015 - RNA, 21 nt, Streptococcus pneumoniae R6
uuaugcuuggugagaaaguuu

SEQ ID NO: 2173016 - RNA, 15 nt, Streptococcus pneumoniae R6
uuauuaacaaaagag

SEQ ID NO: 2173017 - RNA, 13 nt, Streptococcus pneumoniae R6
uuauuaaguagaa

SEQ ID NO: 2173018 - RNA, 14 nt, Streptococcus pneumoniae R6
uuauuaaguagaau

SEQ ID NO: 2173019 - RNA, 20 nt, Streptococcus pneumoniae R6
uuauuaccuuucuuguaaua

SEQ ID NO: 2173020 - RNA, 15 nt, Streptococcus pneumoniae R6
uuauuacaacaauaa

SEQ ID NO: 2173021 - RNA, 16 nt, Streptococcus pneumoniae R6
uuaucuaagacugcuu

SEQ ID NO: 2173022 - RNA, 21 nt, Streptococcus pneumoniae R6
uuaucuaacaauaagauauca

SEQ ID NO: 2173023 - RNA, 17 nt, Streptococcus pneumoniae R6
uuaucuaucucaacaaa

SEQ ID NO: 2173024 - RNA, 14 nt, Streptococcus pneumoniae R6
uuaucuagugcuau

SEQ ID NO: 2173025 - RNA, 15 nt, Streptococcus pneumoniae R6
uuaucuagugcuaua

SEQ ID NO: 2173026 - RNA, 17 nt, Streptococcus pneumoniae R6
uuaucguaauuaaaguu

SEQ ID NO: 2173027 - RNA, 15 nt, Streptococcus pneumoniae R6
uuaucugcaaccuca

SEQ ID NO: 2173028 - RNA, 18 nt, Streptococcus pneumoniae R6
uuaucugcaaccucaaaa

SEQ ID NO: 2173029 - RNA, 13 nt, Streptococcus pneumoniae R6
uuaucuuuccuuc

SEQ ID NO: 2173030 - RNA, 21 nt, Streptococcus pneumoniae R6
uuaucuuugggacgauuuuca

SEQ ID NO: 2173031 - RNA, 19 nt, Streptococcus pneumoniae R6
uuaugaaauuuaaaaagaa

SEQ ID NO: 2173032 - RNA, 14 nt, Streptococcus pneumoniae R6
uuaugaaaaccaag

SEQ ID NO: 2173033 - RNA, 16 nt, Streptococcus pneumoniae R6
uuaugaaaaccaagaa

SEQ ID NO: 2173034 - RNA, 16 nt, Streptococcus pneumoniae R6
uuaugaaaaagauuuu

SEQ ID NO: 2173035 - RNA, 19 nt, Streptococcus pneumoniae R6
uuaugaaaaagauuuuuua

SEQ ID NO: 2173036 - RNA, 17 nt, Streptococcus pneumoniae R6
uuaugaucuuaaauuuu

SEQ ID NO: 2173037 - RNA, 11 nt, Streptococcus pneumoniae R6
uuaugauauac

SEQ ID NO: 2173038 - RNA, 22 nt, Streptococcus pneumoniae R6
uuaugacgaaugauaaucaaac

SEQ ID NO: 2173039 - RNA, 14 nt, Streptococcus pneumoniae R6
uuauagucuuuuca

SEQ ID NO: 2173040 - RNA, 14 nt, Streptococcus pneumoniae R6
uuauagguaaaauc

SEQ ID NO: 2173041 - RNA, 14 nt, Streptococcus pneumoniae R6
uuauaguuuaagua

SEQ ID NO: 2173042 - RNA, 17 nt, Streptococcus pneumoniae R6
uuauaguuuucacuauu

SEQ ID NO: 2173043 - RNA, 18 nt, Streptococcus pneumoniae R6
uuauagacuauauugauu

SEQ ID NO: 2173044 - RNA, 18 nt, Streptococcus pneumoniae R6
uuauagcgacuauaaaaa

SEQ ID NO: 2173045 - RNA, 19 nt, Streptococcus pneumoniae R6
uuauagcgacuauaaaaaa

SEQ ID NO: 2173046 - RNA, 19 nt, Streptococcus pneumoniae R6
uuauaggcgauaauuucgc

SEQ ID NO: 2173047 - RNA, 20 nt, Streptococcus pneumoniae R6
uuauauacccaaaacacaaa

SEQ ID NO: 2173048 - RNA, 16 nt, Streptococcus pneumoniae R6
uuauauaguagccaaa

SEQ ID NO: 2173049 - RNA, 14 nt, Streptococcus pneumoniae R6
uuauauugacagaa

SEQ ID NO: 2173050 - RNA, 15 nt, Streptococcus pneumoniae R6
uuauauugacagaag

SEQ ID NO: 2173051 - RNA, 14 nt, Streptococcus pneumoniae R6
uuauaucuaauaau

SEQ ID NO: 2173052 - RNA, 17 nt, Streptococcus pneumoniae R6
uuauaugauuucaauuu

SEQ ID NO: 2173053 - RNA, 16 nt, Streptococcus pneumoniae R6
uuauaugcgaacuagc

SEQ ID NO: 2173054 - RNA, 12 nt, Streptococcus pneumoniae R6
uuauauuucucu

SEQ ID NO: 2173055 - RNA, 11 nt, Streptococcus pneumoniae R6
uuaucaaaucg

SEQ ID NO: 2173056 - RNA, 20 nt, Streptococcus pneumoniae R6
uuaucaaaucgaucuguucu

SEQ ID NO: 2173057 - RNA, 13 nt, Streptococcus pneumoniae R6
uuauccuaggaag

SEQ ID NO: 2173058 - RNA, 20 nt, Streptococcus pneumoniae R6
uuauccaaucuauuuaugaa

SEQ ID NO: 2173059 - RNA, 20 nt, Streptococcus pneumoniae R6
uuauccgaacccuguuuuau

SEQ ID NO: 2173060 - RNA, 13 nt, Streptococcus pneumoniae R6
uuaucauuuugaa

SEQ ID NO: 2173061 - RNA, 16 nt, Streptococcus pneumoniae R6
uuaucauuuugaaauc

SEQ ID NO: 2173062 - RNA, 15 nt, Streptococcus pneumoniae R6
uuaucauuuccauug

SEQ ID NO: 2173063 - RNA, 13 nt, Streptococcus pneumoniae R6
uuaucauuccaga

SEQ ID NO: 2173064 - RNA, 14 nt, Streptococcus pneumoniae R6
uuaucauagaaaua

SEQ ID NO: 2173065 - RNA, 18 nt, Streptococcus pneumoniae R6
uuaucaguauauugaaau

SEQ ID NO: 2173066 - RNA, 22 nt, Streptococcus pneumoniae R6
uuaucaguauauugaaaugaaa

SEQ ID NO: 2173067 - RNA, 21 nt, Streptococcus pneumoniae R6
uuaucacagcuagucuagucu

SEQ ID NO: 2173068 - RNA, 17 nt, Streptococcus pneumoniae R6
uuaucaaguucuuccac

SEQ ID NO: 2173069 - RNA, 16 nt, Streptococcus pneumoniae R6
uucuaugcaaguucuu

SEQ ID NO: 2173070 - RNA, 19 nt, Streptococcus pneumoniae R6
uucuauggcuuguucaauu

SEQ ID NO: 2173071 - RNA, 22 nt, Streptococcus pneumoniae R6
uucuauuuaaaucgcuucugua

SEQ ID NO: 2173072 - RNA, 14 nt, Streptococcus pneumoniae R6
uucuauuuuaaaaa

SEQ ID NO: 2173073 - RNA, 17 nt, Streptococcus pneumoniae R6
uucuauuuuaaaaauag

SEQ ID NO: 2173074 - RNA, 13 nt, Streptococcus pneumoniae R6
uucuauaaauguu

SEQ ID NO: 2173075 - RNA, 18 nt, Streptococcus pneumoniae R6
uucuaguugguuuccuug

SEQ ID NO: 2173076 - RNA, 14 nt, Streptococcus pneumoniae R6
uucuaguuucaauc

SEQ ID NO: 2173077 - RNA, 15 nt, Streptococcus pneumoniae R6
uucuaguuucaaucu

SEQ ID NO: 2173078 - RNA, 18 nt, Streptococcus pneumoniae R6
uucuaguuucaaucuacu

SEQ ID NO: 2173079 - RNA, 20 nt, Streptococcus pneumoniae R6
uucuaauguacagaagacua

SEQ ID NO: 2173080 - RNA, 14 nt, Streptococcus pneumoniae R6
uucuaauuaaauaa

SEQ ID NO: 2173081 - RNA, 15 nt, Streptococcus pneumoniae R6
uucuaauuauuucaa

SEQ ID NO: 2173082 - RNA, 21 nt, Streptococcus pneumoniae R6
uucuaauacaagcucaucuuu

SEQ ID NO: 2173083 - RNA, 17 nt, Streptococcus pneumoniae R6
uucuacaaauguuuuag

SEQ ID NO: 2173084 - RNA, 16 nt, Streptococcus pneumoniae R6
uucucagauaauaauu

SEQ ID NO: 2173085 - RNA, 16 nt, Streptococcus pneumoniae R6
uucucacguccuagcu

SEQ ID NO: 2173086 - RNA, 20 nt, Streptococcus pneumoniae R6
uucucacguccuagcucucg

SEQ ID NO: 2173087 - RNA, 21 nt, Streptococcus pneumoniae R6
uucucagggucuuuguucuga

SEQ ID NO: 2173088 - RNA, 14 nt, Streptococcus pneumoniae R6
uucucauagccaua

SEQ ID NO: 2173089 - RNA, 19 nt, Streptococcus pneumoniae R6
uucucauagccauaaaaca

SEQ ID NO: 2173090 - RNA, 21 nt, Streptococcus pneumoniae R6
uucucauagccauaaaacauu

SEQ ID NO: 2173091 - RNA, 17 nt, Streptococcus pneumoniae R6
uucucggacuuuuucca

SEQ ID NO: 2173092 - RNA, 22 nt, Streptococcus pneumoniae R6
uucucggacuuuuuccaaaucu

SEQ ID NO: 2173093 - RNA, 19 nt, Streptococcus pneumoniae R6
uucucggucuuguuuuuau

SEQ ID NO: 2173094 - RNA, 13 nt, Streptococcus pneumoniae R6
uucugauuucaaa

SEQ ID NO: 2173095 - RNA, 22 nt, Streptococcus pneumoniae R6
uucugcaaccucuacaauaaca

SEQ ID NO: 2173096 - RNA, 11 nt, Streptococcus pneumoniae R6
uucugcaaaaa

SEQ ID NO: 2173097 - RNA, 13 nt, Streptococcus pneumoniae R6
uucugcaaaaaau

SEQ ID NO: 2173098 - RNA, 21 nt, Streptococcus pneumoniae R6
uucucuguuaccacaggagcu

SEQ ID NO: 2173099 - RNA, 17 nt, Streptococcus pneumoniae R6
uucucuugaaaaugaaa

SEQ ID NO: 2173100 - RNA, 20 nt, Streptococcus pneumoniae R6
uucucuggcgcuucuacucc

SEQ ID NO: 2173101 - RNA, 16 nt, Streptococcus pneumoniae R6
uucucucugaauagaa

SEQ ID NO: 2173102 - RNA, 19 nt, Streptococcus pneumoniae R6
uucucuccuaaccuaaaag

SEQ ID NO: 2173103 - RNA, 20 nt, Streptococcus pneumoniae R6
uucgcuuagacaauuuauau

SEQ ID NO: 2173104 - RNA, 17 nt, Streptococcus pneumoniae R6
uucgcuuauaaacugua

SEQ ID NO: 2173105 - RNA, 18 nt, Streptococcus pneumoniae R6
uucgcuguuaaagccauc

SEQ ID NO: 2173106 - RNA, 24 nt, Streptococcus pneumoniae R6
uucggugaguuuggcuucaguaau

SEQ ID NO: 2173107 - RNA, 21 nt, Streptococcus pneumoniae R6
uucguacacucaaaucaaaau

SEQ ID NO: 2173108 - RNA, 16 nt, Streptococcus pneumoniae R6
uucguacucucuuuuu

SEQ ID NO: 2173109 - RNA, 12 nt, Streptococcus pneumoniae R6
uucgucagucuu

SEQ ID NO: 2173110 - RNA, 20 nt, Streptococcus pneumoniae R6
uucgucaccaaauuucauau

SEQ ID NO: 2173111 - RNA, 21 nt, Streptococcus pneumoniae R6
uucuaaauuacgauucauagu

SEQ ID NO: 2173112 - RNA, 21 nt, Streptococcus pneumoniae R6
uucuaaaugcugaaaaguugu

SEQ ID NO: 2173113 - RNA, 22 nt, Streptococcus pneumoniae R6
uuccuuucaauagcauauuuuu

SEQ ID NO: 2173114 - RNA, 23 nt, Streptococcus pneumoniae R6
uuccuugcgcgugguccagauaa

SEQ ID NO: 2173115 - RNA, 20 nt, Streptococcus pneumoniae R6
uuccuugccuaauuuuucaa

SEQ ID NO: 2173116 - RNA, 15 nt, Streptococcus pneumoniae R6
uuccuuuuuuuacau

SEQ ID NO: 2173117 - RNA, 13 nt, Streptococcus pneumoniae R6
uuccuuuuuucua

SEQ ID NO: 2173118 - RNA, 15 nt, Streptococcus pneumoniae R6
uucgaaaaccaaagg

SEQ ID NO: 2173119 - RNA, 15 nt, Streptococcus pneumoniae R6
uuccuuugucuuuag

SEQ ID NO: 2173120 - RNA, 20 nt, Streptococcus pneumoniae R6
uuccuuuucuuauccagaaa

SEQ ID NO: 2173121 - RNA, 20 nt, Streptococcus pneumoniae R6
uuccuuucaaaauaucuagg

SEQ ID NO: 2173122 - RNA, 18 nt, Streptococcus pneumoniae R6
uucgaaauuccauaccua

SEQ ID NO: 2173123 - RNA, 22 nt, Streptococcus pneumoniae R6
uucgaaaggcuuuauucuuaaa

SEQ ID NO: 2173124 - RNA, 18 nt, Streptococcus pneumoniae R6
uucgaaaaucucugcaaa

SEQ ID NO: 2173125 - RNA, 18 nt, Streptococcus pneumoniae R6
uucgaaaaucucuucaaa

SEQ ID NO: 2173126 - RNA, 21 nt, Streptococcus pneumoniae R6
uucgaaaaucucuucaaacca

SEQ ID NO: 2173127 - RNA, 21 nt, Streptococcus pneumoniae R6
uucgcagucacugucuugcca

SEQ ID NO: 2173128 - RNA, 22 nt, Streptococcus pneumoniae R6
uuccauccacaaccuuaaaaca

SEQ ID NO: 2173129 - RNA, 18 nt, Streptococcus pneumoniae R6
uuccauagcgugagcgga

SEQ ID NO: 2173130 - RNA, 23 nt, Streptococcus pneumoniae R6
uuccauauccgacuugguaaaau

SEQ ID NO: 2173131 - RNA, 19 nt, Streptococcus pneumoniae R6
uuccauauagucuuucaaa

SEQ ID NO: 2173132 - RNA, 22 nt, Streptococcus pneumoniae R6
uuccauaccuaaacuuugagcc

SEQ ID NO: 2173133 - RNA, 22 nt, Streptococcus pneumoniae R6
uuccaugacaacgggguuucca

SEQ ID NO: 2173134 - RNA, 17 nt, Streptococcus pneumoniae R6
uuccaucugcagccuca

SEQ ID NO: 2173135 - RNA, 15 nt, Streptococcus pneumoniae R6
uuccaucuacaaccu

SEQ ID NO: 2173136 - RNA, 20 nt, Streptococcus pneumoniae R6
uuccaucuacaaccuuaaaa

SEQ ID NO: 2173137 - RNA, 21 nt, Streptococcus pneumoniae R6
uuccaucguuccugucuuauu

SEQ ID NO: 2173138 - RNA, 17 nt, Streptococcus pneumoniae R6
uuccauuucagaagaaa

SEQ ID NO: 2173139 - RNA, 17 nt, Streptococcus pneumoniae R6
uuccauucgauucguuu

SEQ ID NO: 2173140 - RNA, 15 nt, Streptococcus pneumoniae R6
uuccauguaaaauua

SEQ ID NO: 2173141 - RNA, 13 nt, Streptococcus pneumoniae R6
uuccauucaaauu

SEQ ID NO: 2173142 - RNA, 17 nt, Streptococcus pneumoniae R6
uuccaugacgcacaaac

SEQ ID NO: 2173143 - RNA, 23 nt, Streptococcus pneumoniae R6
uuccaugacgcacaaacuucauc

SEQ ID NO: 2173144 - RNA, 14 nt, Streptococcus pneumoniae R6
uuccaugcuacuag

SEQ ID NO: 2173145 - RNA, 20 nt, Streptococcus pneumoniae R6
uuccagucccaaguuccaaa

SEQ ID NO: 2173146 - RNA, 21 nt, Streptococcus pneumoniae R6
uuccagcuuuauagucaugaa

SEQ ID NO: 2173147 - RNA, 17 nt, Streptococcus pneumoniae R6
uuccaggaauguccuua

SEQ ID NO: 2173148 - RNA, 18 nt, Streptococcus pneumoniae R6
uuccaggagaguaugauu

SEQ ID NO: 2173149 - RNA, 18 nt, Streptococcus pneumoniae R6
uuccagcgguaucaauca

SEQ ID NO: 2173150 - RNA, 22 nt, Streptococcus pneumoniae R6
uuccagcgguaucaaucauauc

SEQ ID NO: 2173151 - RNA, 12 nt, Streptococcus pneumoniae R6
uuccacaagaac

SEQ ID NO: 2173152 - RNA, 16 nt, Streptococcus pneumoniae R6
uuccaccaccugcaac

SEQ ID NO: 2173153 - RNA, 15 nt, Streptococcus pneumoniae R6
uuccacgauauuguu

SEQ ID NO: 2173154 - RNA, 21 nt, Streptococcus pneumoniae R6
uuccacucgcugacacuggca

SEQ ID NO: 2173155 - RNA, 19 nt, Streptococcus pneumoniae R6
uuccacuuccagaagauac

SEQ ID NO: 2173156 - RNA, 20 nt, Streptococcus pneumoniae R6
uuccacuuguggcaaggagu

SEQ ID NO: 2173157 - RNA, 18 nt, Streptococcus pneumoniae R6
uuccagacucaucuguag

SEQ ID NO: 2173158 - RNA, 21 nt, Streptococcus pneumoniae R6
uuccagacccugcacaaagaa

SEQ ID NO: 2173159 - RNA, 22 nt, Streptococcus pneumoniae R6
uuccucaacaaaauguucaguu

SEQ ID NO: 2173160 - RNA, 15 nt, Streptococcus pneumoniae R6
uuccuaguuugcucu

SEQ ID NO: 2173161 - RNA, 18 nt, Streptococcus pneumoniae R6
uuccucccugcgacaaaa

SEQ ID NO: 2173162 - RNA, 11 nt, Streptococcus pneumoniae R6
uuccuccauug

SEQ ID NO: 2173163 - RNA, 20 nt, Streptococcus pneumoniae R6
uuccuccauaaacgcaagca

SEQ ID NO: 2173164 - RNA, 19 nt, Streptococcus pneumoniae R6
uuccuacugauaucuuuag

SEQ ID NO: 2173165 - RNA, 13 nt, Streptococcus pneumoniae R6
uuccugcucaaaa

SEQ ID NO: 2173166 - RNA, 22 nt, Streptococcus pneumoniae R6
uuccugauuuugugcucuuaaa

SEQ ID NO: 2173167 - RNA, 15 nt, Streptococcus pneumoniae R6
uuccugauagaguug

SEQ ID NO: 2173168 - RNA, 15 nt, Streptococcus pneumoniae R6
uuccugcaaguuuau

SEQ ID NO: 2173169 - RNA, 24 nt, Streptococcus pneumoniae R6
uuccugcaaguuuaugccuugcag

SEQ ID NO: 2173170 - RNA, 19 nt, Streptococcus pneumoniae R6
uuccucgauuuguuuuugg

SEQ ID NO: 2173171 - RNA, 23 nt, Streptococcus pneumoniae R6
uuccuggaaucagaacacuucca

SEQ ID NO: 2173172 - RNA, 18 nt, Streptococcus pneumoniae R6
uuccuuaacaucuuugaa

SEQ ID NO: 2173173 - RNA, 24 nt, Streptococcus pneumoniae R6
uuccuuaaaaguagcgcccuuguu

SEQ ID NO: 2173174 - RNA, 18 nt, Streptococcus pneumoniae R6
uuccuuaaacucuugauu

SEQ ID NO: 2173175 - RNA, 21 nt, Streptococcus pneumoniae R6
uuccuugaugagcaaaggauu

SEQ ID NO: 2173176 - RNA, 18 nt, Streptococcus pneumoniae R6
uuccugugcuacgacacu

SEQ ID NO: 2173177 - RNA, 20 nt, Streptococcus pneumoniae R6
uuccuguguacuguucuaaa

SEQ ID NO: 2173178 - RNA, 16 nt, Streptococcus pneumoniae R6
uuccugucuuauuuca

SEQ ID NO: 2173179 - RNA, 17 nt, Streptococcus pneumoniae R6
uucccaaacaaaaaacc

SEQ ID NO: 2173180 - RNA, 13 nt, Streptococcus pneumoniae R6
uucccaaacuugu

SEQ ID NO: 2173181 - RNA, 22 nt, Streptococcus pneumoniae R6
uucccaaguacgagucaaguca

SEQ ID NO: 2173182 - RNA, 20 nt, Streptococcus pneumoniae R6
uucccaaguaguaguuucag

SEQ ID NO: 2173183 - RNA, 15 nt, Streptococcus pneumoniae R6
uucccacccauauuu

SEQ ID NO: 2173184 - RNA, 19 nt, Streptococcus pneumoniae R6
uucccacccauauuuuucc

SEQ ID NO: 2173185 - RNA, 18 nt, Streptococcus pneumoniae R6
uucccacaauaaaacgca

SEQ ID NO: 2173186 - RNA, 17 nt, Streptococcus pneumoniae R6
uucccaucugucuuuau

SEQ ID NO: 2173187 - RNA, 17 nt, Streptococcus pneumoniae R6
uucccacuuguguuuau

SEQ ID NO: 2173188 - RNA, 17 nt, Streptococcus pneumoniae R6
uucccuuuuguauucca

SEQ ID NO: 2173189 - RNA, 15 nt, Streptococcus pneumoniae R6
uuccgaagaguucaa

SEQ ID NO: 2173190 - RNA, 20 nt, Streptococcus pneumoniae R6
uuccgaauaccugaaaccau

SEQ ID NO: 2173191 - RNA, 19 nt, Streptococcus pneumoniae R6
uuccgaauagcucaaaagc

SEQ ID NO: 2173192 - RNA, 18 nt, Streptococcus pneumoniae R6
uuccgauaaugcuuugaa

SEQ ID NO: 2173193 - RNA, 15 nt, Streptococcus pneumoniae R6
uucccauugcaaucc

SEQ ID NO: 2173194 - RNA, 13 nt, Streptococcus pneumoniae R6
uugccugaacgcu

SEQ ID NO: 2173195 - RNA, 21 nt, Streptococcus pneumoniae R6
uugccugaacgcuagcuacuu

SEQ ID NO: 2173196 - RNA, 20 nt, Streptococcus pneumoniae R6
uugcgcauguaaagaggagu

SEQ ID NO: 2173197 - RNA, 16 nt, Streptococcus pneumoniae R6
uugcucauagccauaa

SEQ ID NO: 2173198 - RNA, 17 nt, Streptococcus pneumoniae R6
uugcucauauagaccaa

SEQ ID NO: 2173199 - RNA, 16 nt, Streptococcus pneumoniae R6
uugcuaaaaaaaggga

SEQ ID NO: 2173200 - RNA, 16 nt, Streptococcus pneumoniae R6
uugcucaauaaccacu

SEQ ID NO: 2173201 - RNA, 23 nt, Streptococcus pneumoniae R6
uugcucggcuuuuuguuuucuau

SEQ ID NO: 2173202 - RNA, 12 nt, Streptococcus pneumoniae R6
uugcucugucac

SEQ ID NO: 2173203 - RNA, 13 nt, Streptococcus pneumoniae R6
uugcucuuaucug

SEQ ID NO: 2173204 - RNA, 18 nt, Streptococcus pneumoniae R6
uugcucuuaucuguccuc

SEQ ID NO: 2173205 - RNA, 21 nt, Streptococcus pneumoniae R6
uugcucuauacacauccagug

SEQ ID NO: 2173206 - RNA, 13 nt, Streptococcus pneumoniae R6
uugcauuuuaauu

SEQ ID NO: 2173207 - RNA, 17 nt, Streptococcus pneumoniae R6
uugcacggguuuaacua

SEQ ID NO: 2173208 - RNA, 18 nt, Streptococcus pneumoniae R6
uugcccucuaaauacaaa

SEQ ID NO: 2173209 - RNA, 14 nt, Streptococcus pneumoniae R6
uugcccuagcuguu

SEQ ID NO: 2173210 - RNA, 16 nt, Streptococcus pneumoniae R6
uugauugcaagcccuu

SEQ ID NO: 2173211 - RNA, 19 nt, Streptococcus pneumoniae R6
uugauuuugagacuaagga

SEQ ID NO: 2173212 - RNA, 16 nt, Streptococcus pneumoniae R6
uugauuuuucugaguc

SEQ ID NO: 2173213 - RNA, 16 nt, Streptococcus pneumoniae R6
uugauuuuuauugagu

SEQ ID NO: 2173214 - RNA, 22 nt, Streptococcus pneumoniae R6
uugauucaugacaucuuccaaa

SEQ ID NO: 2173215 - RNA, 14 nt, Streptococcus pneumoniae R6
uugauucagauuca

SEQ ID NO: 2173216 - RNA, 13 nt, Streptococcus pneumoniae R6
uugauucaaaguc

SEQ ID NO: 2173217 - RNA, 16 nt, Streptococcus pneumoniae R6
uugauucaaagucaua

SEQ ID NO: 2173218 - RNA, 18 nt, Streptococcus pneumoniae R6
uugauucaaagucauaaa

SEQ ID NO: 2173219 - RNA, 17 nt, Streptococcus pneumoniae R6
uugaugagauuauuggu

SEQ ID NO: 2173220 - RNA, 14 nt, Streptococcus pneumoniae R6
uugaugaggaaaga

SEQ ID NO: 2173221 - RNA, 16 nt, Streptococcus pneumoniae R6
uugaugaguaaguuuu

SEQ ID NO: 2173222 - RNA, 20 nt, Streptococcus pneumoniae R6
uugcaaagaguuuucugauu

SEQ ID NO: 2173223 - RNA, 13 nt, Streptococcus pneumoniae R6
uugcaagagaaau

SEQ ID NO: 2173224 - RNA, 16 nt, Streptococcus pneumoniae R6
uugcaagagaaaucau

SEQ ID NO: 2173225 - RNA, 12 nt, Streptococcus pneumoniae R6
uugcaagaagca

SEQ ID NO: 2173226 - RNA, 19 nt, Streptococcus pneumoniae R6
uugcaagaaaguagagucc

SEQ ID NO: 2173227 - RNA, 18 nt, Streptococcus pneumoniae R6
uugcaacuggagacuuuc

SEQ ID NO: 2173228 - RNA, 22 nt, Streptococcus pneumoniae R6
uugcaacuggagacuuucguuc

SEQ ID NO: 2173229 - RNA, 21 nt, Streptococcus pneumoniae R6
uugcaagcccuuauuuccauc

SEQ ID NO: 2173230 - RNA, 22 nt, Streptococcus pneumoniae R6
uugcaagcccuuauuuccaucu

SEQ ID NO: 2173231 - RNA, 12 nt, Streptococcus pneumoniae R6
uugcaaguuuua

SEQ ID NO: 2173232 - RNA, 20 nt, Streptococcus pneumoniae R6
uugcaaucucuguuaagaaa

SEQ ID NO: 2173233 - RNA, 17 nt, Streptococcus pneumoniae R6
uugcacaauauagccua

SEQ ID NO: 2173234 - RNA, 14 nt, Streptococcus pneumoniae R6
uugagcaaucccua

SEQ ID NO: 2173235 - RNA, 13 nt, Streptococcus pneumoniae R6
uugaguuucucuu

SEQ ID NO: 2173236 - RNA, 19 nt, Streptococcus pneumoniae R6
uugauaaauuucaaaguag

SEQ ID NO: 2173237 - RNA, 15 nt, Streptococcus pneumoniae R6
uugauaaccuuaauc

SEQ ID NO: 2173238 - RNA, 18 nt, Streptococcus pneumoniae R6
uugauaaccacagacuga

SEQ ID NO: 2173239 - RNA, 15 nt, Streptococcus pneumoniae R6
uugaguuuuuuauuu

SEQ ID NO: 2173240 - RNA, 23 nt, Streptococcus pneumoniae R6
uugagaagugggagaaaaguuuc

SEQ ID NO: 2173241 - RNA, 17 nt, Streptococcus pneumoniae R6
uugagaaacuagaagug

SEQ ID NO: 2173242 - RNA, 20 nt, Streptococcus pneumoniae R6
uugagacuggcgauuuuagg

SEQ ID NO: 2173243 - RNA, 22 nt, Streptococcus pneumoniae R6
uugagagaagcaagugacaaag

SEQ ID NO: 2173244 - RNA, 20 nt, Streptococcus pneumoniae R6
uugacuuucuuguuuucuua

SEQ ID NO: 2173245 - RNA, 15 nt, Streptococcus pneumoniae R6
uugacuuuucuaauc

SEQ ID NO: 2173246 - RNA, 10 nt, Streptococcus pneumoniae R6
uugacugagu

SEQ ID NO: 2173247 - RNA, 18 nt, Streptococcus pneumoniae R6
uugacuuaaugaauacca

SEQ ID NO: 2173248 - RNA, 22 nt, Streptococcus pneumoniae R6
uugacuuccaaaauuaaaaugu

SEQ ID NO: 2173249 - RNA, 13 nt, Streptococcus pneumoniae R6
uugaugaacugcu

SEQ ID NO: 2173250 - RNA, 23 nt, Streptococcus pneumoniae R6
uugaugaacugcuugagcugcug

SEQ ID NO: 2173251 - RNA, 11 nt, Streptococcus pneumoniae R6
uugauaugaug

SEQ ID NO: 2173252 - RNA, 14 nt, Streptococcus pneumoniae R6
uugauauuuccauc

SEQ ID NO: 2173253 - RNA, 15 nt, Streptococcus pneumoniae R6
uugauauuuccauca

SEQ ID NO: 2173254 - RNA, 17 nt, Streptococcus pneumoniae R6
uugauauuuauagaaaa

SEQ ID NO: 2173255 - RNA, 20 nt, Streptococcus pneumoniae R6
uugauauauaaaugaaaacc

SEQ ID NO: 2173256 - RNA, 17 nt, Streptococcus pneumoniae R6
uugaaauuuaucaacca

SEQ ID NO: 2173257 - RNA, 14 nt, Streptococcus pneumoniae R6
uugaaaugaaauaa

SEQ ID NO: 2173258 - RNA, 11 nt, Streptococcus pneumoniae R6
uugaaaugacc

SEQ ID NO: 2173259 - RNA, 13 nt, Streptococcus pneumoniae R6
uugaaaugaccug

SEQ ID NO: 2173260 - RNA, 16 nt, Streptococcus pneumoniae R6
uugaacaccugauuuu

SEQ ID NO: 2173261 - RNA, 17 nt, Streptococcus pneumoniae R6
uugaaacaaauaaauca

SEQ ID NO: 2173262 - RNA, 22 nt, Streptococcus pneumoniae R6
uugaaacaagaacaagacaaaa

SEQ ID NO: 2173263 - RNA, 12 nt, Streptococcus pneumoniae R6
uugaaacaauga

SEQ ID NO: 2173264 - RNA, 14 nt, Streptococcus pneumoniae R6
uugaaagauuauag

SEQ ID NO: 2173265 - RNA, 14 nt, Streptococcus pneumoniae R6
uugaaauaagauau

SEQ ID NO: 2173266 - RNA, 18 nt, Streptococcus pneumoniae R6
uugaaauagaauaugaac

SEQ ID NO: 2173267 - RNA, 22 nt, Streptococcus pneumoniae R6
uugaaaggaaaaugauuuuuua

SEQ ID NO: 2173268 - RNA, 13 nt, Streptococcus pneumoniae R6
uugaaaucaaggc

SEQ ID NO: 2173269 - RNA, 15 nt, Streptococcus pneumoniae R6
uugaaaucagaaaaa

SEQ ID NO: 2173270 - RNA, 16 nt, Streptococcus pneumoniae R6
uugaaaucagaaaaaa

SEQ ID NO: 2173271 - RNA, 17 nt, Streptococcus pneumoniae R6
uugaaaucagaaaaaac

SEQ ID NO: 2173272 - RNA, 13 nt, Streptococcus pneumoniae R6
uucuuuuucuccu

SEQ ID NO: 2173273 - RNA, 20 nt, Streptococcus pneumoniae R6
uucuuuuuugaaguuuucaa

SEQ ID NO: 2173274 - RNA, 13 nt, Streptococcus pneumoniae R6
uucuuuuuuacuu

SEQ ID NO: 2173275 - RNA, 14 nt, Streptococcus pneumoniae R6
uucuuuuuuauccu

SEQ ID NO: 2173276 - RNA, 19 nt, Streptococcus pneumoniae R6
uucuuuuuuauccucaaaa

SEQ ID NO: 2173277 - RNA, 20 nt, Streptococcus pneumoniae R6
uucuuuuuuauccucaaaau

SEQ ID NO: 2173278 - RNA, 19 nt, Streptococcus pneumoniae R6
uugaaaaacuagaauagaa

SEQ ID NO: 2173279 - RNA, 19 nt, Streptococcus pneumoniae R6
uucuuuuuuugauauuuau

SEQ ID NO: 2173280 - RNA, 15 nt, Streptococcus pneumoniae R6
uugaaaaaccaauag

SEQ ID NO: 2173281 - RNA, 14 nt, Streptococcus pneumoniae R6
uugaaaauuccauu

SEQ ID NO: 2173282 - RNA, 14 nt, Streptococcus pneumoniae R6
uugaaaacaauauu

SEQ ID NO: 2173283 - RNA, 22 nt, Streptococcus pneumoniae R6
uugaaaacaauauuuuugagcc

SEQ ID NO: 2173284 - RNA, 18 nt, Streptococcus pneumoniae R6
uugaaaacugaugaaguc

SEQ ID NO: 2173285 - RNA, 16 nt, Streptococcus pneumoniae R6
uucuuuuguaaagggu

SEQ ID NO: 2173286 - RNA, 12 nt, Streptococcus pneumoniae R6
uucuuuuuacuu

SEQ ID NO: 2173287 - RNA, 17 nt, Streptococcus pneumoniae R6
uucuuuuuguccuucuu

SEQ ID NO: 2173288 - RNA, 16 nt, Streptococcus pneumoniae R6
uucuuuucauaaagag

SEQ ID NO: 2173289 - RNA, 17 nt, Streptococcus pneumoniae R6
uucuuuucauaaagaga

SEQ ID NO: 2173290 - RNA, 16 nt, Streptococcus pneumoniae R6
uucuuuuacucuaguu

SEQ ID NO: 2173291 - RNA, 20 nt, Streptococcus pneumoniae R6
uucuuucucaaacauuguga

SEQ ID NO: 2173292 - RNA, 19 nt, Streptococcus pneumoniae R6
uucuuuccgucaagagaug

SEQ ID NO: 2173293 - RNA, 18 nt, Streptococcus pneumoniae R6
uucuuucaucccuuccuu

SEQ ID NO: 2173294 - RNA, 15 nt, Streptococcus pneumoniae R6
uucuuuguuaaauga

SEQ ID NO: 2173295 - RNA, 18 nt, Streptococcus pneumoniae R6
uucuuuauauaaaaagac

SEQ ID NO: 2173296 - RNA, 19 nt, Streptococcus pneumoniae R6
uucuuuagaaagguuuuaa

SEQ ID NO: 2173297 - RNA, 14 nt, Streptococcus pneumoniae R6
uucuuuacuucuga

SEQ ID NO: 2173298 - RNA, 18 nt, Streptococcus pneumoniae R6
uucuuuaaucuugacuau

SEQ ID NO: 2173299 - RNA, 24 nt, Streptococcus pneumoniae R6
uucuuucaacuucgucacauuccc

SEQ ID NO: 2173300 - RNA, 17 nt, Streptococcus pneumoniae R6
uucuuucaagcgcucca

SEQ ID NO: 2173301 - RNA, 13 nt, Streptococcus pneumoniae R6
uucuuuauuagca

SEQ ID NO: 2173302 - RNA, 19 nt, Streptococcus pneumoniae R6
uucugcaucguucaaugga

SEQ ID NO: 2173303 - RNA, 15 nt, Streptococcus pneumoniae R6
uucuuuaaaaaauuu

SEQ ID NO: 2173304 - RNA, 17 nt, Streptococcus pneumoniae R6
uucuugagaacuuucuu

SEQ ID NO: 2173305 - RNA, 20 nt, Streptococcus pneumoniae R6
uucuugacagcuugcccuuu

SEQ ID NO: 2173306 - RNA, 22 nt, Streptococcus pneumoniae R6
uucuugacagcuugcccuuugu

SEQ ID NO: 2173307 - RNA, 16 nt, Streptococcus pneumoniae R6
uucuugaguaguucca

SEQ ID NO: 2173308 - RNA, 22 nt, Streptococcus pneumoniae R6
uucuugauacugaucaaaaaau

SEQ ID NO: 2173309 - RNA, 23 nt, Streptococcus pneumoniae R6
uucuugauacugaucaaaaaauu

SEQ ID NO: 2173310 - RNA, 14 nt, Streptococcus pneumoniae R6
uugaacuugaaucc

SEQ ID NO: 2173311 - RNA, 12 nt, Streptococcus pneumoniae R6
uugaacuuuaga

SEQ ID NO: 2173312 - RNA, 11 nt, Streptococcus pneumoniae R6
uugaagaaaag

SEQ ID NO: 2173313 - RNA, 21 nt, Streptococcus pneumoniae R6
uugaaggggcaacucuucaag

SEQ ID NO: 2173314 - RNA, 17 nt, Streptococcus pneumoniae R6
uugaagucagcuaagcu

SEQ ID NO: 2173315 - RNA, 14 nt, Streptococcus pneumoniae R6
uugaagagauuuuu

SEQ ID NO: 2173316 - RNA, 13 nt, Streptococcus pneumoniae R6
uugaagcaaauca

SEQ ID NO: 2173317 - RNA, 22 nt, Streptococcus pneumoniae R6
uugaaguucauuuucuuuacuu

SEQ ID NO: 2173318 - RNA, 23 nt, Streptococcus pneumoniae R6
uugaaguugacgaaguuguucuu

SEQ ID NO: 2173319 - RNA, 19 nt, Streptococcus pneumoniae R6
uugaaguugauucaugaca

SEQ ID NO: 2173320 - RNA, 17 nt, Streptococcus pneumoniae R6
uugaaguuggaauaguc

SEQ ID NO: 2173321 - RNA, 15 nt, Streptococcus pneumoniae R6
uugaauaaccucuau

SEQ ID NO: 2173322 - RNA, 21 nt, Streptococcus pneumoniae R6
uugaauauggauaauugaaua

SEQ ID NO: 2173323 - RNA, 21 nt, Streptococcus pneumoniae R6
uugaauagauacaaaaccaaa

SEQ ID NO: 2173324 - RNA, 19 nt, Streptococcus pneumoniae R6
uugaauagcuuuugugaua

SEQ ID NO: 2173325 - RNA, 14 nt, Streptococcus pneumoniae R6
uugaaucaauucuu

SEQ ID NO: 2173326 - RNA, 18 nt, Streptococcus pneumoniae R6
uugaaucaccuaaaguag

SEQ ID NO: 2173327 - RNA, 17 nt, Streptococcus pneumoniae R6
uugaaucuggcuuucaa

SEQ ID NO: 2173328 - RNA, 17 nt, Streptococcus pneumoniae R6
uugaaugccuguuccaa

SEQ ID NO: 2173329 - RNA, 15 nt, Streptococcus pneumoniae R6
uugacguugcaaguu

SEQ ID NO: 2173330 - RNA, 22 nt, Streptococcus pneumoniae R6
uugacuauauuucuauacuuuu

SEQ ID NO: 2173331 - RNA, 19 nt, Streptococcus pneumoniae R6
uugacuauauuucuuaauu

SEQ ID NO: 2173332 - RNA, 12 nt, Streptococcus pneumoniae R6
uugacucugcug

SEQ ID NO: 2173333 - RNA, 20 nt, Streptococcus pneumoniae R6
uugacucguuacuauaagac

SEQ ID NO: 2173334 - RNA, 23 nt, Streptococcus pneumoniae R6
uugacucguuacuauaagacucc

SEQ ID NO: 2173335 - RNA, 19 nt, Streptococcus pneumoniae R6
uugacuccccauuuaccaa

SEQ ID NO: 2173336 - RNA, 22 nt, Streptococcus pneumoniae R6
uugacuccccauuuaccaagcu

SEQ ID NO: 2173337 - RNA, 23 nt, Streptococcus pneumoniae R6
uugaccuguugaugcaucaagug

SEQ ID NO: 2173338 - RNA, 13 nt, Streptococcus pneumoniae R6
uugaccuguuuuc

SEQ ID NO: 2173339 - RNA, 13 nt, Streptococcus pneumoniae R6
uugaccucuggau

SEQ ID NO: 2173340 - RNA, 13 nt, Streptococcus pneumoniae R6
uugacccugacuc

SEQ ID NO: 2173341 - RNA, 21 nt, Streptococcus pneumoniae R6
uugacccugacucuccuuagu

SEQ ID NO: 2173342 - RNA, 19 nt, Streptococcus pneumoniae R6
uugacgauuuucucuuugu

SEQ ID NO: 2173343 - RNA, 17 nt, Streptococcus pneumoniae R6
uugacgaagaaaccaag

SEQ ID NO: 2173344 - RNA, 20 nt, Streptococcus pneumoniae R6
uugacgaagaaaccaagcaa

SEQ ID NO: 2173345 - RNA, 17 nt, Streptococcus pneumoniae R6
uugacgcgguuugaaga

SEQ ID NO: 2173346 - RNA, 16 nt, Streptococcus pneumoniae R6
uugacaagguuuccug

SEQ ID NO: 2173347 - RNA, 23 nt, Streptococcus pneumoniae R6
uugacaaagagccaaaaaagaaa

SEQ ID NO: 2173348 - RNA, 22 nt, Streptococcus pneumoniae R6
uugacaaagagccauaaaaaua

SEQ ID NO: 2173349 - RNA, 21 nt, Streptococcus pneumoniae R6
uugacaaagagccccuuucuc

SEQ ID NO: 2173350 - RNA, 20 nt, Streptococcus pneumoniae R6
uugacaaagagccuaauucc

SEQ ID NO: 2173351 - RNA, 18 nt, Streptococcus pneumoniae R6
uugacauuuaagccuuuu

SEQ ID NO: 2173352 - RNA, 18 nt, Streptococcus pneumoniae R6
uugaccaaagacugggug

SEQ ID NO: 2173353 - RNA, 15 nt, Streptococcus pneumoniae R6
uugaccaaagcauca

SEQ ID NO: 2173354 - RNA, 15 nt, Streptococcus pneumoniae R6
uugacaucugugauu

SEQ ID NO: 2173355 - RNA, 18 nt, Streptococcus pneumoniae R6
uugacaccacuuuugguc

SEQ ID NO: 2173356 - RNA, 16 nt, Streptococcus pneumoniae R6
uuuaccccaaauuccu

SEQ ID NO: 2173357 - RNA, 19 nt, Streptococcus pneumoniae R6
uuuaauuuuggaagucaaa

SEQ ID NO: 2173358 - RNA, 23 nt, Streptococcus pneumoniae R6
uuuacaauguugucaauuuccau

SEQ ID NO: 2173359 - RNA, 20 nt, Streptococcus pneumoniae R6
uuuaccaaaaaugugaacau

SEQ ID NO: 2173360 - RNA, 15 nt, Streptococcus pneumoniae R6
uuuaccaaaaccuuc

SEQ ID NO: 2173361 - RNA, 15 nt, Streptococcus pneumoniae R6
uuuaauucuuuuuca

SEQ ID NO: 2173362 - RNA, 18 nt, Streptococcus pneumoniae R6
uuuaauuauuuucaaaau

SEQ ID NO: 2173363 - RNA, 15 nt, Streptococcus pneumoniae R6
uuuaauuagaaaaaa

SEQ ID NO: 2173364 - RNA, 18 nt, Streptococcus pneumoniae R6
uuuaacuacuugauaaaa

SEQ ID NO: 2173365 - RNA, 22 nt, Streptococcus pneumoniae R6
uuuaacuacuugauaaaaguua

SEQ ID NO: 2173366 - RNA, 15 nt, Streptococcus pneumoniae R6
uuuaacgccucccaa

SEQ ID NO: 2173367 - RNA, 14 nt, Streptococcus pneumoniae R6
uuuaaccugaugaa

SEQ ID NO: 2173368 - RNA, 20 nt, Streptococcus pneumoniae R6
uuuaggagaaaaagaaguaa

SEQ ID NO: 2173369 - RNA, 17 nt, Streptococcus pneumoniae R6
uuuagcuugcaaugagc

SEQ ID NO: 2173370 - RNA, 16 nt, Streptococcus pneumoniae R6
uuuagcucuugcaaua

SEQ ID NO: 2173371 - RNA, 14 nt, Streptococcus pneumoniae R6
uuuacucucauucu

SEQ ID NO: 2173372 - RNA, 17 nt, Streptococcus pneumoniae R6
uuuaguuuuaccuuaau

SEQ ID NO: 2173373 - RNA, 17 nt, Streptococcus pneumoniae R6
uuuaguuuuaucuuaau

SEQ ID NO: 2173374 - RNA, 16 nt, Streptococcus pneumoniae R6
uuuaguucucaggaau

SEQ ID NO: 2173375 - RNA, 16 nt, Streptococcus pneumoniae R6
uuuaguucuguacugc

SEQ ID NO: 2173376 - RNA, 13 nt, Streptococcus pneumoniae R6
uuuauaaacuuua

SEQ ID NO: 2173377 - RNA, 17 nt, Streptococcus pneumoniae R6
uuuaguccacgguaaau

SEQ ID NO: 2173378 - RNA, 23 nt, Streptococcus pneumoniae R6
uuuaguaccagcucguucuaugg

SEQ ID NO: 2173379 - RNA, 17 nt, Streptococcus pneumoniae R6
uuuaggcaauaaaauau

SEQ ID NO: 2173380 - RNA, 19 nt, Streptococcus pneumoniae R6
uuuaguauaguaaacugaa

SEQ ID NO: 2173381 - RNA, 13 nt, Streptococcus pneumoniae R6
uuuaguaucaagc

SEQ ID NO: 2173382 - RNA, 13 nt, Streptococcus pneumoniae R6
uuuaguaaacaaa

SEQ ID NO: 2173383 - RNA, 19 nt, Streptococcus pneumoniae R6
uuguuguaagcuagcaaca

SEQ ID NO: 2173384 - RNA, 15 nt, Streptococcus pneumoniae R6
uuguuguaguaauca

SEQ ID NO: 2173385 - RNA, 21 nt, Streptococcus pneumoniae R6
uuguucaaaauuaagauagcc

SEQ ID NO: 2173386 - RNA, 19 nt, Streptococcus pneumoniae R6
uuguuauuuaggacaucau

SEQ ID NO: 2173387 - RNA, 16 nt, Streptococcus pneumoniae R6
uuguuagauuuauaau

SEQ ID NO: 2173388 - RNA, 23 nt, Streptococcus pneumoniae R6
uuguuagccauacguuucaugga

SEQ ID NO: 2173389 - RNA, 19 nt, Streptococcus pneumoniae R6
uugcugcguuaaauccuau

SEQ ID NO: 2173390 - RNA, 19 nt, Streptococcus pneumoniae R6
uuguuuaagagcacaaaau

SEQ ID NO: 2173391 - RNA, 22 nt, Streptococcus pneumoniae R6
uuguuuaagguggcgauuuuuu

SEQ ID NO: 2173392 - RNA, 18 nt, Streptococcus pneumoniae R6
uuguuuaauacucaauga

SEQ ID NO: 2173393 - RNA, 22 nt, Streptococcus pneumoniae R6
uuguuuaauacucaaugaaaau

SEQ ID NO: 2173394 - RNA, 16 nt, Streptococcus pneumoniae R6
uuguuuauaaaauaac

SEQ ID NO: 2173395 - RNA, 18 nt, Streptococcus pneumoniae R6
uuuaaaaaaucuuuuuca

SEQ ID NO: 2173396 - RNA, 22 nt, Streptococcus pneumoniae R6
uuuaaaaaagugguaucauaua

SEQ ID NO: 2173397 - RNA, 15 nt, Streptococcus pneumoniae R6
uuguuuuuaaaggaa

SEQ ID NO: 2173398 - RNA, 16 nt, Streptococcus pneumoniae R6
uuguuuugucgcuuuu

SEQ ID NO: 2173399 - RNA, 14 nt, Streptococcus pneumoniae R6
uuguuuuuuccuau

SEQ ID NO: 2173400 - RNA, 18 nt, Streptococcus pneumoniae R6
uuuaaauguuuucucaua

SEQ ID NO: 2173401 - RNA, 17 nt, Streptococcus pneumoniae R6
uuuaaauacuuuuuccu

SEQ ID NO: 2173402 - RNA, 18 nt, Streptococcus pneumoniae R6
uuuaaaucgcuucuguaa

SEQ ID NO: 2173403 - RNA, 22 nt, Streptococcus pneumoniae R6
uuuaacaaucuaucuuuuaauu

SEQ ID NO: 2173404 - RNA, 23 nt, Streptococcus pneumoniae R6
uuuaaauuuuucugcaaaaaaua

SEQ ID NO: 2173405 - RNA, 23 nt, Streptococcus pneumoniae R6
uuuaaaggaauuuuauuuucuga

SEQ ID NO: 2173406 - RNA, 16 nt, Streptococcus pneumoniae R6
uuuaaagauguccuuu

SEQ ID NO: 2173407 - RNA, 13 nt, Streptococcus pneumoniae R6
uuuaaacugauuu

SEQ ID NO: 2173408 - RNA, 23 nt, Streptococcus pneumoniae R6
uuuaaagacagucugaaaaauag

SEQ ID NO: 2173409 - RNA, 23 nt, Streptococcus pneumoniae R6
uuuaaagacgauguugacaugag

SEQ ID NO: 2173410 - RNA, 20 nt, Streptococcus pneumoniae R6
uuuaaagacuuuuuucuaua

SEQ ID NO: 2173411 - RNA, 22 nt, Streptococcus pneumoniae R6
uuuaaagaaauagaaaacaaaa

SEQ ID NO: 2173412 - RNA, 18 nt, Streptococcus pneumoniae R6
uuuaaacguuuuuacuuu

SEQ ID NO: 2173413 - RNA, 12 nt, Streptococcus pneumoniae R6
uuuaaaauccuc

SEQ ID NO: 2173414 - RNA, 13 nt, Streptococcus pneumoniae R6
uuuaaaauccucu

SEQ ID NO: 2173415 - RNA, 15 nt, Streptococcus pneumoniae R6
uuuaaaauccauaau

SEQ ID NO: 2173416 - RNA, 13 nt, Streptococcus pneumoniae R6
uuuaaaauaagag

SEQ ID NO: 2173417 - RNA, 23 nt, Streptococcus pneumoniae R6
uuuaaaauacgcaaaaucauaaa

SEQ ID NO: 2173418 - RNA, 23 nt, Streptococcus pneumoniae R6
uuuaaaaucaaaaagggaauuua

SEQ ID NO: 2173419 - RNA, 20 nt, Streptococcus pneumoniae R6
uuuaaaccaauuuuaagaau

SEQ ID NO: 2173420 - RNA, 18 nt, Streptococcus pneumoniae R6
uuuaaaccgcgauuuuuu

SEQ ID NO: 2173421 - RNA, 13 nt, Streptococcus pneumoniae R6
uuucacaaauucu

SEQ ID NO: 2173422 - RNA, 12 nt, Streptococcus pneumoniae R6
uuucaauuguag

SEQ ID NO: 2173423 - RNA, 14 nt, Streptococcus pneumoniae R6
uuucaauuuacuau

SEQ ID NO: 2173424 - RNA, 16 nt, Streptococcus pneumoniae R6
uuucaauuuuaaauuu

SEQ ID NO: 2173425 - RNA, 17 nt, Streptococcus pneumoniae R6
uuucacaauuucauuuc

SEQ ID NO: 2173426 - RNA, 12 nt, Streptococcus pneumoniae R6
uuucacauagcu

SEQ ID NO: 2173427 - RNA, 16 nt, Streptococcus pneumoniae R6
uuucacauuuucaaaa

SEQ ID NO: 2173428 - RNA, 18 nt, Streptococcus pneumoniae R6
uuucacguuguucaagcc

SEQ ID NO: 2173429 - RNA, 21 nt, Streptococcus pneumoniae R6
uuucacguuguucaagccuua

SEQ ID NO: 2173430 - RNA, 16 nt, Streptococcus pneumoniae R6
uuucacuagaaaauga

SEQ ID NO: 2173431 - RNA, 17 nt, Streptococcus pneumoniae R6
uuucacuagaaaaugag

SEQ ID NO: 2173432 - RNA, 22 nt, Streptococcus pneumoniae R6
uuucacuagaaaaugaggaaaa

SEQ ID NO: 2173433 - RNA, 22 nt, Streptococcus pneumoniae R6
uuucacuauauugcaagagaaa

SEQ ID NO: 2173434 - RNA, 22 nt, Streptococcus pneumoniae R6
uuucacgcgcauucguuucuuu

SEQ ID NO: 2173435 - RNA, 23 nt, Streptococcus pneumoniae R6
uuucaagaaugaaaguuuauaaa

SEQ ID NO: 2173436 - RNA, 18 nt, Streptococcus pneumoniae R6
uuucaagaauuaagugac

SEQ ID NO: 2173437 - RNA, 14 nt, Streptococcus pneumoniae R6
uuucaagugacaua

SEQ ID NO: 2173438 - RNA, 20 nt, Streptococcus pneumoniae R6
uuucaagcgaacaucuccaa

SEQ ID NO: 2173439 - RNA, 13 nt, Streptococcus pneumoniae R6
uuucaauucuuca

SEQ ID NO: 2173440 - RNA, 12 nt, Streptococcus pneumoniae R6
uuucaauugacu

SEQ ID NO: 2173441 - RNA, 13 nt, Streptococcus pneumoniae R6
uuucaauguacua

SEQ ID NO: 2173442 - RNA, 19 nt, Streptococcus pneumoniae R6
uuucaauauguuugguugu

SEQ ID NO: 2173443 - RNA, 17 nt, Streptococcus pneumoniae R6
uuucaacugcuuuuuca

SEQ ID NO: 2173444 - RNA, 21 nt, Streptococcus pneumoniae R6
uuucaacucagcauuuucuuu

SEQ ID NO: 2173445 - RNA, 13 nt, Streptococcus pneumoniae R6
uuucaacuccuua

SEQ ID NO: 2173446 - RNA, 17 nt, Streptococcus pneumoniae R6
uuucaacuccuuacuuu

SEQ ID NO: 2173447 - RNA, 15 nt, Streptococcus pneumoniae R6
uuucaacugaugaga

SEQ ID NO: 2173448 - RNA, 14 nt, Streptococcus pneumoniae R6
uuucaaaugaaaua

SEQ ID NO: 2173449 - RNA, 21 nt, Streptococcus pneumoniae R6
uuucaaaugaaauauuuuuua

SEQ ID NO: 2173450 - RNA, 18 nt, Streptococcus pneumoniae R6
uuucaaauguauuugaaa

SEQ ID NO: 2173451 - RNA, 16 nt, Streptococcus pneumoniae R6
uuucaaauuuucuuua

SEQ ID NO: 2173452 - RNA, 19 nt, Streptococcus pneumoniae R6
uuucaaauucuuuagaaaa

SEQ ID NO: 2173453 - RNA, 22 nt, Streptococcus pneumoniae R6
uuucaaauucuuuagaaaacua

SEQ ID NO: 2173454 - RNA, 23 nt, Streptococcus pneumoniae R6
uuucaaauucuuuagaaaacuag

SEQ ID NO: 2173455 - RNA, 19 nt, Streptococcus pneumoniae R6
uuucaaaaucuucuggcac

SEQ ID NO: 2173456 - RNA, 21 nt, Streptococcus pneumoniae R6
uuuauuugcuuaauccucaau

SEQ ID NO: 2173457 - RNA, 14 nt, Streptococcus pneumoniae R6
uuuauuuucaagcg

SEQ ID NO: 2173458 - RNA, 14 nt, Streptococcus pneumoniae R6
uuucaaagccuucc

SEQ ID NO: 2173459 - RNA, 23 nt, Streptococcus pneumoniae R6
uuucaaagcgggauuuaaaauaa

SEQ ID NO: 2173460 - RNA, 18 nt, Streptococcus pneumoniae R6
uuucaaaggcuuuuucuu

SEQ ID NO: 2173461 - RNA, 22 nt, Streptococcus pneumoniae R6
uuucaaagcuacuuuuuuacca

SEQ ID NO: 2173462 - RNA, 18 nt, Streptococcus pneumoniae R6
uuuauuauuaauauauaa

SEQ ID NO: 2173463 - RNA, 22 nt, Streptococcus pneumoniae R6
uuuauucagacuauauaugcac

SEQ ID NO: 2173464 - RNA, 16 nt, Streptococcus pneumoniae R6
uuuauaguaauuccac

SEQ ID NO: 2173465 - RNA, 19 nt, Streptococcus pneumoniae R6
uuuauaguaaaaugaaaua

SEQ ID NO: 2173466 - RNA, 16 nt, Streptococcus pneumoniae R6
uuuauagaaaaauuuu

SEQ ID NO: 2173467 - RNA, 15 nt, Streptococcus pneumoniae R6
uuuauagaauauauu

SEQ ID NO: 2173468 - RNA, 20 nt, Streptococcus pneumoniae R6
uuuauagaauauauuucuca

SEQ ID NO: 2173469 - RNA, 14 nt, Streptococcus pneumoniae R6
uuuauauaaaauaa

SEQ ID NO: 2173470 - RNA, 20 nt, Streptococcus pneumoniae R6
uuuauagugguuauggaaaa

SEQ ID NO: 2173471 - RNA, 14 nt, Streptococcus pneumoniae R6
uuuauagaaauuaa

SEQ ID NO: 2173472 - RNA, 22 nt, Streptococcus pneumoniae R6
uuuauacucaucugcuuucaaa

SEQ ID NO: 2173473 - RNA, 22 nt, Streptococcus pneumoniae R6
uuuauacucaucuguuuucaaa

SEQ ID NO: 2173474 - RNA, 22 nt, Streptococcus pneumoniae R6
uuuauacucuuagaaaaucucu

SEQ ID NO: 2173475 - RNA, 15 nt, Streptococcus pneumoniae R6
uuuauaaauuuucca

SEQ ID NO: 2173476 - RNA, 15 nt, Streptococcus pneumoniae R6
uuucauccacaaccu

SEQ ID NO: 2173477 - RNA, 19 nt, Streptococcus pneumoniae R6
uuucauccacaaccucaaa

SEQ ID NO: 2173478 - RNA, 23 nt, Streptococcus pneumoniae R6
uuucauccacaaccucaaaacag

SEQ ID NO: 2173479 - RNA, 18 nt, Streptococcus pneumoniae R6
uuucauauuuucagauaa

SEQ ID NO: 2173480 - RNA, 17 nt, Streptococcus pneumoniae R6
uuucaucuacaaccuca

SEQ ID NO: 2173481 - RNA, 19 nt, Streptococcus pneumoniae R6
uuucaucuacaaccucaaa

SEQ ID NO: 2173482 - RNA, 17 nt, Streptococcus pneumoniae R6
uuucauugaguauuauu

SEQ ID NO: 2173483 - RNA, 21 nt, Streptococcus pneumoniae R6
uuucauugaguauuauuucau

SEQ ID NO: 2173484 - RNA, 22 nt, Streptococcus pneumoniae R6
uuucauuccaucauaaaaauaa

SEQ ID NO: 2173485 - RNA, 18 nt, Streptococcus pneumoniae R6
uuucauuacagaacauuu

SEQ ID NO: 2173486 - RNA, 23 nt, Streptococcus pneumoniae R6
uuucauuacagaacauuuuaauu

SEQ ID NO: 2173487 - RNA, 19 nt, Streptococcus pneumoniae R6
uuucaugacagauucauca

SEQ ID NO: 2173488 - RNA, 23 nt, Streptococcus pneumoniae R6
uuucaucuuuuucggcuuuagca

SEQ ID NO: 2173489 - RNA, 20 nt, Streptococcus pneumoniae R6
uuuccagccuucauuuuaca

SEQ ID NO: 2173490 - RNA, 23 nt, Streptococcus pneumoniae R6
uuuccacaucaaaaacagccgaa

SEQ ID NO: 2173491 - RNA, 15 nt, Streptococcus pneumoniae R6
uuuccaccuucuuug

SEQ ID NO: 2173492 - RNA, 12 nt, Streptococcus pneumoniae R6
uuuccacuaaag

SEQ ID NO: 2173493 - RNA, 22 nt, Streptococcus pneumoniae R6
uuuccaaggaaaguucuucccc

SEQ ID NO: 2173494 - RNA, 20 nt, Streptococcus pneumoniae R6
uuucauuuucuacuccuuuu

SEQ ID NO: 2173495 - RNA, 18 nt, Streptococcus pneumoniae R6
uuucauuuggcuauaaaa

SEQ ID NO: 2173496 - RNA, 17 nt, Streptococcus pneumoniae R6
uuucauuucgacugaaa

SEQ ID NO: 2173497 - RNA, 15 nt, Streptococcus pneumoniae R6
uuuccaagaucuuuu

SEQ ID NO: 2173498 - RNA, 18 nt, Streptococcus pneumoniae R6
uuuccaagaucuuuuuau

SEQ ID NO: 2173499 - RNA, 16 nt, Streptococcus pneumoniae R6
uuuccaacgauuuuau

SEQ ID NO: 2173500 - RNA, 20 nt, Streptococcus pneumoniae R6
uuucagcuucuauuucuugu

SEQ ID NO: 2173501 - RNA, 15 nt, Streptococcus pneumoniae R6
uuucaguagauaaua

SEQ ID NO: 2173502 - RNA, 16 nt, Streptococcus pneumoniae R6
uuucagguguuucuau

SEQ ID NO: 2173503 - RNA, 13 nt, Streptococcus pneumoniae R6
uuucauaauuucu

SEQ ID NO: 2173504 - RNA, 23 nt, Streptococcus pneumoniae R6
uuucauaauuuuuuucauagaaa

SEQ ID NO: 2173505 - RNA, 19 nt, Streptococcus pneumoniae R6
uuucaguuuacuauacuag

SEQ ID NO: 2173506 - RNA, 12 nt, Streptococcus pneumoniae R6
uuucaguuucau

SEQ ID NO: 2173507 - RNA, 18 nt, Streptococcus pneumoniae R6
uuucauaaaguuuucuga

SEQ ID NO: 2173508 - RNA, 22 nt, Streptococcus pneumoniae R6
uuucacuuuauuuuuucuguaa

SEQ ID NO: 2173509 - RNA, 21 nt, Streptococcus pneumoniae R6
uuucacuuguauccuccucua

SEQ ID NO: 2173510 - RNA, 18 nt, Streptococcus pneumoniae R6
uuucacuccacuauaaaa

SEQ ID NO: 2173511 - RNA, 21 nt, Streptococcus pneumoniae R6
uuucagaacuuuuaacuucag

SEQ ID NO: 2173512 - RNA, 18 nt, Streptococcus pneumoniae R6
uuucagaagaaaaugaag

SEQ ID NO: 2173513 - RNA, 19 nt, Streptococcus pneumoniae R6
uuucagaaucccaaagaag

SEQ ID NO: 2173514 - RNA, 21 nt, Streptococcus pneumoniae R6
uuucagaaagaagggcagcca

SEQ ID NO: 2173515 - RNA, 17 nt, Streptococcus pneumoniae R6
uuucagagacagcuugu

SEQ ID NO: 2173516 - RNA, 14 nt, Streptococcus pneumoniae R6
uuucagagggcuuu

SEQ ID NO: 2173517 - RNA, 20 nt, Streptococcus pneumoniae R6
uuucagagggcuuuuucauu

SEQ ID NO: 2173518 - RNA, 12 nt, Streptococcus pneumoniae R6
uuucagauuuua

SEQ ID NO: 2173519 - RNA, 13 nt, Streptococcus pneumoniae R6
uuucagauuuuua

SEQ ID NO: 2173520 - RNA, 18 nt, Streptococcus pneumoniae R6
uuucagccaagugaguaa

SEQ ID NO: 2173521 - RNA, 18 nt, Streptococcus pneumoniae R6
uuucagccacuauuuuau

SEQ ID NO: 2173522 - RNA, 23 nt, Streptococcus pneumoniae R6
uuugccagaaaaagucaauaaua

SEQ ID NO: 2173523 - RNA, 15 nt, Streptococcus pneumoniae R6
uuugccuaaaauuca

SEQ ID NO: 2173524 - RNA, 16 nt, Streptococcus pneumoniae R6
uuugccucaauaucuu

SEQ ID NO: 2173525 - RNA, 20 nt, Streptococcus pneumoniae R6
uuugcucaccaucuucguca

SEQ ID NO: 2173526 - RNA, 14 nt, Streptococcus pneumoniae R6
uuugcucuuugauu

SEQ ID NO: 2173527 - RNA, 19 nt, Streptococcus pneumoniae R6
uuugcucuuugauuuuuau

SEQ ID NO: 2173528 - RNA, 22 nt, Streptococcus pneumoniae R6
uuugcgaccguggaguacuucu

SEQ ID NO: 2173529 - RNA, 21 nt, Streptococcus pneumoniae R6
uuugcaaucauuucaaagccu

SEQ ID NO: 2173530 - RNA, 21 nt, Streptococcus pneumoniae R6
uuugcaagagcgguuaauuua

SEQ ID NO: 2173531 - RNA, 21 nt, Streptococcus pneumoniae R6
uuugcagaaggcuuucuaauu

SEQ ID NO: 2173532 - RNA, 19 nt, Streptococcus pneumoniae R6
uuugcacuuugauuuuuau

SEQ ID NO: 2173533 - RNA, 23 nt, Streptococcus pneumoniae R6
uuugcaaagaugaugauaacgaa

SEQ ID NO: 2173534 - RNA, 13 nt, Streptococcus pneumoniae R6
uuugauuuuccua

SEQ ID NO: 2173535 - RNA, 18 nt, Streptococcus pneumoniae R6
uuugauuuuguaaaaaua

SEQ ID NO: 2173536 - RNA, 14 nt, Streptococcus pneumoniae R6
uuugauuuuuauug

SEQ ID NO: 2173537 - RNA, 19 nt, Streptococcus pneumoniae R6
uuugauuuuuauugaguau

SEQ ID NO: 2173538 - RNA, 14 nt, Streptococcus pneumoniae R6
uuugauuaguccau

SEQ ID NO: 2173539 - RNA, 17 nt, Streptococcus pneumoniae R6
uuugauuauuuuugaaa

SEQ ID NO: 2173540 - RNA, 16 nt, Streptococcus pneumoniae R6
uuugauuuuaaagacu

SEQ ID NO: 2173541 - RNA, 13 nt, Streptococcus pneumoniae R6
uuugauuuuaaau

SEQ ID NO: 2173542 - RNA, 23 nt, Streptococcus pneumoniae R6
uuugauuucuggaugauucuuuu

SEQ ID NO: 2173543 - RNA, 18 nt, Streptococcus pneumoniae R6
uuugaugacauucaggcu

SEQ ID NO: 2173544 - RNA, 17 nt, Streptococcus pneumoniae R6
uuugaugaggaaagaau

SEQ ID NO: 2173545 - RNA, 14 nt, Streptococcus pneumoniae R6
uuugauuagcaaaa

SEQ ID NO: 2173546 - RNA, 18 nt, Streptococcus pneumoniae R6
uuugauuagcaaaacgua

SEQ ID NO: 2173547 - RNA, 17 nt, Streptococcus pneumoniae R6
uuugauguggaaaacua

SEQ ID NO: 2173548 - RNA, 21 nt, Streptococcus pneumoniae R6
uuugauggguucuuugccagu

SEQ ID NO: 2173549 - RNA, 17 nt, Streptococcus pneumoniae R6
uuugauaucuaucaaac

SEQ ID NO: 2173550 - RNA, 13 nt, Streptococcus pneumoniae R6
uuugauagcaucu

SEQ ID NO: 2173551 - RNA, 18 nt, Streptococcus pneumoniae R6
uuugauacuguuaauaaa

SEQ ID NO: 2173552 - RNA, 16 nt, Streptococcus pneumoniae R6
uuugauagugauauca

SEQ ID NO: 2173553 - RNA, 22 nt, Streptococcus pneumoniae R6
uuugaggauaaaaaagaaggag

SEQ ID NO: 2173554 - RNA, 19 nt, Streptococcus pneumoniae R6
uuugaguaaggacuuugcu

SEQ ID NO: 2173555 - RNA, 19 nt, Streptococcus pneumoniae R6
uuugaguaaaagacaucag

SEQ ID NO: 2173556 - RNA, 14 nt, Streptococcus pneumoniae R6
uuucuugauuuguu

SEQ ID NO: 2173557 - RNA, 20 nt, Streptococcus pneumoniae R6
uuucuugaugaaagauauuu

SEQ ID NO: 2173558 - RNA, 21 nt, Streptococcus pneumoniae R6
uuucuugaugaaagauauuuu

SEQ ID NO: 2173559 - RNA, 19 nt, Streptococcus pneumoniae R6
uuucuugaaaucaacugcu

SEQ ID NO: 2173560 - RNA, 21 nt, Streptococcus pneumoniae R6
uuucuugagaagagcuucuuu

SEQ ID NO: 2173561 - RNA, 23 nt, Streptococcus pneumoniae R6
uuucuucuuuuuguccuucuucu

SEQ ID NO: 2173562 - RNA, 17 nt, Streptococcus pneumoniae R6
uuucuucuuucacuuca

SEQ ID NO: 2173563 - RNA, 18 nt, Streptococcus pneumoniae R6
uuucuucguccagacguu

SEQ ID NO: 2173564 - RNA, 13 nt, Streptococcus pneumoniae R6
uuucuucuagcuu

SEQ ID NO: 2173565 - RNA, 21 nt, Streptococcus pneumoniae R6
uuucuuuggcaccuuuguaug

SEQ ID NO: 2173566 - RNA, 17 nt, Streptococcus pneumoniae R6
uuucuuuaaucuugacu

SEQ ID NO: 2173567 - RNA, 13 nt, Streptococcus pneumoniae R6
uuucuuuaaaaaa

SEQ ID NO: 2173568 - RNA, 19 nt, Streptococcus pneumoniae R6
uuucuuucaacuucgucac

SEQ ID NO: 2173569 - RNA, 14 nt, Streptococcus pneumoniae R6
uuucuucagauuuu

SEQ ID NO: 2173570 - RNA, 16 nt, Streptococcus pneumoniae R6
uuucuucagauuuuau

SEQ ID NO: 2173571 - RNA, 20 nt, Streptococcus pneumoniae R6
uuucuucaacccacuacagu

SEQ ID NO: 2173572 - RNA, 16 nt, Streptococcus pneumoniae R6
uuucuucaauugguuu

SEQ ID NO: 2173573 - RNA, 14 nt, Streptococcus pneumoniae R6
uuucuuauuuuccu

SEQ ID NO: 2173574 - RNA, 22 nt, Streptococcus pneumoniae R6
uuucuucaacaaaccuuguucu

SEQ ID NO: 2173575 - RNA, 15 nt, Streptococcus pneumoniae R6
uuucuuaucuugucc

SEQ ID NO: 2173576 - RNA, 13 nt, Streptococcus pneumoniae R6
uuucuuccuuucu

SEQ ID NO: 2173577 - RNA, 16 nt, Streptococcus pneumoniae R6
uuucugugcuuuuuca

SEQ ID NO: 2173578 - RNA, 19 nt, Streptococcus pneumoniae R6
uuucuguugauauuuccau

SEQ ID NO: 2173579 - RNA, 13 nt, Streptococcus pneumoniae R6
uuugagaucuuuu

SEQ ID NO: 2173580 - RNA, 19 nt, Streptococcus pneumoniae R6
uuugagaucuuuuucgcuu

SEQ ID NO: 2173581 - RNA, 20 nt, Streptococcus pneumoniae R6
uuugagaugggacuaaagau

SEQ ID NO: 2173582 - RNA, 18 nt, Streptococcus pneumoniae R6
uuugagcucuuugacaga

SEQ ID NO: 2173583 - RNA, 19 nt, Streptococcus pneumoniae R6
uuugagauuacugauaaaa

SEQ ID NO: 2173584 - RNA, 21 nt, Streptococcus pneumoniae R6
uuugagcaauacuuuuucguu

SEQ ID NO: 2173585 - RNA, 19 nt, Streptococcus pneumoniae R6
uuugagcagaacaaugacu

SEQ ID NO: 2173586 - RNA, 16 nt, Streptococcus pneumoniae R6
uuugacuggagaguug

SEQ ID NO: 2173587 - RNA, 14 nt, Streptococcus pneumoniae R6
uuugacuguccuga

SEQ ID NO: 2173588 - RNA, 16 nt, Streptococcus pneumoniae R6
uuugacuuuucuaauc

SEQ ID NO: 2173589 - RNA, 18 nt, Streptococcus pneumoniae R6
uuugacguuuccuucuac

SEQ ID NO: 2173590 - RNA, 17 nt, Streptococcus pneumoniae R6
uuugacgagugaagaau

SEQ ID NO: 2173591 - RNA, 19 nt, Streptococcus pneumoniae R6
uuugaaucaccuaaaguag

SEQ ID NO: 2173592 - RNA, 13 nt, Streptococcus pneumoniae R6
uuugaauuccaaa

SEQ ID NO: 2173593 - RNA, 14 nt, Streptococcus pneumoniae R6
uuugaauucuccaa

SEQ ID NO: 2173594 - RNA, 16 nt, Streptococcus pneumoniae R6
uuugaauucuccaauc

SEQ ID NO: 2173595 - RNA, 14 nt, Streptococcus pneumoniae R6
uuugaauuucaugg

SEQ ID NO: 2173596 - RNA, 14 nt, Streptococcus pneumoniae R6
uuugacauccuuuu

SEQ ID NO: 2173597 - RNA, 16 nt, Streptococcus pneumoniae R6
uuugacaaguaaguag

SEQ ID NO: 2173598 - RNA, 12 nt, Streptococcus pneumoniae R6
uuugaacaaagu

SEQ ID NO: 2173599 - RNA, 15 nt, Streptococcus pneumoniae R6
uuugaaaucagaaaa

SEQ ID NO: 2173600 - RNA, 14 nt, Streptococcus pneumoniae R6
uuugaaguuuucaa

SEQ ID NO: 2173601 - RNA, 13 nt, Streptococcus pneumoniae R6
uuugaagauaucg

SEQ ID NO: 2173602 - RNA, 15 nt, Streptococcus pneumoniae R6
uuugaauauccccug

SEQ ID NO: 2173603 - RNA, 17 nt, Streptococcus pneumoniae R6
uuugaaaaaaauuuuau

SEQ ID NO: 2173604 - RNA, 18 nt, Streptococcus pneumoniae R6
uuugaaaaaccuugauau

SEQ ID NO: 2173605 - RNA, 12 nt, Streptococcus pneumoniae R6
uuugaaaaacua

SEQ ID NO: 2173606 - RNA, 13 nt, Streptococcus pneumoniae R6
uuugaaaaacuag

SEQ ID NO: 2173607 - RNA, 16 nt, Streptococcus pneumoniae R6
uuugaaacuagaauag

SEQ ID NO: 2173608 - RNA, 15 nt, Streptococcus pneumoniae R6
uuugaaaaauauaca

SEQ ID NO: 2173609 - RNA, 20 nt, Streptococcus pneumoniae R6
uuucccuaauaauacaaaaa

SEQ ID NO: 2173610 - RNA, 21 nt, Streptococcus pneumoniae R6
uuucccuaauaauacaaaaaa

SEQ ID NO: 2173611 - RNA, 20 nt, Streptococcus pneumoniae R6
uuucccuuugauagcaucuu

SEQ ID NO: 2173612 - RNA, 15 nt, Streptococcus pneumoniae R6
uuuccgauuucagaa

SEQ ID NO: 2173613 - RNA, 14 nt, Streptococcus pneumoniae R6
uuuccauucaaauu

SEQ ID NO: 2173614 - RNA, 18 nt, Streptococcus pneumoniae R6
uuucccagacaaauuguu

SEQ ID NO: 2173615 - RNA, 17 nt, Streptococcus pneumoniae R6
uuucccagccuucagcc

SEQ ID NO: 2173616 - RNA, 13 nt, Streptococcus pneumoniae R6
uuucccaccuuuu

SEQ ID NO: 2173617 - RNA, 15 nt, Streptococcus pneumoniae R6
uuucccaccuuuucu

SEQ ID NO: 2173618 - RNA, 18 nt, Streptococcus pneumoniae R6
uuuccauuguuguuucuu

SEQ ID NO: 2173619 - RNA, 16 nt, Streptococcus pneumoniae R6
uuuccauuuacagaag

SEQ ID NO: 2173620 - RNA, 13 nt, Streptococcus pneumoniae R6
uuuccauuucuuu

SEQ ID NO: 2173621 - RNA, 20 nt, Streptococcus pneumoniae R6
uuuccccugccaacuuauca

SEQ ID NO: 2173622 - RNA, 16 nt, Streptococcus pneumoniae R6
uuuccugauuuugugc

SEQ ID NO: 2173623 - RNA, 15 nt, Streptococcus pneumoniae R6
uuuccuucauuucca

SEQ ID NO: 2173624 - RNA, 20 nt, Streptococcus pneumoniae R6
uuuccuugaccaaguccuca

SEQ ID NO: 2173625 - RNA, 18 nt, Streptococcus pneumoniae R6
uuuccuucguuuucacaa

SEQ ID NO: 2173626 - RNA, 21 nt, Streptococcus pneumoniae R6
uuuccuccgauaauuauuuuu

SEQ ID NO: 2173627 - RNA, 21 nt, Streptococcus pneumoniae R6
uuuccucgguuagcuccagaa

SEQ ID NO: 2173628 - RNA, 14 nt, Streptococcus pneumoniae R6
uuuccuauuauuua

SEQ ID NO: 2173629 - RNA, 17 nt, Streptococcus pneumoniae R6
uuuccucauuuucuagu

SEQ ID NO: 2173630 - RNA, 18 nt, Streptococcus pneumoniae R6
uuuccguucucaaagcgu

SEQ ID NO: 2173631 - RNA, 16 nt, Streptococcus pneumoniae R6
uuuccuaaucaauuug

SEQ ID NO: 2173632 - RNA, 18 nt, Streptococcus pneumoniae R6
uuuccuaaucgauuuguu

SEQ ID NO: 2173633 - RNA, 19 nt, Streptococcus pneumoniae R6
uuuccuagauuacaaaaaa

SEQ ID NO: 2173634 - RNA, 16 nt, Streptococcus pneumoniae R6
uuucgaguaacaucaa

SEQ ID NO: 2173635 - RNA, 22 nt, Streptococcus pneumoniae R6
uuucgauaucguuauuagcauc

SEQ ID NO: 2173636 - RNA, 17 nt, Streptococcus pneumoniae R6
uuucgagccaauacugc

SEQ ID NO: 2173637 - RNA, 21 nt, Streptococcus pneumoniae R6
uuuccuuucaauguuucgugu

SEQ ID NO: 2173638 - RNA, 15 nt, Streptococcus pneumoniae R6
uuucgaaaagaauua

SEQ ID NO: 2173639 - RNA, 13 nt, Streptococcus pneumoniae R6
uuucgaaaaguau

SEQ ID NO: 2173640 - RNA, 14 nt, Streptococcus pneumoniae R6
uuucgauaaaguag

SEQ ID NO: 2173641 - RNA, 13 nt, Streptococcus pneumoniae R6
uuucgcauuugag

SEQ ID NO: 2173642 - RNA, 14 nt, Streptococcus pneumoniae R6
uuucgcuauuuaaa

SEQ ID NO: 2173643 - RNA, 19 nt, Streptococcus pneumoniae R6
uuucgucaccaaauuucau

SEQ ID NO: 2173644 - RNA, 18 nt, Streptococcus pneumoniae R6
uuucguauaccauaauaa

SEQ ID NO: 2173645 - RNA, 21 nt, Streptococcus pneumoniae R6
uuucguacuauuucagauuca

SEQ ID NO: 2173646 - RNA, 13 nt, Streptococcus pneumoniae R6
uuucggcuuuagc

SEQ ID NO: 2173647 - RNA, 19 nt, Streptococcus pneumoniae R6
uuucuaaauuuaacauuaa

SEQ ID NO: 2173648 - RNA, 14 nt, Streptococcus pneumoniae R6
uuucuaaaauagug

SEQ ID NO: 2173649 - RNA, 14 nt, Streptococcus pneumoniae R6
uuucuaaaaaauug

SEQ ID NO: 2173650 - RNA, 20 nt, Streptococcus pneumoniae R6
uuucuaaacaauguucucau

SEQ ID NO: 2173651 - RNA, 16 nt, Streptococcus pneumoniae R6
uuucuaaagaauuuga

SEQ ID NO: 2173652 - RNA, 12 nt, Streptococcus pneumoniae R6
uuucuaaagagu

SEQ ID NO: 2173653 - RNA, 15 nt, Streptococcus pneumoniae R6
uuucuaaagcaauuu

SEQ ID NO: 2173654 - RNA, 17 nt, Streptococcus pneumoniae R6
uuucuaaagcaauuuug

SEQ ID NO: 2173655 - RNA, 15 nt, Streptococcus pneumoniae R6
uuucguuccagacuc

SEQ ID NO: 2173656 - RNA, 17 nt, Streptococcus pneumoniae R6
uuucguuugauaaguuu

SEQ ID NO: 2173657 - RNA, 18 nt, Streptococcus pneumoniae R6
uuucgucuuccauuucuu

SEQ ID NO: 2173658 - RNA, 18 nt, Streptococcus pneumoniae R6
uuucguguuuggauuauu

SEQ ID NO: 2173659 - RNA, 16 nt, Streptococcus pneumoniae R6
uuucuauacuuuuucu

SEQ ID NO: 2173660 - RNA, 13 nt, Streptococcus pneumoniae R6
uuucuauauuuau

SEQ ID NO: 2173661 - RNA, 15 nt, Streptococcus pneumoniae R6
uuucuauauuuauau

SEQ ID NO: 2173662 - RNA, 15 nt, Streptococcus pneumoniae R6
uuucuaugauuuuca

SEQ ID NO: 2173663 - RNA, 22 nt, Streptococcus pneumoniae R6
uuucuagccccucggauuuuau

SEQ ID NO: 2173664 - RNA, 13 nt, Streptococcus pneumoniae R6
uuucuaguuugcu

SEQ ID NO: 2173665 - RNA, 14 nt, Streptococcus pneumoniae R6
uuucuaguuugcuc

SEQ ID NO: 2173666 - RNA, 21 nt, Streptococcus pneumoniae R6
uuucuaguuuugguuuuucuu

SEQ ID NO: 2173667 - RNA, 17 nt, Streptococcus pneumoniae R6
uuucuaguuuacucuuu

SEQ ID NO: 2173668 - RNA, 22 nt, Streptococcus pneumoniae R6
uuucuacuguauacuuuuucag

SEQ ID NO: 2173669 - RNA, 13 nt, Streptococcus pneumoniae R6
uuucuacuaaaau

SEQ ID NO: 2173670 - RNA, 14 nt, Streptococcus pneumoniae R6
uuucuacuaaaauu

SEQ ID NO: 2173671 - RNA, 23 nt, Streptococcus pneumoniae R6
uuucuagaaauuaauuugacuuu

SEQ ID NO: 2173672 - RNA, 23 nt, Streptococcus pneumoniae R6
uuucuacagcuguaucaauugcu

SEQ ID NO: 2173673 - RNA, 18 nt, Streptococcus pneumoniae R6
uuucuaaggagaauucua

SEQ ID NO: 2173674 - RNA, 16 nt, Streptococcus pneumoniae R6
uuucuaagcuaccucu

SEQ ID NO: 2173675 - RNA, 13 nt, Streptococcus pneumoniae R6
uuucuaauaauuu

SEQ ID NO: 2173676 - RNA, 18 nt, Streptococcus pneumoniae R6
uuucuaauaauuuuaacu

SEQ ID NO: 2173677 - RNA, 23 nt, Streptococcus pneumoniae R6
uuucuaauacaagcucaucuuug

SEQ ID NO: 2173678 - RNA, 22 nt, Streptococcus pneumoniae R6
uuucuaauuaaaucauccauau

SEQ ID NO: 2173679 - RNA, 15 nt, Streptococcus pneumoniae R6
uuucuaauuauuuca

SEQ ID NO: 2173680 - RNA, 17 nt, Streptococcus pneumoniae R6
uuucucacuuaauucuu

SEQ ID NO: 2173681 - RNA, 20 nt, Streptococcus pneumoniae R6
uuucucacuuaauucuucau

SEQ ID NO: 2173682 - RNA, 12 nt, Streptococcus pneumoniae R6
uuucucaauauc

SEQ ID NO: 2173683 - RNA, 21 nt, Streptococcus pneumoniae R6
uuucucaaacauugugaggaa

SEQ ID NO: 2173684 - RNA, 16 nt, Streptococcus pneumoniae R6
uuucucaaaaaaguua

SEQ ID NO: 2173685 - RNA, 12 nt, Streptococcus pneumoniae R6
uuucuauuucuu

SEQ ID NO: 2173686 - RNA, 20 nt, Streptococcus pneumoniae R6
uuucuccaaagccuucuugg

SEQ ID NO: 2173687 - RNA, 16 nt, Streptococcus pneumoniae R6
uuucucaucuauuuuu

SEQ ID NO: 2173688 - RNA, 14 nt, Streptococcus pneumoniae R6
uuucuccuaaaauu

SEQ ID NO: 2173689 - RNA, 18 nt, Streptococcus pneumoniae R6
uuucuccuauuuucuucu

SEQ ID NO: 2173690 - RNA, 16 nt, Streptococcus pneumoniae R6
uuucucucugaauaga

SEQ ID NO: 2173691 - RNA, 15 nt, Streptococcus pneumoniae R6
uuucucggucuuguu

SEQ ID NO: 2173692 - RNA, 15 nt, Streptococcus pneumoniae R6
uuucucuacaaauaa

SEQ ID NO: 2173693 - RNA, 22 nt, Streptococcus pneumoniae R6
uuucugaagacaaaucauuuug

SEQ ID NO: 2173694 - RNA, 21 nt, Streptococcus pneumoniae R6
uuucugauagaagagucagcu

SEQ ID NO: 2173695 - RNA, 22 nt, Streptococcus pneumoniae R6
uuucugauagaagagucagcuc

SEQ ID NO: 2173696 - RNA, 16 nt, Streptococcus pneumoniae R6
uuucuguaauuucuac

SEQ ID NO: 2173697 - RNA, 18 nt, Streptococcus pneumoniae R6
uuucuggauaacugaaau

SEQ ID NO: 2173698 - RNA, 22 nt, Streptococcus pneumoniae R6
uuucuggcaggucgguuuuauu

SEQ ID NO: 2173699 - RNA, 19 nt, Streptococcus pneumoniae R6
uuuucagccucuauacuua

SEQ ID NO: 2173700 - RNA, 15 nt, Streptococcus pneumoniae R6
uuuucagauuuuaaa

SEQ ID NO: 2173701 - RNA, 18 nt, Streptococcus pneumoniae R6
uuuucacagaguauuaaa

SEQ ID NO: 2173702 - RNA, 21 nt, Streptococcus pneumoniae R6
uuuucaccaaaacuauauucu

SEQ ID NO: 2173703 - RNA, 14 nt, Streptococcus pneumoniae R6
uuuucauagaaauc

SEQ ID NO: 2173704 - RNA, 14 nt, Streptococcus pneumoniae R6
uuuucauuccaaac

SEQ ID NO: 2173705 - RNA, 18 nt, Streptococcus pneumoniae R6
uuuucauuccaaacgucu

SEQ ID NO: 2173706 - RNA, 14 nt, Streptococcus pneumoniae R6
uuuucauaacuuua

SEQ ID NO: 2173707 - RNA, 11 nt, Streptococcus pneumoniae R6
uuuucauaagc

SEQ ID NO: 2173708 - RNA, 16 nt, Streptococcus pneumoniae R6
uuuucauaaagagaag

SEQ ID NO: 2173709 - RNA, 18 nt, Streptococcus pneumoniae R6
uuuucaaauguauuugaa

SEQ ID NO: 2173710 - RNA, 18 nt, Streptococcus pneumoniae R6
uuuucaaauucuuuagaa

SEQ ID NO: 2173711 - RNA, 14 nt, Streptococcus pneumoniae R6
uuuucaaaaugaca

SEQ ID NO: 2173712 - RNA, 23 nt, Streptococcus pneumoniae R6
uuuucaaaaugacaauuuuucca

SEQ ID NO: 2173713 - RNA, 15 nt, Streptococcus pneumoniae R6
uuuucaaaaucagaa

SEQ ID NO: 2173714 - RNA, 20 nt, Streptococcus pneumoniae R6
uuuucaaaaucagaaaaacg

SEQ ID NO: 2173715 - RNA, 12 nt, Streptococcus pneumoniae R6
uuuucaaaacug

SEQ ID NO: 2173716 - RNA, 12 nt, Streptococcus pneumoniae R6
uuuucaaaaaau

SEQ ID NO: 2173717 - RNA, 18 nt, Streptococcus pneumoniae R6
uuuucaaaguuccgaaau

SEQ ID NO: 2173718 - RNA, 13 nt, Streptococcus pneumoniae R6
uuuucaaaaaaau

SEQ ID NO: 2173719 - RNA, 19 nt, Streptococcus pneumoniae R6
uuuuauuucauuccaucau

SEQ ID NO: 2173720 - RNA, 18 nt, Streptococcus pneumoniae R6
uuuuccugauuaaaauca

SEQ ID NO: 2173721 - RNA, 17 nt, Streptococcus pneumoniae R6
uuuuccuauucugaagu

SEQ ID NO: 2173722 - RNA, 19 nt, Streptococcus pneumoniae R6
uuuuccgaccucagacucg

SEQ ID NO: 2173723 - RNA, 21 nt, Streptococcus pneumoniae R6
uuuucccagccuucagcccaa

SEQ ID NO: 2173724 - RNA, 16 nt, Streptococcus pneumoniae R6
uuuucccaccuuuucu

SEQ ID NO: 2173725 - RNA, 20 nt, Streptococcus pneumoniae R6
uuuucccaccuuuucucaau

SEQ ID NO: 2173726 - RNA, 17 nt, Streptococcus pneumoniae R6
uuuucauuuaauauauu

SEQ ID NO: 2173727 - RNA, 18 nt, Streptococcus pneumoniae R6
uuuucauugagcuuuaaa

SEQ ID NO: 2173728 - RNA, 23 nt, Streptococcus pneumoniae R6
uuuucauugagcuuuaaaaucca

SEQ ID NO: 2173729 - RNA, 19 nt, Streptococcus pneumoniae R6
uuuucauugaguaugaaau

SEQ ID NO: 2173730 - RNA, 22 nt, Streptococcus pneumoniae R6
uuuucauugaguaugaaauaag

SEQ ID NO: 2173731 - RNA, 22 nt, Streptococcus pneumoniae R6
uuuuccagcguugcgauuuuug

SEQ ID NO: 2173732 - RNA, 19 nt, Streptococcus pneumoniae R6
uuuucguacaauauuuguu

SEQ ID NO: 2173733 - RNA, 22 nt, Streptococcus pneumoniae R6
uuuucguacacucaaaucaaaa

SEQ ID NO: 2173734 - RNA, 19 nt, Streptococcus pneumoniae R6
uuuucguacauaguuucau

SEQ ID NO: 2173735 - RNA, 14 nt, Streptococcus pneumoniae R6
uuuucgaaaauucu

SEQ ID NO: 2173736 - RNA, 17 nt, Streptococcus pneumoniae R6
uuuucgaaaauucuuug

SEQ ID NO: 2173737 - RNA, 14 nt, Streptococcus pneumoniae R6
uuuucgaaauuuau

SEQ ID NO: 2173738 - RNA, 21 nt, Streptococcus pneumoniae R6
uuuucgaagaguauaaaauca

SEQ ID NO: 2173739 - RNA, 19 nt, Streptococcus pneumoniae R6
uuuucgaagaguauaaauc

SEQ ID NO: 2173740 - RNA, 13 nt, Streptococcus pneumoniae R6
uuuuauacucaau

SEQ ID NO: 2173741 - RNA, 20 nt, Streptococcus pneumoniae R6
uuuuauacuuuuaauauuuc

SEQ ID NO: 2173742 - RNA, 19 nt, Streptococcus pneumoniae R6
uuuuauagaauauauuucu

SEQ ID NO: 2173743 - RNA, 19 nt, Streptococcus pneumoniae R6
uuuuauaauaucacuaaau

SEQ ID NO: 2173744 - RNA, 12 nt, Streptococcus pneumoniae R6
uuuuaguuuuau

SEQ ID NO: 2173745 - RNA, 15 nt, Streptococcus pneumoniae R6
uuuuaggaauauuau

SEQ ID NO: 2173746 - RNA, 20 nt, Streptococcus pneumoniae R6
uuuuaggaauauuauauaaa

SEQ ID NO: 2173747 - RNA, 18 nt, Streptococcus pneumoniae R6
uuuuaggacauaaauaug

SEQ ID NO: 2173748 - RNA, 11 nt, Streptococcus pneumoniae R6
uuuuaguagaa

SEQ ID NO: 2173749 - RNA, 14 nt, Streptococcus pneumoniae R6
uuuuaguucagaau

SEQ ID NO: 2173750 - RNA, 14 nt, Streptococcus pneumoniae R6
uuuuaguucuacuu

SEQ ID NO: 2173751 - RNA, 15 nt, Streptococcus pneumoniae R6
uuuuagucucuaaau

SEQ ID NO: 2173752 - RNA, 15 nt, Streptococcus pneumoniae R6
uuuuagaacucuauu

SEQ ID NO: 2173753 - RNA, 17 nt, Streptococcus pneumoniae R6
uuuuagaaggauaaauu

SEQ ID NO: 2173754 - RNA, 14 nt, Streptococcus pneumoniae R6
uuuuagauuuuuua

SEQ ID NO: 2173755 - RNA, 15 nt, Streptococcus pneumoniae R6
uuuuagcaauuguuu

SEQ ID NO: 2173756 - RNA, 22 nt, Streptococcus pneumoniae R6
uuuuagaugagaaagauuuuca

SEQ ID NO: 2173757 - RNA, 23 nt, Streptococcus pneumoniae R6
uuuuagaugagaaagauuuucaa

SEQ ID NO: 2173758 - RNA, 16 nt, Streptococcus pneumoniae R6
uuuuacuucuucccca

SEQ ID NO: 2173759 - RNA, 17 nt, Streptococcus pneumoniae R6
uuuuacuauaaaauaag

SEQ ID NO: 2173760 - RNA, 22 nt, Streptococcus pneumoniae R6
uuuuacuaugggaagauuuacu

SEQ ID NO: 2173761 - RNA, 15 nt, Streptococcus pneumoniae R6
uuuuacucaaggacu

SEQ ID NO: 2173762 - RNA, 17 nt, Streptococcus pneumoniae R6
uuuuauauauaaaauuu

SEQ ID NO: 2173763 - RNA, 11 nt, Streptococcus pneumoniae R6
uuuuaucaaag

SEQ ID NO: 2173764 - RNA, 22 nt, Streptococcus pneumoniae R6
uuuuaucauagaaauauuuacu

SEQ ID NO: 2173765 - RNA, 18 nt, Streptococcus pneumoniae R6
uuuuaucauagaaauuuu

SEQ ID NO: 2173766 - RNA, 21 nt, Streptococcus pneumoniae R6
uuuuauccucaaaauucuguc

SEQ ID NO: 2173767 - RNA, 16 nt, Streptococcus pneumoniae R6
uuuuauccauuuuuca

SEQ ID NO: 2173768 - RNA, 12 nt, Streptococcus pneumoniae R6
uuuuaugcguuu

SEQ ID NO: 2173769 - RNA, 13 nt, Streptococcus pneumoniae R6
uuuuaucugcaau

SEQ ID NO: 2173770 - RNA, 15 nt, Streptococcus pneumoniae R6
uuuuaucuuugaaau

SEQ ID NO: 2173771 - RNA, 15 nt, Streptococcus pneumoniae R6
uuuuauuauugguuu

SEQ ID NO: 2173772 - RNA, 18 nt, Streptococcus pneumoniae R6
uuuuauuauuuccucaau

SEQ ID NO: 2173773 - RNA, 23 nt, Streptococcus pneumoniae R6
uuuuauuauuuccucaauguuuu

SEQ ID NO: 2173774 - RNA, 22 nt, Streptococcus pneumoniae R6
uuuuauuauguagagacuuaua

SEQ ID NO: 2173775 - RNA, 22 nt, Streptococcus pneumoniae R6
uuuuauuguuccuaaaacaguu

SEQ ID NO: 2173776 - RNA, 15 nt, Streptococcus pneumoniae R6
uuuuauugcaauuua

SEQ ID NO: 2173777 - RNA, 11 nt, Streptococcus pneumoniae R6
uuuuauuucuu

SEQ ID NO: 2173778 - RNA, 11 nt, Streptococcus pneumoniae R6
uuuuauuuaag

SEQ ID NO: 2173779 - RNA, 13 nt, Streptococcus pneumoniae R6
uuuuauuacauaa

SEQ ID NO: 2173780 - RNA, 17 nt, Streptococcus pneumoniae R6
uuugucacacaaaaaag

SEQ ID NO: 2173781 - RNA, 20 nt, Streptococcus pneumoniae R6
uuugucaguaaaaaaaacau

SEQ ID NO: 2173782 - RNA, 21 nt, Streptococcus pneumoniae R6
uuuguccauuaugauauauag

SEQ ID NO: 2173783 - RNA, 19 nt, Streptococcus pneumoniae R6
uuugucaucguuccaguuu

SEQ ID NO: 2173784 - RNA, 21 nt, Streptococcus pneumoniae R6
uuuguccuauucuuauuucau

SEQ ID NO: 2173785 - RNA, 21 nt, Streptococcus pneumoniae R6
uuuguccuggucuuauuucau

SEQ ID NO: 2173786 - RNA, 21 nt, Streptococcus pneumoniae R6
uuuguccuguucuuauuucau

SEQ ID NO: 2173787 - RNA, 14 nt, Streptococcus pneumoniae R6
uuugugaggaccag

SEQ ID NO: 2173788 - RNA, 12 nt, Streptococcus pneumoniae R6
uuuguguuuuuu

SEQ ID NO: 2173789 - RNA, 14 nt, Streptococcus pneumoniae R6
uuuguauuuugaau

SEQ ID NO: 2173790 - RNA, 12 nt, Streptococcus pneumoniae R6
uuuguaucuucc

SEQ ID NO: 2173791 - RNA, 19 nt, Streptococcus pneumoniae R6
uuuguaggccacaaaugcu

SEQ ID NO: 2173792 - RNA, 15 nt, Streptococcus pneumoniae R6
uuugcuucauuuuuu

SEQ ID NO: 2173793 - RNA, 13 nt, Streptococcus pneumoniae R6
uuugcuuuuugau

SEQ ID NO: 2173794 - RNA, 14 nt, Streptococcus pneumoniae R6
uuugcuuuuugauu

SEQ ID NO: 2173795 - RNA, 9 nt, Streptococcus pneumoniae R6
uuuggaaaa

SEQ ID NO: 2173796 - RNA, 15 nt, Streptococcus pneumoniae R6
uuuggaaaauaguuu

SEQ ID NO: 2173797 - RNA, 22 nt, Streptococcus pneumoniae R6
uuuggaagucaaaucaauuuuu

SEQ ID NO: 2173798 - RNA, 16 nt, Streptococcus pneumoniae R6
uuuggagucaauaauc

SEQ ID NO: 2173799 - RNA, 18 nt, Streptococcus pneumoniae R6
uuuggacucacuaaaauu

SEQ ID NO: 2173800 - RNA, 15 nt, Streptococcus pneumoniae R6
uuugguaugaaauag

SEQ ID NO: 2173801 - RNA, 20 nt, Streptococcus pneumoniae R6
uuugguguucacgaaagcaa

SEQ ID NO: 2173802 - RNA, 17 nt, Streptococcus pneumoniae R6
uuugguuauaaaaaaca

SEQ ID NO: 2173803 - RNA, 19 nt, Streptococcus pneumoniae R6
uuugguugcuacaucuucu

SEQ ID NO: 2173804 - RNA, 22 nt, Streptococcus pneumoniae R6
uuuggcuauaauuauucugcaa

SEQ ID NO: 2173805 - RNA, 13 nt, Streptococcus pneumoniae R6
uuugggaauuggu

SEQ ID NO: 2173806 - RNA, 16 nt, Streptococcus pneumoniae R6
uuugggacgauuuuca

SEQ ID NO: 2173807 - RNA, 12 nt, Streptococcus pneumoniae R6
uuuuacaggaau

SEQ ID NO: 2173808 - RNA, 20 nt, Streptococcus pneumoniae R6
uuuuacaauuguaaaaagag

SEQ ID NO: 2173809 - RNA, 23 nt, Streptococcus pneumoniae R6
uuuuacagaguacuaaauauaag

SEQ ID NO: 2173810 - RNA, 18 nt, Streptococcus pneumoniae R6
uuuuaccacuaaacuaca

SEQ ID NO: 2173811 - RNA, 19 nt, Streptococcus pneumoniae R6
uuuuaauucuuuuucaaau

SEQ ID NO: 2173812 - RNA, 17 nt, Streptococcus pneumoniae R6
uuuuaauuuaauccacu

SEQ ID NO: 2173813 - RNA, 13 nt, Streptococcus pneumoniae R6
uuuuaauuuuucu

SEQ ID NO: 2173814 - RNA, 22 nt, Streptococcus pneumoniae R6
uuuuaaccagaucuuagaagca

SEQ ID NO: 2173815 - RNA, 13 nt, Streptococcus pneumoniae R6
uuuuaacagauuu

SEQ ID NO: 2173816 - RNA, 13 nt, Streptococcus pneumoniae R6
uuuuaacaaaaau

SEQ ID NO: 2173817 - RNA, 14 nt, Streptococcus pneumoniae R6
uuuuaacaaaaauu

SEQ ID NO: 2173818 - RNA, 18 nt, Streptococcus pneumoniae R6
uuuuaaauuuacuuaaaa

SEQ ID NO: 2173819 - RNA, 13 nt, Streptococcus pneumoniae R6
uuuuaacuucagc

SEQ ID NO: 2173820 - RNA, 22 nt, Streptococcus pneumoniae R6
uuuuaagguugcagauagaacu

SEQ ID NO: 2173821 - RNA, 22 nt, Streptococcus pneumoniae R6
uuuuaagguuguagauggaacu

SEQ ID NO: 2173822 - RNA, 14 nt, Streptococcus pneumoniae R6
uuuuaauauauaaa

SEQ ID NO: 2173823 - RNA, 13 nt, Streptococcus pneumoniae R6
uuuguucugaaag

SEQ ID NO: 2173824 - RNA, 22 nt, Streptococcus pneumoniae R6
uuuguucguauccuauuucacu

SEQ ID NO: 2173825 - RNA, 21 nt, Streptococcus pneumoniae R6
uuuguucgcaucuuauuucaa

SEQ ID NO: 2173826 - RNA, 13 nt, Streptococcus pneumoniae R6
uuuguucccaagg

SEQ ID NO: 2173827 - RNA, 18 nt, Streptococcus pneumoniae R6
uuuguuagauuuauaauu

SEQ ID NO: 2173828 - RNA, 14 nt, Streptococcus pneumoniae R6
uuuguuaccaauac

SEQ ID NO: 2173829 - RNA, 16 nt, Streptococcus pneumoniae R6
uuuguuuucuauuucu

SEQ ID NO: 2173830 - RNA, 14 nt, Streptococcus pneumoniae R6
uuuguuuucaagug

SEQ ID NO: 2173831 - RNA, 16 nt, Streptococcus pneumoniae R6
uuuuaaaaaaucuuuu

SEQ ID NO: 2173832 - RNA, 14 nt, Streptococcus pneumoniae R6
uuuguuucuugaaa

SEQ ID NO: 2173833 - RNA, 14 nt, Streptococcus pneumoniae R6
uuuguuucuuaauc

SEQ ID NO: 2173834 - RNA, 23 nt, Streptococcus pneumoniae R6
uuuuaaaguauucccuacaaaua

SEQ ID NO: 2173835 - RNA, 20 nt, Streptococcus pneumoniae R6
uuuuaaaggucaauuccuca

SEQ ID NO: 2173836 - RNA, 21 nt, Streptococcus pneumoniae R6
uuuuaaagaaauagaaaacaa

SEQ ID NO: 2173837 - RNA, 20 nt, Streptococcus pneumoniae R6
uuuuaaagacagucugaaaa

SEQ ID NO: 2173838 - RNA, 18 nt, Streptococcus pneumoniae R6
uuuuggauaauauccaca

SEQ ID NO: 2173839 - RNA, 21 nt, Streptococcus pneumoniae R6
uuuugcuguuaauaacucuca

SEQ ID NO: 2173840 - RNA, 22 nt, Streptococcus pneumoniae R6
uuuugcuguuaauaacucucau

SEQ ID NO: 2173841 - RNA, 19 nt, Streptococcus pneumoniae R6
uuuugcguuggaauaaggu

SEQ ID NO: 2173842 - RNA, 14 nt, Streptococcus pneumoniae R6
uuuugcccucuaaa

SEQ ID NO: 2173843 - RNA, 21 nt, Streptococcus pneumoniae R6
uuuugcccuuuuugaaaaacu

SEQ ID NO: 2173844 - RNA, 10 nt, Streptococcus pneumoniae R6
uuuugauuuc

SEQ ID NO: 2173845 - RNA, 21 nt, Streptococcus pneumoniae R6
uuuugauggguucuuugccag

SEQ ID NO: 2173846 - RNA, 14 nt, Streptococcus pneumoniae R6
uuuugauguucaga

SEQ ID NO: 2173847 - RNA, 17 nt, Streptococcus pneumoniae R6
uuuugaugccugacaau

SEQ ID NO: 2173848 - RNA, 13 nt, Streptococcus pneumoniae R6
uuuugauuauuuu

SEQ ID NO: 2173849 - RNA, 19 nt, Streptococcus pneumoniae R6
uuuugauuauuuuuuaaca

SEQ ID NO: 2173850 - RNA, 15 nt, Streptococcus pneumoniae R6
uuuugauucaguaac

SEQ ID NO: 2173851 - RNA, 18 nt, Streptococcus pneumoniae R6
uuuugcaaucauuucaaa

SEQ ID NO: 2173852 - RNA, 18 nt, Streptococcus pneumoniae R6
uuuugcaucaacuauucu

SEQ ID NO: 2173853 - RNA, 18 nt, Streptococcus pneumoniae R6
uuuugagguugcagauaa

SEQ ID NO: 2173854 - RNA, 14 nt, Streptococcus pneumoniae R6
uuuugauaucuucc

SEQ ID NO: 2173855 - RNA, 19 nt, Streptococcus pneumoniae R6
uuuugauaugagcccaugu

SEQ ID NO: 2173856 - RNA, 14 nt, Streptococcus pneumoniae R6
uuuugagcuaauuu

SEQ ID NO: 2173857 - RNA, 23 nt, Streptococcus pneumoniae R6
uuuugauacagccuucuuuuuac

SEQ ID NO: 2173858 - RNA, 15 nt, Streptococcus pneumoniae R6
uuuugauaccacaga

SEQ ID NO: 2173859 - RNA, 21 nt, Streptococcus pneumoniae R6
uuuugaaugcucccuucuuua

SEQ ID NO: 2173860 - RNA, 23 nt, Streptococcus pneumoniae R6
uuuugaauauuaguaaauagaag

SEQ ID NO: 2173861 - RNA, 21 nt, Streptococcus pneumoniae R6
uuuugacugauggaaguaauu

SEQ ID NO: 2173862 - RNA, 11 nt, Streptococcus pneumoniae R6
uuuucuucuuc

SEQ ID NO: 2173863 - RNA, 14 nt, Streptococcus pneumoniae R6
uuuucuucugaaau

SEQ ID NO: 2173864 - RNA, 19 nt, Streptococcus pneumoniae R6
uuuucuguugauauuucca

SEQ ID NO: 2173865 - RNA, 12 nt, Streptococcus pneumoniae R6
uuuucuguuuaa

SEQ ID NO: 2173866 - RNA, 14 nt, Streptococcus pneumoniae R6
uuuucuuacuuccu

SEQ ID NO: 2173867 - RNA, 17 nt, Streptococcus pneumoniae R6
uuuucuuauuuuccuaa

SEQ ID NO: 2173868 - RNA, 17 nt, Streptococcus pneumoniae R6
uuuucuucaacccacua

SEQ ID NO: 2173869 - RNA, 20 nt, Streptococcus pneumoniae R6
uuuugaaaggaaagcauagg

SEQ ID NO: 2173870 - RNA, 16 nt, Streptococcus pneumoniae R6
uuuugaaacuagaaua

SEQ ID NO: 2173871 - RNA, 14 nt, Streptococcus pneumoniae R6
uuuugaaaauuuuu

SEQ ID NO: 2173872 - RNA, 14 nt, Streptococcus pneumoniae R6
uuuugaaaaugaau

SEQ ID NO: 2173873 - RNA, 16 nt, Streptococcus pneumoniae R6
uuuugaaaaugaauuu

SEQ ID NO: 2173874 - RNA, 12 nt, Streptococcus pneumoniae R6
uuuucuuugcag

SEQ ID NO: 2173875 - RNA, 14 nt, Streptococcus pneumoniae R6
uuuucuuuguucuu

SEQ ID NO: 2173876 - RNA, 18 nt, Streptococcus pneumoniae R6
uuuucuuuuaccugaaau

SEQ ID NO: 2173877 - RNA, 20 nt, Streptococcus pneumoniae R6
uuuucuaaagcaauuuugaa

SEQ ID NO: 2173878 - RNA, 24 nt, Streptococcus pneumoniae R6
uuuucuacuaaaauuauguuuuug

SEQ ID NO: 2173879 - RNA, 17 nt, Streptococcus pneumoniae R6
uuuucuacuccuuuucu

SEQ ID NO: 2173880 - RNA, 14 nt, Streptococcus pneumoniae R6
uuuucuaucacucc

SEQ ID NO: 2173881 - RNA, 21 nt, Streptococcus pneumoniae R6
uuuucuauaguagauugaaau

SEQ ID NO: 2173882 - RNA, 22 nt, Streptococcus pneumoniae R6
uuuucuauaguagauugaaaua

SEQ ID NO: 2173883 - RNA, 13 nt, Streptococcus pneumoniae R6
uuuucucuuuguc

SEQ ID NO: 2173884 - RNA, 15 nt, Streptococcus pneumoniae R6
uuuucugauuuugaa

SEQ ID NO: 2173885 - RNA, 21 nt, Streptococcus pneumoniae R6
uuuucugaguuaaacucucca

SEQ ID NO: 2173886 - RNA, 19 nt, Streptococcus pneumoniae R6
uuuucugcaaaaaauauuu

SEQ ID NO: 2173887 - RNA, 19 nt, Streptococcus pneumoniae R6
uuuucuggcagauuuugaa

SEQ ID NO: 2173888 - RNA, 18 nt, Streptococcus pneumoniae R6
uuuucugggugauuuuuu

SEQ ID NO: 2173889 - RNA, 17 nt, Streptococcus pneumoniae R6
uuuucuggcucuuuguc

SEQ ID NO: 2173890 - RNA, 14 nt, Streptococcus pneumoniae R6
uuuuucaugaauac

SEQ ID NO: 2173891 - RNA, 17 nt, Streptococcus pneumoniae R6
uuuuucauggaugcaau

SEQ ID NO: 2173892 - RNA, 17 nt, Streptococcus pneumoniae R6
uuuuucauguauuccaa

SEQ ID NO: 2173893 - RNA, 18 nt, Streptococcus pneumoniae R6
uuuuucauugaguauaaa

SEQ ID NO: 2173894 - RNA, 16 nt, Streptococcus pneumoniae R6
uuuuucccaccuuuuc

SEQ ID NO: 2173895 - RNA, 21 nt, Streptococcus pneumoniae R6
uuuuucccaccuuuucucaau

SEQ ID NO: 2173896 - RNA, 21 nt, Streptococcus pneumoniae R6
uuuuucccagccuucagccca

SEQ ID NO: 2173897 - RNA, 13 nt, Streptococcus pneumoniae R6
uuuuucaaaaacc

SEQ ID NO: 2173898 - RNA, 22 nt, Streptococcus pneumoniae R6
uuuuucaacagcuccuucaagu

SEQ ID NO: 2173899 - RNA, 22 nt, Streptococcus pneumoniae R6
uuuuucaaggugaaguucacgu

SEQ ID NO: 2173900 - RNA, 17 nt, Streptococcus pneumoniae R6
uuuuucaaucaauguca

SEQ ID NO: 2173901 - RNA, 21 nt, Streptococcus pneumoniae R6
uuuuucagcuggcuccuucuu

SEQ ID NO: 2173902 - RNA, 21 nt, Streptococcus pneumoniae R6
uuuuucacuagagagcuuucu

SEQ ID NO: 2173903 - RNA, 15 nt, Streptococcus pneumoniae R6
uuuuucaccaaaacc

SEQ ID NO: 2173904 - RNA, 16 nt, Streptococcus pneumoniae R6
uuuuuauaauaucacu

SEQ ID NO: 2173905 - RNA, 14 nt, Streptococcus pneumoniae R6
uuuuuauacucaau

SEQ ID NO: 2173906 - RNA, 17 nt, Streptococcus pneumoniae R6
uuuuuauaagcaauuca

SEQ ID NO: 2173907 - RNA, 21 nt, Streptococcus pneumoniae R6
uuuuuaggcaauaaaauauga

SEQ ID NO: 2173908 - RNA, 14 nt, Streptococcus pneumoniae R6
uuuuuauauauaaa

SEQ ID NO: 2173909 - RNA, 12 nt, Streptococcus pneumoniae R6
uuuuuaucccga

SEQ ID NO: 2173910 - RNA, 17 nt, Streptococcus pneumoniae R6
uuuuuaagauuuuaccu

SEQ ID NO: 2173911 - RNA, 18 nt, Streptococcus pneumoniae R6
uuuuuaaagauauagccu

SEQ ID NO: 2173912 - RNA, 14 nt, Streptococcus pneumoniae R6
uuuuuaaucauaca

SEQ ID NO: 2173913 - RNA, 14 nt, Streptococcus pneumoniae R6
uuuuuaauuaauca

SEQ ID NO: 2173914 - RNA, 14 nt, Streptococcus pneumoniae R6
uuuuuaauuauuuu

SEQ ID NO: 2173915 - RNA, 14 nt, Streptococcus pneumoniae R6
uuuuuaauuuuucu

SEQ ID NO: 2173916 - RNA, 18 nt, Streptococcus pneumoniae R6
uuuuuaauuauuuucaaa

SEQ ID NO: 2173917 - RNA, 16 nt, Streptococcus pneumoniae R6
uuuuuacaauuguaaa

SEQ ID NO: 2173918 - RNA, 16 nt, Streptococcus pneumoniae R6
uuuuuacaguauuuau

SEQ ID NO: 2173919 - RNA, 14 nt, Streptococcus pneumoniae R6
uuuuuaaaggugaa

SEQ ID NO: 2173920 - RNA, 13 nt, Streptococcus pneumoniae R6
uuuuuaaaaaauc

SEQ ID NO: 2173921 - RNA, 20 nt, Streptococcus pneumoniae R6
uuuuguuucuuaaucuguuu

SEQ ID NO: 2173922 - RNA, 22 nt, Streptococcus pneumoniae R6
uuuuguuucacuaggauuuuag

SEQ ID NO: 2173923 - RNA, 18 nt, Streptococcus pneumoniae R6
uuuuguuuccaguuaucu

SEQ ID NO: 2173924 - RNA, 19 nt, Streptococcus pneumoniae R6
uuuuguaggccacaaaugc

SEQ ID NO: 2173925 - RNA, 16 nt, Streptococcus pneumoniae R6
uuuuguauuucuucuu

SEQ ID NO: 2173926 - RNA, 23 nt, Streptococcus pneumoniae R6
uuuugucaguaaaaaaaacauau

SEQ ID NO: 2173927 - RNA, 20 nt, Streptococcus pneumoniae R6
uuuugucucugaaaacaagu

SEQ ID NO: 2173928 - RNA, 23 nt, Streptococcus pneumoniae R6
uuuugucuucuaagcucuuaaaa

SEQ ID NO: 2173929 - RNA, 15 nt, Streptococcus pneumoniae R6
uuuuguucaaaauua

SEQ ID NO: 2173930 - RNA, 16 nt, Streptococcus pneumoniae R6
uuuuguuuaauacuca

SEQ ID NO: 2173931 - RNA, 18 nt, Streptococcus pneumoniae R6
uuuuguuuaauacucaau

SEQ ID NO: 2173932 - RNA, 21 nt, Streptococcus pneumoniae R6
uuuuguucuuuuucaaaagcu

SEQ ID NO: 2173933 - RNA, 21 nt, Streptococcus pneumoniae R6
aaauguuuucucauagccaua

SEQ ID NO: 2173934 - RNA, 19 nt, Streptococcus pneumoniae R6
aaauguuugcucauagcca

SEQ ID NO: 2173935 - RNA, 19 nt, Streptococcus pneumoniae R6
aaauguucuguaaugaaau

SEQ ID NO: 2173936 - RNA, 18 nt, Streptococcus pneumoniae R6
aaaugugauuucuguaaa

SEQ ID NO: 2173937 - RNA, 13 nt, Streptococcus pneumoniae R6
uuuuuuacuuaau

SEQ ID NO: 2173938 - RNA, 22 nt, Streptococcus pneumoniae R6
uuuuuuauaacaguauacugga

SEQ ID NO: 2173939 - RNA, 16 nt, Streptococcus pneumoniae R6
uuuuuuauaagcaauu

SEQ ID NO: 2173940 - RNA, 14 nt, Streptococcus pneumoniae R6
uuuuuuauaauauc

SEQ ID NO: 2173941 - RNA, 23 nt, Streptococcus pneumoniae R6
aaauuaauuucuauaaauguuuu

SEQ ID NO: 2173942 - RNA, 16 nt, Streptococcus pneumoniae R6
aaauuaauuugaauuu

SEQ ID NO: 2173943 - RNA, 20 nt, Streptococcus pneumoniae R6
aaauuaauuugaauuuucua

SEQ ID NO: 2173944 - RNA, 21 nt, Streptococcus pneumoniae R6
aaauuaauuuauagaaaaauu

SEQ ID NO: 2173945 - RNA, 20 nt, Streptococcus pneumoniae R6
aaauuaauuuauagaaauau

SEQ ID NO: 2173946 - RNA, 19 nt, Streptococcus pneumoniae R6
aaauuaaucagaauggguu

SEQ ID NO: 2173947 - RNA, 13 nt, Streptococcus pneumoniae R6
uuuuugaaaaacu

SEQ ID NO: 2173948 - RNA, 11 nt, Streptococcus pneumoniae R6
uuuuucuucuu

SEQ ID NO: 2173949 - RNA, 13 nt, Streptococcus pneumoniae R6
uuuuucuucuuau

SEQ ID NO: 2173950 - RNA, 15 nt, Streptococcus pneumoniae R6
uuuuucuuccuuucu

SEQ ID NO: 2173951 - RNA, 23 nt, Streptococcus pneumoniae R6
uuuuugacugauggaaguaauuu

SEQ ID NO: 2173952 - RNA, 17 nt, Streptococcus pneumoniae R6
uuuuugaaguuuucaaa

SEQ ID NO: 2173953 - RNA, 13 nt, Streptococcus pneumoniae R6
uuuuugaauaacc

SEQ ID NO: 2173954 - RNA, 12 nt, Streptococcus pneumoniae R6
uuuuugaacacc

SEQ ID NO: 2173955 - RNA, 21 nt, Streptococcus pneumoniae R6
uuuuucucaucuauuuuuacu

SEQ ID NO: 2173956 - RNA, 23 nt, Streptococcus pneumoniae R6
uuuuucugauuucaaagaauuuu

SEQ ID NO: 2173957 - RNA, 19 nt, Streptococcus pneumoniae R6
uuuuucggcaguuuuuucu

SEQ ID NO: 2173958 - RNA, 23 nt, Streptococcus pneumoniae R6
uuuuucggcaguuuuuucuuucu

SEQ ID NO: 2173959 - RNA, 16 nt, Streptococcus pneumoniae R6
uuuuucgaagcuugcu

SEQ ID NO: 2173960 - RNA, 19 nt, Streptococcus pneumoniae R6
uuuuuguauuucuucuucu

SEQ ID NO: 2173961 - RNA, 12 nt, Streptococcus pneumoniae R6
uuuuuguauauu

SEQ ID NO: 2173962 - RNA, 15 nt, Streptococcus pneumoniae R6
uuuuuguccuucuuc

SEQ ID NO: 2173963 - RNA, 21 nt, Streptococcus pneumoniae R6
uuuuugguaugaaauagccaa

SEQ ID NO: 2173964 - RNA, 21 nt, Streptococcus pneumoniae R6
uuuuuggauuggauaguuuuu

SEQ ID NO: 2173965 - RNA, 21 nt, Streptococcus pneumoniae R6
uuuuuggcaaccucgauggcu

SEQ ID NO: 2173966 - RNA, 11 nt, Streptococcus pneumoniae R6
uuuuugagccu

SEQ ID NO: 2173967 - RNA, 20 nt, Streptococcus pneumoniae R6
uuuuugauacagccuucuuu

SEQ ID NO: 2173968 - RNA, 15 nt, Streptococcus pneumoniae R6
uuuuugauguucaaa

SEQ ID NO: 2173969 - RNA, 16 nt, Streptococcus pneumoniae R6
uuuuugauuuauccaa

SEQ ID NO: 2173970 - RNA, 18 nt, Streptococcus pneumoniae R6
aaauucaaacucaaauuu

SEQ ID NO: 2173971 - RNA, 16 nt, Streptococcus pneumoniae R6
aaauuccauaccuaaa

SEQ ID NO: 2173972 - RNA, 20 nt, Streptococcus pneumoniae R6
aaauuccaaauuagaaaaag

SEQ ID NO: 2173973 - RNA, 14 nt, Streptococcus pneumoniae R6
aaauucauuugauu

SEQ ID NO: 2173974 - RNA, 14 nt, Streptococcus pneumoniae R6
aaauucaguaugcu

SEQ ID NO: 2173975 - RNA, 17 nt, Streptococcus pneumoniae R6
aaauucaggugauuuac

SEQ ID NO: 2173976 - RNA, 19 nt, Streptococcus pneumoniae R6
aaauucaggugauuuacca

SEQ ID NO: 2173977 - RNA, 14 nt, Streptococcus pneumoniae R6
aaauuccuuuaaaa

SEQ ID NO: 2173978 - RNA, 19 nt, Streptococcus pneumoniae R6
aaauuccuuuaaaaacaau

SEQ ID NO: 2173979 - RNA, 14 nt, Streptococcus pneumoniae R6
aaauuccuuaaacu

SEQ ID NO: 2173980 - RNA, 17 nt, Streptococcus pneumoniae R6
aaauuccuuaaacucuu

SEQ ID NO: 2173981 - RNA, 19 nt, Streptococcus pneumoniae R6
aaauucgcuuuuuuaaaug

SEQ ID NO: 2173982 - RNA, 21 nt, Streptococcus pneumoniae R6
aaauucgcuuuuuuaaaugcu

SEQ ID NO: 2173983 - RNA, 18 nt, Streptococcus pneumoniae R6
aaauucuggcauuuguaa

SEQ ID NO: 2173984 - RNA, 15 nt, Streptococcus pneumoniae R6
aaauucuuacuaccu

SEQ ID NO: 2173985 - RNA, 16 nt, Streptococcus pneumoniae R6
aaauucuuacuaccua

SEQ ID NO: 2173986 - RNA, 19 nt, Streptococcus pneumoniae R6
aaauucuuacuaccuacuu

SEQ ID NO: 2173987 - RNA, 20 nt, Streptococcus pneumoniae R6
aaauucuccacagaccuguc

SEQ ID NO: 2173988 - RNA, 13 nt, Streptococcus pneumoniae R6
aaauuagaaaaag

SEQ ID NO: 2173989 - RNA, 18 nt, Streptococcus pneumoniae R6
aaauuacaguuauuuuag

SEQ ID NO: 2173990 - RNA, 19 nt, Streptococcus pneumoniae R6
aaauuacaguuauuuuagu

SEQ ID NO: 2173991 - RNA, 20 nt, Streptococcus pneumoniae R6
aaauuacaguuauuuuagua

SEQ ID NO: 2173992 - RNA, 12 nt, Streptococcus pneumoniae R6
uuuuuucuaauu

SEQ ID NO: 2173993 - RNA, 15 nt, Streptococcus pneumoniae R6
uuuuuucuaauuaaa

SEQ ID NO: 2173994 - RNA, 11 nt, Streptococcus pneumoniae R6
uuuuuucucug

SEQ ID NO: 2173995 - RNA, 12 nt, Streptococcus pneumoniae R6
uuuuuucugaag

SEQ ID NO: 2173996 - RNA, 12 nt, Streptococcus pneumoniae R6
uuuuuucuuugc

SEQ ID NO: 2173997 - RNA, 14 nt, Streptococcus pneumoniae R6
aaauuaguuuuuag

SEQ ID NO: 2173998 - RNA, 16 nt, Streptococcus pneumoniae R6
aaauuaguuuuuagaa

SEQ ID NO: 2173999 - RNA, 14 nt, Streptococcus pneumoniae R6
aaauuauaaaacca

SEQ ID NO: 2174000 - RNA, 20 nt, Streptococcus pneumoniae R6
aaauuauagucuuuucacuu

SEQ ID NO: 2174001 - RNA, 20 nt, Streptococcus pneumoniae R6
aaauuauacucuuagaaaau

SEQ ID NO: 2174002 - RNA, 17 nt, Streptococcus pneumoniae R6
aaauuagggauacucca

SEQ ID NO: 2174003 - RNA, 15 nt, Streptococcus pneumoniae R6
aaauuauguuuuuga

SEQ ID NO: 2174004 - RNA, 21 nt, Streptococcus pneumoniae R6
aaauuauuaaaaucaaaaaac

SEQ ID NO: 2174005 - RNA, 23 nt, Streptococcus pneumoniae R6
aaauuauuggucgcuucaaguuu

SEQ ID NO: 2174006 - RNA, 18 nt, Streptococcus pneumoniae R6
aaauuauuuauuuacuua

SEQ ID NO: 2174007 - RNA, 17 nt, Streptococcus pneumoniae R6
aaauuauuucuuuugua

SEQ ID NO: 2174008 - RNA, 20 nt, Streptococcus pneumoniae R6
aauaaagucaacagaguuuc

SEQ ID NO: 2174009 - RNA, 16 nt, Streptococcus pneumoniae R6
aauaaagccuuucgaa

SEQ ID NO: 2174010 - RNA, 18 nt, Streptococcus pneumoniae R6
aauacaagcucaucuuug

SEQ ID NO: 2174011 - RNA, 15 nt, Streptococcus pneumoniae R6
aauacaaauuguaag

SEQ ID NO: 2174012 - RNA, 17 nt, Streptococcus pneumoniae R6
aauacagaacuaaaucu

SEQ ID NO: 2174013 - RNA, 23 nt, Streptococcus pneumoniae R6
aauacagcuuuuuucuuugccuc

SEQ ID NO: 2174014 - RNA, 15 nt, Streptococcus pneumoniae R6
aauacaggaaaacca

SEQ ID NO: 2174015 - RNA, 16 nt, Streptococcus pneumoniae R6
aauacaggaaaaccag

SEQ ID NO: 2174016 - RNA, 18 nt, Streptococcus pneumoniae R6
aauacguuuucaaagcua

SEQ ID NO: 2174017 - RNA, 20 nt, Streptococcus pneumoniae R6
aauacuagucuuucuucguu

SEQ ID NO: 2174018 - RNA, 16 nt, Streptococcus pneumoniae R6
aauacuaaggaaaguc

SEQ ID NO: 2174019 - RNA, 13 nt, Streptococcus pneumoniae R6
aauacucaaugaa

SEQ ID NO: 2174020 - RNA, 15 nt, Streptococcus pneumoniae R6
aauacucaaugaaaa

SEQ ID NO: 2174021 - RNA, 17 nt, Streptococcus pneumoniae R6
aauacucaaugaaaauc

SEQ ID NO: 2174022 - RNA, 19 nt, Streptococcus pneumoniae R6
aauacucaaugaaaaucaa

SEQ ID NO: 2174023 - RNA, 12 nt, Streptococcus pneumoniae R6
aauacuucaaca

SEQ ID NO: 2174024 - RNA, 15 nt, Streptococcus pneumoniae R6
aauacuugaacuauu

SEQ ID NO: 2174025 - RNA, 14 nt, Streptococcus pneumoniae R6
aauagaaguucaau

SEQ ID NO: 2174026 - RNA, 20 nt, Streptococcus pneumoniae R6
aauacgaagggcaggaaaaa

SEQ ID NO: 2174027 - RNA, 21 nt, Streptococcus pneumoniae R6
aauacgaagggcaggaaaaag

SEQ ID NO: 2174028 - RNA, 22 nt, Streptococcus pneumoniae R6
aauacgucggaacaucuuuucc

SEQ ID NO: 2174029 - RNA, 18 nt, Streptococcus pneumoniae R6
aauacccccuuaaaacca

SEQ ID NO: 2174030 - RNA, 18 nt, Streptococcus pneumoniae R6
aauacccauuuauggaaa

SEQ ID NO: 2174031 - RNA, 13 nt, Streptococcus pneumoniae R6
aauaccagguaau

SEQ ID NO: 2174032 - RNA, 14 nt, Streptococcus pneumoniae R6
aauaccagcaauca

SEQ ID NO: 2174033 - RNA, 16 nt, Streptococcus pneumoniae R6
aauagcucaaaagcuu

SEQ ID NO: 2174034 - RNA, 15 nt, Streptococcus pneumoniae R6
aauagcucaaaaguu

SEQ ID NO: 2174035 - RNA, 22 nt, Streptococcus pneumoniae R6
aauagcuaguagggaaaccacu

SEQ ID NO: 2174036 - RNA, 18 nt, Streptococcus pneumoniae R6
aauagcugaacccuuguc

SEQ ID NO: 2174037 - RNA, 16 nt, Streptococcus pneumoniae R6
aauagcuaaaccuuau

SEQ ID NO: 2174038 - RNA, 23 nt, Streptococcus pneumoniae R6
aauagacccuuguuucuaaaaca

SEQ ID NO: 2174039 - RNA, 12 nt, Streptococcus pneumoniae R6
aauagaagauaa

SEQ ID NO: 2174040 - RNA, 14 nt, Streptococcus pneumoniae R6
aauagaagauaaag

SEQ ID NO: 2174041 - RNA, 21 nt, Streptococcus pneumoniae R6
aauagaagauuuccuccauaa

SEQ ID NO: 2174042 - RNA, 16 nt, Streptococcus pneumoniae R6
aauaguacgaaacaau

SEQ ID NO: 2174043 - RNA, 23 nt, Streptococcus pneumoniae R6
aauaguauaccacacuaaauuua

SEQ ID NO: 2174044 - RNA, 23 nt, Streptococcus pneumoniae R6
aauaguccacugcaauuucuaaa

SEQ ID NO: 2174045 - RNA, 16 nt, Streptococcus pneumoniae R6
aauaguccgacgaagu

SEQ ID NO: 2174046 - RNA, 11 nt, Streptococcus pneumoniae R6
aauaguccucc

SEQ ID NO: 2174047 - RNA, 19 nt, Streptococcus pneumoniae R6
aauaguaugucugaauaua

SEQ ID NO: 2174048 - RNA, 16 nt, Streptococcus pneumoniae R6
aauaguugaaaucaag

SEQ ID NO: 2174049 - RNA, 21 nt, Streptococcus pneumoniae R6
aauaguugaaaucaaggcagu

SEQ ID NO: 2174050 - RNA, 18 nt, Streptococcus pneumoniae R6
aauaguuuaaaacauuuu

SEQ ID NO: 2174051 - RNA, 16 nt, Streptococcus pneumoniae R6
aauagcuuccuugaug

SEQ ID NO: 2174052 - RNA, 18 nt, Streptococcus pneumoniae R6
aauagcugcggcuuucuu

SEQ ID NO: 2174053 - RNA, 16 nt, Streptococcus pneumoniae R6
aauagcuuaaaaucuu

SEQ ID NO: 2174054 - RNA, 19 nt, Streptococcus pneumoniae R6
aauaggaguuuuagaacuc

SEQ ID NO: 2174055 - RNA, 14 nt, Streptococcus pneumoniae R6
aauaguaagaguug

SEQ ID NO: 2174056 - RNA, 17 nt, Streptococcus pneumoniae R6
aauaugaacaaaaccug

SEQ ID NO: 2174057 - RNA, 23 nt, Streptococcus pneumoniae R6
aauaucuuuauugaugaagucua

SEQ ID NO: 2174058 - RNA, 19 nt, Streptococcus pneumoniae R6
aauaucuuuuauuuuuaua

SEQ ID NO: 2174059 - RNA, 18 nt, Streptococcus pneumoniae R6
aauaucagauauucuaaa

SEQ ID NO: 2174060 - RNA, 22 nt, Streptococcus pneumoniae R6
aauaucagccagagcaccaacc

SEQ ID NO: 2174061 - RNA, 23 nt, Streptococcus pneumoniae R6
aauaucagccagagcaccaacca

SEQ ID NO: 2174062 - RNA, 17 nt, Streptococcus pneumoniae R6
aauaucgauaccuucag

SEQ ID NO: 2174063 - RNA, 23 nt, Streptococcus pneumoniae R6
aauaucgaugcccucuucuuuga

SEQ ID NO: 2174064 - RNA, 17 nt, Streptococcus pneumoniae R6
aauaguuuuugcaauau

SEQ ID NO: 2174065 - RNA, 17 nt, Streptococcus pneumoniae R6
aauauaacuaguuaaua

SEQ ID NO: 2174066 - RNA, 23 nt, Streptococcus pneumoniae R6
aauauaacuaguuaauacugacu

SEQ ID NO: 2174067 - RNA, 15 nt, Streptococcus pneumoniae R6
aauauauucuccagc

SEQ ID NO: 2174068 - RNA, 16 nt, Streptococcus pneumoniae R6
aauauauuauauaucu

SEQ ID NO: 2174069 - RNA, 18 nt, Streptococcus pneumoniae R6
aauaucaaaaaaagaagu

SEQ ID NO: 2174070 - RNA, 14 nt, Streptococcus pneumoniae R6
aauauauuuauuau

SEQ ID NO: 2174071 - RNA, 13 nt, Streptococcus pneumoniae R6
aauaucaaaguuu

SEQ ID NO: 2174072 - RNA, 23 nt, Streptococcus pneumoniae R6
aauaucaaaguuuacgacacauu

SEQ ID NO: 2174073 - RNA, 17 nt, Streptococcus pneumoniae R6
aauaugaacauuuuccg

SEQ ID NO: 2174074 - RNA, 16 nt, Streptococcus pneumoniae R6
aauauuagaugauuuu

SEQ ID NO: 2174075 - RNA, 14 nt, Streptococcus pneumoniae R6
aauauuagcaaaaa

SEQ ID NO: 2174076 - RNA, 23 nt, Streptococcus pneumoniae R6
aauauuacguccuguugcuucau

SEQ ID NO: 2174077 - RNA, 21 nt, Streptococcus pneumoniae R6
aauauuguuuuaauauaauau

SEQ ID NO: 2174078 - RNA, 19 nt, Streptococcus pneumoniae R6
aauauuuacuucauguuuu

SEQ ID NO: 2174079 - RNA, 18 nt, Streptococcus pneumoniae R6
aauauuuacuucauuuuu

SEQ ID NO: 2174080 - RNA, 19 nt, Streptococcus pneumoniae R6
aauauuguaaauucuuaaa

SEQ ID NO: 2174081 - RNA, 21 nt, Streptococcus pneumoniae R6
aauauuggcuacuguaggcuu

SEQ ID NO: 2174082 - RNA, 13 nt, Streptococcus pneumoniae R6
aauauucucuaga

SEQ ID NO: 2174083 - RNA, 15 nt, Streptococcus pneumoniae R6
aauauucucuagaaa

SEQ ID NO: 2174084 - RNA, 18 nt, Streptococcus pneumoniae R6
aauauucucuagaaaucu

SEQ ID NO: 2174085 - RNA, 15 nt, Streptococcus pneumoniae R6
aaucaaauugugcag

SEQ ID NO: 2174086 - RNA, 13 nt, Streptococcus pneumoniae R6
aaucaaaucaaua

SEQ ID NO: 2174087 - RNA, 20 nt, Streptococcus pneumoniae R6
aaucaaaucgauaaagaaga

SEQ ID NO: 2174088 - RNA, 19 nt, Streptococcus pneumoniae R6
aaucaacaugagaauacaa

SEQ ID NO: 2174089 - RNA, 21 nt, Streptococcus pneumoniae R6
aaucaacacaggauuaccuuu

SEQ ID NO: 2174090 - RNA, 14 nt, Streptococcus pneumoniae R6
aaucaaagugcaaa

SEQ ID NO: 2174091 - RNA, 13 nt, Streptococcus pneumoniae R6
aaucaaagccacc

SEQ ID NO: 2174092 - RNA, 17 nt, Streptococcus pneumoniae R6
aaucaaaggagauagua

SEQ ID NO: 2174093 - RNA, 19 nt, Streptococcus pneumoniae R6
aaucaaaggagauaguauc

SEQ ID NO: 2174094 - RNA, 19 nt, Streptococcus pneumoniae R6
aaucaaacuagcaagugcu

SEQ ID NO: 2174095 - RNA, 15 nt, Streptococcus pneumoniae R6
aaucaaaaaugaagu

SEQ ID NO: 2174096 - RNA, 17 nt, Streptococcus pneumoniae R6
aaucaaaacuauaaaug

SEQ ID NO: 2174097 - RNA, 12 nt, Streptococcus pneumoniae R6
aaucaaaauuau

SEQ ID NO: 2174098 - RNA, 23 nt, Streptococcus pneumoniae R6
aauauuuuaaacguuuuuacuuu

SEQ ID NO: 2174099 - RNA, 18 nt, Streptococcus pneumoniae R6
aaucaaaaaaauucuuca

SEQ ID NO: 2174100 - RNA, 20 nt, Streptococcus pneumoniae R6
aaucaaaaaaauucuucaca

SEQ ID NO: 2174101 - RNA, 11 nt, Streptococcus pneumoniae R6
aauauuuugcu

SEQ ID NO: 2174102 - RNA, 20 nt, Streptococcus pneumoniae R6
aauauuuuaguauuccugug

SEQ ID NO: 2174103 - RNA, 17 nt, Streptococcus pneumoniae R6
aaucacgcuuuucuuga

SEQ ID NO: 2174104 - RNA, 20 nt, Streptococcus pneumoniae R6
aaucacguacaacagcuaca

SEQ ID NO: 2174105 - RNA, 20 nt, Streptococcus pneumoniae R6
aaucacguugcuuauacuca

SEQ ID NO: 2174106 - RNA, 16 nt, Streptococcus pneumoniae R6
aaucacgacuuucuga

SEQ ID NO: 2174107 - RNA, 16 nt, Streptococcus pneumoniae R6
aaucaccugcaauaau

SEQ ID NO: 2174108 - RNA, 20 nt, Streptococcus pneumoniae R6
aaucagacuguuuuucuuga

SEQ ID NO: 2174109 - RNA, 14 nt, Streptococcus pneumoniae R6
aaucagcuaaaaau

SEQ ID NO: 2174110 - RNA, 20 nt, Streptococcus pneumoniae R6
aaucagccauugaaaauccu

SEQ ID NO: 2174111 - RNA, 13 nt, Streptococcus pneumoniae R6
aaucaguuuuugc

SEQ ID NO: 2174112 - RNA, 23 nt, Streptococcus pneumoniae R6
aaucaucacuaguaauaauuuca

SEQ ID NO: 2174113 - RNA, 13 nt, Streptococcus pneumoniae R6
aaucauaaacacc

SEQ ID NO: 2174114 - RNA, 15 nt, Streptococcus pneumoniae R6
aaucauaaagccagu

SEQ ID NO: 2174115 - RNA, 23 nt, Streptococcus pneumoniae R6
aaucauaagcaacuuuacgaaau

SEQ ID NO: 2174116 - RNA, 17 nt, Streptococcus pneumoniae R6
aaucaagauacaagucu

SEQ ID NO: 2174117 - RNA, 19 nt, Streptococcus pneumoniae R6
aaucaagauagcugugaag

SEQ ID NO: 2174118 - RNA, 12 nt, Streptococcus pneumoniae R6
aaucaagcuggc

SEQ ID NO: 2174119 - RNA, 18 nt, Streptococcus pneumoniae R6
aaucaagcuggcuacaga

SEQ ID NO: 2174120 - RNA, 15 nt, Streptococcus pneumoniae R6
aaucaagguuuccaa

SEQ ID NO: 2174121 - RNA, 23 nt, Streptococcus pneumoniae R6
aaucaaguaggcucauccccuca

SEQ ID NO: 2174122 - RNA, 22 nt, Streptococcus pneumoniae R6
aaucaauaacacgagaaacaau

SEQ ID NO: 2174123 - RNA, 20 nt, Streptococcus pneumoniae R6
aaucaaucguccuugauuua

SEQ ID NO: 2174124 - RNA, 22 nt, Streptococcus pneumoniae R6
aaucacaugacguucaaaggca

SEQ ID NO: 2174125 - RNA, 18 nt, Streptococcus pneumoniae R6
aaucaccguccccaaaaa

SEQ ID NO: 2174126 - RNA, 14 nt, Streptococcus pneumoniae R6
aaucaauuucuagc

SEQ ID NO: 2174127 - RNA, 21 nt, Streptococcus pneumoniae R6
aaucaauuucuagcaaaguuu

SEQ ID NO: 2174128 - RNA, 15 nt, Streptococcus pneumoniae R6
aaucaauuuguucgu

SEQ ID NO: 2174129 - RNA, 16 nt, Streptococcus pneumoniae R6
aaucaauuuuacagga

SEQ ID NO: 2174130 - RNA, 20 nt, Streptococcus pneumoniae R6
aaucaauuuuacaggaauau

SEQ ID NO: 2174131 - RNA, 13 nt, Streptococcus pneumoniae R6
aaucaauuuuucg

SEQ ID NO: 2174132 - RNA, 17 nt, Streptococcus pneumoniae R6
aaucaauuuuucggcca

SEQ ID NO: 2174133 - RNA, 23 nt, Streptococcus pneumoniae R6
aaucuggagaguacgaaauucgu

SEQ ID NO: 2174134 - RNA, 20 nt, Streptococcus pneumoniae R6
aaucugcaccugauuucucc

SEQ ID NO: 2174135 - RNA, 21 nt, Streptococcus pneumoniae R6
aaucugccgccauacuuucuc

SEQ ID NO: 2174136 - RNA, 17 nt, Streptococcus pneumoniae R6
aaucuucuggcacagaa

SEQ ID NO: 2174137 - RNA, 21 nt, Streptococcus pneumoniae R6
aaucuugacuauauuucuuaa

SEQ ID NO: 2174138 - RNA, 16 nt, Streptococcus pneumoniae R6
aaucuuggcaaaacgu

SEQ ID NO: 2174139 - RNA, 21 nt, Streptococcus pneumoniae R6
aaucuucaaauuuuucauaau

SEQ ID NO: 2174140 - RNA, 12 nt, Streptococcus pneumoniae R6
aaucuucaaaau

SEQ ID NO: 2174141 - RNA, 19 nt, Streptococcus pneumoniae R6
aaucuucaaaaucucagcu

SEQ ID NO: 2174142 - RNA, 18 nt, Streptococcus pneumoniae R6
aaucuucccauaguaaaa

SEQ ID NO: 2174143 - RNA, 23 nt, Streptococcus pneumoniae R6
aaucuucccauaguaaaacgcau

SEQ ID NO: 2174144 - RNA, 24 nt, Streptococcus pneumoniae R6
aaucuucccauaguaaaacgcaua

SEQ ID NO: 2174145 - RNA, 21 nt, Streptococcus pneumoniae R6
aaucuucuagcuaucuccuca

SEQ ID NO: 2174146 - RNA, 22 nt, Streptococcus pneumoniae R6
aaucuucuagcuaucuccucau

SEQ ID NO: 2174147 - RNA, 20 nt, Streptococcus pneumoniae R6
aaucuuuaagauacuugauu

SEQ ID NO: 2174148 - RNA, 15 nt, Streptococcus pneumoniae R6
aaucuugucaagaau

SEQ ID NO: 2174149 - RNA, 13 nt, Streptococcus pneumoniae R6
aaucuuguuaaga

SEQ ID NO: 2174150 - RNA, 16 nt, Streptococcus pneumoniae R6
aaucuuggucaacaua

SEQ ID NO: 2174151 - RNA, 15 nt, Streptococcus pneumoniae R6
aaugacaauuauaua

SEQ ID NO: 2174152 - RNA, 16 nt, Streptococcus pneumoniae R6
aaugacaauuauauaa

SEQ ID NO: 2174153 - RNA, 19 nt, Streptococcus pneumoniae R6
aaugacacguaucggaaau

SEQ ID NO: 2174154 - RNA, 16 nt, Streptococcus pneumoniae R6
aaugaagcaaacauuc

SEQ ID NO: 2174155 - RNA, 19 nt, Streptococcus pneumoniae R6
aaugaagacaucauauaaa

SEQ ID NO: 2174156 - RNA, 21 nt, Streptococcus pneumoniae R6
aaugaagacaucauauaaaua

SEQ ID NO: 2174157 - RNA, 21 nt, Streptococcus pneumoniae R6
aaugauaccuugaucaaucau

SEQ ID NO: 2174158 - RNA, 19 nt, Streptococcus pneumoniae R6
aaugauauuuucaaaaaaa

SEQ ID NO: 2174159 - RNA, 20 nt, Streptococcus pneumoniae R6
aaugauauuuucaaaaaaau

SEQ ID NO: 2174160 - RNA, 20 nt, Streptococcus pneumoniae R6
aaugauucuuuucaucucuu

SEQ ID NO: 2174161 - RNA, 16 nt, Streptococcus pneumoniae R6
aaugcaccaaaacagg

SEQ ID NO: 2174162 - RNA, 23 nt, Streptococcus pneumoniae R6
aaugagugcuguaauacgaaggg

SEQ ID NO: 2174163 - RNA, 16 nt, Streptococcus pneumoniae R6
aaugagaaauuuuugg

SEQ ID NO: 2174164 - RNA, 18 nt, Streptococcus pneumoniae R6
aaugagguaauuaugaaa

SEQ ID NO: 2174165 - RNA, 15 nt, Streptococcus pneumoniae R6
aaugauaacgagggu

SEQ ID NO: 2174166 - RNA, 17 nt, Streptococcus pneumoniae R6
aaugaguccgaaaaauu

SEQ ID NO: 2174167 - RNA, 16 nt, Streptococcus pneumoniae R6
aaugaguuguuuuguc

SEQ ID NO: 2174168 - RNA, 22 nt, Streptococcus pneumoniae R6
aaugacuuucuaauuauuucaa

SEQ ID NO: 2174169 - RNA, 19 nt, Streptococcus pneumoniae R6
aaugacucaaaaacuucuu

SEQ ID NO: 2174170 - RNA, 22 nt, Streptococcus pneumoniae R6
aaugacucccauaaaaauaaua

SEQ ID NO: 2174171 - RNA, 23 nt, Streptococcus pneumoniae R6
aaugacaugcuccucuguaucaa

SEQ ID NO: 2174172 - RNA, 21 nt, Streptococcus pneumoniae R6
aaucuccacgcuccacuuccc

SEQ ID NO: 2174173 - RNA, 13 nt, Streptococcus pneumoniae R6
aaucucaaaacag

SEQ ID NO: 2174174 - RNA, 13 nt, Streptococcus pneumoniae R6
aaucucaaauccu

SEQ ID NO: 2174175 - RNA, 14 nt, Streptococcus pneumoniae R6
aaucucaaauccuu

SEQ ID NO: 2174176 - RNA, 14 nt, Streptococcus pneumoniae R6
aaucuaaaauagua

SEQ ID NO: 2174177 - RNA, 18 nt, Streptococcus pneumoniae R6
aaucguuuaaaacaccuu

SEQ ID NO: 2174178 - RNA, 14 nt, Streptococcus pneumoniae R6
aaucguuucaaaaa

SEQ ID NO: 2174179 - RNA, 17 nt, Streptococcus pneumoniae R6
aaucuaaucauucugaa

SEQ ID NO: 2174180 - RNA, 14 nt, Streptococcus pneumoniae R6
aaucuaaguaacua

SEQ ID NO: 2174181 - RNA, 18 nt, Streptococcus pneumoniae R6
aaucuaacccuaaguguc

SEQ ID NO: 2174182 - RNA, 16 nt, Streptococcus pneumoniae R6
aaucucuuuccacacu

SEQ ID NO: 2174183 - RNA, 20 nt, Streptococcus pneumoniae R6
aaucucuuuccacacuuguu

SEQ ID NO: 2174184 - RNA, 15 nt, Streptococcus pneumoniae R6
aaucucuugaacaua

SEQ ID NO: 2174185 - RNA, 18 nt, Streptococcus pneumoniae R6
aaucugaaauaguacgaa

SEQ ID NO: 2174186 - RNA, 12 nt, Streptococcus pneumoniae R6
aaucugaaaaau

SEQ ID NO: 2174187 - RNA, 14 nt, Streptococcus pneumoniae R6
aaucugaauguuuc

SEQ ID NO: 2174188 - RNA, 17 nt, Streptococcus pneumoniae R6
aaucugaaucaaaauua

SEQ ID NO: 2174189 - RNA, 17 nt, Streptococcus pneumoniae R6
aaucugaugaaccuuca

SEQ ID NO: 2174190 - RNA, 16 nt, Streptococcus pneumoniae R6
aaucucuagccccucu

SEQ ID NO: 2174191 - RNA, 18 nt, Streptococcus pneumoniae R6
aaucucuagccccucuca

SEQ ID NO: 2174192 - RNA, 23 nt, Streptococcus pneumoniae R6
aaucucuagccccucucacacca

SEQ ID NO: 2174193 - RNA, 14 nt, Streptococcus pneumoniae R6
aaucucuucaaacc

SEQ ID NO: 2174194 - RNA, 16 nt, Streptococcus pneumoniae R6
aaucucuucaaaccau

SEQ ID NO: 2174195 - RNA, 18 nt, Streptococcus pneumoniae R6
aaucucuucaaacuacgu

SEQ ID NO: 2174196 - RNA, 24 nt, Streptococcus pneumoniae R6
aaucucuccuuaucaaaaucgaua

SEQ ID NO: 2174197 - RNA, 14 nt, Streptococcus pneumoniae R6
aaucucugauaaua

SEQ ID NO: 2174198 - RNA, 22 nt, Streptococcus pneumoniae R6
aaucgaguaggggauaaucucu

SEQ ID NO: 2174199 - RNA, 20 nt, Streptococcus pneumoniae R6
aaucgagaagauuuccugau

SEQ ID NO: 2174200 - RNA, 17 nt, Streptococcus pneumoniae R6
aaucgaggucuaaaucu

SEQ ID NO: 2174201 - RNA, 14 nt, Streptococcus pneumoniae R6
aauccuuuauuuuc

SEQ ID NO: 2174202 - RNA, 13 nt, Streptococcus pneumoniae R6
aauccuuuucuga

SEQ ID NO: 2174203 - RNA, 16 nt, Streptococcus pneumoniae R6
aaucgaaacuccauaa

SEQ ID NO: 2174204 - RNA, 20 nt, Streptococcus pneumoniae R6
aaucgucuguacaaauccca

SEQ ID NO: 2174205 - RNA, 15 nt, Streptococcus pneumoniae R6
aaucgugaguuccug

SEQ ID NO: 2174206 - RNA, 20 nt, Streptococcus pneumoniae R6
aaucgaucaggacagucaaa

SEQ ID NO: 2174207 - RNA, 21 nt, Streptococcus pneumoniae R6
aaucgaucaggacagucaaau

SEQ ID NO: 2174208 - RNA, 19 nt, Streptococcus pneumoniae R6
aaucgcaagguagagacag

SEQ ID NO: 2174209 - RNA, 21 nt, Streptococcus pneumoniae R6
aaucgauugggaaaguaaaau

SEQ ID NO: 2174210 - RNA, 14 nt, Streptococcus pneumoniae R6
aaucgauuaggaaa

SEQ ID NO: 2174211 - RNA, 15 nt, Streptococcus pneumoniae R6
aaucgauuuguucau

SEQ ID NO: 2174212 - RNA, 21 nt, Streptococcus pneumoniae R6
aaucgauuuguucauaucuua

SEQ ID NO: 2174213 - RNA, 13 nt, Streptococcus pneumoniae R6
aauuaaaguuaau

SEQ ID NO: 2174214 - RNA, 19 nt, Streptococcus pneumoniae R6
aauuaaaaugcaagacaca

SEQ ID NO: 2174215 - RNA, 17 nt, Streptococcus pneumoniae R6
aauuaagaaauuuucuu

SEQ ID NO: 2174216 - RNA, 20 nt, Streptococcus pneumoniae R6
aauuaagugaccuugaugau

SEQ ID NO: 2174217 - RNA, 12 nt, Streptococcus pneumoniae R6
aauuagaaaauu

SEQ ID NO: 2174218 - RNA, 13 nt, Streptococcus pneumoniae R6
aauuagaaaguca

SEQ ID NO: 2174219 - RNA, 22 nt, Streptococcus pneumoniae R6
aauuagaagcggucaaucgcuu

SEQ ID NO: 2174220 - RNA, 12 nt, Streptococcus pneumoniae R6
aauuagaaaaag

SEQ ID NO: 2174221 - RNA, 20 nt, Streptococcus pneumoniae R6
aauuacgauucauaguuacu

SEQ ID NO: 2174222 - RNA, 17 nt, Streptococcus pneumoniae R6
aauuaaucaccuagucc

SEQ ID NO: 2174223 - RNA, 17 nt, Streptococcus pneumoniae R6
aauuacaguuauuuuag

SEQ ID NO: 2174224 - RNA, 21 nt, Streptococcus pneumoniae R6
aauuacaguuauuuuaguaaa

SEQ ID NO: 2174225 - RNA, 23 nt, Streptococcus pneumoniae R6
aauuacaguuauuuuaguaaaaa

SEQ ID NO: 2174226 - RNA, 19 nt, Streptococcus pneumoniae R6
aauguuuuauuacauaagu

SEQ ID NO: 2174227 - RNA, 19 nt, Streptococcus pneumoniae R6
aauguuuucccuuugauag

SEQ ID NO: 2174228 - RNA, 14 nt, Streptococcus pneumoniae R6
aauguuuuagaaau

SEQ ID NO: 2174229 - RNA, 16 nt, Streptococcus pneumoniae R6
aauguuuuagaaauag

SEQ ID NO: 2174230 - RNA, 17 nt, Streptococcus pneumoniae R6
aauuaaaaggcucauaa

SEQ ID NO: 2174231 - RNA, 14 nt, Streptococcus pneumoniae R6
aauuaaaaagagua

SEQ ID NO: 2174232 - RNA, 22 nt, Streptococcus pneumoniae R6
aauguuugcuucauuuuuuccu

SEQ ID NO: 2174233 - RNA, 19 nt, Streptococcus pneumoniae R6
aauguugucaauuuccauu

SEQ ID NO: 2174234 - RNA, 21 nt, Streptococcus pneumoniae R6
aauguugguaagagaaauuuc

SEQ ID NO: 2174235 - RNA, 16 nt, Streptococcus pneumoniae R6
aaugugggaaacagau

SEQ ID NO: 2174236 - RNA, 13 nt, Streptococcus pneumoniae R6
aauguuaugcaac

SEQ ID NO: 2174237 - RNA, 16 nt, Streptococcus pneumoniae R6
aauguuaaccacaaaa

SEQ ID NO: 2174238 - RNA, 16 nt, Streptococcus pneumoniae R6
aaugcucccuucuuua

SEQ ID NO: 2174239 - RNA, 15 nt, Streptococcus pneumoniae R6
aaugcuccaauacaa

SEQ ID NO: 2174240 - RNA, 17 nt, Streptococcus pneumoniae R6
aaugcuaauuuagaaau

SEQ ID NO: 2174241 - RNA, 14 nt, Streptococcus pneumoniae R6
aaugcguucaccag

SEQ ID NO: 2174242 - RNA, 17 nt, Streptococcus pneumoniae R6
aaugcccaauucuugag

SEQ ID NO: 2174243 - RNA, 14 nt, Streptococcus pneumoniae R6
aaugcccaagagac

SEQ ID NO: 2174244 - RNA, 22 nt, Streptococcus pneumoniae R6
aauggcggcauucaagagacuc

SEQ ID NO: 2174245 - RNA, 16 nt, Streptococcus pneumoniae R6
aauggcaaauucuguc

SEQ ID NO: 2174246 - RNA, 20 nt, Streptococcus pneumoniae R6
aauggcaaaaaauugagaaa

SEQ ID NO: 2174247 - RNA, 15 nt, Streptococcus pneumoniae R6
aaugcuguuucuaua

SEQ ID NO: 2174248 - RNA, 15 nt, Streptococcus pneumoniae R6
aauggucuucaugcu

SEQ ID NO: 2174249 - RNA, 17 nt, Streptococcus pneumoniae R6
aaugggcuuuuucuguu

SEQ ID NO: 2174250 - RNA, 21 nt, Streptococcus pneumoniae R6
aaugggcuuuuucuguuuaau

SEQ ID NO: 2174251 - RNA, 16 nt, Streptococcus pneumoniae R6
aaugggauacuaucuc

SEQ ID NO: 2174252 - RNA, 17 nt, Streptococcus pneumoniae R6
aaugggcgcauuuuccu

SEQ ID NO: 2174253 - RNA, 22 nt, Streptococcus pneumoniae R6
aaugguaacagucuuagcaaaa

SEQ ID NO: 2174254 - RNA, 15 nt, Streptococcus pneumoniae R6
aauggucaagaguug

SEQ ID NO: 2174255 - RNA, 19 nt, Streptococcus pneumoniae R6
aaugucuuccaaacgugga

SEQ ID NO: 2174256 - RNA, 16 nt, Streptococcus pneumoniae R6
aauguccauaacugcu

SEQ ID NO: 2174257 - RNA, 16 nt, Streptococcus pneumoniae R6
aaugucgaaccaagag

SEQ ID NO: 2174258 - RNA, 17 nt, Streptococcus pneumoniae R6
aagaccaccucaucuug

SEQ ID NO: 2174259 - RNA, 21 nt, Streptococcus pneumoniae R6
aagacagggccuuagcagacu

SEQ ID NO: 2174260 - RNA, 15 nt, Streptococcus pneumoniae R6
aagacagucugaaaa

SEQ ID NO: 2174261 - RNA, 20 nt, Streptococcus pneumoniae R6
aagacagucugaaaaagagg

SEQ ID NO: 2174262 - RNA, 17 nt, Streptococcus pneumoniae R6
aagacagucugaaaaau

SEQ ID NO: 2174263 - RNA, 20 nt, Streptococcus pneumoniae R6
aagacagucugaaaaauagg

SEQ ID NO: 2174264 - RNA, 23 nt, Streptococcus pneumoniae R6
aagacaucuucucaggcuuuuuc

SEQ ID NO: 2174265 - RNA, 19 nt, Streptococcus pneumoniae R6
aagacaucauauaaauaau

SEQ ID NO: 2174266 - RNA, 15 nt, Streptococcus pneumoniae R6
aagaccaugaggaaa

SEQ ID NO: 2174267 - RNA, 15 nt, Streptococcus pneumoniae R6
aagaccauagcaaag

SEQ ID NO: 2174268 - RNA, 21 nt, Streptococcus pneumoniae R6
aagaccuucuuacguuccaag

SEQ ID NO: 2174269 - RNA, 22 nt, Streptococcus pneumoniae R6
aagaccuuaaacuuguaaguca

SEQ ID NO: 2174270 - RNA, 17 nt, Streptococcus pneumoniae R6
aagacgaaccaaugugc

SEQ ID NO: 2174271 - RNA, 19 nt, Streptococcus pneumoniae R6
aagacgaaccaaugugcag

SEQ ID NO: 2174272 - RNA, 13 nt, Streptococcus pneumoniae R6
aagaauuugaaaa

SEQ ID NO: 2174273 - RNA, 16 nt, Streptococcus pneumoniae R6
aagaauuugaaaaaaa

SEQ ID NO: 2174274 - RNA, 17 nt, Streptococcus pneumoniae R6
aagaauuugaaaaaaau

SEQ ID NO: 2174275 - RNA, 13 nt, Streptococcus pneumoniae R6
aagaauuugauua

SEQ ID NO: 2174276 - RNA, 12 nt, Streptococcus pneumoniae R6
aagaauuuaaaa

SEQ ID NO: 2174277 - RNA, 14 nt, Streptococcus pneumoniae R6
aagaauuuaaaaau

SEQ ID NO: 2174278 - RNA, 19 nt, Streptococcus pneumoniae R6
aagaauuuaaaaaucuauu

SEQ ID NO: 2174279 - RNA, 21 nt, Streptococcus pneumoniae R6
aagaauuuaaaaaucuauuuu

SEQ ID NO: 2174280 - RNA, 22 nt, Streptococcus pneumoniae R6
aagaauucaauugcaggagaaa

SEQ ID NO: 2174281 - RNA, 16 nt, Streptococcus pneumoniae R6
aagacacucaacaagc

SEQ ID NO: 2174282 - RNA, 13 nt, Streptococcus pneumoniae R6
aagacagauuuga

SEQ ID NO: 2174283 - RNA, 13 nt, Streptococcus pneumoniae R6
aagacagcgcugg

SEQ ID NO: 2174284 - RNA, 15 nt, Streptococcus pneumoniae R6
aagacaccaccgaag

SEQ ID NO: 2174285 - RNA, 15 nt, Streptococcus pneumoniae R6
aagaaucccucuuuu

SEQ ID NO: 2174286 - RNA, 16 nt, Streptococcus pneumoniae R6
aagaauccugccaaug

SEQ ID NO: 2174287 - RNA, 18 nt, Streptococcus pneumoniae R6
aagaauaucaagauaaga

SEQ ID NO: 2174288 - RNA, 13 nt, Streptococcus pneumoniae R6
aagaaucuuuucu

SEQ ID NO: 2174289 - RNA, 13 nt, Streptococcus pneumoniae R6
aagaaugagugcu

SEQ ID NO: 2174290 - RNA, 14 nt, Streptococcus pneumoniae R6
aagaaugaaaguuu

SEQ ID NO: 2174291 - RNA, 14 nt, Streptococcus pneumoniae R6
aagaauuaggaaaa

SEQ ID NO: 2174292 - RNA, 18 nt, Streptococcus pneumoniae R6
aagaauuaggaaaacaug

SEQ ID NO: 2174293 - RNA, 22 nt, Streptococcus pneumoniae R6
aagaauggcggcauucaagaga

SEQ ID NO: 2174294 - RNA, 11 nt, Streptococcus pneumoniae R6
aagaauguuuu

SEQ ID NO: 2174295 - RNA, 13 nt, Streptococcus pneumoniae R6
aaauugaacuuuu

SEQ ID NO: 2174296 - RNA, 13 nt, Streptococcus pneumoniae R6
aaauugaaauaag

SEQ ID NO: 2174297 - RNA, 10 nt, Streptococcus pneumoniae R6
aaauucuucc

SEQ ID NO: 2174298 - RNA, 14 nt, Streptococcus pneumoniae R6
aaauucuuuagaaa

SEQ ID NO: 2174299 - RNA, 19 nt, Streptococcus pneumoniae R6
aaauucuuuagaaaacuag

SEQ ID NO: 2174300 - RNA, 21 nt, Streptococcus pneumoniae R6
aaauucuuugaaaucagaaaa

SEQ ID NO: 2174301 - RNA, 22 nt, Streptococcus pneumoniae R6
aaauugauaauagcacuuaaaa

SEQ ID NO: 2174302 - RNA, 14 nt, Streptococcus pneumoniae R6
aaauugauaauagu

SEQ ID NO: 2174303 - RNA, 18 nt, Streptococcus pneumoniae R6
aaauugacuggaauucuc

SEQ ID NO: 2174304 - RNA, 17 nt, Streptococcus pneumoniae R6
aagaaguuuuccuugcc

SEQ ID NO: 2174305 - RNA, 18 nt, Streptococcus pneumoniae R6
aagagaauuaagauaaaa

SEQ ID NO: 2174306 - RNA, 16 nt, Streptococcus pneumoniae R6
aagagaauaacagcca

SEQ ID NO: 2174307 - RNA, 14 nt, Streptococcus pneumoniae R6
aagagaagagagca

SEQ ID NO: 2174308 - RNA, 23 nt, Streptococcus pneumoniae R6
aagacuuuuccuguuguauuuau

SEQ ID NO: 2174309 - RNA, 14 nt, Streptococcus pneumoniae R6
aagacuuuuuaaag

SEQ ID NO: 2174310 - RNA, 17 nt, Streptococcus pneumoniae R6
aagacuuuuauccaccu

SEQ ID NO: 2174311 - RNA, 22 nt, Streptococcus pneumoniae R6
aagacuugaaauacuaaaaaaa

SEQ ID NO: 2174312 - RNA, 21 nt, Streptococcus pneumoniae R6
aagacuugaccggagaaagaa

SEQ ID NO: 2174313 - RNA, 13 nt, Streptococcus pneumoniae R6
aagacuuuaaaaa

SEQ ID NO: 2174314 - RNA, 21 nt, Streptococcus pneumoniae R6
aagacuuguuagcugauuuuu

SEQ ID NO: 2174315 - RNA, 22 nt, Streptococcus pneumoniae R6
aagacuuguuagcugauuuuuu

SEQ ID NO: 2174316 - RNA, 16 nt, Streptococcus pneumoniae R6
aagagauuugacauaa

SEQ ID NO: 2174317 - RNA, 18 nt, Streptococcus pneumoniae R6
aagagauuuucaaagagu

SEQ ID NO: 2174318 - RNA, 24 nt, Streptococcus pneumoniae R6
aagagauuuucgaagaguauaaaa

SEQ ID NO: 2174319 - RNA, 23 nt, Streptococcus pneumoniae R6
aagagauuuucuaagaguauaaa

SEQ ID NO: 2174320 - RNA, 21 nt, Streptococcus pneumoniae R6
aagagauugaugcaaaucuca

SEQ ID NO: 2174321 - RNA, 20 nt, Streptococcus pneumoniae R6
aagagacuucauuacuauca

SEQ ID NO: 2174322 - RNA, 12 nt, Streptococcus pneumoniae R6
aagagaaauuuc

SEQ ID NO: 2174323 - RNA, 19 nt, Streptococcus pneumoniae R6
aagagaccuuucauaaagu

SEQ ID NO: 2174324 - RNA, 16 nt, Streptococcus pneumoniae R6
aagagaggaucagacu

SEQ ID NO: 2174325 - RNA, 12 nt, Streptococcus pneumoniae R6
aagacuuauacu

SEQ ID NO: 2174326 - RNA, 18 nt, Streptococcus pneumoniae R6
aagacuggguguuugcca

SEQ ID NO: 2174327 - RNA, 18 nt, Streptococcus pneumoniae R6
aagacuggugagauaaaa

SEQ ID NO: 2174328 - RNA, 21 nt, Streptococcus pneumoniae R6
aagacuaggugagcaucagga

SEQ ID NO: 2174329 - RNA, 11 nt, Streptococcus pneumoniae R6
aagacuccucu

SEQ ID NO: 2174330 - RNA, 13 nt, Streptococcus pneumoniae R6
aagacugaaaauu

SEQ ID NO: 2174331 - RNA, 20 nt, Streptococcus pneumoniae R6
aagacugacgaagucagcuc

SEQ ID NO: 2174332 - RNA, 21 nt, Streptococcus pneumoniae R6
aagacugacgaagucagcuca

SEQ ID NO: 2174333 - RNA, 17 nt, Streptococcus pneumoniae R6
aagacugaguauuuuau

SEQ ID NO: 2174334 - RNA, 22 nt, Streptococcus pneumoniae R6
aagacucuugcccuuggcuagu

SEQ ID NO: 2174335 - RNA, 19 nt, Streptococcus pneumoniae R6
aagacuagaaaaagcuuca

SEQ ID NO: 2174336 - RNA, 13 nt, Streptococcus pneumoniae R6
aagacuaaguuag

SEQ ID NO: 2174337 - RNA, 15 nt, Streptococcus pneumoniae R6
aagacuaaguuagaa

SEQ ID NO: 2174338 - RNA, 14 nt, Streptococcus pneumoniae R6
aagaguaaacuaga

SEQ ID NO: 2174339 - RNA, 21 nt, Streptococcus pneumoniae R6
aagagggauucuuauauuaaa

SEQ ID NO: 2174340 - RNA, 15 nt, Streptococcus pneumoniae R6
aagagggauuuugua

SEQ ID NO: 2174341 - RNA, 21 nt, Streptococcus pneumoniae R6
aagagggcuucuucaacagcu

SEQ ID NO: 2174342 - RNA, 14 nt, Streptococcus pneumoniae R6
aagagguaaggauu

SEQ ID NO: 2174343 - RNA, 13 nt, Streptococcus pneumoniae R6
aagaggaguagga

SEQ ID NO: 2174344 - RNA, 22 nt, Streptococcus pneumoniae R6
aagaggagugauaaugucguuu

SEQ ID NO: 2174345 - RNA, 13 nt, Streptococcus pneumoniae R6
aagaggagguaaa

SEQ ID NO: 2174346 - RNA, 20 nt, Streptococcus pneumoniae R6
aagaggagguaaaucccaag

SEQ ID NO: 2174347 - RNA, 15 nt, Streptococcus pneumoniae R6
aagagcuucuuucau

SEQ ID NO: 2174348 - RNA, 23 nt, Streptococcus pneumoniae R6
aagagcuugguaagagucacugu

SEQ ID NO: 2174349 - RNA, 18 nt, Streptococcus pneumoniae R6
aagagccuuuuuaaagau

SEQ ID NO: 2174350 - RNA, 17 nt, Streptococcus pneumoniae R6
aagagccgaaaaaauag

SEQ ID NO: 2174351 - RNA, 18 nt, Streptococcus pneumoniae R6
aagagccggaaauugucu

SEQ ID NO: 2174352 - RNA, 13 nt, Streptococcus pneumoniae R6
aagagcacugcua

SEQ ID NO: 2174353 - RNA, 15 nt, Streptococcus pneumoniae R6
aagagccaaaaaaga

SEQ ID NO: 2174354 - RNA, 22 nt, Streptococcus pneumoniae R6
aagauaacaguuuuuaauuuuu

SEQ ID NO: 2174355 - RNA, 16 nt, Streptococcus pneumoniae R6
aagauaauaaauaguu

SEQ ID NO: 2174356 - RNA, 23 nt, Streptococcus pneumoniae R6
aagauaagguucaaaaaaugccu

SEQ ID NO: 2174357 - RNA, 19 nt, Streptococcus pneumoniae R6
aagauaacugcuagaaaug

SEQ ID NO: 2174358 - RNA, 21 nt, Streptococcus pneumoniae R6
aagauaaaauugauaauagca

SEQ ID NO: 2174359 - RNA, 14 nt, Streptococcus pneumoniae R6
aagaguugaggcaa

SEQ ID NO: 2174360 - RNA, 12 nt, Streptococcus pneumoniae R6
aagaguuucaug

SEQ ID NO: 2174361 - RNA, 17 nt, Streptococcus pneumoniae R6
aagaguggauuuucacg

SEQ ID NO: 2174362 - RNA, 17 nt, Streptococcus pneumoniae R6
aagagucuccucaaaaa

SEQ ID NO: 2174363 - RNA, 16 nt, Streptococcus pneumoniae R6
aagaguagagagaaag

SEQ ID NO: 2174364 - RNA, 18 nt, Streptococcus pneumoniae R6
aagaguauaaaaucaaau

SEQ ID NO: 2174365 - RNA, 20 nt, Streptococcus pneumoniae R6
aagaguauaaaaucaaauuu

SEQ ID NO: 2174366 - RNA, 14 nt, Streptococcus pneumoniae R6
aagaguauaaaauu

SEQ ID NO: 2174367 - RNA, 17 nt, Streptococcus pneumoniae R6
aagaguauaagucuuug

SEQ ID NO: 2174368 - RNA, 12 nt, Streptococcus pneumoniae R6
aagaguaacuuc

SEQ ID NO: 2174369 - RNA, 13 nt, Streptococcus pneumoniae R6
aagaguacagucu

SEQ ID NO: 2174370 - RNA, 23 nt, Streptococcus pneumoniae R6
aagagguuggucgauuggcagcc

SEQ ID NO: 2174371 - RNA, 15 nt, Streptococcus pneumoniae R6
aagaguauuaaacaa

SEQ ID NO: 2174372 - RNA, 14 nt, Streptococcus pneumoniae R6
aagaguauuauucu

SEQ ID NO: 2174373 - RNA, 13 nt, Streptococcus pneumoniae R6
aagaguaggcugu

SEQ ID NO: 2174374 - RNA, 19 nt, Streptococcus pneumoniae R6
aagagucagacuuggaaca

SEQ ID NO: 2174375 - RNA, 12 nt, Streptococcus pneumoniae R6
aagagucagcuc

SEQ ID NO: 2174376 - RNA, 23 nt, Streptococcus pneumoniae R6
aagaguccugcccacuaaaaaua

SEQ ID NO: 2174377 - RNA, 18 nt, Streptococcus pneumoniae R6
aagagucccuuagaaaaa

SEQ ID NO: 2174378 - RNA, 19 nt, Streptococcus pneumoniae R6
aagagucccuuagaaaaac

SEQ ID NO: 2174379 - RNA, 17 nt, Streptococcus pneumoniae R6
aagauuuuuggaaaaaa

SEQ ID NO: 2174380 - RNA, 22 nt, Streptococcus pneumoniae R6
aagauuuuuggaaaaaauaaaa

SEQ ID NO: 2174381 - RNA, 21 nt, Streptococcus pneumoniae R6
aagauuuuuuggauucucaaa

SEQ ID NO: 2174382 - RNA, 12 nt, Streptococcus pneumoniae R6
aagcaaaaaaag

SEQ ID NO: 2174383 - RNA, 14 nt, Streptococcus pneumoniae R6
aagcaaaagaacaa

SEQ ID NO: 2174384 - RNA, 15 nt, Streptococcus pneumoniae R6
aagcaaaagaacaag

SEQ ID NO: 2174385 - RNA, 17 nt, Streptococcus pneumoniae R6
aagcaacaaaaacgaua

SEQ ID NO: 2174386 - RNA, 23 nt, Streptococcus pneumoniae R6
aagcaacuaaaaaggaaccaggu

SEQ ID NO: 2174387 - RNA, 16 nt, Streptococcus pneumoniae R6
aagcaacuaaaaucau

SEQ ID NO: 2174388 - RNA, 12 nt, Streptococcus pneumoniae R6
aagcaaaucaaa

SEQ ID NO: 2174389 - RNA, 14 nt, Streptococcus pneumoniae R6
aagcaagacaaaaa

SEQ ID NO: 2174390 - RNA, 13 nt, Streptococcus pneumoniae R6
aagcaauuuugaa

SEQ ID NO: 2174391 - RNA, 16 nt, Streptococcus pneumoniae R6
aagcaauuuugaaaga

SEQ ID NO: 2174392 - RNA, 17 nt, Streptococcus pneumoniae R6
aagcaauuuugaaagau

SEQ ID NO: 2174393 - RNA, 12 nt, Streptococcus pneumoniae R6
aagcagaaaaau

SEQ ID NO: 2174394 - RNA, 13 nt, Streptococcus pneumoniae R6
aagcagaaaaauu

SEQ ID NO: 2174395 - RNA, 17 nt, Streptococcus pneumoniae R6
aagcagaaaaauuucau

SEQ ID NO: 2174396 - RNA, 18 nt, Streptococcus pneumoniae R6
aagcagaaaaauuucauu

SEQ ID NO: 2174397 - RNA, 17 nt, Streptococcus pneumoniae R6
aagcacugauuugaggu

SEQ ID NO: 2174398 - RNA, 17 nt, Streptococcus pneumoniae R6
aagcauuuuuuugauaa

SEQ ID NO: 2174399 - RNA, 14 nt, Streptococcus pneumoniae R6
aagcauaacuaaaa

SEQ ID NO: 2174400 - RNA, 17 nt, Streptococcus pneumoniae R6
aagcauagagaaaaaca

SEQ ID NO: 2174401 - RNA, 19 nt, Streptococcus pneumoniae R6
aagcauagagaaaaacagc

SEQ ID NO: 2174402 - RNA, 15 nt, Streptococcus pneumoniae R6
aagcauauuccacau

SEQ ID NO: 2174403 - RNA, 16 nt, Streptococcus pneumoniae R6
aagcauauuccacauu

SEQ ID NO: 2174404 - RNA, 22 nt, Streptococcus pneumoniae R6
aagcagaugaguguaaaaagaa

SEQ ID NO: 2174405 - RNA, 13 nt, Streptococcus pneumoniae R6
aagauaguaaaga

SEQ ID NO: 2174406 - RNA, 23 nt, Streptococcus pneumoniae R6
aagauaguaaagagcugcugcuu

SEQ ID NO: 2174407 - RNA, 22 nt, Streptococcus pneumoniae R6
aagauaggcgcaaauccgaaaa

SEQ ID NO: 2174408 - RNA, 20 nt, Streptococcus pneumoniae R6
aagauauagcauacugaauu

SEQ ID NO: 2174409 - RNA, 21 nt, Streptococcus pneumoniae R6
aagauauagccuguaaaaagu

SEQ ID NO: 2174410 - RNA, 18 nt, Streptococcus pneumoniae R6
aagauauacuaaaagcga

SEQ ID NO: 2174411 - RNA, 19 nt, Streptococcus pneumoniae R6
aagauagucgauaaaaagg

SEQ ID NO: 2174412 - RNA, 19 nt, Streptococcus pneumoniae R6
aagauauuaagaaucuuuu

SEQ ID NO: 2174413 - RNA, 17 nt, Streptococcus pneumoniae R6
aagauaugaacaaaucg

SEQ ID NO: 2174414 - RNA, 23 nt, Streptococcus pneumoniae R6
aagauacuugauuuuugccauau

SEQ ID NO: 2174415 - RNA, 18 nt, Streptococcus pneumoniae R6
aagauagaacuaugaacu

SEQ ID NO: 2174416 - RNA, 13 nt, Streptococcus pneumoniae R6
aagauagaaucca

SEQ ID NO: 2174417 - RNA, 19 nt, Streptococcus pneumoniae R6
aagauagagaaagaaaaac

SEQ ID NO: 2174418 - RNA, 23 nt, Streptococcus pneumoniae R6
aagauagagaaagaaaaacugcu

SEQ ID NO: 2174419 - RNA, 23 nt, Streptococcus pneumoniae R6
aagauagagagcuccaaagaaga

SEQ ID NO: 2174420 - RNA, 13 nt, Streptococcus pneumoniae R6
aagauaaucaucu

SEQ ID NO: 2174421 - RNA, 19 nt, Streptococcus pneumoniae R6
aagauaaucgcaagguaga

SEQ ID NO: 2174422 - RNA, 23 nt, Streptococcus pneumoniae R6
aagauaauagcgaugaagagaga

SEQ ID NO: 2174423 - RNA, 14 nt, Streptococcus pneumoniae R6
aagauacccacaaa

SEQ ID NO: 2174424 - RNA, 16 nt, Streptococcus pneumoniae R6
aagauccaauccuuuu

SEQ ID NO: 2174425 - RNA, 13 nt, Streptococcus pneumoniae R6
aagaucauuaacu

SEQ ID NO: 2174426 - RNA, 13 nt, Streptococcus pneumoniae R6
aagaucaguucau

SEQ ID NO: 2174427 - RNA, 21 nt, Streptococcus pneumoniae R6
aagaucaguucauuuuuccuu

SEQ ID NO: 2174428 - RNA, 15 nt, Streptococcus pneumoniae R6
aagaucuuuuuauac

SEQ ID NO: 2174429 - RNA, 18 nt, Streptococcus pneumoniae R6
aagaugagacuugcaaga

SEQ ID NO: 2174430 - RNA, 17 nt, Streptococcus pneumoniae R6
aagaugauaucaagaca

SEQ ID NO: 2174431 - RNA, 18 nt, Streptococcus pneumoniae R6
aagaugaugauaacgaau

SEQ ID NO: 2174432 - RNA, 15 nt, Streptococcus pneumoniae R6
aagaugacaucuaaa

SEQ ID NO: 2174433 - RNA, 15 nt, Streptococcus pneumoniae R6
aagaugaccuuaucu

SEQ ID NO: 2174434 - RNA, 14 nt, Streptococcus pneumoniae R6
aagaugcgaacaaa

SEQ ID NO: 2174435 - RNA, 16 nt, Streptococcus pneumoniae R6
aagauguuagaaaaag

SEQ ID NO: 2174436 - RNA, 20 nt, Streptococcus pneumoniae R6
aagauuaaucuucaaauuuu

SEQ ID NO: 2174437 - RNA, 13 nt, Streptococcus pneumoniae R6
aagauguaaaagu

SEQ ID NO: 2174438 - RNA, 17 nt, Streptococcus pneumoniae R6
aagauguaaaaguuuau

SEQ ID NO: 2174439 - RNA, 12 nt, Streptococcus pneumoniae R6
aagauuaugaug

SEQ ID NO: 2174440 - RNA, 14 nt, Streptococcus pneumoniae R6
aagauuaggagaau

SEQ ID NO: 2174441 - RNA, 14 nt, Streptococcus pneumoniae R6
aagauuuguuuuuc

SEQ ID NO: 2174442 - RNA, 20 nt, Streptococcus pneumoniae R6
aagauuuuauccaaucuauu

SEQ ID NO: 2174443 - RNA, 20 nt, Streptococcus pneumoniae R6
aagauuuuccucauuuucua

SEQ ID NO: 2174444 - RNA, 21 nt, Streptococcus pneumoniae R6
aagauuuacuucuuuuucucc

SEQ ID NO: 2174445 - RNA, 14 nt, Streptococcus pneumoniae R6
aagauuucuuucau

SEQ ID NO: 2174446 - RNA, 15 nt, Streptococcus pneumoniae R6
aagauuugaaacuaa

SEQ ID NO: 2174447 - RNA, 14 nt, Streptococcus pneumoniae R6
aauaaaaaagagag

SEQ ID NO: 2174448 - RNA, 16 nt, Streptococcus pneumoniae R6
aaguuuuuugacuucu

SEQ ID NO: 2174449 - RNA, 13 nt, Streptococcus pneumoniae R6
aaguuuuuucucu

SEQ ID NO: 2174450 - RNA, 18 nt, Streptococcus pneumoniae R6
aaguuuuuuaucucgguu

SEQ ID NO: 2174451 - RNA, 13 nt, Streptococcus pneumoniae R6
aauaaaacuuuua

SEQ ID NO: 2174452 - RNA, 22 nt, Streptococcus pneumoniae R6
aauaaaacuuuuaaaauccaua

SEQ ID NO: 2174453 - RNA, 19 nt, Streptococcus pneumoniae R6
aauaaaacgcaucauauca

SEQ ID NO: 2174454 - RNA, 13 nt, Streptococcus pneumoniae R6
aauaaaacaaaaa

SEQ ID NO: 2174455 - RNA, 14 nt, Streptococcus pneumoniae R6
aauaaaacaaaaaa

SEQ ID NO: 2174456 - RNA, 20 nt, Streptococcus pneumoniae R6
aauaaacuugauuaggauuu

SEQ ID NO: 2174457 - RNA, 16 nt, Streptococcus pneumoniae R6
aauaaacuggguugaa

SEQ ID NO: 2174458 - RNA, 17 nt, Streptococcus pneumoniae R6
aauaaacuggguugaag

SEQ ID NO: 2174459 - RNA, 21 nt, Streptococcus pneumoniae R6
aauaaaauuccuuuaaaaaca

SEQ ID NO: 2174460 - RNA, 19 nt, Streptococcus pneumoniae R6
aauaaaauuuuuuucaaau

SEQ ID NO: 2174461 - RNA, 14 nt, Streptococcus pneumoniae R6
aauaaaaugaaaua

SEQ ID NO: 2174462 - RNA, 20 nt, Streptococcus pneumoniae R6
aaguuguaguacugaacaau

SEQ ID NO: 2174463 - RNA, 16 nt, Streptococcus pneumoniae R6
aaguuagacaaauaau

SEQ ID NO: 2174464 - RNA, 14 nt, Streptococcus pneumoniae R6
aaguuagacagaaa

SEQ ID NO: 2174465 - RNA, 18 nt, Streptococcus pneumoniae R6
aaguuagacagaaaaaau

SEQ ID NO: 2174466 - RNA, 19 nt, Streptococcus pneumoniae R6
aaguuagauuuuuucuguc

SEQ ID NO: 2174467 - RNA, 21 nt, Streptococcus pneumoniae R6
aaguucuucucuuuucuuauc

SEQ ID NO: 2174468 - RNA, 17 nt, Streptococcus pneumoniae R6
aaguucuugacgauauu

SEQ ID NO: 2174469 - RNA, 22 nt, Streptococcus pneumoniae R6
aaguucuuccacucaaaucauu

SEQ ID NO: 2174470 - RNA, 12 nt, Streptococcus pneumoniae R6
aaguucuucccc

SEQ ID NO: 2174471 - RNA, 22 nt, Streptococcus pneumoniae R6
aaguucucuuucuaaaauagug

SEQ ID NO: 2174472 - RNA, 14 nt, Streptococcus pneumoniae R6
aaguuuuaggaacu

SEQ ID NO: 2174473 - RNA, 21 nt, Streptococcus pneumoniae R6
aaguuuucaaaguuccgaaaa

SEQ ID NO: 2174474 - RNA, 20 nt, Streptococcus pneumoniae R6
aaguuuuuccaucuuuuauu

SEQ ID NO: 2174475 - RNA, 14 nt, Streptococcus pneumoniae R6
aaguuucuguaauu

SEQ ID NO: 2174476 - RNA, 13 nt, Streptococcus pneumoniae R6
aaguuugcaaagu

SEQ ID NO: 2174477 - RNA, 17 nt, Streptococcus pneumoniae R6
aaguuuggcagacacca

SEQ ID NO: 2174478 - RNA, 20 nt, Streptococcus pneumoniae R6
aaguuuauaaacuuugguua

SEQ ID NO: 2174479 - RNA, 19 nt, Streptococcus pneumoniae R6
aaguuuauaucuaauaauu

SEQ ID NO: 2174480 - RNA, 21 nt, Streptococcus pneumoniae R6
aaguuuaucuagaauuucuuu

SEQ ID NO: 2174481 - RNA, 23 nt, Streptococcus pneumoniae R6
aaguuuccgaauaccugaaacca

SEQ ID NO: 2174482 - RNA, 12 nt, Streptococcus pneumoniae R6
aaguuucgaaaa

SEQ ID NO: 2174483 - RNA, 15 nt, Streptococcus pneumoniae R6
aaguuucgaaaacca

SEQ ID NO: 2174484 - RNA, 13 nt, Streptococcus pneumoniae R6
aagucuagcaauu

SEQ ID NO: 2174485 - RNA, 14 nt, Streptococcus pneumoniae R6
aagucuagcaauuc

SEQ ID NO: 2174486 - RNA, 11 nt, Streptococcus pneumoniae R6
aagucuagcac

SEQ ID NO: 2174487 - RNA, 20 nt, Streptococcus pneumoniae R6
aaguccuacccacugugcuu

SEQ ID NO: 2174488 - RNA, 14 nt, Streptococcus pneumoniae R6
aaguccucccacca

SEQ ID NO: 2174489 - RNA, 13 nt, Streptococcus pneumoniae R6
aagucagcuaagc

SEQ ID NO: 2174490 - RNA, 16 nt, Streptococcus pneumoniae R6
aagucagcuaggcucg

SEQ ID NO: 2174491 - RNA, 17 nt, Streptococcus pneumoniae R6
aagucagcucaaaacac

SEQ ID NO: 2174492 - RNA, 18 nt, Streptococcus pneumoniae R6
aagucagcucaaaacaca

SEQ ID NO: 2174493 - RNA, 21 nt, Streptococcus pneumoniae R6
aagucagcucaaaacacuguu

SEQ ID NO: 2174494 - RNA, 19 nt, Streptococcus pneumoniae R6
aagucagcucaaaacagug

SEQ ID NO: 2174495 - RNA, 17 nt, Streptococcus pneumoniae R6
aagucagcucaaaacau

SEQ ID NO: 2174496 - RNA, 20 nt, Streptococcus pneumoniae R6
aagucagcucaaaacauguu

SEQ ID NO: 2174497 - RNA, 18 nt, Streptococcus pneumoniae R6
aaguccagaaccguucaa

SEQ ID NO: 2174498 - RNA, 21 nt, Streptococcus pneumoniae R6
aaguccauaaugucuucugcu

SEQ ID NO: 2174499 - RNA, 22 nt, Streptococcus pneumoniae R6
aaguccauagcgucaaagaagg

SEQ ID NO: 2174500 - RNA, 23 nt, Streptococcus pneumoniae R6
aaguccauauuagggcaaauaaa

SEQ ID NO: 2174501 - RNA, 14 nt, Streptococcus pneumoniae R6
aaguccgaaaaauu

SEQ ID NO: 2174502 - RNA, 16 nt, Streptococcus pneumoniae R6
aaguauuaaaauaagu

SEQ ID NO: 2174503 - RNA, 17 nt, Streptococcus pneumoniae R6
aaguauuaaucacuaau

SEQ ID NO: 2174504 - RNA, 22 nt, Streptococcus pneumoniae R6
aagucaagccuccaauagcaac

SEQ ID NO: 2174505 - RNA, 13 nt, Streptococcus pneumoniae R6
aagucaacuugaa

SEQ ID NO: 2174506 - RNA, 22 nt, Streptococcus pneumoniae R6
aagguuuuucuuauacaaauaa

SEQ ID NO: 2174507 - RNA, 17 nt, Streptococcus pneumoniae R6
aagguuuuaucugagau

SEQ ID NO: 2174508 - RNA, 13 nt, Streptococcus pneumoniae R6
aaguaagagaaac

SEQ ID NO: 2174509 - RNA, 18 nt, Streptococcus pneumoniae R6
aaguaaguacaugcaaag

SEQ ID NO: 2174510 - RNA, 16 nt, Streptococcus pneumoniae R6
aaguaauaaauaggau

SEQ ID NO: 2174511 - RNA, 23 nt, Streptococcus pneumoniae R6
aagugcuuuugugauuuuaaauu

SEQ ID NO: 2174512 - RNA, 15 nt, Streptococcus pneumoniae R6
aagugcuucuuugua

SEQ ID NO: 2174513 - RNA, 19 nt, Streptococcus pneumoniae R6
aaguggaauucauuuucuu

SEQ ID NO: 2174514 - RNA, 14 nt, Streptococcus pneumoniae R6
aagugggagaaaag

SEQ ID NO: 2174515 - RNA, 22 nt, Streptococcus pneumoniae R6
aagugggcugauuuugaaaaug

SEQ ID NO: 2174516 - RNA, 23 nt, Streptococcus pneumoniae R6
aaguguugaaaacccuugauacu

SEQ ID NO: 2174517 - RNA, 20 nt, Streptococcus pneumoniae R6
aaguguugacaagugaaagu

SEQ ID NO: 2174518 - RNA, 19 nt, Streptococcus pneumoniae R6
aaguguugaccgacuauuu

SEQ ID NO: 2174519 - RNA, 12 nt, Streptococcus pneumoniae R6
aaguuaaaaaaa

SEQ ID NO: 2174520 - RNA, 13 nt, Streptococcus pneumoniae R6
aaguguuuucacu

SEQ ID NO: 2174521 - RNA, 23 nt, Streptococcus pneumoniae R6
aaguguuuaggcaagugucucug

SEQ ID NO: 2174522 - RNA, 16 nt, Streptococcus pneumoniae R6
aaguuaacuuuuccag

SEQ ID NO: 2174523 - RNA, 16 nt, Streptococcus pneumoniae R6
aaguuaaaucuuauau

SEQ ID NO: 2174524 - RNA, 16 nt, Streptococcus pneumoniae R6
aaguuaaauuauuaaa

SEQ ID NO: 2174525 - RNA, 21 nt, Streptococcus pneumoniae R6
aaguuaacuaggcuagcaaau

SEQ ID NO: 2174526 - RNA, 13 nt, Streptococcus pneumoniae R6
aaguuaaaaaacu

SEQ ID NO: 2174527 - RNA, 15 nt, Streptococcus pneumoniae R6
aaguuaaaaauccug

SEQ ID NO: 2174528 - RNA, 16 nt, Streptococcus pneumoniae R6
aaguuacucuauugua

SEQ ID NO: 2174529 - RNA, 16 nt, Streptococcus pneumoniae R6
aaguuacuugauugca

SEQ ID NO: 2174530 - RNA, 13 nt, Streptococcus pneumoniae R6
aaguuagaaauaa

SEQ ID NO: 2174531 - RNA, 14 nt, Streptococcus pneumoniae R6
aaguuagaaauaaa

SEQ ID NO: 2174532 - RNA, 15 nt, Streptococcus pneumoniae R6
aaguuagaaauaaaa

SEQ ID NO: 2174533 - RNA, 13 nt, Streptococcus pneumoniae R6
aaguuagaauaag

SEQ ID NO: 2174534 - RNA, 17 nt, Streptococcus pneumoniae R6
aaguuagaauauguaag

SEQ ID NO: 2174535 - RNA, 17 nt, Streptococcus pneumoniae R6
aagucuuuaaaauuaua

SEQ ID NO: 2174536 - RNA, 20 nt, Streptococcus pneumoniae R6
aagucuucggagaagaaaac

SEQ ID NO: 2174537 - RNA, 21 nt, Streptococcus pneumoniae R6
aagucuugacaaagaaaaaac

SEQ ID NO: 2174538 - RNA, 18 nt, Streptococcus pneumoniae R6
aagucuuuucggauggcu

SEQ ID NO: 2174539 - RNA, 13 nt, Streptococcus pneumoniae R6
aagucuuggaaaa

SEQ ID NO: 2174540 - RNA, 13 nt, Streptococcus pneumoniae R6
aagucuauuauuu

SEQ ID NO: 2174541 - RNA, 23 nt, Streptococcus pneumoniae R6
aagugaacaagccuagucuucug

SEQ ID NO: 2174542 - RNA, 18 nt, Streptococcus pneumoniae R6
aagugauuuaaauguuug

SEQ ID NO: 2174543 - RNA, 18 nt, Streptococcus pneumoniae R6
aagugauuuaaauguuuu

SEQ ID NO: 2174544 - RNA, 19 nt, Streptococcus pneumoniae R6
aagugauuuguuccgauuu

SEQ ID NO: 2174545 - RNA, 13 nt, Streptococcus pneumoniae R6
aagugcucacaga

SEQ ID NO: 2174546 - RNA, 14 nt, Streptococcus pneumoniae R6
aagugcguugauaa

SEQ ID NO: 2174547 - RNA, 16 nt, Streptococcus pneumoniae R6
aagugcguugauaauc

SEQ ID NO: 2174548 - RNA, 18 nt, Streptococcus pneumoniae R6
aagcuagucgcagguugc

SEQ ID NO: 2174549 - RNA, 17 nt, Streptococcus pneumoniae R6
aagcuagcaacagauga

SEQ ID NO: 2174550 - RNA, 21 nt, Streptococcus pneumoniae R6
aagcuagcaauuuguggaaaa

SEQ ID NO: 2174551 - RNA, 20 nt, Streptococcus pneumoniae R6
aagcuagccguagguugcuc

SEQ ID NO: 2174552 - RNA, 18 nt, Streptococcus pneumoniae R6
aagcuagguccaagcgga

SEQ ID NO: 2174553 - RNA, 13 nt, Streptococcus pneumoniae R6
aagcguguaggaa

SEQ ID NO: 2174554 - RNA, 13 nt, Streptococcus pneumoniae R6
aagcgugagauuu

SEQ ID NO: 2174555 - RNA, 14 nt, Streptococcus pneumoniae R6
aagcuccuaaauca

SEQ ID NO: 2174556 - RNA, 14 nt, Streptococcus pneumoniae R6
aagcuacuauaaaa

SEQ ID NO: 2174557 - RNA, 14 nt, Streptococcus pneumoniae R6
aagcucgagaaagg

SEQ ID NO: 2174558 - RNA, 15 nt, Streptococcus pneumoniae R6
aagcucgagaaagga

SEQ ID NO: 2174559 - RNA, 22 nt, Streptococcus pneumoniae R6
aagcucgagaaaggacaaauuu

SEQ ID NO: 2174560 - RNA, 23 nt, Streptococcus pneumoniae R6
aagcucgagaaaggggcucuuug

SEQ ID NO: 2174561 - RNA, 17 nt, Streptococcus pneumoniae R6
aagcucgauaaaggaca

SEQ ID NO: 2174562 - RNA, 17 nt, Streptococcus pneumoniae R6
aagcucguucaaccguu

SEQ ID NO: 2174563 - RNA, 16 nt, Streptococcus pneumoniae R6
aagcgcuggaacuugu

SEQ ID NO: 2174564 - RNA, 21 nt, Streptococcus pneumoniae R6
aagccaagaguagagagaaag

SEQ ID NO: 2174565 - RNA, 12 nt, Streptococcus pneumoniae R6
aagccaaaucaa

SEQ ID NO: 2174566 - RNA, 13 nt, Streptococcus pneumoniae R6
aagccaaaucaau

SEQ ID NO: 2174567 - RNA, 14 nt, Streptococcus pneumoniae R6
aagccaaaucaauu

SEQ ID NO: 2174568 - RNA, 16 nt, Streptococcus pneumoniae R6
aagcggaugaaccguu

SEQ ID NO: 2174569 - RNA, 14 nt, Streptococcus pneumoniae R6
aaggaagauguaaa

SEQ ID NO: 2174570 - RNA, 16 nt, Streptococcus pneumoniae R6
aaggaaugccaaagac

SEQ ID NO: 2174571 - RNA, 17 nt, Streptococcus pneumoniae R6
aaggaaguugaguucag

SEQ ID NO: 2174572 - RNA, 14 nt, Streptococcus pneumoniae R6
aaggaagucuuguu

SEQ ID NO: 2174573 - RNA, 17 nt, Streptococcus pneumoniae R6
aaggauaugaggagaaa

SEQ ID NO: 2174574 - RNA, 21 nt, Streptococcus pneumoniae R6
aaggauagcuccuccaagucc

SEQ ID NO: 2174575 - RNA, 16 nt, Streptococcus pneumoniae R6
aaggauuguaggugua

SEQ ID NO: 2174576 - RNA, 13 nt, Streptococcus pneumoniae R6
aaggauaaaaagu

SEQ ID NO: 2174577 - RNA, 15 nt, Streptococcus pneumoniae R6
aaggauaaaaagucc

SEQ ID NO: 2174578 - RNA, 17 nt, Streptococcus pneumoniae R6
aaggaauuuuagaaggu

SEQ ID NO: 2174579 - RNA, 22 nt, Streptococcus pneumoniae R6
aaggacaaauuucguccuuucu

SEQ ID NO: 2174580 - RNA, 17 nt, Streptococcus pneumoniae R6
aaggagccagcugaaaa

SEQ ID NO: 2174581 - RNA, 22 nt, Streptococcus pneumoniae R6
aaggaguugucuauaguuaaau

SEQ ID NO: 2174582 - RNA, 20 nt, Streptococcus pneumoniae R6
aaggaggauuggguaaaucu

SEQ ID NO: 2174583 - RNA, 13 nt, Streptococcus pneumoniae R6
aaggaguagaaaa

SEQ ID NO: 2174584 - RNA, 16 nt, Streptococcus pneumoniae R6
aagcugucaagaaauu

SEQ ID NO: 2174585 - RNA, 15 nt, Streptococcus pneumoniae R6
aagcugccccaccug

SEQ ID NO: 2174586 - RNA, 18 nt, Streptococcus pneumoniae R6
aagcuguuaaaaacucag

SEQ ID NO: 2174587 - RNA, 20 nt, Streptococcus pneumoniae R6
aagcuuuauugucucuaaaa

SEQ ID NO: 2174588 - RNA, 23 nt, Streptococcus pneumoniae R6
aagcuuuauugucucuaaaaaua

SEQ ID NO: 2174589 - RNA, 21 nt, Streptococcus pneumoniae R6
aagcuuguuuaaaaucucuuu

SEQ ID NO: 2174590 - RNA, 22 nt, Streptococcus pneumoniae R6
aagcuuguuuaaaaucucuuua

SEQ ID NO: 2174591 - RNA, 15 nt, Streptococcus pneumoniae R6
aagcuugugaaagcu

SEQ ID NO: 2174592 - RNA, 19 nt, Streptococcus pneumoniae R6
aagguagagacagaagaua

SEQ ID NO: 2174593 - RNA, 15 nt, Streptococcus pneumoniae R6
aagguaauugaagag

SEQ ID NO: 2174594 - RNA, 12 nt, Streptococcus pneumoniae R6
aagguaauccaa

SEQ ID NO: 2174595 - RNA, 22 nt, Streptococcus pneumoniae R6
aagguaauccaauugaggaagu

SEQ ID NO: 2174596 - RNA, 16 nt, Streptococcus pneumoniae R6
aagguaaaaccaauau

SEQ ID NO: 2174597 - RNA, 13 nt, Streptococcus pneumoniae R6
aaggcuuuaccaa

SEQ ID NO: 2174598 - RNA, 21 nt, Streptococcus pneumoniae R6
aaggcugcgcaacacacuguu

SEQ ID NO: 2174599 - RNA, 16 nt, Streptococcus pneumoniae R6
aagguuuuaccuucaa

SEQ ID NO: 2174600 - RNA, 20 nt, Streptococcus pneumoniae R6
aagguuuccugcaugaaggu

SEQ ID NO: 2174601 - RNA, 21 nt, Streptococcus pneumoniae R6
aagguuuggauugauugagaa

SEQ ID NO: 2174602 - RNA, 15 nt, Streptococcus pneumoniae R6
aagguuuuaaacaaa

SEQ ID NO: 2174603 - RNA, 14 nt, Streptococcus pneumoniae R6
aagguuauuuggau

SEQ ID NO: 2174604 - RNA, 17 nt, Streptococcus pneumoniae R6
aagguucauggcaugga

SEQ ID NO: 2174605 - RNA, 16 nt, Streptococcus pneumoniae R6
aagguucaaucauuuu

SEQ ID NO: 2174606 - RNA, 19 nt, Streptococcus pneumoniae R6
aagguucaaucauuuugua

SEQ ID NO: 2174607 - RNA, 19 nt, Streptococcus pneumoniae R6
aagguugaugaguaaguuu

SEQ ID NO: 2174608 - RNA, 19 nt, Streptococcus pneumoniae R6
aaggugagggcugagaagg

SEQ ID NO: 2174609 - RNA, 22 nt, Streptococcus pneumoniae R6
aaggucuuuugucuugcuugcu

SEQ ID NO: 2174610 - RNA, 13 nt, Streptococcus pneumoniae R6
aaggcgaugcuga

SEQ ID NO: 2174611 - RNA, 14 nt, Streptococcus pneumoniae R6
aaggcgaugcugac

SEQ ID NO: 2174612 - RNA, 23 nt, Streptococcus pneumoniae R6
aaggcccccuuguaguucucaau

SEQ ID NO: 2174613 - RNA, 14 nt, Streptococcus pneumoniae R6
aaggcaauuaaaag

SEQ ID NO: 2174614 - RNA, 19 nt, Streptococcus pneumoniae R6
aaggauuucuuugaaaucu

SEQ ID NO: 2174615 - RNA, 23 nt, Streptococcus pneumoniae R6
aaggcauucucgugaaauuuuag

SEQ ID NO: 2174616 - RNA, 14 nt, Streptococcus pneumoniae R6
aaggcauuuuuugu

SEQ ID NO: 2174617 - RNA, 22 nt, Streptococcus pneumoniae R6
aaggcaucuugucaaagaguug

SEQ ID NO: 2174618 - RNA, 18 nt, Streptococcus pneumoniae R6
aaggcaucuuaacauucu

SEQ ID NO: 2174619 - RNA, 17 nt, Streptococcus pneumoniae R6
aaggcagauucucuauc

SEQ ID NO: 2174620 - RNA, 15 nt, Streptococcus pneumoniae R6
aaggcaucaucugaa

SEQ ID NO: 2174621 - RNA, 20 nt, Streptococcus pneumoniae R6
aaggcaucacgaaaauauuu

SEQ ID NO: 2174622 - RNA, 23 nt, Streptococcus pneumoniae R6
acaaaucgauugggaaaguaaaa

SEQ ID NO: 2174623 - RNA, 15 nt, Streptococcus pneumoniae R6
acaaaucagaaaagu

SEQ ID NO: 2174624 - RNA, 19 nt, Streptococcus pneumoniae R6
acaaaucagaaaaguaacu

SEQ ID NO: 2174625 - RNA, 22 nt, Streptococcus pneumoniae R6
acaaaucagaaaaguaacuauu

SEQ ID NO: 2174626 - RNA, 15 nt, Streptococcus pneumoniae R6
acaaauccaaucuuc

SEQ ID NO: 2174627 - RNA, 14 nt, Streptococcus pneumoniae R6
acaaauaaaucauu

SEQ ID NO: 2174628 - RNA, 16 nt, Streptococcus pneumoniae R6
acaacaccgacagcaa

SEQ ID NO: 2174629 - RNA, 20 nt, Streptococcus pneumoniae R6
acaacaccaucauagucuuu

SEQ ID NO: 2174630 - RNA, 19 nt, Streptococcus pneumoniae R6
acaaauuucguccuuucuu

SEQ ID NO: 2174631 - RNA, 18 nt, Streptococcus pneumoniae R6
acaaauucaaacucaaau

SEQ ID NO: 2174632 - RNA, 23 nt, Streptococcus pneumoniae R6
acaaauucgacugccucucuucu

SEQ ID NO: 2174633 - RNA, 19 nt, Streptococcus pneumoniae R6
acaaauugauuugaauucc

SEQ ID NO: 2174634 - RNA, 18 nt, Streptococcus pneumoniae R6
acaaauuuauacuaauac

SEQ ID NO: 2174635 - RNA, 19 nt, Streptococcus pneumoniae R6
acaaauuuauacuaauaca

SEQ ID NO: 2174636 - RNA, 17 nt, Streptococcus pneumoniae R6
acaaauguugaaucauu

SEQ ID NO: 2174637 - RNA, 13 nt, Streptococcus pneumoniae R6
acaaauguuuuag

SEQ ID NO: 2174638 - RNA, 16 nt, Streptococcus pneumoniae R6
acaaauguuuuagcaa

SEQ ID NO: 2174639 - RNA, 18 nt, Streptococcus pneumoniae R6
acaaauguuuuagcaauc

SEQ ID NO: 2174640 - RNA, 16 nt, Streptococcus pneumoniae R6
acaaagucugaaacag

SEQ ID NO: 2174641 - RNA, 14 nt, Streptococcus pneumoniae R6
acaaaguauuuuuu

SEQ ID NO: 2174642 - RNA, 22 nt, Streptococcus pneumoniae R6
acaaaguggagguguucuauca

SEQ ID NO: 2174643 - RNA, 14 nt, Streptococcus pneumoniae R6
acaaaguuugaaaa

SEQ ID NO: 2174644 - RNA, 15 nt, Streptococcus pneumoniae R6
acaaaguuugaaaag

SEQ ID NO: 2174645 - RNA, 23 nt, Streptococcus pneumoniae R6
acaaagggaugauguuaucaaau

SEQ ID NO: 2174646 - RNA, 11 nt, Streptococcus pneumoniae R6
acaaaggauuu

SEQ ID NO: 2174647 - RNA, 18 nt, Streptococcus pneumoniae R6
acaaaggucaaaauuccu

SEQ ID NO: 2174648 - RNA, 22 nt, Streptococcus pneumoniae R6
acaaaggucaaaauuccuaaaa

SEQ ID NO: 2174649 - RNA, 14 nt, Streptococcus pneumoniae R6
acaaaguauuaaaa

SEQ ID NO: 2174650 - RNA, 17 nt, Streptococcus pneumoniae R6
acaaaguauuaaaauaa

SEQ ID NO: 2174651 - RNA, 19 nt, Streptococcus pneumoniae R6
acaaaguauuaaaauaagu

SEQ ID NO: 2174652 - RNA, 12 nt, Streptococcus pneumoniae R6
acaaagauaaaa

SEQ ID NO: 2174653 - RNA, 18 nt, Streptococcus pneumoniae R6
acaaagauaaaauugaua

SEQ ID NO: 2174654 - RNA, 15 nt, Streptococcus pneumoniae R6
acaaagagauugccc

SEQ ID NO: 2174655 - RNA, 17 nt, Streptococcus pneumoniae R6
acaaagagccaaaaaag

SEQ ID NO: 2174656 - RNA, 14 nt, Streptococcus pneumoniae R6
acaaagagccauaa

SEQ ID NO: 2174657 - RNA, 17 nt, Streptococcus pneumoniae R6
acaaagagccauaaaaa

SEQ ID NO: 2174658 - RNA, 18 nt, Streptococcus pneumoniae R6
acaaagagccauaaaaau

SEQ ID NO: 2174659 - RNA, 20 nt, Streptococcus pneumoniae R6
acaaagagccauaaaaauaa

SEQ ID NO: 2174660 - RNA, 22 nt, Streptococcus pneumoniae R6
acaaagagccauaaaaauaacu

SEQ ID NO: 2174661 - RNA, 17 nt, Streptococcus pneumoniae R6
acaaagagccccuuucu

SEQ ID NO: 2174662 - RNA, 17 nt, Streptococcus pneumoniae R6
acaaagagccgaaaaaa

SEQ ID NO: 2174663 - RNA, 18 nt, Streptococcus pneumoniae R6
acaaagagccgaaaaaau

SEQ ID NO: 2174664 - RNA, 18 nt, Streptococcus pneumoniae R6
acaaagcuaagaaaguaa

SEQ ID NO: 2174665 - RNA, 18 nt, Streptococcus pneumoniae R6
acaaagaacaugaaagau

SEQ ID NO: 2174666 - RNA, 17 nt, Streptococcus pneumoniae R6
acaaagaccuuugaaaa

SEQ ID NO: 2174667 - RNA, 21 nt, Streptococcus pneumoniae R6
acaaagaccuuugaaaacuga

SEQ ID NO: 2174668 - RNA, 14 nt, Streptococcus pneumoniae R6
acaaagaauaaaau

SEQ ID NO: 2174669 - RNA, 12 nt, Streptococcus pneumoniae R6
acaaagaaaaaa

SEQ ID NO: 2174670 - RNA, 14 nt, Streptococcus pneumoniae R6
acaaagaaaaaaca

SEQ ID NO: 2174671 - RNA, 15 nt, Streptococcus pneumoniae R6
acaaagaaaaaacaa

SEQ ID NO: 2174672 - RNA, 21 nt, Streptococcus pneumoniae R6
acaaagaaaaaacaaaguauu

SEQ ID NO: 2174673 - RNA, 15 nt, Streptococcus pneumoniae R6
acaaagaaaaagaag

SEQ ID NO: 2174674 - RNA, 16 nt, Streptococcus pneumoniae R6
acaaacuccucuccag

SEQ ID NO: 2174675 - RNA, 15 nt, Streptococcus pneumoniae R6
acaagaccucaauau

SEQ ID NO: 2174676 - RNA, 17 nt, Streptococcus pneumoniae R6
acaagacgaaccaaugu

SEQ ID NO: 2174677 - RNA, 20 nt, Streptococcus pneumoniae R6
acaagacgaaccaaugugca

SEQ ID NO: 2174678 - RNA, 17 nt, Streptococcus pneumoniae R6
acaagccuuuaucugcc

SEQ ID NO: 2174679 - RNA, 14 nt, Streptococcus pneumoniae R6
acaagaacagucuc

SEQ ID NO: 2174680 - RNA, 13 nt, Streptococcus pneumoniae R6
acaacuuaaaaag

SEQ ID NO: 2174681 - RNA, 14 nt, Streptococcus pneumoniae R6
acaacuuaaaaaga

SEQ ID NO: 2174682 - RNA, 15 nt, Streptococcus pneumoniae R6
acaacuuaaaaagag

SEQ ID NO: 2174683 - RNA, 17 nt, Streptococcus pneumoniae R6
acaacuuaaaaagaggu

SEQ ID NO: 2174684 - RNA, 16 nt, Streptococcus pneumoniae R6
acaacugauucuacuu

SEQ ID NO: 2174685 - RNA, 23 nt, Streptococcus pneumoniae R6
acaacugauucuacuuuuucaaa

SEQ ID NO: 2174686 - RNA, 17 nt, Streptococcus pneumoniae R6
acaacuaacaauuaugc

SEQ ID NO: 2174687 - RNA, 14 nt, Streptococcus pneumoniae R6
acaaccuuaaaaca

SEQ ID NO: 2174688 - RNA, 22 nt, Streptococcus pneumoniae R6
acaaccuuaaaacgguguuuug

SEQ ID NO: 2174689 - RNA, 22 nt, Streptococcus pneumoniae R6
acaaccucaaaacaauguuuug

SEQ ID NO: 2174690 - RNA, 16 nt, Streptococcus pneumoniae R6
acaaccucaaaacagu

SEQ ID NO: 2174691 - RNA, 14 nt, Streptococcus pneumoniae R6
acaaccgauaagaa

SEQ ID NO: 2174692 - RNA, 16 nt, Streptococcus pneumoniae R6
acaacgucuuuugccu

SEQ ID NO: 2174693 - RNA, 16 nt, Streptococcus pneumoniae R6
acaacaggaaaagucu

SEQ ID NO: 2174694 - RNA, 14 nt, Streptococcus pneumoniae R6
acaacagcuacacc

SEQ ID NO: 2174695 - RNA, 21 nt, Streptococcus pneumoniae R6
acaacauggcuuccaggaaug

SEQ ID NO: 2174696 - RNA, 23 nt, Streptococcus pneumoniae R6
acaaccaauuucuuaauagcuga

SEQ ID NO: 2174697 - RNA, 16 nt, Streptococcus pneumoniae R6
aauuuugaggauaaaa

SEQ ID NO: 2174698 - RNA, 17 nt, Streptococcus pneumoniae R6
aauuuugagucguucuc

SEQ ID NO: 2174699 - RNA, 15 nt, Streptococcus pneumoniae R6
aauuuucuuuuuccu

SEQ ID NO: 2174700 - RNA, 14 nt, Streptococcus pneumoniae R6
aauuuugucucuga

SEQ ID NO: 2174701 - RNA, 16 nt, Streptococcus pneumoniae R6
aauuuucuguggauac

SEQ ID NO: 2174702 - RNA, 18 nt, Streptococcus pneumoniae R6
aauuuucaaaaucagaaa

SEQ ID NO: 2174703 - RNA, 19 nt, Streptococcus pneumoniae R6
aauuuucaaaaucagaaaa

SEQ ID NO: 2174704 - RNA, 17 nt, Streptococcus pneumoniae R6
aauuuuauuuucugaua

SEQ ID NO: 2174705 - RNA, 18 nt, Streptococcus pneumoniae R6
aauuuuuuucuaauuaaa

SEQ ID NO: 2174706 - RNA, 15 nt, Streptococcus pneumoniae R6
acaaaaaaaacaccc

SEQ ID NO: 2174707 - RNA, 24 nt, Streptococcus pneumoniae R6
aauuuuuuggcuaaaaagcuacua

SEQ ID NO: 2174708 - RNA, 21 nt, Streptococcus pneumoniae R6
aauuuuuuucaaauucuuuag

SEQ ID NO: 2174709 - RNA, 14 nt, Streptococcus pneumoniae R6
aauuuuuuauagac

SEQ ID NO: 2174710 - RNA, 17 nt, Streptococcus pneumoniae R6
aauuuuuugagcaaguu

SEQ ID NO: 2174711 - RNA, 18 nt, Streptococcus pneumoniae R6
aauuuuuugagcaauaau

SEQ ID NO: 2174712 - RNA, 15 nt, Streptococcus pneumoniae R6
aauuuuuaugggaau

SEQ ID NO: 2174713 - RNA, 12 nt, Streptococcus pneumoniae R6
aauuuuuccuuu

SEQ ID NO: 2174714 - RNA, 15 nt, Streptococcus pneumoniae R6
aauuuuucauuuaau

SEQ ID NO: 2174715 - RNA, 18 nt, Streptococcus pneumoniae R6
aauuuuucugcuucuuuu

SEQ ID NO: 2174716 - RNA, 22 nt, Streptococcus pneumoniae R6
aauuuuugagccguuucuuugg

SEQ ID NO: 2174717 - RNA, 16 nt, Streptococcus pneumoniae R6
acaaaaacucaauuuc

SEQ ID NO: 2174718 - RNA, 15 nt, Streptococcus pneumoniae R6
acaaaacuuuuuaaa

SEQ ID NO: 2174719 - RNA, 16 nt, Streptococcus pneumoniae R6
acaaaacuuuuuaaaa

SEQ ID NO: 2174720 - RNA, 16 nt, Streptococcus pneumoniae R6
acaaaacuggcaaaau

SEQ ID NO: 2174721 - RNA, 20 nt, Streptococcus pneumoniae R6
acaaaacuguaaaguagcaa

SEQ ID NO: 2174722 - RNA, 17 nt, Streptococcus pneumoniae R6
acaaaagagaaagacuu

SEQ ID NO: 2174723 - RNA, 19 nt, Streptococcus pneumoniae R6
acaaaagagaaagacuuga

SEQ ID NO: 2174724 - RNA, 15 nt, Streptococcus pneumoniae R6
acaaaagauaagaua

SEQ ID NO: 2174725 - RNA, 15 nt, Streptococcus pneumoniae R6
acaaaagcacucaau

SEQ ID NO: 2174726 - RNA, 17 nt, Streptococcus pneumoniae R6
acaaaaacgauaaaagc

SEQ ID NO: 2174727 - RNA, 20 nt, Streptococcus pneumoniae R6
acaaaaacgauaaaagcuaa

SEQ ID NO: 2174728 - RNA, 21 nt, Streptococcus pneumoniae R6
acaaaaaaucuagucaucaga

SEQ ID NO: 2174729 - RNA, 19 nt, Streptococcus pneumoniae R6
acaaaaaaggucaucagca

SEQ ID NO: 2174730 - RNA, 12 nt, Streptococcus pneumoniae R6
acaaaaaagcca

SEQ ID NO: 2174731 - RNA, 23 nt, Streptococcus pneumoniae R6
acaaaaaagagguugucuguaac

SEQ ID NO: 2174732 - RNA, 15 nt, Streptococcus pneumoniae R6
acaaaaucuuaaaaa

SEQ ID NO: 2174733 - RNA, 22 nt, Streptococcus pneumoniae R6
acaaaauaggcuccauaauauc

SEQ ID NO: 2174734 - RNA, 18 nt, Streptococcus pneumoniae R6
acaaaaguugaccaacua

SEQ ID NO: 2174735 - RNA, 20 nt, Streptococcus pneumoniae R6
acaaaauaaaaacaucuacc

SEQ ID NO: 2174736 - RNA, 23 nt, Streptococcus pneumoniae R6
acaaaagcgaccguauuuuuguu

SEQ ID NO: 2174737 - RNA, 16 nt, Streptococcus pneumoniae R6
acaaaagguucuuuua

SEQ ID NO: 2174738 - RNA, 19 nt, Streptococcus pneumoniae R6
acaaaauucguccuuucuu

SEQ ID NO: 2174739 - RNA, 12 nt, Streptococcus pneumoniae R6
acaaaauugaua

SEQ ID NO: 2174740 - RNA, 16 nt, Streptococcus pneumoniae R6
acaaaauuauuaaaau

SEQ ID NO: 2174741 - RNA, 21 nt, Streptococcus pneumoniae R6
acaaaauuauuaaaaucaaaa

SEQ ID NO: 2174742 - RNA, 14 nt, Streptococcus pneumoniae R6
acaaaauuugguuu

SEQ ID NO: 2174743 - RNA, 20 nt, Streptococcus pneumoniae R6
acaaacaaauccaaucuucu

SEQ ID NO: 2174744 - RNA, 23 nt, Streptococcus pneumoniae R6
aauuugguuuuuggcaauuuuug

SEQ ID NO: 2174745 - RNA, 16 nt, Streptococcus pneumoniae R6
aauuuguaaaguuaau

SEQ ID NO: 2174746 - RNA, 17 nt, Streptococcus pneumoniae R6
aauuuggcguuugaaua

SEQ ID NO: 2174747 - RNA, 14 nt, Streptococcus pneumoniae R6
aauuuggaaaauag

SEQ ID NO: 2174748 - RNA, 17 nt, Streptococcus pneumoniae R6
aauuugcacuuugauuu

SEQ ID NO: 2174749 - RNA, 18 nt, Streptococcus pneumoniae R6
aauuugcuacaaauagug

SEQ ID NO: 2174750 - RNA, 15 nt, Streptococcus pneumoniae R6
aauuugaaacaauga

SEQ ID NO: 2174751 - RNA, 19 nt, Streptococcus pneumoniae R6
aauuucuuuuuguguuaaa

SEQ ID NO: 2174752 - RNA, 17 nt, Streptococcus pneumoniae R6
aauuucuuuucauucca

SEQ ID NO: 2174753 - RNA, 21 nt, Streptococcus pneumoniae R6
aauuugaccauuucaaccuug

SEQ ID NO: 2174754 - RNA, 13 nt, Streptococcus pneumoniae R6
aauuugaacaaag

SEQ ID NO: 2174755 - RNA, 21 nt, Streptococcus pneumoniae R6
aauuugaacaaaguucaaagc

SEQ ID NO: 2174756 - RNA, 19 nt, Streptococcus pneumoniae R6
aauuugauuauuuuugaaa

SEQ ID NO: 2174757 - RNA, 16 nt, Streptococcus pneumoniae R6
aauuugaguaaaagac

SEQ ID NO: 2174758 - RNA, 13 nt, Streptococcus pneumoniae R6
aauuugaugauuu

SEQ ID NO: 2174759 - RNA, 18 nt, Streptococcus pneumoniae R6
aauuugauauauaaauga

SEQ ID NO: 2174760 - RNA, 19 nt, Streptococcus pneumoniae R6
aauuugauauauaaaugaa

SEQ ID NO: 2174761 - RNA, 19 nt, Streptococcus pneumoniae R6
aauuuuagugaguccaaaa

SEQ ID NO: 2174762 - RNA, 16 nt, Streptococcus pneumoniae R6
aauuuuaguagaaaau

SEQ ID NO: 2174763 - RNA, 16 nt, Streptococcus pneumoniae R6
aauuuuaucuuugaaa

SEQ ID NO: 2174764 - RNA, 18 nt, Streptococcus pneumoniae R6
aauuuuaucuuugaaaua

SEQ ID NO: 2174765 - RNA, 16 nt, Streptococcus pneumoniae R6
aauuuuagaacuguaa

SEQ ID NO: 2174766 - RNA, 17 nt, Streptococcus pneumoniae R6
aauuuuacuucuucccc

SEQ ID NO: 2174767 - RNA, 21 nt, Streptococcus pneumoniae R6
aauuucuuuauauaaaaagac

SEQ ID NO: 2174768 - RNA, 18 nt, Streptococcus pneumoniae R6
aauuucucaaaaaaguua

SEQ ID NO: 2174769 - RNA, 15 nt, Streptococcus pneumoniae R6
aauuucuaugauaaa

SEQ ID NO: 2174770 - RNA, 17 nt, Streptococcus pneumoniae R6
aauuucucuacaaauaa

SEQ ID NO: 2174771 - RNA, 18 nt, Streptococcus pneumoniae R6
aauuucucuacaaauaag

SEQ ID NO: 2174772 - RNA, 23 nt, Streptococcus pneumoniae R6
aauuucuagcaaaguuuuaggaa

SEQ ID NO: 2174773 - RNA, 17 nt, Streptococcus pneumoniae R6
aauuucuauaaauguuu

SEQ ID NO: 2174774 - RNA, 20 nt, Streptococcus pneumoniae R6
aauuucuauaaauguuuuag

SEQ ID NO: 2174775 - RNA, 12 nt, Streptococcus pneumoniae R6
aauuucuaaugu

SEQ ID NO: 2174776 - RNA, 15 nt, Streptococcus pneumoniae R6
aauuucgcuguuaaa

SEQ ID NO: 2174777 - RNA, 22 nt, Streptococcus pneumoniae R6
aauuucauuaaauggaauagua

SEQ ID NO: 2174778 - RNA, 13 nt, Streptococcus pneumoniae R6
aauuucauuacua

SEQ ID NO: 2174779 - RNA, 20 nt, Streptococcus pneumoniae R6
aauuucaugguucgggauaa

SEQ ID NO: 2174780 - RNA, 12 nt, Streptococcus pneumoniae R6
aauuucauuucu

SEQ ID NO: 2174781 - RNA, 21 nt, Streptococcus pneumoniae R6
aauuucaugacagauucauca

SEQ ID NO: 2174782 - RNA, 17 nt, Streptococcus pneumoniae R6
aauuauacucuuagaaa

SEQ ID NO: 2174783 - RNA, 17 nt, Streptococcus pneumoniae R6
aauuauagacacauucg

SEQ ID NO: 2174784 - RNA, 14 nt, Streptococcus pneumoniae R6
aauuauaaaaccau

SEQ ID NO: 2174785 - RNA, 16 nt, Streptococcus pneumoniae R6
aauuauaaaaccauua

SEQ ID NO: 2174786 - RNA, 20 nt, Streptococcus pneumoniae R6
aauuauaaaaccauuauuag

SEQ ID NO: 2174787 - RNA, 14 nt, Streptococcus pneumoniae R6
aauuaguucagaau

SEQ ID NO: 2174788 - RNA, 20 nt, Streptococcus pneumoniae R6
acaauuuccggcucuuuguc

SEQ ID NO: 2174789 - RNA, 21 nt, Streptococcus pneumoniae R6
acaauugcuaaaacauuuaua

SEQ ID NO: 2174790 - RNA, 14 nt, Streptococcus pneumoniae R6
acaauuguaaaaag

SEQ ID NO: 2174791 - RNA, 15 nt, Streptococcus pneumoniae R6
acaauuguaaaaaga

SEQ ID NO: 2174792 - RNA, 20 nt, Streptococcus pneumoniae R6
acaauuagcaagaaauugau

SEQ ID NO: 2174793 - RNA, 20 nt, Streptococcus pneumoniae R6
acaaugucuaaaucuuuaac

SEQ ID NO: 2174794 - RNA, 17 nt, Streptococcus pneumoniae R6
acaauguuuuagaagua

SEQ ID NO: 2174795 - RNA, 18 nt, Streptococcus pneumoniae R6
acaauguuuuagaaguag

SEQ ID NO: 2174796 - RNA, 14 nt, Streptococcus pneumoniae R6
acaauguucuuuuc

SEQ ID NO: 2174797 - RNA, 21 nt, Streptococcus pneumoniae R6
acaauguugucaauuuccauu

SEQ ID NO: 2174798 - RNA, 15 nt, Streptococcus pneumoniae R6
acaaugcuuuagaaa

SEQ ID NO: 2174799 - RNA, 16 nt, Streptococcus pneumoniae R6
acaaugguuagaaaau

SEQ ID NO: 2174800 - RNA, 18 nt, Streptococcus pneumoniae R6
acaauguagccaucaucc

SEQ ID NO: 2174801 - RNA, 14 nt, Streptococcus pneumoniae R6
acaauggaaaugau

SEQ ID NO: 2174802 - RNA, 19 nt, Streptococcus pneumoniae R6
acacauaguaguaaacaca

SEQ ID NO: 2174803 - RNA, 18 nt, Streptococcus pneumoniae R6
acacaagaguucuagcuu

SEQ ID NO: 2174804 - RNA, 18 nt, Streptococcus pneumoniae R6
acacaaugguuagaaaau

SEQ ID NO: 2174805 - RNA, 20 nt, Streptococcus pneumoniae R6
acacaaucgggaucugauaa

SEQ ID NO: 2174806 - RNA, 18 nt, Streptococcus pneumoniae R6
acaaggugaacuugaccu

SEQ ID NO: 2174807 - RNA, 21 nt, Streptococcus pneumoniae R6
acaagucagcucaaagcgaca

SEQ ID NO: 2174808 - RNA, 20 nt, Streptococcus pneumoniae R6
acaagucuugccuucaaccu

SEQ ID NO: 2174809 - RNA, 15 nt, Streptococcus pneumoniae R6
acaagucauccauga

SEQ ID NO: 2174810 - RNA, 18 nt, Streptococcus pneumoniae R6
acaagucauccaugauaa

SEQ ID NO: 2174811 - RNA, 13 nt, Streptococcus pneumoniae R6
acaagugaaagug

SEQ ID NO: 2174812 - RNA, 23 nt, Streptococcus pneumoniae R6
acaagugaaguaacgauagcacc

SEQ ID NO: 2174813 - RNA, 23 nt, Streptococcus pneumoniae R6
acaaguucaucuucaaaaucaaa

SEQ ID NO: 2174814 - RNA, 16 nt, Streptococcus pneumoniae R6
acaagggauuuuucug

SEQ ID NO: 2174815 - RNA, 16 nt, Streptococcus pneumoniae R6
acaagggcaaaaaaga

SEQ ID NO: 2174816 - RNA, 20 nt, Streptococcus pneumoniae R6
acaagggcaaaaaagaaacc

SEQ ID NO: 2174817 - RNA, 16 nt, Streptococcus pneumoniae R6
acaagcugccaaagca

SEQ ID NO: 2174818 - RNA, 18 nt, Streptococcus pneumoniae R6
acaauaagagaauuaaga

SEQ ID NO: 2174819 - RNA, 19 nt, Streptococcus pneumoniae R6
acaauaagauaucacucau

SEQ ID NO: 2174820 - RNA, 19 nt, Streptococcus pneumoniae R6
acaauacccacugcgaaga

SEQ ID NO: 2174821 - RNA, 16 nt, Streptococcus pneumoniae R6
acaauaaaaucaaaca

SEQ ID NO: 2174822 - RNA, 17 nt, Streptococcus pneumoniae R6
acaauaaaaucaaacaa

SEQ ID NO: 2174823 - RNA, 15 nt, Streptococcus pneumoniae R6
acaauaaaauccaug

SEQ ID NO: 2174824 - RNA, 16 nt, Streptococcus pneumoniae R6
acaaguugcuugaaaa

SEQ ID NO: 2174825 - RNA, 15 nt, Streptococcus pneumoniae R6
acaaguucuuuucug

SEQ ID NO: 2174826 - RNA, 13 nt, Streptococcus pneumoniae R6
acaauaaaaagca

SEQ ID NO: 2174827 - RNA, 19 nt, Streptococcus pneumoniae R6
acaauagcuaguagggaaa

SEQ ID NO: 2174828 - RNA, 18 nt, Streptococcus pneumoniae R6
acaauauauccaaaacca

SEQ ID NO: 2174829 - RNA, 15 nt, Streptococcus pneumoniae R6
acaauauuuuagaag

SEQ ID NO: 2174830 - RNA, 13 nt, Streptococcus pneumoniae R6
acaaucaagaccc

SEQ ID NO: 2174831 - RNA, 16 nt, Streptococcus pneumoniae R6
acaaucaagacccaag

SEQ ID NO: 2174832 - RNA, 20 nt, Streptococcus pneumoniae R6
acaaugagaaauuuuugguc

SEQ ID NO: 2174833 - RNA, 11 nt, Streptococcus pneumoniae R6
acaaucuaucu

SEQ ID NO: 2174834 - RNA, 21 nt, Streptococcus pneumoniae R6
acaaucuaucuuuuaauucau

SEQ ID NO: 2174835 - RNA, 14 nt, Streptococcus pneumoniae R6
acacccugcaugag

SEQ ID NO: 2174836 - RNA, 19 nt, Streptococcus pneumoniae R6
acacccuagccucagcaaa

SEQ ID NO: 2174837 - RNA, 15 nt, Streptococcus pneumoniae R6
acaccucuuucuuuc

SEQ ID NO: 2174838 - RNA, 14 nt, Streptococcus pneumoniae R6
acacgagaaacaau

SEQ ID NO: 2174839 - RNA, 16 nt, Streptococcus pneumoniae R6
acacgaccuauagaaa

SEQ ID NO: 2174840 - RNA, 13 nt, Streptococcus pneumoniae R6
acacccacgucac

SEQ ID NO: 2174841 - RNA, 19 nt, Streptococcus pneumoniae R6
acaccaguauucuuuuuaa

SEQ ID NO: 2174842 - RNA, 18 nt, Streptococcus pneumoniae R6
acaccauaaauauuugcu

SEQ ID NO: 2174843 - RNA, 18 nt, Streptococcus pneumoniae R6
acaccaaacauaacagga

SEQ ID NO: 2174844 - RNA, 19 nt, Streptococcus pneumoniae R6
acaccaaaaagugcaugag

SEQ ID NO: 2174845 - RNA, 15 nt, Streptococcus pneumoniae R6
acacuagcaauuuuu

SEQ ID NO: 2174846 - RNA, 21 nt, Streptococcus pneumoniae R6
acacuauuuguagcaaauuca

SEQ ID NO: 2174847 - RNA, 22 nt, Streptococcus pneumoniae R6
acagaaacaccuuuaucagcca

SEQ ID NO: 2174848 - RNA, 21 nt, Streptococcus pneumoniae R6
acagaaaaaccuugauacuau

SEQ ID NO: 2174849 - RNA, 23 nt, Streptococcus pneumoniae R6
acacuauuuacaaguguuuucac

SEQ ID NO: 2174850 - RNA, 13 nt, Streptococcus pneumoniae R6
acagaagcuuuac

SEQ ID NO: 2174851 - RNA, 15 nt, Streptococcus pneumoniae R6
acagaagaagugaca

SEQ ID NO: 2174852 - RNA, 18 nt, Streptococcus pneumoniae R6
acagaacuggcguuuuau

SEQ ID NO: 2174853 - RNA, 22 nt, Streptococcus pneumoniae R6
acagaaccaucuucauuuuggu

SEQ ID NO: 2174854 - RNA, 14 nt, Streptococcus pneumoniae R6
acagaaccuuggaa

SEQ ID NO: 2174855 - RNA, 18 nt, Streptococcus pneumoniae R6
acagaaccuuggaaauaa

SEQ ID NO: 2174856 - RNA, 12 nt, Streptococcus pneumoniae R6
acagaaagaaca

SEQ ID NO: 2174857 - RNA, 13 nt, Streptococcus pneumoniae R6
acagaaagaacaa

SEQ ID NO: 2174858 - RNA, 14 nt, Streptococcus pneumoniae R6
acagaaagaacaaa

SEQ ID NO: 2174859 - RNA, 15 nt, Streptococcus pneumoniae R6
acagaacauuuuaau

SEQ ID NO: 2174860 - RNA, 12 nt, Streptococcus pneumoniae R6
acacgguaugga

SEQ ID NO: 2174861 - RNA, 16 nt, Streptococcus pneumoniae R6
acacgguauuugagag

SEQ ID NO: 2174862 - RNA, 15 nt, Streptococcus pneumoniae R6
acacggaaguauauu

SEQ ID NO: 2174863 - RNA, 21 nt, Streptococcus pneumoniae R6
acagcaguuaugauauauuua

SEQ ID NO: 2174864 - RNA, 16 nt, Streptococcus pneumoniae R6
acagcaaaaaauuaug

SEQ ID NO: 2174865 - RNA, 11 nt, Streptococcus pneumoniae R6
acagauaagag

SEQ ID NO: 2174866 - RNA, 15 nt, Streptococcus pneumoniae R6
acagauaagagcaac

SEQ ID NO: 2174867 - RNA, 12 nt, Streptococcus pneumoniae R6
acagagaaaguc

SEQ ID NO: 2174868 - RNA, 16 nt, Streptococcus pneumoniae R6
acagagaaaauucuaa

SEQ ID NO: 2174869 - RNA, 17 nt, Streptococcus pneumoniae R6
acagaaucccagauaaa

SEQ ID NO: 2174870 - RNA, 18 nt, Streptococcus pneumoniae R6
acagaaucccagauaaag

SEQ ID NO: 2174871 - RNA, 22 nt, Streptococcus pneumoniae R6
acagaccuguccaacagacuca

SEQ ID NO: 2174872 - RNA, 17 nt, Streptococcus pneumoniae R6
acauacugaacucaacu

SEQ ID NO: 2174873 - RNA, 19 nt, Streptococcus pneumoniae R6
acauagacuccauagggca

SEQ ID NO: 2174874 - RNA, 24 nt, Streptococcus pneumoniae R6
acauagacuccauagggcauaagu

SEQ ID NO: 2174875 - RNA, 14 nt, Streptococcus pneumoniae R6
acauagacuuccca

SEQ ID NO: 2174876 - RNA, 15 nt, Streptococcus pneumoniae R6
acauagacuucccag

SEQ ID NO: 2174877 - RNA, 23 nt, Streptococcus pneumoniae R6
acauagagagacagcaguuauga

SEQ ID NO: 2174878 - RNA, 15 nt, Streptococcus pneumoniae R6
acauacugugccagc

SEQ ID NO: 2174879 - RNA, 21 nt, Streptococcus pneumoniae R6
acauacuguuuuccuuucaau

SEQ ID NO: 2174880 - RNA, 22 nt, Streptococcus pneumoniae R6
acauaggcuaaugagucuauuc

SEQ ID NO: 2174881 - RNA, 14 nt, Streptococcus pneumoniae R6
acauagucaaagag

SEQ ID NO: 2174882 - RNA, 16 nt, Streptococcus pneumoniae R6
acauagucaagcucuu

SEQ ID NO: 2174883 - RNA, 14 nt, Streptococcus pneumoniae R6
acauaguuucauaa

SEQ ID NO: 2174884 - RNA, 19 nt, Streptococcus pneumoniae R6
acauaggauucgugguuuu

SEQ ID NO: 2174885 - RNA, 20 nt, Streptococcus pneumoniae R6
acauagcuggucaagaagcg

SEQ ID NO: 2174886 - RNA, 17 nt, Streptococcus pneumoniae R6
acauacccaugcuuuuc

SEQ ID NO: 2174887 - RNA, 15 nt, Streptococcus pneumoniae R6
acauaccaccaagua

SEQ ID NO: 2174888 - RNA, 15 nt, Streptococcus pneumoniae R6
acauaauaaaacgca

SEQ ID NO: 2174889 - RNA, 14 nt, Streptococcus pneumoniae R6
acaguuucggcugu

SEQ ID NO: 2174890 - RNA, 21 nt, Streptococcus pneumoniae R6
acaguuucggcuguucuuuuu

SEQ ID NO: 2174891 - RNA, 23 nt, Streptococcus pneumoniae R6
acagcauuggaggcaaacuucua

SEQ ID NO: 2174892 - RNA, 19 nt, Streptococcus pneumoniae R6
acagccaaaaguccaaaga

SEQ ID NO: 2174893 - RNA, 20 nt, Streptococcus pneumoniae R6
acagccaaaaguccaaagau

SEQ ID NO: 2174894 - RNA, 16 nt, Streptococcus pneumoniae R6
acauauguaagaagau

SEQ ID NO: 2174895 - RNA, 19 nt, Streptococcus pneumoniae R6
acaucaguauuucauuaca

SEQ ID NO: 2174896 - RNA, 18 nt, Streptococcus pneumoniae R6
acauaugauugucuccuu

SEQ ID NO: 2174897 - RNA, 19 nt, Streptococcus pneumoniae R6
acauaugauugucuccuuu

SEQ ID NO: 2174898 - RNA, 14 nt, Streptococcus pneumoniae R6
acauaucuuuagug

SEQ ID NO: 2174899 - RNA, 20 nt, Streptococcus pneumoniae R6
acauauauaauccaagauga

SEQ ID NO: 2174900 - RNA, 12 nt, Streptococcus pneumoniae R6
acauauccauuc

SEQ ID NO: 2174901 - RNA, 19 nt, Streptococcus pneumoniae R6
acauaucaaccuuucucag

SEQ ID NO: 2174902 - RNA, 19 nt, Streptococcus pneumoniae R6
acauccguuuuucuccucu

SEQ ID NO: 2174903 - RNA, 17 nt, Streptococcus pneumoniae R6
acaucgaaguuguguuu

SEQ ID NO: 2174904 - RNA, 21 nt, Streptococcus pneumoniae R6
acaucgaaguuguguuugacc

SEQ ID NO: 2174905 - RNA, 13 nt, Streptococcus pneumoniae R6
acaucgucaccau

SEQ ID NO: 2174906 - RNA, 22 nt, Streptococcus pneumoniae R6
acaucgugguacaaguaucuac

SEQ ID NO: 2174907 - RNA, 12 nt, Streptococcus pneumoniae R6
acaucuuuucca

SEQ ID NO: 2174908 - RNA, 20 nt, Streptococcus pneumoniae R6
acaucuugaaguugauucau

SEQ ID NO: 2174909 - RNA, 22 nt, Streptococcus pneumoniae R6
acaucuucgcguucguauuuca

SEQ ID NO: 2174910 - RNA, 19 nt, Streptococcus pneumoniae R6
acaugaaccucuucauuca

SEQ ID NO: 2174911 - RNA, 22 nt, Streptococcus pneumoniae R6
acaugaaacuguggaaaauaga

SEQ ID NO: 2174912 - RNA, 14 nt, Streptococcus pneumoniae R6
acauuaacaucacu

SEQ ID NO: 2174913 - RNA, 17 nt, Streptococcus pneumoniae R6
acauuaacgaucaauca

SEQ ID NO: 2174914 - RNA, 14 nt, Streptococcus pneumoniae R6
acauuaaagacaau

SEQ ID NO: 2174915 - RNA, 20 nt, Streptococcus pneumoniae R6
acauuaaagacaauguucuu

SEQ ID NO: 2174916 - RNA, 15 nt, Streptococcus pneumoniae R6
acaugcguuaaaagu

SEQ ID NO: 2174917 - RNA, 17 nt, Streptococcus pneumoniae R6
acaugcguuaaaaguua

SEQ ID NO: 2174918 - RNA, 22 nt, Streptococcus pneumoniae R6
acaugcguuucagcauauuucc

SEQ ID NO: 2174919 - RNA, 23 nt, Streptococcus pneumoniae R6
acaugcguuucagcauauuuccc

SEQ ID NO: 2174920 - RNA, 16 nt, Streptococcus pneumoniae R6
acaugcgcaaaauaau

SEQ ID NO: 2174921 - RNA, 19 nt, Streptococcus pneumoniae R6
acauugauugcaagcccuu

SEQ ID NO: 2174922 - RNA, 19 nt, Streptococcus pneumoniae R6
acauucuuuuuaaggaguu

SEQ ID NO: 2174923 - RNA, 13 nt, Streptococcus pneumoniae R6
acauugaaaaugu

SEQ ID NO: 2174924 - RNA, 15 nt, Streptococcus pneumoniae R6
acauugaaaauguga

SEQ ID NO: 2174925 - RNA, 18 nt, Streptococcus pneumoniae R6
acauugacaucugugauu

SEQ ID NO: 2174926 - RNA, 23 nt, Streptococcus pneumoniae R6
acauucuccaguagaucacugaa

SEQ ID NO: 2174927 - RNA, 15 nt, Streptococcus pneumoniae R6
acauucguuccuuua

SEQ ID NO: 2174928 - RNA, 17 nt, Streptococcus pneumoniae R6
acauucguuccuuuaaa

SEQ ID NO: 2174929 - RNA, 11 nt, Streptococcus pneumoniae R6
acauucccauu

SEQ ID NO: 2174930 - RNA, 15 nt, Streptococcus pneumoniae R6
acauucccaaacaaa

SEQ ID NO: 2174931 - RNA, 18 nt, Streptococcus pneumoniae R6
acauuauccaugaaaaau

SEQ ID NO: 2174932 - RNA, 17 nt, Streptococcus pneumoniae R6
acauuagggucuuuaau

SEQ ID NO: 2174933 - RNA, 23 nt, Streptococcus pneumoniae R6
acauugguucuuuuuacuuauaa

SEQ ID NO: 2174934 - RNA, 21 nt, Streptococcus pneumoniae R6
acauugugaggaauugauuua

SEQ ID NO: 2174935 - RNA, 19 nt, Streptococcus pneumoniae R6
acauugucuaaaauuucau

SEQ ID NO: 2174936 - RNA, 14 nt, Streptococcus pneumoniae R6
acauuguuagaaau

SEQ ID NO: 2174937 - RNA, 16 nt, Streptococcus pneumoniae R6
acauuuccgauuucag

SEQ ID NO: 2174938 - RNA, 21 nt, Streptococcus pneumoniae R6
acauuugcuugaccagcuacu

SEQ ID NO: 2174939 - RNA, 23 nt, Streptococcus pneumoniae R6
acauuucgauaaagggaagcccc

SEQ ID NO: 2174940 - RNA, 23 nt, Streptococcus pneumoniae R6
accaaaagcagaggcaaugacaa

SEQ ID NO: 2174941 - RNA, 13 nt, Streptococcus pneumoniae R6
accaaaaucauac

SEQ ID NO: 2174942 - RNA, 18 nt, Streptococcus pneumoniae R6
accaaacaucaccagcau

SEQ ID NO: 2174943 - RNA, 17 nt, Streptococcus pneumoniae R6
accaaacggauuuugug

SEQ ID NO: 2174944 - RNA, 12 nt, Streptococcus pneumoniae R6
accaaauuucau

SEQ ID NO: 2174945 - RNA, 15 nt, Streptococcus pneumoniae R6
accaagcauuuucau

SEQ ID NO: 2174946 - RNA, 20 nt, Streptococcus pneumoniae R6
accaagaucuugucugcaug

SEQ ID NO: 2174947 - RNA, 12 nt, Streptococcus pneumoniae R6
accaagagcaaa

SEQ ID NO: 2174948 - RNA, 13 nt, Streptococcus pneumoniae R6
accaagagcaaaa

SEQ ID NO: 2174949 - RNA, 15 nt, Streptococcus pneumoniae R6
accaagagcaaaaac

SEQ ID NO: 2174950 - RNA, 13 nt, Streptococcus pneumoniae R6
accaauacagcuu

SEQ ID NO: 2174951 - RNA, 19 nt, Streptococcus pneumoniae R6
accaauacaggaaaaccag

SEQ ID NO: 2174952 - RNA, 14 nt, Streptococcus pneumoniae R6
accaauaauaaaac

SEQ ID NO: 2174953 - RNA, 20 nt, Streptococcus pneumoniae R6
accaauaauaaaacuuuuaa

SEQ ID NO: 2174954 - RNA, 14 nt, Streptococcus pneumoniae R6
accacaacaaaaaa

SEQ ID NO: 2174955 - RNA, 13 nt, Streptococcus pneumoniae R6
accagcuaccaga

SEQ ID NO: 2174956 - RNA, 15 nt, Streptococcus pneumoniae R6
accagcuacuguacu

SEQ ID NO: 2174957 - RNA, 23 nt, Streptococcus pneumoniae R6
accaccagaguggauuugguuuu

SEQ ID NO: 2174958 - RNA, 14 nt, Streptococcus pneumoniae R6
accaccuuccuugg

SEQ ID NO: 2174959 - RNA, 19 nt, Streptococcus pneumoniae R6
accaccugcaacaauaccu

SEQ ID NO: 2174960 - RNA, 22 nt, Streptococcus pneumoniae R6
accacuagcagccacuuuuuau

SEQ ID NO: 2174961 - RNA, 20 nt, Streptococcus pneumoniae R6
accacguucugcaacaacag

SEQ ID NO: 2174962 - RNA, 15 nt, Streptococcus pneumoniae R6
accacuuccuaccua

SEQ ID NO: 2174963 - RNA, 21 nt, Streptococcus pneumoniae R6
accacuuaacaacugauacug

SEQ ID NO: 2174964 - RNA, 23 nt, Streptococcus pneumoniae R6
accacgucagcuuuaucugcaac

SEQ ID NO: 2174965 - RNA, 15 nt, Streptococcus pneumoniae R6
accaucuaacucaua

SEQ ID NO: 2174966 - RNA, 21 nt, Streptococcus pneumoniae R6
accaucuagccauuugcagac

SEQ ID NO: 2174967 - RNA, 17 nt, Streptococcus pneumoniae R6
accaugaaauucaaaag

SEQ ID NO: 2174968 - RNA, 19 nt, Streptococcus pneumoniae R6
accaucuuccgcaauccac

SEQ ID NO: 2174969 - RNA, 13 nt, Streptococcus pneumoniae R6
accaucaaagacc

SEQ ID NO: 2174970 - RNA, 14 nt, Streptococcus pneumoniae R6
accaggaaaccagc

SEQ ID NO: 2174971 - RNA, 16 nt, Streptococcus pneumoniae R6
accaggaaaccagcug

SEQ ID NO: 2174972 - RNA, 15 nt, Streptococcus pneumoniae R6
accaggaucuuaucu

SEQ ID NO: 2174973 - RNA, 15 nt, Streptococcus pneumoniae R6
accaggagccaagau

SEQ ID NO: 2174974 - RNA, 20 nt, Streptococcus pneumoniae R6
accaugcguuggaacgauuu

SEQ ID NO: 2174975 - RNA, 21 nt, Streptococcus pneumoniae R6
accaugcugaccgcaaaagcu

SEQ ID NO: 2174976 - RNA, 19 nt, Streptococcus pneumoniae R6
accauggacuaaaguugua

SEQ ID NO: 2174977 - RNA, 17 nt, Streptococcus pneumoniae R6
accauguuuugagcuga

SEQ ID NO: 2174978 - RNA, 19 nt, Streptococcus pneumoniae R6
accauguuuugagcugacu

SEQ ID NO: 2174979 - RNA, 19 nt, Streptococcus pneumoniae R6
accaugucguuuccuucca

SEQ ID NO: 2174980 - RNA, 18 nt, Streptococcus pneumoniae R6
accauuuuccaagacuuu

SEQ ID NO: 2174981 - RNA, 21 nt, Streptococcus pneumoniae R6
acccaaaagauagaugauuua

SEQ ID NO: 2174982 - RNA, 16 nt, Streptococcus pneumoniae R6
acccauagauuuuuau

SEQ ID NO: 2174983 - RNA, 15 nt, Streptococcus pneumoniae R6
acccaggcaaagagu

SEQ ID NO: 2174984 - RNA, 20 nt, Streptococcus pneumoniae R6
acccacucgccaguugcugc

SEQ ID NO: 2174985 - RNA, 16 nt, Streptococcus pneumoniae R6
acccacuacaguugac

SEQ ID NO: 2174986 - RNA, 22 nt, Streptococcus pneumoniae R6
acccauguauggacgaagugcu

SEQ ID NO: 2174987 - RNA, 14 nt, Streptococcus pneumoniae R6
acccauucaccauu

SEQ ID NO: 2174988 - RNA, 16 nt, Streptococcus pneumoniae R6
accgaauuuuucaagu

SEQ ID NO: 2174989 - RNA, 14 nt, Streptococcus pneumoniae R6
accgacaacccagu

SEQ ID NO: 2174990 - RNA, 17 nt, Streptococcus pneumoniae R6
accgaagucgaaaauaa

SEQ ID NO: 2174991 - RNA, 22 nt, Streptococcus pneumoniae R6
acccuuuuuauacucaaugaaa

SEQ ID NO: 2174992 - RNA, 21 nt, Streptococcus pneumoniae R6
accgacgauaaggacgguagc

SEQ ID NO: 2174993 - RNA, 19 nt, Streptococcus pneumoniae R6
accgaccuugucuccccau

SEQ ID NO: 2174994 - RNA, 12 nt, Streptococcus pneumoniae R6
acccuauauuuc

SEQ ID NO: 2174995 - RNA, 12 nt, Streptococcus pneumoniae R6
acccuucuuuuu

SEQ ID NO: 2174996 - RNA, 12 nt, Streptococcus pneumoniae R6
acccuugauuuu

SEQ ID NO: 2174997 - RNA, 18 nt, Streptococcus pneumoniae R6
acccuugcgccaguuacc

SEQ ID NO: 2174998 - RNA, 17 nt, Streptococcus pneumoniae R6
acccuugcuuuuucuuu

SEQ ID NO: 2174999 - RNA, 19 nt, Streptococcus pneumoniae R6
acccuugcuuuuucuuuuu

SEQ ID NO: 2175000 - RNA, 16 nt, Streptococcus pneumoniae R6
acccuuguaggaaguu

SEQ ID NO: 2175001 - RNA, 18 nt, Streptococcus pneumoniae R6
acccuuguuucuaaaaca

SEQ ID NO: 2175002 - RNA, 22 nt, Streptococcus pneumoniae R6
acccuuguuucuaaaacauugu

SEQ ID NO: 2175003 - RNA, 20 nt, Streptococcus pneumoniae R6
accgauagcuuuugcagcac

SEQ ID NO: 2175004 - RNA, 16 nt, Streptococcus pneumoniae R6
accgauauggccugcu

SEQ ID NO: 2175005 - RNA, 20 nt, Streptococcus pneumoniae R6
accgauacgaugaccaagau

SEQ ID NO: 2175006 - RNA, 16 nt, Streptococcus pneumoniae R6
accgagggaaguaauu

SEQ ID NO: 2175007 - RNA, 18 nt, Streptococcus pneumoniae R6
acguaguuuuuuuuguaa

SEQ ID NO: 2175008 - RNA, 13 nt, Streptococcus pneumoniae R6
acgggagaaaagu

SEQ ID NO: 2175009 - RNA, 14 nt, Streptococcus pneumoniae R6
acguaucggaaaua

SEQ ID NO: 2175010 - RNA, 21 nt, Streptococcus pneumoniae R6
acgucauggccucuaaaucga

SEQ ID NO: 2175011 - RNA, 18 nt, Streptococcus pneumoniae R6
acguccaaggcugaaauu

SEQ ID NO: 2175012 - RNA, 16 nt, Streptococcus pneumoniae R6
acguccaauuuugucu

SEQ ID NO: 2175013 - RNA, 19 nt, Streptococcus pneumoniae R6
acguccaccacaaaagaga

SEQ ID NO: 2175014 - RNA, 16 nt, Streptococcus pneumoniae R6
acguccagccuugucu

SEQ ID NO: 2175015 - RNA, 20 nt, Streptococcus pneumoniae R6
acgucuucaauaccaaagaa

SEQ ID NO: 2175016 - RNA, 12 nt, Streptococcus pneumoniae R6
acgucuucacgg

SEQ ID NO: 2175017 - RNA, 20 nt, Streptococcus pneumoniae R6
acgucuuuugccuuagcaac

SEQ ID NO: 2175018 - RNA, 18 nt, Streptococcus pneumoniae R6
acgugauaauaaggccua

SEQ ID NO: 2175019 - RNA, 16 nt, Streptococcus pneumoniae R6
acgugacucagcuucu

SEQ ID NO: 2175020 - RNA, 15 nt, Streptococcus pneumoniae R6
acguguaauggcugu

SEQ ID NO: 2175021 - RNA, 22 nt, Streptococcus pneumoniae R6
acgugggaaggugguuugaaaa

SEQ ID NO: 2175022 - RNA, 23 nt, Streptococcus pneumoniae R6
acgugggaaggugguuugaaaau

SEQ ID NO: 2175023 - RNA, 15 nt, Streptococcus pneumoniae R6
acguggguugaggcc

SEQ ID NO: 2175024 - RNA, 20 nt, Streptococcus pneumoniae R6
acuacuggaauggcaaccgu

SEQ ID NO: 2175025 - RNA, 13 nt, Streptococcus pneumoniae R6
acuagagaagcca

SEQ ID NO: 2175026 - RNA, 15 nt, Streptococcus pneumoniae R6
acuagagaagccaag

SEQ ID NO: 2175027 - RNA, 21 nt, Streptococcus pneumoniae R6
acuagagaagccaagaguaga

SEQ ID NO: 2175028 - RNA, 22 nt, Streptococcus pneumoniae R6
acuagagagcuuucuaaacaau

SEQ ID NO: 2175029 - RNA, 16 nt, Streptococcus pneumoniae R6
acuagagaggggagga

SEQ ID NO: 2175030 - RNA, 20 nt, Streptococcus pneumoniae R6
acuacuauuuacgacaacgg

SEQ ID NO: 2175031 - RNA, 13 nt, Streptococcus pneumoniae R6
acuacuaguucug

SEQ ID NO: 2175032 - RNA, 22 nt, Streptococcus pneumoniae R6
acuacagaaaucacaauuccua

SEQ ID NO: 2175033 - RNA, 13 nt, Streptococcus pneumoniae R6
acuacaaagagag

SEQ ID NO: 2175034 - RNA, 22 nt, Streptococcus pneumoniae R6
acuacaauaauugguacauuuu

SEQ ID NO: 2175035 - RNA, 20 nt, Streptococcus pneumoniae R6
acuaaucuuugccaccuagc

SEQ ID NO: 2175036 - RNA, 17 nt, Streptococcus pneumoniae R6
acuaauuuggaaauaag

SEQ ID NO: 2175037 - RNA, 14 nt, Streptococcus pneumoniae R6
acuaggauuuucuu

SEQ ID NO: 2175038 - RNA, 20 nt, Streptococcus pneumoniae R6
acuagucuaacuucuccauc

SEQ ID NO: 2175039 - RNA, 22 nt, Streptococcus pneumoniae R6
acuauagacaacuccuugaauc

SEQ ID NO: 2175040 - RNA, 18 nt, Streptococcus pneumoniae R6
acuauauucucucuuacu

SEQ ID NO: 2175041 - RNA, 15 nt, Streptococcus pneumoniae R6
acuaucuaaaaaaau

SEQ ID NO: 2175042 - RNA, 17 nt, Streptococcus pneumoniae R6
acuaucuaaaaaaauga

SEQ ID NO: 2175043 - RNA, 20 nt, Streptococcus pneumoniae R6
acuauauugcaagagaaauc

SEQ ID NO: 2175044 - RNA, 16 nt, Streptococcus pneumoniae R6
acuauauaucaugcuu

SEQ ID NO: 2175045 - RNA, 13 nt, Streptococcus pneumoniae R6
acuauaucauaua

SEQ ID NO: 2175046 - RNA, 17 nt, Streptococcus pneumoniae R6
acuauaguuuaauuuaa

SEQ ID NO: 2175047 - RNA, 12 nt, Streptococcus pneumoniae R6
acuaguauucau

SEQ ID NO: 2175048 - RNA, 14 nt, Streptococcus pneumoniae R6
acuaguauucaucu

SEQ ID NO: 2175049 - RNA, 20 nt, Streptococcus pneumoniae R6
acuaguauucaucuuaucaa

SEQ ID NO: 2175050 - RNA, 14 nt, Streptococcus pneumoniae R6
acuagucaugaccc

SEQ ID NO: 2175051 - RNA, 22 nt, Streptococcus pneumoniae R6
acuaggugagcaucaggaaaga

SEQ ID NO: 2175052 - RNA, 20 nt, Streptococcus pneumoniae R6
acuagguuagucaaaaagaa

SEQ ID NO: 2175053 - RNA, 14 nt, Streptococcus pneumoniae R6
acuaggcuagcaaa

SEQ ID NO: 2175054 - RNA, 15 nt, Streptococcus pneumoniae R6
acuagggaaacacca

SEQ ID NO: 2175055 - RNA, 17 nt, Streptococcus pneumoniae R6
acuaggaauauugaaaa

SEQ ID NO: 2175056 - RNA, 15 nt, Streptococcus pneumoniae R6
acuagcuccaaacau

SEQ ID NO: 2175057 - RNA, 16 nt, Streptococcus pneumoniae R6
acuagcugcaggcugc

SEQ ID NO: 2175058 - RNA, 18 nt, Streptococcus pneumoniae R6
acuaggaaacuagcugca

SEQ ID NO: 2175059 - RNA, 21 nt, Streptococcus pneumoniae R6
acuaggaaacuagcugcaggc

SEQ ID NO: 2175060 - RNA, 22 nt, Streptococcus pneumoniae R6
acuaauacauuuuguaaaaaag

SEQ ID NO: 2175061 - RNA, 17 nt, Streptococcus pneumoniae R6
acuaacgccaaauccua

SEQ ID NO: 2175062 - RNA, 23 nt, Streptococcus pneumoniae R6
acuaaccuuguccgcauagccaa

SEQ ID NO: 2175063 - RNA, 16 nt, Streptococcus pneumoniae R6
acuaagauuuguuuuu

SEQ ID NO: 2175064 - RNA, 15 nt, Streptococcus pneumoniae R6
acuaaggaaagucaa

SEQ ID NO: 2175065 - RNA, 18 nt, Streptococcus pneumoniae R6
acuaaccaacuucuuuuu

SEQ ID NO: 2175066 - RNA, 18 nt, Streptococcus pneumoniae R6
acuaacccuagaaaacca

SEQ ID NO: 2175067 - RNA, 19 nt, Streptococcus pneumoniae R6
acuaacccuagaaaaccaa

SEQ ID NO: 2175068 - RNA, 16 nt, Streptococcus pneumoniae R6
acuaacccuucuuuuu

SEQ ID NO: 2175069 - RNA, 13 nt, Streptococcus pneumoniae R6
acuaaauccaaaa

SEQ ID NO: 2175070 - RNA, 16 nt, Streptococcus pneumoniae R6
acuaaauuuagaucau

SEQ ID NO: 2175071 - RNA, 21 nt, Streptococcus pneumoniae R6
acguugauauuggucagauug

SEQ ID NO: 2175072 - RNA, 21 nt, Streptococcus pneumoniae R6
acguugacgcggauugaagag

SEQ ID NO: 2175073 - RNA, 18 nt, Streptococcus pneumoniae R6
acguugacgcgguuugaa

SEQ ID NO: 2175074 - RNA, 14 nt, Streptococcus pneumoniae R6
acguucuucaagag

SEQ ID NO: 2175075 - RNA, 18 nt, Streptococcus pneumoniae R6
acguucugcaacaacagc

SEQ ID NO: 2175076 - RNA, 16 nt, Streptococcus pneumoniae R6
acguuccuauggguuc

SEQ ID NO: 2175077 - RNA, 23 nt, Streptococcus pneumoniae R6
acuccaaacgcgauacaauaaag

SEQ ID NO: 2175078 - RNA, 16 nt, Streptococcus pneumoniae R6
acuccaacuggucuug

SEQ ID NO: 2175079 - RNA, 23 nt, Streptococcus pneumoniae R6
acuccaacuggucuugccagccu

SEQ ID NO: 2175080 - RNA, 12 nt, Streptococcus pneumoniae R6
acucauuaauaa

SEQ ID NO: 2175081 - RNA, 17 nt, Streptococcus pneumoniae R6
acucaugugucuugcau

SEQ ID NO: 2175082 - RNA, 18 nt, Streptococcus pneumoniae R6
acucaugugucuugcauu

SEQ ID NO: 2175083 - RNA, 18 nt, Streptococcus pneumoniae R6
acucaugacagccucaau

SEQ ID NO: 2175084 - RNA, 20 nt, Streptococcus pneumoniae R6
acucaucugcuuucaaaaag

SEQ ID NO: 2175085 - RNA, 16 nt, Streptococcus pneumoniae R6
acuccagugaaaacag

SEQ ID NO: 2175086 - RNA, 21 nt, Streptococcus pneumoniae R6
acuccauagccaucuuuugac

SEQ ID NO: 2175087 - RNA, 21 nt, Streptococcus pneumoniae R6
acuccauagggcauaaguucg

SEQ ID NO: 2175088 - RNA, 15 nt, Streptococcus pneumoniae R6
acuccaaaaauaaau

SEQ ID NO: 2175089 - RNA, 13 nt, Streptococcus pneumoniae R6
acuccaagcaagc

SEQ ID NO: 2175090 - RNA, 18 nt, Streptococcus pneumoniae R6
acucagguccuuucuuuu

SEQ ID NO: 2175091 - RNA, 18 nt, Streptococcus pneumoniae R6
acucauaaagucuuuaac

SEQ ID NO: 2175092 - RNA, 19 nt, Streptococcus pneumoniae R6
acucauacaagcugccaaa

SEQ ID NO: 2175093 - RNA, 16 nt, Streptococcus pneumoniae R6
acucauaauagucucu

SEQ ID NO: 2175094 - RNA, 23 nt, Streptococcus pneumoniae R6
acucagaccgauucgucugaguu

SEQ ID NO: 2175095 - RNA, 17 nt, Streptococcus pneumoniae R6
acucaauuguauaguga

SEQ ID NO: 2175096 - RNA, 19 nt, Streptococcus pneumoniae R6
acuaugcuauacuguaguu

SEQ ID NO: 2175097 - RNA, 21 nt, Streptococcus pneumoniae R6
acuaucugcuaacugcuggau

SEQ ID NO: 2175098 - RNA, 16 nt, Streptococcus pneumoniae R6
acuaucucuacauucc

SEQ ID NO: 2175099 - RNA, 18 nt, Streptococcus pneumoniae R6
acuaucucuacauuccca

SEQ ID NO: 2175100 - RNA, 18 nt, Streptococcus pneumoniae R6
acucgugaagaaaucauc

SEQ ID NO: 2175101 - RNA, 16 nt, Streptococcus pneumoniae R6
acucuaaauugaauaa

SEQ ID NO: 2175102 - RNA, 22 nt, Streptococcus pneumoniae R6
acucuaaauugaauaaagucaa

SEQ ID NO: 2175103 - RNA, 23 nt, Streptococcus pneumoniae R6
acucucauuaaaacggagaauaa

SEQ ID NO: 2175104 - RNA, 14 nt, Streptococcus pneumoniae R6
acucuccaauauca

SEQ ID NO: 2175105 - RNA, 15 nt, Streptococcus pneumoniae R6
acucgcgacaacagc

SEQ ID NO: 2175106 - RNA, 19 nt, Streptococcus pneumoniae R6
acucgcgacaacagcuugg

SEQ ID NO: 2175107 - RNA, 17 nt, Streptococcus pneumoniae R6
acucgauuuuaaaucac

SEQ ID NO: 2175108 - RNA, 21 nt, Streptococcus pneumoniae R6
acucccuguuccaaagaagua

SEQ ID NO: 2175109 - RNA, 21 nt, Streptococcus pneumoniae R6
acucuuauuauucucuauaua

SEQ ID NO: 2175110 - RNA, 15 nt, Streptococcus pneumoniae R6
acucuuauacuuuuc

SEQ ID NO: 2175111 - RNA, 20 nt, Streptococcus pneumoniae R6
acucuuauacuuuucucuua

SEQ ID NO: 2175112 - RNA, 19 nt, Streptococcus pneumoniae R6
acucuuagaaaaucucuuc

SEQ ID NO: 2175113 - RNA, 16 nt, Streptococcus pneumoniae R6
acucuuagucuuuauu

SEQ ID NO: 2175114 - RNA, 18 nt, Streptococcus pneumoniae R6
acucuccuccauaaaaag

SEQ ID NO: 2175115 - RNA, 20 nt, Streptococcus pneumoniae R6
acucuccuccauaaaaagac

SEQ ID NO: 2175116 - RNA, 17 nt, Streptococcus pneumoniae R6
acucuugauuuucauug

SEQ ID NO: 2175117 - RNA, 15 nt, Streptococcus pneumoniae R6
acucuugcccuuggc

SEQ ID NO: 2175118 - RNA, 17 nt, Streptococcus pneumoniae R6
acucuugcccuuggcua

SEQ ID NO: 2175119 - RNA, 12 nt, Streptococcus pneumoniae R6
acucuucugguu

SEQ ID NO: 2175120 - RNA, 13 nt, Streptococcus pneumoniae R6
acucuucugguuu

SEQ ID NO: 2175121 - RNA, 19 nt, Streptococcus pneumoniae R6
acucuucgaaaaucucuuc

SEQ ID NO: 2175122 - RNA, 14 nt, Streptococcus pneumoniae R6
acucuuuacuuugc

SEQ ID NO: 2175123 - RNA, 12 nt, Streptococcus pneumoniae R6
acucuucuuuug

SEQ ID NO: 2175124 - RNA, 15 nt, Streptococcus pneumoniae R6
acucuuugauuuuca

SEQ ID NO: 2175125 - RNA, 16 nt, Streptococcus pneumoniae R6
acucuuugauuuucau

SEQ ID NO: 2175126 - RNA, 16 nt, Streptococcus pneumoniae R6
acugaacaaugaaaaa

SEQ ID NO: 2175127 - RNA, 16 nt, Streptococcus pneumoniae R6
acugaacuauuuuauu

SEQ ID NO: 2175128 - RNA, 13 nt, Streptococcus pneumoniae R6
acugaacucaacu

SEQ ID NO: 2175129 - RNA, 20 nt, Streptococcus pneumoniae R6
acugaacggugaacuucuuc

SEQ ID NO: 2175130 - RNA, 23 nt, Streptococcus pneumoniae R6
acugaauccgcacugucguuccu

SEQ ID NO: 2175131 - RNA, 17 nt, Streptococcus pneumoniae R6
acugaagcguucaauca

SEQ ID NO: 2175132 - RNA, 20 nt, Streptococcus pneumoniae R6
acgcauaagcaauuuuuuau

SEQ ID NO: 2175133 - RNA, 17 nt, Streptococcus pneumoniae R6
acgcaguucuucauaca

SEQ ID NO: 2175134 - RNA, 22 nt, Streptococcus pneumoniae R6
acgcagagguggaaugauaaca

SEQ ID NO: 2175135 - RNA, 12 nt, Streptococcus pneumoniae R6
acgccagauacu

SEQ ID NO: 2175136 - RNA, 23 nt, Streptococcus pneumoniae R6
acgcuacgacguuuaucaauaau

SEQ ID NO: 2175137 - RNA, 14 nt, Streptococcus pneumoniae R6
acgcuaaguagaaa

SEQ ID NO: 2175138 - RNA, 23 nt, Streptococcus pneumoniae R6
acgcucuucuggcagauagaugg

SEQ ID NO: 2175139 - RNA, 19 nt, Streptococcus pneumoniae R6
acgcucgguuucaacugau

SEQ ID NO: 2175140 - RNA, 15 nt, Streptococcus pneumoniae R6
acgcgguuugaagag

SEQ ID NO: 2175141 - RNA, 15 nt, Streptococcus pneumoniae R6
acgcggauugaagag

SEQ ID NO: 2175142 - RNA, 14 nt, Streptococcus pneumoniae R6
acgcgauacaauaa

SEQ ID NO: 2175143 - RNA, 16 nt, Streptococcus pneumoniae R6
acgcuucccucucaga

SEQ ID NO: 2175144 - RNA, 18 nt, Streptococcus pneumoniae R6
acgcuucccucucagauu

SEQ ID NO: 2175145 - RNA, 23 nt, Streptococcus pneumoniae R6
acgcugacgugguuugcagagau

SEQ ID NO: 2175146 - RNA, 16 nt, Streptococcus pneumoniae R6
acggagauaguaccau

SEQ ID NO: 2175147 - RNA, 15 nt, Streptococcus pneumoniae R6
acggacguugauuug

SEQ ID NO: 2175148 - RNA, 14 nt, Streptococcus pneumoniae R6
acggcugucgcguu

SEQ ID NO: 2175149 - RNA, 13 nt, Streptococcus pneumoniae R6
acggcauaaaauc

SEQ ID NO: 2175150 - RNA, 13 nt, Streptococcus pneumoniae R6
agaauaucaagau

SEQ ID NO: 2175151 - RNA, 17 nt, Streptococcus pneumoniae R6
agaauaguacacuucua

SEQ ID NO: 2175152 - RNA, 20 nt, Streptococcus pneumoniae R6
agaauaguacacuucugcuu

SEQ ID NO: 2175153 - RNA, 21 nt, Streptococcus pneumoniae R6
agaauaagggauucgaacccu

SEQ ID NO: 2175154 - RNA, 13 nt, Streptococcus pneumoniae R6
agaauaauuaaau

SEQ ID NO: 2175155 - RNA, 14 nt, Streptococcus pneumoniae R6
agaauaauuaaauc

SEQ ID NO: 2175156 - RNA, 13 nt, Streptococcus pneumoniae R6
agaaguuuuccuu

SEQ ID NO: 2175157 - RNA, 18 nt, Streptococcus pneumoniae R6
agaauguccauaacugcu

SEQ ID NO: 2175158 - RNA, 14 nt, Streptococcus pneumoniae R6
agaaugucuuccaa

SEQ ID NO: 2175159 - RNA, 14 nt, Streptococcus pneumoniae R6
agaauccaaaaaau

SEQ ID NO: 2175160 - RNA, 14 nt, Streptococcus pneumoniae R6
agaaucccaaagaa

SEQ ID NO: 2175161 - RNA, 12 nt, Streptococcus pneumoniae R6
agaauccaucug

SEQ ID NO: 2175162 - RNA, 23 nt, Streptococcus pneumoniae R6
agaaauuaauuugacuuuucuaa

SEQ ID NO: 2175163 - RNA, 23 nt, Streptococcus pneumoniae R6
agaaauuacaguuauuuuaguaa

SEQ ID NO: 2175164 - RNA, 10 nt, Streptococcus pneumoniae R6
agaaauuccu

SEQ ID NO: 2175165 - RNA, 15 nt, Streptococcus pneumoniae R6
agaaaugaguaagaa

SEQ ID NO: 2175166 - RNA, 22 nt, Streptococcus pneumoniae R6
agaaaugccgauucccaaacuu

SEQ ID NO: 2175167 - RNA, 22 nt, Streptococcus pneumoniae R6
agaaaugcgccaccaacugcac

SEQ ID NO: 2175168 - RNA, 21 nt, Streptococcus pneumoniae R6
agaaauggucggcauucuucu

SEQ ID NO: 2175169 - RNA, 19 nt, Streptococcus pneumoniae R6
agaaauggaaguuucaaaa

SEQ ID NO: 2175170 - RNA, 23 nt, Streptococcus pneumoniae R6
agaaauggaaguuucaaaauucc

SEQ ID NO: 2175171 - RNA, 12 nt, Streptococcus pneumoniae R6
agaagagagcau

SEQ ID NO: 2175172 - RNA, 16 nt, Streptococcus pneumoniae R6
agaagaucaauaguga

SEQ ID NO: 2175173 - RNA, 23 nt, Streptococcus pneumoniae R6
agaagaucaauagugagacaagc

SEQ ID NO: 2175174 - RNA, 21 nt, Streptococcus pneumoniae R6
agaagaggcugugguccuugu

SEQ ID NO: 2175175 - RNA, 14 nt, Streptococcus pneumoniae R6
agaaggaguugagc

SEQ ID NO: 2175176 - RNA, 21 nt, Streptococcus pneumoniae R6
agaaggacuugauauaaauga

SEQ ID NO: 2175177 - RNA, 17 nt, Streptococcus pneumoniae R6
agaaggagccagcugaa

SEQ ID NO: 2175178 - RNA, 21 nt, Streptococcus pneumoniae R6
agaagugacagucgcaaagag

SEQ ID NO: 2175179 - RNA, 21 nt, Streptococcus pneumoniae R6
agaaggccgagucaaaauucu

SEQ ID NO: 2175180 - RNA, 11 nt, Streptococcus pneumoniae R6
agaaggcuggu

SEQ ID NO: 2175181 - RNA, 19 nt, Streptococcus pneumoniae R6
agaaggcuuucuaauuuuu

SEQ ID NO: 2175182 - RNA, 20 nt, Streptococcus pneumoniae R6
agaauuuucuuacuuccuuu

SEQ ID NO: 2175183 - RNA, 10 nt, Streptococcus pneumoniae R6
agacaaaaaa

SEQ ID NO: 2175184 - RNA, 12 nt, Streptococcus pneumoniae R6
agacaaaaaaaa

SEQ ID NO: 2175185 - RNA, 14 nt, Streptococcus pneumoniae R6
agacaaaaaaaaca

SEQ ID NO: 2175186 - RNA, 15 nt, Streptococcus pneumoniae R6
agacaaaaaaaacac

SEQ ID NO: 2175187 - RNA, 16 nt, Streptococcus pneumoniae R6
agaauuugaaaaaaau

SEQ ID NO: 2175188 - RNA, 16 nt, Streptococcus pneumoniae R6
agacaauuuucaucca

SEQ ID NO: 2175189 - RNA, 22 nt, Streptococcus pneumoniae R6
agacaauuuccggcucuuuguc

SEQ ID NO: 2175190 - RNA, 14 nt, Streptococcus pneumoniae R6
agacagcaccaacu

SEQ ID NO: 2175191 - RNA, 21 nt, Streptococcus pneumoniae R6
agacaggucaauggcaaaaaa

SEQ ID NO: 2175192 - RNA, 13 nt, Streptococcus pneumoniae R6
agacagucugaaa

SEQ ID NO: 2175193 - RNA, 20 nt, Streptococcus pneumoniae R6
agacagucugaaaaagagga

SEQ ID NO: 2175194 - RNA, 17 nt, Streptococcus pneumoniae R6
agacagucugaaaaaua

SEQ ID NO: 2175195 - RNA, 20 nt, Streptococcus pneumoniae R6
agacagugaaaucauacugc

SEQ ID NO: 2175196 - RNA, 15 nt, Streptococcus pneumoniae R6
agacagguuucacau

SEQ ID NO: 2175197 - RNA, 17 nt, Streptococcus pneumoniae R6
agacagcuuguugcuuu

SEQ ID NO: 2175198 - RNA, 12 nt, Streptococcus pneumoniae R6
agaccaaagaaa

SEQ ID NO: 2175199 - RNA, 21 nt, Streptococcus pneumoniae R6
agacgaaucggucugaguuuu

SEQ ID NO: 2175200 - RNA, 14 nt, Streptococcus pneumoniae R6
agacgaauaaagaa

SEQ ID NO: 2175201 - RNA, 23 nt, Streptococcus pneumoniae R6
agaccuuucauaaaguuuucuga

SEQ ID NO: 2175202 - RNA, 22 nt, Streptococcus pneumoniae R6
agaccuuuuuucguaaccaaau

SEQ ID NO: 2175203 - RNA, 16 nt, Streptococcus pneumoniae R6
agaccuguuuggucag

SEQ ID NO: 2175204 - RNA, 15 nt, Streptococcus pneumoniae R6
agaccuguauucauu

SEQ ID NO: 2175205 - RNA, 20 nt, Streptococcus pneumoniae R6
agaccgauagcuuuugcagc

SEQ ID NO: 2175206 - RNA, 16 nt, Streptococcus pneumoniae R6
agaccgagaaacaaga

SEQ ID NO: 2175207 - RNA, 21 nt, Streptococcus pneumoniae R6
agacugacuagaugauuacuc

SEQ ID NO: 2175208 - RNA, 21 nt, Streptococcus pneumoniae R6
agacuuagucuucuuuucuuu

SEQ ID NO: 2175209 - RNA, 15 nt, Streptococcus pneumoniae R6
agacuucaacagcac

SEQ ID NO: 2175210 - RNA, 19 nt, Streptococcus pneumoniae R6
agacuggguaacaauucca

SEQ ID NO: 2175211 - RNA, 13 nt, Streptococcus pneumoniae R6
agacugucaaguu

SEQ ID NO: 2175212 - RNA, 17 nt, Streptococcus pneumoniae R6
agacuggugugauuuuc

SEQ ID NO: 2175213 - RNA, 18 nt, Streptococcus pneumoniae R6
agacugguucucucuuuu

SEQ ID NO: 2175214 - RNA, 19 nt, Streptococcus pneumoniae R6
agacucauuuaaaauuaaa

SEQ ID NO: 2175215 - RNA, 16 nt, Streptococcus pneumoniae R6
agacugaaucugaaau

SEQ ID NO: 2175216 - RNA, 19 nt, Streptococcus pneumoniae R6
agacugacgaagucagcuc

SEQ ID NO: 2175217 - RNA, 14 nt, Streptococcus pneumoniae R6
agacugaaaauuug

SEQ ID NO: 2175218 - RNA, 18 nt, Streptococcus pneumoniae R6
agacgcuggcuuucacgu

SEQ ID NO: 2175219 - RNA, 21 nt, Streptococcus pneumoniae R6
agacuuucucacgaauaacca

SEQ ID NO: 2175220 - RNA, 19 nt, Streptococcus pneumoniae R6
agacuuucaauucuucacu

SEQ ID NO: 2175221 - RNA, 21 nt, Streptococcus pneumoniae R6
agacuuucaaaccauugcugg

SEQ ID NO: 2175222 - RNA, 22 nt, Streptococcus pneumoniae R6
agacuuuacaacacuucauguu

SEQ ID NO: 2175223 - RNA, 17 nt, Streptococcus pneumoniae R6
agacuuugguauuacuu

SEQ ID NO: 2175224 - RNA, 19 nt, Streptococcus pneumoniae R6
agacuuuuccuguuguauu

SEQ ID NO: 2175225 - RNA, 22 nt, Streptococcus pneumoniae R6
agacuuuuugccuggucucuuu

SEQ ID NO: 2175226 - RNA, 14 nt, Streptococcus pneumoniae R6
agacuuuuuuccag

SEQ ID NO: 2175227 - RNA, 15 nt, Streptococcus pneumoniae R6
agacuuuuuuccagc

SEQ ID NO: 2175228 - RNA, 13 nt, Streptococcus pneumoniae R6
agacuuuuuucua

SEQ ID NO: 2175229 - RNA, 14 nt, Streptococcus pneumoniae R6
agacuuuuuucuau

SEQ ID NO: 2175230 - RNA, 16 nt, Streptococcus pneumoniae R6
agacuugaaauacuaa

SEQ ID NO: 2175231 - RNA, 21 nt, Streptococcus pneumoniae R6
agagaaagucagcugggcuaa

SEQ ID NO: 2175232 - RNA, 13 nt, Streptococcus pneumoniae R6
agagaaagaaaaa

SEQ ID NO: 2175233 - RNA, 20 nt, Streptococcus pneumoniae R6
agagaaagaaaaacugcuua

SEQ ID NO: 2175234 - RNA, 14 nt, Streptococcus pneumoniae R6
agagaaagaaaaca

SEQ ID NO: 2175235 - RNA, 15 nt, Streptococcus pneumoniae R6
agagaaagaaaacaa

SEQ ID NO: 2175236 - RNA, 17 nt, Streptococcus pneumoniae R6
agagaaaaugggcuuuu

SEQ ID NO: 2175237 - RNA, 13 nt, Streptococcus pneumoniae R6
agagaaaaccaaa

SEQ ID NO: 2175238 - RNA, 14 nt, Streptococcus pneumoniae R6
agagaaaaccaaaa

SEQ ID NO: 2175239 - RNA, 15 nt, Streptococcus pneumoniae R6
agagaaaaccaaaac

SEQ ID NO: 2175240 - RNA, 18 nt, Streptococcus pneumoniae R6
agagaaaaccaaaacuca

SEQ ID NO: 2175241 - RNA, 13 nt, Streptococcus pneumoniae R6
agagacagaagau

SEQ ID NO: 2175242 - RNA, 15 nt, Streptococcus pneumoniae R6
agagaaauuucugaa

SEQ ID NO: 2175243 - RNA, 14 nt, Streptococcus pneumoniae R6
agagaagaaauaug

SEQ ID NO: 2175244 - RNA, 17 nt, Streptococcus pneumoniae R6
agagaagccaagaguag

SEQ ID NO: 2175245 - RNA, 19 nt, Streptococcus pneumoniae R6
agagaagccaagaguagag

SEQ ID NO: 2175246 - RNA, 23 nt, Streptococcus pneumoniae R6
agagaagccaagaguagagagaa

SEQ ID NO: 2175247 - RNA, 14 nt, Streptococcus pneumoniae R6
agaguuaaaaaaag

SEQ ID NO: 2175248 - RNA, 21 nt, Streptococcus pneumoniae R6
agaguucacggauucucucag

SEQ ID NO: 2175249 - RNA, 19 nt, Streptococcus pneumoniae R6
agaguacgaaauucguacu

SEQ ID NO: 2175250 - RNA, 17 nt, Streptococcus pneumoniae R6
agaggcucgcaccucuu

SEQ ID NO: 2175251 - RNA, 19 nt, Streptococcus pneumoniae R6
agaggcguuauuugaaaaa

SEQ ID NO: 2175252 - RNA, 12 nt, Streptococcus pneumoniae R6
agaggugccagu

SEQ ID NO: 2175253 - RNA, 16 nt, Streptococcus pneumoniae R6
agagguuauucaaaaa

SEQ ID NO: 2175254 - RNA, 21 nt, Streptococcus pneumoniae R6
agaguaaaagaaauacaguac

SEQ ID NO: 2175255 - RNA, 18 nt, Streptococcus pneumoniae R6
agauaagcgcuagcaaaa

SEQ ID NO: 2175256 - RNA, 22 nt, Streptococcus pneumoniae R6
agauaagcaccuaguacaaaga

SEQ ID NO: 2175257 - RNA, 16 nt, Streptococcus pneumoniae R6
agauaacugcuagaaa

SEQ ID NO: 2175258 - RNA, 13 nt, Streptococcus pneumoniae R6
agauaaccccacg

SEQ ID NO: 2175259 - RNA, 16 nt, Streptococcus pneumoniae R6
agauaaccaucucaca

SEQ ID NO: 2175260 - RNA, 15 nt, Streptococcus pneumoniae R6
agauaacaguuuuua

SEQ ID NO: 2175261 - RNA, 21 nt, Streptococcus pneumoniae R6
agauaacaguuuuuaauuuuu

SEQ ID NO: 2175262 - RNA, 23 nt, Streptococcus pneumoniae R6
agauaaagagucuggaacaaaau

SEQ ID NO: 2175263 - RNA, 18 nt, Streptococcus pneumoniae R6
agauaaaagaaugcucag

SEQ ID NO: 2175264 - RNA, 23 nt, Streptococcus pneumoniae R6
agauaaaagggaacacagcugug

SEQ ID NO: 2175265 - RNA, 18 nt, Streptococcus pneumoniae R6
agagcuaacuuuuccuua

SEQ ID NO: 2175266 - RNA, 14 nt, Streptococcus pneumoniae R6
agagcuccaaaugg

SEQ ID NO: 2175267 - RNA, 14 nt, Streptococcus pneumoniae R6
agagccuaguugcu

SEQ ID NO: 2175268 - RNA, 17 nt, Streptococcus pneumoniae R6
agagcggacuaggcggc

SEQ ID NO: 2175269 - RNA, 14 nt, Streptococcus pneumoniae R6
agaggacauagaaa

SEQ ID NO: 2175270 - RNA, 16 nt, Streptococcus pneumoniae R6
agaggacauagaaaau

SEQ ID NO: 2175271 - RNA, 13 nt, Streptococcus pneumoniae R6
agaggaagaggac

SEQ ID NO: 2175272 - RNA, 15 nt, Streptococcus pneumoniae R6
agaggaagaggacau

SEQ ID NO: 2175273 - RNA, 18 nt, Streptococcus pneumoniae R6
agaggacuuuuuguguuu

SEQ ID NO: 2175274 - RNA, 18 nt, Streptococcus pneumoniae R6
agaggagaauuuuugaga

SEQ ID NO: 2175275 - RNA, 13 nt, Streptococcus pneumoniae R6
agaggaggauaga

SEQ ID NO: 2175276 - RNA, 21 nt, Streptococcus pneumoniae R6
agaggaggugaaacuaaugag

SEQ ID NO: 2175277 - RNA, 17 nt, Streptococcus pneumoniae R6
agaggcaacagaaauaa

SEQ ID NO: 2175278 - RNA, 18 nt, Streptococcus pneumoniae R6
agaggccuauuuaccaug

SEQ ID NO: 2175279 - RNA, 15 nt, Streptococcus pneumoniae R6
agagcauuuuucgaa

SEQ ID NO: 2175280 - RNA, 21 nt, Streptococcus pneumoniae R6
agagcaucugccgcaugacaa

SEQ ID NO: 2175281 - RNA, 18 nt, Streptococcus pneumoniae R6
agagcauucuuuuguuca

SEQ ID NO: 2175282 - RNA, 21 nt, Streptococcus pneumoniae R6
agagccgaaaaaauaggcaga

SEQ ID NO: 2175283 - RNA, 16 nt, Streptococcus pneumoniae R6
agagcccaauauucuc

SEQ ID NO: 2175284 - RNA, 20 nt, Streptococcus pneumoniae R6
agagacucuuuaagagaguu

SEQ ID NO: 2175285 - RNA, 15 nt, Streptococcus pneumoniae R6
agagaccuuucauaa

SEQ ID NO: 2175286 - RNA, 16 nt, Streptococcus pneumoniae R6
agagacauaaucaaga

SEQ ID NO: 2175287 - RNA, 22 nt, Streptococcus pneumoniae R6
agagcagauagggcuaggcuaa

SEQ ID NO: 2175288 - RNA, 13 nt, Streptococcus pneumoniae R6
agagcauauuuac

SEQ ID NO: 2175289 - RNA, 16 nt, Streptococcus pneumoniae R6
agagcaguuuuccuau

SEQ ID NO: 2175290 - RNA, 13 nt, Streptococcus pneumoniae R6
agaaaaccaaaac

SEQ ID NO: 2175291 - RNA, 19 nt, Streptococcus pneumoniae R6
agaaaaacaccccaugaua

SEQ ID NO: 2175292 - RNA, 12 nt, Streptococcus pneumoniae R6
agaaaaagaagg

SEQ ID NO: 2175293 - RNA, 14 nt, Streptococcus pneumoniae R6
agaaaacaacuuau

SEQ ID NO: 2175294 - RNA, 14 nt, Streptococcus pneumoniae R6
agaaaacagaaaaa

SEQ ID NO: 2175295 - RNA, 16 nt, Streptococcus pneumoniae R6
acuuuuccaguaauuu

SEQ ID NO: 2175296 - RNA, 20 nt, Streptococcus pneumoniae R6
acuuuuccaauagauaauuu

SEQ ID NO: 2175297 - RNA, 11 nt, Streptococcus pneumoniae R6
agaaaaaaggc

SEQ ID NO: 2175298 - RNA, 13 nt, Streptococcus pneumoniae R6
agaaaaaacaaag

SEQ ID NO: 2175299 - RNA, 16 nt, Streptococcus pneumoniae R6
agaaaacuaguuuaaa

SEQ ID NO: 2175300 - RNA, 21 nt, Streptococcus pneumoniae R6
agaaaacuaguuuaaaucaua

SEQ ID NO: 2175301 - RNA, 23 nt, Streptococcus pneumoniae R6
agaaaacuaguuuaaaucauaau

SEQ ID NO: 2175302 - RNA, 14 nt, Streptococcus pneumoniae R6
agaaaagagcauau

SEQ ID NO: 2175303 - RNA, 14 nt, Streptococcus pneumoniae R6
agaaaagcaaaaug

SEQ ID NO: 2175304 - RNA, 19 nt, Streptococcus pneumoniae R6
agaaaagcguucaaagacu

SEQ ID NO: 2175305 - RNA, 15 nt, Streptococcus pneumoniae R6
agaaaauaaaguaaa

SEQ ID NO: 2175306 - RNA, 18 nt, Streptococcus pneumoniae R6
agaaaauaaaguaaaaau

SEQ ID NO: 2175307 - RNA, 19 nt, Streptococcus pneumoniae R6
agaaaagggugacuucgca

SEQ ID NO: 2175308 - RNA, 17 nt, Streptococcus pneumoniae R6
agaaaagucacuggaaa

SEQ ID NO: 2175309 - RNA, 18 nt, Streptococcus pneumoniae R6
agaaaagucacuggaaac

SEQ ID NO: 2175310 - RNA, 18 nt, Streptococcus pneumoniae R6
agaaaagugcaaauaaga

SEQ ID NO: 2175311 - RNA, 17 nt, Streptococcus pneumoniae R6
agaaacaauaaaaucaa

SEQ ID NO: 2175312 - RNA, 15 nt, Streptococcus pneumoniae R6
agaaagaacaaaaaa

SEQ ID NO: 2175313 - RNA, 13 nt, Streptococcus pneumoniae R6
agaaagaaaaacu

SEQ ID NO: 2175314 - RNA, 15 nt, Streptococcus pneumoniae R6
agaaagagaauaaca

SEQ ID NO: 2175315 - RNA, 14 nt, Streptococcus pneumoniae R6
agaaagacuugacc

SEQ ID NO: 2175316 - RNA, 24 nt, Streptococcus pneumoniae R6
agaaagacuugaccggagaaagaa

SEQ ID NO: 2175317 - RNA, 19 nt, Streptococcus pneumoniae R6
agaaagauuuucaaagucc

SEQ ID NO: 2175318 - RNA, 18 nt, Streptococcus pneumoniae R6
agaaagcaaggcuuugug

SEQ ID NO: 2175319 - RNA, 16 nt, Streptococcus pneumoniae R6
agaaaguuaaaaaaac

SEQ ID NO: 2175320 - RNA, 21 nt, Streptococcus pneumoniae R6
agaaaguuaaaaaaacuaugg

SEQ ID NO: 2175321 - RNA, 15 nt, Streptococcus pneumoniae R6
agaaagaucauuaac

SEQ ID NO: 2175322 - RNA, 14 nt, Streptococcus pneumoniae R6
agaaagaaaacaag

SEQ ID NO: 2175323 - RNA, 19 nt, Streptococcus pneumoniae R6
agaaauaaaaguaacaccu

SEQ ID NO: 2175324 - RNA, 23 nt, Streptococcus pneumoniae R6
agaaaucacaauuccuaagauau

SEQ ID NO: 2175325 - RNA, 22 nt, Streptococcus pneumoniae R6
agaaaucauuggauacaaggag

SEQ ID NO: 2175326 - RNA, 22 nt, Streptococcus pneumoniae R6
agaaauccaaacgauuaucuaa

SEQ ID NO: 2175327 - RNA, 15 nt, Streptococcus pneumoniae R6
agaaaucauacaccu

SEQ ID NO: 2175328 - RNA, 18 nt, Streptococcus pneumoniae R6
agaaaucauacaccucuu

SEQ ID NO: 2175329 - RNA, 13 nt, Streptococcus pneumoniae R6
agaaaucucuuuu

SEQ ID NO: 2175330 - RNA, 18 nt, Streptococcus pneumoniae R6
agaaaucucuuuuuucuc

SEQ ID NO: 2175331 - RNA, 19 nt, Streptococcus pneumoniae R6
agaaaucgauuugacuguc

SEQ ID NO: 2175332 - RNA, 15 nt, Streptococcus pneumoniae R6
agaaauagaaaacaa

SEQ ID NO: 2175333 - RNA, 19 nt, Streptococcus pneumoniae R6
agaaauagaaaacaaaaag

SEQ ID NO: 2175334 - RNA, 22 nt, Streptococcus pneumoniae R6
agaaaucaauuugacuguccuu

SEQ ID NO: 2175335 - RNA, 16 nt, Streptococcus pneumoniae R6
agaaauauuuacuuca

SEQ ID NO: 2175336 - RNA, 16 nt, Streptococcus pneumoniae R6
agaaauaguuuagaua

SEQ ID NO: 2175337 - RNA, 20 nt, Streptococcus pneumoniae R6
agaaauaguuuagauaaaac

SEQ ID NO: 2175338 - RNA, 22 nt, Streptococcus pneumoniae R6
agaaauagcagagacauuagaa

SEQ ID NO: 2175339 - RNA, 23 nt, Streptococcus pneumoniae R6
agaaauagcagagacauuagaaa

SEQ ID NO: 2175340 - RNA, 19 nt, Streptococcus pneumoniae R6
acuuguuagcugauuuuuu

SEQ ID NO: 2175341 - RNA, 19 nt, Streptococcus pneumoniae R6
acuugugauuuaguagcau

SEQ ID NO: 2175342 - RNA, 16 nt, Streptococcus pneumoniae R6
acuuguauccuccucu

SEQ ID NO: 2175343 - RNA, 16 nt, Streptococcus pneumoniae R6
acuuuaaaaauuuuuu

SEQ ID NO: 2175344 - RNA, 19 nt, Streptococcus pneumoniae R6
acuuuaaaaauuuuuuucu

SEQ ID NO: 2175345 - RNA, 22 nt, Streptococcus pneumoniae R6
acuuuaaaaauuuuuuucuaau

SEQ ID NO: 2175346 - RNA, 21 nt, Streptococcus pneumoniae R6
acuuuaagagcuucuuuugga

SEQ ID NO: 2175347 - RNA, 12 nt, Streptococcus pneumoniae R6
acuuuauuuucu

SEQ ID NO: 2175348 - RNA, 18 nt, Streptococcus pneumoniae R6
acuuuauuuucucaucaa

SEQ ID NO: 2175349 - RNA, 21 nt, Streptococcus pneumoniae R6
acuuuauuuucucaucaaaug

SEQ ID NO: 2175350 - RNA, 15 nt, Streptococcus pneumoniae R6
acuuucaauucuuca

SEQ ID NO: 2175351 - RNA, 17 nt, Streptococcus pneumoniae R6
acuuuagcagcuuucaa

SEQ ID NO: 2175352 - RNA, 20 nt, Streptococcus pneumoniae R6
acuuuaucaccuccuucucc

SEQ ID NO: 2175353 - RNA, 22 nt, Streptococcus pneumoniae R6
acuuuaucaccuccuucuccaa

SEQ ID NO: 2175354 - RNA, 22 nt, Streptococcus pneumoniae R6
acuuuaucaccuccuucuccag

SEQ ID NO: 2175355 - RNA, 21 nt, Streptococcus pneumoniae R6
acuuugguuauaaaaaacaaa

SEQ ID NO: 2175356 - RNA, 14 nt, Streptococcus pneumoniae R6
acuuugauuuuuau

SEQ ID NO: 2175357 - RNA, 18 nt, Streptococcus pneumoniae R6
acuuugaaauuuaucaac

SEQ ID NO: 2175358 - RNA, 12 nt, Streptococcus pneumoniae R6
acuuucuuguuu

SEQ ID NO: 2175359 - RNA, 20 nt, Streptococcus pneumoniae R6
acuuucuagggcacuauggg

SEQ ID NO: 2175360 - RNA, 18 nt, Streptococcus pneumoniae R6
acuuucuaucuucauuuu

SEQ ID NO: 2175361 - RNA, 21 nt, Streptococcus pneumoniae R6
acuuucugauagauuuauuuu

SEQ ID NO: 2175362 - RNA, 18 nt, Streptococcus pneumoniae R6
acuuucuucgaaauucca

SEQ ID NO: 2175363 - RNA, 21 nt, Streptococcus pneumoniae R6
acuuucccuuuccaagaaucc

SEQ ID NO: 2175364 - RNA, 14 nt, Streptococcus pneumoniae R6
acuuuccugauaga

SEQ ID NO: 2175365 - RNA, 22 nt, Streptococcus pneumoniae R6
acuuacgugaguguagauguua

SEQ ID NO: 2175366 - RNA, 13 nt, Streptococcus pneumoniae R6
acuuacucuuauu

SEQ ID NO: 2175367 - RNA, 14 nt, Streptococcus pneumoniae R6
acuuaccaaggcuu

SEQ ID NO: 2175368 - RNA, 21 nt, Streptococcus pneumoniae R6
acuuaccaaggcuuugagggc

SEQ ID NO: 2175369 - RNA, 18 nt, Streptococcus pneumoniae R6
acuucaacccacuacagu

SEQ ID NO: 2175370 - RNA, 21 nt, Streptococcus pneumoniae R6
acuucaacccacuacaguuga

SEQ ID NO: 2175371 - RNA, 23 nt, Streptococcus pneumoniae R6
acuucaacccacuacaguugaca

SEQ ID NO: 2175372 - RNA, 13 nt, Streptococcus pneumoniae R6
acuucaaccuuac

SEQ ID NO: 2175373 - RNA, 16 nt, Streptococcus pneumoniae R6
acuucaaccuuaccac

SEQ ID NO: 2175374 - RNA, 17 nt, Streptococcus pneumoniae R6
acuucaaccuuaccacu

SEQ ID NO: 2175375 - RNA, 17 nt, Streptococcus pneumoniae R6
acuucaagaacuuuaac

SEQ ID NO: 2175376 - RNA, 16 nt, Streptococcus pneumoniae R6
acuuccaaaauuaaaa

SEQ ID NO: 2175377 - RNA, 16 nt, Streptococcus pneumoniae R6
acuuaaugaauaccau

SEQ ID NO: 2175378 - RNA, 17 nt, Streptococcus pneumoniae R6
acugugacuagcaauca

SEQ ID NO: 2175379 - RNA, 17 nt, Streptococcus pneumoniae R6
acuguccugaucgauuu

SEQ ID NO: 2175380 - RNA, 21 nt, Streptococcus pneumoniae R6
acugugcuuugugucaucagc

SEQ ID NO: 2175381 - RNA, 15 nt, Streptococcus pneumoniae R6
acuguggaaaauaga

SEQ ID NO: 2175382 - RNA, 21 nt, Streptococcus pneumoniae R6
acuguggaaaauagaaaaaau

SEQ ID NO: 2175383 - RNA, 15 nt, Streptococcus pneumoniae R6
acugugguauuaaca

SEQ ID NO: 2175384 - RNA, 16 nt, Streptococcus pneumoniae R6
acuguaggcuugugug

SEQ ID NO: 2175385 - RNA, 14 nt, Streptococcus pneumoniae R6
acugacuaaaacuu

SEQ ID NO: 2175386 - RNA, 17 nt, Streptococcus pneumoniae R6
acugacuaaaacuugug

SEQ ID NO: 2175387 - RNA, 23 nt, Streptococcus pneumoniae R6
acugacuaaaacuugugauuuag

SEQ ID NO: 2175388 - RNA, 19 nt, Streptococcus pneumoniae R6
acugacgaaaucaguaaca

SEQ ID NO: 2175389 - RNA, 18 nt, Streptococcus pneumoniae R6
acugacgaagucagcuca

SEQ ID NO: 2175390 - RNA, 20 nt, Streptococcus pneumoniae R6
acugacgaagucagcucaaa

SEQ ID NO: 2175391 - RNA, 23 nt, Streptococcus pneumoniae R6
acugacgaagucagcucaaaaca

SEQ ID NO: 2175392 - RNA, 15 nt, Streptococcus pneumoniae R6
acuguaugagaaaca

SEQ ID NO: 2175393 - RNA, 14 nt, Streptococcus pneumoniae R6
acuguauacuuuuu

SEQ ID NO: 2175394 - RNA, 15 nt, Streptococcus pneumoniae R6
acuguaguggguuga

SEQ ID NO: 2175395 - RNA, 16 nt, Streptococcus pneumoniae R6
acuguaguggguugaa

SEQ ID NO: 2175396 - RNA, 19 nt, Streptococcus pneumoniae R6
acuguauugaccaaagcau

SEQ ID NO: 2175397 - RNA, 15 nt, Streptococcus pneumoniae R6
acuucuaaggaaaaa

SEQ ID NO: 2175398 - RNA, 18 nt, Streptococcus pneumoniae R6
acuucgucacauucccau

SEQ ID NO: 2175399 - RNA, 16 nt, Streptococcus pneumoniae R6
acuucgucaguucuau

SEQ ID NO: 2175400 - RNA, 22 nt, Streptococcus pneumoniae R6
acuucgucaguucuaucuacaa

SEQ ID NO: 2175401 - RNA, 16 nt, Streptococcus pneumoniae R6
acuucgucaguuucau

SEQ ID NO: 2175402 - RNA, 17 nt, Streptococcus pneumoniae R6
acuucgucaguuucauc

SEQ ID NO: 2175403 - RNA, 14 nt, Streptococcus pneumoniae R6
acuucuaaaacauu

SEQ ID NO: 2175404 - RNA, 17 nt, Streptococcus pneumoniae R6
acuucuaaaacauucuu

SEQ ID NO: 2175405 - RNA, 19 nt, Streptococcus pneumoniae R6
acuucuaaaacauucuuag

SEQ ID NO: 2175406 - RNA, 19 nt, Streptococcus pneumoniae R6
acuucuaaaacauuguuag

SEQ ID NO: 2175407 - RNA, 16 nt, Streptococcus pneumoniae R6
acuuccaagcgaugau

SEQ ID NO: 2175408 - RNA, 22 nt, Streptococcus pneumoniae R6
acuuccaagcgaugauauccug

SEQ ID NO: 2175409 - RNA, 13 nt, Streptococcus pneumoniae R6
acuuccagcaugg

SEQ ID NO: 2175410 - RNA, 17 nt, Streptococcus pneumoniae R6
acuuccacuuccagaag

SEQ ID NO: 2175411 - RNA, 19 nt, Streptococcus pneumoniae R6
acuuccacuuccagaagau

SEQ ID NO: 2175412 - RNA, 19 nt, Streptococcus pneumoniae R6
acuucuugaccaacuuuaa

SEQ ID NO: 2175413 - RNA, 22 nt, Streptococcus pneumoniae R6
acuucuucauggaucauuucuu

SEQ ID NO: 2175414 - RNA, 20 nt, Streptococcus pneumoniae R6
acuucugagguuaaaaucuu

SEQ ID NO: 2175415 - RNA, 20 nt, Streptococcus pneumoniae R6
acuucugaaguuaaguuuuu

SEQ ID NO: 2175416 - RNA, 22 nt, Streptococcus pneumoniae R6
acuucugaaucugccucaagaa

SEQ ID NO: 2175417 - RNA, 14 nt, Streptococcus pneumoniae R6
acuucuguaaguca

SEQ ID NO: 2175418 - RNA, 16 nt, Streptococcus pneumoniae R6
acuucuguaagucauu

SEQ ID NO: 2175419 - RNA, 19 nt, Streptococcus pneumoniae R6
acuucugcuucuaaaacau

SEQ ID NO: 2175420 - RNA, 21 nt, Streptococcus pneumoniae R6
acuucuuaaucaauuaucauu

SEQ ID NO: 2175421 - RNA, 18 nt, Streptococcus pneumoniae R6
acuugauauuaugcguuu

SEQ ID NO: 2175422 - RNA, 21 nt, Streptococcus pneumoniae R6
acuugaguaaugaacucaggu

SEQ ID NO: 2175423 - RNA, 14 nt, Streptococcus pneumoniae R6
acuugagacuguuu

SEQ ID NO: 2175424 - RNA, 20 nt, Streptococcus pneumoniae R6
acuugacgcuucccucucag

SEQ ID NO: 2175425 - RNA, 19 nt, Streptococcus pneumoniae R6
acuugaaucuggcuuucaa

SEQ ID NO: 2175426 - RNA, 20 nt, Streptococcus pneumoniae R6
acuugaaucuggcuuucaau

SEQ ID NO: 2175427 - RNA, 17 nt, Streptococcus pneumoniae R6
acuugaccggagaaaga

SEQ ID NO: 2175428 - RNA, 22 nt, Streptococcus pneumoniae R6
acuugaccggagaaagaaucca

SEQ ID NO: 2175429 - RNA, 19 nt, Streptococcus pneumoniae R6
acuucuuuuucuccuaaaa

SEQ ID NO: 2175430 - RNA, 21 nt, Streptococcus pneumoniae R6
acuucuuuuucuccuaaaauu

SEQ ID NO: 2175431 - RNA, 20 nt, Streptococcus pneumoniae R6
acuucuuuuuuugauauuua

SEQ ID NO: 2175432 - RNA, 20 nt, Streptococcus pneumoniae R6
acuucuuuuugauuuaucca

SEQ ID NO: 2175433 - RNA, 21 nt, Streptococcus pneumoniae R6
acuucuuuuugauuuauccaa

SEQ ID NO: 2175434 - RNA, 15 nt, Streptococcus pneumoniae R6
acuucuuuuuguauu

SEQ ID NO: 2175435 - RNA, 22 nt, Streptococcus pneumoniae R6
acuucuuuuuguauuucuucuu

SEQ ID NO: 2175436 - RNA, 23 nt, Streptococcus pneumoniae R6
acuucuuuuuguauuucuucuuc

SEQ ID NO: 2175437 - RNA, 19 nt, Streptococcus pneumoniae R6
acuugaugaaaaaaaguuu

SEQ ID NO: 2175438 - RNA, 18 nt, Streptococcus pneumoniae R6
acuugauuaggauuuuuu

SEQ ID NO: 2175439 - RNA, 17 nt, Streptococcus pneumoniae R6
acuugauuuuugccaua

SEQ ID NO: 2175440 - RNA, 22 nt, Streptococcus pneumoniae R6
acuugauuuuugccauauagca

SEQ ID NO: 2175441 - RNA, 22 nt, Streptococcus pneumoniae R6
acuugcaaaaagacuuagcaaa

SEQ ID NO: 2175442 - RNA, 16 nt, Streptococcus pneumoniae R6
acuugauugcaaagca

SEQ ID NO: 2175443 - RNA, 21 nt, Streptococcus pneumoniae R6
acuugcauuuagauaguacca

SEQ ID NO: 2175444 - RNA, 18 nt, Streptococcus pneumoniae R6
acuugcaggaaauuuuuu

SEQ ID NO: 2175445 - RNA, 13 nt, Streptococcus pneumoniae R6
acuugccaguagc

SEQ ID NO: 2175446 - RNA, 21 nt, Streptococcus pneumoniae R6
acuugccugcuuuuucaagca

SEQ ID NO: 2175447 - RNA, 15 nt, Streptococcus pneumoniae R6
acuugcguuucuucu

SEQ ID NO: 2175448 - RNA, 13 nt, Streptococcus pneumoniae R6
acuuggaaaaaug

SEQ ID NO: 2175449 - RNA, 12 nt, Streptococcus pneumoniae R6
acuuggcaaaau

SEQ ID NO: 2175450 - RNA, 13 nt, Streptococcus pneumoniae R6
acuuggauucuuu

SEQ ID NO: 2175451 - RNA, 21 nt, Streptococcus pneumoniae R6
acuuguaggcuucuugaccag

SEQ ID NO: 2175452 - RNA, 17 nt, Streptococcus pneumoniae R6
acuugggucguaaaccu

SEQ ID NO: 2175453 - RNA, 19 nt, Streptococcus pneumoniae R6
acuugguaggauaaagugu

SEQ ID NO: 2175454 - RNA, 20 nt, Streptococcus pneumoniae R6
acuuggucgcugaguaaaga

SEQ ID NO: 2175455 - RNA, 18 nt, Streptococcus pneumoniae R6
acuuggugcccaaauacu

SEQ ID NO: 2175456 - RNA, 14 nt, Streptococcus pneumoniae R6
acuuggugcuauuu

SEQ ID NO: 2175457 - RNA, 16 nt, Streptococcus pneumoniae R6
acuugguguugagaaa

SEQ ID NO: 2175458 - RNA, 21 nt, Streptococcus pneumoniae R6
acuugguguugagaaagcacu

SEQ ID NO: 2175459 - RNA, 22 nt, Streptococcus pneumoniae R6
acuugguguugagaaagcacuu

SEQ ID NO: 2175460 - RNA, 23 nt, Streptococcus pneumoniae R6
acuugguguugagaaagcacuug

SEQ ID NO: 2175461 - RNA, 23 nt, Streptococcus pneumoniae R6
agccaagauaggaaucccuggag

SEQ ID NO: 2175462 - RNA, 12 nt, Streptococcus pneumoniae R6
agccaagacacu

SEQ ID NO: 2175463 - RNA, 21 nt, Streptococcus pneumoniae R6
agccaaucaaaaaaucucacu

SEQ ID NO: 2175464 - RNA, 12 nt, Streptococcus pneumoniae R6
agcauuuucaaa

SEQ ID NO: 2175465 - RNA, 14 nt, Streptococcus pneumoniae R6
agcauuuucuuuuu

SEQ ID NO: 2175466 - RNA, 20 nt, Streptococcus pneumoniae R6
agccaaaaguccaaagauga

SEQ ID NO: 2175467 - RNA, 18 nt, Streptococcus pneumoniae R6
agccaacucauacuuucu

SEQ ID NO: 2175468 - RNA, 14 nt, Streptococcus pneumoniae R6
agccaacaacugau

SEQ ID NO: 2175469 - RNA, 14 nt, Streptococcus pneumoniae R6
agcauuauagcucg

SEQ ID NO: 2175470 - RNA, 22 nt, Streptococcus pneumoniae R6
agcauuucgauaucguuauuag

SEQ ID NO: 2175471 - RNA, 16 nt, Streptococcus pneumoniae R6
agcauucuuuuguuca

SEQ ID NO: 2175472 - RNA, 22 nt, Streptococcus pneumoniae R6
agcaugcgcucgcuuuucaccu

SEQ ID NO: 2175473 - RNA, 15 nt, Streptococcus pneumoniae R6
agcauggcaccgccg

SEQ ID NO: 2175474 - RNA, 18 nt, Streptococcus pneumoniae R6
agccauucccaucaauau

SEQ ID NO: 2175475 - RNA, 17 nt, Streptococcus pneumoniae R6
agccaucuuuugacagu

SEQ ID NO: 2175476 - RNA, 17 nt, Streptococcus pneumoniae R6
agccaucauccaccuug

SEQ ID NO: 2175477 - RNA, 22 nt, Streptococcus pneumoniae R6
agccaggcuaauugcaaauuua

SEQ ID NO: 2175478 - RNA, 17 nt, Streptococcus pneumoniae R6
agccaguuuucguagca

SEQ ID NO: 2175479 - RNA, 13 nt, Streptococcus pneumoniae R6
agccauaaaaaua

SEQ ID NO: 2175480 - RNA, 19 nt, Streptococcus pneumoniae R6
agccauaaaaauaacuuca

SEQ ID NO: 2175481 - RNA, 15 nt, Streptococcus pneumoniae R6
agccauaaaacauuu

SEQ ID NO: 2175482 - RNA, 18 nt, Streptococcus pneumoniae R6
agccauaaaacauuuccg

SEQ ID NO: 2175483 - RNA, 15 nt, Streptococcus pneumoniae R6
agccagacugggcag

SEQ ID NO: 2175484 - RNA, 19 nt, Streptococcus pneumoniae R6
agccacugcaucugguucu

SEQ ID NO: 2175485 - RNA, 21 nt, Streptococcus pneumoniae R6
agccagaaaaaucccuuguuu

SEQ ID NO: 2175486 - RNA, 20 nt, Streptococcus pneumoniae R6
agccacuguacguccaacug

SEQ ID NO: 2175487 - RNA, 21 nt, Streptococcus pneumoniae R6
agccaccgccagaacuuccac

SEQ ID NO: 2175488 - RNA, 13 nt, Streptococcus pneumoniae R6
agcauauuuuuag

SEQ ID NO: 2175489 - RNA, 15 nt, Streptococcus pneumoniae R6
agcaucgguaagaaa

SEQ ID NO: 2175490 - RNA, 19 nt, Streptococcus pneumoniae R6
agcaucgcccauggccaua

SEQ ID NO: 2175491 - RNA, 18 nt, Streptococcus pneumoniae R6
agcaucuuguguuuuuug

SEQ ID NO: 2175492 - RNA, 16 nt, Streptococcus pneumoniae R6
agcaucuccauccuca

SEQ ID NO: 2175493 - RNA, 21 nt, Streptococcus pneumoniae R6
agcaguuguguacuacucuaa

SEQ ID NO: 2175494 - RNA, 13 nt, Streptococcus pneumoniae R6
agcauaaaagccu

SEQ ID NO: 2175495 - RNA, 16 nt, Streptococcus pneumoniae R6
agcauaacgacagaag

SEQ ID NO: 2175496 - RNA, 17 nt, Streptococcus pneumoniae R6
agcauaacgacagaaga

SEQ ID NO: 2175497 - RNA, 19 nt, Streptococcus pneumoniae R6
agcauaacgacagaagaag

SEQ ID NO: 2175498 - RNA, 23 nt, Streptococcus pneumoniae R6
agcauaacgacagaagaagugac

SEQ ID NO: 2175499 - RNA, 21 nt, Streptococcus pneumoniae R6
agcauacagagaaagucagcu

SEQ ID NO: 2175500 - RNA, 20 nt, Streptococcus pneumoniae R6
agcauacugcccugaaaucc

SEQ ID NO: 2175501 - RNA, 18 nt, Streptococcus pneumoniae R6
agcauacugaauuuagaa

SEQ ID NO: 2175502 - RNA, 13 nt, Streptococcus pneumoniae R6
agcauaggggaau

SEQ ID NO: 2175503 - RNA, 18 nt, Streptococcus pneumoniae R6
agcauaggggaauaucga

SEQ ID NO: 2175504 - RNA, 21 nt, Streptococcus pneumoniae R6
agcauagcgugcccaaaaauu

SEQ ID NO: 2175505 - RNA, 20 nt, Streptococcus pneumoniae R6
agcaguaguuggcuugucuu

SEQ ID NO: 2175506 - RNA, 15 nt, Streptococcus pneumoniae R6
agcagucaagaugga

SEQ ID NO: 2175507 - RNA, 13 nt, Streptococcus pneumoniae R6
agcaguuaugaua

SEQ ID NO: 2175508 - RNA, 13 nt, Streptococcus pneumoniae R6
agcagugguuuag

SEQ ID NO: 2175509 - RNA, 23 nt, Streptococcus pneumoniae R6
agcaguuccacgauauuguuguu

SEQ ID NO: 2175510 - RNA, 21 nt, Streptococcus pneumoniae R6
agcaggaguuuucccuguugu

SEQ ID NO: 2175511 - RNA, 21 nt, Streptococcus pneumoniae R6
agcaggacuuggauaagagaa

SEQ ID NO: 2175512 - RNA, 12 nt, Streptococcus pneumoniae R6
agcaggagaaag

SEQ ID NO: 2175513 - RNA, 19 nt, Streptococcus pneumoniae R6
agcagcuuucaaagcggga

SEQ ID NO: 2175514 - RNA, 16 nt, Streptococcus pneumoniae R6
agcagcuaaaagcaaa

SEQ ID NO: 2175515 - RNA, 22 nt, Streptococcus pneumoniae R6
agcagcuaaaagcaaagcagau

SEQ ID NO: 2175516 - RNA, 19 nt, Streptococcus pneumoniae R6
agcagcuaagaccuugaua

SEQ ID NO: 2175517 - RNA, 20 nt, Streptococcus pneumoniae R6
agcagcuaagaccuugauag

SEQ ID NO: 2175518 - RNA, 22 nt, Streptococcus pneumoniae R6
agcagccacuuuuuauccguca

SEQ ID NO: 2175519 - RNA, 20 nt, Streptococcus pneumoniae R6
agcagccuccguaccaacac

SEQ ID NO: 2175520 - RNA, 18 nt, Streptococcus pneumoniae R6
agcaauugaucccauacc

SEQ ID NO: 2175521 - RNA, 20 nt, Streptococcus pneumoniae R6
agcaauuccuuacgaacaac

SEQ ID NO: 2175522 - RNA, 23 nt, Streptococcus pneumoniae R6
agcacaaaaucaggaaaucuucu

SEQ ID NO: 2175523 - RNA, 17 nt, Streptococcus pneumoniae R6
agcaauuuugaaagauu

SEQ ID NO: 2175524 - RNA, 14 nt, Streptococcus pneumoniae R6
agcacaccaaacau

SEQ ID NO: 2175525 - RNA, 12 nt, Streptococcus pneumoniae R6
agcacacaaauc

SEQ ID NO: 2175526 - RNA, 16 nt, Streptococcus pneumoniae R6
agcacaugacaaauuc

SEQ ID NO: 2175527 - RNA, 18 nt, Streptococcus pneumoniae R6
agcaccuacaacauagac

SEQ ID NO: 2175528 - RNA, 14 nt, Streptococcus pneumoniae R6
agcaccugaacgua

SEQ ID NO: 2175529 - RNA, 18 nt, Streptococcus pneumoniae R6
agcaccuaguacaaagaa

SEQ ID NO: 2175530 - RNA, 20 nt, Streptococcus pneumoniae R6
agcaccuaguacaaagaaua

SEQ ID NO: 2175531 - RNA, 16 nt, Streptococcus pneumoniae R6
agcaccagacauuuca

SEQ ID NO: 2175532 - RNA, 22 nt, Streptococcus pneumoniae R6
agcaccuuuugcgucuucuaca

SEQ ID NO: 2175533 - RNA, 16 nt, Streptococcus pneumoniae R6
agcacggagaaucuuc

SEQ ID NO: 2175534 - RNA, 19 nt, Streptococcus pneumoniae R6
agcacggagaaucuucccg

SEQ ID NO: 2175535 - RNA, 14 nt, Streptococcus pneumoniae R6
agcacucaauauua

SEQ ID NO: 2175536 - RNA, 12 nt, Streptococcus pneumoniae R6
agcacugauuug

SEQ ID NO: 2175537 - RNA, 18 nt, Streptococcus pneumoniae R6
agcacugauuugagguug

SEQ ID NO: 2175538 - RNA, 14 nt, Streptococcus pneumoniae R6
agcacuuaaaaagu

SEQ ID NO: 2175539 - RNA, 23 nt, Streptococcus pneumoniae R6
agcacgugcggcuagccuccuag

SEQ ID NO: 2175540 - RNA, 15 nt, Streptococcus pneumoniae R6
agcacguuuuucuuc

SEQ ID NO: 2175541 - RNA, 14 nt, Streptococcus pneumoniae R6
agcacuugcuuuug

SEQ ID NO: 2175542 - RNA, 19 nt, Streptococcus pneumoniae R6
agcacuugaugaaaaaaag

SEQ ID NO: 2175543 - RNA, 20 nt, Streptococcus pneumoniae R6
agcacuugaugaaaaaaagu

SEQ ID NO: 2175544 - RNA, 13 nt, Streptococcus pneumoniae R6
agcacuuuuccau

SEQ ID NO: 2175545 - RNA, 23 nt, Streptococcus pneumoniae R6
agcagaaaaaugacaauaaaaua

SEQ ID NO: 2175546 - RNA, 13 nt, Streptococcus pneumoniae R6
agcagaguuuuua

SEQ ID NO: 2175547 - RNA, 12 nt, Streptococcus pneumoniae R6
agcagagaaaga

SEQ ID NO: 2175548 - RNA, 16 nt, Streptococcus pneumoniae R6
agcagauugaaauaag

SEQ ID NO: 2175549 - RNA, 20 nt, Streptococcus pneumoniae R6
agauuuguuuuucaaagacu

SEQ ID NO: 2175550 - RNA, 19 nt, Streptococcus pneumoniae R6
agauuuucauaaacaagag

SEQ ID NO: 2175551 - RNA, 22 nt, Streptococcus pneumoniae R6
agauuugacguuuccuucuacu

SEQ ID NO: 2175552 - RNA, 13 nt, Streptococcus pneumoniae R6
agauuugcaucaa

SEQ ID NO: 2175553 - RNA, 18 nt, Streptococcus pneumoniae R6
agauuugcaucaaucucu

SEQ ID NO: 2175554 - RNA, 12 nt, Streptococcus pneumoniae R6
agauuucuuuua

SEQ ID NO: 2175555 - RNA, 15 nt, Streptococcus pneumoniae R6
agauuugaaaacuga

SEQ ID NO: 2175556 - RNA, 14 nt, Streptococcus pneumoniae R6
agauuuauuuuugg

SEQ ID NO: 2175557 - RNA, 13 nt, Streptococcus pneumoniae R6
agauuucagaaau

SEQ ID NO: 2175558 - RNA, 22 nt, Streptococcus pneumoniae R6
agauuuccuccauaaacgcaag

SEQ ID NO: 2175559 - RNA, 18 nt, Streptococcus pneumoniae R6
agauuucgcuccagcaua

SEQ ID NO: 2175560 - RNA, 16 nt, Streptococcus pneumoniae R6
agauuuaguucuguau

SEQ ID NO: 2175561 - RNA, 21 nt, Streptococcus pneumoniae R6
agauuuacuucuuuuucuccu

SEQ ID NO: 2175562 - RNA, 21 nt, Streptococcus pneumoniae R6
agauuguaaaggaugacaaua

SEQ ID NO: 2175563 - RNA, 22 nt, Streptococcus pneumoniae R6
agauaauuuaaaacucauuaau

SEQ ID NO: 2175564 - RNA, 12 nt, Streptococcus pneumoniae R6
agauaauucucu

SEQ ID NO: 2175565 - RNA, 20 nt, Streptococcus pneumoniae R6
agauuuaaaaauguugcauu

SEQ ID NO: 2175566 - RNA, 23 nt, Streptococcus pneumoniae R6
agauuuaaaaauguugcauuuuu

SEQ ID NO: 2175567 - RNA, 21 nt, Streptococcus pneumoniae R6
agauugucgguagaacgauaa

SEQ ID NO: 2175568 - RNA, 20 nt, Streptococcus pneumoniae R6
agauaaucugcaaaguauuc

SEQ ID NO: 2175569 - RNA, 21 nt, Streptococcus pneumoniae R6
agauaauaauugacgaagaaa

SEQ ID NO: 2175570 - RNA, 16 nt, Streptococcus pneumoniae R6
agauaauagcgaugaa

SEQ ID NO: 2175571 - RNA, 22 nt, Streptococcus pneumoniae R6
agauaauagcgaugaagagaga

SEQ ID NO: 2175572 - RNA, 16 nt, Streptococcus pneumoniae R6
agauaaguuccaucug

SEQ ID NO: 2175573 - RNA, 12 nt, Streptococcus pneumoniae R6
agauaauaaaua

SEQ ID NO: 2175574 - RNA, 19 nt, Streptococcus pneumoniae R6
agauaagguucaaaaaaug

SEQ ID NO: 2175575 - RNA, 16 nt, Streptococcus pneumoniae R6
agauaaggccugauaa

SEQ ID NO: 2175576 - RNA, 13 nt, Streptococcus pneumoniae R6
agauaaggacugc

SEQ ID NO: 2175577 - RNA, 21 nt, Streptococcus pneumoniae R6
agcaaacgaacgccuuaaaaa

SEQ ID NO: 2175578 - RNA, 22 nt, Streptococcus pneumoniae R6
agcaaacgaacgccuuaaaaaa

SEQ ID NO: 2175579 - RNA, 23 nt, Streptococcus pneumoniae R6
agcaaacuaaauaccuuauccaa

SEQ ID NO: 2175580 - RNA, 12 nt, Streptococcus pneumoniae R6
agcaaagauauu

SEQ ID NO: 2175581 - RNA, 20 nt, Streptococcus pneumoniae R6
agcaaauuaaccuuauuucu

SEQ ID NO: 2175582 - RNA, 17 nt, Streptococcus pneumoniae R6
agcaaaucaacuggcau

SEQ ID NO: 2175583 - RNA, 17 nt, Streptococcus pneumoniae R6
agcaaaagcagcgacau

SEQ ID NO: 2175584 - RNA, 13 nt, Streptococcus pneumoniae R6
agcaaaagaacaa

SEQ ID NO: 2175585 - RNA, 18 nt, Streptococcus pneumoniae R6
agcaaaaaggaguuaccu

SEQ ID NO: 2175586 - RNA, 12 nt, Streptococcus pneumoniae R6
agcaaaacacua

SEQ ID NO: 2175587 - RNA, 15 nt, Streptococcus pneumoniae R6
agcaaaacacuacca

SEQ ID NO: 2175588 - RNA, 18 nt, Streptococcus pneumoniae R6
agauuuuccucauuuucu

SEQ ID NO: 2175589 - RNA, 16 nt, Streptococcus pneumoniae R6
agauuuucgaagagua

SEQ ID NO: 2175590 - RNA, 21 nt, Streptococcus pneumoniae R6
agauuuucgaagaguauaaaa

SEQ ID NO: 2175591 - RNA, 21 nt, Streptococcus pneumoniae R6
agauuuucuaagaguauaaaa

SEQ ID NO: 2175592 - RNA, 18 nt, Streptococcus pneumoniae R6
agauuuucuggcagauuu

SEQ ID NO: 2175593 - RNA, 22 nt, Streptococcus pneumoniae R6
agauuuucuggcagauuuugaa

SEQ ID NO: 2175594 - RNA, 19 nt, Streptococcus pneumoniae R6
agauuuuuaaauucuucca

SEQ ID NO: 2175595 - RNA, 14 nt, Streptococcus pneumoniae R6
agauuuuuggaaaa

SEQ ID NO: 2175596 - RNA, 21 nt, Streptococcus pneumoniae R6
agauuuuuucugucuaacuuu

SEQ ID NO: 2175597 - RNA, 12 nt, Streptococcus pneumoniae R6
agcaaaaacaau

SEQ ID NO: 2175598 - RNA, 20 nt, Streptococcus pneumoniae R6
agcaaaaaaagcccuauauu

SEQ ID NO: 2175599 - RNA, 21 nt, Streptococcus pneumoniae R6
agauuuuuuggauucucaaaa

SEQ ID NO: 2175600 - RNA, 18 nt, Streptococcus pneumoniae R6
agcaaccacguuccuugg

SEQ ID NO: 2175601 - RNA, 19 nt, Streptococcus pneumoniae R6
agcaaccacguuccuuggc

SEQ ID NO: 2175602 - RNA, 12 nt, Streptococcus pneumoniae R6
agcaaauuuaau

SEQ ID NO: 2175603 - RNA, 13 nt, Streptococcus pneumoniae R6
agcaacagcugga

SEQ ID NO: 2175604 - RNA, 18 nt, Streptococcus pneumoniae R6
agcaacuaaaaaggaacc

SEQ ID NO: 2175605 - RNA, 13 nt, Streptococcus pneumoniae R6
agcaacuucagau

SEQ ID NO: 2175606 - RNA, 14 nt, Streptococcus pneumoniae R6
agcaacuucagauu

SEQ ID NO: 2175607 - RNA, 19 nt, Streptococcus pneumoniae R6
agcaacuguuuuuucaaca

SEQ ID NO: 2175608 - RNA, 22 nt, Streptococcus pneumoniae R6
agcaaugccaaagguaauccaa

SEQ ID NO: 2175609 - RNA, 21 nt, Streptococcus pneumoniae R6
agcaaugauagacauuucacg

SEQ ID NO: 2175610 - RNA, 16 nt, Streptococcus pneumoniae R6
agcaaugguuuagaag

SEQ ID NO: 2175611 - RNA, 17 nt, Streptococcus pneumoniae R6
agcaaucauaccugcau

SEQ ID NO: 2175612 - RNA, 18 nt, Streptococcus pneumoniae R6
agcaaucauaccugcauu

SEQ ID NO: 2175613 - RNA, 14 nt, Streptococcus pneumoniae R6
agcaaucacucuaa

SEQ ID NO: 2175614 - RNA, 17 nt, Streptococcus pneumoniae R6
agcaaucacucuaacuu

SEQ ID NO: 2175615 - RNA, 18 nt, Streptococcus pneumoniae R6
agcaaucgcaaucuacuu

SEQ ID NO: 2175616 - RNA, 19 nt, Streptococcus pneumoniae R6
agcaaucgcaaucuacuug

SEQ ID NO: 2175617 - RNA, 16 nt, Streptococcus pneumoniae R6
agcaaucucuuccaaa

SEQ ID NO: 2175618 - RNA, 22 nt, Streptococcus pneumoniae R6
agcaaucuuccuuacuagcaaa

SEQ ID NO: 2175619 - RNA, 23 nt, Streptococcus pneumoniae R6
agcaagucuagacugauuaaaua

SEQ ID NO: 2175620 - RNA, 23 nt, Streptococcus pneumoniae R6
agcaaggcuuuguggucuugcuu

SEQ ID NO: 2175621 - RNA, 17 nt, Streptococcus pneumoniae R6
agcaaggcuagugggag

SEQ ID NO: 2175622 - RNA, 14 nt, Streptococcus pneumoniae R6
agcaaguucaagac

SEQ ID NO: 2175623 - RNA, 15 nt, Streptococcus pneumoniae R6
agcaagugacaaaga

SEQ ID NO: 2175624 - RNA, 14 nt, Streptococcus pneumoniae R6
agcaagugcuaaga

SEQ ID NO: 2175625 - RNA, 20 nt, Streptococcus pneumoniae R6
agcaagugcuuuuacaauau

SEQ ID NO: 2175626 - RNA, 17 nt, Streptococcus pneumoniae R6
agcaagugguucuccaa

SEQ ID NO: 2175627 - RNA, 13 nt, Streptococcus pneumoniae R6
agcaauaagacua

SEQ ID NO: 2175628 - RNA, 14 nt, Streptococcus pneumoniae R6
agcaagcuccuaaa

SEQ ID NO: 2175629 - RNA, 19 nt, Streptococcus pneumoniae R6
agcaagcuccuaaaucaac

SEQ ID NO: 2175630 - RNA, 14 nt, Streptococcus pneumoniae R6
agcaagaguuuuuc

SEQ ID NO: 2175631 - RNA, 17 nt, Streptococcus pneumoniae R6
agcugauagagauuaua

SEQ ID NO: 2175632 - RNA, 19 nt, Streptococcus pneumoniae R6
agcugauagagauuauagu

SEQ ID NO: 2175633 - RNA, 14 nt, Streptococcus pneumoniae R6
agcugaucaauauu

SEQ ID NO: 2175634 - RNA, 12 nt, Streptococcus pneumoniae R6
agcugagauacc

SEQ ID NO: 2175635 - RNA, 14 nt, Streptococcus pneumoniae R6
agcugaggaaaucc

SEQ ID NO: 2175636 - RNA, 18 nt, Streptococcus pneumoniae R6
agcugaguggauuuuucg

SEQ ID NO: 2175637 - RNA, 16 nt, Streptococcus pneumoniae R6
agcugcggcuuucuuc

SEQ ID NO: 2175638 - RNA, 18 nt, Streptococcus pneumoniae R6
agcugcggcuuucuucac

SEQ ID NO: 2175639 - RNA, 20 nt, Streptococcus pneumoniae R6
agcugcggcuuuuucuuuca

SEQ ID NO: 2175640 - RNA, 22 nt, Streptococcus pneumoniae R6
agcugcgggcugcucaaaacac

SEQ ID NO: 2175641 - RNA, 23 nt, Streptococcus pneumoniae R6
agcugcgggcugcucaaaacacu

SEQ ID NO: 2175642 - RNA, 14 nt, Streptococcus pneumoniae R6
agcugcugcuucca

SEQ ID NO: 2175643 - RNA, 21 nt, Streptococcus pneumoniae R6
agcucguucuauggcuuguuc

SEQ ID NO: 2175644 - RNA, 20 nt, Streptococcus pneumoniae R6
agcugacuucgucaguucua

SEQ ID NO: 2175645 - RNA, 19 nt, Streptococcus pneumoniae R6
agcucuguuuuuggauuuu

SEQ ID NO: 2175646 - RNA, 23 nt, Streptococcus pneumoniae R6
agcucuguuuuuggauuuuguuu

SEQ ID NO: 2175647 - RNA, 11 nt, Streptococcus pneumoniae R6
agcucuuaaaa

SEQ ID NO: 2175648 - RNA, 16 nt, Streptococcus pneumoniae R6
agcucuucagcaaaac

SEQ ID NO: 2175649 - RNA, 23 nt, Streptococcus pneumoniae R6
agcucuuggucauccauauaaau

SEQ ID NO: 2175650 - RNA, 18 nt, Streptococcus pneumoniae R6
agcucuuuagucccagcu

SEQ ID NO: 2175651 - RNA, 23 nt, Streptococcus pneumoniae R6
agcucuuuagucccagcuucuuu

SEQ ID NO: 2175652 - RNA, 17 nt, Streptococcus pneumoniae R6
agcuccauaacaauagc

SEQ ID NO: 2175653 - RNA, 21 nt, Streptococcus pneumoniae R6
agcuccaauuuauuuguuuau

SEQ ID NO: 2175654 - RNA, 13 nt, Streptococcus pneumoniae R6
agcuauagauaag

SEQ ID NO: 2175655 - RNA, 20 nt, Streptococcus pneumoniae R6
agcuauagauaaggucaucu

SEQ ID NO: 2175656 - RNA, 14 nt, Streptococcus pneumoniae R6
agcuccaaagaaga

SEQ ID NO: 2175657 - RNA, 20 nt, Streptococcus pneumoniae R6
agcuccaaauggcaugagga

SEQ ID NO: 2175658 - RNA, 22 nt, Streptococcus pneumoniae R6
agcuccaaauggcaugaggaga

SEQ ID NO: 2175659 - RNA, 13 nt, Streptococcus pneumoniae R6
agcuccaucucca

SEQ ID NO: 2175660 - RNA, 15 nt, Streptococcus pneumoniae R6
agcuccaucuccaac

SEQ ID NO: 2175661 - RNA, 18 nt, Streptococcus pneumoniae R6
agcuccgaagacggggcu

SEQ ID NO: 2175662 - RNA, 14 nt, Streptococcus pneumoniae R6
agcuccuugugcac

SEQ ID NO: 2175663 - RNA, 19 nt, Streptococcus pneumoniae R6
agcuccuugugcacacuca

SEQ ID NO: 2175664 - RNA, 21 nt, Streptococcus pneumoniae R6
agcuccuuuagugauaucuug

SEQ ID NO: 2175665 - RNA, 13 nt, Streptococcus pneumoniae R6
agcucgauaaagg

SEQ ID NO: 2175666 - RNA, 17 nt, Streptococcus pneumoniae R6
agcucgagaaaggacaa

SEQ ID NO: 2175667 - RNA, 12 nt, Streptococcus pneumoniae R6
agcguugauucc

SEQ ID NO: 2175668 - RNA, 17 nt, Streptococcus pneumoniae R6
agcguugacgauuuuuu

SEQ ID NO: 2175669 - RNA, 19 nt, Streptococcus pneumoniae R6
agcguuuugaaacuagaac

SEQ ID NO: 2175670 - RNA, 19 nt, Streptococcus pneumoniae R6
agcuagccgcagguugcuc

SEQ ID NO: 2175671 - RNA, 22 nt, Streptococcus pneumoniae R6
agcuagccgcagguugcucaaa

SEQ ID NO: 2175672 - RNA, 13 nt, Streptococcus pneumoniae R6
agcuaggagagcu

SEQ ID NO: 2175673 - RNA, 20 nt, Streptococcus pneumoniae R6
agcuagucgugaaagagcag

SEQ ID NO: 2175674 - RNA, 15 nt, Streptococcus pneumoniae R6
agcuagauauuucca

SEQ ID NO: 2175675 - RNA, 22 nt, Streptococcus pneumoniae R6
agcuacauagagauugauaucu

SEQ ID NO: 2175676 - RNA, 22 nt, Streptococcus pneumoniae R6
agcuacgacaccugacaaugua

SEQ ID NO: 2175677 - RNA, 16 nt, Streptococcus pneumoniae R6
agcuacggaacagucg

SEQ ID NO: 2175678 - RNA, 16 nt, Streptococcus pneumoniae R6
agcuaccagaccaagu

SEQ ID NO: 2175679 - RNA, 13 nt, Streptococcus pneumoniae R6
agcuacagagcua

SEQ ID NO: 2175680 - RNA, 14 nt, Streptococcus pneumoniae R6
agcuacagagcuaa

SEQ ID NO: 2175681 - RNA, 15 nt, Streptococcus pneumoniae R6
agcuaaaagcaaagc

SEQ ID NO: 2175682 - RNA, 21 nt, Streptococcus pneumoniae R6
agcguuuuuguguucuacucu

SEQ ID NO: 2175683 - RNA, 18 nt, Streptococcus pneumoniae R6
agcgcucgaugucuugga

SEQ ID NO: 2175684 - RNA, 13 nt, Streptococcus pneumoniae R6
agcgcuugauagc

SEQ ID NO: 2175685 - RNA, 15 nt, Streptococcus pneumoniae R6
agcggauuuggcuuu

SEQ ID NO: 2175686 - RNA, 15 nt, Streptococcus pneumoniae R6
agcgauuuccuugag

SEQ ID NO: 2175687 - RNA, 14 nt, Streptococcus pneumoniae R6
agcgcaaagcuaaa

SEQ ID NO: 2175688 - RNA, 19 nt, Streptococcus pneumoniae R6
agcgauugaaacagcugcg

SEQ ID NO: 2175689 - RNA, 22 nt, Streptococcus pneumoniae R6
agcgcacaagcgcuauuaaaau

SEQ ID NO: 2175690 - RNA, 20 nt, Streptococcus pneumoniae R6
agcgaguuucgauugaaauu

SEQ ID NO: 2175691 - RNA, 18 nt, Streptococcus pneumoniae R6
agcgaguagagagucaca

SEQ ID NO: 2175692 - RNA, 14 nt, Streptococcus pneumoniae R6
agcgcaggaagaaa

SEQ ID NO: 2175693 - RNA, 22 nt, Streptococcus pneumoniae R6
agcgcaggaagaaagaggagua

SEQ ID NO: 2175694 - RNA, 16 nt, Streptococcus pneumoniae R6
agcccgaaaaauuucu

SEQ ID NO: 2175695 - RNA, 22 nt, Streptococcus pneumoniae R6
agcccuauauuauaagacuuuu

SEQ ID NO: 2175696 - RNA, 16 nt, Streptococcus pneumoniae R6
agccauugaaaauccu

SEQ ID NO: 2175697 - RNA, 20 nt, Streptococcus pneumoniae R6
agccauugaaaauccuguuu

SEQ ID NO: 2175698 - RNA, 16 nt, Streptococcus pneumoniae R6
agcccacugugauuuc

SEQ ID NO: 2175699 - RNA, 23 nt, Streptococcus pneumoniae R6
agcccaguugacuguguuugaga

SEQ ID NO: 2175700 - RNA, 14 nt, Streptococcus pneumoniae R6
agcccauaaagaga

SEQ ID NO: 2175701 - RNA, 23 nt, Streptococcus pneumoniae R6
agcccaugauaucuuugauuuua

SEQ ID NO: 2175702 - RNA, 12 nt, Streptococcus pneumoniae R6
agcccuuuauga

SEQ ID NO: 2175703 - RNA, 16 nt, Streptococcus pneumoniae R6
agcccuucaucaguca

SEQ ID NO: 2175704 - RNA, 14 nt, Streptococcus pneumoniae R6
agccgacuauacuc

SEQ ID NO: 2175705 - RNA, 21 nt, Streptococcus pneumoniae R6
agccgaugaccuugagcucuu

SEQ ID NO: 2175706 - RNA, 17 nt, Streptococcus pneumoniae R6
agccggaaauugucuga

SEQ ID NO: 2175707 - RNA, 19 nt, Streptococcus pneumoniae R6
agccgcugagucauucaau

SEQ ID NO: 2175708 - RNA, 15 nt, Streptococcus pneumoniae R6
agccuucauuuuaca

SEQ ID NO: 2175709 - RNA, 16 nt, Streptococcus pneumoniae R6
agccugcuaucuuuuu

SEQ ID NO: 2175710 - RNA, 19 nt, Streptococcus pneumoniae R6
agccuguggugauugugaa

SEQ ID NO: 2175711 - RNA, 17 nt, Streptococcus pneumoniae R6
agccuguaaaaagugaa

SEQ ID NO: 2175712 - RNA, 18 nt, Streptococcus pneumoniae R6
agccuguaaaaagugaaa

SEQ ID NO: 2175713 - RNA, 22 nt, Streptococcus pneumoniae R6
agccuguaaaaagugaaaggaa

SEQ ID NO: 2175714 - RNA, 12 nt, Streptococcus pneumoniae R6
agcgaaaucaac

SEQ ID NO: 2175715 - RNA, 14 nt, Streptococcus pneumoniae R6
agcgaaaucaacac

SEQ ID NO: 2175716 - RNA, 18 nt, Streptococcus pneumoniae R6
agccuuugucguuccaag

SEQ ID NO: 2175717 - RNA, 21 nt, Streptococcus pneumoniae R6
agccuucuccuaggauuucau

SEQ ID NO: 2175718 - RNA, 22 nt, Streptococcus pneumoniae R6
agccuucuggucugauuuucau

SEQ ID NO: 2175719 - RNA, 12 nt, Streptococcus pneumoniae R6
agccuucuucca

SEQ ID NO: 2175720 - RNA, 17 nt, Streptococcus pneumoniae R6
agccuugacuccccauu

SEQ ID NO: 2175721 - RNA, 19 nt, Streptococcus pneumoniae R6
agccuugaguggauuuuua

SEQ ID NO: 2175722 - RNA, 22 nt, Streptococcus pneumoniae R6
agccuugaguggauuuuuaaga

SEQ ID NO: 2175723 - RNA, 13 nt, Streptococcus pneumoniae R6
agcgacauugacu

SEQ ID NO: 2175724 - RNA, 20 nt, Streptococcus pneumoniae R6
agcgacuauaaaaaagugaa

SEQ ID NO: 2175725 - RNA, 19 nt, Streptococcus pneumoniae R6
agcgaaaggagaaaaaaua

SEQ ID NO: 2175726 - RNA, 17 nt, Streptococcus pneumoniae R6
agcgaaaucaacacguu

SEQ ID NO: 2175727 - RNA, 16 nt, Streptococcus pneumoniae R6
agcgaacaucuccaac

SEQ ID NO: 2175728 - RNA, 17 nt, Streptococcus pneumoniae R6
agccuaucguagcuuuu

SEQ ID NO: 2175729 - RNA, 15 nt, Streptococcus pneumoniae R6
agccucauaaaaggu

SEQ ID NO: 2175730 - RNA, 22 nt, Streptococcus pneumoniae R6
agccucaaugauaccaucuuua

SEQ ID NO: 2175731 - RNA, 18 nt, Streptococcus pneumoniae R6
agccuccuaguuugcucu

SEQ ID NO: 2175732 - RNA, 15 nt, Streptococcus pneumoniae R6
agccuauaaaaagaa

SEQ ID NO: 2175733 - RNA, 14 nt, Streptococcus pneumoniae R6
agccuagucuucug

SEQ ID NO: 2175734 - RNA, 15 nt, Streptococcus pneumoniae R6
agccuacacagacug

SEQ ID NO: 2175735 - RNA, 22 nt, Streptococcus pneumoniae R6
agccuaccugcggauaaaagag

SEQ ID NO: 2175736 - RNA, 14 nt, Streptococcus pneumoniae R6
agccuaagacaacc

SEQ ID NO: 2175737 - RNA, 16 nt, Streptococcus pneumoniae R6
agccuaagacaaccaa

SEQ ID NO: 2175738 - RNA, 17 nt, Streptococcus pneumoniae R6
agccuaagacaaccaaa

SEQ ID NO: 2175739 - RNA, 21 nt, Streptococcus pneumoniae R6
agccucuugaguaauucucca

SEQ ID NO: 2175740 - RNA, 20 nt, Streptococcus pneumoniae R6
agccucuuucauagcaaaau

SEQ ID NO: 2175741 - RNA, 16 nt, Streptococcus pneumoniae R6
agccugaaucauguag

SEQ ID NO: 2175742 - RNA, 23 nt, Streptococcus pneumoniae R6
agccucuacaccauaaauauuug

SEQ ID NO: 2175743 - RNA, 13 nt, Streptococcus pneumoniae R6
agccugagaagac

SEQ ID NO: 2175744 - RNA, 21 nt, Streptococcus pneumoniae R6
agccugagaagacaucuucuc

SEQ ID NO: 2175745 - RNA, 18 nt, Streptococcus pneumoniae R6
agccugagaugauucuca

SEQ ID NO: 2175746 - RNA, 16 nt, Streptococcus pneumoniae R6
agccguugaguuuuuu

SEQ ID NO: 2175747 - RNA, 17 nt, Streptococcus pneumoniae R6
agccggcuugucuuuga

SEQ ID NO: 2175748 - RNA, 19 nt, Streptococcus pneumoniae R6
aguacgauugguucugcuc

SEQ ID NO: 2175749 - RNA, 13 nt, Streptococcus pneumoniae R6
aguacgaaacaau

SEQ ID NO: 2175750 - RNA, 22 nt, Streptococcus pneumoniae R6
agcuggccgacaucagaaccaa

SEQ ID NO: 2175751 - RNA, 16 nt, Streptococcus pneumoniae R6
aguacuuucaacuccu

SEQ ID NO: 2175752 - RNA, 23 nt, Streptococcus pneumoniae R6
aguacugcuuugagguuguagau

SEQ ID NO: 2175753 - RNA, 17 nt, Streptococcus pneumoniae R6
aguacuaaauauaagau

SEQ ID NO: 2175754 - RNA, 20 nt, Streptococcus pneumoniae R6
aguacuauugaguucacaaa

SEQ ID NO: 2175755 - RNA, 24 nt, Streptococcus pneumoniae R6
aguacuauugaguucacaaaugag

SEQ ID NO: 2175756 - RNA, 23 nt, Streptococcus pneumoniae R6
aguacugaacaaugaaaaaaaca

SEQ ID NO: 2175757 - RNA, 22 nt, Streptococcus pneumoniae R6
aguagcaaaacacuaccaagca

SEQ ID NO: 2175758 - RNA, 13 nt, Streptococcus pneumoniae R6
aguagauugaaac

SEQ ID NO: 2175759 - RNA, 16 nt, Streptococcus pneumoniae R6
aguagauugaaauaag

SEQ ID NO: 2175760 - RNA, 18 nt, Streptococcus pneumoniae R6
aguagauugaaauaagau

SEQ ID NO: 2175761 - RNA, 21 nt, Streptococcus pneumoniae R6
aguagaucaugacugagagcu

SEQ ID NO: 2175762 - RNA, 17 nt, Streptococcus pneumoniae R6
aguagaugauuuucaaa

SEQ ID NO: 2175763 - RNA, 17 nt, Streptococcus pneumoniae R6
aguagauaauauacccu

SEQ ID NO: 2175764 - RNA, 14 nt, Streptococcus pneumoniae R6
aguagagagaaagg

SEQ ID NO: 2175765 - RNA, 16 nt, Streptococcus pneumoniae R6
aguagagagaaaggag

SEQ ID NO: 2175766 - RNA, 16 nt, Streptococcus pneumoniae R6
aguagagaguucugaa

SEQ ID NO: 2175767 - RNA, 18 nt, Streptococcus pneumoniae R6
aguagacugaaucugaaa

SEQ ID NO: 2175768 - RNA, 14 nt, Streptococcus pneumoniae R6
aguagaaaguuaau

SEQ ID NO: 2175769 - RNA, 20 nt, Streptococcus pneumoniae R6
aguagaaaguuaaucucucc

SEQ ID NO: 2175770 - RNA, 22 nt, Streptococcus pneumoniae R6
aguacuuuuaauauacuugaua

SEQ ID NO: 2175771 - RNA, 21 nt, Streptococcus pneumoniae R6
aguaggccaaacuugaaauga

SEQ ID NO: 2175772 - RNA, 15 nt, Streptococcus pneumoniae R6
aguagccaaaauccu

SEQ ID NO: 2175773 - RNA, 17 nt, Streptococcus pneumoniae R6
aguagcaccaagaauaa

SEQ ID NO: 2175774 - RNA, 22 nt, Streptococcus pneumoniae R6
aguagccuugaccagaaauaaa

SEQ ID NO: 2175775 - RNA, 14 nt, Streptococcus pneumoniae R6
aguaguuuguauaa

SEQ ID NO: 2175776 - RNA, 23 nt, Streptococcus pneumoniae R6
aguagugguuuuuaggcaauaaa

SEQ ID NO: 2175777 - RNA, 22 nt, Streptococcus pneumoniae R6
aguauaaucccauugagaaaau

SEQ ID NO: 2175778 - RNA, 23 nt, Streptococcus pneumoniae R6
aguauaagauauacuaaaagcga

SEQ ID NO: 2175779 - RNA, 22 nt, Streptococcus pneumoniae R6
aguauaagucuuugauuuugag

SEQ ID NO: 2175780 - RNA, 20 nt, Streptococcus pneumoniae R6
aguauacucuaauugaaaac

SEQ ID NO: 2175781 - RNA, 22 nt, Streptococcus pneumoniae R6
aguauagcauaguauaucacuu

SEQ ID NO: 2175782 - RNA, 17 nt, Streptococcus pneumoniae R6
aguauaguaaacugaau

SEQ ID NO: 2175783 - RNA, 14 nt, Streptococcus pneumoniae R6
agucagcucuuuuu

SEQ ID NO: 2175784 - RNA, 21 nt, Streptococcus pneumoniae R6
agucagcugucuuuucaaagu

SEQ ID NO: 2175785 - RNA, 15 nt, Streptococcus pneumoniae R6
agucagcucaaaaca

SEQ ID NO: 2175786 - RNA, 17 nt, Streptococcus pneumoniae R6
agucagcucaaaacacu

SEQ ID NO: 2175787 - RNA, 13 nt, Streptococcus pneumoniae R6
agucagcucaaag

SEQ ID NO: 2175788 - RNA, 17 nt, Streptococcus pneumoniae R6
agucauaacauucuaca

SEQ ID NO: 2175789 - RNA, 19 nt, Streptococcus pneumoniae R6
agucauaacauucuacauc

SEQ ID NO: 2175790 - RNA, 20 nt, Streptococcus pneumoniae R6
agucagugguucacuggcau

SEQ ID NO: 2175791 - RNA, 16 nt, Streptococcus pneumoniae R6
agucacugucuugcca

SEQ ID NO: 2175792 - RNA, 15 nt, Streptococcus pneumoniae R6
agucaauaauccuaa

SEQ ID NO: 2175793 - RNA, 13 nt, Streptococcus pneumoniae R6
agucaagucaacu

SEQ ID NO: 2175794 - RNA, 21 nt, Streptococcus pneumoniae R6
agucaagguucuuaaccucuu

SEQ ID NO: 2175795 - RNA, 15 nt, Streptococcus pneumoniae R6
agucaagcucuugga

SEQ ID NO: 2175796 - RNA, 15 nt, Streptococcus pneumoniae R6
agucaagaagagggc

SEQ ID NO: 2175797 - RNA, 15 nt, Streptococcus pneumoniae R6
agucaaaaaaggagu

SEQ ID NO: 2175798 - RNA, 12 nt, Streptococcus pneumoniae R6
agucaaaaagaa

SEQ ID NO: 2175799 - RNA, 15 nt, Streptococcus pneumoniae R6
agucaaaaagaagga

SEQ ID NO: 2175800 - RNA, 17 nt, Streptococcus pneumoniae R6
agucaaaaccaucauaa

SEQ ID NO: 2175801 - RNA, 19 nt, Streptococcus pneumoniae R6
agucaaaauucuuugaaau

SEQ ID NO: 2175802 - RNA, 20 nt, Streptococcus pneumoniae R6
agucaaaauucuuugaaauc

SEQ ID NO: 2175803 - RNA, 18 nt, Streptococcus pneumoniae R6
agucaaaucaauuuuuaa

SEQ ID NO: 2175804 - RNA, 19 nt, Streptococcus pneumoniae R6
agucaaaucgauuucuaaa

SEQ ID NO: 2175805 - RNA, 14 nt, Streptococcus pneumoniae R6
agucacauauauaa

SEQ ID NO: 2175806 - RNA, 15 nt, Streptococcus pneumoniae R6
agucaauugaaacaa

SEQ ID NO: 2175807 - RNA, 16 nt, Streptococcus pneumoniae R6
agucaauugaaacaag

SEQ ID NO: 2175808 - RNA, 17 nt, Streptococcus pneumoniae R6
agucaaucuacuuguuc

SEQ ID NO: 2175809 - RNA, 17 nt, Streptococcus pneumoniae R6
agucaauaccagguaau

SEQ ID NO: 2175810 - RNA, 17 nt, Streptococcus pneumoniae R6
aguaucagguguugaau

SEQ ID NO: 2175811 - RNA, 18 nt, Streptococcus pneumoniae R6
aguauauucugugugugg

SEQ ID NO: 2175812 - RNA, 18 nt, Streptococcus pneumoniae R6
aguauauugaaaugaaau

SEQ ID NO: 2175813 - RNA, 18 nt, Streptococcus pneumoniae R6
aguaucaagguuuuagaa

SEQ ID NO: 2175814 - RNA, 17 nt, Streptococcus pneumoniae R6
aguaucaaguguugaaa

SEQ ID NO: 2175815 - RNA, 19 nt, Streptococcus pneumoniae R6
aguaucaaguuuuugcaca

SEQ ID NO: 2175816 - RNA, 12 nt, Streptococcus pneumoniae R6
aguaucccauuc

SEQ ID NO: 2175817 - RNA, 15 nt, Streptococcus pneumoniae R6
aguaucugaugcuga

SEQ ID NO: 2175818 - RNA, 17 nt, Streptococcus pneumoniae R6
aguaucugaugcugaca

SEQ ID NO: 2175819 - RNA, 19 nt, Streptococcus pneumoniae R6
aguaucugaugcugacaag

SEQ ID NO: 2175820 - RNA, 14 nt, Streptococcus pneumoniae R6
aguaugaaaagaga

SEQ ID NO: 2175821 - RNA, 20 nt, Streptococcus pneumoniae R6
aguaugcucgugauguuaaa

SEQ ID NO: 2175822 - RNA, 22 nt, Streptococcus pneumoniae R6
aguaugucugaauauauaauua

SEQ ID NO: 2175823 - RNA, 16 nt, Streptococcus pneumoniae R6
aguauguuuaaagucu

SEQ ID NO: 2175824 - RNA, 22 nt, Streptococcus pneumoniae R6
aguauguuuaaagucucugucc

SEQ ID NO: 2175825 - RNA, 16 nt, Streptococcus pneumoniae R6
aguauuaaaauaaguu

SEQ ID NO: 2175826 - RNA, 17 nt, Streptococcus pneumoniae R6
aguauuaaaauaaguuc

SEQ ID NO: 2175827 - RNA, 23 nt, Streptococcus pneumoniae R6
aguauuaaaauaaguucaacaaa

SEQ ID NO: 2175828 - RNA, 15 nt, Streptococcus pneumoniae R6
aguauuaaacaaaaa

SEQ ID NO: 2175829 - RNA, 18 nt, Streptococcus pneumoniae R6
aguauuagccauagcaag

SEQ ID NO: 2175830 - RNA, 15 nt, Streptococcus pneumoniae R6
aguauuacaaucaua

SEQ ID NO: 2175831 - RNA, 16 nt, Streptococcus pneumoniae R6
aguauuacauccacca

SEQ ID NO: 2175832 - RNA, 23 nt, Streptococcus pneumoniae R6
aguauucguucugucugcugacu

SEQ ID NO: 2175833 - RNA, 17 nt, Streptococcus pneumoniae R6
aguauuguaagaauuug

SEQ ID NO: 2175834 - RNA, 19 nt, Streptococcus pneumoniae R6
aguauuucauuacagaaca

SEQ ID NO: 2175835 - RNA, 12 nt, Streptococcus pneumoniae R6
aguauuuuuagu

SEQ ID NO: 2175836 - RNA, 19 nt, Streptococcus pneumoniae R6
aguauuuuuaguucuacuu

SEQ ID NO: 2175837 - RNA, 21 nt, Streptococcus pneumoniae R6
aguauuuuaaaacgaaaggau

SEQ ID NO: 2175838 - RNA, 20 nt, Streptococcus pneumoniae R6
aguauuuuauaguaauuccc

SEQ ID NO: 2175839 - RNA, 20 nt, Streptococcus pneumoniae R6
agucgcuacaggcaugggca

SEQ ID NO: 2175840 - RNA, 15 nt, Streptococcus pneumoniae R6
agucggcaggcuggu

SEQ ID NO: 2175841 - RNA, 13 nt, Streptococcus pneumoniae R6
agucgaguuuuuu

SEQ ID NO: 2175842 - RNA, 13 nt, Streptococcus pneumoniae R6
agucgauaaaaag

SEQ ID NO: 2175843 - RNA, 21 nt, Streptococcus pneumoniae R6
agucgcagguugcucaaagua

SEQ ID NO: 2175844 - RNA, 17 nt, Streptococcus pneumoniae R6
agucgcaaagaggaaga

SEQ ID NO: 2175845 - RNA, 14 nt, Streptococcus pneumoniae R6
agucccuuagaaaa

SEQ ID NO: 2175846 - RNA, 16 nt, Streptococcus pneumoniae R6
aguccucauuucaaua

SEQ ID NO: 2175847 - RNA, 22 nt, Streptococcus pneumoniae R6
aguccucaauuugaaccugcuu

SEQ ID NO: 2175848 - RNA, 17 nt, Streptococcus pneumoniae R6
aguccucccuucuuucu

SEQ ID NO: 2175849 - RNA, 22 nt, Streptococcus pneumoniae R6
aguccucguagcggauuuucaa

SEQ ID NO: 2175850 - RNA, 15 nt, Streptococcus pneumoniae R6
aguccugaaaaucau

SEQ ID NO: 2175851 - RNA, 19 nt, Streptococcus pneumoniae R6
aguccugcgacuacuaguu

SEQ ID NO: 2175852 - RNA, 23 nt, Streptococcus pneumoniae R6
aguccaacuguaaagacauuaua

SEQ ID NO: 2175853 - RNA, 20 nt, Streptococcus pneumoniae R6
aguccaagacguucaaagau

SEQ ID NO: 2175854 - RNA, 20 nt, Streptococcus pneumoniae R6
aguccaagauucaacaucac

SEQ ID NO: 2175855 - RNA, 16 nt, Streptococcus pneumoniae R6
aguccacguuuuucca

SEQ ID NO: 2175856 - RNA, 16 nt, Streptococcus pneumoniae R6
aguccauuuggcaccg

SEQ ID NO: 2175857 - RNA, 17 nt, Streptococcus pneumoniae R6
agucccagcuucuuuuu

SEQ ID NO: 2175858 - RNA, 15 nt, Streptococcus pneumoniae R6
agucccauuuucaga

SEQ ID NO: 2175859 - RNA, 23 nt, Streptococcus pneumoniae R6
aguccauauuagggcaaauaaaa

SEQ ID NO: 2175860 - RNA, 19 nt, Streptococcus pneumoniae R6
aguccauagcgucaaagaa

SEQ ID NO: 2175861 - RNA, 15 nt, Streptococcus pneumoniae R6
agucauacuuucucg

SEQ ID NO: 2175862 - RNA, 23 nt, Streptococcus pneumoniae R6
agucauagacacgguaaguggua

SEQ ID NO: 2175863 - RNA, 15 nt, Streptococcus pneumoniae R6
agucaucaauauuag

SEQ ID NO: 2175864 - RNA, 18 nt, Streptococcus pneumoniae R6
agucaucuauaaucaaua

SEQ ID NO: 2175865 - RNA, 19 nt, Streptococcus pneumoniae R6
agucaucuauaaucaauau

SEQ ID NO: 2175866 - RNA, 16 nt, Streptococcus pneumoniae R6
agucaugggcgaugaa

SEQ ID NO: 2175867 - RNA, 17 nt, Streptococcus pneumoniae R6
agucaugaccccuaaau

SEQ ID NO: 2175868 - RNA, 23 nt, Streptococcus pneumoniae R6
agucaugaccccuaaauauaauc

SEQ ID NO: 2175869 - RNA, 22 nt, Streptococcus pneumoniae R6
agucaugagaguuuuuggcauu

SEQ ID NO: 2175870 - RNA, 18 nt, Streptococcus pneumoniae R6
agucauuagauauagaau

SEQ ID NO: 2175871 - RNA, 13 nt, Streptococcus pneumoniae R6
agucauucaaucc

SEQ ID NO: 2175872 - RNA, 22 nt, Streptococcus pneumoniae R6
agucauuccauggcugacaaca

SEQ ID NO: 2175873 - RNA, 11 nt, Streptococcus pneumoniae R6
agucauuuucu

SEQ ID NO: 2175874 - RNA, 15 nt, Streptococcus pneumoniae R6
agucauuuuguucuc

SEQ ID NO: 2175875 - RNA, 23 nt, Streptococcus pneumoniae R6
agucauucgaaugauuucucuug

SEQ ID NO: 2175876 - RNA, 22 nt, Streptococcus pneumoniae R6
agucauuguucuuguuuugaca

SEQ ID NO: 2175877 - RNA, 16 nt, Streptococcus pneumoniae R6
aguggcaggaauaucc

SEQ ID NO: 2175878 - RNA, 17 nt, Streptococcus pneumoniae R6
aguggcaggaauaucca

SEQ ID NO: 2175879 - RNA, 18 nt, Streptococcus pneumoniae R6
aguggaaagaggacuuuu

SEQ ID NO: 2175880 - RNA, 23 nt, Streptococcus pneumoniae R6
agugcggacggucuuuggaaaua

SEQ ID NO: 2175881 - RNA, 19 nt, Streptococcus pneumoniae R6
agugcaaauaagaaaucuc

SEQ ID NO: 2175882 - RNA, 20 nt, Streptococcus pneumoniae R6
agugcaaacuaggaagcuag

SEQ ID NO: 2175883 - RNA, 22 nt, Streptococcus pneumoniae R6
agugauuuaaauguuuucucau

SEQ ID NO: 2175884 - RNA, 23 nt, Streptococcus pneumoniae R6
agugauuguguccucaauauagu

SEQ ID NO: 2175885 - RNA, 14 nt, Streptococcus pneumoniae R6
agugauaacauaac

SEQ ID NO: 2175886 - RNA, 17 nt, Streptococcus pneumoniae R6
agugauaacgaauacca

SEQ ID NO: 2175887 - RNA, 20 nt, Streptococcus pneumoniae R6
agugaguuuuacaauguaau

SEQ ID NO: 2175888 - RNA, 17 nt, Streptococcus pneumoniae R6
agugaaggcuuuaaaug

SEQ ID NO: 2175889 - RNA, 12 nt, Streptococcus pneumoniae R6
agugaaaggaag

SEQ ID NO: 2175890 - RNA, 13 nt, Streptococcus pneumoniae R6
agugaaaggaaga

SEQ ID NO: 2175891 - RNA, 13 nt, Streptococcus pneumoniae R6
agucuauucuuuc

SEQ ID NO: 2175892 - RNA, 22 nt, Streptococcus pneumoniae R6
auaacagcugcgauuuuagcac

SEQ ID NO: 2175893 - RNA, 21 nt, Streptococcus pneumoniae R6
auaacaggaauuucgcuauuu

SEQ ID NO: 2175894 - RNA, 13 nt, Streptococcus pneumoniae R6
auaacaaaccaag

SEQ ID NO: 2175895 - RNA, 21 nt, Streptococcus pneumoniae R6
auaacaacucccuccuaagga

SEQ ID NO: 2175896 - RNA, 21 nt, Streptococcus pneumoniae R6
auaaauuucaaaguagauacu

SEQ ID NO: 2175897 - RNA, 14 nt, Streptococcus pneumoniae R6
auaaauugagcauu

SEQ ID NO: 2175898 - RNA, 17 nt, Streptococcus pneumoniae R6
auaaauugcuggagaau

SEQ ID NO: 2175899 - RNA, 22 nt, Streptococcus pneumoniae R6
auaaauugcuggagaaucauca

SEQ ID NO: 2175900 - RNA, 17 nt, Streptococcus pneumoniae R6
auaaccaucauuuuuag

SEQ ID NO: 2175901 - RNA, 19 nt, Streptococcus pneumoniae R6
auaacgaauccaacucuug

SEQ ID NO: 2175902 - RNA, 21 nt, Streptococcus pneumoniae R6
auaacaguuuuuaauuuuucu

SEQ ID NO: 2175903 - RNA, 23 nt, Streptococcus pneumoniae R6
auaacaguuuuuaauuuuucuuu

SEQ ID NO: 2175904 - RNA, 23 nt, Streptococcus pneumoniae R6
auaacaguauacuggagaauuga

SEQ ID NO: 2175905 - RNA, 16 nt, Streptococcus pneumoniae R6
auaaauccagcugaga

SEQ ID NO: 2175906 - RNA, 11 nt, Streptococcus pneumoniae R6
auaaaucaauu

SEQ ID NO: 2175907 - RNA, 13 nt, Streptococcus pneumoniae R6
auaaauuauuucu

SEQ ID NO: 2175908 - RNA, 14 nt, Streptococcus pneumoniae R6
auaaauaguuauag

SEQ ID NO: 2175909 - RNA, 15 nt, Streptococcus pneumoniae R6
auaaauauaguaaaa

SEQ ID NO: 2175910 - RNA, 17 nt, Streptococcus pneumoniae R6
auaaauaucaaaaaaag

SEQ ID NO: 2175911 - RNA, 22 nt, Streptococcus pneumoniae R6
auaaauagauuggauaaaaucu

SEQ ID NO: 2175912 - RNA, 15 nt, Streptococcus pneumoniae R6
auaaauacuaucaau

SEQ ID NO: 2175913 - RNA, 17 nt, Streptococcus pneumoniae R6
auaaauacuaucaauaa

SEQ ID NO: 2175914 - RNA, 20 nt, Streptococcus pneumoniae R6
auaaauacuaucaauaaaau

SEQ ID NO: 2175915 - RNA, 14 nt, Streptococcus pneumoniae R6
auaaaguuucugua

SEQ ID NO: 2175916 - RNA, 16 nt, Streptococcus pneumoniae R6
auaaaguuucuguaau

SEQ ID NO: 2175917 - RNA, 16 nt, Streptococcus pneumoniae R6
auaaaguuaugaaaaa

SEQ ID NO: 2175918 - RNA, 21 nt, Streptococcus pneumoniae R6
auaaaguuccuuuaggugaaa

SEQ ID NO: 2175919 - RNA, 18 nt, Streptococcus pneumoniae R6
auaaagugucucccuuuu

SEQ ID NO: 2175920 - RNA, 19 nt, Streptococcus pneumoniae R6
auaaacaucucgugcauuu

SEQ ID NO: 2175921 - RNA, 17 nt, Streptococcus pneumoniae R6
auaaaauuucuugacau

SEQ ID NO: 2175922 - RNA, 20 nt, Streptococcus pneumoniae R6
auaaaauuucuugacauaca

SEQ ID NO: 2175923 - RNA, 17 nt, Streptococcus pneumoniae R6
auaaacagcgagcuuca

SEQ ID NO: 2175924 - RNA, 21 nt, Streptococcus pneumoniae R6
auaaacuuuuucauaaauaga

SEQ ID NO: 2175925 - RNA, 13 nt, Streptococcus pneumoniae R6
auaaagaaacuug

SEQ ID NO: 2175926 - RNA, 20 nt, Streptococcus pneumoniae R6
auaaagaaacuuggcaaaau

SEQ ID NO: 2175927 - RNA, 20 nt, Streptococcus pneumoniae R6
auaaacuugcaggaaauuuu

SEQ ID NO: 2175928 - RNA, 15 nt, Streptococcus pneumoniae R6
auaaacuuugguuau

SEQ ID NO: 2175929 - RNA, 19 nt, Streptococcus pneumoniae R6
auaaacuuugguuauaaaa

SEQ ID NO: 2175930 - RNA, 21 nt, Streptococcus pneumoniae R6
auaaacgcaagcaacaaaaac

SEQ ID NO: 2175931 - RNA, 21 nt, Streptococcus pneumoniae R6
auaaaauuuaaaaauagauuu

SEQ ID NO: 2175932 - RNA, 17 nt, Streptococcus pneumoniae R6
auaaaauuccuuuaaaa

SEQ ID NO: 2175933 - RNA, 18 nt, Streptococcus pneumoniae R6
auaaaauuccuuuaaaaa

SEQ ID NO: 2175934 - RNA, 20 nt, Streptococcus pneumoniae R6
auaaaauuccuuuaaaaaca

SEQ ID NO: 2175935 - RNA, 12 nt, Streptococcus pneumoniae R6
auaaaauauagu

SEQ ID NO: 2175936 - RNA, 15 nt, Streptococcus pneumoniae R6
auaaaauauaguaga

SEQ ID NO: 2175937 - RNA, 21 nt, Streptococcus pneumoniae R6
auaaaaucagguguucaaaaa

SEQ ID NO: 2175938 - RNA, 15 nt, Streptococcus pneumoniae R6
auaaaaucaaacaaa

SEQ ID NO: 2175939 - RNA, 12 nt, Streptococcus pneumoniae R6
auaaaaugaaau

SEQ ID NO: 2175940 - RNA, 14 nt, Streptococcus pneumoniae R6
auaaaaugaaauaa

SEQ ID NO: 2175941 - RNA, 18 nt, Streptococcus pneumoniae R6
auaaaaucugaagaaagc

SEQ ID NO: 2175942 - RNA, 20 nt, Streptococcus pneumoniae R6
auaaaaucugaagaaagcaa

SEQ ID NO: 2175943 - RNA, 16 nt, Streptococcus pneumoniae R6
auaaaaucugaaucaa

SEQ ID NO: 2175944 - RNA, 18 nt, Streptococcus pneumoniae R6
auaaaagaguuuuuggaa

SEQ ID NO: 2175945 - RNA, 11 nt, Streptococcus pneumoniae R6
auaaaagauag

SEQ ID NO: 2175946 - RNA, 23 nt, Streptococcus pneumoniae R6
auaaaagauagagaaagaaaaac

SEQ ID NO: 2175947 - RNA, 13 nt, Streptococcus pneumoniae R6
auaaaacuuauga

SEQ ID NO: 2175948 - RNA, 14 nt, Streptococcus pneumoniae R6
auaaaacuuuuaaa

SEQ ID NO: 2175949 - RNA, 22 nt, Streptococcus pneumoniae R6
auaaaacuuuuaaaauccauaa

SEQ ID NO: 2175950 - RNA, 16 nt, Streptococcus pneumoniae R6
auaaaagucuggcucg

SEQ ID NO: 2175951 - RNA, 19 nt, Streptococcus pneumoniae R6
auaaaaguaacaccucuuc

SEQ ID NO: 2175952 - RNA, 16 nt, Streptococcus pneumoniae R6
auaaaagguauugcaa

SEQ ID NO: 2175953 - RNA, 13 nt, Streptococcus pneumoniae R6
auaaaagcuaaca

SEQ ID NO: 2175954 - RNA, 17 nt, Streptococcus pneumoniae R6
auaaaacguaauuucau

SEQ ID NO: 2175955 - RNA, 22 nt, Streptococcus pneumoniae R6
auaaaacguacaguaucaaggu

SEQ ID NO: 2175956 - RNA, 23 nt, Streptococcus pneumoniae R6
auaaaacuauaaucuguuaucuu

SEQ ID NO: 2175957 - RNA, 16 nt, Streptococcus pneumoniae R6
auaaaacuauugacuu

SEQ ID NO: 2175958 - RNA, 17 nt, Streptococcus pneumoniae R6
auaaaacuauugacuuu

SEQ ID NO: 2175959 - RNA, 22 nt, Streptococcus pneumoniae R6
auaaaacugacgugguuuaaaa

SEQ ID NO: 2175960 - RNA, 22 nt, Streptococcus pneumoniae R6
auaaaaccuguuugaaucaauu

SEQ ID NO: 2175961 - RNA, 16 nt, Streptococcus pneumoniae R6
auaaaaauccuuuuuu

SEQ ID NO: 2175962 - RNA, 23 nt, Streptococcus pneumoniae R6
auaaaaccaaaaaguggaaagag

SEQ ID NO: 2175963 - RNA, 22 nt, Streptococcus pneumoniae R6
aguucaguagauuaaaggcaua

SEQ ID NO: 2175964 - RNA, 20 nt, Streptococcus pneumoniae R6
aguucaucuucaaaaucaaa

SEQ ID NO: 2175965 - RNA, 13 nt, Streptococcus pneumoniae R6
aguucauuaugau

SEQ ID NO: 2175966 - RNA, 20 nt, Streptococcus pneumoniae R6
aguucgaugucaccaaacaa

SEQ ID NO: 2175967 - RNA, 21 nt, Streptococcus pneumoniae R6
aguuccggaaaccaaaggcuu

SEQ ID NO: 2175968 - RNA, 12 nt, Streptococcus pneumoniae R6
aguucuuuaaag

SEQ ID NO: 2175969 - RNA, 18 nt, Streptococcus pneumoniae R6
aguucuuuucauaaagag

SEQ ID NO: 2175970 - RNA, 16 nt, Streptococcus pneumoniae R6
aguucuuuucauuguu

SEQ ID NO: 2175971 - RNA, 14 nt, Streptococcus pneumoniae R6
aguucuuuuguaaa

SEQ ID NO: 2175972 - RNA, 17 nt, Streptococcus pneumoniae R6
aguucuugaaaugaagu

SEQ ID NO: 2175973 - RNA, 17 nt, Streptococcus pneumoniae R6
aguucucuuucuaaaau

SEQ ID NO: 2175974 - RNA, 20 nt, Streptococcus pneumoniae R6
aguucucuuucuaaaauagu

SEQ ID NO: 2175975 - RNA, 19 nt, Streptococcus pneumoniae R6
aguucucuagucuggagau

SEQ ID NO: 2175976 - RNA, 22 nt, Streptococcus pneumoniae R6
aguucuagcuuccccauucuau

SEQ ID NO: 2175977 - RNA, 15 nt, Streptococcus pneumoniae R6
aguucucaaccacaa

SEQ ID NO: 2175978 - RNA, 20 nt, Streptococcus pneumoniae R6
aguucuauccacaaccucaa

SEQ ID NO: 2175979 - RNA, 22 nt, Streptococcus pneumoniae R6
aguucuauccacaaccucaaaa

SEQ ID NO: 2175980 - RNA, 20 nt, Streptococcus pneumoniae R6
aguucuauccacaaccuuaa

SEQ ID NO: 2175981 - RNA, 22 nt, Streptococcus pneumoniae R6
aguucuauccacaaccuuaaaa

SEQ ID NO: 2175982 - RNA, 13 nt, Streptococcus pneumoniae R6
aguucuaucugca

SEQ ID NO: 2175983 - RNA, 15 nt, Streptococcus pneumoniae R6
aguucuaucugcaac

SEQ ID NO: 2175984 - RNA, 16 nt, Streptococcus pneumoniae R6
aguucuaucugcaacc

SEQ ID NO: 2175985 - RNA, 20 nt, Streptococcus pneumoniae R6
aguucuaucugcaaccucaa

SEQ ID NO: 2175986 - RNA, 22 nt, Streptococcus pneumoniae R6
aguucuaucugcaaccucaaaa

SEQ ID NO: 2175987 - RNA, 20 nt, Streptococcus pneumoniae R6
aguucuaucugcaaccuuaa

SEQ ID NO: 2175988 - RNA, 22 nt, Streptococcus pneumoniae R6
aguucuaucugccaccucaaaa

SEQ ID NO: 2175989 - RNA, 14 nt, Streptococcus pneumoniae R6
aguuauuaacaaaa

SEQ ID NO: 2175990 - RNA, 18 nt, Streptococcus pneumoniae R6
aguuaugauauugaguuu

SEQ ID NO: 2175991 - RNA, 14 nt, Streptococcus pneumoniae R6
aguuaucugcaaaa

SEQ ID NO: 2175992 - RNA, 18 nt, Streptococcus pneumoniae R6
aguuauauugacagaaga

SEQ ID NO: 2175993 - RNA, 20 nt, Streptococcus pneumoniae R6
aguuauauugacagaagauu

SEQ ID NO: 2175994 - RNA, 12 nt, Streptococcus pneumoniae R6
aguuaccauuga

SEQ ID NO: 2175995 - RNA, 19 nt, Streptococcus pneumoniae R6
aguuacaucaguauuucau

SEQ ID NO: 2175996 - RNA, 22 nt, Streptococcus pneumoniae R6
aguuauuggaacuaaaguuccu

SEQ ID NO: 2175997 - RNA, 22 nt, Streptococcus pneumoniae R6
aguuauuucuccuaaagaaaaa

SEQ ID NO: 2175998 - RNA, 23 nt, Streptococcus pneumoniae R6
aguuauuucuccuaaagaaaaag

SEQ ID NO: 2175999 - RNA, 19 nt, Streptococcus pneumoniae R6
aguucagaauuuucuuacu

SEQ ID NO: 2176000 - RNA, 21 nt, Streptococcus pneumoniae R6
aguucagcaguaaucacugca

SEQ ID NO: 2176001 - RNA, 18 nt, Streptococcus pneumoniae R6
aguuaauggccaccuuca

SEQ ID NO: 2176002 - RNA, 16 nt, Streptococcus pneumoniae R6
aguuaaucucuccuua

SEQ ID NO: 2176003 - RNA, 17 nt, Streptococcus pneumoniae R6
aguuaaauuaguuuuua

SEQ ID NO: 2176004 - RNA, 15 nt, Streptococcus pneumoniae R6
aguuaaauuauuaaa

SEQ ID NO: 2176005 - RNA, 19 nt, Streptococcus pneumoniae R6
aguuaaauucuucuccuac

SEQ ID NO: 2176006 - RNA, 18 nt, Streptococcus pneumoniae R6
aguuaaauaauagaaauu

SEQ ID NO: 2176007 - RNA, 13 nt, Streptococcus pneumoniae R6
aguuuaucuagaa

SEQ ID NO: 2176008 - RNA, 23 nt, Streptococcus pneumoniae R6
aguuuaucucuugccuagcgauu

SEQ ID NO: 2176009 - RNA, 15 nt, Streptococcus pneumoniae R6
aguuuagaagaggua

SEQ ID NO: 2176010 - RNA, 15 nt, Streptococcus pneumoniae R6
aguuuacuauccuca

SEQ ID NO: 2176011 - RNA, 15 nt, Streptococcus pneumoniae R6
aguugugaaugccac

SEQ ID NO: 2176012 - RNA, 21 nt, Streptococcus pneumoniae R6
aguugggugaugaguucaucu

SEQ ID NO: 2176013 - RNA, 14 nt, Streptococcus pneumoniae R6
aguugguagguaua

SEQ ID NO: 2176014 - RNA, 21 nt, Streptococcus pneumoniae R6
aguugguuuauugaguuuuuu

SEQ ID NO: 2176015 - RNA, 19 nt, Streptococcus pneumoniae R6
aguuguaaucuuagcaaag

SEQ ID NO: 2176016 - RNA, 20 nt, Streptococcus pneumoniae R6
aguuguaaucuuagcaaaga

SEQ ID NO: 2176017 - RNA, 23 nt, Streptococcus pneumoniae R6
aguugggauaaacguaaaaguca

SEQ ID NO: 2176018 - RNA, 21 nt, Streptococcus pneumoniae R6
aguuggcuugguucuucacua

SEQ ID NO: 2176019 - RNA, 15 nt, Streptococcus pneumoniae R6
aguuggcuugucuuu

SEQ ID NO: 2176020 - RNA, 20 nt, Streptococcus pneumoniae R6
aguugauagaaagcaaggcu

SEQ ID NO: 2176021 - RNA, 23 nt, Streptococcus pneumoniae R6
aguugcauugucagagucuugau

SEQ ID NO: 2176022 - RNA, 21 nt, Streptococcus pneumoniae R6
aguugcaucuuaguuaaaaua

SEQ ID NO: 2176023 - RNA, 14 nt, Streptococcus pneumoniae R6
aguugcccaccugc

SEQ ID NO: 2176024 - RNA, 21 nt, Streptococcus pneumoniae R6
aguugaugggauauauauaau

SEQ ID NO: 2176025 - RNA, 20 nt, Streptococcus pneumoniae R6
aguugcauagcgaagaacaa

SEQ ID NO: 2176026 - RNA, 22 nt, Streptococcus pneumoniae R6
aguugaccuugaccagccaaga

SEQ ID NO: 2176027 - RNA, 12 nt, Streptococcus pneumoniae R6
aguugagcuggc

SEQ ID NO: 2176028 - RNA, 12 nt, Streptococcus pneumoniae R6
aguuuuuccucg

SEQ ID NO: 2176029 - RNA, 13 nt, Streptococcus pneumoniae R6
aguuuucaaaguu

SEQ ID NO: 2176030 - RNA, 15 nt, Streptococcus pneumoniae R6
auaaaaaagugaaca

SEQ ID NO: 2176031 - RNA, 13 nt, Streptococcus pneumoniae R6
auaaaaaagagag

SEQ ID NO: 2176032 - RNA, 20 nt, Streptococcus pneumoniae R6
auaaaaaacucuccugggaa

SEQ ID NO: 2176033 - RNA, 13 nt, Streptococcus pneumoniae R6
auaaaaaagaagg

SEQ ID NO: 2176034 - RNA, 20 nt, Streptococcus pneumoniae R6
aguuuuuucucuguuaccac

SEQ ID NO: 2176035 - RNA, 16 nt, Streptococcus pneumoniae R6
aguuuuuuauuuuccc

SEQ ID NO: 2176036 - RNA, 21 nt, Streptococcus pneumoniae R6
aguuuuuuauuuucccaguag

SEQ ID NO: 2176037 - RNA, 17 nt, Streptococcus pneumoniae R6
aguuucaauuugauaua

SEQ ID NO: 2176038 - RNA, 22 nt, Streptococcus pneumoniae R6
aguuucaucuacaaccucaaaa

SEQ ID NO: 2176039 - RNA, 17 nt, Streptococcus pneumoniae R6
aguuuuaggaauauuau

SEQ ID NO: 2176040 - RNA, 16 nt, Streptococcus pneumoniae R6
aguuuuaucaguaauc

SEQ ID NO: 2176041 - RNA, 20 nt, Streptococcus pneumoniae R6
aguuuuaucaguaaucucaa

SEQ ID NO: 2176042 - RNA, 22 nt, Streptococcus pneumoniae R6
aguuuuaucaguaaucucaaaa

SEQ ID NO: 2176043 - RNA, 14 nt, Streptococcus pneumoniae R6
aguuugcucuuuga

SEQ ID NO: 2176044 - RNA, 17 nt, Streptococcus pneumoniae R6
aguuugcucuuugauuu

SEQ ID NO: 2176045 - RNA, 21 nt, Streptococcus pneumoniae R6
aguuugcucuuugauuuucau

SEQ ID NO: 2176046 - RNA, 16 nt, Streptococcus pneumoniae R6
aguuuggcgaugauuu

SEQ ID NO: 2176047 - RNA, 17 nt, Streptococcus pneumoniae R6
aguuuggcuucaguaau

SEQ ID NO: 2176048 - RNA, 15 nt, Streptococcus pneumoniae R6
auagaaauauuuuag

SEQ ID NO: 2176049 - RNA, 19 nt, Streptococcus pneumoniae R6
auagaaaucacgacuuucu

SEQ ID NO: 2176050 - RNA, 18 nt, Streptococcus pneumoniae R6
auagaaagcuuacaucau

SEQ ID NO: 2176051 - RNA, 18 nt, Streptococcus pneumoniae R6
auagaaguggauuuucuu

SEQ ID NO: 2176052 - RNA, 17 nt, Streptococcus pneumoniae R6
auagaaggcaauuaaaa

SEQ ID NO: 2176053 - RNA, 11 nt, Streptococcus pneumoniae R6
auagaacugac

SEQ ID NO: 2176054 - RNA, 12 nt, Streptococcus pneumoniae R6
auagaauuuuuu

SEQ ID NO: 2176055 - RNA, 17 nt, Streptococcus pneumoniae R6
auagaauuuuuuguugc

SEQ ID NO: 2176056 - RNA, 14 nt, Streptococcus pneumoniae R6
auagaauaauuugg

SEQ ID NO: 2176057 - RNA, 17 nt, Streptococcus pneumoniae R6
auagaaucauggccacg

SEQ ID NO: 2176058 - RNA, 16 nt, Streptococcus pneumoniae R6
auagaauccauuuguu

SEQ ID NO: 2176059 - RNA, 12 nt, Streptococcus pneumoniae R6
auacuuauccuu

SEQ ID NO: 2176060 - RNA, 14 nt, Streptococcus pneumoniae R6
auacuuauccuuuu

SEQ ID NO: 2176061 - RNA, 19 nt, Streptococcus pneumoniae R6
auacuuauccuuuuuuacu

SEQ ID NO: 2176062 - RNA, 14 nt, Streptococcus pneumoniae R6
auacuguuuuccuu

SEQ ID NO: 2176063 - RNA, 14 nt, Streptococcus pneumoniae R6
auacuacaauaauu

SEQ ID NO: 2176064 - RNA, 22 nt, Streptococcus pneumoniae R6
auacuagauggcuaacuucauu

SEQ ID NO: 2176065 - RNA, 19 nt, Streptococcus pneumoniae R6
auacuagauucuauuuuuu

SEQ ID NO: 2176066 - RNA, 13 nt, Streptococcus pneumoniae R6
auacuauaaaaca

SEQ ID NO: 2176067 - RNA, 14 nt, Streptococcus pneumoniae R6
auagaaaacaacuu

SEQ ID NO: 2176068 - RNA, 19 nt, Streptococcus pneumoniae R6
auagaaaacaacuuauaaa

SEQ ID NO: 2176069 - RNA, 14 nt, Streptococcus pneumoniae R6
auagaaaaaucccc

SEQ ID NO: 2176070 - RNA, 20 nt, Streptococcus pneumoniae R6
auagaaaaaagucuuuaaaa

SEQ ID NO: 2176071 - RNA, 20 nt, Streptococcus pneumoniae R6
auagaaacaucuuauuauca

SEQ ID NO: 2176072 - RNA, 20 nt, Streptococcus pneumoniae R6
auagaaaaugguuccaaaag

SEQ ID NO: 2176073 - RNA, 16 nt, Streptococcus pneumoniae R6
auagaaaaggaguaga

SEQ ID NO: 2176074 - RNA, 14 nt, Streptococcus pneumoniae R6
auacuuuuucaguu

SEQ ID NO: 2176075 - RNA, 18 nt, Streptococcus pneumoniae R6
auacuuuuucaguuuuag

SEQ ID NO: 2176076 - RNA, 13 nt, Streptococcus pneumoniae R6
auacuuuuuccug

SEQ ID NO: 2176077 - RNA, 23 nt, Streptococcus pneumoniae R6
auacuuuuuccugguaauagcgu

SEQ ID NO: 2176078 - RNA, 23 nt, Streptococcus pneumoniae R6
auacuuuuucguuugguaagagu

SEQ ID NO: 2176079 - RNA, 15 nt, Streptococcus pneumoniae R6
auacuuuuucuuccu

SEQ ID NO: 2176080 - RNA, 20 nt, Streptococcus pneumoniae R6
auacuuuuucuuccuuucuc

SEQ ID NO: 2176081 - RNA, 22 nt, Streptococcus pneumoniae R6
auacuuuuucuuccuuucucug

SEQ ID NO: 2176082 - RNA, 15 nt, Streptococcus pneumoniae R6
auacuuagauuuucu

SEQ ID NO: 2176083 - RNA, 18 nt, Streptococcus pneumoniae R6
auacuuagauuuucuggc

SEQ ID NO: 2176084 - RNA, 23 nt, Streptococcus pneumoniae R6
auagaccuguuuggucagacugg

SEQ ID NO: 2176085 - RNA, 16 nt, Streptococcus pneumoniae R6
auagauuggauaaaau

SEQ ID NO: 2176086 - RNA, 15 nt, Streptococcus pneumoniae R6
auagauaauuuaaaa

SEQ ID NO: 2176087 - RNA, 16 nt, Streptococcus pneumoniae R6
auagauaaauacucug

SEQ ID NO: 2176088 - RNA, 12 nt, Streptococcus pneumoniae R6
auagcaucuuuu

SEQ ID NO: 2176089 - RNA, 17 nt, Streptococcus pneumoniae R6
auagcauuuggaagaau

SEQ ID NO: 2176090 - RNA, 20 nt, Streptococcus pneumoniae R6
auagccaaaaaggaagcccu

SEQ ID NO: 2176091 - RNA, 16 nt, Streptococcus pneumoniae R6
auagcauagaugacaa

SEQ ID NO: 2176092 - RNA, 23 nt, Streptococcus pneumoniae R6
auagcaguaguuggcuugucuuu

SEQ ID NO: 2176093 - RNA, 17 nt, Streptococcus pneumoniae R6
auacggacauagcagau

SEQ ID NO: 2176094 - RNA, 18 nt, Streptococcus pneumoniae R6
auacuaauacauuuugua

SEQ ID NO: 2176095 - RNA, 18 nt, Streptococcus pneumoniae R6
auacuaaggaaagucaaa

SEQ ID NO: 2176096 - RNA, 19 nt, Streptococcus pneumoniae R6
auacuaaaauauuucuaga

SEQ ID NO: 2176097 - RNA, 19 nt, Streptococcus pneumoniae R6
auacguuucauggacuguu

SEQ ID NO: 2176098 - RNA, 20 nt, Streptococcus pneumoniae R6
auacguuuuuacuacuuuug

SEQ ID NO: 2176099 - RNA, 21 nt, Streptococcus pneumoniae R6
auacguuuuuugauuuuaaua

SEQ ID NO: 2176100 - RNA, 20 nt, Streptococcus pneumoniae R6
auacuaaaaaaaaaaaguau

SEQ ID NO: 2176101 - RNA, 18 nt, Streptococcus pneumoniae R6
auaccuuuuccuucauuu

SEQ ID NO: 2176102 - RNA, 22 nt, Streptococcus pneumoniae R6
auaccuuuuccuucauuuccaa

SEQ ID NO: 2176103 - RNA, 13 nt, Streptococcus pneumoniae R6
auacgaaaaguag

SEQ ID NO: 2176104 - RNA, 18 nt, Streptococcus pneumoniae R6
auacgaaaucauaagagg

SEQ ID NO: 2176105 - RNA, 14 nt, Streptococcus pneumoniae R6
auaccuaaucuuuc

SEQ ID NO: 2176106 - RNA, 16 nt, Streptococcus pneumoniae R6
auaccauauccuuuca

SEQ ID NO: 2176107 - RNA, 13 nt, Streptococcus pneumoniae R6
auaccaguuuuug

SEQ ID NO: 2176108 - RNA, 14 nt, Streptococcus pneumoniae R6
auaccaguuuuuga

SEQ ID NO: 2176109 - RNA, 15 nt, Streptococcus pneumoniae R6
auaccauaauaaaag

SEQ ID NO: 2176110 - RNA, 22 nt, Streptococcus pneumoniae R6
auaccagguaauccagaaaugg

SEQ ID NO: 2176111 - RNA, 12 nt, Streptococcus pneumoniae R6
auaccauuuucc

SEQ ID NO: 2176112 - RNA, 13 nt, Streptococcus pneumoniae R6
auaccagcaauca

SEQ ID NO: 2176113 - RNA, 21 nt, Streptococcus pneumoniae R6
auaccagaugagacgagcagu

SEQ ID NO: 2176114 - RNA, 20 nt, Streptococcus pneumoniae R6
auaccaccagacauaucuuu

SEQ ID NO: 2176115 - RNA, 12 nt, Streptococcus pneumoniae R6
auaccaaccagu

SEQ ID NO: 2176116 - RNA, 20 nt, Streptococcus pneumoniae R6
auaccaagcucagcauuuuu

SEQ ID NO: 2176117 - RNA, 22 nt, Streptococcus pneumoniae R6
auaccaaggauugucugaacug

SEQ ID NO: 2176118 - RNA, 14 nt, Streptococcus pneumoniae R6
auacauuuuuucug

SEQ ID NO: 2176119 - RNA, 15 nt, Streptococcus pneumoniae R6
auacauuuuuucuga

SEQ ID NO: 2176120 - RNA, 14 nt, Streptococcus pneumoniae R6
auaccaaaaaaacu

SEQ ID NO: 2176121 - RNA, 17 nt, Streptococcus pneumoniae R6
auacauuuuguaaaaaa

SEQ ID NO: 2176122 - RNA, 13 nt, Streptococcus pneumoniae R6
auaccaaagaagu

SEQ ID NO: 2176123 - RNA, 15 nt, Streptococcus pneumoniae R6
auaccaaagaaguca

SEQ ID NO: 2176124 - RNA, 22 nt, Streptococcus pneumoniae R6
auaccaaagaagucaccauaaa

SEQ ID NO: 2176125 - RNA, 12 nt, Streptococcus pneumoniae R6
auaauuuuaaag

SEQ ID NO: 2176126 - RNA, 13 nt, Streptococcus pneumoniae R6
auaauuuuaaaga

SEQ ID NO: 2176127 - RNA, 16 nt, Streptococcus pneumoniae R6
auaauuucuuuaaucu

SEQ ID NO: 2176128 - RNA, 15 nt, Streptococcus pneumoniae R6
auaauuucaaaaucu

SEQ ID NO: 2176129 - RNA, 20 nt, Streptococcus pneumoniae R6
auaauuuccauaccaaagua

SEQ ID NO: 2176130 - RNA, 18 nt, Streptococcus pneumoniae R6
auaauuuccaugucaauu

SEQ ID NO: 2176131 - RNA, 20 nt, Streptococcus pneumoniae R6
auaauugguacauuuugauu

SEQ ID NO: 2176132 - RNA, 14 nt, Streptococcus pneumoniae R6
auaauuguaaacaa

SEQ ID NO: 2176133 - RNA, 15 nt, Streptococcus pneumoniae R6
auaauuguaaacaaa

SEQ ID NO: 2176134 - RNA, 13 nt, Streptococcus pneumoniae R6
auaauuuaaaaua

SEQ ID NO: 2176135 - RNA, 18 nt, Streptococcus pneumoniae R6
auaauugaauauggaaua

SEQ ID NO: 2176136 - RNA, 19 nt, Streptococcus pneumoniae R6
auaauuagguaguuaaucu

SEQ ID NO: 2176137 - RNA, 15 nt, Streptococcus pneumoniae R6
auaaugucuucugcu

SEQ ID NO: 2176138 - RNA, 14 nt, Streptococcus pneumoniae R6
auaauuauucugca

SEQ ID NO: 2176139 - RNA, 19 nt, Streptococcus pneumoniae R6
auaauucaccuauuaacaa

SEQ ID NO: 2176140 - RNA, 15 nt, Streptococcus pneumoniae R6
auaaucauuaaaaua

SEQ ID NO: 2176141 - RNA, 22 nt, Streptococcus pneumoniae R6
auaaucaucgcuaucaaugguu

SEQ ID NO: 2176142 - RNA, 15 nt, Streptococcus pneumoniae R6
auaauccaacaccaa

SEQ ID NO: 2176143 - RNA, 18 nt, Streptococcus pneumoniae R6
auaaucccaccuagaaca

SEQ ID NO: 2176144 - RNA, 21 nt, Streptococcus pneumoniae R6
auaauccuugucgucauacca

SEQ ID NO: 2176145 - RNA, 16 nt, Streptococcus pneumoniae R6
auaaucgacaagauac

SEQ ID NO: 2176146 - RNA, 23 nt, Streptococcus pneumoniae R6
auaaucugggcuaauucucuggc

SEQ ID NO: 2176147 - RNA, 14 nt, Streptococcus pneumoniae R6
auaaugagguugcu

SEQ ID NO: 2176148 - RNA, 15 nt, Streptococcus pneumoniae R6
auaauggcuuauucc

SEQ ID NO: 2176149 - RNA, 21 nt, Streptococcus pneumoniae R6
auaaugauuuggcaaauuccu

SEQ ID NO: 2176150 - RNA, 18 nt, Streptococcus pneumoniae R6
auacagacacuugacuag

SEQ ID NO: 2176151 - RNA, 12 nt, Streptococcus pneumoniae R6
auacagagaaag

SEQ ID NO: 2176152 - RNA, 14 nt, Streptococcus pneumoniae R6
auacaauugcucuu

SEQ ID NO: 2176153 - RNA, 19 nt, Streptococcus pneumoniae R6
auacaauugcucuucugaa

SEQ ID NO: 2176154 - RNA, 14 nt, Streptococcus pneumoniae R6
auacacacuuaaau

SEQ ID NO: 2176155 - RNA, 15 nt, Streptococcus pneumoniae R6
auacacacuuaaauu

SEQ ID NO: 2176156 - RNA, 16 nt, Streptococcus pneumoniae R6
auacaacuuaaaaaga

SEQ ID NO: 2176157 - RNA, 17 nt, Streptococcus pneumoniae R6
auacaacuuaaaaagag

SEQ ID NO: 2176158 - RNA, 23 nt, Streptococcus pneumoniae R6
auacaacuuuaaccaauuguuua

SEQ ID NO: 2176159 - RNA, 19 nt, Streptococcus pneumoniae R6
auacaagucuugccuucaa

SEQ ID NO: 2176160 - RNA, 16 nt, Streptococcus pneumoniae R6
auacaaagcucuuggu

SEQ ID NO: 2176161 - RNA, 16 nt, Streptococcus pneumoniae R6
auacaaaguauuuuuu

SEQ ID NO: 2176162 - RNA, 14 nt, Streptococcus pneumoniae R6
auaauuuuucauuu

SEQ ID NO: 2176163 - RNA, 17 nt, Streptococcus pneumoniae R6
auaauuuuccuuaaucc

SEQ ID NO: 2176164 - RNA, 23 nt, Streptococcus pneumoniae R6
auacaaaaucccucuuuuuacaa

SEQ ID NO: 2176165 - RNA, 20 nt, Streptococcus pneumoniae R6
auacaaaaaucuaagauaaa

SEQ ID NO: 2176166 - RNA, 16 nt, Streptococcus pneumoniae R6
auacaguauccacauu

SEQ ID NO: 2176167 - RNA, 20 nt, Streptococcus pneumoniae R6
auacagugaaggcuuuaaau

SEQ ID NO: 2176168 - RNA, 23 nt, Streptococcus pneumoniae R6
auacaguaccgaauguggauacu

SEQ ID NO: 2176169 - RNA, 20 nt, Streptococcus pneumoniae R6
auacaguagaugauuuucaa

SEQ ID NO: 2176170 - RNA, 16 nt, Streptococcus pneumoniae R6
auacagcuuuuuucuu

SEQ ID NO: 2176171 - RNA, 17 nt, Streptococcus pneumoniae R6
auacagcuuuuuucuuu

SEQ ID NO: 2176172 - RNA, 23 nt, Streptococcus pneumoniae R6
auacauuuagaaagguaaaauau

SEQ ID NO: 2176173 - RNA, 16 nt, Streptococcus pneumoniae R6
auacaugcaaguagaa

SEQ ID NO: 2176174 - RNA, 20 nt, Streptococcus pneumoniae R6
auacauccguuuuucuccuc

SEQ ID NO: 2176175 - RNA, 22 nt, Streptococcus pneumoniae R6
auacauccguuuuucuccucua

SEQ ID NO: 2176176 - RNA, 19 nt, Streptococcus pneumoniae R6
auacaucuggguuaaaaau

SEQ ID NO: 2176177 - RNA, 17 nt, Streptococcus pneumoniae R6
auauuucuaugauaaaa

SEQ ID NO: 2176178 - RNA, 11 nt, Streptococcus pneumoniae R6
auauuucucca

SEQ ID NO: 2176179 - RNA, 16 nt, Streptococcus pneumoniae R6
auauuucgcuuauaaa

SEQ ID NO: 2176180 - RNA, 15 nt, Streptococcus pneumoniae R6
auauuuccaucaacu

SEQ ID NO: 2176181 - RNA, 15 nt, Streptococcus pneumoniae R6
auauuucccauuuuu

SEQ ID NO: 2176182 - RNA, 13 nt, Streptococcus pneumoniae R6
auauuucuuaauu

SEQ ID NO: 2176183 - RNA, 18 nt, Streptococcus pneumoniae R6
aucaaaacuauaaaugau

SEQ ID NO: 2176184 - RNA, 11 nt, Streptococcus pneumoniae R6
aucaaaauaaa

SEQ ID NO: 2176185 - RNA, 21 nt, Streptococcus pneumoniae R6
aucaaaagauguuagaaaaag

SEQ ID NO: 2176186 - RNA, 23 nt, Streptococcus pneumoniae R6
aucaaaagauguuagaaaaaguu

SEQ ID NO: 2176187 - RNA, 18 nt, Streptococcus pneumoniae R6
aucaaaaucgauagccaa

SEQ ID NO: 2176188 - RNA, 18 nt, Streptococcus pneumoniae R6
aucaaaauauguuuucuu

SEQ ID NO: 2176189 - RNA, 17 nt, Streptococcus pneumoniae R6
aucaaagagcaaacuag

SEQ ID NO: 2176190 - RNA, 17 nt, Streptococcus pneumoniae R6
aucaaagugcaaacuag

SEQ ID NO: 2176191 - RNA, 21 nt, Streptococcus pneumoniae R6
aucaaaguuggucauauuaaa

SEQ ID NO: 2176192 - RNA, 21 nt, Streptococcus pneumoniae R6
aucaaauugugcaguuuucau

SEQ ID NO: 2176193 - RNA, 15 nt, Streptococcus pneumoniae R6
aucaaauugaaauaa

SEQ ID NO: 2176194 - RNA, 23 nt, Streptococcus pneumoniae R6
aucaaaugucuuggcagaaaggu

SEQ ID NO: 2176195 - RNA, 12 nt, Streptococcus pneumoniae R6
aucaaaucaaua

SEQ ID NO: 2176196 - RNA, 22 nt, Streptococcus pneumoniae R6
aucaaauccugccucaauccuu

SEQ ID NO: 2176197 - RNA, 17 nt, Streptococcus pneumoniae R6
aucaaauccuucagcuu

SEQ ID NO: 2176198 - RNA, 22 nt, Streptococcus pneumoniae R6
aucaaaucgaucuguucuucua

SEQ ID NO: 2176199 - RNA, 20 nt, Streptococcus pneumoniae R6
aucaacagcuccauaacaau

SEQ ID NO: 2176200 - RNA, 21 nt, Streptococcus pneumoniae R6
aucaacagcuccauaacaaua

SEQ ID NO: 2176201 - RNA, 22 nt, Streptococcus pneumoniae R6
aucaacagcuccauaacaauag

SEQ ID NO: 2176202 - RNA, 16 nt, Streptococcus pneumoniae R6
aucaacugcuguuuuc

SEQ ID NO: 2176203 - RNA, 18 nt, Streptococcus pneumoniae R6
aucaacugcuguuuucau

SEQ ID NO: 2176204 - RNA, 12 nt, Streptococcus pneumoniae R6
aucaacugccug

SEQ ID NO: 2176205 - RNA, 14 nt, Streptococcus pneumoniae R6
aucaauccaaagaa

SEQ ID NO: 2176206 - RNA, 20 nt, Streptococcus pneumoniae R6
aucaauaaccaucauuuuua

SEQ ID NO: 2176207 - RNA, 20 nt, Streptococcus pneumoniae R6
aucaagacccaagucggcag

SEQ ID NO: 2176208 - RNA, 15 nt, Streptococcus pneumoniae R6
aucaagacagauuug

SEQ ID NO: 2176209 - RNA, 18 nt, Streptococcus pneumoniae R6
aucaagaacaauuucaca

SEQ ID NO: 2176210 - RNA, 19 nt, Streptococcus pneumoniae R6
auauuggucagauuguaaa

SEQ ID NO: 2176211 - RNA, 18 nt, Streptococcus pneumoniae R6
auauuuacgaauuauuuc

SEQ ID NO: 2176212 - RNA, 20 nt, Streptococcus pneumoniae R6
auauuuacgaauuauuuccu

SEQ ID NO: 2176213 - RNA, 14 nt, Streptococcus pneumoniae R6
auauuuauuauaaa

SEQ ID NO: 2176214 - RNA, 15 nt, Streptococcus pneumoniae R6
auauuuacuaauuaa

SEQ ID NO: 2176215 - RNA, 16 nt, Streptococcus pneumoniae R6
auauuuacuucauguu

SEQ ID NO: 2176216 - RNA, 14 nt, Streptococcus pneumoniae R6
auauuccacauuca

SEQ ID NO: 2176217 - RNA, 15 nt, Streptococcus pneumoniae R6
auauugaaaugaaau

SEQ ID NO: 2176218 - RNA, 16 nt, Streptococcus pneumoniae R6
auauugaaaugaaaua

SEQ ID NO: 2176219 - RNA, 14 nt, Streptococcus pneumoniae R6
auauugaaaauuuc

SEQ ID NO: 2176220 - RNA, 16 nt, Streptococcus pneumoniae R6
auauuccuaugauuaa

SEQ ID NO: 2176221 - RNA, 15 nt, Streptococcus pneumoniae R6
auauuccauuccucu

SEQ ID NO: 2176222 - RNA, 20 nt, Streptococcus pneumoniae R6
auauguaaacaguaauaaag

SEQ ID NO: 2176223 - RNA, 19 nt, Streptococcus pneumoniae R6
auaugguauuuaaaaccuc

SEQ ID NO: 2176224 - RNA, 21 nt, Streptococcus pneumoniae R6
auaugggauuuucauauaaua

SEQ ID NO: 2176225 - RNA, 23 nt, Streptococcus pneumoniae R6
auauguccuucaugaaauuauuu

SEQ ID NO: 2176226 - RNA, 23 nt, Streptococcus pneumoniae R6
auauuaccaaguuaaacaaccuu

SEQ ID NO: 2176227 - RNA, 22 nt, Streptococcus pneumoniae R6
auauuagucggaaucuuuaagg

SEQ ID NO: 2176228 - RNA, 24 nt, Streptococcus pneumoniae R6
auauuagcugucucggcauuauua

SEQ ID NO: 2176229 - RNA, 12 nt, Streptococcus pneumoniae R6
auauuagaugau

SEQ ID NO: 2176230 - RNA, 18 nt, Streptococcus pneumoniae R6
auauuagaugauuuuucu

SEQ ID NO: 2176231 - RNA, 21 nt, Streptococcus pneumoniae R6
auauuaagaaucuuuucuauu

SEQ ID NO: 2176232 - RNA, 13 nt, Streptococcus pneumoniae R6
auauauaaaugaa

SEQ ID NO: 2176233 - RNA, 15 nt, Streptococcus pneumoniae R6
auauauaaaugaaaa

SEQ ID NO: 2176234 - RNA, 21 nt, Streptococcus pneumoniae R6
auauauaaggauauucagaaa

SEQ ID NO: 2176235 - RNA, 15 nt, Streptococcus pneumoniae R6
auauaguuaaaaaag

SEQ ID NO: 2176236 - RNA, 23 nt, Streptococcus pneumoniae R6
auauaguuaaaaaagauuugaaa

SEQ ID NO: 2176237 - RNA, 14 nt, Streptococcus pneumoniae R6
auauagucuauuga

SEQ ID NO: 2176238 - RNA, 18 nt, Streptococcus pneumoniae R6
auauagucuauugaaguu

SEQ ID NO: 2176239 - RNA, 19 nt, Streptococcus pneumoniae R6
auauaguuuaaucaaaaua

SEQ ID NO: 2176240 - RNA, 20 nt, Streptococcus pneumoniae R6
auauaguuuaaucaaaauaa

SEQ ID NO: 2176241 - RNA, 14 nt, Streptococcus pneumoniae R6
auauauaaaauuuc

SEQ ID NO: 2176242 - RNA, 13 nt, Streptococcus pneumoniae R6
auauauaaaaaau

SEQ ID NO: 2176243 - RNA, 19 nt, Streptococcus pneumoniae R6
auauagcauacugaauuua

SEQ ID NO: 2176244 - RNA, 21 nt, Streptococcus pneumoniae R6
auauagccuguaaaaagugaa

SEQ ID NO: 2176245 - RNA, 22 nt, Streptococcus pneumoniae R6
auauagccuguaaaaagugaaa

SEQ ID NO: 2176246 - RNA, 11 nt, Streptococcus pneumoniae R6
auauaggcaua

SEQ ID NO: 2176247 - RNA, 17 nt, Streptococcus pneumoniae R6
auauagucuacaauagc

SEQ ID NO: 2176248 - RNA, 15 nt, Streptococcus pneumoniae R6
auauaguaaaaugaa

SEQ ID NO: 2176249 - RNA, 16 nt, Streptococcus pneumoniae R6
auauaguaaaaugaaa

SEQ ID NO: 2176250 - RNA, 18 nt, Streptococcus pneumoniae R6
auauaguagauugaaaua

SEQ ID NO: 2176251 - RNA, 19 nt, Streptococcus pneumoniae R6
auauaguagccaaaauccu

SEQ ID NO: 2176252 - RNA, 20 nt, Streptococcus pneumoniae R6
auauaguagccaaaauccuu

SEQ ID NO: 2176253 - RNA, 17 nt, Streptococcus pneumoniae R6
auauagggcuuuuuuug

SEQ ID NO: 2176254 - RNA, 20 nt, Streptococcus pneumoniae R6
auauacaggggauugauuau

SEQ ID NO: 2176255 - RNA, 17 nt, Streptococcus pneumoniae R6
auauacccaaaacacaa

SEQ ID NO: 2176256 - RNA, 18 nt, Streptococcus pneumoniae R6
auauacccaaaacacaaa

SEQ ID NO: 2176257 - RNA, 21 nt, Streptococcus pneumoniae R6
auauacccaaaacacaaaaag

SEQ ID NO: 2176258 - RNA, 14 nt, Streptococcus pneumoniae R6
auauagauaaaaaa

SEQ ID NO: 2176259 - RNA, 20 nt, Streptococcus pneumoniae R6
auauagauggucaaaauauu

SEQ ID NO: 2176260 - RNA, 22 nt, Streptococcus pneumoniae R6
auauagaguucuugguuuuuua

SEQ ID NO: 2176261 - RNA, 15 nt, Streptococcus pneumoniae R6
auauacacacuuaaa

SEQ ID NO: 2176262 - RNA, 16 nt, Streptococcus pneumoniae R6
auauacacuaaacaaa

SEQ ID NO: 2176263 - RNA, 18 nt, Streptococcus pneumoniae R6
auauaauagauugaaacu

SEQ ID NO: 2176264 - RNA, 15 nt, Streptococcus pneumoniae R6
auauaauaucucuuu

SEQ ID NO: 2176265 - RNA, 14 nt, Streptococcus pneumoniae R6
auauaaucagguug

SEQ ID NO: 2176266 - RNA, 13 nt, Streptococcus pneumoniae R6
auauaaaugaaaa

SEQ ID NO: 2176267 - RNA, 14 nt, Streptococcus pneumoniae R6
auagucaagcucuu

SEQ ID NO: 2176268 - RNA, 18 nt, Streptococcus pneumoniae R6
auaguaucccauucuuca

SEQ ID NO: 2176269 - RNA, 14 nt, Streptococcus pneumoniae R6
auaguaucaaauga

SEQ ID NO: 2176270 - RNA, 16 nt, Streptococcus pneumoniae R6
auaguaucaaaugacu

SEQ ID NO: 2176271 - RNA, 17 nt, Streptococcus pneumoniae R6
auaguaucaaaugacua

SEQ ID NO: 2176272 - RNA, 17 nt, Streptococcus pneumoniae R6
auagucaauugaaacaa

SEQ ID NO: 2176273 - RNA, 22 nt, Streptococcus pneumoniae R6
auagucaauugaaacaagaaca

SEQ ID NO: 2176274 - RNA, 14 nt, Streptococcus pneumoniae R6
auagcgaaaucgug

SEQ ID NO: 2176275 - RNA, 13 nt, Streptococcus pneumoniae R6
auagcgaaauucu

SEQ ID NO: 2176276 - RNA, 20 nt, Streptococcus pneumoniae R6
auagcgauucccaagucuga

SEQ ID NO: 2176277 - RNA, 13 nt, Streptococcus pneumoniae R6
auauaaauacaac

SEQ ID NO: 2176278 - RNA, 16 nt, Streptococcus pneumoniae R6
auauaaauacaacagg

SEQ ID NO: 2176279 - RNA, 18 nt, Streptococcus pneumoniae R6
auauaaauacaacaggaa

SEQ ID NO: 2176280 - RNA, 21 nt, Streptococcus pneumoniae R6
auauaaauacaacaggaaaag

SEQ ID NO: 2176281 - RNA, 19 nt, Streptococcus pneumoniae R6
auagucgauaaaaagguug

SEQ ID NO: 2176282 - RNA, 22 nt, Streptococcus pneumoniae R6
auaguuaaauguaguuggauuu

SEQ ID NO: 2176283 - RNA, 13 nt, Streptococcus pneumoniae R6
auagucuuuucac

SEQ ID NO: 2176284 - RNA, 21 nt, Streptococcus pneumoniae R6
auaucaugcuuuacuaguucu

SEQ ID NO: 2176285 - RNA, 17 nt, Streptococcus pneumoniae R6
auaucaucgauuuuuuc

SEQ ID NO: 2176286 - RNA, 22 nt, Streptococcus pneumoniae R6
auaucaucgcuuggaaguuuuc

SEQ ID NO: 2176287 - RNA, 21 nt, Streptococcus pneumoniae R6
auaucauguuucaacauguca

SEQ ID NO: 2176288 - RNA, 13 nt, Streptococcus pneumoniae R6
auauccauuccuc

SEQ ID NO: 2176289 - RNA, 14 nt, Streptococcus pneumoniae R6
auauccuuguucau

SEQ ID NO: 2176290 - RNA, 17 nt, Streptococcus pneumoniae R6
auauccuuauauaucca

SEQ ID NO: 2176291 - RNA, 16 nt, Streptococcus pneumoniae R6
auauccugucuauaca

SEQ ID NO: 2176292 - RNA, 13 nt, Streptococcus pneumoniae R6
auauccccagaca

SEQ ID NO: 2176293 - RNA, 16 nt, Streptococcus pneumoniae R6
auauccuccuucacca

SEQ ID NO: 2176294 - RNA, 20 nt, Streptococcus pneumoniae R6
auauccuccuucaccaauca

SEQ ID NO: 2176295 - RNA, 18 nt, Streptococcus pneumoniae R6
auaucuccagauagagcu

SEQ ID NO: 2176296 - RNA, 20 nt, Streptococcus pneumoniae R6
auaucuccagauagagcuaa

SEQ ID NO: 2176297 - RNA, 14 nt, Streptococcus pneumoniae R6
auaucuccauuacu

SEQ ID NO: 2176298 - RNA, 13 nt, Streptococcus pneumoniae R6
auaucucuuugaa

SEQ ID NO: 2176299 - RNA, 22 nt, Streptococcus pneumoniae R6
auaucugaaaguuuaucucuug

SEQ ID NO: 2176300 - RNA, 20 nt, Streptococcus pneumoniae R6
auaucugcacucucauucau

SEQ ID NO: 2176301 - RNA, 22 nt, Streptococcus pneumoniae R6
auaucugagauaguauuuuaaa

SEQ ID NO: 2176302 - RNA, 19 nt, Streptococcus pneumoniae R6
auaugcaacuuguuuuucc

SEQ ID NO: 2176303 - RNA, 13 nt, Streptococcus pneumoniae R6
auaugcacagaca

SEQ ID NO: 2176304 - RNA, 14 nt, Streptococcus pneumoniae R6
auaugauuucaauu

SEQ ID NO: 2176305 - RNA, 21 nt, Streptococcus pneumoniae R6
auaugauuucaauuuuaaauu

SEQ ID NO: 2176306 - RNA, 15 nt, Streptococcus pneumoniae R6
auaugcgaacuagcu

SEQ ID NO: 2176307 - RNA, 18 nt, Streptococcus pneumoniae R6
auauggaaaaauggauga

SEQ ID NO: 2176308 - RNA, 13 nt, Streptococcus pneumoniae R6
aucuuauugauuu

SEQ ID NO: 2176309 - RNA, 17 nt, Streptococcus pneumoniae R6
aucuuauugauuuuucu

SEQ ID NO: 2176310 - RNA, 15 nt, Streptococcus pneumoniae R6
aucuucaaaaucaaa

SEQ ID NO: 2176311 - RNA, 15 nt, Streptococcus pneumoniae R6
aucuucaaauuuuuc

SEQ ID NO: 2176312 - RNA, 16 nt, Streptococcus pneumoniae R6
aucuucaaauuuuuca

SEQ ID NO: 2176313 - RNA, 17 nt, Streptococcus pneumoniae R6
aucuucaaauuuuucau

SEQ ID NO: 2176314 - RNA, 13 nt, Streptococcus pneumoniae R6
aucuuauuuuucu

SEQ ID NO: 2176315 - RNA, 16 nt, Streptococcus pneumoniae R6
aucuucagacacacca

SEQ ID NO: 2176316 - RNA, 13 nt, Streptococcus pneumoniae R6
aucuuaagacuaa

SEQ ID NO: 2176317 - RNA, 22 nt, Streptococcus pneumoniae R6
aucuuaagacuaaguuagaaua

SEQ ID NO: 2176318 - RNA, 20 nt, Streptococcus pneumoniae R6
aucuguuuuuuccguuuuau

SEQ ID NO: 2176319 - RNA, 18 nt, Streptococcus pneumoniae R6
aucuguuuggcaagugcc

SEQ ID NO: 2176320 - RNA, 13 nt, Streptococcus pneumoniae R6
aucuguuuuaaac

SEQ ID NO: 2176321 - RNA, 15 nt, Streptococcus pneumoniae R6
aucuguuaaaaaaua

SEQ ID NO: 2176322 - RNA, 22 nt, Streptococcus pneumoniae R6
aucuguuaaaaaauaaucaaaa

SEQ ID NO: 2176323 - RNA, 15 nt, Streptococcus pneumoniae R6
aucuuaguuaaaaua

SEQ ID NO: 2176324 - RNA, 16 nt, Streptococcus pneumoniae R6
aucuuaguuaaaauaa

SEQ ID NO: 2176325 - RNA, 17 nt, Streptococcus pneumoniae R6
aucuuaucacccaaaac

SEQ ID NO: 2176326 - RNA, 19 nt, Streptococcus pneumoniae R6
aucuuagguugguugcuuc

SEQ ID NO: 2176327 - RNA, 16 nt, Streptococcus pneumoniae R6
aucuuaguaguuugua

SEQ ID NO: 2176328 - RNA, 22 nt, Streptococcus pneumoniae R6
aucuuagauagacucaggaugu

SEQ ID NO: 2176329 - RNA, 16 nt, Streptococcus pneumoniae R6
aucuuagcgauuuaau

SEQ ID NO: 2176330 - RNA, 19 nt, Streptococcus pneumoniae R6
aucuuagaagcaguugugu

SEQ ID NO: 2176331 - RNA, 23 nt, Streptococcus pneumoniae R6
aucuuaccagccaauguauuaag

SEQ ID NO: 2176332 - RNA, 17 nt, Streptococcus pneumoniae R6
aucuuaauucucuuauu

SEQ ID NO: 2176333 - RNA, 22 nt, Streptococcus pneumoniae R6
aucuguaauaugaacaaaaccu

SEQ ID NO: 2176334 - RNA, 20 nt, Streptococcus pneumoniae R6
aucuguacgguaaucaagug

SEQ ID NO: 2176335 - RNA, 20 nt, Streptococcus pneumoniae R6
aucuguagaguuuugguuga

SEQ ID NO: 2176336 - RNA, 16 nt, Streptococcus pneumoniae R6
aucuggugugaugaua

SEQ ID NO: 2176337 - RNA, 16 nt, Streptococcus pneumoniae R6
aucugucguuagcaca

SEQ ID NO: 2176338 - RNA, 15 nt, Streptococcus pneumoniae R6
aucugucagugacag

SEQ ID NO: 2176339 - RNA, 23 nt, Streptococcus pneumoniae R6
aucugucagugacagaaaugagu

SEQ ID NO: 2176340 - RNA, 19 nt, Streptococcus pneumoniae R6
aucugucuuaccacaaaca

SEQ ID NO: 2176341 - RNA, 16 nt, Streptococcus pneumoniae R6
aucuaauagacuaucu

SEQ ID NO: 2176342 - RNA, 13 nt, Streptococcus pneumoniae R6
aucuaagacugcu

SEQ ID NO: 2176343 - RNA, 19 nt, Streptococcus pneumoniae R6
aucuaauacccauuuaugg

SEQ ID NO: 2176344 - RNA, 18 nt, Streptococcus pneumoniae R6
aucuaagauguucaaucu

SEQ ID NO: 2176345 - RNA, 17 nt, Streptococcus pneumoniae R6
aucuggucuuaagacac

SEQ ID NO: 2176346 - RNA, 14 nt, Streptococcus pneumoniae R6
aucuggaguagcau

SEQ ID NO: 2176347 - RNA, 18 nt, Streptococcus pneumoniae R6
aucugcuauguugcaaau

SEQ ID NO: 2176348 - RNA, 18 nt, Streptococcus pneumoniae R6
aucugcucaaucuuauca

SEQ ID NO: 2176349 - RNA, 19 nt, Streptococcus pneumoniae R6
aucugcucaaucuuaucaa

SEQ ID NO: 2176350 - RNA, 18 nt, Streptococcus pneumoniae R6
aucuucuccaguuuuaau

SEQ ID NO: 2176351 - RNA, 21 nt, Streptococcus pneumoniae R6
aucuucuccaguuuuaaucuu

SEQ ID NO: 2176352 - RNA, 19 nt, Streptococcus pneumoniae R6
aucuugauuuucuuuaaaa

SEQ ID NO: 2176353 - RNA, 21 nt, Streptococcus pneumoniae R6
aucuugauuuucuuuaaaaaa

SEQ ID NO: 2176354 - RNA, 12 nt, Streptococcus pneumoniae R6
aucuucuagcua

SEQ ID NO: 2176355 - RNA, 17 nt, Streptococcus pneumoniae R6
aucuugucuucaaaggu

SEQ ID NO: 2176356 - RNA, 20 nt, Streptococcus pneumoniae R6
aucuuguguuuuuugagcaa

SEQ ID NO: 2176357 - RNA, 13 nt, Streptococcus pneumoniae R6
aucuuggaguuga

SEQ ID NO: 2176358 - RNA, 21 nt, Streptococcus pneumoniae R6
aucuuggauauucaauucuuu

SEQ ID NO: 2176359 - RNA, 21 nt, Streptococcus pneumoniae R6
aucuuggcuaauuucaagaag

SEQ ID NO: 2176360 - RNA, 14 nt, Streptococcus pneumoniae R6
aucuuguaaaaccu

SEQ ID NO: 2176361 - RNA, 20 nt, Streptococcus pneumoniae R6
aucuucccacaauaaaacgc

SEQ ID NO: 2176362 - RNA, 22 nt, Streptococcus pneumoniae R6
aucuucccguagguuuucuccu

SEQ ID NO: 2176363 - RNA, 14 nt, Streptococcus pneumoniae R6
aucuucauuuugca

SEQ ID NO: 2176364 - RNA, 16 nt, Streptococcus pneumoniae R6
aucuuccaaaguucga

SEQ ID NO: 2176365 - RNA, 23 nt, Streptococcus pneumoniae R6
aucuuccaaaguucgaaaggcuu

SEQ ID NO: 2176366 - RNA, 17 nt, Streptococcus pneumoniae R6
aucuuccuuacuagcaa

SEQ ID NO: 2176367 - RNA, 22 nt, Streptococcus pneumoniae R6
aucuuccuugaaagaccaguuc

SEQ ID NO: 2176368 - RNA, 20 nt, Streptococcus pneumoniae R6
aucuuuuuucauuacacaaa

SEQ ID NO: 2176369 - RNA, 12 nt, Streptococcus pneumoniae R6
augaaaaccaag

SEQ ID NO: 2176370 - RNA, 16 nt, Streptococcus pneumoniae R6
augaaaaagauuuuuu

SEQ ID NO: 2176371 - RNA, 14 nt, Streptococcus pneumoniae R6
augaaaaaaaguuu

SEQ ID NO: 2176372 - RNA, 18 nt, Streptococcus pneumoniae R6
augaaaaaaaguuuaaaa

SEQ ID NO: 2176373 - RNA, 15 nt, Streptococcus pneumoniae R6
augaaauuaaauaug

SEQ ID NO: 2176374 - RNA, 14 nt, Streptococcus pneumoniae R6
augaacaaaucaau

SEQ ID NO: 2176375 - RNA, 21 nt, Streptococcus pneumoniae R6
augaaaagaacuccagugaaa

SEQ ID NO: 2176376 - RNA, 20 nt, Streptococcus pneumoniae R6
aucuuuagcaccaccuuuga

SEQ ID NO: 2176377 - RNA, 23 nt, Streptococcus pneumoniae R6
aucuuguugaaugagcuuccagu

SEQ ID NO: 2176378 - RNA, 17 nt, Streptococcus pneumoniae R6
aucuuuagaaagauuac

SEQ ID NO: 2176379 - RNA, 13 nt, Streptococcus pneumoniae R6
aucuuugaaauaa

SEQ ID NO: 2176380 - RNA, 13 nt, Streptococcus pneumoniae R6
aucuuuggcaauu

SEQ ID NO: 2176381 - RNA, 20 nt, Streptococcus pneumoniae R6
aucuuuggacauagccaaua

SEQ ID NO: 2176382 - RNA, 14 nt, Streptococcus pneumoniae R6
aucuuugauuuuac

SEQ ID NO: 2176383 - RNA, 19 nt, Streptococcus pneumoniae R6
aucuuuguaaguuucuucu

SEQ ID NO: 2176384 - RNA, 20 nt, Streptococcus pneumoniae R6
aucuuuguaaguuucuucuu

SEQ ID NO: 2176385 - RNA, 21 nt, Streptococcus pneumoniae R6
aucuuuuuauacucaaugaaa

SEQ ID NO: 2176386 - RNA, 16 nt, Streptococcus pneumoniae R6
augaccccuaaauaua

SEQ ID NO: 2176387 - RNA, 17 nt, Streptococcus pneumoniae R6
augaccccuaaauauaa

SEQ ID NO: 2176388 - RNA, 13 nt, Streptococcus pneumoniae R6
augacagccucaa

SEQ ID NO: 2176389 - RNA, 17 nt, Streptococcus pneumoniae R6
augacagccucaaugau

SEQ ID NO: 2176390 - RNA, 15 nt, Streptococcus pneumoniae R6
augacaauuuuucca

SEQ ID NO: 2176391 - RNA, 14 nt, Streptococcus pneumoniae R6
augacaaucaagac

SEQ ID NO: 2176392 - RNA, 13 nt, Streptococcus pneumoniae R6
augacaauuauau

SEQ ID NO: 2176393 - RNA, 19 nt, Streptococcus pneumoniae R6
augacaaaacguucccaac

SEQ ID NO: 2176394 - RNA, 21 nt, Streptococcus pneumoniae R6
augacaacaccgacagcaagg

SEQ ID NO: 2176395 - RNA, 19 nt, Streptococcus pneumoniae R6
augacaacgggguuuccaa

SEQ ID NO: 2176396 - RNA, 22 nt, Streptococcus pneumoniae R6
augacaacgggguuuccaacga

SEQ ID NO: 2176397 - RNA, 20 nt, Streptococcus pneumoniae R6
augacaacugggaacucacu

SEQ ID NO: 2176398 - RNA, 17 nt, Streptococcus pneumoniae R6
augaaccugcuucagau

SEQ ID NO: 2176399 - RNA, 18 nt, Streptococcus pneumoniae R6
augaaccugcuucagauu

SEQ ID NO: 2176400 - RNA, 20 nt, Streptococcus pneumoniae R6
augaaccugcuucagauugu

SEQ ID NO: 2176401 - RNA, 21 nt, Streptococcus pneumoniae R6
augaaccuucaucaaaugacu

SEQ ID NO: 2176402 - RNA, 14 nt, Streptococcus pneumoniae R6
augaaccucuucau

SEQ ID NO: 2176403 - RNA, 20 nt, Streptococcus pneumoniae R6
augacucccauaaaaauaau

SEQ ID NO: 2176404 - RNA, 14 nt, Streptococcus pneumoniae R6
augacuagugaagc

SEQ ID NO: 2176405 - RNA, 18 nt, Streptococcus pneumoniae R6
augacuaacaauuaauuc

SEQ ID NO: 2176406 - RNA, 22 nt, Streptococcus pneumoniae R6
augacuaacaauuaauucuaaa

SEQ ID NO: 2176407 - RNA, 16 nt, Streptococcus pneumoniae R6
augagcuggaagaauu

SEQ ID NO: 2176408 - RNA, 17 nt, Streptococcus pneumoniae R6
augagcuggaagaauuu

SEQ ID NO: 2176409 - RNA, 15 nt, Streptococcus pneumoniae R6
augagcgucuuucuu

SEQ ID NO: 2176410 - RNA, 21 nt, Streptococcus pneumoniae R6
augagcauagcgugcccaaaa

SEQ ID NO: 2176411 - RNA, 13 nt, Streptococcus pneumoniae R6
augagccaaggaa

SEQ ID NO: 2176412 - RNA, 18 nt, Streptococcus pneumoniae R6
augauacgcucagcugau

SEQ ID NO: 2176413 - RNA, 15 nt, Streptococcus pneumoniae R6
augauauauaguaga

SEQ ID NO: 2176414 - RNA, 11 nt, Streptococcus pneumoniae R6
augauauacac

SEQ ID NO: 2176415 - RNA, 17 nt, Streptococcus pneumoniae R6
augauaauagauauaau

SEQ ID NO: 2176416 - RNA, 14 nt, Streptococcus pneumoniae R6
augagggcagggau

SEQ ID NO: 2176417 - RNA, 20 nt, Streptococcus pneumoniae R6
augaggauggcuuucuuuca

SEQ ID NO: 2176418 - RNA, 16 nt, Streptococcus pneumoniae R6
augaucuaaauguauu

SEQ ID NO: 2176419 - RNA, 20 nt, Streptococcus pneumoniae R6
augaucuauuccuagucaga

SEQ ID NO: 2176420 - RNA, 16 nt, Streptococcus pneumoniae R6
augaucgguucacguu

SEQ ID NO: 2176421 - RNA, 19 nt, Streptococcus pneumoniae R6
augauauuuucaaaaaaau

SEQ ID NO: 2176422 - RNA, 22 nt, Streptococcus pneumoniae R6
augauaucugguauauuuuguu

SEQ ID NO: 2176423 - RNA, 14 nt, Streptococcus pneumoniae R6
augaugauagacug

SEQ ID NO: 2176424 - RNA, 15 nt, Streptococcus pneumoniae R6
augauuacucaaaac

SEQ ID NO: 2176425 - RNA, 15 nt, Streptococcus pneumoniae R6
augauuaaucaaaug

SEQ ID NO: 2176426 - RNA, 13 nt, Streptococcus pneumoniae R6
augauuaacuaug

SEQ ID NO: 2176427 - RNA, 18 nt, Streptococcus pneumoniae R6
augaugcuuacugcugcc

SEQ ID NO: 2176428 - RNA, 22 nt, Streptococcus pneumoniae R6
augaugcguuuuauaauuuuaa

SEQ ID NO: 2176429 - RNA, 15 nt, Streptococcus pneumoniae R6
augcauaguugaugg

SEQ ID NO: 2176430 - RNA, 16 nt, Streptococcus pneumoniae R6
augcauacgaaaagua

SEQ ID NO: 2176431 - RNA, 15 nt, Streptococcus pneumoniae R6
augauuuuuuacugu

SEQ ID NO: 2176432 - RNA, 16 nt, Streptococcus pneumoniae R6
augauucuuuucaaaa

SEQ ID NO: 2176433 - RNA, 18 nt, Streptococcus pneumoniae R6
augauucuccuuuuugau

SEQ ID NO: 2176434 - RNA, 13 nt, Streptococcus pneumoniae R6
augauucugaaau

SEQ ID NO: 2176435 - RNA, 18 nt, Streptococcus pneumoniae R6
augauucugaaauaacuc

SEQ ID NO: 2176436 - RNA, 17 nt, Streptococcus pneumoniae R6
augauugaccucuggau

SEQ ID NO: 2176437 - RNA, 17 nt, Streptococcus pneumoniae R6
auggcgugggucaucaa

SEQ ID NO: 2176438 - RNA, 15 nt, Streptococcus pneumoniae R6
auggcaagaucaagu

SEQ ID NO: 2176439 - RNA, 17 nt, Streptococcus pneumoniae R6
auggcaagaucaaguuc

SEQ ID NO: 2176440 - RNA, 13 nt, Streptococcus pneumoniae R6
auggauugaaaua

SEQ ID NO: 2176441 - RNA, 18 nt, Streptococcus pneumoniae R6
auggccgauaacagccaa

SEQ ID NO: 2176442 - RNA, 20 nt, Streptococcus pneumoniae R6
auggcaccgccgaggacgga

SEQ ID NO: 2176443 - RNA, 19 nt, Streptococcus pneumoniae R6
auggcuuaucagucucaua

SEQ ID NO: 2176444 - RNA, 22 nt, Streptococcus pneumoniae R6
auggcuucauuaugaguggcag

SEQ ID NO: 2176445 - RNA, 21 nt, Streptococcus pneumoniae R6
auggcuuucuuucaaaccagc

SEQ ID NO: 2176446 - RNA, 18 nt, Streptococcus pneumoniae R6
augguauuuguaaaauug

SEQ ID NO: 2176447 - RNA, 19 nt, Streptococcus pneumoniae R6
auggucaaaauauuuggag

SEQ ID NO: 2176448 - RNA, 22 nt, Streptococcus pneumoniae R6
augguauguugcgucaggagca

SEQ ID NO: 2176449 - RNA, 22 nt, Streptococcus pneumoniae R6
augguauucauuaagucaacau

SEQ ID NO: 2176450 - RNA, 20 nt, Streptococcus pneumoniae R6
augguauuuaaaaccuccaa

SEQ ID NO: 2176451 - RNA, 12 nt, Streptococcus pneumoniae R6
auguaaaucauu

SEQ ID NO: 2176452 - RNA, 15 nt, Streptococcus pneumoniae R6
auguaaauaaauauc

SEQ ID NO: 2176453 - RNA, 17 nt, Streptococcus pneumoniae R6
augguugucccugggac

SEQ ID NO: 2176454 - RNA, 17 nt, Streptococcus pneumoniae R6
augguugggaaggugag

SEQ ID NO: 2176455 - RNA, 23 nt, Streptococcus pneumoniae R6
augguuauccgucgcauauuuca

SEQ ID NO: 2176456 - RNA, 17 nt, Streptococcus pneumoniae R6
auguaauuucugaaauc

SEQ ID NO: 2176457 - RNA, 14 nt, Streptococcus pneumoniae R6
auguacuaggcguc

SEQ ID NO: 2176458 - RNA, 16 nt, Streptococcus pneumoniae R6
auguagauugacauuu

SEQ ID NO: 2176459 - RNA, 17 nt, Streptococcus pneumoniae R6
auguauuugaaagggua

SEQ ID NO: 2176460 - RNA, 22 nt, Streptococcus pneumoniae R6
augucagcugaaagcaaguuuu

SEQ ID NO: 2176461 - RNA, 14 nt, Streptococcus pneumoniae R6
auguucuaagaacu

SEQ ID NO: 2176462 - RNA, 13 nt, Streptococcus pneumoniae R6
auguuauccuauu

SEQ ID NO: 2176463 - RNA, 20 nt, Streptococcus pneumoniae R6
auguguuaccgguuacauau

SEQ ID NO: 2176464 - RNA, 22 nt, Streptococcus pneumoniae R6
auguuacugacuucgucaguuc

SEQ ID NO: 2176465 - RNA, 19 nt, Streptococcus pneumoniae R6
auguuacugauuucgucag

SEQ ID NO: 2176466 - RNA, 18 nt, Streptococcus pneumoniae R6
auguuacuucugaaucug

SEQ ID NO: 2176467 - RNA, 13 nt, Streptococcus pneumoniae R6
auguuagaaaaau

SEQ ID NO: 2176468 - RNA, 15 nt, Streptococcus pneumoniae R6
augugcuuaacaaaa

SEQ ID NO: 2176469 - RNA, 21 nt, Streptococcus pneumoniae R6
augucucgacugguaaagaau

SEQ ID NO: 2176470 - RNA, 14 nt, Streptococcus pneumoniae R6
auggacuguuauag

SEQ ID NO: 2176471 - RNA, 20 nt, Streptococcus pneumoniae R6
auggaguuccuccauugcaa

SEQ ID NO: 2176472 - RNA, 13 nt, Streptococcus pneumoniae R6
auggaguuuucaa

SEQ ID NO: 2176473 - RNA, 20 nt, Streptococcus pneumoniae R6
auggaguguucuaaaauaag

SEQ ID NO: 2176474 - RNA, 21 nt, Streptococcus pneumoniae R6
auggaugauaccaucuaacuc

SEQ ID NO: 2176475 - RNA, 22 nt, Streptococcus pneumoniae R6
auggaugauuuaauuagaaaaa

SEQ ID NO: 2176476 - RNA, 22 nt, Streptococcus pneumoniae R6
augcuuuuuucuaugauuuuca

SEQ ID NO: 2176477 - RNA, 18 nt, Streptococcus pneumoniae R6
auggaaaaacuuacuaca

SEQ ID NO: 2176478 - RNA, 12 nt, Streptococcus pneumoniae R6
auggaaaaaaug

SEQ ID NO: 2176479 - RNA, 20 nt, Streptococcus pneumoniae R6
augcuuuccaacgauuuuau

SEQ ID NO: 2176480 - RNA, 13 nt, Streptococcus pneumoniae R6
augcuuuccauua

SEQ ID NO: 2176481 - RNA, 17 nt, Streptococcus pneumoniae R6
augcuuuccauuaauuc

SEQ ID NO: 2176482 - RNA, 19 nt, Streptococcus pneumoniae R6
augcuuuuauucagccaag

SEQ ID NO: 2176483 - RNA, 18 nt, Streptococcus pneumoniae R6
augcuuugaacaaauguu

SEQ ID NO: 2176484 - RNA, 21 nt, Streptococcus pneumoniae R6
auggaagguugaguuuuugaa

SEQ ID NO: 2176485 - RNA, 15 nt, Streptococcus pneumoniae R6
auggaauaccaauau

SEQ ID NO: 2176486 - RNA, 22 nt, Streptococcus pneumoniae R6
auggaauaguaucugaugcuga

SEQ ID NO: 2176487 - RNA, 14 nt, Streptococcus pneumoniae R6
auggaaucuugcau

SEQ ID NO: 2176488 - RNA, 19 nt, Streptococcus pneumoniae R6
auggaaauauaggccaaga

SEQ ID NO: 2176489 - RNA, 13 nt, Streptococcus pneumoniae R6
augcugcauuuug

SEQ ID NO: 2176490 - RNA, 15 nt, Streptococcus pneumoniae R6
augcugacaaagaga

SEQ ID NO: 2176491 - RNA, 20 nt, Streptococcus pneumoniae R6
augcugacaagucauccaug

SEQ ID NO: 2176492 - RNA, 22 nt, Streptococcus pneumoniae R6
augcugacaagucauccaugau

SEQ ID NO: 2176493 - RNA, 15 nt, Streptococcus pneumoniae R6
augcuugcaaaucau

SEQ ID NO: 2176494 - RNA, 14 nt, Streptococcus pneumoniae R6
augcuugcauuuuu

SEQ ID NO: 2176495 - RNA, 23 nt, Streptococcus pneumoniae R6
augcuuuacuaguucucaaauuu

SEQ ID NO: 2176496 - RNA, 17 nt, Streptococcus pneumoniae R6
augcugguuguccaggc

SEQ ID NO: 2176497 - RNA, 20 nt, Streptococcus pneumoniae R6
augcugguuguccaggcaaa

SEQ ID NO: 2176498 - RNA, 20 nt, Streptococcus pneumoniae R6
augcuuacuucacuucugua

SEQ ID NO: 2176499 - RNA, 17 nt, Streptococcus pneumoniae R6
augcuccaauacaaauu

SEQ ID NO: 2176500 - RNA, 18 nt, Streptococcus pneumoniae R6
augcuaauaguggugugu

SEQ ID NO: 2176501 - RNA, 16 nt, Streptococcus pneumoniae R6
augcucgugauguuaa

SEQ ID NO: 2176502 - RNA, 19 nt, Streptococcus pneumoniae R6
augcggucccaguuuucuu

SEQ ID NO: 2176503 - RNA, 14 nt, Streptococcus pneumoniae R6
augcgguuugaaga

SEQ ID NO: 2176504 - RNA, 15 nt, Streptococcus pneumoniae R6
augcguuuuucagau

SEQ ID NO: 2176505 - RNA, 18 nt, Streptococcus pneumoniae R6
augcguuuuucugauuuu

SEQ ID NO: 2176506 - RNA, 21 nt, Streptococcus pneumoniae R6
augcguuuuucugauuuugaa

SEQ ID NO: 2176507 - RNA, 18 nt, Streptococcus pneumoniae R6
augcguuuuuucugauuu

SEQ ID NO: 2176508 - RNA, 22 nt, Streptococcus pneumoniae R6
augcguuuuuuugauuuuaaag

SEQ ID NO: 2176509 - RNA, 15 nt, Streptococcus pneumoniae R6
augcgucuaauguac

SEQ ID NO: 2176510 - RNA, 21 nt, Streptococcus pneumoniae R6
augcgaacuagcuaacugcuu

SEQ ID NO: 2176511 - RNA, 12 nt, Streptococcus pneumoniae R6
augccaaaauuc

SEQ ID NO: 2176512 - RNA, 18 nt, Streptococcus pneumoniae R6
augcgaaucaauuuuucg

SEQ ID NO: 2176513 - RNA, 18 nt, Streptococcus pneumoniae R6
aucaggaaggucacuuuu

SEQ ID NO: 2176514 - RNA, 22 nt, Streptococcus pneumoniae R6
aucaggaauaaauccagcugag

SEQ ID NO: 2176515 - RNA, 14 nt, Streptococcus pneumoniae R6
aucaggauuuuuaa

SEQ ID NO: 2176516 - RNA, 21 nt, Streptococcus pneumoniae R6
aucaggauuuuuucauggaug

SEQ ID NO: 2176517 - RNA, 18 nt, Streptococcus pneumoniae R6
aucaguauauugaaauga

SEQ ID NO: 2176518 - RNA, 15 nt, Streptococcus pneumoniae R6
aucagguauugaaaa

SEQ ID NO: 2176519 - RNA, 18 nt, Streptococcus pneumoniae R6
aucaguuaucuuaucacc

SEQ ID NO: 2176520 - RNA, 23 nt, Streptococcus pneumoniae R6
aucaguuacauccaaacgaaugu

SEQ ID NO: 2176521 - RNA, 20 nt, Streptococcus pneumoniae R6
aucagugugacccaagauag

SEQ ID NO: 2176522 - RNA, 14 nt, Streptococcus pneumoniae R6
aucagucaagaguu

SEQ ID NO: 2176523 - RNA, 19 nt, Streptococcus pneumoniae R6
aucagucaagaguucuucu

SEQ ID NO: 2176524 - RNA, 13 nt, Streptococcus pneumoniae R6
aucauaaaaauaa

SEQ ID NO: 2176525 - RNA, 15 nt, Streptococcus pneumoniae R6
aucaguucuuuaaag

SEQ ID NO: 2176526 - RNA, 16 nt, Streptococcus pneumoniae R6
aucaguucauuuuucc

SEQ ID NO: 2176527 - RNA, 14 nt, Streptococcus pneumoniae R6
aucaguuccagcaa

SEQ ID NO: 2176528 - RNA, 21 nt, Streptococcus pneumoniae R6
aucauaagaggucugaaacua

SEQ ID NO: 2176529 - RNA, 19 nt, Streptococcus pneumoniae R6
aucauaaaucaauuuuucg

SEQ ID NO: 2176530 - RNA, 16 nt, Streptococcus pneumoniae R6
aucauacuuggagaac

SEQ ID NO: 2176531 - RNA, 14 nt, Streptococcus pneumoniae R6
aucauagaaauuuu

SEQ ID NO: 2176532 - RNA, 16 nt, Streptococcus pneumoniae R6
aucauagaaauuuuua

SEQ ID NO: 2176533 - RNA, 17 nt, Streptococcus pneumoniae R6
aucauagaaauuuuuac

SEQ ID NO: 2176534 - RNA, 22 nt, Streptococcus pneumoniae R6
aucauagugagauugugaauua

SEQ ID NO: 2176535 - RNA, 14 nt, Streptococcus pneumoniae R6
aucauauaaauaau

SEQ ID NO: 2176536 - RNA, 16 nt, Streptococcus pneumoniae R6
aucauauaaauauaga

SEQ ID NO: 2176537 - RNA, 15 nt, Streptococcus pneumoniae R6
aucauauagauaaaa

SEQ ID NO: 2176538 - RNA, 17 nt, Streptococcus pneumoniae R6
aucauagauucaccagu

SEQ ID NO: 2176539 - RNA, 23 nt, Streptococcus pneumoniae R6
aucauagcuguuuugguuggggc

SEQ ID NO: 2176540 - RNA, 16 nt, Streptococcus pneumoniae R6
aucauaggcauaguac

SEQ ID NO: 2176541 - RNA, 18 nt, Streptococcus pneumoniae R6
aucauaggcauaguacca

SEQ ID NO: 2176542 - RNA, 16 nt, Streptococcus pneumoniae R6
aucauaucagugaagg

SEQ ID NO: 2176543 - RNA, 20 nt, Streptococcus pneumoniae R6
aucauaucaucaaucaagau

SEQ ID NO: 2176544 - RNA, 14 nt, Streptococcus pneumoniae R6
aucauauccagcuu

SEQ ID NO: 2176545 - RNA, 15 nt, Streptococcus pneumoniae R6
aucaucgccaaauca

SEQ ID NO: 2176546 - RNA, 16 nt, Streptococcus pneumoniae R6
aucaucgauuuuuuca

SEQ ID NO: 2176547 - RNA, 14 nt, Streptococcus pneumoniae R6
aucauccgaagcaa

SEQ ID NO: 2176548 - RNA, 14 nt, Streptococcus pneumoniae R6
aucaucugaaugac

SEQ ID NO: 2176549 - RNA, 14 nt, Streptococcus pneumoniae R6
aucaucugcaucaa

SEQ ID NO: 2176550 - RNA, 14 nt, Streptococcus pneumoniae R6
aucaucacacuagc

SEQ ID NO: 2176551 - RNA, 23 nt, Streptococcus pneumoniae R6
aucaucaaccucacuuaauacuu

SEQ ID NO: 2176552 - RNA, 17 nt, Streptococcus pneumoniae R6
aucaucaaauugaaaua

SEQ ID NO: 2176553 - RNA, 24 nt, Streptococcus pneumoniae R6
aucaucaaauugaaauaagaaaua

SEQ ID NO: 2176554 - RNA, 16 nt, Streptococcus pneumoniae R6
aucauccaccuugcaa

SEQ ID NO: 2176555 - RNA, 22 nt, Streptococcus pneumoniae R6
aucauccaccuugcaaaaaaac

SEQ ID NO: 2176556 - RNA, 23 nt, Streptococcus pneumoniae R6
aucauccaccuugcaaaaaaacu

SEQ ID NO: 2176557 - RNA, 16 nt, Streptococcus pneumoniae R6
aucauccagauuuuuc

SEQ ID NO: 2176558 - RNA, 18 nt, Streptococcus pneumoniae R6
aucauccagauuuuucug

SEQ ID NO: 2176559 - RNA, 15 nt, Streptococcus pneumoniae R6
aucaucauaaaaaua

SEQ ID NO: 2176560 - RNA, 23 nt, Streptococcus pneumoniae R6
aucaugcuuggauccauugcugg

SEQ ID NO: 2176561 - RNA, 14 nt, Streptococcus pneumoniae R6
aucaugcuuuacua

SEQ ID NO: 2176562 - RNA, 20 nt, Streptococcus pneumoniae R6
aucaugcuuuacuaguucuc

SEQ ID NO: 2176563 - RNA, 13 nt, Streptococcus pneumoniae R6
aucauggauuuuu

SEQ ID NO: 2176564 - RNA, 13 nt, Streptococcus pneumoniae R6
aucaugagaauau

SEQ ID NO: 2176565 - RNA, 13 nt, Streptococcus pneumoniae R6
aucauuauauuuc

SEQ ID NO: 2176566 - RNA, 15 nt, Streptococcus pneumoniae R6
aucauuauauuucuc

SEQ ID NO: 2176567 - RNA, 15 nt, Streptococcus pneumoniae R6
aucauuauccaugau

SEQ ID NO: 2176568 - RNA, 22 nt, Streptococcus pneumoniae R6
aucauguuuuuaagcuacuacu

SEQ ID NO: 2176569 - RNA, 20 nt, Streptococcus pneumoniae R6
aucauuaaagaccaaagaaa

SEQ ID NO: 2176570 - RNA, 12 nt, Streptococcus pneumoniae R6
aucauuaacaau

SEQ ID NO: 2176571 - RNA, 19 nt, Streptococcus pneumoniae R6
aucauugauaguaacacuu

SEQ ID NO: 2176572 - RNA, 16 nt, Streptococcus pneumoniae R6
aucauugauauaaaga

SEQ ID NO: 2176573 - RNA, 12 nt, Streptococcus pneumoniae R6
aucauugauuuc

SEQ ID NO: 2176574 - RNA, 23 nt, Streptococcus pneumoniae R6
aucauucuuauuuggcaauucaa

SEQ ID NO: 2176575 - RNA, 20 nt, Streptococcus pneumoniae R6
aucauucugaacuaaaaaau

SEQ ID NO: 2176576 - RNA, 15 nt, Streptococcus pneumoniae R6
aucauuucuucaaca

SEQ ID NO: 2176577 - RNA, 16 nt, Streptococcus pneumoniae R6
aucauuucuucuggaa

SEQ ID NO: 2176578 - RNA, 20 nt, Streptococcus pneumoniae R6
aucauuuccuucguuuucac

SEQ ID NO: 2176579 - RNA, 21 nt, Streptococcus pneumoniae R6
aucauuuccuucguuuucaca

SEQ ID NO: 2176580 - RNA, 12 nt, Streptococcus pneumoniae R6
aucauuuaauaa

SEQ ID NO: 2176581 - RNA, 14 nt, Streptococcus pneumoniae R6
aucauuuaauaaug

SEQ ID NO: 2176582 - RNA, 13 nt, Streptococcus pneumoniae R6
aucauugugccau

SEQ ID NO: 2176583 - RNA, 20 nt, Streptococcus pneumoniae R6
auccaacucaggaaagauga

SEQ ID NO: 2176584 - RNA, 23 nt, Streptococcus pneumoniae R6
auccaagcgucugaggcaacaaa

SEQ ID NO: 2176585 - RNA, 12 nt, Streptococcus pneumoniae R6
auccaagcuucu

SEQ ID NO: 2176586 - RNA, 17 nt, Streptococcus pneumoniae R6
auccaagcuucuacaga

SEQ ID NO: 2176587 - RNA, 20 nt, Streptococcus pneumoniae R6
auccaaauaaguaguguuag

SEQ ID NO: 2176588 - RNA, 20 nt, Streptococcus pneumoniae R6
auccaaacgauuaucuaaca

SEQ ID NO: 2176589 - RNA, 22 nt, Streptococcus pneumoniae R6
auccaaacgauuaucuaacaau

SEQ ID NO: 2176590 - RNA, 13 nt, Streptococcus pneumoniae R6
auccaaaauaugc

SEQ ID NO: 2176591 - RNA, 15 nt, Streptococcus pneumoniae R6
auccaaaguaaaaua

SEQ ID NO: 2176592 - RNA, 19 nt, Streptococcus pneumoniae R6
aucauuuuauucauauccc

SEQ ID NO: 2176593 - RNA, 22 nt, Streptococcus pneumoniae R6
auccaaaagcaggaguuuuccc

SEQ ID NO: 2176594 - RNA, 13 nt, Streptococcus pneumoniae R6
auccaaaaccauu

SEQ ID NO: 2176595 - RNA, 19 nt, Streptococcus pneumoniae R6
auccaaaaccauucaaaau

SEQ ID NO: 2176596 - RNA, 20 nt, Streptococcus pneumoniae R6
auccaaaaaaucuuccuaca

SEQ ID NO: 2176597 - RNA, 22 nt, Streptococcus pneumoniae R6
auccacauuuacgaaucucuuu

SEQ ID NO: 2176598 - RNA, 18 nt, Streptococcus pneumoniae R6
auccacaucaucaaaugu

SEQ ID NO: 2176599 - RNA, 13 nt, Streptococcus pneumoniae R6
auccaauucuuca

SEQ ID NO: 2176600 - RNA, 15 nt, Streptococcus pneumoniae R6
auccacaaccucaaa

SEQ ID NO: 2176601 - RNA, 18 nt, Streptococcus pneumoniae R6
auccacaaccucaaaaca

SEQ ID NO: 2176602 - RNA, 14 nt, Streptococcus pneumoniae R6
auccacaaccuuaa

SEQ ID NO: 2176603 - RNA, 15 nt, Streptococcus pneumoniae R6
auccacaaccuuaaa

SEQ ID NO: 2176604 - RNA, 17 nt, Streptococcus pneumoniae R6
auccacaaccuuaaaac

SEQ ID NO: 2176605 - RNA, 17 nt, Streptococcus pneumoniae R6
auccaagccauaagaaa

SEQ ID NO: 2176606 - RNA, 18 nt, Streptococcus pneumoniae R6
auccaaguuuggcagaca

SEQ ID NO: 2176607 - RNA, 18 nt, Streptococcus pneumoniae R6
auccaauccuuuucuuuu

SEQ ID NO: 2176608 - RNA, 16 nt, Streptococcus pneumoniae R6
auccaccuauuauaca

SEQ ID NO: 2176609 - RNA, 22 nt, Streptococcus pneumoniae R6
auccacguuuacgaaucucuuu

SEQ ID NO: 2176610 - RNA, 17 nt, Streptococcus pneumoniae R6
auccagagcauucuuuu

SEQ ID NO: 2176611 - RNA, 20 nt, Streptococcus pneumoniae R6
auccagagcauucuuuuguu

SEQ ID NO: 2176612 - RNA, 14 nt, Streptococcus pneumoniae R6
auccagaaauugau

SEQ ID NO: 2176613 - RNA, 22 nt, Streptococcus pneumoniae R6
auccacuugggaaaccaaacgg

SEQ ID NO: 2176614 - RNA, 19 nt, Streptococcus pneumoniae R6
auccacuuguaaagcgaaa

SEQ ID NO: 2176615 - RNA, 17 nt, Streptococcus pneumoniae R6
auccaucacaguuuaca

SEQ ID NO: 2176616 - RNA, 21 nt, Streptococcus pneumoniae R6
auccaucaaguuuaccauuca

SEQ ID NO: 2176617 - RNA, 13 nt, Streptococcus pneumoniae R6
auccauauucaau

SEQ ID NO: 2176618 - RNA, 12 nt, Streptococcus pneumoniae R6
auccauucuuuu

SEQ ID NO: 2176619 - RNA, 13 nt, Streptococcus pneumoniae R6
auccauucuuuuu

SEQ ID NO: 2176620 - RNA, 16 nt, Streptococcus pneumoniae R6
aucccaugacaaucau

SEQ ID NO: 2176621 - RNA, 20 nt, Streptococcus pneumoniae R6
aucccaugacaaucauuuca

SEQ ID NO: 2176622 - RNA, 21 nt, Streptococcus pneumoniae R6
aucccaugacaaucauuucag

SEQ ID NO: 2176623 - RNA, 15 nt, Streptococcus pneumoniae R6
aucccauauuuuucc

SEQ ID NO: 2176624 - RNA, 16 nt, Streptococcus pneumoniae R6
aucccaguaaaggacu

SEQ ID NO: 2176625 - RNA, 17 nt, Streptococcus pneumoniae R6
aucccagauaaagcuga

SEQ ID NO: 2176626 - RNA, 17 nt, Streptococcus pneumoniae R6
aucccaauggucaagag

SEQ ID NO: 2176627 - RNA, 12 nt, Streptococcus pneumoniae R6
aucccaaagaag

SEQ ID NO: 2176628 - RNA, 17 nt, Streptococcus pneumoniae R6
aucccaacuccuccuuc

SEQ ID NO: 2176629 - RNA, 15 nt, Streptococcus pneumoniae R6
auccauuuuucaaau

SEQ ID NO: 2176630 - RNA, 21 nt, Streptococcus pneumoniae R6
auccauuuggguaggucuuuu

SEQ ID NO: 2176631 - RNA, 17 nt, Streptococcus pneumoniae R6
auccaguguauggagcu

SEQ ID NO: 2176632 - RNA, 20 nt, Streptococcus pneumoniae R6
auccaguacauugauugcuu

SEQ ID NO: 2176633 - RNA, 16 nt, Streptococcus pneumoniae R6
auccagccuucauaaa

SEQ ID NO: 2176634 - RNA, 13 nt, Streptococcus pneumoniae R6
auccagcaggaga

SEQ ID NO: 2176635 - RNA, 22 nt, Streptococcus pneumoniae R6
aucccauuuauauaaaaagaaa

SEQ ID NO: 2176636 - RNA, 23 nt, Streptococcus pneumoniae R6
auccccauuuguaugagaggcaa

SEQ ID NO: 2176637 - RNA, 16 nt, Streptococcus pneumoniae R6
aucccuccauuucaua

SEQ ID NO: 2176638 - RNA, 17 nt, Streptococcus pneumoniae R6
aucccuagcuuuuuccu

SEQ ID NO: 2176639 - RNA, 21 nt, Streptococcus pneumoniae R6
aucccuguagggggcauauaa

SEQ ID NO: 2176640 - RNA, 20 nt, Streptococcus pneumoniae R6
aucccuuguuuaguaaacaa

SEQ ID NO: 2176641 - RNA, 15 nt, Streptococcus pneumoniae R6
auccgaaaaauuucu

SEQ ID NO: 2176642 - RNA, 15 nt, Streptococcus pneumoniae R6
auccgcaagagauuu

SEQ ID NO: 2176643 - RNA, 15 nt, Streptococcus pneumoniae R6
auccgauaauauaua

SEQ ID NO: 2176644 - RNA, 15 nt, Streptococcus pneumoniae R6
auccgccguuaucca

SEQ ID NO: 2176645 - RNA, 18 nt, Streptococcus pneumoniae R6
auccgcuugggaaaccaa

SEQ ID NO: 2176646 - RNA, 19 nt, Streptococcus pneumoniae R6
auccgcuugggaaaccaaa

SEQ ID NO: 2176647 - RNA, 22 nt, Streptococcus pneumoniae R6
auccgcuugggaaaccaaacgg

SEQ ID NO: 2176648 - RNA, 14 nt, Streptococcus pneumoniae R6
auccucauauucuu

SEQ ID NO: 2176649 - RNA, 15 nt, Streptococcus pneumoniae R6
auccuauuuauuacu

SEQ ID NO: 2176650 - RNA, 23 nt, Streptococcus pneumoniae R6
auccuauuucacuccacuauaaa

SEQ ID NO: 2176651 - RNA, 16 nt, Streptococcus pneumoniae R6
auccuaucuucuagaa

SEQ ID NO: 2176652 - RNA, 20 nt, Streptococcus pneumoniae R6
auccuaugauacccaaaauc

SEQ ID NO: 2176653 - RNA, 17 nt, Streptococcus pneumoniae R6
auccuaaauccucuauc

SEQ ID NO: 2176654 - RNA, 15 nt, Streptococcus pneumoniae R6
auccguuuuuuaaaa

SEQ ID NO: 2176655 - RNA, 11 nt, Streptococcus pneumoniae R6
auccuaaaaaa

SEQ ID NO: 2176656 - RNA, 14 nt, Streptococcus pneumoniae R6
auccugcauuguga

SEQ ID NO: 2176657 - RNA, 20 nt, Streptococcus pneumoniae R6
auccugccucaauccuuuuc

SEQ ID NO: 2176658 - RNA, 18 nt, Streptococcus pneumoniae R6
auccucuaucaugcgaau

SEQ ID NO: 2176659 - RNA, 16 nt, Streptococcus pneumoniae R6
auccucugucacaaag

SEQ ID NO: 2176660 - RNA, 18 nt, Streptococcus pneumoniae R6
auccucugucacaaagag

SEQ ID NO: 2176661 - RNA, 21 nt, Streptococcus pneumoniae R6
auccucugaguauuuagcaac

SEQ ID NO: 2176662 - RNA, 23 nt, Streptococcus pneumoniae R6
auccucugaguauuuagcaacca

SEQ ID NO: 2176663 - RNA, 14 nt, Streptococcus pneumoniae R6
auccugaagaaugg

SEQ ID NO: 2176664 - RNA, 15 nt, Streptococcus pneumoniae R6
auccugaaaagccac

SEQ ID NO: 2176665 - RNA, 15 nt, Streptococcus pneumoniae R6
aucguagcuuuucuu

SEQ ID NO: 2176666 - RNA, 18 nt, Streptococcus pneumoniae R6
aucguagcuuuucuuauu

SEQ ID NO: 2176667 - RNA, 13 nt, Streptococcus pneumoniae R6
aucuaaaacuggu

SEQ ID NO: 2176668 - RNA, 20 nt, Streptococcus pneumoniae R6
aucuaacaauaagauaucac

SEQ ID NO: 2176669 - RNA, 24 nt, Streptococcus pneumoniae R6
aucuaacaauaagauaucacucau

SEQ ID NO: 2176670 - RNA, 20 nt, Streptococcus pneumoniae R6
aucggaagcuacagagcuaa

SEQ ID NO: 2176671 - RNA, 22 nt, Streptococcus pneumoniae R6
aucggagacggacuagaaugcu

SEQ ID NO: 2176672 - RNA, 20 nt, Streptococcus pneumoniae R6
aucgcuauaaauaaggggau

SEQ ID NO: 2176673 - RNA, 22 nt, Streptococcus pneumoniae R6
aucgcuaucaaugguuuugggu

SEQ ID NO: 2176674 - RNA, 15 nt, Streptococcus pneumoniae R6
aucgauuauauuuag

SEQ ID NO: 2176675 - RNA, 17 nt, Streptococcus pneumoniae R6
aucgauuaggaaaggaa

SEQ ID NO: 2176676 - RNA, 19 nt, Streptococcus pneumoniae R6
aucgauuuauguccuaaaa

SEQ ID NO: 2176677 - RNA, 16 nt, Streptococcus pneumoniae R6
aucgauuucuaaaaau

SEQ ID NO: 2176678 - RNA, 16 nt, Streptococcus pneumoniae R6
aucgaucauauuuaug

SEQ ID NO: 2176679 - RNA, 19 nt, Streptococcus pneumoniae R6
aucgaugacccaagcuuua

SEQ ID NO: 2176680 - RNA, 15 nt, Streptococcus pneumoniae R6
aucgaugcccucuuc

SEQ ID NO: 2176681 - RNA, 18 nt, Streptococcus pneumoniae R6
aucgaugcccucuucuuu

SEQ ID NO: 2176682 - RNA, 17 nt, Streptococcus pneumoniae R6
auccuugguaacaacac

SEQ ID NO: 2176683 - RNA, 18 nt, Streptococcus pneumoniae R6
auccuuuacuuguuuuag

SEQ ID NO: 2176684 - RNA, 14 nt, Streptococcus pneumoniae R6
auccuuuauuuuca

SEQ ID NO: 2176685 - RNA, 18 nt, Streptococcus pneumoniae R6
auccuuuauuuucaagcg

SEQ ID NO: 2176686 - RNA, 20 nt, Streptococcus pneumoniae R6
auccuugaugcgauugauuu

SEQ ID NO: 2176687 - RNA, 19 nt, Streptococcus pneumoniae R6
auccuuacggucaaaguca

SEQ ID NO: 2176688 - RNA, 21 nt, Streptococcus pneumoniae R6
caauucaguaacugauccagu

SEQ ID NO: 2176689 - RNA, 15 nt, Streptococcus pneumoniae R6
caauucagccuuauc

SEQ ID NO: 2176690 - RNA, 16 nt, Streptococcus pneumoniae R6
caauucagccuuaucc

SEQ ID NO: 2176691 - RNA, 22 nt, Streptococcus pneumoniae R6
caauucccguuaaaggugugau

SEQ ID NO: 2176692 - RNA, 17 nt, Streptococcus pneumoniae R6
caauuccucauuuugaa

SEQ ID NO: 2176693 - RNA, 22 nt, Streptococcus pneumoniae R6
caauuccucauuuugaagauug

SEQ ID NO: 2176694 - RNA, 20 nt, Streptococcus pneumoniae R6
caauuccuuacgaacaacga

SEQ ID NO: 2176695 - RNA, 14 nt, Streptococcus pneumoniae R6
caauucuaaaaaca

SEQ ID NO: 2176696 - RNA, 16 nt, Streptococcus pneumoniae R6
caauucuaaaaacaga

SEQ ID NO: 2176697 - RNA, 13 nt, Streptococcus pneumoniae R6
caauucuuggauc

SEQ ID NO: 2176698 - RNA, 23 nt, Streptococcus pneumoniae R6
caauucuugguugccuuuuugaa

SEQ ID NO: 2176699 - RNA, 22 nt, Streptococcus pneumoniae R6
caauucugggauuacaagaccg

SEQ ID NO: 2176700 - RNA, 19 nt, Streptococcus pneumoniae R6
caauucgguugguuuuuuu

SEQ ID NO: 2176701 - RNA, 21 nt, Streptococcus pneumoniae R6
caauugcaagagggcuucaau

SEQ ID NO: 2176702 - RNA, 11 nt, Streptococcus pneumoniae R6
caauugaggaa

SEQ ID NO: 2176703 - RNA, 21 nt, Streptococcus pneumoniae R6
caauuuaauacucaaugaaaa

SEQ ID NO: 2176704 - RNA, 21 nt, Streptococcus pneumoniae R6
caauuuaauacucugugaaaa

SEQ ID NO: 2176705 - RNA, 17 nt, Streptococcus pneumoniae R6
caauugugcauaagaaa

SEQ ID NO: 2176706 - RNA, 23 nt, Streptococcus pneumoniae R6
caauuguuucguacuauuucaga

SEQ ID NO: 2176707 - RNA, 22 nt, Streptococcus pneumoniae R6
caauugcucaacuucuuuuugu

SEQ ID NO: 2176708 - RNA, 17 nt, Streptococcus pneumoniae R6
caauugcuaaaacauuu

SEQ ID NO: 2176709 - RNA, 22 nt, Streptococcus pneumoniae R6
caauugcuaaaacauuuauaga

SEQ ID NO: 2176710 - RNA, 23 nt, Streptococcus pneumoniae R6
caauugcuaaaacauuuauagaa

SEQ ID NO: 2176711 - RNA, 14 nt, Streptococcus pneumoniae R6
caauuguaaaaaga

SEQ ID NO: 2176712 - RNA, 22 nt, Streptococcus pneumoniae R6
caauuguaaaaagagggauucu

SEQ ID NO: 2176713 - RNA, 21 nt, Streptococcus pneumoniae R6
caauuguagauguucuuugaa

SEQ ID NO: 2176714 - RNA, 17 nt, Streptococcus pneumoniae R6
caauuggaaauaacaaa

SEQ ID NO: 2176715 - RNA, 15 nt, Streptococcus pneumoniae R6
caauuaucauuucca

SEQ ID NO: 2176716 - RNA, 14 nt, Streptococcus pneumoniae R6
caauuauccauauu

SEQ ID NO: 2176717 - RNA, 16 nt, Streptococcus pneumoniae R6
caauucaauuuuauac

SEQ ID NO: 2176718 - RNA, 20 nt, Streptococcus pneumoniae R6
caauucaauuuuauacucau

SEQ ID NO: 2176719 - RNA, 16 nt, Streptococcus pneumoniae R6
caauuaauucuaaauc

SEQ ID NO: 2176720 - RNA, 16 nt, Streptococcus pneumoniae R6
caauuacguuuaaaga

SEQ ID NO: 2176721 - RNA, 13 nt, Streptococcus pneumoniae R6
caauuauauaaac

SEQ ID NO: 2176722 - RNA, 21 nt, Streptococcus pneumoniae R6
caaucaguaauuuaguucuca

SEQ ID NO: 2176723 - RNA, 15 nt, Streptococcus pneumoniae R6
caaucagaugacugg

SEQ ID NO: 2176724 - RNA, 23 nt, Streptococcus pneumoniae R6
caaucagacuauaauauaauaaa

SEQ ID NO: 2176725 - RNA, 20 nt, Streptococcus pneumoniae R6
caaucagacuguuuuucuug

SEQ ID NO: 2176726 - RNA, 14 nt, Streptococcus pneumoniae R6
caaucacuugacca

SEQ ID NO: 2176727 - RNA, 15 nt, Streptococcus pneumoniae R6
caauuaauuuauccg

SEQ ID NO: 2176728 - RNA, 22 nt, Streptococcus pneumoniae R6
caauuaauuuauccgaagauuu

SEQ ID NO: 2176729 - RNA, 17 nt, Streptococcus pneumoniae R6
caauuaagaaauuuucu

SEQ ID NO: 2176730 - RNA, 16 nt, Streptococcus pneumoniae R6
caauuaaaaggcucau

SEQ ID NO: 2176731 - RNA, 11 nt, Streptococcus pneumoniae R6
caauuuuaaau

SEQ ID NO: 2176732 - RNA, 21 nt, Streptococcus pneumoniae R6
caauuuuacaggaauauugag

SEQ ID NO: 2176733 - RNA, 15 nt, Streptococcus pneumoniae R6
caauuuuaccuuuca

SEQ ID NO: 2176734 - RNA, 19 nt, Streptococcus pneumoniae R6
caauuuuacuucuucccca

SEQ ID NO: 2176735 - RNA, 19 nt, Streptococcus pneumoniae R6
caauuuuaggagaaaaaga

SEQ ID NO: 2176736 - RNA, 20 nt, Streptococcus pneumoniae R6
cacaaaagagaaagacuuga

SEQ ID NO: 2176737 - RNA, 13 nt, Streptococcus pneumoniae R6
cacaaaaaagcua

SEQ ID NO: 2176738 - RNA, 22 nt, Streptococcus pneumoniae R6
cacaaaaaagcuagauauuucc

SEQ ID NO: 2176739 - RNA, 10 nt, Streptococcus pneumoniae R6
caauuuuuga

SEQ ID NO: 2176740 - RNA, 12 nt, Streptococcus pneumoniae R6
caauuuuuccag

SEQ ID NO: 2176741 - RNA, 16 nt, Streptococcus pneumoniae R6
caauuuccauuuacag

SEQ ID NO: 2176742 - RNA, 20 nt, Streptococcus pneumoniae R6
caauuuccauuuacagaagc

SEQ ID NO: 2176743 - RNA, 16 nt, Streptococcus pneumoniae R6
caauuucacaacucuu

SEQ ID NO: 2176744 - RNA, 22 nt, Streptococcus pneumoniae R6
caauuucacaacucuuauacuu

SEQ ID NO: 2176745 - RNA, 12 nt, Streptococcus pneumoniae R6
caauuuaucucc

SEQ ID NO: 2176746 - RNA, 21 nt, Streptococcus pneumoniae R6
caauuucucuacaaauaagaa

SEQ ID NO: 2176747 - RNA, 16 nt, Streptococcus pneumoniae R6
caauuucucguguaau

SEQ ID NO: 2176748 - RNA, 14 nt, Streptococcus pneumoniae R6
caauuucgauaaua

SEQ ID NO: 2176749 - RNA, 18 nt, Streptococcus pneumoniae R6
caauuucgauaauaccua

SEQ ID NO: 2176750 - RNA, 13 nt, Streptococcus pneumoniae R6
caauuucuuaaua

SEQ ID NO: 2176751 - RNA, 21 nt, Streptococcus pneumoniae R6
caauuugauauauaaaugaaa

SEQ ID NO: 2176752 - RNA, 16 nt, Streptococcus pneumoniae R6
cacaaagaacaugaaa

SEQ ID NO: 2176753 - RNA, 21 nt, Streptococcus pneumoniae R6
cacaaagaacaugaaagauga

SEQ ID NO: 2176754 - RNA, 11 nt, Streptococcus pneumoniae R6
cacaaagauaa

SEQ ID NO: 2176755 - RNA, 13 nt, Streptococcus pneumoniae R6
cacaaagauaaaa

SEQ ID NO: 2176756 - RNA, 17 nt, Streptococcus pneumoniae R6
cacaaauucuggcauuu

SEQ ID NO: 2176757 - RNA, 17 nt, Streptococcus pneumoniae R6
cacaaauugauuaggaa

SEQ ID NO: 2176758 - RNA, 20 nt, Streptococcus pneumoniae R6
cacaaauugauuaggaaauu

SEQ ID NO: 2176759 - RNA, 20 nt, Streptococcus pneumoniae R6
cacaaaguggagguguucua

SEQ ID NO: 2176760 - RNA, 12 nt, Streptococcus pneumoniae R6
cacaaaauccuu

SEQ ID NO: 2176761 - RNA, 12 nt, Streptococcus pneumoniae R6
cacaaaaggagg

SEQ ID NO: 2176762 - RNA, 14 nt, Streptococcus pneumoniae R6
cacaaccuuaaaac

SEQ ID NO: 2176763 - RNA, 13 nt, Streptococcus pneumoniae R6
cacaaccucaaaa

SEQ ID NO: 2176764 - RNA, 21 nt, Streptococcus pneumoniae R6
cacaccugauauuaugcguuu

SEQ ID NO: 2176765 - RNA, 15 nt, Streptococcus pneumoniae R6
cacagaaagcauccc

SEQ ID NO: 2176766 - RNA, 15 nt, Streptococcus pneumoniae R6
cacacuuccaagucg

SEQ ID NO: 2176767 - RNA, 17 nt, Streptococcus pneumoniae R6
cacacuagcaauuuuuu

SEQ ID NO: 2176768 - RNA, 13 nt, Streptococcus pneumoniae R6
cacaaucgucuca

SEQ ID NO: 2176769 - RNA, 16 nt, Streptococcus pneumoniae R6
cacaaugcuguuucua

SEQ ID NO: 2176770 - RNA, 20 nt, Streptococcus pneumoniae R6
cacauauacacuuaaauuca

SEQ ID NO: 2176771 - RNA, 12 nt, Streptococcus pneumoniae R6
cacauauagacg

SEQ ID NO: 2176772 - RNA, 16 nt, Streptococcus pneumoniae R6
cacauaguaguaaaca

SEQ ID NO: 2176773 - RNA, 16 nt, Streptococcus pneumoniae R6
cacaguuaaauuauaa

SEQ ID NO: 2176774 - RNA, 20 nt, Streptococcus pneumoniae R6
cacaggcaaccaaaaucaua

SEQ ID NO: 2176775 - RNA, 18 nt, Streptococcus pneumoniae R6
cacaggaauacuaaaaua

SEQ ID NO: 2176776 - RNA, 22 nt, Streptococcus pneumoniae R6
cacaggagcuggaucuugagga

SEQ ID NO: 2176777 - RNA, 16 nt, Streptococcus pneumoniae R6
cacagacugaggacca

SEQ ID NO: 2176778 - RNA, 18 nt, Streptococcus pneumoniae R6
cacagaccgacacaccau

SEQ ID NO: 2176779 - RNA, 20 nt, Streptococcus pneumoniae R6
cacaugacaaauucuccaca

SEQ ID NO: 2176780 - RNA, 17 nt, Streptococcus pneumoniae R6
cacaugacauuauuuuc

SEQ ID NO: 2176781 - RNA, 22 nt, Streptococcus pneumoniae R6
cacaucuguguagcacuuuucc

SEQ ID NO: 2176782 - RNA, 15 nt, Streptococcus pneumoniae R6
cacaucuacuucuaa

SEQ ID NO: 2176783 - RNA, 14 nt, Streptococcus pneumoniae R6
cacaucgucaagca

SEQ ID NO: 2176784 - RNA, 17 nt, Streptococcus pneumoniae R6
cacauccgccugaguua

SEQ ID NO: 2176785 - RNA, 22 nt, Streptococcus pneumoniae R6
cacauucguuccuuuaaaauga

SEQ ID NO: 2176786 - RNA, 22 nt, Streptococcus pneumoniae R6
cacauuggcaagagcuguucca

SEQ ID NO: 2176787 - RNA, 18 nt, Streptococcus pneumoniae R6
cacauuuccauguaaaau

SEQ ID NO: 2176788 - RNA, 16 nt, Streptococcus pneumoniae R6
cacauuuucaauguga

SEQ ID NO: 2176789 - RNA, 17 nt, Streptococcus pneumoniae R6
cacauuuugaaauguuc

SEQ ID NO: 2176790 - RNA, 20 nt, Streptococcus pneumoniae R6
cacauuuugaaauguuccaa

SEQ ID NO: 2176791 - RNA, 18 nt, Streptococcus pneumoniae R6
caccaaaaccaaucaauu

SEQ ID NO: 2176792 - RNA, 18 nt, Streptococcus pneumoniae R6
caccaaaacuauauucuc

SEQ ID NO: 2176793 - RNA, 21 nt, Streptococcus pneumoniae R6
caccaauacagcuuuuuucuu

SEQ ID NO: 2176794 - RNA, 17 nt, Streptococcus pneumoniae R6
caccaaucaguaauuua

SEQ ID NO: 2176795 - RNA, 22 nt, Streptococcus pneumoniae R6
caccaaucaguaauuuaguucu

SEQ ID NO: 2176796 - RNA, 15 nt, Streptococcus pneumoniae R6
caccaaucauuugga

SEQ ID NO: 2176797 - RNA, 19 nt, Streptococcus pneumoniae R6
caccaagaauaauuaccau

SEQ ID NO: 2176798 - RNA, 19 nt, Streptococcus pneumoniae R6
caccaagcauuuucauaag

SEQ ID NO: 2176799 - RNA, 17 nt, Streptococcus pneumoniae R6
caccaccgauauggccu

SEQ ID NO: 2176800 - RNA, 20 nt, Streptococcus pneumoniae R6
caccaucuauaaguaagaga

SEQ ID NO: 2176801 - RNA, 19 nt, Streptococcus pneumoniae R6
cacccaaaacuucugcaau

SEQ ID NO: 2176802 - RNA, 15 nt, Streptococcus pneumoniae R6
cacccacgucacaaa

SEQ ID NO: 2176803 - RNA, 19 nt, Streptococcus pneumoniae R6
cacccauggcaacguuaaa

SEQ ID NO: 2176804 - RNA, 16 nt, Streptococcus pneumoniae R6
caccauaguguuucuc

SEQ ID NO: 2176805 - RNA, 21 nt, Streptococcus pneumoniae R6
caccuaucugcuauguugcaa

SEQ ID NO: 2176806 - RNA, 15 nt, Streptococcus pneumoniae R6
caccuagaacaagcu

SEQ ID NO: 2176807 - RNA, 14 nt, Streptococcus pneumoniae R6
caccuagcgccugu

SEQ ID NO: 2176808 - RNA, 18 nt, Streptococcus pneumoniae R6
caccuagcgccuguucua

SEQ ID NO: 2176809 - RNA, 20 nt, Streptococcus pneumoniae R6
caccuaaaauucccuuaucc

SEQ ID NO: 2176810 - RNA, 17 nt, Streptococcus pneumoniae R6
caccugcagcgauugaa

SEQ ID NO: 2176811 - RNA, 18 nt, Streptococcus pneumoniae R6
caccugauuucuccgcuu

SEQ ID NO: 2176812 - RNA, 15 nt, Streptococcus pneumoniae R6
caccugauacuaugc

SEQ ID NO: 2176813 - RNA, 18 nt, Streptococcus pneumoniae R6
caccugacaauguaccug

SEQ ID NO: 2176814 - RNA, 12 nt, Streptococcus pneumoniae R6
caccucaucuug

SEQ ID NO: 2176815 - RNA, 23 nt, Streptococcus pneumoniae R6
caccuccgccuccagagaagcca

SEQ ID NO: 2176816 - RNA, 15 nt, Streptococcus pneumoniae R6
caccuccuucuccaa

SEQ ID NO: 2176817 - RNA, 17 nt, Streptococcus pneumoniae R6
caccuccuucuccaauc

SEQ ID NO: 2176818 - RNA, 16 nt, Streptococcus pneumoniae R6
caccuccuucuccagu

SEQ ID NO: 2176819 - RNA, 21 nt, Streptococcus pneumoniae R6
cacgacuaauuucaaaggcuu

SEQ ID NO: 2176820 - RNA, 15 nt, Streptococcus pneumoniae R6
cacgacuuucugaua

SEQ ID NO: 2176821 - RNA, 20 nt, Streptococcus pneumoniae R6
cacgacuuucugauggauuu

SEQ ID NO: 2176822 - RNA, 22 nt, Streptococcus pneumoniae R6
cacgaguggacucgaaccaccg

SEQ ID NO: 2176823 - RNA, 15 nt, Streptococcus pneumoniae R6
cacgagucacugugg

SEQ ID NO: 2176824 - RNA, 20 nt, Streptococcus pneumoniae R6
cacgaggaggagaaaaagcg

SEQ ID NO: 2176825 - RNA, 18 nt, Streptococcus pneumoniae R6
cacgacgggcuuggaaau

SEQ ID NO: 2176826 - RNA, 19 nt, Streptococcus pneumoniae R6
cacgacgcaguucuucaua

SEQ ID NO: 2176827 - RNA, 17 nt, Streptococcus pneumoniae R6
cacgaaaauauuuggaa

SEQ ID NO: 2176828 - RNA, 11 nt, Streptococcus pneumoniae R6
caccuuuucuc

SEQ ID NO: 2176829 - RNA, 18 nt, Streptococcus pneumoniae R6
caccuuuugcgucuucua

SEQ ID NO: 2176830 - RNA, 15 nt, Streptococcus pneumoniae R6
cacgaaggacaucuu

SEQ ID NO: 2176831 - RNA, 17 nt, Streptococcus pneumoniae R6
cacgaagggcuucauca

SEQ ID NO: 2176832 - RNA, 18 nt, Streptococcus pneumoniae R6
cacgaagggcuucaucaa

SEQ ID NO: 2176833 - RNA, 18 nt, Streptococcus pneumoniae R6
cacgaagcauaucagaca

SEQ ID NO: 2176834 - RNA, 19 nt, Streptococcus pneumoniae R6
cacgaagcauaucagacau

SEQ ID NO: 2176835 - RNA, 16 nt, Streptococcus pneumoniae R6
caccuuuaucagccaa

SEQ ID NO: 2176836 - RNA, 15 nt, Streptococcus pneumoniae R6
caccuugaucuucca

SEQ ID NO: 2176837 - RNA, 17 nt, Streptococcus pneumoniae R6
caccuugaucuuccauu

SEQ ID NO: 2176838 - RNA, 21 nt, Streptococcus pneumoniae R6
cacccuuagucgcuacaggca

SEQ ID NO: 2176839 - RNA, 20 nt, Streptococcus pneumoniae R6
caccgacuugguaguugagc

SEQ ID NO: 2176840 - RNA, 16 nt, Streptococcus pneumoniae R6
caccgacgauaaggac

SEQ ID NO: 2176841 - RNA, 22 nt, Streptococcus pneumoniae R6
caccgccgaggacggagcuugg

SEQ ID NO: 2176842 - RNA, 12 nt, Streptococcus pneumoniae R6
caccgccugcuc

SEQ ID NO: 2176843 - RNA, 14 nt, Streptococcus pneumoniae R6
cacgcuaaguagaa

SEQ ID NO: 2176844 - RNA, 15 nt, Streptococcus pneumoniae R6
cacgcuaccauuauc

SEQ ID NO: 2176845 - RNA, 15 nt, Streptococcus pneumoniae R6
cacgcuccacuuccc

SEQ ID NO: 2176846 - RNA, 20 nt, Streptococcus pneumoniae R6
cacggagcgagacaaaacaa

SEQ ID NO: 2176847 - RNA, 16 nt, Streptococcus pneumoniae R6
cacggauucucucagc

SEQ ID NO: 2176848 - RNA, 16 nt, Streptococcus pneumoniae R6
cacggaucuugaacug

SEQ ID NO: 2176849 - RNA, 19 nt, Streptococcus pneumoniae R6
cacgcauaagcaauuuuuu

SEQ ID NO: 2176850 - RNA, 17 nt, Streptococcus pneumoniae R6
cacgauaaucugggcua

SEQ ID NO: 2176851 - RNA, 18 nt, Streptococcus pneumoniae R6
cacgaucauccauucuuu

SEQ ID NO: 2176852 - RNA, 22 nt, Streptococcus pneumoniae R6
cacgauuggggucagaaagaag

SEQ ID NO: 2176853 - RNA, 18 nt, Streptococcus pneumoniae R6
cacguucuuuaaucaaga

SEQ ID NO: 2176854 - RNA, 18 nt, Streptococcus pneumoniae R6
cacguuccauaccaucaa

SEQ ID NO: 2176855 - RNA, 22 nt, Streptococcus pneumoniae R6
cacgugcggcuagccuccuagu

SEQ ID NO: 2176856 - RNA, 15 nt, Streptococcus pneumoniae R6
cacgugcucaaaaca

SEQ ID NO: 2176857 - RNA, 19 nt, Streptococcus pneumoniae R6
cacgugcucaaaacacugu

SEQ ID NO: 2176858 - RNA, 11 nt, Streptococcus pneumoniae R6
cacuaaaaaua

SEQ ID NO: 2176859 - RNA, 17 nt, Streptococcus pneumoniae R6
cacguuucuaauaauua

SEQ ID NO: 2176860 - RNA, 13 nt, Streptococcus pneumoniae R6
cacuaaacuacac

SEQ ID NO: 2176861 - RNA, 17 nt, Streptococcus pneumoniae R6
cacuacaguugacaaag

SEQ ID NO: 2176862 - RNA, 22 nt, Streptococcus pneumoniae R6
cacuacaguugacaaagagcca

SEQ ID NO: 2176863 - RNA, 17 nt, Streptococcus pneumoniae R6
cacuacacuugacaaag

SEQ ID NO: 2176864 - RNA, 22 nt, Streptococcus pneumoniae R6
cacuaauuaucuaucucaacaa

SEQ ID NO: 2176865 - RNA, 24 nt, Streptococcus pneumoniae R6
cacguaaauugcccuugucauccu

SEQ ID NO: 2176866 - RNA, 14 nt, Streptococcus pneumoniae R6
cacguauaauucua

SEQ ID NO: 2176867 - RNA, 16 nt, Streptococcus pneumoniae R6
cacguauaauucuaac

SEQ ID NO: 2176868 - RNA, 15 nt, Streptococcus pneumoniae R6
cacguacuuuaaaau

SEQ ID NO: 2176869 - RNA, 22 nt, Streptococcus pneumoniae R6
cacguccaucgaugauuggugc

SEQ ID NO: 2176870 - RNA, 13 nt, Streptococcus pneumoniae R6
cacguccaauuuu

SEQ ID NO: 2176871 - RNA, 15 nt, Streptococcus pneumoniae R6
cacggguuuaacuaa

SEQ ID NO: 2176872 - RNA, 15 nt, Streptococcus pneumoniae R6
cacgguaauuguuuu

SEQ ID NO: 2176873 - RNA, 15 nt, Streptococcus pneumoniae R6
cacuauaacuuguuu

SEQ ID NO: 2176874 - RNA, 20 nt, Streptococcus pneumoniae R6
cacuagugaauuugguucca

SEQ ID NO: 2176875 - RNA, 19 nt, Streptococcus pneumoniae R6
cacuauauugcaagagaaa

SEQ ID NO: 2176876 - RNA, 20 nt, Streptococcus pneumoniae R6
cacuauaguccaaacgucca

SEQ ID NO: 2176877 - RNA, 12 nt, Streptococcus pneumoniae R6
cacuaucuaaaa

SEQ ID NO: 2176878 - RNA, 14 nt, Streptococcus pneumoniae R6
cacuaucuaaaaaa

SEQ ID NO: 2176879 - RNA, 14 nt, Streptococcus pneumoniae R6
cacuauuagcaucu

SEQ ID NO: 2176880 - RNA, 14 nt, Streptococcus pneumoniae R6
cacuauucaucagg

SEQ ID NO: 2176881 - RNA, 19 nt, Streptococcus pneumoniae R6
cacuagaugcaucugccag

SEQ ID NO: 2176882 - RNA, 20 nt, Streptococcus pneumoniae R6
cacuagcagccacuuuuuau

SEQ ID NO: 2176883 - RNA, 22 nt, Streptococcus pneumoniae R6
cacuagcauaauggcucauuug

SEQ ID NO: 2176884 - RNA, 13 nt, Streptococcus pneumoniae R6
cacuagccccagc

SEQ ID NO: 2176885 - RNA, 23 nt, Streptococcus pneumoniae R6
cacuagaaaaugaggaaaaucuu

SEQ ID NO: 2176886 - RNA, 22 nt, Streptococcus pneumoniae R6
cacuaguuuuaggacauaaaua

SEQ ID NO: 2176887 - RNA, 15 nt, Streptococcus pneumoniae R6
cacuauaaaacauuc

SEQ ID NO: 2176888 - RNA, 14 nt, Streptococcus pneumoniae R6
cacucaauuuaucu

SEQ ID NO: 2176889 - RNA, 12 nt, Streptococcus pneumoniae R6
cacucaauauua

SEQ ID NO: 2176890 - RNA, 13 nt, Streptococcus pneumoniae R6
cacucaauauuau

SEQ ID NO: 2176891 - RNA, 23 nt, Streptococcus pneumoniae R6
cacucaauauuaugcguuuuuuc

SEQ ID NO: 2176892 - RNA, 15 nt, Streptococcus pneumoniae R6
cacuauuguauuuau

SEQ ID NO: 2176893 - RNA, 18 nt, Streptococcus pneumoniae R6
cacuauuguuauuuuucu

SEQ ID NO: 2176894 - RNA, 20 nt, Streptococcus pneumoniae R6
cacucaaaucaaaauauagc

SEQ ID NO: 2176895 - RNA, 17 nt, Streptococcus pneumoniae R6
cacucaacauuauccau

SEQ ID NO: 2176896 - RNA, 18 nt, Streptococcus pneumoniae R6
cacucagggcaagauggg

SEQ ID NO: 2176897 - RNA, 22 nt, Streptococcus pneumoniae R6
cacucaguauuacauccaccag

SEQ ID NO: 2176898 - RNA, 15 nt, Streptococcus pneumoniae R6
auucuuccuacugau

SEQ ID NO: 2176899 - RNA, 19 nt, Streptococcus pneumoniae R6
auucuucauagucaaaacc

SEQ ID NO: 2176900 - RNA, 17 nt, Streptococcus pneumoniae R6
auucuucgugaaagaca

SEQ ID NO: 2176901 - RNA, 19 nt, Streptococcus pneumoniae R6
auucuucuucugaaaagac

SEQ ID NO: 2176902 - RNA, 15 nt, Streptococcus pneumoniae R6
auucuucuguuucug

SEQ ID NO: 2176903 - RNA, 18 nt, Streptococcus pneumoniae R6
auucuuuagcagaugcuu

SEQ ID NO: 2176904 - RNA, 22 nt, Streptococcus pneumoniae R6
auucuuuagcuuucaaguuuug

SEQ ID NO: 2176905 - RNA, 14 nt, Streptococcus pneumoniae R6
auucuuucaagcgc

SEQ ID NO: 2176906 - RNA, 17 nt, Streptococcus pneumoniae R6
auucuuuagaaaacuag

SEQ ID NO: 2176907 - RNA, 16 nt, Streptococcus pneumoniae R6
auucuuuccgucaaga

SEQ ID NO: 2176908 - RNA, 17 nt, Streptococcus pneumoniae R6
auucuuucuaaugaguu

SEQ ID NO: 2176909 - RNA, 22 nt, Streptococcus pneumoniae R6
auucuuugaaaucagaaaaaac

SEQ ID NO: 2176910 - RNA, 23 nt, Streptococcus pneumoniae R6
auugaacccgcgcaauuaagcag

SEQ ID NO: 2176911 - RNA, 20 nt, Streptococcus pneumoniae R6
auugaagaagacuagaccac

SEQ ID NO: 2176912 - RNA, 16 nt, Streptococcus pneumoniae R6
auugaaaugaaauaaa

SEQ ID NO: 2176913 - RNA, 18 nt, Streptococcus pneumoniae R6
auugaaaugaaauaaaau

SEQ ID NO: 2176914 - RNA, 20 nt, Streptococcus pneumoniae R6
auucuuuuacacucaauuua

SEQ ID NO: 2176915 - RNA, 13 nt, Streptococcus pneumoniae R6
auucuuuguuaaa

SEQ ID NO: 2176916 - RNA, 21 nt, Streptococcus pneumoniae R6
auucuuuguuaaaugaauaua

SEQ ID NO: 2176917 - RNA, 15 nt, Streptococcus pneumoniae R6
auucuuuucaaagua

SEQ ID NO: 2176918 - RNA, 19 nt, Streptococcus pneumoniae R6
auucguccuuucuuuuuug

SEQ ID NO: 2176919 - RNA, 21 nt, Streptococcus pneumoniae R6
auucgugggcuuucccagaca

SEQ ID NO: 2176920 - RNA, 14 nt, Streptococcus pneumoniae R6
auucgugguuuuau

SEQ ID NO: 2176921 - RNA, 17 nt, Streptococcus pneumoniae R6
auucguucuugguagua

SEQ ID NO: 2176922 - RNA, 15 nt, Streptococcus pneumoniae R6
auucguuucauuauu

SEQ ID NO: 2176923 - RNA, 16 nt, Streptococcus pneumoniae R6
auucguuccuuuaaaa

SEQ ID NO: 2176924 - RNA, 15 nt, Streptococcus pneumoniae R6
auucguacucucuuu

SEQ ID NO: 2176925 - RNA, 19 nt, Streptococcus pneumoniae R6
auucguccauccaagcguc

SEQ ID NO: 2176926 - RNA, 16 nt, Streptococcus pneumoniae R6
auucuaauuaaauaaa

SEQ ID NO: 2176927 - RNA, 20 nt, Streptococcus pneumoniae R6
auucuaagcgaccaucuuga

SEQ ID NO: 2176928 - RNA, 21 nt, Streptococcus pneumoniae R6
auucuaaaggcuuaauauuac

SEQ ID NO: 2176929 - RNA, 17 nt, Streptococcus pneumoniae R6
auucuccauaauugcuu

SEQ ID NO: 2176930 - RNA, 18 nt, Streptococcus pneumoniae R6
auucuccaguagaucacu

SEQ ID NO: 2176931 - RNA, 21 nt, Streptococcus pneumoniae R6
auucuccaguagaucacugaa

SEQ ID NO: 2176932 - RNA, 14 nt, Streptococcus pneumoniae R6
auucuccacagacc

SEQ ID NO: 2176933 - RNA, 19 nt, Streptococcus pneumoniae R6
auucucucuuacuauacuu

SEQ ID NO: 2176934 - RNA, 21 nt, Streptococcus pneumoniae R6
auugcgcggguucaauacaaa

SEQ ID NO: 2176935 - RNA, 21 nt, Streptococcus pneumoniae R6
auuggaacuaaaguuccuaau

SEQ ID NO: 2176936 - RNA, 21 nt, Streptococcus pneumoniae R6
auuggacaaguuagccacaac

SEQ ID NO: 2176937 - RNA, 19 nt, Streptococcus pneumoniae R6
auugcuuuuagagauuuuc

SEQ ID NO: 2176938 - RNA, 22 nt, Streptococcus pneumoniae R6
auugcuggaaauagauguuaag

SEQ ID NO: 2176939 - RNA, 22 nt, Streptococcus pneumoniae R6
auuggaaauaacaaaccaagaa

SEQ ID NO: 2176940 - RNA, 14 nt, Streptococcus pneumoniae R6
auuggaaauucaag

SEQ ID NO: 2176941 - RNA, 14 nt, Streptococcus pneumoniae R6
auuggaaaauaaau

SEQ ID NO: 2176942 - RNA, 19 nt, Streptococcus pneumoniae R6
auugauaagaggauuuuaa

SEQ ID NO: 2176943 - RNA, 21 nt, Streptococcus pneumoniae R6
auugauaauaguaugucugaa

SEQ ID NO: 2176944 - RNA, 22 nt, Streptococcus pneumoniae R6
auugauaggauauugacaacuc

SEQ ID NO: 2176945 - RNA, 18 nt, Streptococcus pneumoniae R6
auugauaucuggauuuuc

SEQ ID NO: 2176946 - RNA, 12 nt, Streptococcus pneumoniae R6
auugauauggua

SEQ ID NO: 2176947 - RNA, 20 nt, Streptococcus pneumoniae R6
auugaccaagcuaucagaga

SEQ ID NO: 2176948 - RNA, 14 nt, Streptococcus pneumoniae R6
auugacauuuaagc

SEQ ID NO: 2176949 - RNA, 18 nt, Streptococcus pneumoniae R6
auugacauaccaccaagu

SEQ ID NO: 2176950 - RNA, 21 nt, Streptococcus pneumoniae R6
auugacauaccaccaaguaca

SEQ ID NO: 2176951 - RNA, 18 nt, Streptococcus pneumoniae R6
auugacagaaccuuggaa

SEQ ID NO: 2176952 - RNA, 12 nt, Streptococcus pneumoniae R6
auugacagaaga

SEQ ID NO: 2176953 - RNA, 13 nt, Streptococcus pneumoniae R6
auugacagaagau

SEQ ID NO: 2176954 - RNA, 13 nt, Streptococcus pneumoniae R6
auugaguuuuuug

SEQ ID NO: 2176955 - RNA, 19 nt, Streptococcus pneumoniae R6
auugauaaaggcagauuuc

SEQ ID NO: 2176956 - RNA, 18 nt, Streptococcus pneumoniae R6
auugacaaaauuugguuu

SEQ ID NO: 2176957 - RNA, 17 nt, Streptococcus pneumoniae R6
auugaugaagucuagca

SEQ ID NO: 2176958 - RNA, 15 nt, Streptococcus pneumoniae R6
auugaugauguuuaa

SEQ ID NO: 2176959 - RNA, 18 nt, Streptococcus pneumoniae R6
auugaugcaaaucucauu

SEQ ID NO: 2176960 - RNA, 21 nt, Streptococcus pneumoniae R6
auugauuaggaaauucaaaug

SEQ ID NO: 2176961 - RNA, 14 nt, Streptococcus pneumoniae R6
auugauugagaaau

SEQ ID NO: 2176962 - RNA, 16 nt, Streptococcus pneumoniae R6
auugauuuauagaaau

SEQ ID NO: 2176963 - RNA, 22 nt, Streptococcus pneumoniae R6
auugcagccaauuucuuuagca

SEQ ID NO: 2176964 - RNA, 13 nt, Streptococcus pneumoniae R6
auuccacacagaa

SEQ ID NO: 2176965 - RNA, 16 nt, Streptococcus pneumoniae R6
auuccaaauuagaaaa

SEQ ID NO: 2176966 - RNA, 14 nt, Streptococcus pneumoniae R6
auucauuugauuuu

SEQ ID NO: 2176967 - RNA, 16 nt, Streptococcus pneumoniae R6
auucauuugauuuucc

SEQ ID NO: 2176968 - RNA, 15 nt, Streptococcus pneumoniae R6
auucauuuacucucc

SEQ ID NO: 2176969 - RNA, 19 nt, Streptococcus pneumoniae R6
auucauuuacucuccucca

SEQ ID NO: 2176970 - RNA, 16 nt, Streptococcus pneumoniae R6
auucauuuacugaacg

SEQ ID NO: 2176971 - RNA, 14 nt, Streptococcus pneumoniae R6
auucccacaaggga

SEQ ID NO: 2176972 - RNA, 13 nt, Streptococcus pneumoniae R6
auuccauuggaag

SEQ ID NO: 2176973 - RNA, 20 nt, Streptococcus pneumoniae R6
auuccacguuucuaauaauu

SEQ ID NO: 2176974 - RNA, 17 nt, Streptococcus pneumoniae R6
auuccacauucauacca

SEQ ID NO: 2176975 - RNA, 13 nt, Streptococcus pneumoniae R6
auuccacgagcca

SEQ ID NO: 2176976 - RNA, 15 nt, Streptococcus pneumoniae R6
auuccacgagccaaa

SEQ ID NO: 2176977 - RNA, 17 nt, Streptococcus pneumoniae R6
auuccagacagcuucaa

SEQ ID NO: 2176978 - RNA, 17 nt, Streptococcus pneumoniae R6
auguugacuuaaugaau

SEQ ID NO: 2176979 - RNA, 20 nt, Streptococcus pneumoniae R6
auguucuguaaugaaauacu

SEQ ID NO: 2176980 - RNA, 19 nt, Streptococcus pneumoniae R6
auucauagguucaucuagu

SEQ ID NO: 2176981 - RNA, 12 nt, Streptococcus pneumoniae R6
auucauaaaaua

SEQ ID NO: 2176982 - RNA, 19 nt, Streptococcus pneumoniae R6
auucauaguuacuccuuuu

SEQ ID NO: 2176983 - RNA, 13 nt, Streptococcus pneumoniae R6
auucaucaagaga

SEQ ID NO: 2176984 - RNA, 19 nt, Streptococcus pneumoniae R6
auucauauccccagacaua

SEQ ID NO: 2176985 - RNA, 14 nt, Streptococcus pneumoniae R6
auucaugauugguc

SEQ ID NO: 2176986 - RNA, 15 nt, Streptococcus pneumoniae R6
auucggaaagccaaa

SEQ ID NO: 2176987 - RNA, 20 nt, Streptococcus pneumoniae R6
auucggaaagccaaaucaau

SEQ ID NO: 2176988 - RNA, 21 nt, Streptococcus pneumoniae R6
auucgccacguucaacaugac

SEQ ID NO: 2176989 - RNA, 21 nt, Streptococcus pneumoniae R6
auuccuugaugagcaaaggau

SEQ ID NO: 2176990 - RNA, 22 nt, Streptococcus pneumoniae R6
auuccuugaugagcaaaggauu

SEQ ID NO: 2176991 - RNA, 16 nt, Streptococcus pneumoniae R6
auuccuucuugaccac

SEQ ID NO: 2176992 - RNA, 18 nt, Streptococcus pneumoniae R6
auuccuuaaacucuugau

SEQ ID NO: 2176993 - RNA, 21 nt, Streptococcus pneumoniae R6
auuccuucaagggcagacaua

SEQ ID NO: 2176994 - RNA, 14 nt, Streptococcus pneumoniae R6
auuccuguguacug

SEQ ID NO: 2176995 - RNA, 14 nt, Streptococcus pneumoniae R6
auuccugauaaaag

SEQ ID NO: 2176996 - RNA, 19 nt, Streptococcus pneumoniae R6
auuccuggaaucagaacac

SEQ ID NO: 2176997 - RNA, 23 nt, Streptococcus pneumoniae R6
auuccuggaaucagaacacuucc

SEQ ID NO: 2176998 - RNA, 16 nt, Streptococcus pneumoniae R6
auuccuuuuuuuacau

SEQ ID NO: 2176999 - RNA, 16 nt, Streptococcus pneumoniae R6
auuccuuuuuucuaug

SEQ ID NO: 2177000 - RNA, 17 nt, Streptococcus pneumoniae R6
auucgaaaaucaaagug

SEQ ID NO: 2177001 - RNA, 19 nt, Streptococcus pneumoniae R6
auucgacugccucucuucu

SEQ ID NO: 2177002 - RNA, 15 nt, Streptococcus pneumoniae R6
auucccuacaaauac

SEQ ID NO: 2177003 - RNA, 20 nt, Streptococcus pneumoniae R6
auucccuuguagaaaagcaa

SEQ ID NO: 2177004 - RNA, 15 nt, Streptococcus pneumoniae R6
auuccccaucuucaa

SEQ ID NO: 2177005 - RNA, 22 nt, Streptococcus pneumoniae R6
auucccauucccuuguagaaaa

SEQ ID NO: 2177006 - RNA, 15 nt, Streptococcus pneumoniae R6
auucccaucaauauc

SEQ ID NO: 2177007 - RNA, 18 nt, Streptococcus pneumoniae R6
auucccaucaauaucgua

SEQ ID NO: 2177008 - RNA, 21 nt, Streptococcus pneumoniae R6
auucccuuuuugauuuuaaau

SEQ ID NO: 2177009 - RNA, 23 nt, Streptococcus pneumoniae R6
auuccuaugauuaaucaaaugag

SEQ ID NO: 2177010 - RNA, 15 nt, Streptococcus pneumoniae R6
auuccuacuucaaau

SEQ ID NO: 2177011 - RNA, 17 nt, Streptococcus pneumoniae R6
auuccuaaaauaacacu

SEQ ID NO: 2177012 - RNA, 12 nt, Streptococcus pneumoniae R6
auuucaauuuac

SEQ ID NO: 2177013 - RNA, 16 nt, Streptococcus pneumoniae R6
auuuauguccuaaaac

SEQ ID NO: 2177014 - RNA, 15 nt, Streptococcus pneumoniae R6
auuucacgguaauug

SEQ ID NO: 2177015 - RNA, 16 nt, Streptococcus pneumoniae R6
auuucacuagaaaaug

SEQ ID NO: 2177016 - RNA, 22 nt, Streptococcus pneumoniae R6
auuucacuccacuauaaaacau

SEQ ID NO: 2177017 - RNA, 23 nt, Streptococcus pneumoniae R6
auuucacuccacuauaaaacauu

SEQ ID NO: 2177018 - RNA, 23 nt, Streptococcus pneumoniae R6
auuucacgcgcauucguuucuuu

SEQ ID NO: 2177019 - RNA, 21 nt, Streptococcus pneumoniae R6
auuucagaaaucuucucuuga

SEQ ID NO: 2177020 - RNA, 19 nt, Streptococcus pneumoniae R6
auuucacuuguauccuccu

SEQ ID NO: 2177021 - RNA, 21 nt, Streptococcus pneumoniae R6
auuucacuuguauccuccucu

SEQ ID NO: 2177022 - RNA, 18 nt, Streptococcus pneumoniae R6
auuucauuucacuauguu

SEQ ID NO: 2177023 - RNA, 20 nt, Streptococcus pneumoniae R6
auuucauuucgacugaaaau

SEQ ID NO: 2177024 - RNA, 14 nt, Streptococcus pneumoniae R6
auuucauauuuuca

SEQ ID NO: 2177025 - RNA, 12 nt, Streptococcus pneumoniae R6
auuuccaaaaag

SEQ ID NO: 2177026 - RNA, 12 nt, Streptococcus pneumoniae R6
auuucauuuuac

SEQ ID NO: 2177027 - RNA, 14 nt, Streptococcus pneumoniae R6
auuucauuuucuac

SEQ ID NO: 2177028 - RNA, 22 nt, Streptococcus pneumoniae R6
auuucauuuucuacuaaaauua

SEQ ID NO: 2177029 - RNA, 22 nt, Streptococcus pneumoniae R6
auuucauuuugcgauauaguga

SEQ ID NO: 2177030 - RNA, 15 nt, Streptococcus pneumoniae R6
auuuccaaugaugag

SEQ ID NO: 2177031 - RNA, 21 nt, Streptococcus pneumoniae R6
auuucccauugcaaucccaag

SEQ ID NO: 2177032 - RNA, 17 nt, Streptococcus pneumoniae R6
auuuccauuggacaggg

SEQ ID NO: 2177033 - RNA, 15 nt, Streptococcus pneumoniae R6
auuuccauuggagua

SEQ ID NO: 2177034 - RNA, 17 nt, Streptococcus pneumoniae R6
auuuccaccugcagcaa

SEQ ID NO: 2177035 - RNA, 14 nt, Streptococcus pneumoniae R6
auuuccauaccaaa

SEQ ID NO: 2177036 - RNA, 14 nt, Streptococcus pneumoniae R6
auuucgacugaaaa

SEQ ID NO: 2177037 - RNA, 16 nt, Streptococcus pneumoniae R6
auuucgauugucauca

SEQ ID NO: 2177038 - RNA, 17 nt, Streptococcus pneumoniae R6
auuucgauugucaucau

SEQ ID NO: 2177039 - RNA, 20 nt, Streptococcus pneumoniae R6
auuuccuucgcacuuauuuu

SEQ ID NO: 2177040 - RNA, 15 nt, Streptococcus pneumoniae R6
auuuccuagccaaua

SEQ ID NO: 2177041 - RNA, 15 nt, Streptococcus pneumoniae R6
auuuaccaaggaagc

SEQ ID NO: 2177042 - RNA, 19 nt, Streptococcus pneumoniae R6
auuuacagaaagaacaaaa

SEQ ID NO: 2177043 - RNA, 16 nt, Streptococcus pneumoniae R6
auuuaccauaguucca

SEQ ID NO: 2177044 - RNA, 22 nt, Streptococcus pneumoniae R6
auuuaccauuuucguccaaguc

SEQ ID NO: 2177045 - RNA, 19 nt, Streptococcus pneumoniae R6
auuuacgaaucucuuucca

SEQ ID NO: 2177046 - RNA, 23 nt, Streptococcus pneumoniae R6
auuuacgaaucucuuuccacacu

SEQ ID NO: 2177047 - RNA, 23 nt, Streptococcus pneumoniae R6
auuuacucuccuccauaaaaaga

SEQ ID NO: 2177048 - RNA, 21 nt, Streptococcus pneumoniae R6
auuuacugaacggugaacuuc

SEQ ID NO: 2177049 - RNA, 15 nt, Streptococcus pneumoniae R6
auuuacguccuugga

SEQ ID NO: 2177050 - RNA, 22 nt, Streptococcus pneumoniae R6
auuuacuauuauagagaggguc

SEQ ID NO: 2177051 - RNA, 14 nt, Streptococcus pneumoniae R6
auuuacuaauuaau

SEQ ID NO: 2177052 - RNA, 22 nt, Streptococcus pneumoniae R6
auuuaggcuaagagagaagccu

SEQ ID NO: 2177053 - RNA, 18 nt, Streptococcus pneumoniae R6
auuuaggacuaaauacaa

SEQ ID NO: 2177054 - RNA, 20 nt, Streptococcus pneumoniae R6
auuuagaaagguaaaauaua

SEQ ID NO: 2177055 - RNA, 16 nt, Streptococcus pneumoniae R6
auuuacuucauguuuu

SEQ ID NO: 2177056 - RNA, 21 nt, Streptococcus pneumoniae R6
auuuacuuaaaauuguuucau

SEQ ID NO: 2177057 - RNA, 17 nt, Streptococcus pneumoniae R6
auuuacuucauuuuugc

SEQ ID NO: 2177058 - RNA, 15 nt, Streptococcus pneumoniae R6
auuuaucaguauauu

SEQ ID NO: 2177059 - RNA, 23 nt, Streptococcus pneumoniae R6
auuuaucaguauauugaaaugaa

SEQ ID NO: 2177060 - RNA, 21 nt, Streptococcus pneumoniae R6
auuuaucauccagauuuuucu

SEQ ID NO: 2177061 - RNA, 21 nt, Streptococcus pneumoniae R6
auuuaguaaaaacguuuuuca

SEQ ID NO: 2177062 - RNA, 19 nt, Streptococcus pneumoniae R6
auuuauauaaaaagaaaug

SEQ ID NO: 2177063 - RNA, 16 nt, Streptococcus pneumoniae R6
auuguuuuauuuuuau

SEQ ID NO: 2177064 - RNA, 11 nt, Streptococcus pneumoniae R6
auuguuuucaa

SEQ ID NO: 2177065 - RNA, 13 nt, Streptococcus pneumoniae R6
auuguuuuuaaag

SEQ ID NO: 2177066 - RNA, 11 nt, Streptococcus pneumoniae R6
auuuaaaaaga

SEQ ID NO: 2177067 - RNA, 19 nt, Streptococcus pneumoniae R6
auuuaaaacucauuaauaa

SEQ ID NO: 2177068 - RNA, 13 nt, Streptococcus pneumoniae R6
auuuaaaauacgc

SEQ ID NO: 2177069 - RNA, 21 nt, Streptococcus pneumoniae R6
auuuaaaauacgcaaaaucau

SEQ ID NO: 2177070 - RNA, 16 nt, Streptococcus pneumoniae R6
auuuaaaaaucuauuu

SEQ ID NO: 2177071 - RNA, 15 nt, Streptococcus pneumoniae R6
auuuaaaaagaaaua

SEQ ID NO: 2177072 - RNA, 19 nt, Streptococcus pneumoniae R6
auuuaaaaauagauuuuua

SEQ ID NO: 2177073 - RNA, 15 nt, Streptococcus pneumoniae R6
auuggcucaaucaau

SEQ ID NO: 2177074 - RNA, 14 nt, Streptococcus pneumoniae R6
auuggcuaaagagu

SEQ ID NO: 2177075 - RNA, 18 nt, Streptococcus pneumoniae R6
auugguauuaauaauuuu

SEQ ID NO: 2177076 - RNA, 16 nt, Streptococcus pneumoniae R6
auuggucgcuucaagu

SEQ ID NO: 2177077 - RNA, 17 nt, Streptococcus pneumoniae R6
auugguggcuuccaguu

SEQ ID NO: 2177078 - RNA, 18 nt, Streptococcus pneumoniae R6
auuggugucaaaaaggaa

SEQ ID NO: 2177079 - RNA, 16 nt, Streptococcus pneumoniae R6
auugguguuugguuga

SEQ ID NO: 2177080 - RNA, 16 nt, Streptococcus pneumoniae R6
auuuaagcaaaaaaag

SEQ ID NO: 2177081 - RNA, 17 nt, Streptococcus pneumoniae R6
auuuaacucuuuuuugg

SEQ ID NO: 2177082 - RNA, 13 nt, Streptococcus pneumoniae R6
auuuacaaauauu

SEQ ID NO: 2177083 - RNA, 20 nt, Streptococcus pneumoniae R6
auuuaaugcaguaaaucaua

SEQ ID NO: 2177084 - RNA, 16 nt, Streptococcus pneumoniae R6
auuuaagauaaguucc

SEQ ID NO: 2177085 - RNA, 23 nt, Streptococcus pneumoniae R6
auuucuaguuuugguuuuucuuc

SEQ ID NO: 2177086 - RNA, 14 nt, Streptococcus pneumoniae R6
auuucuauaaauca

SEQ ID NO: 2177087 - RNA, 16 nt, Streptococcus pneumoniae R6
auuucuauaaaucaau

SEQ ID NO: 2177088 - RNA, 18 nt, Streptococcus pneumoniae R6
auuucuauaaaucaauuu

SEQ ID NO: 2177089 - RNA, 17 nt, Streptococcus pneumoniae R6
auuucuauaaauucauu

SEQ ID NO: 2177090 - RNA, 15 nt, Streptococcus pneumoniae R6
auuucucuacaaaua

SEQ ID NO: 2177091 - RNA, 21 nt, Streptococcus pneumoniae R6
auuucucuacaaauaagaaac

SEQ ID NO: 2177092 - RNA, 17 nt, Streptococcus pneumoniae R6
auuucuaugauaaaacg

SEQ ID NO: 2177093 - RNA, 15 nt, Streptococcus pneumoniae R6
auuucucuauucuuu

SEQ ID NO: 2177094 - RNA, 15 nt, Streptococcus pneumoniae R6
auuucguaagaaauu

SEQ ID NO: 2177095 - RNA, 13 nt, Streptococcus pneumoniae R6
auuucuagaaauu

SEQ ID NO: 2177096 - RNA, 22 nt, Streptococcus pneumoniae R6
auuucguccuuucuuuuuugaa

SEQ ID NO: 2177097 - RNA, 15 nt, Streptococcus pneumoniae R6
auuucuguaaaaaua

SEQ ID NO: 2177098 - RNA, 15 nt, Streptococcus pneumoniae R6
auuucuguguuucau

SEQ ID NO: 2177099 - RNA, 21 nt, Streptococcus pneumoniae R6
auuucuguguuucauagauuu

SEQ ID NO: 2177100 - RNA, 16 nt, Streptococcus pneumoniae R6
auuucuggauuuccau

SEQ ID NO: 2177101 - RNA, 12 nt, Streptococcus pneumoniae R6
auuucuggauga

SEQ ID NO: 2177102 - RNA, 20 nt, Streptococcus pneumoniae R6
auuucuggaugauucuuuuc

SEQ ID NO: 2177103 - RNA, 22 nt, Streptococcus pneumoniae R6
auuucugccauauguccuucau

SEQ ID NO: 2177104 - RNA, 20 nt, Streptococcus pneumoniae R6
auuucugcauaagcuggucu

SEQ ID NO: 2177105 - RNA, 17 nt, Streptococcus pneumoniae R6
auuugaauagaaaguau

SEQ ID NO: 2177106 - RNA, 14 nt, Streptococcus pneumoniae R6
auuucuuuuuauga

SEQ ID NO: 2177107 - RNA, 17 nt, Streptococcus pneumoniae R6
auuucuugugcugacau

SEQ ID NO: 2177108 - RNA, 16 nt, Streptococcus pneumoniae R6
auuucuuguucaacca

SEQ ID NO: 2177109 - RNA, 16 nt, Streptococcus pneumoniae R6
auuucuuaguuacagc

SEQ ID NO: 2177110 - RNA, 14 nt, Streptococcus pneumoniae R6
auuucuuuagcaua

SEQ ID NO: 2177111 - RNA, 13 nt, Streptococcus pneumoniae R6
auuucuuuagucc

SEQ ID NO: 2177112 - RNA, 19 nt, Streptococcus pneumoniae R6
auuuuaaaauauuagcaaa

SEQ ID NO: 2177113 - RNA, 21 nt, Streptococcus pneumoniae R6
auuuggugccucauuaguaau

SEQ ID NO: 2177114 - RNA, 21 nt, Streptococcus pneumoniae R6
auuuggacuauucguuugaug

SEQ ID NO: 2177115 - RNA, 23 nt, Streptococcus pneumoniae R6
auuuggacuauucguuugaugua

SEQ ID NO: 2177116 - RNA, 23 nt, Streptococcus pneumoniae R6
auuuggaaaauaguuuuugcaau

SEQ ID NO: 2177117 - RNA, 17 nt, Streptococcus pneumoniae R6
auuuguagcaaauucac

SEQ ID NO: 2177118 - RNA, 14 nt, Streptococcus pneumoniae R6
auuugccagaaaaa

SEQ ID NO: 2177119 - RNA, 19 nt, Streptococcus pneumoniae R6
auuugcagacgaaauacaa

SEQ ID NO: 2177120 - RNA, 20 nt, Streptococcus pneumoniae R6
auuugcuuuucuuuuuuaua

SEQ ID NO: 2177121 - RNA, 16 nt, Streptococcus pneumoniae R6
auuugcuucaucauuu

SEQ ID NO: 2177122 - RNA, 14 nt, Streptococcus pneumoniae R6
auuugaccauuuca

SEQ ID NO: 2177123 - RNA, 16 nt, Streptococcus pneumoniae R6
auuugaccauuucaac

SEQ ID NO: 2177124 - RNA, 15 nt, Streptococcus pneumoniae R6
auuugacuuccaaaa

SEQ ID NO: 2177125 - RNA, 17 nt, Streptococcus pneumoniae R6
auuugacuuccaaaauu

SEQ ID NO: 2177126 - RNA, 18 nt, Streptococcus pneumoniae R6
auuugacuuccaaaauua

SEQ ID NO: 2177127 - RNA, 16 nt, Streptococcus pneumoniae R6
auuugagguuguagau

SEQ ID NO: 2177128 - RNA, 22 nt, Streptococcus pneumoniae R6
auuugaguaacggcuuccugug

SEQ ID NO: 2177129 - RNA, 18 nt, Streptococcus pneumoniae R6
auuugagagcauuuuucg

SEQ ID NO: 2177130 - RNA, 12 nt, Streptococcus pneumoniae R6
auuugacugucc

SEQ ID NO: 2177131 - RNA, 17 nt, Streptococcus pneumoniae R6
auuugacuuuucuaauc

SEQ ID NO: 2177132 - RNA, 20 nt, Streptococcus pneumoniae R6
auuugauuuuccuaaucaau

SEQ ID NO: 2177133 - RNA, 15 nt, Streptococcus pneumoniae R6
auuuuuacaguauuu

SEQ ID NO: 2177134 - RNA, 20 nt, Streptococcus pneumoniae R6
auuuuuacaguauuuauaaa

SEQ ID NO: 2177135 - RNA, 12 nt, Streptococcus pneumoniae R6
auuuuuaagaaa

SEQ ID NO: 2177136 - RNA, 13 nt, Streptococcus pneumoniae R6
auuuuguaaaaaa

SEQ ID NO: 2177137 - RNA, 13 nt, Streptococcus pneumoniae R6
auuuuguaaaaau

SEQ ID NO: 2177138 - RNA, 14 nt, Streptococcus pneumoniae R6
auuuuguaaaaaua

SEQ ID NO: 2177139 - RNA, 12 nt, Streptococcus pneumoniae R6
auuuucuuuacu

SEQ ID NO: 2177140 - RNA, 14 nt, Streptococcus pneumoniae R6
auuuucuuuaaaaa

SEQ ID NO: 2177141 - RNA, 16 nt, Streptococcus pneumoniae R6
auuuucuuuuugaagu

SEQ ID NO: 2177142 - RNA, 14 nt, Streptococcus pneumoniae R6
auuuucuuuuuccu

SEQ ID NO: 2177143 - RNA, 21 nt, Streptococcus pneumoniae R6
auuuugaaauguuccaagucc

SEQ ID NO: 2177144 - RNA, 21 nt, Streptococcus pneumoniae R6
auuuucuacuaaaauuauguu

SEQ ID NO: 2177145 - RNA, 12 nt, Streptococcus pneumoniae R6
auuuucucauca

SEQ ID NO: 2177146 - RNA, 13 nt, Streptococcus pneumoniae R6
auuuucucaucaa

SEQ ID NO: 2177147 - RNA, 19 nt, Streptococcus pneumoniae R6
auuuucuugauuuguucuc

SEQ ID NO: 2177148 - RNA, 19 nt, Streptococcus pneumoniae R6
auuuugacguucuucugca

SEQ ID NO: 2177149 - RNA, 14 nt, Streptococcus pneumoniae R6
auuuugcuguuuau

SEQ ID NO: 2177150 - RNA, 15 nt, Streptococcus pneumoniae R6
auuuuauuuaagcaa

SEQ ID NO: 2177151 - RNA, 19 nt, Streptococcus pneumoniae R6
auuuuauuuaagcaaaaaa

SEQ ID NO: 2177152 - RNA, 16 nt, Streptococcus pneumoniae R6
auuuucaaaaugacaa

SEQ ID NO: 2177153 - RNA, 15 nt, Streptococcus pneumoniae R6
auuuucaaaacuggu

SEQ ID NO: 2177154 - RNA, 18 nt, Streptococcus pneumoniae R6
auuuucaaaauaggaauc

SEQ ID NO: 2177155 - RNA, 15 nt, Streptococcus pneumoniae R6
auuuucaaaaagaag

SEQ ID NO: 2177156 - RNA, 18 nt, Streptococcus pneumoniae R6
auuuucaagaauugcagc

SEQ ID NO: 2177157 - RNA, 21 nt, Streptococcus pneumoniae R6
auuuucaaauuuucuuuacua

SEQ ID NO: 2177158 - RNA, 16 nt, Streptococcus pneumoniae R6
auuuucuaauugauuu

SEQ ID NO: 2177159 - RNA, 20 nt, Streptococcus pneumoniae R6
auuuucuacacuugauuuau

SEQ ID NO: 2177160 - RNA, 19 nt, Streptococcus pneumoniae R6
auuuuccgagacagagaca

SEQ ID NO: 2177161 - RNA, 19 nt, Streptococcus pneumoniae R6
auuuuauccaaucuauuua

SEQ ID NO: 2177162 - RNA, 14 nt, Streptococcus pneumoniae R6
auuuuauagucuaa

SEQ ID NO: 2177163 - RNA, 12 nt, Streptococcus pneumoniae R6
auuuuauauaaa

SEQ ID NO: 2177164 - RNA, 12 nt, Streptococcus pneumoniae R6
auuuuaggaaac

SEQ ID NO: 2177165 - RNA, 18 nt, Streptococcus pneumoniae R6
auuuuaccuuucaaaccg

SEQ ID NO: 2177166 - RNA, 15 nt, Streptococcus pneumoniae R6
auuuuagauuuuuua

SEQ ID NO: 2177167 - RNA, 17 nt, Streptococcus pneumoniae R6
auuuuaauuucaaugua

SEQ ID NO: 2177168 - RNA, 14 nt, Streptococcus pneumoniae R6
caacuaggguuuua

SEQ ID NO: 2177169 - RNA, 18 nt, Streptococcus pneumoniae R6
caacuauagccaucucua

SEQ ID NO: 2177170 - RNA, 14 nt, Streptococcus pneumoniae R6
caacuaucugaaua

SEQ ID NO: 2177171 - RNA, 16 nt, Streptococcus pneumoniae R6
caacguuaaagaguug

SEQ ID NO: 2177172 - RNA, 14 nt, Streptococcus pneumoniae R6
caacuccuccuuca

SEQ ID NO: 2177173 - RNA, 18 nt, Streptococcus pneumoniae R6
caacuccuuacuuuuuau

SEQ ID NO: 2177174 - RNA, 17 nt, Streptococcus pneumoniae R6
caacuccuugaaucauc

SEQ ID NO: 2177175 - RNA, 19 nt, Streptococcus pneumoniae R6
caacucagcauuuucuuuu

SEQ ID NO: 2177176 - RNA, 14 nt, Streptococcus pneumoniae R6
caacucaggaaaga

SEQ ID NO: 2177177 - RNA, 13 nt, Streptococcus pneumoniae R6
caaccuuucucag

SEQ ID NO: 2177178 - RNA, 20 nt, Streptococcus pneumoniae R6
caaccuuucucagauaauaa

SEQ ID NO: 2177179 - RNA, 19 nt, Streptococcus pneumoniae R6
caaccuuaccacuagugaa

SEQ ID NO: 2177180 - RNA, 12 nt, Streptococcus pneumoniae R6
caaccuuaaaac

SEQ ID NO: 2177181 - RNA, 14 nt, Streptococcus pneumoniae R6
caaccuuaaaacag

SEQ ID NO: 2177182 - RNA, 17 nt, Streptococcus pneumoniae R6
caaccugcacauugguu

SEQ ID NO: 2177183 - RNA, 13 nt, Streptococcus pneumoniae R6
caacgaaaauaau

SEQ ID NO: 2177184 - RNA, 16 nt, Streptococcus pneumoniae R6
caacgaacuauaaaau

SEQ ID NO: 2177185 - RNA, 17 nt, Streptococcus pneumoniae R6
caagacguucaaagaua

SEQ ID NO: 2177186 - RNA, 22 nt, Streptococcus pneumoniae R6
caagacuugguuuggcauugag

SEQ ID NO: 2177187 - RNA, 21 nt, Streptococcus pneumoniae R6
caagacuuucaaaccauugcu

SEQ ID NO: 2177188 - RNA, 16 nt, Streptococcus pneumoniae R6
caagacgaaccaaugu

SEQ ID NO: 2177189 - RNA, 14 nt, Streptococcus pneumoniae R6
caagagcaaaaaca

SEQ ID NO: 2177190 - RNA, 22 nt, Streptococcus pneumoniae R6
caagagacgauuccaaacaaca

SEQ ID NO: 2177191 - RNA, 23 nt, Streptococcus pneumoniae R6
caagagacgauuccaaacaacaa

SEQ ID NO: 2177192 - RNA, 13 nt, Streptococcus pneumoniae R6
caagagacucuuu

SEQ ID NO: 2177193 - RNA, 20 nt, Streptococcus pneumoniae R6
caagagccuuuuuaaagaua

SEQ ID NO: 2177194 - RNA, 21 nt, Streptococcus pneumoniae R6
caagagccuuuuuaaagauau

SEQ ID NO: 2177195 - RNA, 15 nt, Streptococcus pneumoniae R6
caagaccauuuccau

SEQ ID NO: 2177196 - RNA, 22 nt, Streptococcus pneumoniae R6
caagaccgagaaacaagaacuc

SEQ ID NO: 2177197 - RNA, 15 nt, Streptococcus pneumoniae R6
caagaccgagaguuc

SEQ ID NO: 2177198 - RNA, 17 nt, Streptococcus pneumoniae R6
caagacauagucaagcu

SEQ ID NO: 2177199 - RNA, 23 nt, Streptococcus pneumoniae R6
caagaaugggcucccacuuucaa

SEQ ID NO: 2177200 - RNA, 15 nt, Streptococcus pneumoniae R6
caagaguugauagag

SEQ ID NO: 2177201 - RNA, 14 nt, Streptococcus pneumoniae R6
caagauaagaaaaa

SEQ ID NO: 2177202 - RNA, 19 nt, Streptococcus pneumoniae R6
caagauaaggaauuuuaga

SEQ ID NO: 2177203 - RNA, 19 nt, Streptococcus pneumoniae R6
caagagcgguuaauuuaaa

SEQ ID NO: 2177204 - RNA, 15 nt, Streptococcus pneumoniae R6
caagagcugauagag

SEQ ID NO: 2177205 - RNA, 17 nt, Streptococcus pneumoniae R6
caagagcugauagagau

SEQ ID NO: 2177206 - RNA, 21 nt, Streptococcus pneumoniae R6
caagagcugauagugguguuu

SEQ ID NO: 2177207 - RNA, 18 nt, Streptococcus pneumoniae R6
caagauggacuguuauag

SEQ ID NO: 2177208 - RNA, 22 nt, Streptococcus pneumoniae R6
caagaugauuccugucauggcu

SEQ ID NO: 2177209 - RNA, 16 nt, Streptococcus pneumoniae R6
caagaucuugucugca

SEQ ID NO: 2177210 - RNA, 18 nt, Streptococcus pneumoniae R6
caagaucuugucugcaug

SEQ ID NO: 2177211 - RNA, 24 nt, Streptococcus pneumoniae R6
caagaucuuuuuauacucaaugaa

SEQ ID NO: 2177212 - RNA, 14 nt, Streptococcus pneumoniae R6
caagauauucuuga

SEQ ID NO: 2177213 - RNA, 15 nt, Streptococcus pneumoniae R6
caagauaguaaagag

SEQ ID NO: 2177214 - RNA, 12 nt, Streptococcus pneumoniae R6
caagauaggaga

SEQ ID NO: 2177215 - RNA, 13 nt, Streptococcus pneumoniae R6
caacuuuuccuug

SEQ ID NO: 2177216 - RNA, 20 nt, Streptococcus pneumoniae R6
caacuuuuccaauagauaau

SEQ ID NO: 2177217 - RNA, 17 nt, Streptococcus pneumoniae R6
caacuugaaucugauga

SEQ ID NO: 2177218 - RNA, 15 nt, Streptococcus pneumoniae R6
caacuuguaaacauc

SEQ ID NO: 2177219 - RNA, 13 nt, Streptococcus pneumoniae R6
caacuucuuuuug

SEQ ID NO: 2177220 - RNA, 16 nt, Streptococcus pneumoniae R6
caacuucuuuuugauu

SEQ ID NO: 2177221 - RNA, 22 nt, Streptococcus pneumoniae R6
caacuugaagcaaaucaacugg

SEQ ID NO: 2177222 - RNA, 22 nt, Streptococcus pneumoniae R6
caagaaaagugcaaauaagaaa

SEQ ID NO: 2177223 - RNA, 16 nt, Streptococcus pneumoniae R6
caagaaagagaauaac

SEQ ID NO: 2177224 - RNA, 17 nt, Streptococcus pneumoniae R6
caagaaagagaauaaca

SEQ ID NO: 2177225 - RNA, 18 nt, Streptococcus pneumoniae R6
caagaacaagacaaaaga

SEQ ID NO: 2177226 - RNA, 16 nt, Streptococcus pneumoniae R6
caagaacucuucuggu

SEQ ID NO: 2177227 - RNA, 22 nt, Streptococcus pneumoniae R6
caagaagaucagaguagucuuu

SEQ ID NO: 2177228 - RNA, 13 nt, Streptococcus pneumoniae R6
caagaaguccaua

SEQ ID NO: 2177229 - RNA, 22 nt, Streptococcus pneumoniae R6
caagaaguccauaaugucuucu

SEQ ID NO: 2177230 - RNA, 17 nt, Streptococcus pneumoniae R6
caaucacucuaacuucu

SEQ ID NO: 2177231 - RNA, 13 nt, Streptococcus pneumoniae R6
caauauggguaua

SEQ ID NO: 2177232 - RNA, 15 nt, Streptococcus pneumoniae R6
caaucaauccaaaga

SEQ ID NO: 2177233 - RNA, 14 nt, Streptococcus pneumoniae R6
caauagcaagguuc

SEQ ID NO: 2177234 - RNA, 13 nt, Streptococcus pneumoniae R6
caauagcaacuac

SEQ ID NO: 2177235 - RNA, 15 nt, Streptococcus pneumoniae R6
caauagcaacuacug

SEQ ID NO: 2177236 - RNA, 22 nt, Streptococcus pneumoniae R6
caauaucuuuauugaugaaguc

SEQ ID NO: 2177237 - RNA, 12 nt, Streptococcus pneumoniae R6
caauauagucua

SEQ ID NO: 2177238 - RNA, 19 nt, Streptococcus pneumoniae R6
caauauauccaaaaccauu

SEQ ID NO: 2177239 - RNA, 17 nt, Streptococcus pneumoniae R6
caauagcauauuuuuag

SEQ ID NO: 2177240 - RNA, 18 nt, Streptococcus pneumoniae R6
caauauagaaguaguuua

SEQ ID NO: 2177241 - RNA, 22 nt, Streptococcus pneumoniae R6
caauagcauugucacaaaggau

SEQ ID NO: 2177242 - RNA, 20 nt, Streptococcus pneumoniae R6
caauacccccuuaaaaccau

SEQ ID NO: 2177243 - RNA, 13 nt, Streptococcus pneumoniae R6
caauaauucaccu

SEQ ID NO: 2177244 - RNA, 20 nt, Streptococcus pneumoniae R6
caauaauguuaaccacaaaa

SEQ ID NO: 2177245 - RNA, 20 nt, Streptococcus pneumoniae R6
caauacagcuuuuuucuuug

SEQ ID NO: 2177246 - RNA, 17 nt, Streptococcus pneumoniae R6
caauacaggaaaaccag

SEQ ID NO: 2177247 - RNA, 17 nt, Streptococcus pneumoniae R6
caauacaguagaugauu

SEQ ID NO: 2177248 - RNA, 19 nt, Streptococcus pneumoniae R6
caauaauccuaacuuaaaa

SEQ ID NO: 2177249 - RNA, 21 nt, Streptococcus pneumoniae R6
caauaagcccgaaaaauuucu

SEQ ID NO: 2177250 - RNA, 17 nt, Streptococcus pneumoniae R6
caauaagcgauugagaa

SEQ ID NO: 2177251 - RNA, 19 nt, Streptococcus pneumoniae R6
caauaaccaucauuuuuag

SEQ ID NO: 2177252 - RNA, 13 nt, Streptococcus pneumoniae R6
caaguuguuugac

SEQ ID NO: 2177253 - RNA, 14 nt, Streptococcus pneumoniae R6
caaguugugcagug

SEQ ID NO: 2177254 - RNA, 16 nt, Streptococcus pneumoniae R6
caaguugcuugaaaac

SEQ ID NO: 2177255 - RNA, 15 nt, Streptococcus pneumoniae R6
caaguuaugcauuuu

SEQ ID NO: 2177256 - RNA, 15 nt, Streptococcus pneumoniae R6
caaguuccucuuuca

SEQ ID NO: 2177257 - RNA, 13 nt, Streptococcus pneumoniae R6
caaguucuucucu

SEQ ID NO: 2177258 - RNA, 22 nt, Streptococcus pneumoniae R6
caaguucuuuucauaaagagaa

SEQ ID NO: 2177259 - RNA, 13 nt, Streptococcus pneumoniae R6
caaguucuuuucu

SEQ ID NO: 2177260 - RNA, 14 nt, Streptococcus pneumoniae R6
caaguucuuuucug

SEQ ID NO: 2177261 - RNA, 18 nt, Streptococcus pneumoniae R6
caaguucuuccacucaaa

SEQ ID NO: 2177262 - RNA, 19 nt, Streptococcus pneumoniae R6
caaguucuuccacucaaau

SEQ ID NO: 2177263 - RNA, 23 nt, Streptococcus pneumoniae R6
caaguucugucuugcugucucca

SEQ ID NO: 2177264 - RNA, 19 nt, Streptococcus pneumoniae R6
caagugccaagaagguuuc

SEQ ID NO: 2177265 - RNA, 18 nt, Streptococcus pneumoniae R6
caagucuucugaauagcu

SEQ ID NO: 2177266 - RNA, 16 nt, Streptococcus pneumoniae R6
caagucuugcucuuca

SEQ ID NO: 2177267 - RNA, 18 nt, Streptococcus pneumoniae R6
caagucuugugaauagcu

SEQ ID NO: 2177268 - RNA, 23 nt, Streptococcus pneumoniae R6
caagucuuccgaauagcucaaaa

SEQ ID NO: 2177269 - RNA, 18 nt, Streptococcus pneumoniae R6
caagucguaagucuucgu

SEQ ID NO: 2177270 - RNA, 14 nt, Streptococcus pneumoniae R6
caagucuagacuga

SEQ ID NO: 2177271 - RNA, 18 nt, Streptococcus pneumoniae R6
caaguguuuucacuuccu

SEQ ID NO: 2177272 - RNA, 22 nt, Streptococcus pneumoniae R6
caaguuaaauaauagaaauuuu

SEQ ID NO: 2177273 - RNA, 15 nt, Streptococcus pneumoniae R6
caagugguucuccaa

SEQ ID NO: 2177274 - RNA, 17 nt, Streptococcus pneumoniae R6
caaguaaguagcaucuu

SEQ ID NO: 2177275 - RNA, 17 nt, Streptococcus pneumoniae R6
caagguuuccaaaccaa

SEQ ID NO: 2177276 - RNA, 16 nt, Streptococcus pneumoniae R6
caagguuuccugcaug

SEQ ID NO: 2177277 - RNA, 23 nt, Streptococcus pneumoniae R6
caaguacgauugguucugcucca

SEQ ID NO: 2177278 - RNA, 15 nt, Streptococcus pneumoniae R6
caaguaaucugcacc

SEQ ID NO: 2177279 - RNA, 14 nt, Streptococcus pneumoniae R6
caagcaacaaaaac

SEQ ID NO: 2177280 - RNA, 17 nt, Streptococcus pneumoniae R6
caagcgcuauuaaaauu

SEQ ID NO: 2177281 - RNA, 23 nt, Streptococcus pneumoniae R6
caagcgcuauuaaaauucguuuc

SEQ ID NO: 2177282 - RNA, 15 nt, Streptococcus pneumoniae R6
caagcgcccaagcua

SEQ ID NO: 2177283 - RNA, 19 nt, Streptococcus pneumoniae R6
caagcugucaagaaauuac

SEQ ID NO: 2177284 - RNA, 17 nt, Streptococcus pneumoniae R6
caagcugugaguucauu

SEQ ID NO: 2177285 - RNA, 14 nt, Streptococcus pneumoniae R6
caagcucugaaugg

SEQ ID NO: 2177286 - RNA, 18 nt, Streptococcus pneumoniae R6
caagcucgauauucuuuu

SEQ ID NO: 2177287 - RNA, 14 nt, Streptococcus pneumoniae R6
caaggauugguaaa

SEQ ID NO: 2177288 - RNA, 21 nt, Streptococcus pneumoniae R6
caaggcaguacuuugagcaac

SEQ ID NO: 2177289 - RNA, 11 nt, Streptococcus pneumoniae R6
caacaguaacg

SEQ ID NO: 2177290 - RNA, 22 nt, Streptococcus pneumoniae R6
caacaacagcugucgcaccuga

SEQ ID NO: 2177291 - RNA, 23 nt, Streptococcus pneumoniae R6
caaauggauagaucuuuacuuga

SEQ ID NO: 2177292 - RNA, 15 nt, Streptococcus pneumoniae R6
caaauggcaugagga

SEQ ID NO: 2177293 - RNA, 16 nt, Streptococcus pneumoniae R6
caaauccgacuucaau

SEQ ID NO: 2177294 - RNA, 23 nt, Streptococcus pneumoniae R6
caaauccuauucggacuuuggcu

SEQ ID NO: 2177295 - RNA, 16 nt, Streptococcus pneumoniae R6
caaauccuugaagauu

SEQ ID NO: 2177296 - RNA, 23 nt, Streptococcus pneumoniae R6
caaauuuucaguuuuauuuuuga

SEQ ID NO: 2177297 - RNA, 22 nt, Streptococcus pneumoniae R6
caaauuuucuuuacuauaguag

SEQ ID NO: 2177298 - RNA, 12 nt, Streptococcus pneumoniae R6
caaauucaccaa

SEQ ID NO: 2177299 - RNA, 23 nt, Streptococcus pneumoniae R6
caaauucaccaacuacaguugca

SEQ ID NO: 2177300 - RNA, 18 nt, Streptococcus pneumoniae R6
caaauucaccaauuuuac

SEQ ID NO: 2177301 - RNA, 16 nt, Streptococcus pneumoniae R6
caacaaaguaaccauc

SEQ ID NO: 2177302 - RNA, 18 nt, Streptococcus pneumoniae R6
caacaaaucagaaaagua

SEQ ID NO: 2177303 - RNA, 19 nt, Streptococcus pneumoniae R6
caacaaaaucgggagauug

SEQ ID NO: 2177304 - RNA, 15 nt, Streptococcus pneumoniae R6
caaauaccauaaacu

SEQ ID NO: 2177305 - RNA, 17 nt, Streptococcus pneumoniae R6
caaauaccauaaacuaa

SEQ ID NO: 2177306 - RNA, 19 nt, Streptococcus pneumoniae R6
caaauaccauauccuuuca

SEQ ID NO: 2177307 - RNA, 13 nt, Streptococcus pneumoniae R6
caaauaaaucauu

SEQ ID NO: 2177308 - RNA, 22 nt, Streptococcus pneumoniae R6
caaaggagaggagaauuuuuga

SEQ ID NO: 2177309 - RNA, 24 nt, Streptococcus pneumoniae R6
caaaggauuguagguguaaacuuu

SEQ ID NO: 2177310 - RNA, 16 nt, Streptococcus pneumoniae R6
caaaggauuuaguucu

SEQ ID NO: 2177311 - RNA, 17 nt, Streptococcus pneumoniae R6
caaaggauuuaguucug

SEQ ID NO: 2177312 - RNA, 23 nt, Streptococcus pneumoniae R6
caaaggauuucugcuuuuuauac

SEQ ID NO: 2177313 - RNA, 22 nt, Streptococcus pneumoniae R6
caaaggacuaugaucagcauuu

SEQ ID NO: 2177314 - RNA, 18 nt, Streptococcus pneumoniae R6
caaaggaaccaaaugauu

SEQ ID NO: 2177315 - RNA, 14 nt, Streptococcus pneumoniae R6
caaaggaagcugag

SEQ ID NO: 2177316 - RNA, 19 nt, Streptococcus pneumoniae R6
caaaggcuuuuucuucuuc

SEQ ID NO: 2177317 - RNA, 19 nt, Streptococcus pneumoniae R6
caaagggagguaaagauag

SEQ ID NO: 2177318 - RNA, 19 nt, Streptococcus pneumoniae R6
caaaggcaucaucugaaau

SEQ ID NO: 2177319 - RNA, 19 nt, Streptococcus pneumoniae R6
caaaggcauugugcuugau

SEQ ID NO: 2177320 - RNA, 12 nt, Streptococcus pneumoniae R6
caaauacuugua

SEQ ID NO: 2177321 - RNA, 23 nt, Streptococcus pneumoniae R6
caaauacucggaggacaucacug

SEQ ID NO: 2177322 - RNA, 13 nt, Streptococcus pneumoniae R6
caaauauuguaaa

SEQ ID NO: 2177323 - RNA, 11 nt, Streptococcus pneumoniae R6
caaaucaaauu

SEQ ID NO: 2177324 - RNA, 12 nt, Streptococcus pneumoniae R6
caaauccauagu

SEQ ID NO: 2177325 - RNA, 16 nt, Streptococcus pneumoniae R6
caaauccaaucuucua

SEQ ID NO: 2177326 - RNA, 13 nt, Streptococcus pneumoniae R6
caaaucauuuuga

SEQ ID NO: 2177327 - RNA, 19 nt, Streptococcus pneumoniae R6
caaaucauugaguuggcuu

SEQ ID NO: 2177328 - RNA, 14 nt, Streptococcus pneumoniae R6
caaaucccuagcuc

SEQ ID NO: 2177329 - RNA, 23 nt, Streptococcus pneumoniae R6
caaauccccaucuuuagcuccac

SEQ ID NO: 2177330 - RNA, 14 nt, Streptococcus pneumoniae R6
caaaucccaugaca

SEQ ID NO: 2177331 - RNA, 16 nt, Streptococcus pneumoniae R6
caaagaccaugaggaa

SEQ ID NO: 2177332 - RNA, 17 nt, Streptococcus pneumoniae R6
caaagaccaugaggaaa

SEQ ID NO: 2177333 - RNA, 18 nt, Streptococcus pneumoniae R6
caaagagucccuuagaaa

SEQ ID NO: 2177334 - RNA, 21 nt, Streptococcus pneumoniae R6
caaagagucccuuagaaaaac

SEQ ID NO: 2177335 - RNA, 17 nt, Streptococcus pneumoniae R6
caaagagccgaaaaaau

SEQ ID NO: 2177336 - RNA, 21 nt, Streptococcus pneumoniae R6
caaagagccggaaaauucucu

SEQ ID NO: 2177337 - RNA, 13 nt, Streptococcus pneumoniae R6
caaagagccuaua

SEQ ID NO: 2177338 - RNA, 14 nt, Streptococcus pneumoniae R6
caaagacugggugu

SEQ ID NO: 2177339 - RNA, 18 nt, Streptococcus pneumoniae R6
caaagacuggguguuugc

SEQ ID NO: 2177340 - RNA, 14 nt, Streptococcus pneumoniae R6
caaagacuuauacu

SEQ ID NO: 2177341 - RNA, 14 nt, Streptococcus pneumoniae R6
caaagagccaaaaa

SEQ ID NO: 2177342 - RNA, 17 nt, Streptococcus pneumoniae R6
caaagagccaaaaaaga

SEQ ID NO: 2177343 - RNA, 19 nt, Streptococcus pneumoniae R6
caaagagccaaaaaagaaa

SEQ ID NO: 2177344 - RNA, 20 nt, Streptococcus pneumoniae R6
caaagagccagaaaaauccc

SEQ ID NO: 2177345 - RNA, 17 nt, Streptococcus pneumoniae R6
caaagagccauaaaaau

SEQ ID NO: 2177346 - RNA, 18 nt, Streptococcus pneumoniae R6
caaagagccauaaaaaua

SEQ ID NO: 2177347 - RNA, 14 nt, Streptococcus pneumoniae R6
caaacuugaaauga

SEQ ID NO: 2177348 - RNA, 16 nt, Streptococcus pneumoniae R6
caaacuucuaaggaaa

SEQ ID NO: 2177349 - RNA, 16 nt, Streptococcus pneumoniae R6
caaacuggagcauuuc

SEQ ID NO: 2177350 - RNA, 14 nt, Streptococcus pneumoniae R6
caaacuguccacaa

SEQ ID NO: 2177351 - RNA, 15 nt, Streptococcus pneumoniae R6
caaagaugagaggag

SEQ ID NO: 2177352 - RNA, 14 nt, Streptococcus pneumoniae R6
caaagauguucuca

SEQ ID NO: 2177353 - RNA, 17 nt, Streptococcus pneumoniae R6
caaagauuaaucuucaa

SEQ ID NO: 2177354 - RNA, 12 nt, Streptococcus pneumoniae R6
caaagcgauaaa

SEQ ID NO: 2177355 - RNA, 15 nt, Streptococcus pneumoniae R6
caaagcgauaaaaau

SEQ ID NO: 2177356 - RNA, 16 nt, Streptococcus pneumoniae R6
caaagcgauaaaaauc

SEQ ID NO: 2177357 - RNA, 15 nt, Streptococcus pneumoniae R6
caaagauauugagac

SEQ ID NO: 2177358 - RNA, 22 nt, Streptococcus pneumoniae R6
caaagauaaggccugauaagau

SEQ ID NO: 2177359 - RNA, 14 nt, Streptococcus pneumoniae R6
caaagcuaaauccu

SEQ ID NO: 2177360 - RNA, 20 nt, Streptococcus pneumoniae R6
caaagcgggauuuaaaauaa

SEQ ID NO: 2177361 - RNA, 14 nt, Streptococcus pneumoniae R6
caaagcucuucagc

SEQ ID NO: 2177362 - RNA, 21 nt, Streptococcus pneumoniae R6
caaacauaacgggaaucccaa

SEQ ID NO: 2177363 - RNA, 19 nt, Streptococcus pneumoniae R6
caaacauaacaggaauuuc

SEQ ID NO: 2177364 - RNA, 21 nt, Streptococcus pneumoniae R6
caaaccagcaccagacauuuc

SEQ ID NO: 2177365 - RNA, 12 nt, Streptococcus pneumoniae R6
caaaccaagaau

SEQ ID NO: 2177366 - RNA, 18 nt, Streptococcus pneumoniae R6
caaaccaacauagauaaa

SEQ ID NO: 2177367 - RNA, 17 nt, Streptococcus pneumoniae R6
caaacaucgugguacaa

SEQ ID NO: 2177368 - RNA, 18 nt, Streptococcus pneumoniae R6
caaacgggugguuuaucc

SEQ ID NO: 2177369 - RNA, 22 nt, Streptococcus pneumoniae R6
caaacuagcaagugcuaagaua

SEQ ID NO: 2177370 - RNA, 16 nt, Streptococcus pneumoniae R6
caaacuaggaagcuag

SEQ ID NO: 2177371 - RNA, 22 nt, Streptococcus pneumoniae R6
caaacuaggaggcuagccgcac

SEQ ID NO: 2177372 - RNA, 16 nt, Streptococcus pneumoniae R6
caaacuaggauuuucu

SEQ ID NO: 2177373 - RNA, 17 nt, Streptococcus pneumoniae R6
caaacucaguuaaaauc

SEQ ID NO: 2177374 - RNA, 15 nt, Streptococcus pneumoniae R6
caaacucucauuaaa

SEQ ID NO: 2177375 - RNA, 16 nt, Streptococcus pneumoniae R6
caaacucgaucugaau

SEQ ID NO: 2177376 - RNA, 18 nt, Streptococcus pneumoniae R6
caaacucgaucugaaugu

SEQ ID NO: 2177377 - RNA, 18 nt, Streptococcus pneumoniae R6
caaacucuucacacaaga

SEQ ID NO: 2177378 - RNA, 21 nt, Streptococcus pneumoniae R6
caaacgaacgccuuaaaaaac

SEQ ID NO: 2177379 - RNA, 14 nt, Streptococcus pneumoniae R6
caaaccguccucuu

SEQ ID NO: 2177380 - RNA, 14 nt, Streptococcus pneumoniae R6
caaacgcgauacaa

SEQ ID NO: 2177381 - RNA, 21 nt, Streptococcus pneumoniae R6
caaacgauuuuuuucaaacaa

SEQ ID NO: 2177382 - RNA, 22 nt, Streptococcus pneumoniae R6
caaacgauuuuuuucaaacaau

SEQ ID NO: 2177383 - RNA, 14 nt, Streptococcus pneumoniae R6
caaacgauuaucua

SEQ ID NO: 2177384 - RNA, 15 nt, Streptococcus pneumoniae R6
caaacgauuaucuaa

SEQ ID NO: 2177385 - RNA, 22 nt, Streptococcus pneumoniae R6
auuuuuaugauucgcuauucuu

SEQ ID NO: 2177386 - RNA, 18 nt, Streptococcus pneumoniae R6
auuuuuauugaguauuag

SEQ ID NO: 2177387 - RNA, 13 nt, Streptococcus pneumoniae R6
auuuuucaaauaa

SEQ ID NO: 2177388 - RNA, 14 nt, Streptococcus pneumoniae R6
auuuuucaaauaac

SEQ ID NO: 2177389 - RNA, 17 nt, Streptococcus pneumoniae R6
caaaaguuagaaauaaa

SEQ ID NO: 2177390 - RNA, 21 nt, Streptococcus pneumoniae R6
caaaaguuagaaauaaaacuc

SEQ ID NO: 2177391 - RNA, 20 nt, Streptococcus pneumoniae R6
caaaaguuagacagaaaaaa

SEQ ID NO: 2177392 - RNA, 22 nt, Streptococcus pneumoniae R6
caaaaguuagacagaaaaaauc

SEQ ID NO: 2177393 - RNA, 15 nt, Streptococcus pneumoniae R6
caaaaguuagauuuu

SEQ ID NO: 2177394 - RNA, 21 nt, Streptococcus pneumoniae R6
caaaaguuuaucuagaauuuc

SEQ ID NO: 2177395 - RNA, 21 nt, Streptococcus pneumoniae R6
caaaauaaaaacaucuaccua

SEQ ID NO: 2177396 - RNA, 21 nt, Streptococcus pneumoniae R6
caaaagucgaguucauguuuc

SEQ ID NO: 2177397 - RNA, 16 nt, Streptococcus pneumoniae R6
caaaagguucuuuuau

SEQ ID NO: 2177398 - RNA, 18 nt, Streptococcus pneumoniae R6
caaaauagugugaccugc

SEQ ID NO: 2177399 - RNA, 13 nt, Streptococcus pneumoniae R6
caaaauaugcucc

SEQ ID NO: 2177400 - RNA, 16 nt, Streptococcus pneumoniae R6
caaaauaggaaucaac

SEQ ID NO: 2177401 - RNA, 17 nt, Streptococcus pneumoniae R6
caaaauaggaaucaacc

SEQ ID NO: 2177402 - RNA, 24 nt, Streptococcus pneumoniae R6
caaaauucuuccuacugauaucuu

SEQ ID NO: 2177403 - RNA, 21 nt, Streptococcus pneumoniae R6
caaaauucugucuuagacuuu

SEQ ID NO: 2177404 - RNA, 19 nt, Streptococcus pneumoniae R6
caaacaaaaaaccccagca

SEQ ID NO: 2177405 - RNA, 18 nt, Streptococcus pneumoniae R6
caaaauguucaguuucua

SEQ ID NO: 2177406 - RNA, 14 nt, Streptococcus pneumoniae R6
caaaauuaaaaugu

SEQ ID NO: 2177407 - RNA, 16 nt, Streptococcus pneumoniae R6
caaaauuaaaauguuc

SEQ ID NO: 2177408 - RNA, 19 nt, Streptococcus pneumoniae R6
caaaauccguuuuuuaaaa

SEQ ID NO: 2177409 - RNA, 18 nt, Streptococcus pneumoniae R6
caaaaucccucuuuuuac

SEQ ID NO: 2177410 - RNA, 13 nt, Streptococcus pneumoniae R6
caaaauccuuugu

SEQ ID NO: 2177411 - RNA, 16 nt, Streptococcus pneumoniae R6
caaaauccuuuguuua

SEQ ID NO: 2177412 - RNA, 22 nt, Streptococcus pneumoniae R6
caaaaucgaaacuccauaaaau

SEQ ID NO: 2177413 - RNA, 15 nt, Streptococcus pneumoniae R6
cauccaucccauuua

SEQ ID NO: 2177414 - RNA, 13 nt, Streptococcus pneumoniae R6
cauccagcaggag

SEQ ID NO: 2177415 - RNA, 18 nt, Streptococcus pneumoniae R6
cauccacaaccucaaaac

SEQ ID NO: 2177416 - RNA, 21 nt, Streptococcus pneumoniae R6
cauccaaucacgugugaaaac

SEQ ID NO: 2177417 - RNA, 21 nt, Streptococcus pneumoniae R6
cauccaaagguucaaucauuu

SEQ ID NO: 2177418 - RNA, 18 nt, Streptococcus pneumoniae R6
caucccauuuauauaaaa

SEQ ID NO: 2177419 - RNA, 15 nt, Streptococcus pneumoniae R6
caucccuugucuuug

SEQ ID NO: 2177420 - RNA, 18 nt, Streptococcus pneumoniae R6
caucgauuuuuucaccaa

SEQ ID NO: 2177421 - RNA, 20 nt, Streptococcus pneumoniae R6
caucgcuuggaaguuuuccu

SEQ ID NO: 2177422 - RNA, 16 nt, Streptococcus pneumoniae R6
caucucagaauaauau

SEQ ID NO: 2177423 - RNA, 22 nt, Streptococcus pneumoniae R6
caucucaggcuuggucauuaaa

SEQ ID NO: 2177424 - RNA, 22 nt, Streptococcus pneumoniae R6
caucucgugcauuucaucccca

SEQ ID NO: 2177425 - RNA, 14 nt, Streptococcus pneumoniae R6
caucuacaaccuca

SEQ ID NO: 2177426 - RNA, 18 nt, Streptococcus pneumoniae R6
caucuacaaccucaaaaa

SEQ ID NO: 2177427 - RNA, 19 nt, Streptococcus pneumoniae R6
caucuacaaccucaaaaac

SEQ ID NO: 2177428 - RNA, 19 nt, Streptococcus pneumoniae R6
caucuacaaccucaaaaca

SEQ ID NO: 2177429 - RNA, 20 nt, Streptococcus pneumoniae R6
caucuacaaccucaaaacca

SEQ ID NO: 2177430 - RNA, 16 nt, Streptococcus pneumoniae R6
caucuacaaccuuaaa

SEQ ID NO: 2177431 - RNA, 16 nt, Streptococcus pneumoniae R6
caucuaauguuuuuau

SEQ ID NO: 2177432 - RNA, 13 nt, Streptococcus pneumoniae R6
caucuauuuuuac

SEQ ID NO: 2177433 - RNA, 12 nt, Streptococcus pneumoniae R6
caucuaccuauu

SEQ ID NO: 2177434 - RNA, 12 nt, Streptococcus pneumoniae R6
caucuaaauaau

SEQ ID NO: 2177435 - RNA, 22 nt, Streptococcus pneumoniae R6
caucuaaauaauacuuggacua

SEQ ID NO: 2177436 - RNA, 17 nt, Streptococcus pneumoniae R6
caucuaaaacuggugau

SEQ ID NO: 2177437 - RNA, 20 nt, Streptococcus pneumoniae R6
caucuaacucauagcagaua

SEQ ID NO: 2177438 - RNA, 13 nt, Streptococcus pneumoniae R6
caucacuguuuuu

SEQ ID NO: 2177439 - RNA, 15 nt, Streptococcus pneumoniae R6
caucacuucgucugc

SEQ ID NO: 2177440 - RNA, 16 nt, Streptococcus pneumoniae R6
caucacuaguaauaau

SEQ ID NO: 2177441 - RNA, 15 nt, Streptococcus pneumoniae R6
caucaauauuagaug

SEQ ID NO: 2177442 - RNA, 13 nt, Streptococcus pneumoniae R6
caucaacaguaac

SEQ ID NO: 2177443 - RNA, 15 nt, Streptococcus pneumoniae R6
caucaauacccccuu

SEQ ID NO: 2177444 - RNA, 16 nt, Streptococcus pneumoniae R6
caucaaucucuugucu

SEQ ID NO: 2177445 - RNA, 18 nt, Streptococcus pneumoniae R6
caucaaucucuugucuua

SEQ ID NO: 2177446 - RNA, 24 nt, Streptococcus pneumoniae R6
caucaaagcuaguuguuuuucguc

SEQ ID NO: 2177447 - RNA, 18 nt, Streptococcus pneumoniae R6
caucaaauugaaauaaga

SEQ ID NO: 2177448 - RNA, 22 nt, Streptococcus pneumoniae R6
caucaaaugacuaaccuugucc

SEQ ID NO: 2177449 - RNA, 14 nt, Streptococcus pneumoniae R6
caucaaaugagauu

SEQ ID NO: 2177450 - RNA, 22 nt, Streptococcus pneumoniae R6
caucaaaugagauuugcaucaa

SEQ ID NO: 2177451 - RNA, 11 nt, Streptococcus pneumoniae R6
cauauccccag

SEQ ID NO: 2177452 - RNA, 23 nt, Streptococcus pneumoniae R6
cauauccuccuucaccaaucaaa

SEQ ID NO: 2177453 - RNA, 22 nt, Streptococcus pneumoniae R6
cauauucuuuuacacucaauuu

SEQ ID NO: 2177454 - RNA, 17 nt, Streptococcus pneumoniae R6
cauagugagauugugaa

SEQ ID NO: 2177455 - RNA, 14 nt, Streptococcus pneumoniae R6
cauaguuacuccuu

SEQ ID NO: 2177456 - RNA, 18 nt, Streptococcus pneumoniae R6
cauaguugcauuaaaauc

SEQ ID NO: 2177457 - RNA, 20 nt, Streptococcus pneumoniae R6
cauaguuuaucucacacaaa

SEQ ID NO: 2177458 - RNA, 15 nt, Streptococcus pneumoniae R6
cauauagaccaacua

SEQ ID NO: 2177459 - RNA, 14 nt, Streptococcus pneumoniae R6
cauauagauaaaaa

SEQ ID NO: 2177460 - RNA, 17 nt, Streptococcus pneumoniae R6
cauauagauaaaaaaca

SEQ ID NO: 2177461 - RNA, 19 nt, Streptococcus pneumoniae R6
cauaucagugaagguauuu

SEQ ID NO: 2177462 - RNA, 23 nt, Streptococcus pneumoniae R6
cauaucagugaagguauuuugac

SEQ ID NO: 2177463 - RNA, 17 nt, Streptococcus pneumoniae R6
cauaggcauaguaccag

SEQ ID NO: 2177464 - RNA, 16 nt, Streptococcus pneumoniae R6
cauaguacaauaccuu

SEQ ID NO: 2177465 - RNA, 21 nt, Streptococcus pneumoniae R6
cauaguacaauaccuuuccuc

SEQ ID NO: 2177466 - RNA, 14 nt, Streptococcus pneumoniae R6
cauaguaguaaaca

SEQ ID NO: 2177467 - RNA, 23 nt, Streptococcus pneumoniae R6
cauaguagucuccguaaaagaca

SEQ ID NO: 2177468 - RNA, 18 nt, Streptococcus pneumoniae R6
cauaguagugguuuuuag

SEQ ID NO: 2177469 - RNA, 19 nt, Streptococcus pneumoniae R6
cauaguaucagguguuuca

SEQ ID NO: 2177470 - RNA, 14 nt, Streptococcus pneumoniae R6
cauagucaaaacca

SEQ ID NO: 2177471 - RNA, 16 nt, Streptococcus pneumoniae R6
cauagucaagcucuug

SEQ ID NO: 2177472 - RNA, 16 nt, Streptococcus pneumoniae R6
cauagacuguuaccac

SEQ ID NO: 2177473 - RNA, 14 nt, Streptococcus pneumoniae R6
cauaauuuaaaaua

SEQ ID NO: 2177474 - RNA, 19 nt, Streptococcus pneumoniae R6
cauaauuuuaguagaaaau

SEQ ID NO: 2177475 - RNA, 15 nt, Streptococcus pneumoniae R6
cauaaugucuucugc

SEQ ID NO: 2177476 - RNA, 17 nt, Streptococcus pneumoniae R6
cauagaugaugguuuug

SEQ ID NO: 2177477 - RNA, 21 nt, Streptococcus pneumoniae R6
cauagauucaccaguagacuu

SEQ ID NO: 2177478 - RNA, 16 nt, Streptococcus pneumoniae R6
cauagcaaaauaagcu

SEQ ID NO: 2177479 - RNA, 20 nt, Streptococcus pneumoniae R6
cauagagauugauaucugga

SEQ ID NO: 2177480 - RNA, 15 nt, Streptococcus pneumoniae R6
cauagagagggucug

SEQ ID NO: 2177481 - RNA, 22 nt, Streptococcus pneumoniae R6
cauagcccguuggcuaaagaua

SEQ ID NO: 2177482 - RNA, 13 nt, Streptococcus pneumoniae R6
cauagccaaauaa

SEQ ID NO: 2177483 - RNA, 14 nt, Streptococcus pneumoniae R6
cauagccaauaaau

SEQ ID NO: 2177484 - RNA, 18 nt, Streptococcus pneumoniae R6
cauagccaauaaauguuu

SEQ ID NO: 2177485 - RNA, 14 nt, Streptococcus pneumoniae R6
cauagcaagagcac

SEQ ID NO: 2177486 - RNA, 23 nt, Streptococcus pneumoniae R6
cauucgaaugacuacauuuuuug

SEQ ID NO: 2177487 - RNA, 21 nt, Streptococcus pneumoniae R6
cauucgaaugauuucucuugc

SEQ ID NO: 2177488 - RNA, 21 nt, Streptococcus pneumoniae R6
cauucccuuguagaaaagcaa

SEQ ID NO: 2177489 - RNA, 19 nt, Streptococcus pneumoniae R6
cauuccugauaaaagauag

SEQ ID NO: 2177490 - RNA, 17 nt, Streptococcus pneumoniae R6
cauucauagguucaucu

SEQ ID NO: 2177491 - RNA, 20 nt, Streptococcus pneumoniae R6
cauuccagacagcuucaaga

SEQ ID NO: 2177492 - RNA, 22 nt, Streptococcus pneumoniae R6
cauuccaugaaaaucccuccca

SEQ ID NO: 2177493 - RNA, 15 nt, Streptococcus pneumoniae R6
cauucccaaacaaaa

SEQ ID NO: 2177494 - RNA, 17 nt, Streptococcus pneumoniae R6
cauucccaaacaaaaaa

SEQ ID NO: 2177495 - RNA, 22 nt, Streptococcus pneumoniae R6
cauucaauccaucuccaaccau

SEQ ID NO: 2177496 - RNA, 22 nt, Streptococcus pneumoniae R6
cauucaaugugggaaacagauu

SEQ ID NO: 2177497 - RNA, 21 nt, Streptococcus pneumoniae R6
cauucaagagacucuuuaaga

SEQ ID NO: 2177498 - RNA, 15 nt, Streptococcus pneumoniae R6
cauuauauuucucuc

SEQ ID NO: 2177499 - RNA, 16 nt, Streptococcus pneumoniae R6
cauuauauuucucucc

SEQ ID NO: 2177500 - RNA, 13 nt, Streptococcus pneumoniae R6
cauguguuaccau

SEQ ID NO: 2177501 - RNA, 14 nt, Streptococcus pneumoniae R6
cauguguuaccaua

SEQ ID NO: 2177502 - RNA, 22 nt, Streptococcus pneumoniae R6
cauguguuaccauaguuccgac

SEQ ID NO: 2177503 - RNA, 15 nt, Streptococcus pneumoniae R6
cauguuagaaaaaug

SEQ ID NO: 2177504 - RNA, 21 nt, Streptococcus pneumoniae R6
cauuauacaucuucccacaau

SEQ ID NO: 2177505 - RNA, 12 nt, Streptococcus pneumoniae R6
cauuauagaagg

SEQ ID NO: 2177506 - RNA, 19 nt, Streptococcus pneumoniae R6
cauuauagcauucuucuca

SEQ ID NO: 2177507 - RNA, 12 nt, Streptococcus pneumoniae R6
cauuauagcucg

SEQ ID NO: 2177508 - RNA, 20 nt, Streptococcus pneumoniae R6
cauuauagucgcuagacuga

SEQ ID NO: 2177509 - RNA, 16 nt, Streptococcus pneumoniae R6
cauuacucaaguccuu

SEQ ID NO: 2177510 - RNA, 14 nt, Streptococcus pneumoniae R6
cauucuucucagcu

SEQ ID NO: 2177511 - RNA, 16 nt, Streptococcus pneumoniae R6
cauucuucuuuuccaa

SEQ ID NO: 2177512 - RNA, 18 nt, Streptococcus pneumoniae R6
cauucuucuuuuccaaac

SEQ ID NO: 2177513 - RNA, 23 nt, Streptococcus pneumoniae R6
cauucuuuuuuaauucuuuuuca

SEQ ID NO: 2177514 - RNA, 19 nt, Streptococcus pneumoniae R6
cauucuuuuguucaucauu

SEQ ID NO: 2177515 - RNA, 21 nt, Streptococcus pneumoniae R6
cauugguguuugguugaccag

SEQ ID NO: 2177516 - RNA, 13 nt, Streptococcus pneumoniae R6
cauuguauccuga

SEQ ID NO: 2177517 - RNA, 14 nt, Streptococcus pneumoniae R6
cauuuauauaaaaa

SEQ ID NO: 2177518 - RNA, 17 nt, Streptococcus pneumoniae R6
cauuuagauaguaccaa

SEQ ID NO: 2177519 - RNA, 20 nt, Streptococcus pneumoniae R6
cauuuacucuccuccauaaa

SEQ ID NO: 2177520 - RNA, 15 nt, Streptococcus pneumoniae R6
cauuuagaacaccau

SEQ ID NO: 2177521 - RNA, 13 nt, Streptococcus pneumoniae R6
cauuuaucuucuu

SEQ ID NO: 2177522 - RNA, 14 nt, Streptococcus pneumoniae R6
cauuuaucuucuua

SEQ ID NO: 2177523 - RNA, 19 nt, Streptococcus pneumoniae R6
cauuuauggaaaaaaugaa

SEQ ID NO: 2177524 - RNA, 22 nt, Streptococcus pneumoniae R6
cauuuaucauccagauuuuucu

SEQ ID NO: 2177525 - RNA, 13 nt, Streptococcus pneumoniae R6
cauuucaaagccu

SEQ ID NO: 2177526 - RNA, 17 nt, Streptococcus pneumoniae R6
cauuucaauagcuccuu

SEQ ID NO: 2177527 - RNA, 17 nt, Streptococcus pneumoniae R6
cauuucggauuuuaaaa

SEQ ID NO: 2177528 - RNA, 14 nt, Streptococcus pneumoniae R6
cauuucccauugca

SEQ ID NO: 2177529 - RNA, 16 nt, Streptococcus pneumoniae R6
cauuuccauuguuguu

SEQ ID NO: 2177530 - RNA, 20 nt, Streptococcus pneumoniae R6
cauuucaguugccucagauu

SEQ ID NO: 2177531 - RNA, 24 nt, Streptococcus pneumoniae R6
cauuucaguugccucagauucuga

SEQ ID NO: 2177532 - RNA, 13 nt, Streptococcus pneumoniae R6
cauuucaaccuug

SEQ ID NO: 2177533 - RNA, 20 nt, Streptococcus pneumoniae R6
cauuuccaccugcagcaagu

SEQ ID NO: 2177534 - RNA, 12 nt, Streptococcus pneumoniae R6
cauuuccaauga

SEQ ID NO: 2177535 - RNA, 17 nt, Streptococcus pneumoniae R6
caucucucuauaauaac

SEQ ID NO: 2177536 - RNA, 16 nt, Streptococcus pneumoniae R6
caugaaccucuucauu

SEQ ID NO: 2177537 - RNA, 23 nt, Streptococcus pneumoniae R6
caugaaccucuucauucaaagaa

SEQ ID NO: 2177538 - RNA, 18 nt, Streptococcus pneumoniae R6
caugaaugaucaguaguc

SEQ ID NO: 2177539 - RNA, 22 nt, Streptococcus pneumoniae R6
caugaauauuccuaugauuaau

SEQ ID NO: 2177540 - RNA, 17 nt, Streptococcus pneumoniae R6
caugaaguaaauauuuc

SEQ ID NO: 2177541 - RNA, 19 nt, Streptococcus pneumoniae R6
caugacuccacucaacauu

SEQ ID NO: 2177542 - RNA, 12 nt, Streptococcus pneumoniae R6
caugacuaguga

SEQ ID NO: 2177543 - RNA, 23 nt, Streptococcus pneumoniae R6
caugacuucgucguaaccuucuu

SEQ ID NO: 2177544 - RNA, 23 nt, Streptococcus pneumoniae R6
caugacagccucaaugauaccau

SEQ ID NO: 2177545 - RNA, 19 nt, Streptococcus pneumoniae R6
caugacagauucaucacga

SEQ ID NO: 2177546 - RNA, 16 nt, Streptococcus pneumoniae R6
caugacaaucaagacc

SEQ ID NO: 2177547 - RNA, 17 nt, Streptococcus pneumoniae R6
caugacaaucaagaccc

SEQ ID NO: 2177548 - RNA, 14 nt, Streptococcus pneumoniae R6
caugacauuauuuu

SEQ ID NO: 2177549 - RNA, 15 nt, Streptococcus pneumoniae R6
caugaccaccaggaa

SEQ ID NO: 2177550 - RNA, 15 nt, Streptococcus pneumoniae R6
caugauuagaaauag

SEQ ID NO: 2177551 - RNA, 19 nt, Streptococcus pneumoniae R6
caugauugagaaaguuaaa

SEQ ID NO: 2177552 - RNA, 22 nt, Streptococcus pneumoniae R6
caugauugagaaaguuaaaaaa

SEQ ID NO: 2177553 - RNA, 17 nt, Streptococcus pneumoniae R6
caugagaguuuuuggca

SEQ ID NO: 2177554 - RNA, 16 nt, Streptococcus pneumoniae R6
caugagaauacaaaaa

SEQ ID NO: 2177555 - RNA, 18 nt, Streptococcus pneumoniae R6
caugauaucaaacuuuuu

SEQ ID NO: 2177556 - RNA, 16 nt, Streptococcus pneumoniae R6
caugaguuuuucacca

SEQ ID NO: 2177557 - RNA, 19 nt, Streptococcus pneumoniae R6
caugcugaccgcaaaagcu

SEQ ID NO: 2177558 - RNA, 24 nt, Streptococcus pneumoniae R6
caugcugacgauguugaugauaug

SEQ ID NO: 2177559 - RNA, 12 nt, Streptococcus pneumoniae R6
cauguauauuac

SEQ ID NO: 2177560 - RNA, 16 nt, Streptococcus pneumoniae R6
caugucaauucucacu

SEQ ID NO: 2177561 - RNA, 15 nt, Streptococcus pneumoniae R6
caugucagcccuauc

SEQ ID NO: 2177562 - RNA, 17 nt, Streptococcus pneumoniae R6
cauguaaaucauuuucu

SEQ ID NO: 2177563 - RNA, 19 nt, Streptococcus pneumoniae R6
caggauuuuguucuuuuuc

SEQ ID NO: 2177564 - RNA, 23 nt, Streptococcus pneumoniae R6
caggauuuuguucuuuuucaaaa

SEQ ID NO: 2177565 - RNA, 14 nt, Streptococcus pneumoniae R6
caggauaucaucgc

SEQ ID NO: 2177566 - RNA, 16 nt, Streptococcus pneumoniae R6
caggaaagucaaauua

SEQ ID NO: 2177567 - RNA, 13 nt, Streptococcus pneumoniae R6
caggaaagaugau

SEQ ID NO: 2177568 - RNA, 12 nt, Streptococcus pneumoniae R6
caggcauuauuu

SEQ ID NO: 2177569 - RNA, 14 nt, Streptococcus pneumoniae R6
caggcauaccgccu

SEQ ID NO: 2177570 - RNA, 18 nt, Streptococcus pneumoniae R6
caggcugauuccagcuuc

SEQ ID NO: 2177571 - RNA, 15 nt, Streptococcus pneumoniae R6
caggcuguuuuggau

SEQ ID NO: 2177572 - RNA, 15 nt, Streptococcus pneumoniae R6
caggcuuucucccuu

SEQ ID NO: 2177573 - RNA, 22 nt, Streptococcus pneumoniae R6
caggcuuuuucuguacuauaaa

SEQ ID NO: 2177574 - RNA, 22 nt, Streptococcus pneumoniae R6
cagcuacaaaggcuauagucaa

SEQ ID NO: 2177575 - RNA, 18 nt, Streptococcus pneumoniae R6
cagcuaacaagucuuaaa

SEQ ID NO: 2177576 - RNA, 19 nt, Streptococcus pneumoniae R6
cagcuaacaagucuuaaaa

SEQ ID NO: 2177577 - RNA, 17 nt, Streptococcus pneumoniae R6
cagcuaagccuuuuucu

SEQ ID NO: 2177578 - RNA, 13 nt, Streptococcus pneumoniae R6
cagcuaaaaauaa

SEQ ID NO: 2177579 - RNA, 19 nt, Streptococcus pneumoniae R6
cagcguuuucuacagcugu

SEQ ID NO: 2177580 - RNA, 18 nt, Streptococcus pneumoniae R6
cagcuaaaauguuuuucg

SEQ ID NO: 2177581 - RNA, 21 nt, Streptococcus pneumoniae R6
cagcguuggcugucauuuuuu

SEQ ID NO: 2177582 - RNA, 15 nt, Streptococcus pneumoniae R6
cagcuccuucaaguu

SEQ ID NO: 2177583 - RNA, 21 nt, Streptococcus pneumoniae R6
cagcugcgauuuuagcacugg

SEQ ID NO: 2177584 - RNA, 22 nt, Streptococcus pneumoniae R6
cagcugaguggauuuuucguau

SEQ ID NO: 2177585 - RNA, 14 nt, Streptococcus pneumoniae R6
cagcuucuauuucu

SEQ ID NO: 2177586 - RNA, 17 nt, Streptococcus pneumoniae R6
cagcuucuauuucuugu

SEQ ID NO: 2177587 - RNA, 16 nt, Streptococcus pneumoniae R6
cagcuggcuccuucuu

SEQ ID NO: 2177588 - RNA, 20 nt, Streptococcus pneumoniae R6
cagcuuuguucacuuuuugu

SEQ ID NO: 2177589 - RNA, 17 nt, Streptococcus pneumoniae R6
cagcuuuggcaacugcu

SEQ ID NO: 2177590 - RNA, 18 nt, Streptococcus pneumoniae R6
cagcuuuuuugauaguga

SEQ ID NO: 2177591 - RNA, 11 nt, Streptococcus pneumoniae R6
cagcuuuuucu

SEQ ID NO: 2177592 - RNA, 12 nt, Streptococcus pneumoniae R6
cagcuuuuucuu

SEQ ID NO: 2177593 - RNA, 23 nt, Streptococcus pneumoniae R6
caggaaaaccaguucauaguucu

SEQ ID NO: 2177594 - RNA, 15 nt, Streptococcus pneumoniae R6
cagcuuguucuucug

SEQ ID NO: 2177595 - RNA, 21 nt, Streptococcus pneumoniae R6
cagcuugguaaugcuccaaua

SEQ ID NO: 2177596 - RNA, 21 nt, Streptococcus pneumoniae R6
cagcuuguugcuuuucuucaa

SEQ ID NO: 2177597 - RNA, 18 nt, Streptococcus pneumoniae R6
cagcuuguuguuaaacaa

SEQ ID NO: 2177598 - RNA, 19 nt, Streptococcus pneumoniae R6
caguuauauugacagaaga

SEQ ID NO: 2177599 - RNA, 12 nt, Streptococcus pneumoniae R6
caguuacuuuau

SEQ ID NO: 2177600 - RNA, 17 nt, Streptococcus pneumoniae R6
caguucaucaugauaga

SEQ ID NO: 2177601 - RNA, 15 nt, Streptococcus pneumoniae R6
caguucauaguucua

SEQ ID NO: 2177602 - RNA, 17 nt, Streptococcus pneumoniae R6
caguuccuuugucuuua

SEQ ID NO: 2177603 - RNA, 23 nt, Streptococcus pneumoniae R6
caguuccuuugucuuuagucuua

SEQ ID NO: 2177604 - RNA, 22 nt, Streptococcus pneumoniae R6
caguuccgauguguuggguagc

SEQ ID NO: 2177605 - RNA, 20 nt, Streptococcus pneumoniae R6
caguucccugcauuucuuuu

SEQ ID NO: 2177606 - RNA, 22 nt, Streptococcus pneumoniae R6
caguuccauccacaaccuuaaa

SEQ ID NO: 2177607 - RNA, 18 nt, Streptococcus pneumoniae R6
caguuccaucuacaaccu

SEQ ID NO: 2177608 - RNA, 13 nt, Streptococcus pneumoniae R6
caguuccagcaaa

SEQ ID NO: 2177609 - RNA, 14 nt, Streptococcus pneumoniae R6
caguuccagcaaac

SEQ ID NO: 2177610 - RNA, 22 nt, Streptococcus pneumoniae R6
cagugauuaaaacugccuuucu

SEQ ID NO: 2177611 - RNA, 18 nt, Streptococcus pneumoniae R6
cauaagcuagucuacuug

SEQ ID NO: 2177612 - RNA, 17 nt, Streptococcus pneumoniae R6
cauaagcuggucuuuuu

SEQ ID NO: 2177613 - RNA, 14 nt, Streptococcus pneumoniae R6
cauaagauuaauuu

SEQ ID NO: 2177614 - RNA, 23 nt, Streptococcus pneumoniae R6
cauaagauuaauuucagaaaucu

SEQ ID NO: 2177615 - RNA, 16 nt, Streptococcus pneumoniae R6
cauaaaguuuucugag

SEQ ID NO: 2177616 - RNA, 21 nt, Streptococcus pneumoniae R6
cauaaaguauuauaauauaau

SEQ ID NO: 2177617 - RNA, 14 nt, Streptococcus pneumoniae R6
cauaacuuuaucca

SEQ ID NO: 2177618 - RNA, 15 nt, Streptococcus pneumoniae R6
cauaagucauaacau

SEQ ID NO: 2177619 - RNA, 16 nt, Streptococcus pneumoniae R6
cauaagucauaacauu

SEQ ID NO: 2177620 - RNA, 23 nt, Streptococcus pneumoniae R6
cauaaguuuauaucuaauaauuu

SEQ ID NO: 2177621 - RNA, 19 nt, Streptococcus pneumoniae R6
cauaaguuguaguacugaa

SEQ ID NO: 2177622 - RNA, 23 nt, Streptococcus pneumoniae R6
cauaaguuguaguacugaacaau

SEQ ID NO: 2177623 - RNA, 13 nt, Streptococcus pneumoniae R6
cauaauaauaacc

SEQ ID NO: 2177624 - RNA, 13 nt, Streptococcus pneumoniae R6
cauaauagucucu

SEQ ID NO: 2177625 - RNA, 14 nt, Streptococcus pneumoniae R6
cauaauagcagaaa

SEQ ID NO: 2177626 - RNA, 19 nt, Streptococcus pneumoniae R6
cauaaugauuucaagacca

SEQ ID NO: 2177627 - RNA, 13 nt, Streptococcus pneumoniae R6
caguuuuuuucag

SEQ ID NO: 2177628 - RNA, 16 nt, Streptococcus pneumoniae R6
cauaaaacuauaaucu

SEQ ID NO: 2177629 - RNA, 12 nt, Streptococcus pneumoniae R6
caguuuuuucuu

SEQ ID NO: 2177630 - RNA, 19 nt, Streptococcus pneumoniae R6
caguuuuuucacaaauucu

SEQ ID NO: 2177631 - RNA, 18 nt, Streptococcus pneumoniae R6
caguuuuguuuuuuauaa

SEQ ID NO: 2177632 - RNA, 18 nt, Streptococcus pneumoniae R6
caguuuuuaauuuuucuu

SEQ ID NO: 2177633 - RNA, 14 nt, Streptococcus pneumoniae R6
caguuuucauucua

SEQ ID NO: 2177634 - RNA, 16 nt, Streptococcus pneumoniae R6
cauaaaagucuggcuc

SEQ ID NO: 2177635 - RNA, 13 nt, Streptococcus pneumoniae R6
cauaaaaucacau

SEQ ID NO: 2177636 - RNA, 14 nt, Streptococcus pneumoniae R6
cauaaaaucugaau

SEQ ID NO: 2177637 - RNA, 15 nt, Streptococcus pneumoniae R6
cauaaaaucugaauc

SEQ ID NO: 2177638 - RNA, 13 nt, Streptococcus pneumoniae R6
cauaaagccuuug

SEQ ID NO: 2177639 - RNA, 16 nt, Streptococcus pneumoniae R6
caguuucggcuguucu

SEQ ID NO: 2177640 - RNA, 20 nt, Streptococcus pneumoniae R6
caguuucgccuggagcuuca

SEQ ID NO: 2177641 - RNA, 14 nt, Streptococcus pneumoniae R6
caguauuacaucca

SEQ ID NO: 2177642 - RNA, 12 nt, Streptococcus pneumoniae R6
cagucauuacca

SEQ ID NO: 2177643 - RNA, 15 nt, Streptococcus pneumoniae R6
cagucccauaaaacu

SEQ ID NO: 2177644 - RNA, 11 nt, Streptococcus pneumoniae R6
caguacaaaag

SEQ ID NO: 2177645 - RNA, 21 nt, Streptococcus pneumoniae R6
caguaauaucuccagauagag

SEQ ID NO: 2177646 - RNA, 16 nt, Streptococcus pneumoniae R6
caguaaucucaaaaca

SEQ ID NO: 2177647 - RNA, 21 nt, Streptococcus pneumoniae R6
caguaauuucccauuuguaaa

SEQ ID NO: 2177648 - RNA, 16 nt, Streptococcus pneumoniae R6
caguaaaucuuccuug

SEQ ID NO: 2177649 - RNA, 13 nt, Streptococcus pneumoniae R6
caguaaccauaca

SEQ ID NO: 2177650 - RNA, 21 nt, Streptococcus pneumoniae R6
cagguguuucuaucacggcgg

SEQ ID NO: 2177651 - RNA, 16 nt, Streptococcus pneumoniae R6
cagguguuucuggucu

SEQ ID NO: 2177652 - RNA, 14 nt, Streptococcus pneumoniae R6
cagguucgauuccu

SEQ ID NO: 2177653 - RNA, 15 nt, Streptococcus pneumoniae R6
cagguucuucaauca

SEQ ID NO: 2177654 - RNA, 17 nt, Streptococcus pneumoniae R6
cagguucuucaaucaaa

SEQ ID NO: 2177655 - RNA, 17 nt, Streptococcus pneumoniae R6
cagguauugaaaaaacu

SEQ ID NO: 2177656 - RNA, 18 nt, Streptococcus pneumoniae R6
cagguauugaaaaaacuu

SEQ ID NO: 2177657 - RNA, 19 nt, Streptococcus pneumoniae R6
cagguauugaaaaaacuug

SEQ ID NO: 2177658 - RNA, 20 nt, Streptococcus pneumoniae R6
cagguccaguuacuacugga

SEQ ID NO: 2177659 - RNA, 21 nt, Streptococcus pneumoniae R6
caggucuuauagaaacaucuu

SEQ ID NO: 2177660 - RNA, 23 nt, Streptococcus pneumoniae R6
caggucgguuuuauuaaguagaa

SEQ ID NO: 2177661 - RNA, 12 nt, Streptococcus pneumoniae R6
ccaaaauuccau

SEQ ID NO: 2177662 - RNA, 13 nt, Streptococcus pneumoniae R6
ccaaaauccuuga

SEQ ID NO: 2177663 - RNA, 19 nt, Streptococcus pneumoniae R6
ccaaaaucaugacaaucaa

SEQ ID NO: 2177664 - RNA, 15 nt, Streptococcus pneumoniae R6
ccaaaaguccaaaga

SEQ ID NO: 2177665 - RNA, 18 nt, Streptococcus pneumoniae R6
ccaaaccaaccuucauca

SEQ ID NO: 2177666 - RNA, 19 nt, Streptococcus pneumoniae R6
ccaaacacgaaaccagucc

SEQ ID NO: 2177667 - RNA, 18 nt, Streptococcus pneumoniae R6
ccaaaccaaacagucuca

SEQ ID NO: 2177668 - RNA, 15 nt, Streptococcus pneumoniae R6
ccaaaccauuuuugg

SEQ ID NO: 2177669 - RNA, 17 nt, Streptococcus pneumoniae R6
ccaaaccauuuuuggcu

SEQ ID NO: 2177670 - RNA, 17 nt, Streptococcus pneumoniae R6
ccaaaacgccaucuucc

SEQ ID NO: 2177671 - RNA, 21 nt, Streptococcus pneumoniae R6
ccaaaaauacuuggauuacaa

SEQ ID NO: 2177672 - RNA, 18 nt, Streptococcus pneumoniae R6
ccaaaaauaaaucuauca

SEQ ID NO: 2177673 - RNA, 15 nt, Streptococcus pneumoniae R6
cauuucugcauaagc

SEQ ID NO: 2177674 - RNA, 16 nt, Streptococcus pneumoniae R6
ccaaaaagugcaugag

SEQ ID NO: 2177675 - RNA, 19 nt, Streptococcus pneumoniae R6
ccaaaaagugcaugaguua

SEQ ID NO: 2177676 - RNA, 16 nt, Streptococcus pneumoniae R6
cauuucuggauaacug

SEQ ID NO: 2177677 - RNA, 19 nt, Streptococcus pneumoniae R6
ccaaagaaauuauucuuau

SEQ ID NO: 2177678 - RNA, 14 nt, Streptococcus pneumoniae R6
ccaaagaaguagau

SEQ ID NO: 2177679 - RNA, 22 nt, Streptococcus pneumoniae R6
ccaaagaagucaccauaaaucu

SEQ ID NO: 2177680 - RNA, 16 nt, Streptococcus pneumoniae R6
ccaaacggauuuuuua

SEQ ID NO: 2177681 - RNA, 18 nt, Streptococcus pneumoniae R6
ccaaacgauuaucuaaca

SEQ ID NO: 2177682 - RNA, 20 nt, Streptococcus pneumoniae R6
ccaaacguccagccuugucu

SEQ ID NO: 2177683 - RNA, 16 nt, Streptococcus pneumoniae R6
ccaaacucgaucugaa

SEQ ID NO: 2177684 - RNA, 21 nt, Streptococcus pneumoniae R6
ccaaaggaagcugagcucuuu

SEQ ID NO: 2177685 - RNA, 14 nt, Streptococcus pneumoniae R6
ccaaaggauuuagu

SEQ ID NO: 2177686 - RNA, 22 nt, Streptococcus pneumoniae R6
ccaaaggauuuaguucuguacu

SEQ ID NO: 2177687 - RNA, 21 nt, Streptococcus pneumoniae R6
ccaaagcacggagaacaauau

SEQ ID NO: 2177688 - RNA, 20 nt, Streptococcus pneumoniae R6
ccaaauccccaucuuuagcu

SEQ ID NO: 2177689 - RNA, 11 nt, Streptococcus pneumoniae R6
ccaaaucaauu

SEQ ID NO: 2177690 - RNA, 18 nt, Streptococcus pneumoniae R6
ccaaaucagauaagcacc

SEQ ID NO: 2177691 - RNA, 21 nt, Streptococcus pneumoniae R6
ccaaaguaaaauacaaaccaa

SEQ ID NO: 2177692 - RNA, 17 nt, Streptococcus pneumoniae R6
ccaaaguagcuugcucc

SEQ ID NO: 2177693 - RNA, 16 nt, Streptococcus pneumoniae R6
ccaaaguauauuuagu

SEQ ID NO: 2177694 - RNA, 23 nt, Streptococcus pneumoniae R6
ccaaauaaguaguguuagauuag

SEQ ID NO: 2177695 - RNA, 18 nt, Streptococcus pneumoniae R6
ccaacugcaaguccagaa

SEQ ID NO: 2177696 - RNA, 15 nt, Streptococcus pneumoniae R6
ccaacuucuuuuuga

SEQ ID NO: 2177697 - RNA, 15 nt, Streptococcus pneumoniae R6
ccaacugcaaagaua

SEQ ID NO: 2177698 - RNA, 17 nt, Streptococcus pneumoniae R6
ccaacugcaaagauacc

SEQ ID NO: 2177699 - RNA, 13 nt, Streptococcus pneumoniae R6
ccaacucuuggaa

SEQ ID NO: 2177700 - RNA, 17 nt, Streptococcus pneumoniae R6
ccaacucaggaaagaug

SEQ ID NO: 2177701 - RNA, 20 nt, Streptococcus pneumoniae R6
ccaacuaaccaacuucuuuu

SEQ ID NO: 2177702 - RNA, 22 nt, Streptococcus pneumoniae R6
ccaacuacuaaaccaauaauaa

SEQ ID NO: 2177703 - RNA, 18 nt, Streptococcus pneumoniae R6
ccaaauggauagaucuuu

SEQ ID NO: 2177704 - RNA, 22 nt, Streptococcus pneumoniae R6
ccaaauuccuggcauaagucau

SEQ ID NO: 2177705 - RNA, 20 nt, Streptococcus pneumoniae R6
ccaacauagauaaagacacc

SEQ ID NO: 2177706 - RNA, 14 nt, Streptococcus pneumoniae R6
ccaaggauugucug

SEQ ID NO: 2177707 - RNA, 18 nt, Streptococcus pneumoniae R6
ccaaggaaaguucuuccc

SEQ ID NO: 2177708 - RNA, 19 nt, Streptococcus pneumoniae R6
ccaaggaaaguucuucccc

SEQ ID NO: 2177709 - RNA, 16 nt, Streptococcus pneumoniae R6
ccaaguggaagucugu

SEQ ID NO: 2177710 - RNA, 18 nt, Streptococcus pneumoniae R6
ccaaguggaauucauuuu

SEQ ID NO: 2177711 - RNA, 13 nt, Streptococcus pneumoniae R6
ccaaguggcauug

SEQ ID NO: 2177712 - RNA, 21 nt, Streptococcus pneumoniae R6
ccaaguggcauugcuucauaa

SEQ ID NO: 2177713 - RNA, 19 nt, Streptococcus pneumoniae R6
ccaaguuaaaaaacuuggu

SEQ ID NO: 2177714 - RNA, 22 nt, Streptococcus pneumoniae R6
ccaaguucuuuucauaaagaga

SEQ ID NO: 2177715 - RNA, 17 nt, Streptococcus pneumoniae R6
ccaaguaguaguuucag

SEQ ID NO: 2177716 - RNA, 14 nt, Streptococcus pneumoniae R6
ccaagucugcaugc

SEQ ID NO: 2177717 - RNA, 16 nt, Streptococcus pneumoniae R6
ccaagucggcaggcug

SEQ ID NO: 2177718 - RNA, 15 nt, Streptococcus pneumoniae R6
ccaaguccucaauuu

SEQ ID NO: 2177719 - RNA, 20 nt, Streptococcus pneumoniae R6
ccaagaguagagagaaagga

SEQ ID NO: 2177720 - RNA, 19 nt, Streptococcus pneumoniae R6
ccaagagacgauuccaaac

SEQ ID NO: 2177721 - RNA, 21 nt, Streptococcus pneumoniae R6
ccaagagacgauuccaaacaa

SEQ ID NO: 2177722 - RNA, 21 nt, Streptococcus pneumoniae R6
ccaagauagaagguaaauucu

SEQ ID NO: 2177723 - RNA, 18 nt, Streptococcus pneumoniae R6
ccaagcgcccugcaauca

SEQ ID NO: 2177724 - RNA, 17 nt, Streptococcus pneumoniae R6
ccaagcauuuucauaag

SEQ ID NO: 2177725 - RNA, 12 nt, Streptococcus pneumoniae R6
ccaauccuauga

SEQ ID NO: 2177726 - RNA, 14 nt, Streptococcus pneumoniae R6
ccaaucucuugaac

SEQ ID NO: 2177727 - RNA, 17 nt, Streptococcus pneumoniae R6
ccaaucucaaggcacga

SEQ ID NO: 2177728 - RNA, 18 nt, Streptococcus pneumoniae R6
ccaaucaauuuuacagga

SEQ ID NO: 2177729 - RNA, 18 nt, Streptococcus pneumoniae R6
ccaaucaaacuacuauuu

SEQ ID NO: 2177730 - RNA, 13 nt, Streptococcus pneumoniae R6
ccaaucaaaucaa

SEQ ID NO: 2177731 - RNA, 14 nt, Streptococcus pneumoniae R6
ccaaucaaaucaau

SEQ ID NO: 2177732 - RNA, 14 nt, Streptococcus pneumoniae R6
ccaaucauggcugg

SEQ ID NO: 2177733 - RNA, 19 nt, Streptococcus pneumoniae R6
ccaaucauggcugggaugc

SEQ ID NO: 2177734 - RNA, 13 nt, Streptococcus pneumoniae R6
ccaauacaggaaa

SEQ ID NO: 2177735 - RNA, 23 nt, Streptococcus pneumoniae R6
ccaauaauguuaaccacaaaaag

SEQ ID NO: 2177736 - RNA, 23 nt, Streptococcus pneumoniae R6
ccaauaggacgcuccaaaucacc

SEQ ID NO: 2177737 - RNA, 13 nt, Streptococcus pneumoniae R6
ccaauagccgcaa

SEQ ID NO: 2177738 - RNA, 14 nt, Streptococcus pneumoniae R6
ccaauuaaauaagc

SEQ ID NO: 2177739 - RNA, 16 nt, Streptococcus pneumoniae R6
ccaauuccuugauaua

SEQ ID NO: 2177740 - RNA, 13 nt, Streptococcus pneumoniae R6
ccaauugauuaag

SEQ ID NO: 2177741 - RNA, 12 nt, Streptococcus pneumoniae R6
ccaauugaggaa

SEQ ID NO: 2177742 - RNA, 13 nt, Streptococcus pneumoniae R6
ccaauucuucuuc

SEQ ID NO: 2177743 - RNA, 11 nt, Streptococcus pneumoniae R6
ccaauucuucg

SEQ ID NO: 2177744 - RNA, 14 nt, Streptococcus pneumoniae R6
ccacaaaagagaaa

SEQ ID NO: 2177745 - RNA, 23 nt, Streptococcus pneumoniae R6
ccaauuucuuuagcauaauagca

SEQ ID NO: 2177746 - RNA, 15 nt, Streptococcus pneumoniae R6
ccaauuuauguaauc

SEQ ID NO: 2177747 - RNA, 12 nt, Streptococcus pneumoniae R6
ccaauuucuaac

SEQ ID NO: 2177748 - RNA, 23 nt, Streptococcus pneumoniae R6
ccaauuucuaacauauuucuaga

SEQ ID NO: 2177749 - RNA, 18 nt, Streptococcus pneumoniae R6
ccacaaccucaaaacaau

SEQ ID NO: 2177750 - RNA, 13 nt, Streptococcus pneumoniae R6
ccacaacuuuuaa

SEQ ID NO: 2177751 - RNA, 14 nt, Streptococcus pneumoniae R6
ccacaacuuuuaaa

SEQ ID NO: 2177752 - RNA, 20 nt, Streptococcus pneumoniae R6
ccacaguaacccauaccaga

SEQ ID NO: 2177753 - RNA, 13 nt, Streptococcus pneumoniae R6
ccacaggagcugg

SEQ ID NO: 2177754 - RNA, 14 nt, Streptococcus pneumoniae R6
ccacaggagcugga

SEQ ID NO: 2177755 - RNA, 18 nt, Streptococcus pneumoniae R6
ccacagcguuucuauauu

SEQ ID NO: 2177756 - RNA, 13 nt, Streptococcus pneumoniae R6
ccacacauauaga

SEQ ID NO: 2177757 - RNA, 13 nt, Streptococcus pneumoniae R6
ccacaauuuucau

SEQ ID NO: 2177758 - RNA, 14 nt, Streptococcus pneumoniae R6
ccacacagaaagca

SEQ ID NO: 2177759 - RNA, 16 nt, Streptococcus pneumoniae R6
ccacagaccuguccaa

SEQ ID NO: 2177760 - RNA, 20 nt, Streptococcus pneumoniae R6
ccacagaccuguccaacaga

SEQ ID NO: 2177761 - RNA, 17 nt, Streptococcus pneumoniae R6
ccaccacguauaauucu

SEQ ID NO: 2177762 - RNA, 18 nt, Streptococcus pneumoniae R6
ccaccagacauaucuuua

SEQ ID NO: 2177763 - RNA, 16 nt, Streptococcus pneumoniae R6
ccaccagcuauuaaga

SEQ ID NO: 2177764 - RNA, 15 nt, Streptococcus pneumoniae R6
ccaccaccugcaaca

SEQ ID NO: 2177765 - RNA, 18 nt, Streptococcus pneumoniae R6
ccaccaccugcaacaaua

SEQ ID NO: 2177766 - RNA, 11 nt, Streptococcus pneumoniae R6
ccaccacaaaa

SEQ ID NO: 2177767 - RNA, 13 nt, Streptococcus pneumoniae R6
ccacaucaucaaa

SEQ ID NO: 2177768 - RNA, 17 nt, Streptococcus pneumoniae R6
ccacaucaaaaacagcc

SEQ ID NO: 2177769 - RNA, 23 nt, Streptococcus pneumoniae R6
ccacgaugaugauuggaaugacg

SEQ ID NO: 2177770 - RNA, 13 nt, Streptococcus pneumoniae R6
ccacgagucacau

SEQ ID NO: 2177771 - RNA, 15 nt, Streptococcus pneumoniae R6
ccaccuagcuucuca

SEQ ID NO: 2177772 - RNA, 17 nt, Streptococcus pneumoniae R6
ccaccucauuccccuuc

SEQ ID NO: 2177773 - RNA, 13 nt, Streptococcus pneumoniae R6
ccaccucaucuug

SEQ ID NO: 2177774 - RNA, 16 nt, Streptococcus pneumoniae R6
ccaccuugcaaaaaaa

SEQ ID NO: 2177775 - RNA, 12 nt, Streptococcus pneumoniae R6
ccaccuucaaca

SEQ ID NO: 2177776 - RNA, 21 nt, Streptococcus pneumoniae R6
ccacggagauagugaggagcg

SEQ ID NO: 2177777 - RNA, 17 nt, Streptococcus pneumoniae R6
ccagaucuuagaagcag

SEQ ID NO: 2177778 - RNA, 17 nt, Streptococcus pneumoniae R6
ccagcaaucaaauucau

SEQ ID NO: 2177779 - RNA, 14 nt, Streptococcus pneumoniae R6
ccagcauggucagg

SEQ ID NO: 2177780 - RNA, 19 nt, Streptococcus pneumoniae R6
ccagcauggcaccgccgag

SEQ ID NO: 2177781 - RNA, 14 nt, Streptococcus pneumoniae R6
ccacuuuuuauccg

SEQ ID NO: 2177782 - RNA, 13 nt, Streptococcus pneumoniae R6
ccagaaaaucauu

SEQ ID NO: 2177783 - RNA, 16 nt, Streptococcus pneumoniae R6
ccacuugugucauaau

SEQ ID NO: 2177784 - RNA, 14 nt, Streptococcus pneumoniae R6
ccacuuucaagucu

SEQ ID NO: 2177785 - RNA, 16 nt, Streptococcus pneumoniae R6
ccacguucaaauacuc

SEQ ID NO: 2177786 - RNA, 21 nt, Streptococcus pneumoniae R6
ccagaacuuccacuuccagaa

SEQ ID NO: 2177787 - RNA, 21 nt, Streptococcus pneumoniae R6
ccagaacucccuguuccaaag

SEQ ID NO: 2177788 - RNA, 19 nt, Streptococcus pneumoniae R6
ccagagacacuugccuaaa

SEQ ID NO: 2177789 - RNA, 15 nt, Streptococcus pneumoniae R6
ccagagauaguagac

SEQ ID NO: 2177790 - RNA, 14 nt, Streptococcus pneumoniae R6
ccagagcuuuucaa

SEQ ID NO: 2177791 - RNA, 14 nt, Streptococcus pneumoniae R6
ccagagcauucuuu

SEQ ID NO: 2177792 - RNA, 14 nt, Streptococcus pneumoniae R6
ccagagcaaugaua

SEQ ID NO: 2177793 - RNA, 13 nt, Streptococcus pneumoniae R6
ccagagcaccaac

SEQ ID NO: 2177794 - RNA, 18 nt, Streptococcus pneumoniae R6
ccagagccuugaguggau

SEQ ID NO: 2177795 - RNA, 14 nt, Streptococcus pneumoniae R6
ccagagcgacuggg

SEQ ID NO: 2177796 - RNA, 22 nt, Streptococcus pneumoniae R6
ccagacauuucaauaaauugag

SEQ ID NO: 2177797 - RNA, 11 nt, Streptococcus pneumoniae R6
ccagcuucaaa

SEQ ID NO: 2177798 - RNA, 22 nt, Streptococcus pneumoniae R6
ccagcuguaucgaccucuacca

SEQ ID NO: 2177799 - RNA, 14 nt, Streptococcus pneumoniae R6
ccagcuuuuucuug

SEQ ID NO: 2177800 - RNA, 18 nt, Streptococcus pneumoniae R6
ccaggagccaagauagga

SEQ ID NO: 2177801 - RNA, 24 nt, Streptococcus pneumoniae R6
ccaggagaguaugauuacuuauuu

SEQ ID NO: 2177802 - RNA, 22 nt, Streptococcus pneumoniae R6
ccagguucuaaaaucugauucc

SEQ ID NO: 2177803 - RNA, 12 nt, Streptococcus pneumoniae R6
ccaguuuucuuc

SEQ ID NO: 2177804 - RNA, 22 nt, Streptococcus pneumoniae R6
ccaguuuucuucgguuaggaug

SEQ ID NO: 2177805 - RNA, 14 nt, Streptococcus pneumoniae R6
ccaguuuuuuucag

SEQ ID NO: 2177806 - RNA, 22 nt, Streptococcus pneumoniae R6
ccauaaaaauaauaagcuuuga

SEQ ID NO: 2177807 - RNA, 22 nt, Streptococcus pneumoniae R6
ccauaauaucauaaugagcucc

SEQ ID NO: 2177808 - RNA, 13 nt, Streptococcus pneumoniae R6
ccaguuuggacca

SEQ ID NO: 2177809 - RNA, 21 nt, Streptococcus pneumoniae R6
ccaguuuggcgaugauuuccu

SEQ ID NO: 2177810 - RNA, 13 nt, Streptococcus pneumoniae R6
ccaguaccauggg

SEQ ID NO: 2177811 - RNA, 17 nt, Streptococcus pneumoniae R6
ccaguacuuucaacucc

SEQ ID NO: 2177812 - RNA, 14 nt, Streptococcus pneumoniae R6
ccaguagacuugac

SEQ ID NO: 2177813 - RNA, 19 nt, Streptococcus pneumoniae R6
ccauauaaggaccaaauau

SEQ ID NO: 2177814 - RNA, 23 nt, Streptococcus pneumoniae R6
ccauaguaaacuucuucuuccau

SEQ ID NO: 2177815 - RNA, 19 nt, Streptococcus pneumoniae R6
ccauaggcagcuuguucuu

SEQ ID NO: 2177816 - RNA, 22 nt, Streptococcus pneumoniae R6
ccauaggcagcuuguucuucug

SEQ ID NO: 2177817 - RNA, 21 nt, Streptococcus pneumoniae R6
ccauauaaaaaagcaagacca

SEQ ID NO: 2177818 - RNA, 22 nt, Streptococcus pneumoniae R6
ccauaaucucugaggaaucaau

SEQ ID NO: 2177819 - RNA, 14 nt, Streptococcus pneumoniae R6
ccauacgcccucca

SEQ ID NO: 2177820 - RNA, 14 nt, Streptococcus pneumoniae R6
ccauacuuucucug

SEQ ID NO: 2177821 - RNA, 17 nt, Streptococcus pneumoniae R6
ccauagcgucaaagaag

SEQ ID NO: 2177822 - RNA, 14 nt, Streptococcus pneumoniae R6
ccauagauuucuug

SEQ ID NO: 2177823 - RNA, 22 nt, Streptococcus pneumoniae R6
ccauagauuuuuauuauuuccu

SEQ ID NO: 2177824 - RNA, 18 nt, Streptococcus pneumoniae R6
ccaucgcgaccaagagca

SEQ ID NO: 2177825 - RNA, 19 nt, Streptococcus pneumoniae R6
ccaucgcgaccaagagcaa

SEQ ID NO: 2177826 - RNA, 14 nt, Streptococcus pneumoniae R6
ccaucugcagccuc

SEQ ID NO: 2177827 - RNA, 17 nt, Streptococcus pneumoniae R6
ccaucugcagccucaaa

SEQ ID NO: 2177828 - RNA, 21 nt, Streptococcus pneumoniae R6
ccaucucacacaaucgggauc

SEQ ID NO: 2177829 - RNA, 16 nt, Streptococcus pneumoniae R6
ccaucucgacuggcaa

SEQ ID NO: 2177830 - RNA, 14 nt, Streptococcus pneumoniae R6
ccaucauuuuuaga

SEQ ID NO: 2177831 - RNA, 11 nt, Streptococcus pneumoniae R6
ccauccaagcg

SEQ ID NO: 2177832 - RNA, 14 nt, Streptococcus pneumoniae R6
ccauccacaaccuu

SEQ ID NO: 2177833 - RNA, 22 nt, Streptococcus pneumoniae R6
ccaucacgauuaucuagucgaa

SEQ ID NO: 2177834 - RNA, 17 nt, Streptococcus pneumoniae R6
ccaucccauuuauauaa

SEQ ID NO: 2177835 - RNA, 21 nt, Streptococcus pneumoniae R6
ccaucccauuuauauaaaaag

SEQ ID NO: 2177836 - RNA, 16 nt, Streptococcus pneumoniae R6
ccaucugggucggcuu

SEQ ID NO: 2177837 - RNA, 21 nt, Streptococcus pneumoniae R6
ccaucuucaacuucuaucacg

SEQ ID NO: 2177838 - RNA, 23 nt, Streptococcus pneumoniae R6
ccaugaacgucuaaacuguacaa

SEQ ID NO: 2177839 - RNA, 16 nt, Streptococcus pneumoniae R6
ccaugacaaucauuuc

SEQ ID NO: 2177840 - RNA, 16 nt, Streptococcus pneumoniae R6
ccaugaccgaaugaag

SEQ ID NO: 2177841 - RNA, 17 nt, Streptococcus pneumoniae R6
ccaugaugcugguuguc

SEQ ID NO: 2177842 - RNA, 21 nt, Streptococcus pneumoniae R6
ccccauuuguaugagaggcaa

SEQ ID NO: 2177843 - RNA, 23 nt, Streptococcus pneumoniae R6
cccccuacagggaucgaaccugu

SEQ ID NO: 2177844 - RNA, 16 nt, Streptococcus pneumoniae R6
ccccaugaguuuucaa

SEQ ID NO: 2177845 - RNA, 19 nt, Streptococcus pneumoniae R6
cccauuggaucccauggug

SEQ ID NO: 2177846 - RNA, 21 nt, Streptococcus pneumoniae R6
cccauuuauggaaaaaaugaa

SEQ ID NO: 2177847 - RNA, 14 nt, Streptococcus pneumoniae R6
cccaucugucuuua

SEQ ID NO: 2177848 - RNA, 18 nt, Streptococcus pneumoniae R6
cccaucugucuuuauuaa

SEQ ID NO: 2177849 - RNA, 12 nt, Streptococcus pneumoniae R6
cccaugacaauc

SEQ ID NO: 2177850 - RNA, 19 nt, Streptococcus pneumoniae R6
cccaucguuccguucuuau

SEQ ID NO: 2177851 - RNA, 20 nt, Streptococcus pneumoniae R6
cccaucauuucuucaacaaa

SEQ ID NO: 2177852 - RNA, 17 nt, Streptococcus pneumoniae R6
cccauacgcccuccauu

SEQ ID NO: 2177853 - RNA, 20 nt, Streptococcus pneumoniae R6
cccauauuuggcauauuuuu

SEQ ID NO: 2177854 - RNA, 22 nt, Streptococcus pneumoniae R6
cccauauuuggcauauuuuuag

SEQ ID NO: 2177855 - RNA, 22 nt, Streptococcus pneumoniae R6
cccauagauuuuuauuauuucc

SEQ ID NO: 2177856 - RNA, 23 nt, Streptococcus pneumoniae R6
cccauagauuuuuauuauuuccu

SEQ ID NO: 2177857 - RNA, 15 nt, Streptococcus pneumoniae R6
cccaguaaaggacuu

SEQ ID NO: 2177858 - RNA, 20 nt, Streptococcus pneumoniae R6
cccagccaacaacugauucu

SEQ ID NO: 2177859 - RNA, 13 nt, Streptococcus pneumoniae R6
cccagcuucuuuu

SEQ ID NO: 2177860 - RNA, 14 nt, Streptococcus pneumoniae R6
ccauucacaacauc

SEQ ID NO: 2177861 - RNA, 18 nt, Streptococcus pneumoniae R6
ccauuaugauauauagua

SEQ ID NO: 2177862 - RNA, 13 nt, Streptococcus pneumoniae R6
ccauuaucuagac

SEQ ID NO: 2177863 - RNA, 20 nt, Streptococcus pneumoniae R6
ccauguuuuucaauagccug

SEQ ID NO: 2177864 - RNA, 22 nt, Streptococcus pneumoniae R6
ccauguuuuucuccuauuuucu

SEQ ID NO: 2177865 - RNA, 17 nt, Streptococcus pneumoniae R6
ccauuaauucgauuucu

SEQ ID NO: 2177866 - RNA, 20 nt, Streptococcus pneumoniae R6
ccauugcucuauacacaucc

SEQ ID NO: 2177867 - RNA, 20 nt, Streptococcus pneumoniae R6
ccauuccucccauauuuggc

SEQ ID NO: 2177868 - RNA, 14 nt, Streptococcus pneumoniae R6
ccauucgcagucac

SEQ ID NO: 2177869 - RNA, 17 nt, Streptococcus pneumoniae R6
ccauucccaucaauauc

SEQ ID NO: 2177870 - RNA, 18 nt, Streptococcus pneumoniae R6
ccaugucaauucucacuu

SEQ ID NO: 2177871 - RNA, 14 nt, Streptococcus pneumoniae R6
ccauguccuggaua

SEQ ID NO: 2177872 - RNA, 23 nt, Streptococcus pneumoniae R6
ccauguauggacgaagugcuucu

SEQ ID NO: 2177873 - RNA, 15 nt, Streptococcus pneumoniae R6
ccaugcugagacuca

SEQ ID NO: 2177874 - RNA, 15 nt, Streptococcus pneumoniae R6
ccaugcuuccagcuu

SEQ ID NO: 2177875 - RNA, 14 nt, Streptococcus pneumoniae R6
ccaugcuugauuca

SEQ ID NO: 2177876 - RNA, 14 nt, Streptococcus pneumoniae R6
cccacccauauuuu

SEQ ID NO: 2177877 - RNA, 16 nt, Streptococcus pneumoniae R6
cccaacuuacauuuga

SEQ ID NO: 2177878 - RNA, 22 nt, Streptococcus pneumoniae R6
ccauugucacaauuacguuuaa

SEQ ID NO: 2177879 - RNA, 21 nt, Streptococcus pneumoniae R6
ccauuguauccugaaaagcca

SEQ ID NO: 2177880 - RNA, 15 nt, Streptococcus pneumoniae R6
cccaagcccugcaaa

SEQ ID NO: 2177881 - RNA, 13 nt, Streptococcus pneumoniae R6
cccaaguuaaaaa

SEQ ID NO: 2177882 - RNA, 19 nt, Streptococcus pneumoniae R6
cccaaucgauuuguucuca

SEQ ID NO: 2177883 - RNA, 15 nt, Streptococcus pneumoniae R6
cgacauuaccucuuu

SEQ ID NO: 2177884 - RNA, 18 nt, Streptococcus pneumoniae R6
cgacauuaccucuuuuua

SEQ ID NO: 2177885 - RNA, 23 nt, Streptococcus pneumoniae R6
cgacauuuugcccaccugucaag

SEQ ID NO: 2177886 - RNA, 15 nt, Streptococcus pneumoniae R6
cgacauccuauuuau

SEQ ID NO: 2177887 - RNA, 22 nt, Streptococcus pneumoniae R6
cgaccuucaauuccuucuggaa

SEQ ID NO: 2177888 - RNA, 15 nt, Streptococcus pneumoniae R6
cgaauuauuuccuug

SEQ ID NO: 2177889 - RNA, 21 nt, Streptococcus pneumoniae R6
cgaaugauauuuucaaaaaaa

SEQ ID NO: 2177890 - RNA, 15 nt, Streptococcus pneumoniae R6
cgaaucucuuuccac

SEQ ID NO: 2177891 - RNA, 17 nt, Streptococcus pneumoniae R6
cgaaucaauuucuucac

SEQ ID NO: 2177892 - RNA, 17 nt, Streptococcus pneumoniae R6
cgaauagaguucuaaaa

SEQ ID NO: 2177893 - RNA, 12 nt, Streptococcus pneumoniae R6
cgaauaguauaa

SEQ ID NO: 2177894 - RNA, 14 nt, Streptococcus pneumoniae R6
cgaauaggauuugg

SEQ ID NO: 2177895 - RNA, 16 nt, Streptococcus pneumoniae R6
cgacaaacauugacuu

SEQ ID NO: 2177896 - RNA, 19 nt, Streptococcus pneumoniae R6
cgacaauacaguagaugau

SEQ ID NO: 2177897 - RNA, 16 nt, Streptococcus pneumoniae R6
cgaagaaggaagaguc

SEQ ID NO: 2177898 - RNA, 21 nt, Streptococcus pneumoniae R6
cgaagaaggaagagucagacu

SEQ ID NO: 2177899 - RNA, 16 nt, Streptococcus pneumoniae R6
cgaagcauaucagaca

SEQ ID NO: 2177900 - RNA, 22 nt, Streptococcus pneumoniae R6
cgaagauuuaguucuguauugc

SEQ ID NO: 2177901 - RNA, 17 nt, Streptococcus pneumoniae R6
cgaagaguauaaaaacu

SEQ ID NO: 2177902 - RNA, 21 nt, Streptococcus pneumoniae R6
cgaagaguauaaaaacucucu

SEQ ID NO: 2177903 - RNA, 21 nt, Streptococcus pneumoniae R6
cgaacugcgacguuuucuccu

SEQ ID NO: 2177904 - RNA, 14 nt, Streptococcus pneumoniae R6
cgaacggguucuuc

SEQ ID NO: 2177905 - RNA, 13 nt, Streptococcus pneumoniae R6
cgaacuagagaag

SEQ ID NO: 2177906 - RNA, 23 nt, Streptococcus pneumoniae R6
cgaaguuucaaucguuucuggca

SEQ ID NO: 2177907 - RNA, 22 nt, Streptococcus pneumoniae R6
cgaauaaagaaacuuggcaaaa

SEQ ID NO: 2177908 - RNA, 17 nt, Streptococcus pneumoniae R6
cgaaguuguucuugaag

SEQ ID NO: 2177909 - RNA, 13 nt, Streptococcus pneumoniae R6
cgaaguccuuguu

SEQ ID NO: 2177910 - RNA, 21 nt, Streptococcus pneumoniae R6
cgaagucagcucaaaacaugg

SEQ ID NO: 2177911 - RNA, 16 nt, Streptococcus pneumoniae R6
cgaagguuauaccaaa

SEQ ID NO: 2177912 - RNA, 15 nt, Streptococcus pneumoniae R6
cgaaggacaucuucu

SEQ ID NO: 2177913 - RNA, 20 nt, Streptococcus pneumoniae R6
cgaagcguuuacgaugauuu

SEQ ID NO: 2177914 - RNA, 11 nt, Streptococcus pneumoniae R6
cgaagcuucca

SEQ ID NO: 2177915 - RNA, 13 nt, Streptococcus pneumoniae R6
cgaagcuuccaau

SEQ ID NO: 2177916 - RNA, 15 nt, Streptococcus pneumoniae R6
ccuucuguugguuga

SEQ ID NO: 2177917 - RNA, 17 nt, Streptococcus pneumoniae R6
ccuucuggucugauuuu

SEQ ID NO: 2177918 - RNA, 18 nt, Streptococcus pneumoniae R6
ccuugaaggggcaacucu

SEQ ID NO: 2177919 - RNA, 16 nt, Streptococcus pneumoniae R6
ccuugaccaaucaauc

SEQ ID NO: 2177920 - RNA, 12 nt, Streptococcus pneumoniae R6
ccuucuuuuacu

SEQ ID NO: 2177921 - RNA, 13 nt, Streptococcus pneumoniae R6
ccuucuuuuuaau

SEQ ID NO: 2177922 - RNA, 22 nt, Streptococcus pneumoniae R6
ccuuccauauagucuuucaaag

SEQ ID NO: 2177923 - RNA, 14 nt, Streptococcus pneumoniae R6
ccuugauucggcca

SEQ ID NO: 2177924 - RNA, 19 nt, Streptococcus pneumoniae R6
ccuugccaucugcuucauc

SEQ ID NO: 2177925 - RNA, 16 nt, Streptococcus pneumoniae R6
ccuugauaaguucuuu

SEQ ID NO: 2177926 - RNA, 23 nt, Streptococcus pneumoniae R6
ccuugauaaugcguuuagcaucu

SEQ ID NO: 2177927 - RNA, 23 nt, Streptococcus pneumoniae R6
ccuugaucggaagcuacagagcu

SEQ ID NO: 2177928 - RNA, 15 nt, Streptococcus pneumoniae R6
ccuugaugaucuaaa

SEQ ID NO: 2177929 - RNA, 19 nt, Streptococcus pneumoniae R6
ccuuguucaugcaggaagu

SEQ ID NO: 2177930 - RNA, 19 nt, Streptococcus pneumoniae R6
ccuuguuucuaaaacauug

SEQ ID NO: 2177931 - RNA, 14 nt, Streptococcus pneumoniae R6
ccuugugcacacuc

SEQ ID NO: 2177932 - RNA, 13 nt, Streptococcus pneumoniae R6
ccuuuaacauuug

SEQ ID NO: 2177933 - RNA, 14 nt, Streptococcus pneumoniae R6
ccuuuaaaaacaau

SEQ ID NO: 2177934 - RNA, 15 nt, Streptococcus pneumoniae R6
ccuuuaaaaacaauc

SEQ ID NO: 2177935 - RNA, 13 nt, Streptococcus pneumoniae R6
ccuuguaggaagu

SEQ ID NO: 2177936 - RNA, 22 nt, Streptococcus pneumoniae R6
ccuuguaggaaguuuagauuaa

SEQ ID NO: 2177937 - RNA, 18 nt, Streptococcus pneumoniae R6
ccuugguaacaacaccgc

SEQ ID NO: 2177938 - RNA, 20 nt, Streptococcus pneumoniae R6
ccuugguaauuccuucuuga

SEQ ID NO: 2177939 - RNA, 21 nt, Streptococcus pneumoniae R6
ccuuggcaaauugauaaggac

SEQ ID NO: 2177940 - RNA, 22 nt, Streptococcus pneumoniae R6
ccuuucaauagcauauuuuuag

SEQ ID NO: 2177941 - RNA, 17 nt, Streptococcus pneumoniae R6
ccuuucauaaaguuuuc

SEQ ID NO: 2177942 - RNA, 13 nt, Streptococcus pneumoniae R6
ccuuuagaaaggu

SEQ ID NO: 2177943 - RNA, 20 nt, Streptococcus pneumoniae R6
ccuuuagaaagguuuuaaag

SEQ ID NO: 2177944 - RNA, 18 nt, Streptococcus pneumoniae R6
ccuuuagaacuugcucca

SEQ ID NO: 2177945 - RNA, 20 nt, Streptococcus pneumoniae R6
ccuuuagugauaucuugaag

SEQ ID NO: 2177946 - RNA, 14 nt, Streptococcus pneumoniae R6
ccuuuaguuuauuc

SEQ ID NO: 2177947 - RNA, 16 nt, Streptococcus pneumoniae R6
ccuuuaucugcccaaa

SEQ ID NO: 2177948 - RNA, 13 nt, Streptococcus pneumoniae R6
ccuuuauuuucaa

SEQ ID NO: 2177949 - RNA, 12 nt, Streptococcus pneumoniae R6
ccuuucaaaaua

SEQ ID NO: 2177950 - RNA, 12 nt, Streptococcus pneumoniae R6
ccuuuauuuuuu

SEQ ID NO: 2177951 - RNA, 20 nt, Streptococcus pneumoniae R6
ccuuucaaaccgccaccaaa

SEQ ID NO: 2177952 - RNA, 21 nt, Streptococcus pneumoniae R6
ccuuucaaaccgccaccaaac

SEQ ID NO: 2177953 - RNA, 12 nt, Streptococcus pneumoniae R6
ccuuugcugcuu

SEQ ID NO: 2177954 - RNA, 14 nt, Streptococcus pneumoniae R6
ccuuuguauggaaa

SEQ ID NO: 2177955 - RNA, 14 nt, Streptococcus pneumoniae R6
ccuuugcauccaca

SEQ ID NO: 2177956 - RNA, 11 nt, Streptococcus pneumoniae R6
ccuuugaguaa

SEQ ID NO: 2177957 - RNA, 12 nt, Streptococcus pneumoniae R6
ccuuugaguaag

SEQ ID NO: 2177958 - RNA, 13 nt, Streptococcus pneumoniae R6
ccuuucuuuuuug

SEQ ID NO: 2177959 - RNA, 15 nt, Streptococcus pneumoniae R6
ccuuucuuguaauaa

SEQ ID NO: 2177960 - RNA, 15 nt, Streptococcus pneumoniae R6
cgaaaaauuucucug

SEQ ID NO: 2177961 - RNA, 23 nt, Streptococcus pneumoniae R6
cgaaaaauuucucugguuccuua

SEQ ID NO: 2177962 - RNA, 15 nt, Streptococcus pneumoniae R6
cgaaaagucaucuau

SEQ ID NO: 2177963 - RNA, 17 nt, Streptococcus pneumoniae R6
ccuuuuuucucaaucag

SEQ ID NO: 2177964 - RNA, 14 nt, Streptococcus pneumoniae R6
ccuuuuucacuaga

SEQ ID NO: 2177965 - RNA, 21 nt, Streptococcus pneumoniae R6
ccuuuuuaaauccgauaauau

SEQ ID NO: 2177966 - RNA, 18 nt, Streptococcus pneumoniae R6
ccuuuucuauaggauuua

SEQ ID NO: 2177967 - RNA, 15 nt, Streptococcus pneumoniae R6
cgaaccugugaccca

SEQ ID NO: 2177968 - RNA, 16 nt, Streptococcus pneumoniae R6
cgaacgccuuaaaaaa

SEQ ID NO: 2177969 - RNA, 17 nt, Streptococcus pneumoniae R6
cgaacgccuuaaaaaac

SEQ ID NO: 2177970 - RNA, 19 nt, Streptococcus pneumoniae R6
cgaacgccuuaaaaaacca

SEQ ID NO: 2177971 - RNA, 15 nt, Streptococcus pneumoniae R6
cgaacaucuccaacu

SEQ ID NO: 2177972 - RNA, 17 nt, Streptococcus pneumoniae R6
cgaaaggagaaaaaaua

SEQ ID NO: 2177973 - RNA, 18 nt, Streptococcus pneumoniae R6
cgaaaggagaaaaaauau

SEQ ID NO: 2177974 - RNA, 17 nt, Streptococcus pneumoniae R6
cgaaacuccauaaaauc

SEQ ID NO: 2177975 - RNA, 14 nt, Streptococcus pneumoniae R6
cgaaacucuuuuua

SEQ ID NO: 2177976 - RNA, 13 nt, Streptococcus pneumoniae R6
cgaaacgaagaag

SEQ ID NO: 2177977 - RNA, 18 nt, Streptococcus pneumoniae R6
cgaaacgaagaaggaaga

SEQ ID NO: 2177978 - RNA, 20 nt, Streptococcus pneumoniae R6
cgaaauuggauauugaguaa

SEQ ID NO: 2177979 - RNA, 20 nt, Streptococcus pneumoniae R6
cgaaauuuauaauauaaacu

SEQ ID NO: 2177980 - RNA, 16 nt, Streptococcus pneumoniae R6
cgauugauuuccaaaa

SEQ ID NO: 2177981 - RNA, 17 nt, Streptococcus pneumoniae R6
cgauugauuucggccaa

SEQ ID NO: 2177982 - RNA, 15 nt, Streptococcus pneumoniae R6
cgauugguucugcuc

SEQ ID NO: 2177983 - RNA, 21 nt, Streptococcus pneumoniae R6
cgauuggggauugauuuucag

SEQ ID NO: 2177984 - RNA, 18 nt, Streptococcus pneumoniae R6
cgauuggggauuuuuagu

SEQ ID NO: 2177985 - RNA, 18 nt, Streptococcus pneumoniae R6
cgauuggauuugacugga

SEQ ID NO: 2177986 - RNA, 13 nt, Streptococcus pneumoniae R6
cgauugucaucau

SEQ ID NO: 2177987 - RNA, 22 nt, Streptococcus pneumoniae R6
cgauucccacaagggauagcac

SEQ ID NO: 2177988 - RNA, 19 nt, Streptococcus pneumoniae R6
cgauucauaguuacuccuu

SEQ ID NO: 2177989 - RNA, 16 nt, Streptococcus pneumoniae R6
cgauucaucaagagac

SEQ ID NO: 2177990 - RNA, 19 nt, Streptococcus pneumoniae R6
cgauguuugcagcaccagc

SEQ ID NO: 2177991 - RNA, 20 nt, Streptococcus pneumoniae R6
cgauuuguucuguucuuauu

SEQ ID NO: 2177992 - RNA, 21 nt, Streptococcus pneumoniae R6
cgauuuguucuguucuuauuu

SEQ ID NO: 2177993 - RNA, 23 nt, Streptococcus pneumoniae R6
cgauuuucaaaaagaaguucugg

SEQ ID NO: 2177994 - RNA, 18 nt, Streptococcus pneumoniae R6
cgauuuucucuuuguccu

SEQ ID NO: 2177995 - RNA, 12 nt, Streptococcus pneumoniae R6
cgauuuucucuu

SEQ ID NO: 2177996 - RNA, 12 nt, Streptococcus pneumoniae R6
cgauuuuugugu

SEQ ID NO: 2177997 - RNA, 19 nt, Streptococcus pneumoniae R6
cgauuuuuucuuuguucuu

SEQ ID NO: 2177998 - RNA, 11 nt, Streptococcus pneumoniae R6
cgauuucucuc

SEQ ID NO: 2177999 - RNA, 14 nt, Streptococcus pneumoniae R6
cgauuucaagaacu

SEQ ID NO: 2178000 - RNA, 15 nt, Streptococcus pneumoniae R6
cgauuucaagaacuc

SEQ ID NO: 2178001 - RNA, 16 nt, Streptococcus pneumoniae R6
cgauuucagaauccca

SEQ ID NO: 2178002 - RNA, 23 nt, Streptococcus pneumoniae R6
cgauggggggacauaaaaaaauc

SEQ ID NO: 2178003 - RNA, 18 nt, Streptococcus pneumoniae R6
cgcaaggaugccagccuu

SEQ ID NO: 2178004 - RNA, 16 nt, Streptococcus pneumoniae R6
cgcaauuuaauacucu

SEQ ID NO: 2178005 - RNA, 16 nt, Streptococcus pneumoniae R6
cgcaagcaacaaaaac

SEQ ID NO: 2178006 - RNA, 19 nt, Streptococcus pneumoniae R6
cgcauuugagcgaaaucaa

SEQ ID NO: 2178007 - RNA, 12 nt, Streptococcus pneumoniae R6
cgcauuuuccuu

SEQ ID NO: 2178008 - RNA, 15 nt, Streptococcus pneumoniae R6
cgcaucgucaucacg

SEQ ID NO: 2178009 - RNA, 16 nt, Streptococcus pneumoniae R6
cgcaucuuauuucaau

SEQ ID NO: 2178010 - RNA, 14 nt, Streptococcus pneumoniae R6
cgcaucaacauggu

SEQ ID NO: 2178011 - RNA, 19 nt, Streptococcus pneumoniae R6
cgcauacuaauagcaccaa

SEQ ID NO: 2178012 - RNA, 23 nt, Streptococcus pneumoniae R6
cgcauaugcaacuuguuuuuccu

SEQ ID NO: 2178013 - RNA, 22 nt, Streptococcus pneumoniae R6
cgagcaagaauucaauugcagg

SEQ ID NO: 2178014 - RNA, 19 nt, Streptococcus pneumoniae R6
cgagaaaggcgacaucauc

SEQ ID NO: 2178015 - RNA, 16 nt, Streptococcus pneumoniae R6
cgagaaaggacaaauu

SEQ ID NO: 2178016 - RNA, 18 nt, Streptococcus pneumoniae R6
cgagaaaggacaaauuuc

SEQ ID NO: 2178017 - RNA, 20 nt, Streptococcus pneumoniae R6
cgagaaguaccgccaaaccu

SEQ ID NO: 2178018 - RNA, 14 nt, Streptococcus pneumoniae R6
cgagacaaaacaac

SEQ ID NO: 2178019 - RNA, 19 nt, Streptococcus pneumoniae R6
cgagacaacgcacaccaga

SEQ ID NO: 2178020 - RNA, 22 nt, Streptococcus pneumoniae R6
cgagaaucuguauuuggcauug

SEQ ID NO: 2178021 - RNA, 18 nt, Streptococcus pneumoniae R6
cgagauagcgcugggcug

SEQ ID NO: 2178022 - RNA, 17 nt, Streptococcus pneumoniae R6
cgagaguucuuguuucu

SEQ ID NO: 2178023 - RNA, 13 nt, Streptococcus pneumoniae R6
cgacuucaauaaa

SEQ ID NO: 2178024 - RNA, 13 nt, Streptococcus pneumoniae R6
cgacuucacacuu

SEQ ID NO: 2178025 - RNA, 14 nt, Streptococcus pneumoniae R6
cgacugguaaagaa

SEQ ID NO: 2178026 - RNA, 18 nt, Streptococcus pneumoniae R6
cgacguuuucuccuuuga

SEQ ID NO: 2178027 - RNA, 14 nt, Streptococcus pneumoniae R6
cgacuaauuuggaa

SEQ ID NO: 2178028 - RNA, 22 nt, Streptococcus pneumoniae R6
cgacuacuaguucugcagaauc

SEQ ID NO: 2178029 - RNA, 18 nt, Streptococcus pneumoniae R6
cgauaucguuauuagcau

SEQ ID NO: 2178030 - RNA, 20 nt, Streptococcus pneumoniae R6
cgauacaauaaagguguuca

SEQ ID NO: 2178031 - RNA, 19 nt, Streptococcus pneumoniae R6
cgauagauguuuucaaaaa

SEQ ID NO: 2178032 - RNA, 14 nt, Streptococcus pneumoniae R6
cgauaauuucgcug

SEQ ID NO: 2178033 - RNA, 17 nt, Streptococcus pneumoniae R6
cgaguuaaaacaaagaa

SEQ ID NO: 2178034 - RNA, 20 nt, Streptococcus pneumoniae R6
cgaguguauuguacuuucca

SEQ ID NO: 2178035 - RNA, 21 nt, Streptococcus pneumoniae R6
cgaguguauuguacuuuccaa

SEQ ID NO: 2178036 - RNA, 17 nt, Streptococcus pneumoniae R6
cgaguuauuaacaaaag

SEQ ID NO: 2178037 - RNA, 16 nt, Streptococcus pneumoniae R6
cgagguauuucuuguu

SEQ ID NO: 2178038 - RNA, 18 nt, Streptococcus pneumoniae R6
cgaguaaaagauaaucau

SEQ ID NO: 2178039 - RNA, 16 nt, Streptococcus pneumoniae R6
cgagugcaagagcguc

SEQ ID NO: 2178040 - RNA, 14 nt, Streptococcus pneumoniae R6
cgagugacuuuuuc

SEQ ID NO: 2178041 - RNA, 23 nt, Streptococcus pneumoniae R6
cgagcuaauuuuuugagcaauaa

SEQ ID NO: 2178042 - RNA, 15 nt, Streptococcus pneumoniae R6
cgagcucaaaucagc

SEQ ID NO: 2178043 - RNA, 17 nt, Streptococcus pneumoniae R6
cgagcuuguuugcuuca

SEQ ID NO: 2178044 - RNA, 23 nt, Streptococcus pneumoniae R6
ccuaauuauaggacguuuucaga

SEQ ID NO: 2178045 - RNA, 16 nt, Streptococcus pneumoniae R6
ccuaauccacucagac

SEQ ID NO: 2178046 - RNA, 17 nt, Streptococcus pneumoniae R6
ccuacauugacucugcu

SEQ ID NO: 2178047 - RNA, 22 nt, Streptococcus pneumoniae R6
ccuacaugcuguuagaagacuu

SEQ ID NO: 2178048 - RNA, 19 nt, Streptococcus pneumoniae R6
ccuaaucuggagauuucuu

SEQ ID NO: 2178049 - RNA, 21 nt, Streptococcus pneumoniae R6
ccuaauaguuaucguaauuaa

SEQ ID NO: 2178050 - RNA, 19 nt, Streptococcus pneumoniae R6
ccuaauaauacaaaaaaua

SEQ ID NO: 2178051 - RNA, 19 nt, Streptococcus pneumoniae R6
ccgucuuuagagagaugaa

SEQ ID NO: 2178052 - RNA, 12 nt, Streptococcus pneumoniae R6
ccgucuucuucg

SEQ ID NO: 2178053 - RNA, 16 nt, Streptococcus pneumoniae R6
ccguggaguacuucuu

SEQ ID NO: 2178054 - RNA, 21 nt, Streptococcus pneumoniae R6
ccguagguaugguuacugacu

SEQ ID NO: 2178055 - RNA, 15 nt, Streptococcus pneumoniae R6
ccguagguugcucaa

SEQ ID NO: 2178056 - RNA, 14 nt, Streptococcus pneumoniae R6
ccguagguuuucuc

SEQ ID NO: 2178057 - RNA, 18 nt, Streptococcus pneumoniae R6
ccguagguuuucuccuug

SEQ ID NO: 2178058 - RNA, 22 nt, Streptococcus pneumoniae R6
ccguagauagcugcagcugagg

SEQ ID NO: 2178059 - RNA, 15 nt, Streptococcus pneumoniae R6
ccguaagauagggcu

SEQ ID NO: 2178060 - RNA, 19 nt, Streptococcus pneumoniae R6
ccguccuuguaaagacuag

SEQ ID NO: 2178061 - RNA, 13 nt, Streptococcus pneumoniae R6
ccggcuuucacaa

SEQ ID NO: 2178062 - RNA, 14 nt, Streptococcus pneumoniae R6
ccggcuugucuuug

SEQ ID NO: 2178063 - RNA, 16 nt, Streptococcus pneumoniae R6
ccucauuccccuucuu

SEQ ID NO: 2178064 - RNA, 17 nt, Streptococcus pneumoniae R6
ccucauuuucuagugaa

SEQ ID NO: 2178065 - RNA, 19 nt, Streptococcus pneumoniae R6
ccuccaccuugaucuucca

SEQ ID NO: 2178066 - RNA, 22 nt, Streptococcus pneumoniae R6
ccuccagagaagccaccgccag

SEQ ID NO: 2178067 - RNA, 21 nt, Streptococcus pneumoniae R6
ccuccuaaggaguaguugcag

SEQ ID NO: 2178068 - RNA, 18 nt, Streptococcus pneumoniae R6
ccuccucgagcaguucca

SEQ ID NO: 2178069 - RNA, 14 nt, Streptococcus pneumoniae R6
ccuccuucuccaau

SEQ ID NO: 2178070 - RNA, 17 nt, Streptococcus pneumoniae R6
ccuccgauaauuauuuu

SEQ ID NO: 2178071 - RNA, 20 nt, Streptococcus pneumoniae R6
ccuccgagaaguaccgccaa

SEQ ID NO: 2178072 - RNA, 24 nt, Streptococcus pneumoniae R6
ccucccauuuugugaaaaacuuag

SEQ ID NO: 2178073 - RNA, 13 nt, Streptococcus pneumoniae R6
ccucucuccuccc

SEQ ID NO: 2178074 - RNA, 15 nt, Streptococcus pneumoniae R6
ccucuugaguaauuc

SEQ ID NO: 2178075 - RNA, 19 nt, Streptococcus pneumoniae R6
ccucuugaguaauucucca

SEQ ID NO: 2178076 - RNA, 22 nt, Streptococcus pneumoniae R6
ccucuucuuugauggaguuuuc

SEQ ID NO: 2178077 - RNA, 14 nt, Streptococcus pneumoniae R6
ccugaaagugagaa

SEQ ID NO: 2178078 - RNA, 16 nt, Streptococcus pneumoniae R6
ccugaaauaaaaugcu

SEQ ID NO: 2178079 - RNA, 13 nt, Streptococcus pneumoniae R6
ccucuuuuuacaa

SEQ ID NO: 2178080 - RNA, 17 nt, Streptococcus pneumoniae R6
ccugaaaaucaucugca

SEQ ID NO: 2178081 - RNA, 13 nt, Streptococcus pneumoniae R6
ccugaaaaaauaa

SEQ ID NO: 2178082 - RNA, 13 nt, Streptococcus pneumoniae R6
ccucuuuuucccc

SEQ ID NO: 2178083 - RNA, 15 nt, Streptococcus pneumoniae R6
ccucuuuuuccccag

SEQ ID NO: 2178084 - RNA, 13 nt, Streptococcus pneumoniae R6
ccucuuuuuguau

SEQ ID NO: 2178085 - RNA, 22 nt, Streptococcus pneumoniae R6
ccugaaaccauuagauuucagg

SEQ ID NO: 2178086 - RNA, 18 nt, Streptococcus pneumoniae R6
ccuguaaucccucagagu

SEQ ID NO: 2178087 - RNA, 21 nt, Streptococcus pneumoniae R6
ccuguagggggcauauaaaua

SEQ ID NO: 2178088 - RNA, 23 nt, Streptococcus pneumoniae R6
ccuguagggggcauauaaauaca

SEQ ID NO: 2178089 - RNA, 20 nt, Streptococcus pneumoniae R6
ccuguaugggcaucaacagc

SEQ ID NO: 2178090 - RNA, 18 nt, Streptococcus pneumoniae R6
ccugucaagaccauggcg

SEQ ID NO: 2178091 - RNA, 19 nt, Streptococcus pneumoniae R6
ccuguccuaggucuagacu

SEQ ID NO: 2178092 - RNA, 13 nt, Streptococcus pneumoniae R6
ccugugcuacgac

SEQ ID NO: 2178093 - RNA, 15 nt, Streptococcus pneumoniae R6
ccugugcuagugaau

SEQ ID NO: 2178094 - RNA, 12 nt, Streptococcus pneumoniae R6
ccugugcuccau

SEQ ID NO: 2178095 - RNA, 15 nt, Streptococcus pneumoniae R6
ccugcuacugcaucc

SEQ ID NO: 2178096 - RNA, 17 nt, Streptococcus pneumoniae R6
ccugcuacugcauccaa

SEQ ID NO: 2178097 - RNA, 22 nt, Streptococcus pneumoniae R6
ccugcuaccguugaaaucaaua

SEQ ID NO: 2178098 - RNA, 18 nt, Streptococcus pneumoniae R6
ccuggauagguugcaaag

SEQ ID NO: 2178099 - RNA, 16 nt, Streptococcus pneumoniae R6
ccuggauugacuguug

SEQ ID NO: 2178100 - RNA, 12 nt, Streptococcus pneumoniae R6
ccugcaguuccc

SEQ ID NO: 2178101 - RNA, 16 nt, Streptococcus pneumoniae R6
ccugccccugaugagc

SEQ ID NO: 2178102 - RNA, 14 nt, Streptococcus pneumoniae R6
ccugcaugagcugu

SEQ ID NO: 2178103 - RNA, 14 nt, Streptococcus pneumoniae R6
ccugcauuucuuuu

SEQ ID NO: 2178104 - RNA, 13 nt, Streptococcus pneumoniae R6
ccugcaaucauug

SEQ ID NO: 2178105 - RNA, 15 nt, Streptococcus pneumoniae R6
ccugaaugauuucuu

SEQ ID NO: 2178106 - RNA, 19 nt, Streptococcus pneumoniae R6
ccugaaugauuucuucuug

SEQ ID NO: 2178107 - RNA, 20 nt, Streptococcus pneumoniae R6
ccugaaucuccucaggaacu

SEQ ID NO: 2178108 - RNA, 15 nt, Streptococcus pneumoniae R6
ccugcggcugcagcu

SEQ ID NO: 2178109 - RNA, 18 nt, Streptococcus pneumoniae R6
ccugccucgauaccuggg

SEQ ID NO: 2178110 - RNA, 14 nt, Streptococcus pneumoniae R6
ccgaucucaucuuc

SEQ ID NO: 2178111 - RNA, 13 nt, Streptococcus pneumoniae R6
ccgauaacagcca

SEQ ID NO: 2178112 - RNA, 13 nt, Streptococcus pneumoniae R6
ccgaguuuuucag

SEQ ID NO: 2178113 - RNA, 13 nt, Streptococcus pneumoniae R6
ccgaccuugucuc

SEQ ID NO: 2178114 - RNA, 21 nt, Streptococcus pneumoniae R6
ccgacucaaguacagccugug

SEQ ID NO: 2178115 - RNA, 22 nt, Streptococcus pneumoniae R6
ccgacuugguaguugagcuggc

SEQ ID NO: 2178116 - RNA, 23 nt, Streptococcus pneumoniae R6
ccgacuuuaccagggauauagau

SEQ ID NO: 2178117 - RNA, 19 nt, Streptococcus pneumoniae R6
ccgagaguucuuguuucuc

SEQ ID NO: 2178118 - RNA, 16 nt, Streptococcus pneumoniae R6
ccgagcaagaauucaa

SEQ ID NO: 2178119 - RNA, 19 nt, Streptococcus pneumoniae R6
ccgauuucagaaucccaaa

SEQ ID NO: 2178120 - RNA, 17 nt, Streptococcus pneumoniae R6
ccgcaaccucaaaacag

SEQ ID NO: 2178121 - RNA, 18 nt, Streptococcus pneumoniae R6
ccgaugauguucauaacu

SEQ ID NO: 2178122 - RNA, 20 nt, Streptococcus pneumoniae R6
ccgaacuuuugaauuucaug

SEQ ID NO: 2178123 - RNA, 15 nt, Streptococcus pneumoniae R6
ccgaagaaggccaaa

SEQ ID NO: 2178124 - RNA, 18 nt, Streptococcus pneumoniae R6
ccgaagaaggccaaauau

SEQ ID NO: 2178125 - RNA, 13 nt, Streptococcus pneumoniae R6
ccgaagacuuuaa

SEQ ID NO: 2178126 - RNA, 14 nt, Streptococcus pneumoniae R6
ccgaagacuuuaaa

SEQ ID NO: 2178127 - RNA, 16 nt, Streptococcus pneumoniae R6
cccuuuuuuguuucaa

SEQ ID NO: 2178128 - RNA, 13 nt, Streptococcus pneumoniae R6
cccuucuuucuca

SEQ ID NO: 2178129 - RNA, 23 nt, Streptococcus pneumoniae R6
cccuucuuucucaaacauuguga

SEQ ID NO: 2178130 - RNA, 16 nt, Streptococcus pneumoniae R6
cccuguaaucaugaug

SEQ ID NO: 2178131 - RNA, 16 nt, Streptococcus pneumoniae R6
cccuguuguccgccag

SEQ ID NO: 2178132 - RNA, 13 nt, Streptococcus pneumoniae R6
cccugguaaaaga

SEQ ID NO: 2178133 - RNA, 23 nt, Streptococcus pneumoniae R6
cccuuaucauuauggaccaugca

SEQ ID NO: 2178134 - RNA, 12 nt, Streptococcus pneumoniae R6
cccuuaaagugg

SEQ ID NO: 2178135 - RNA, 13 nt, Streptococcus pneumoniae R6
cccuuaaaaccau

SEQ ID NO: 2178136 - RNA, 16 nt, Streptococcus pneumoniae R6
cccuuauuuccaucuu

SEQ ID NO: 2178137 - RNA, 19 nt, Streptococcus pneumoniae R6
cccuuauuuccaucuucac

SEQ ID NO: 2178138 - RNA, 18 nt, Streptococcus pneumoniae R6
ccccuuaaaaccauguuu

SEQ ID NO: 2178139 - RNA, 15 nt, Streptococcus pneumoniae R6
cccucucagauuaca

SEQ ID NO: 2178140 - RNA, 23 nt, Streptococcus pneumoniae R6
cccugaguguaaacugacaacuu

SEQ ID NO: 2178141 - RNA, 14 nt, Streptococcus pneumoniae R6
cccugcauuucuuu

SEQ ID NO: 2178142 - RNA, 19 nt, Streptococcus pneumoniae R6
cccugcaugagcuguuuag

SEQ ID NO: 2178143 - RNA, 13 nt, Streptococcus pneumoniae R6
cccugccucauau

SEQ ID NO: 2178144 - RNA, 14 nt, Streptococcus pneumoniae R6
ccgcccaucaugcu

SEQ ID NO: 2178145 - RNA, 17 nt, Streptococcus pneumoniae R6
cgggcaaauuucaugac

SEQ ID NO: 2178146 - RNA, 12 nt, Streptococcus pneumoniae R6
cgggauaaaaua

SEQ ID NO: 2178147 - RNA, 17 nt, Streptococcus pneumoniae R6
cggcggaaacaaaauua

SEQ ID NO: 2178148 - RNA, 20 nt, Streptococcus pneumoniae R6
cggcucaugagauaauacaa

SEQ ID NO: 2178149 - RNA, 17 nt, Streptococcus pneumoniae R6
cggcucuuugucaacug

SEQ ID NO: 2178150 - RNA, 17 nt, Streptococcus pneumoniae R6
cgguauuuaagauaacg

SEQ ID NO: 2178151 - RNA, 18 nt, Streptococcus pneumoniae R6
cgguaucuugaauauuuu

SEQ ID NO: 2178152 - RNA, 15 nt, Streptococcus pneumoniae R6
cgggcugacaaccac

SEQ ID NO: 2178153 - RNA, 15 nt, Streptococcus pneumoniae R6
cguaacuuguaacua

SEQ ID NO: 2178154 - RNA, 14 nt, Streptococcus pneumoniae R6
cguaaccaaaucag

SEQ ID NO: 2178155 - RNA, 17 nt, Streptococcus pneumoniae R6
cguaacauauuuucaaa

SEQ ID NO: 2178156 - RNA, 17 nt, Streptococcus pneumoniae R6
cguaaaacgauaaauuc

SEQ ID NO: 2178157 - RNA, 20 nt, Streptococcus pneumoniae R6
cguaaaaaagucuugacaaa

SEQ ID NO: 2178158 - RNA, 15 nt, Streptococcus pneumoniae R6
cguaaucauaagcaa

SEQ ID NO: 2178159 - RNA, 20 nt, Streptococcus pneumoniae R6
cguaaucauaagcaacuuua

SEQ ID NO: 2178160 - RNA, 17 nt, Streptococcus pneumoniae R6
cguacaacagcuacacc

SEQ ID NO: 2178161 - RNA, 18 nt, Streptococcus pneumoniae R6
cguacagaaacguccaag

SEQ ID NO: 2178162 - RNA, 17 nt, Streptococcus pneumoniae R6
cguacgcuccugaauua

SEQ ID NO: 2178163 - RNA, 20 nt, Streptococcus pneumoniae R6
cggccagcacggugugugua

SEQ ID NO: 2178164 - RNA, 13 nt, Streptococcus pneumoniae R6
cggcauugaggac

SEQ ID NO: 2178165 - RNA, 16 nt, Streptococcus pneumoniae R6
cggaaugcuugcaaau

SEQ ID NO: 2178166 - RNA, 16 nt, Streptococcus pneumoniae R6
cggacaccucuuucuu

SEQ ID NO: 2178167 - RNA, 22 nt, Streptococcus pneumoniae R6
cggacgauuaaaaguaagagaa

SEQ ID NO: 2178168 - RNA, 12 nt, Streptococcus pneumoniae R6
cggacuauuuua

SEQ ID NO: 2178169 - RNA, 13 nt, Streptococcus pneumoniae R6
cggagaagaaaac

SEQ ID NO: 2178170 - RNA, 23 nt, Streptococcus pneumoniae R6
cggagacggacuagaaugcuuuu

SEQ ID NO: 2178171 - RNA, 14 nt, Streptococcus pneumoniae R6
cggaauagagcauc

SEQ ID NO: 2178172 - RNA, 12 nt, Streptococcus pneumoniae R6
cgcuuucuucau

SEQ ID NO: 2178173 - RNA, 15 nt, Streptococcus pneumoniae R6
cgcuuucuucauuuu

SEQ ID NO: 2178174 - RNA, 12 nt, Streptococcus pneumoniae R6
cgcuuucuaagg

SEQ ID NO: 2178175 - RNA, 16 nt, Streptococcus pneumoniae R6
cgcuuguccugaauga

SEQ ID NO: 2178176 - RNA, 17 nt, Streptococcus pneumoniae R6
cgcuuguccugaaugau

SEQ ID NO: 2178177 - RNA, 14 nt, Streptococcus pneumoniae R6
cgcuugggaaacca

SEQ ID NO: 2178178 - RNA, 21 nt, Streptococcus pneumoniae R6
cgcuugaaugauaaaacauac

SEQ ID NO: 2178179 - RNA, 13 nt, Streptococcus pneumoniae R6
cgcuugaaacuca

SEQ ID NO: 2178180 - RNA, 16 nt, Streptococcus pneumoniae R6
cgcuagcaaaaucaua

SEQ ID NO: 2178181 - RNA, 19 nt, Streptococcus pneumoniae R6
cgcuaagaggguccaaacc

SEQ ID NO: 2178182 - RNA, 13 nt, Streptococcus pneumoniae R6
cgcucuucaaucu

SEQ ID NO: 2178183 - RNA, 13 nt, Streptococcus pneumoniae R6
cgcuccacuuccc

SEQ ID NO: 2178184 - RNA, 14 nt, Streptococcus pneumoniae R6
cgugcauuucaucc

SEQ ID NO: 2178185 - RNA, 17 nt, Streptococcus pneumoniae R6
cgugaagaaaucaucca

SEQ ID NO: 2178186 - RNA, 22 nt, Streptococcus pneumoniae R6
cgugauaccagagcgacuggga

SEQ ID NO: 2178187 - RNA, 17 nt, Streptococcus pneumoniae R6
cgugauuguuuuuaaag

SEQ ID NO: 2178188 - RNA, 23 nt, Streptococcus pneumoniae R6
cgugauuugaauauccccugaau

SEQ ID NO: 2178189 - RNA, 13 nt, Streptococcus pneumoniae R6
cgucuaaacugua

SEQ ID NO: 2178190 - RNA, 18 nt, Streptococcus pneumoniae R6
cgucuuggucugucaaag

SEQ ID NO: 2178191 - RNA, 16 nt, Streptococcus pneumoniae R6
cgucugaaggaacuaa

SEQ ID NO: 2178192 - RNA, 13 nt, Streptococcus pneumoniae R6
cguccagccuugu

SEQ ID NO: 2178193 - RNA, 15 nt, Streptococcus pneumoniae R6
cguccagccuugucu

SEQ ID NO: 2178194 - RNA, 16 nt, Streptococcus pneumoniae R6
cguacuuaccaaggcu

SEQ ID NO: 2178195 - RNA, 17 nt, Streptococcus pneumoniae R6
cguccgagugcaagagc

SEQ ID NO: 2178196 - RNA, 18 nt, Streptococcus pneumoniae R6
cguccuguugcuucaucu

SEQ ID NO: 2178197 - RNA, 20 nt, Streptococcus pneumoniae R6
cgucgaagguuauaccaaaa

SEQ ID NO: 2178198 - RNA, 20 nt, Streptococcus pneumoniae R6
cguccuuggaagauuucagu

SEQ ID NO: 2178199 - RNA, 15 nt, Streptococcus pneumoniae R6
cuaacccuagaaaac

SEQ ID NO: 2178200 - RNA, 17 nt, Streptococcus pneumoniae R6
cuaacccuagaaaacca

SEQ ID NO: 2178201 - RNA, 16 nt, Streptococcus pneumoniae R6
cuaaccaccugagcua

SEQ ID NO: 2178202 - RNA, 14 nt, Streptococcus pneumoniae R6
cuaacuucaauaga

SEQ ID NO: 2178203 - RNA, 16 nt, Streptococcus pneumoniae R6
cuaacuucaauagacu

SEQ ID NO: 2178204 - RNA, 20 nt, Streptococcus pneumoniae R6
cuaacuucugcuaauugagc

SEQ ID NO: 2178205 - RNA, 23 nt, Streptococcus pneumoniae R6
cuaacuucugcuaauugagcgcc

SEQ ID NO: 2178206 - RNA, 17 nt, Streptococcus pneumoniae R6
cuaacuguuugggggca

SEQ ID NO: 2178207 - RNA, 14 nt, Streptococcus pneumoniae R6
cuaacuuaaaagcu

SEQ ID NO: 2178208 - RNA, 22 nt, Streptococcus pneumoniae R6
cuaacuuaaaagcucgauacuc

SEQ ID NO: 2178209 - RNA, 17 nt, Streptococcus pneumoniae R6
cuaagcucgagaaagga

SEQ ID NO: 2178210 - RNA, 17 nt, Streptococcus pneumoniae R6
cuaagcucgagaaaggg

SEQ ID NO: 2178211 - RNA, 18 nt, Streptococcus pneumoniae R6
cuaagcucuuaaaagcaa

SEQ ID NO: 2178212 - RNA, 17 nt, Streptococcus pneumoniae R6
cuaagucaaauaagaaa

SEQ ID NO: 2178213 - RNA, 14 nt, Streptococcus pneumoniae R6
cuaaguccaucacu

SEQ ID NO: 2178214 - RNA, 19 nt, Streptococcus pneumoniae R6
cuaagugucuggaaugaua

SEQ ID NO: 2178215 - RNA, 21 nt, Streptococcus pneumoniae R6
cuaaguucacuugagcaaacu

SEQ ID NO: 2178216 - RNA, 18 nt, Streptococcus pneumoniae R6
cuaaguuuaaacucaggu

SEQ ID NO: 2178217 - RNA, 18 nt, Streptococcus pneumoniae R6
cuaauaauuuuaacuguc

SEQ ID NO: 2178218 - RNA, 14 nt, Streptococcus pneumoniae R6
cuaacuuuuccuua

SEQ ID NO: 2178219 - RNA, 13 nt, Streptococcus pneumoniae R6
cuaacuuuuuugg

SEQ ID NO: 2178220 - RNA, 18 nt, Streptococcus pneumoniae R6
cuaagaaaguaagaaucu

SEQ ID NO: 2178221 - RNA, 13 nt, Streptococcus pneumoniae R6
cuaagacaaccaa

SEQ ID NO: 2178222 - RNA, 20 nt, Streptococcus pneumoniae R6
cuaaagaauuugaaaaaaau

SEQ ID NO: 2178223 - RNA, 21 nt, Streptococcus pneumoniae R6
cuaaagaauuugaaaaaaauu

SEQ ID NO: 2178224 - RNA, 14 nt, Streptococcus pneumoniae R6
cuaaacuuugagcc

SEQ ID NO: 2178225 - RNA, 15 nt, Streptococcus pneumoniae R6
cuaaacuuugagccu

SEQ ID NO: 2178226 - RNA, 17 nt, Streptococcus pneumoniae R6
cuaaacuuugagccuag

SEQ ID NO: 2178227 - RNA, 21 nt, Streptococcus pneumoniae R6
cuaaagacgcuggcuuucacg

SEQ ID NO: 2178228 - RNA, 15 nt, Streptococcus pneumoniae R6
cuaaagcaauuuuga

SEQ ID NO: 2178229 - RNA, 19 nt, Streptococcus pneumoniae R6
cuaaagcaauuuugaaaga

SEQ ID NO: 2178230 - RNA, 22 nt, Streptococcus pneumoniae R6
cuaaagcaauuuugaaagauuc

SEQ ID NO: 2178231 - RNA, 13 nt, Streptococcus pneumoniae R6
cuaaagauugaga

SEQ ID NO: 2178232 - RNA, 13 nt, Streptococcus pneumoniae R6
cuaaaucuucuaa

SEQ ID NO: 2178233 - RNA, 21 nt, Streptococcus pneumoniae R6
cuaaauuccaaauuagaaaaa

SEQ ID NO: 2178234 - RNA, 15 nt, Streptococcus pneumoniae R6
cuaaauuuaacauua

SEQ ID NO: 2178235 - RNA, 14 nt, Streptococcus pneumoniae R6
cuaacaaugcuuua

SEQ ID NO: 2178236 - RNA, 15 nt, Streptococcus pneumoniae R6
cuaacaaugcuuuag

SEQ ID NO: 2178237 - RNA, 12 nt, Streptococcus pneumoniae R6
cuaaaaaauugc

SEQ ID NO: 2178238 - RNA, 18 nt, Streptococcus pneumoniae R6
cuaaaaagcuacuauaaa

SEQ ID NO: 2178239 - RNA, 12 nt, Streptococcus pneumoniae R6
cuaaaaauaaaa

SEQ ID NO: 2178240 - RNA, 14 nt, Streptococcus pneumoniae R6
cuaaaaauaaaaaa

SEQ ID NO: 2178241 - RNA, 15 nt, Streptococcus pneumoniae R6
cuaaaaauaaaaaag

SEQ ID NO: 2178242 - RNA, 22 nt, Streptococcus pneumoniae R6
cuaaaacgucguaaucuuaaag

SEQ ID NO: 2178243 - RNA, 16 nt, Streptococcus pneumoniae R6
cuaaaacauucuuaca

SEQ ID NO: 2178244 - RNA, 17 nt, Streptococcus pneumoniae R6
cuaaaacauuguuaaaa

SEQ ID NO: 2178245 - RNA, 22 nt, Streptococcus pneumoniae R6
cuaaaacauuguuagaaaucaa

SEQ ID NO: 2178246 - RNA, 11 nt, Streptococcus pneumoniae R6
cuaaaacauuu

SEQ ID NO: 2178247 - RNA, 18 nt, Streptococcus pneumoniae R6
cuaaaacauuucuauaaa

SEQ ID NO: 2178248 - RNA, 23 nt, Streptococcus pneumoniae R6
cuaaaacauuucuauaaaucaau

SEQ ID NO: 2178249 - RNA, 21 nt, Streptococcus pneumoniae R6
cuaaaaauaacuaccuuacuc

SEQ ID NO: 2178250 - RNA, 16 nt, Streptococcus pneumoniae R6
cuaaaaccucaaggca

SEQ ID NO: 2178251 - RNA, 13 nt, Streptococcus pneumoniae R6
cuaaaacuccaac

SEQ ID NO: 2178252 - RNA, 13 nt, Streptococcus pneumoniae R6
cuaaaacuccuau

SEQ ID NO: 2178253 - RNA, 22 nt, Streptococcus pneumoniae R6
cuaaaagauuucuauaaauuca

SEQ ID NO: 2178254 - RNA, 12 nt, Streptococcus pneumoniae R6
cuaaaccaauaa

SEQ ID NO: 2178255 - RNA, 19 nt, Streptococcus pneumoniae R6
cguuuccuuccaugauaga

SEQ ID NO: 2178256 - RNA, 15 nt, Streptococcus pneumoniae R6
cguuucgucauucca

SEQ ID NO: 2178257 - RNA, 13 nt, Streptococcus pneumoniae R6
cuaaaaaaaugau

SEQ ID NO: 2178258 - RNA, 16 nt, Streptococcus pneumoniae R6
cguuuuaggacauaaa

SEQ ID NO: 2178259 - RNA, 16 nt, Streptococcus pneumoniae R6
cguuuuuucugauuuc

SEQ ID NO: 2178260 - RNA, 16 nt, Streptococcus pneumoniae R6
cguucugucaaaccau

SEQ ID NO: 2178261 - RNA, 14 nt, Streptococcus pneumoniae R6
cguucuucaacauc

SEQ ID NO: 2178262 - RNA, 12 nt, Streptococcus pneumoniae R6
cguucuucaaga

SEQ ID NO: 2178263 - RNA, 15 nt, Streptococcus pneumoniae R6
cguucucugagaccu

SEQ ID NO: 2178264 - RNA, 20 nt, Streptococcus pneumoniae R6
cguuggaauaaggcagcuua

SEQ ID NO: 2178265 - RNA, 20 nt, Streptococcus pneumoniae R6
cguuauuugaaaaauauaca

SEQ ID NO: 2178266 - RNA, 17 nt, Streptococcus pneumoniae R6
cguuagcacaccaaaca

SEQ ID NO: 2178267 - RNA, 15 nt, Streptococcus pneumoniae R6
cguuacuauaagacu

SEQ ID NO: 2178268 - RNA, 15 nt, Streptococcus pneumoniae R6
cguucccccuuuuuu

SEQ ID NO: 2178269 - RNA, 17 nt, Streptococcus pneumoniae R6
cguuccauaguugagau

SEQ ID NO: 2178270 - RNA, 16 nt, Streptococcus pneumoniae R6
cguguuagauaguuca

SEQ ID NO: 2178271 - RNA, 17 nt, Streptococcus pneumoniae R6
cguuaaaagcaaaaacg

SEQ ID NO: 2178272 - RNA, 19 nt, Streptococcus pneumoniae R6
cguuaaaaguuaguugaac

SEQ ID NO: 2178273 - RNA, 15 nt, Streptococcus pneumoniae R6
cguguuuuuucacau

SEQ ID NO: 2178274 - RNA, 16 nt, Streptococcus pneumoniae R6
cgugguuugcagagau

SEQ ID NO: 2178275 - RNA, 17 nt, Streptococcus pneumoniae R6
cguguggguucauccag

SEQ ID NO: 2178276 - RNA, 23 nt, Streptococcus pneumoniae R6
cgugcucuaaaaucaucgccaaa

SEQ ID NO: 2178277 - RNA, 17 nt, Streptococcus pneumoniae R6
cguggaguacuucuuug

SEQ ID NO: 2178278 - RNA, 19 nt, Streptococcus pneumoniae R6
cucauuugcgcgcuugaau

SEQ ID NO: 2178279 - RNA, 21 nt, Streptococcus pneumoniae R6
cucauuugcgcgcuugaauga

SEQ ID NO: 2178280 - RNA, 13 nt, Streptococcus pneumoniae R6
cuccacuauaaaa

SEQ ID NO: 2178281 - RNA, 17 nt, Streptococcus pneumoniae R6
cuccacuauaaaacauu

SEQ ID NO: 2178282 - RNA, 15 nt, Streptococcus pneumoniae R6
cuccagaaauaauau

SEQ ID NO: 2178283 - RNA, 15 nt, Streptococcus pneumoniae R6
cuccagauuggaggc

SEQ ID NO: 2178284 - RNA, 15 nt, Streptococcus pneumoniae R6
cuccaguuuuaaucu

SEQ ID NO: 2178285 - RNA, 22 nt, Streptococcus pneumoniae R6
cuccauagccaucuuuugacag

SEQ ID NO: 2178286 - RNA, 20 nt, Streptococcus pneumoniae R6
cuccauaggccaagucuuuu

SEQ ID NO: 2178287 - RNA, 14 nt, Streptococcus pneumoniae R6
cuccaguuuuguuu

SEQ ID NO: 2178288 - RNA, 22 nt, Streptococcus pneumoniae R6
cuccauaaaaucacaucugcua

SEQ ID NO: 2178289 - RNA, 18 nt, Streptococcus pneumoniae R6
cuccauaaacgcaagcaa

SEQ ID NO: 2178290 - RNA, 21 nt, Streptococcus pneumoniae R6
cuccguuuuggacgucuucac

SEQ ID NO: 2178291 - RNA, 23 nt, Streptococcus pneumoniae R6
cuccuaguuugcucuuugauuuu

SEQ ID NO: 2178292 - RNA, 15 nt, Streptococcus pneumoniae R6
cucccuguuccaaag

SEQ ID NO: 2178293 - RNA, 16 nt, Streptococcus pneumoniae R6
cucccuguuccaaaga

SEQ ID NO: 2178294 - RNA, 17 nt, Streptococcus pneumoniae R6
cucccuuaguucaaugg

SEQ ID NO: 2178295 - RNA, 14 nt, Streptococcus pneumoniae R6
cucccuucuuucuc

SEQ ID NO: 2178296 - RNA, 21 nt, Streptococcus pneumoniae R6
cucccuucuuucucaaacauu

SEQ ID NO: 2178297 - RNA, 12 nt, Streptococcus pneumoniae R6
cuccauuacuug

SEQ ID NO: 2178298 - RNA, 17 nt, Streptococcus pneumoniae R6
cucccaucgcgaccaag

SEQ ID NO: 2178299 - RNA, 17 nt, Streptococcus pneumoniae R6
cuccccaugaguuuuca

SEQ ID NO: 2178300 - RNA, 20 nt, Streptococcus pneumoniae R6
cucccacuuucaagucuuug

SEQ ID NO: 2178301 - RNA, 16 nt, Streptococcus pneumoniae R6
cucgugaagaaaucau

SEQ ID NO: 2178302 - RNA, 16 nt, Streptococcus pneumoniae R6
cucuaccugccuucca

SEQ ID NO: 2178303 - RNA, 16 nt, Streptococcus pneumoniae R6
cucuacgaacaggaac

SEQ ID NO: 2178304 - RNA, 16 nt, Streptococcus pneumoniae R6
cucuaaauaaaucuua

SEQ ID NO: 2178305 - RNA, 19 nt, Streptococcus pneumoniae R6
cucuaaagagacaggucaa

SEQ ID NO: 2178306 - RNA, 17 nt, Streptococcus pneumoniae R6
cucuaaauacaaaaaua

SEQ ID NO: 2178307 - RNA, 18 nt, Streptococcus pneumoniae R6
cucuacaccauaaauauu

SEQ ID NO: 2178308 - RNA, 14 nt, Streptococcus pneumoniae R6
cucuacauucccaa

SEQ ID NO: 2178309 - RNA, 14 nt, Streptococcus pneumoniae R6
cucuaaaaucaucg

SEQ ID NO: 2178310 - RNA, 13 nt, Streptococcus pneumoniae R6
cucuaaaaucauc

SEQ ID NO: 2178311 - RNA, 19 nt, Streptococcus pneumoniae R6
cucgugcauuucaucccca

SEQ ID NO: 2178312 - RNA, 14 nt, Streptococcus pneumoniae R6
cucggacuuuuucc

SEQ ID NO: 2178313 - RNA, 19 nt, Streptococcus pneumoniae R6
cucgagguuaacuccuuug

SEQ ID NO: 2178314 - RNA, 14 nt, Streptococcus pneumoniae R6
cucgauugaggucg

SEQ ID NO: 2178315 - RNA, 14 nt, Streptococcus pneumoniae R6
cucgagaaaggaca

SEQ ID NO: 2178316 - RNA, 14 nt, Streptococcus pneumoniae R6
cucgacacuagaug

SEQ ID NO: 2178317 - RNA, 20 nt, Streptococcus pneumoniae R6
cuauuuuuuguauuauuagg

SEQ ID NO: 2178318 - RNA, 15 nt, Streptococcus pneumoniae R6
cucaaagcacugauu

SEQ ID NO: 2178319 - RNA, 18 nt, Streptococcus pneumoniae R6
cucaaagcacugauuuga

SEQ ID NO: 2178320 - RNA, 21 nt, Streptococcus pneumoniae R6
cucaaagcacugauuugaggu

SEQ ID NO: 2178321 - RNA, 20 nt, Streptococcus pneumoniae R6
cucaaaguacagauuugaaa

SEQ ID NO: 2178322 - RNA, 16 nt, Streptococcus pneumoniae R6
cucaaaguacugccuu

SEQ ID NO: 2178323 - RNA, 17 nt, Streptococcus pneumoniae R6
cucaaaguacugccuug

SEQ ID NO: 2178324 - RNA, 13 nt, Streptococcus pneumoniae R6
cucaaauaaaaga

SEQ ID NO: 2178325 - RNA, 19 nt, Streptococcus pneumoniae R6
cucaaacucaguuaaaauc

SEQ ID NO: 2178326 - RNA, 20 nt, Streptococcus pneumoniae R6
cucaaaaaaguuaaaucuua

SEQ ID NO: 2178327 - RNA, 13 nt, Streptococcus pneumoniae R6
cuauuucagauuc

SEQ ID NO: 2178328 - RNA, 14 nt, Streptococcus pneumoniae R6
cuauuucagauuca

SEQ ID NO: 2178329 - RNA, 12 nt, Streptococcus pneumoniae R6
cuauuucauuuu

SEQ ID NO: 2178330 - RNA, 21 nt, Streptococcus pneumoniae R6
cuauuucuuuaaaaucaaagu

SEQ ID NO: 2178331 - RNA, 23 nt, Streptococcus pneumoniae R6
cuauuuggcuuaucugacuagca

SEQ ID NO: 2178332 - RNA, 16 nt, Streptococcus pneumoniae R6
cuauuaacaauaaucu

SEQ ID NO: 2178333 - RNA, 21 nt, Streptococcus pneumoniae R6
cuauuaacgauugaaauaacc

SEQ ID NO: 2178334 - RNA, 20 nt, Streptococcus pneumoniae R6
cuauuuaaaccaauuuuaag

SEQ ID NO: 2178335 - RNA, 12 nt, Streptococcus pneumoniae R6
cuauuguugcau

SEQ ID NO: 2178336 - RNA, 16 nt, Streptococcus pneumoniae R6
cuauuuaccauggacu

SEQ ID NO: 2178337 - RNA, 21 nt, Streptococcus pneumoniae R6
cuauuuacgacaacgguaucu

SEQ ID NO: 2178338 - RNA, 17 nt, Streptococcus pneumoniae R6
cuauuacaucguugguu

SEQ ID NO: 2178339 - RNA, 19 nt, Streptococcus pneumoniae R6
cucaagcugugaguucauu

SEQ ID NO: 2178340 - RNA, 15 nt, Streptococcus pneumoniae R6
cucaaucaguuuuug

SEQ ID NO: 2178341 - RNA, 18 nt, Streptococcus pneumoniae R6
cucaaucaguuuuuucac

SEQ ID NO: 2178342 - RNA, 17 nt, Streptococcus pneumoniae R6
cucaaucccauauuuuu

SEQ ID NO: 2178343 - RNA, 18 nt, Streptococcus pneumoniae R6
cucaaucccauauuuuuc

SEQ ID NO: 2178344 - RNA, 15 nt, Streptococcus pneumoniae R6
cucaauccuuuucug

SEQ ID NO: 2178345 - RNA, 16 nt, Streptococcus pneumoniae R6
cucaaugaaaaucaaa

SEQ ID NO: 2178346 - RNA, 23 nt, Streptococcus pneumoniae R6
cucaaugaaaaucaaagugcaaa

SEQ ID NO: 2178347 - RNA, 16 nt, Streptococcus pneumoniae R6
cucaaugaaaaucaua

SEQ ID NO: 2178348 - RNA, 18 nt, Streptococcus pneumoniae R6
cucaauuguauagugaac

SEQ ID NO: 2178349 - RNA, 13 nt, Streptococcus pneumoniae R6
cucaauuucagga

SEQ ID NO: 2178350 - RNA, 16 nt, Streptococcus pneumoniae R6
cucaauuucaggagaa

SEQ ID NO: 2178351 - RNA, 20 nt, Streptococcus pneumoniae R6
cucaaugaauccgaaaaauu

SEQ ID NO: 2178352 - RNA, 20 nt, Streptococcus pneumoniae R6
cucaaugaguccgaaaaauu

SEQ ID NO: 2178353 - RNA, 22 nt, Streptococcus pneumoniae R6
cucaccaggcauuauuucacuu

SEQ ID NO: 2178354 - RNA, 13 nt, Streptococcus pneumoniae R6
cucaccaucuucc

SEQ ID NO: 2178355 - RNA, 14 nt, Streptococcus pneumoniae R6
cucagcugagcggu

SEQ ID NO: 2178356 - RNA, 20 nt, Streptococcus pneumoniae R6
cucagcugagcgguuuuagu

SEQ ID NO: 2178357 - RNA, 11 nt, Streptococcus pneumoniae R6
cucaggaaaga

SEQ ID NO: 2178358 - RNA, 18 nt, Streptococcus pneumoniae R6
cucagcauuuucuuuuug

SEQ ID NO: 2178359 - RNA, 21 nt, Streptococcus pneumoniae R6
cucagccauaagguuauccuu

SEQ ID NO: 2178360 - RNA, 18 nt, Streptococcus pneumoniae R6
cucagcagucguuccuuu

SEQ ID NO: 2178361 - RNA, 19 nt, Streptococcus pneumoniae R6
cucagauucugacaaucca

SEQ ID NO: 2178362 - RNA, 21 nt, Streptococcus pneumoniae R6
cucagauuacaucucuuguaa

SEQ ID NO: 2178363 - RNA, 15 nt, Streptococcus pneumoniae R6
cucagacagcugagu

SEQ ID NO: 2178364 - RNA, 17 nt, Streptococcus pneumoniae R6
cucagaacccuuauuuc

SEQ ID NO: 2178365 - RNA, 19 nt, Streptococcus pneumoniae R6
cucagaacccuuauuuccu

SEQ ID NO: 2178366 - RNA, 16 nt, Streptococcus pneumoniae R6
cucaucuguuuucaaa

SEQ ID NO: 2178367 - RNA, 17 nt, Streptococcus pneumoniae R6
cucaucuguuuucaaaa

SEQ ID NO: 2178368 - RNA, 18 nt, Streptococcus pneumoniae R6
cucaucuucacucuucaa

SEQ ID NO: 2178369 - RNA, 11 nt, Streptococcus pneumoniae R6
cucaucugcuu

SEQ ID NO: 2178370 - RNA, 15 nt, Streptococcus pneumoniae R6
cucauguaaaucauu

SEQ ID NO: 2178371 - RNA, 21 nt, Streptococcus pneumoniae R6
cucauguaaaucauuuucuug

SEQ ID NO: 2178372 - RNA, 17 nt, Streptococcus pneumoniae R6
cucauuucaauagaaau

SEQ ID NO: 2178373 - RNA, 20 nt, Streptococcus pneumoniae R6
cucaucuacgucugcacgga

SEQ ID NO: 2178374 - RNA, 18 nt, Streptococcus pneumoniae R6
cucaucuaauguuuuuau

SEQ ID NO: 2178375 - RNA, 14 nt, Streptococcus pneumoniae R6
cucaucuauuuuua

SEQ ID NO: 2178376 - RNA, 16 nt, Streptococcus pneumoniae R6
cucaucuauuuuuacu

SEQ ID NO: 2178377 - RNA, 12 nt, Streptococcus pneumoniae R6
cucaucugcaau

SEQ ID NO: 2178378 - RNA, 13 nt, Streptococcus pneumoniae R6
cucaucugcaaua

SEQ ID NO: 2178379 - RNA, 17 nt, Streptococcus pneumoniae R6
cucaucugcaauaacaa

SEQ ID NO: 2178380 - RNA, 15 nt, Streptococcus pneumoniae R6
cucaucacaucguca

SEQ ID NO: 2178381 - RNA, 19 nt, Streptococcus pneumoniae R6
cucagguuuuucgucuuuu

SEQ ID NO: 2178382 - RNA, 13 nt, Streptococcus pneumoniae R6
cucaguauuugga

SEQ ID NO: 2178383 - RNA, 18 nt, Streptococcus pneumoniae R6
cucauauuuauuaauuuc

SEQ ID NO: 2178384 - RNA, 12 nt, Streptococcus pneumoniae R6
cucauauuuucu

SEQ ID NO: 2178385 - RNA, 19 nt, Streptococcus pneumoniae R6
cuacgacaccugacaaugu

SEQ ID NO: 2178386 - RNA, 14 nt, Streptococcus pneumoniae R6
cuacgcuauuuaaa

SEQ ID NO: 2178387 - RNA, 16 nt, Streptococcus pneumoniae R6
cuacgcuuuaaaaauc

SEQ ID NO: 2178388 - RNA, 14 nt, Streptococcus pneumoniae R6
cuacgucagcuucc

SEQ ID NO: 2178389 - RNA, 21 nt, Streptococcus pneumoniae R6
cuacggucaccgacaacuuca

SEQ ID NO: 2178390 - RNA, 13 nt, Streptococcus pneumoniae R6
cuaauacauuuug

SEQ ID NO: 2178391 - RNA, 20 nt, Streptococcus pneumoniae R6
cuaauacauuuuguaaaaaa

SEQ ID NO: 2178392 - RNA, 15 nt, Streptococcus pneumoniae R6
cuaauaauuuuucau

SEQ ID NO: 2178393 - RNA, 16 nt, Streptococcus pneumoniae R6
cuaauagguacaaaaa

SEQ ID NO: 2178394 - RNA, 16 nt, Streptococcus pneumoniae R6
cuaccuauucauauau

SEQ ID NO: 2178395 - RNA, 12 nt, Streptococcus pneumoniae R6
cuaccuacuuua

SEQ ID NO: 2178396 - RNA, 14 nt, Streptococcus pneumoniae R6
cuaccugccuucca

SEQ ID NO: 2178397 - RNA, 19 nt, Streptococcus pneumoniae R6
cuaccugcaccagauucga

SEQ ID NO: 2178398 - RNA, 21 nt, Streptococcus pneumoniae R6
cuagccuccuaguuugcucuu

SEQ ID NO: 2178399 - RNA, 13 nt, Streptococcus pneumoniae R6
cuagcgauuucca

SEQ ID NO: 2178400 - RNA, 18 nt, Streptococcus pneumoniae R6
cuagcauccaucccauuu

SEQ ID NO: 2178401 - RNA, 15 nt, Streptococcus pneumoniae R6
cuagccaguauuuuu

SEQ ID NO: 2178402 - RNA, 21 nt, Streptococcus pneumoniae R6
cuagccgcagauugcucaaaa

SEQ ID NO: 2178403 - RNA, 13 nt, Streptococcus pneumoniae R6
cuagcaagaguuu

SEQ ID NO: 2178404 - RNA, 19 nt, Streptococcus pneumoniae R6
cuagcaaugccaaagguaa

SEQ ID NO: 2178405 - RNA, 15 nt, Streptococcus pneumoniae R6
cuagcaaugguuuag

SEQ ID NO: 2178406 - RNA, 17 nt, Streptococcus pneumoniae R6
cuagcagccacuuuuua

SEQ ID NO: 2178407 - RNA, 21 nt, Streptococcus pneumoniae R6
cuagcauaaaagccuccaauc

SEQ ID NO: 2178408 - RNA, 22 nt, Streptococcus pneumoniae R6
cuagcauaaaagccuccaaucu

SEQ ID NO: 2178409 - RNA, 19 nt, Streptococcus pneumoniae R6
cuagauaaaagaaugcuca

SEQ ID NO: 2178410 - RNA, 20 nt, Streptococcus pneumoniae R6
cuagaggggugauuuuauau

SEQ ID NO: 2178411 - RNA, 13 nt, Streptococcus pneumoniae R6
cuagaguccaaga

SEQ ID NO: 2178412 - RNA, 16 nt, Streptococcus pneumoniae R6
cuacuaaaacauuucu

SEQ ID NO: 2178413 - RNA, 23 nt, Streptococcus pneumoniae R6
cuacuaaaacauuucuauaaauc

SEQ ID NO: 2178414 - RNA, 18 nt, Streptococcus pneumoniae R6
cuacuaaaccaauaauaa

SEQ ID NO: 2178415 - RNA, 21 nt, Streptococcus pneumoniae R6
cuacuaaaccaauaauaaaac

SEQ ID NO: 2178416 - RNA, 17 nt, Streptococcus pneumoniae R6
cuagaaacguuguuaaa

SEQ ID NO: 2178417 - RNA, 15 nt, Streptococcus pneumoniae R6
cuagagauuaucccc

SEQ ID NO: 2178418 - RNA, 16 nt, Streptococcus pneumoniae R6
cuagaaccacaccucc

SEQ ID NO: 2178419 - RNA, 20 nt, Streptococcus pneumoniae R6
cuagaaccacaccuccucga

SEQ ID NO: 2178420 - RNA, 16 nt, Streptococcus pneumoniae R6
cuagaaaucucuuuuu

SEQ ID NO: 2178421 - RNA, 18 nt, Streptococcus pneumoniae R6
cuagaaaucucuuuuuuc

SEQ ID NO: 2178422 - RNA, 17 nt, Streptococcus pneumoniae R6
cuauauaucaugcuuua

SEQ ID NO: 2178423 - RNA, 15 nt, Streptococcus pneumoniae R6
cuauauauuaucgga

SEQ ID NO: 2178424 - RNA, 22 nt, Streptococcus pneumoniae R6
cuauaucaaaaccaguccugga

SEQ ID NO: 2178425 - RNA, 14 nt, Streptococcus pneumoniae R6
cuaucugcaaccuc

SEQ ID NO: 2178426 - RNA, 15 nt, Streptococcus pneumoniae R6
cuaucugcaaccuca

SEQ ID NO: 2178427 - RNA, 16 nt, Streptococcus pneumoniae R6
cuaucugcaaccuuaa

SEQ ID NO: 2178428 - RNA, 18 nt, Streptococcus pneumoniae R6
cuaugaacugguuuuccu

SEQ ID NO: 2178429 - RNA, 13 nt, Streptococcus pneumoniae R6
cuaugaaaugaga

SEQ ID NO: 2178430 - RNA, 15 nt, Streptococcus pneumoniae R6
cuaugaaaugagaaa

SEQ ID NO: 2178431 - RNA, 19 nt, Streptococcus pneumoniae R6
cuaucuuauugauuuuucu

SEQ ID NO: 2178432 - RNA, 18 nt, Streptococcus pneumoniae R6
cuaucuucuugauacuga

SEQ ID NO: 2178433 - RNA, 19 nt, Streptococcus pneumoniae R6
cuaucuugagcaagucucu

SEQ ID NO: 2178434 - RNA, 16 nt, Streptococcus pneumoniae R6
cuaucuuggucuagca

SEQ ID NO: 2178435 - RNA, 13 nt, Streptococcus pneumoniae R6
cuaucugucacaa

SEQ ID NO: 2178436 - RNA, 17 nt, Streptococcus pneumoniae R6
cuaucugucacaaucca

SEQ ID NO: 2178437 - RNA, 17 nt, Streptococcus pneumoniae R6
cuaucuucauuuugcac

SEQ ID NO: 2178438 - RNA, 17 nt, Streptococcus pneumoniae R6
cuaugcguuuuaaugug

SEQ ID NO: 2178439 - RNA, 18 nt, Streptococcus pneumoniae R6
cuaugcguuuuauugugg

SEQ ID NO: 2178440 - RNA, 17 nt, Streptococcus pneumoniae R6
cuauaauggcuuauucc

SEQ ID NO: 2178441 - RNA, 17 nt, Streptococcus pneumoniae R6
cuauaauggcuuguucc

SEQ ID NO: 2178442 - RNA, 21 nt, Streptococcus pneumoniae R6
cuauaauggcuuguuccaauu

SEQ ID NO: 2178443 - RNA, 12 nt, Streptococcus pneumoniae R6
cuauaacuuguu

SEQ ID NO: 2178444 - RNA, 19 nt, Streptococcus pneumoniae R6
cuauaacaucugcuauaau

SEQ ID NO: 2178445 - RNA, 15 nt, Streptococcus pneumoniae R6
cuauaagacuccucu

SEQ ID NO: 2178446 - RNA, 16 nt, Streptococcus pneumoniae R6
cuauaagacuccucuu

SEQ ID NO: 2178447 - RNA, 18 nt, Streptococcus pneumoniae R6
cuauaagcccaaaucauc

SEQ ID NO: 2178448 - RNA, 19 nt, Streptococcus pneumoniae R6
cuauaagcccaaaucauca

SEQ ID NO: 2178449 - RNA, 17 nt, Streptococcus pneumoniae R6
cuauaauauaauaaacu

SEQ ID NO: 2178450 - RNA, 14 nt, Streptococcus pneumoniae R6
cuauaaucaauaua

SEQ ID NO: 2178451 - RNA, 19 nt, Streptococcus pneumoniae R6
cuauaagugaauaugauuu

SEQ ID NO: 2178452 - RNA, 18 nt, Streptococcus pneumoniae R6
cuauaccaagcucagcau

SEQ ID NO: 2178453 - RNA, 17 nt, Streptococcus pneumoniae R6
cuauacuagcuuauuau

SEQ ID NO: 2178454 - RNA, 22 nt, Streptococcus pneumoniae R6
cuauagaaaaaagucuuuaaaa

SEQ ID NO: 2178455 - RNA, 13 nt, Streptococcus pneumoniae R6
cuauacuuuuucu

SEQ ID NO: 2178456 - RNA, 19 nt, Streptococcus pneumoniae R6
cuauacuuuuuuaauuuaa

SEQ ID NO: 2178457 - RNA, 14 nt, Streptococcus pneumoniae R6
cuauaaacaaagga

SEQ ID NO: 2178458 - RNA, 23 nt, Streptococcus pneumoniae R6
cuauaaacaaaggaguuaaccuc

SEQ ID NO: 2178459 - RNA, 13 nt, Streptococcus pneumoniae R6
cuauaaaccucau

SEQ ID NO: 2178460 - RNA, 13 nt, Streptococcus pneumoniae R6
cuauaaaauauag

SEQ ID NO: 2178461 - RNA, 21 nt, Streptococcus pneumoniae R6
cuaggcaagcuugaaacaaau

SEQ ID NO: 2178462 - RNA, 19 nt, Streptococcus pneumoniae R6
cuauaaaacauucuuauca

SEQ ID NO: 2178463 - RNA, 19 nt, Streptococcus pneumoniae R6
cuaggagagcuagggauuu

SEQ ID NO: 2178464 - RNA, 21 nt, Streptococcus pneumoniae R6
cugauaacgaagagcuggcug

SEQ ID NO: 2178465 - RNA, 22 nt, Streptococcus pneumoniae R6
cugauaagaugacaucuaaaua

SEQ ID NO: 2178466 - RNA, 14 nt, Streptococcus pneumoniae R6
cugauagaagaguc

SEQ ID NO: 2178467 - RNA, 24 nt, Streptococcus pneumoniae R6
cugauagagauuauagugguguuu

SEQ ID NO: 2178468 - RNA, 19 nt, Streptococcus pneumoniae R6
cugauagaguuagagccgc

SEQ ID NO: 2178469 - RNA, 17 nt, Streptococcus pneumoniae R6
cugauagauuuauuuuu

SEQ ID NO: 2178470 - RNA, 17 nt, Streptococcus pneumoniae R6
cugauccagccuuguau

SEQ ID NO: 2178471 - RNA, 16 nt, Streptococcus pneumoniae R6
cugaucccuccauuuc

SEQ ID NO: 2178472 - RNA, 16 nt, Streptococcus pneumoniae R6
cugaucgauuuguccu

SEQ ID NO: 2178473 - RNA, 21 nt, Streptococcus pneumoniae R6
cugaucaaaaaauuucauuuc

SEQ ID NO: 2178474 - RNA, 15 nt, Streptococcus pneumoniae R6
cugauagugguguuu

SEQ ID NO: 2178475 - RNA, 21 nt, Streptococcus pneumoniae R6
cugauagugguguuucaaguc

SEQ ID NO: 2178476 - RNA, 17 nt, Streptococcus pneumoniae R6
cucuagaaaucucuuuu

SEQ ID NO: 2178477 - RNA, 20 nt, Streptococcus pneumoniae R6
cucuaucaggaaagucaaau

SEQ ID NO: 2178478 - RNA, 23 nt, Streptococcus pneumoniae R6
cucuaucaggaaagucaaauuaa

SEQ ID NO: 2178479 - RNA, 16 nt, Streptococcus pneumoniae R6
cucuaucuuuuaacua

SEQ ID NO: 2178480 - RNA, 20 nt, Streptococcus pneumoniae R6
cugagcucuuuagucccagc

SEQ ID NO: 2178481 - RNA, 12 nt, Streptococcus pneumoniae R6
cugaggaccaaa

SEQ ID NO: 2178482 - RNA, 13 nt, Streptococcus pneumoniae R6
cugagucacguuu

SEQ ID NO: 2178483 - RNA, 12 nt, Streptococcus pneumoniae R6
cugcacucucau

SEQ ID NO: 2178484 - RNA, 21 nt, Streptococcus pneumoniae R6
cugcagaaucgugaguuccug

SEQ ID NO: 2178485 - RNA, 19 nt, Streptococcus pneumoniae R6
cugcaaucaagguuuccaa

SEQ ID NO: 2178486 - RNA, 20 nt, Streptococcus pneumoniae R6
cugcaaucaagguuuccaaa

SEQ ID NO: 2178487 - RNA, 12 nt, Streptococcus pneumoniae R6
cugcaauaaucu

SEQ ID NO: 2178488 - RNA, 17 nt, Streptococcus pneumoniae R6
cugcaguuucucuacua

SEQ ID NO: 2178489 - RNA, 17 nt, Streptococcus pneumoniae R6
cugcaguugugucuucg

SEQ ID NO: 2178490 - RNA, 22 nt, Streptococcus pneumoniae R6
cugcaguucccacacgaaucaa

SEQ ID NO: 2178491 - RNA, 12 nt, Streptococcus pneumoniae R6
cugcaaagauag

SEQ ID NO: 2178492 - RNA, 11 nt, Streptococcus pneumoniae R6
cugcaaaccac

SEQ ID NO: 2178493 - RNA, 12 nt, Streptococcus pneumoniae R6
cugauuucaaag

SEQ ID NO: 2178494 - RNA, 21 nt, Streptococcus pneumoniae R6
cugauuucaaggcauuuuuug

SEQ ID NO: 2178495 - RNA, 19 nt, Streptococcus pneumoniae R6
cugcaaguccagaaccguu

SEQ ID NO: 2178496 - RNA, 16 nt, Streptococcus pneumoniae R6
cugcaaggcaagacug

SEQ ID NO: 2178497 - RNA, 17 nt, Streptococcus pneumoniae R6
cugcaaggcaagacuga

SEQ ID NO: 2178498 - RNA, 15 nt, Streptococcus pneumoniae R6
cugauuaaaaucaua

SEQ ID NO: 2178499 - RNA, 14 nt, Streptococcus pneumoniae R6
cugaugaaacuaau

SEQ ID NO: 2178500 - RNA, 16 nt, Streptococcus pneumoniae R6
cugcccccaaacaguu

SEQ ID NO: 2178501 - RNA, 22 nt, Streptococcus pneumoniae R6
cugccagcugagcuaaggaggc

SEQ ID NO: 2178502 - RNA, 17 nt, Streptococcus pneumoniae R6
cugccucaauccuuuuc

SEQ ID NO: 2178503 - RNA, 13 nt, Streptococcus pneumoniae R6
cugcuaauuuuau

SEQ ID NO: 2178504 - RNA, 13 nt, Streptococcus pneumoniae R6
cugcuaacugcug

SEQ ID NO: 2178505 - RNA, 20 nt, Streptococcus pneumoniae R6
cugcuaaggauuuaggacua

SEQ ID NO: 2178506 - RNA, 19 nt, Streptococcus pneumoniae R6
cugcuaaaacaaaauucuu

SEQ ID NO: 2178507 - RNA, 13 nt, Streptococcus pneumoniae R6
cugcuaaaagauu

SEQ ID NO: 2178508 - RNA, 20 nt, Streptococcus pneumoniae R6
cugcuaaaagauuucuauaa

SEQ ID NO: 2178509 - RNA, 21 nt, Streptococcus pneumoniae R6
cugcuaaaagauuucuauaaa

SEQ ID NO: 2178510 - RNA, 21 nt, Streptococcus pneumoniae R6
cugcguuauaugcuauaauua

SEQ ID NO: 2178511 - RNA, 14 nt, Streptococcus pneumoniae R6
cugcguuaacuuca

SEQ ID NO: 2178512 - RNA, 16 nt, Streptococcus pneumoniae R6
cugccugguaaagacu

SEQ ID NO: 2178513 - RNA, 18 nt, Streptococcus pneumoniae R6
cugccugguaaagacucu

SEQ ID NO: 2178514 - RNA, 18 nt, Streptococcus pneumoniae R6
cugggugcugaauccuca

SEQ ID NO: 2178515 - RNA, 14 nt, Streptococcus pneumoniae R6
cugguaagaaguaa

SEQ ID NO: 2178516 - RNA, 20 nt, Streptococcus pneumoniae R6
cugguacaguugggauucca

SEQ ID NO: 2178517 - RNA, 14 nt, Streptococcus pneumoniae R6
cugggucucagucu

SEQ ID NO: 2178518 - RNA, 17 nt, Streptococcus pneumoniae R6
cugggucucagucugac

SEQ ID NO: 2178519 - RNA, 12 nt, Streptococcus pneumoniae R6
cuggucuuuuug

SEQ ID NO: 2178520 - RNA, 16 nt, Streptococcus pneumoniae R6
cuggucacgaccagaa

SEQ ID NO: 2178521 - RNA, 14 nt, Streptococcus pneumoniae R6
cugguauauuuugu

SEQ ID NO: 2178522 - RNA, 13 nt, Streptococcus pneumoniae R6
cugguauuuuuuc

SEQ ID NO: 2178523 - RNA, 16 nt, Streptococcus pneumoniae R6
cugguacuauuuaaug

SEQ ID NO: 2178524 - RNA, 18 nt, Streptococcus pneumoniae R6
cugguaggcauaaacagg

SEQ ID NO: 2178525 - RNA, 23 nt, Streptococcus pneumoniae R6
cugguaggcauaaacaggcucgg

SEQ ID NO: 2178526 - RNA, 17 nt, Streptococcus pneumoniae R6
cugguagcaacuaucug

SEQ ID NO: 2178527 - RNA, 20 nt, Streptococcus pneumoniae R6
cuguaccguccccuuuugga

SEQ ID NO: 2178528 - RNA, 18 nt, Streptococcus pneumoniae R6
cuguacauuagaauucag

SEQ ID NO: 2178529 - RNA, 12 nt, Streptococcus pneumoniae R6
cuguaauuucuu

SEQ ID NO: 2178530 - RNA, 20 nt, Streptococcus pneumoniae R6
cuguagucagcugucuuuuc

SEQ ID NO: 2178531 - RNA, 13 nt, Streptococcus pneumoniae R6
cuguaguggguug

SEQ ID NO: 2178532 - RNA, 19 nt, Streptococcus pneumoniae R6
cuguaguggguugaaaaaa

SEQ ID NO: 2178533 - RNA, 21 nt, Streptococcus pneumoniae R6
cuguaguggguugaaaaaaag

SEQ ID NO: 2178534 - RNA, 23 nt, Streptococcus pneumoniae R6
cuguaguggguugaaaaaaagcu

SEQ ID NO: 2178535 - RNA, 18 nt, Streptococcus pneumoniae R6
cuguaguggguugaaguc

SEQ ID NO: 2178536 - RNA, 18 nt, Streptococcus pneumoniae R6
cuguagggggcauauaaa

SEQ ID NO: 2178537 - RNA, 23 nt, Streptococcus pneumoniae R6
cuguaacccaaaagauagaugau

SEQ ID NO: 2178538 - RNA, 14 nt, Streptococcus pneumoniae R6
cuguauuuuuuuug

SEQ ID NO: 2178539 - RNA, 14 nt, Streptococcus pneumoniae R6
cugucguagucuag

SEQ ID NO: 2178540 - RNA, 16 nt, Streptococcus pneumoniae R6
cugucguagucuagga

SEQ ID NO: 2178541 - RNA, 16 nt, Streptococcus pneumoniae R6
cugucguaccuaaaaa

SEQ ID NO: 2178542 - RNA, 19 nt, Streptococcus pneumoniae R6
cugucggcaugcugacaaa

SEQ ID NO: 2178543 - RNA, 18 nt, Streptococcus pneumoniae R6
cugucgcaccugacucca

SEQ ID NO: 2178544 - RNA, 21 nt, Streptococcus pneumoniae R6
cugcuuuagauuguccucaau

SEQ ID NO: 2178545 - RNA, 18 nt, Streptococcus pneumoniae R6
cugcuugcaauucuuuuc

SEQ ID NO: 2178546 - RNA, 13 nt, Streptococcus pneumoniae R6
cugcuugcauuug

SEQ ID NO: 2178547 - RNA, 19 nt, Streptococcus pneumoniae R6
cugcuuugagaucuuuuuc

SEQ ID NO: 2178548 - RNA, 12 nt, Streptococcus pneumoniae R6
cugcuuuuucaa

SEQ ID NO: 2178549 - RNA, 16 nt, Streptococcus pneumoniae R6
cugcuuuuucaagcau

SEQ ID NO: 2178550 - RNA, 23 nt, Streptococcus pneumoniae R6
cugcuuuuucaagcauuuuuuug

SEQ ID NO: 2178551 - RNA, 12 nt, Streptococcus pneumoniae R6
cugcuauuucua

SEQ ID NO: 2178552 - RNA, 13 nt, Streptococcus pneumoniae R6
cugcuauuucuaa

SEQ ID NO: 2178553 - RNA, 20 nt, Streptococcus pneumoniae R6
cugcuauuaugcuaaagaaa

SEQ ID NO: 2178554 - RNA, 18 nt, Streptococcus pneumoniae R6
cugcucaaucuuaucaau

SEQ ID NO: 2178555 - RNA, 15 nt, Streptococcus pneumoniae R6
cugcuagacgaccau

SEQ ID NO: 2178556 - RNA, 13 nt, Streptococcus pneumoniae R6
cugcuauagucaa

SEQ ID NO: 2178557 - RNA, 23 nt, Streptococcus pneumoniae R6
cuggaacgggguccuuaccuguu

SEQ ID NO: 2178558 - RNA, 19 nt, Streptococcus pneumoniae R6
cuggaacaaaauaguucuc

SEQ ID NO: 2178559 - RNA, 22 nt, Streptococcus pneumoniae R6
cuggaacaaaauaguucucaac

SEQ ID NO: 2178560 - RNA, 20 nt, Streptococcus pneumoniae R6
cuggaaucagaacacuucca

SEQ ID NO: 2178561 - RNA, 19 nt, Streptococcus pneumoniae R6
cuggaauggcaaauucugu

SEQ ID NO: 2178562 - RNA, 17 nt, Streptococcus pneumoniae R6
cuggaauccacacuucc

SEQ ID NO: 2178563 - RNA, 22 nt, Streptococcus pneumoniae R6
cuggacaaaaacucaauuucag

SEQ ID NO: 2178564 - RNA, 20 nt, Streptococcus pneumoniae R6
cuggacguucuucaagagcu

SEQ ID NO: 2178565 - RNA, 15 nt, Streptococcus pneumoniae R6
cuggagauuuuucaa

SEQ ID NO: 2178566 - RNA, 22 nt, Streptococcus pneumoniae R6
cuggagcaggacuuggauaaga

SEQ ID NO: 2178567 - RNA, 20 nt, Streptococcus pneumoniae R6
cuggauaagcuugugaaagc

SEQ ID NO: 2178568 - RNA, 14 nt, Streptococcus pneumoniae R6
cuggaguucuuuuc

SEQ ID NO: 2178569 - RNA, 20 nt, Streptococcus pneumoniae R6
cuggauaacugaaauugaga

SEQ ID NO: 2178570 - RNA, 20 nt, Streptococcus pneumoniae R6
cuggauaauuucuuuaaucu

SEQ ID NO: 2178571 - RNA, 19 nt, Streptococcus pneumoniae R6
cuggaguagcauccccagu

SEQ ID NO: 2178572 - RNA, 13 nt, Streptococcus pneumoniae R6
cuggcaauuuauc

SEQ ID NO: 2178573 - RNA, 21 nt, Streptococcus pneumoniae R6
cuggcaauacuucaacaaaug

SEQ ID NO: 2178574 - RNA, 14 nt, Streptococcus pneumoniae R6
cuggcaagauuugu

SEQ ID NO: 2178575 - RNA, 13 nt, Streptococcus pneumoniae R6
cuggcauccccag

SEQ ID NO: 2178576 - RNA, 15 nt, Streptococcus pneumoniae R6
cuggcauuccugcuc

SEQ ID NO: 2178577 - RNA, 20 nt, Streptococcus pneumoniae R6
cuggcauuucccauugcaau

SEQ ID NO: 2178578 - RNA, 19 nt, Streptococcus pneumoniae R6
cuucuguugguugaauaua

SEQ ID NO: 2178579 - RNA, 22 nt, Streptococcus pneumoniae R6
cuucuguugucaaaaucaagcu

SEQ ID NO: 2178580 - RNA, 19 nt, Streptococcus pneumoniae R6
cuucuguucauucuucaca

SEQ ID NO: 2178581 - RNA, 14 nt, Streptococcus pneumoniae R6
cuucuggugcugga

SEQ ID NO: 2178582 - RNA, 20 nt, Streptococcus pneumoniae R6
cuucuggcacagaaacaccu

SEQ ID NO: 2178583 - RNA, 23 nt, Streptococcus pneumoniae R6
cuucugggauggucacagaacca

SEQ ID NO: 2178584 - RNA, 19 nt, Streptococcus pneumoniae R6
cuucugguuugugcucaau

SEQ ID NO: 2178585 - RNA, 23 nt, Streptococcus pneumoniae R6
cuucuguaagucauuuucuuuua

SEQ ID NO: 2178586 - RNA, 13 nt, Streptococcus pneumoniae R6
cuucuuggaauuc

SEQ ID NO: 2178587 - RNA, 23 nt, Streptococcus pneumoniae R6
cuucuugggcuggacguucuuca

SEQ ID NO: 2178588 - RNA, 19 nt, Streptococcus pneumoniae R6
cuucuugguuuuugccaug

SEQ ID NO: 2178589 - RNA, 22 nt, Streptococcus pneumoniae R6
cuucuugauacugaucaaaaaa

SEQ ID NO: 2178590 - RNA, 16 nt, Streptococcus pneumoniae R6
cuucuuccaucuucuc

SEQ ID NO: 2178591 - RNA, 21 nt, Streptococcus pneumoniae R6
cuucuucauggaucauuucuu

SEQ ID NO: 2178592 - RNA, 15 nt, Streptococcus pneumoniae R6
cuucugcucgcugga

SEQ ID NO: 2178593 - RNA, 14 nt, Streptococcus pneumoniae R6
cuucugcggauaaa

SEQ ID NO: 2178594 - RNA, 21 nt, Streptococcus pneumoniae R6
cuucugcuugcaucaaaucac

SEQ ID NO: 2178595 - RNA, 20 nt, Streptococcus pneumoniae R6
cuucugaaucugccucaaga

SEQ ID NO: 2178596 - RNA, 22 nt, Streptococcus pneumoniae R6
cuucugcaguugugucuucguc

SEQ ID NO: 2178597 - RNA, 12 nt, Streptococcus pneumoniae R6
cuucugcaauua

SEQ ID NO: 2178598 - RNA, 22 nt, Streptococcus pneumoniae R6
cuucugagguuaaaaucuuuua

SEQ ID NO: 2178599 - RNA, 19 nt, Streptococcus pneumoniae R6
cuucucgauucccugauuu

SEQ ID NO: 2178600 - RNA, 16 nt, Streptococcus pneumoniae R6
cuucucggacuuuuuc

SEQ ID NO: 2178601 - RNA, 23 nt, Streptococcus pneumoniae R6
cuucucggacuuuuuccaaaucu

SEQ ID NO: 2178602 - RNA, 22 nt, Streptococcus pneumoniae R6
cuugauaaggugggaagaguug

SEQ ID NO: 2178603 - RNA, 16 nt, Streptococcus pneumoniae R6
cuugauaaguucuuuu

SEQ ID NO: 2178604 - RNA, 18 nt, Streptococcus pneumoniae R6
cuugauaaguucuuuuug

SEQ ID NO: 2178605 - RNA, 12 nt, Streptococcus pneumoniae R6
cuugaugaaaga

SEQ ID NO: 2178606 - RNA, 18 nt, Streptococcus pneumoniae R6
cuugauagcguccaucuc

SEQ ID NO: 2178607 - RNA, 14 nt, Streptococcus pneumoniae R6
cuugauagcagaau

SEQ ID NO: 2178608 - RNA, 21 nt, Streptococcus pneumoniae R6
cuugagguuuuagauaagacu

SEQ ID NO: 2178609 - RNA, 13 nt, Streptococcus pneumoniae R6
cuugaguaauucu

SEQ ID NO: 2178610 - RNA, 20 nt, Streptococcus pneumoniae R6
cuugaggucccaugcuucca

SEQ ID NO: 2178611 - RNA, 12 nt, Streptococcus pneumoniae R6
cuugaugagugu

SEQ ID NO: 2178612 - RNA, 17 nt, Streptococcus pneumoniae R6
cuugaugucuuggauuu

SEQ ID NO: 2178613 - RNA, 21 nt, Streptococcus pneumoniae R6
cuugaugucuuggauuuuuga

SEQ ID NO: 2178614 - RNA, 21 nt, Streptococcus pneumoniae R6
cuugaaaauaccaaguucauu

SEQ ID NO: 2178615 - RNA, 12 nt, Streptococcus pneumoniae R6
cuugaaagacca

SEQ ID NO: 2178616 - RNA, 14 nt, Streptococcus pneumoniae R6
cuugaaacaaauaa

SEQ ID NO: 2178617 - RNA, 16 nt, Streptococcus pneumoniae R6
cuucuuuauguucauc

SEQ ID NO: 2178618 - RNA, 14 nt, Streptococcus pneumoniae R6
cuugaggaagagcu

SEQ ID NO: 2178619 - RNA, 15 nt, Streptococcus pneumoniae R6
cuugaaccuuucuuc

SEQ ID NO: 2178620 - RNA, 17 nt, Streptococcus pneumoniae R6
cuugaaauacuaaaaaa

SEQ ID NO: 2178621 - RNA, 22 nt, Streptococcus pneumoniae R6
cuugaaauaucuggacuuauau

SEQ ID NO: 2178622 - RNA, 21 nt, Streptococcus pneumoniae R6
cuugcgccaguuacccgaccu

SEQ ID NO: 2178623 - RNA, 22 nt, Streptococcus pneumoniae R6
cuugccugcuuuuucaagcauu

SEQ ID NO: 2178624 - RNA, 19 nt, Streptococcus pneumoniae R6
cuugcuuuugauggguucu

SEQ ID NO: 2178625 - RNA, 13 nt, Streptococcus pneumoniae R6
cuugcucuucauu

SEQ ID NO: 2178626 - RNA, 17 nt, Streptococcus pneumoniae R6
cuugcuccauucuuuua

SEQ ID NO: 2178627 - RNA, 14 nt, Streptococcus pneumoniae R6
cuugcucugucacu

SEQ ID NO: 2178628 - RNA, 16 nt, Streptococcus pneumoniae R6
cuugcuagauauuguu

SEQ ID NO: 2178629 - RNA, 16 nt, Streptococcus pneumoniae R6
cuugcguuucuucuuc

SEQ ID NO: 2178630 - RNA, 19 nt, Streptococcus pneumoniae R6
cuugcuaaaaaaagggauu

SEQ ID NO: 2178631 - RNA, 20 nt, Streptococcus pneumoniae R6
cuugcucaaaguacagauuu

SEQ ID NO: 2178632 - RNA, 21 nt, Streptococcus pneumoniae R6
cuugcucaaaguacagauuug

SEQ ID NO: 2178633 - RNA, 16 nt, Streptococcus pneumoniae R6
cuugcuaucgucaggc

SEQ ID NO: 2178634 - RNA, 16 nt, Streptococcus pneumoniae R6
cuuuaaaaauuuuuuu

SEQ ID NO: 2178635 - RNA, 21 nt, Streptococcus pneumoniae R6
cuuuaaaacuaaagcuuuuuu

SEQ ID NO: 2178636 - RNA, 16 nt, Streptococcus pneumoniae R6
cuuuaaaaucugaaaa

SEQ ID NO: 2178637 - RNA, 16 nt, Streptococcus pneumoniae R6
cuuuaaaaugaauucu

SEQ ID NO: 2178638 - RNA, 16 nt, Streptococcus pneumoniae R6
cuuuaaaauuauaaaa

SEQ ID NO: 2178639 - RNA, 20 nt, Streptococcus pneumoniae R6
cuuuaaacuuuucuaagaug

SEQ ID NO: 2178640 - RNA, 21 nt, Streptococcus pneumoniae R6
cuuuaaauccugcaaagauag

SEQ ID NO: 2178641 - RNA, 16 nt, Streptococcus pneumoniae R6
cuuguuuucuuaucuu

SEQ ID NO: 2178642 - RNA, 23 nt, Streptococcus pneumoniae R6
cuuguuuuaaaauguugggcaga

SEQ ID NO: 2178643 - RNA, 15 nt, Streptococcus pneumoniae R6
cuuguuuuuauauga

SEQ ID NO: 2178644 - RNA, 14 nt, Streptococcus pneumoniae R6
cuuguuucaauuga

SEQ ID NO: 2178645 - RNA, 16 nt, Streptococcus pneumoniae R6
cuuguuuccaaggaaa

SEQ ID NO: 2178646 - RNA, 17 nt, Streptococcus pneumoniae R6
cuuguuugagcucuuug

SEQ ID NO: 2178647 - RNA, 22 nt, Streptococcus pneumoniae R6
cuuguuucuaaaacauugugag

SEQ ID NO: 2178648 - RNA, 18 nt, Streptococcus pneumoniae R6
cuuguuuacguuuuaaaa

SEQ ID NO: 2178649 - RNA, 18 nt, Streptococcus pneumoniae R6
cuuguuuaaaaucucuuu

SEQ ID NO: 2178650 - RNA, 18 nt, Streptococcus pneumoniae R6
cuuguuuaagagcacaaa

SEQ ID NO: 2178651 - RNA, 15 nt, Streptococcus pneumoniae R6
cuuguucuucugcug

SEQ ID NO: 2178652 - RNA, 22 nt, Streptococcus pneumoniae R6
cuuguugaaugagcuuccagua

SEQ ID NO: 2178653 - RNA, 20 nt, Streptococcus pneumoniae R6
cuuguugagcauacugcccu

SEQ ID NO: 2178654 - RNA, 17 nt, Streptococcus pneumoniae R6
cuuguguuuuuccuuug

SEQ ID NO: 2178655 - RNA, 19 nt, Streptococcus pneumoniae R6
cuuguuagcugauuuuuua

SEQ ID NO: 2178656 - RNA, 19 nt, Streptococcus pneumoniae R6
cuuguuccaauuuguuuuc

SEQ ID NO: 2178657 - RNA, 13 nt, Streptococcus pneumoniae R6
cuuguucacuuuu

SEQ ID NO: 2178658 - RNA, 15 nt, Streptococcus pneumoniae R6
cuugugaauagcuca

SEQ ID NO: 2178659 - RNA, 20 nt, Streptococcus pneumoniae R6
cuugugauuuaguagcauca

SEQ ID NO: 2178660 - RNA, 14 nt, Streptococcus pneumoniae R6
cuuguccugaauga

SEQ ID NO: 2178661 - RNA, 15 nt, Streptococcus pneumoniae R6
cuugucuuuuucauc

SEQ ID NO: 2178662 - RNA, 19 nt, Streptococcus pneumoniae R6
cuugugcacacucagaacc

SEQ ID NO: 2178663 - RNA, 19 nt, Streptococcus pneumoniae R6
cuuguggagacagcaccaa

SEQ ID NO: 2178664 - RNA, 19 nt, Streptococcus pneumoniae R6
cuuggaccaggaucuuauc

SEQ ID NO: 2178665 - RNA, 16 nt, Streptococcus pneumoniae R6
cuuggaaaucuucugu

SEQ ID NO: 2178666 - RNA, 20 nt, Streptococcus pneumoniae R6
cuuggaauucuggauuuuuc

SEQ ID NO: 2178667 - RNA, 18 nt, Streptococcus pneumoniae R6
cuuguaaccgauauuucc

SEQ ID NO: 2178668 - RNA, 19 nt, Streptococcus pneumoniae R6
cuuguaaccgauauuuccu

SEQ ID NO: 2178669 - RNA, 20 nt, Streptococcus pneumoniae R6
cuuguaaagcgaaaggagaa

SEQ ID NO: 2178670 - RNA, 16 nt, Streptococcus pneumoniae R6
cuuggagaaacuccuu

SEQ ID NO: 2178671 - RNA, 15 nt, Streptococcus pneumoniae R6
cuuggagaaccuaga

SEQ ID NO: 2178672 - RNA, 20 nt, Streptococcus pneumoniae R6
cuuguaaugacaauuauaua

SEQ ID NO: 2178673 - RNA, 22 nt, Streptococcus pneumoniae R6
cuuguaaugacaauuauauaaa

SEQ ID NO: 2178674 - RNA, 23 nt, Streptococcus pneumoniae R6
cuuguaauaagcuuguuaccuga

SEQ ID NO: 2178675 - RNA, 21 nt, Streptococcus pneumoniae R6
cuuguaauagcaguugguugu

SEQ ID NO: 2178676 - RNA, 19 nt, Streptococcus pneumoniae R6
cuugucaugccagauggac

SEQ ID NO: 2178677 - RNA, 14 nt, Streptococcus pneumoniae R6
cuugucaucuucca

SEQ ID NO: 2178678 - RNA, 16 nt, Streptococcus pneumoniae R6
cuuguccguuuucauc

SEQ ID NO: 2178679 - RNA, 12 nt, Streptococcus pneumoniae R6
cuuuaucauuaa

SEQ ID NO: 2178680 - RNA, 23 nt, Streptococcus pneumoniae R6
cuuuauguucaucuucuuucucc

SEQ ID NO: 2178681 - RNA, 13 nt, Streptococcus pneumoniae R6
cuuuauuagcaua

SEQ ID NO: 2178682 - RNA, 16 nt, Streptococcus pneumoniae R6
cuuuaaucuugacuau

SEQ ID NO: 2178683 - RNA, 18 nt, Streptococcus pneumoniae R6
cuuuauaguggguugaag

SEQ ID NO: 2178684 - RNA, 20 nt, Streptococcus pneumoniae R6
cuuuauauaaaaagaccgga

SEQ ID NO: 2178685 - RNA, 11 nt, Streptococcus pneumoniae R6
cuuuaucaagc

SEQ ID NO: 2178686 - RNA, 15 nt, Streptococcus pneumoniae R6
cuuucgaagucugau

SEQ ID NO: 2178687 - RNA, 16 nt, Streptococcus pneumoniae R6
cuuuccuuaagucugu

SEQ ID NO: 2178688 - RNA, 22 nt, Streptococcus pneumoniae R6
cuuucucgagguuaacuccuuu

SEQ ID NO: 2178689 - RNA, 15 nt, Streptococcus pneumoniae R6
cuuucucaaacauug

SEQ ID NO: 2178690 - RNA, 16 nt, Streptococcus pneumoniae R6
cuuucucaaacauugu

SEQ ID NO: 2178691 - RNA, 22 nt, Streptococcus pneumoniae R6
cuuucucacgaauaaccaaaac

SEQ ID NO: 2178692 - RNA, 22 nt, Streptococcus pneumoniae R6
cuuucucacuuaauucuucaua

SEQ ID NO: 2178693 - RNA, 17 nt, Streptococcus pneumoniae R6
cuuucuaucuucauuuu

SEQ ID NO: 2178694 - RNA, 17 nt, Streptococcus pneumoniae R6
cuuucuaguuugcucuu

SEQ ID NO: 2178695 - RNA, 13 nt, Streptococcus pneumoniae R6
cuuucaucccuuc

SEQ ID NO: 2178696 - RNA, 15 nt, Streptococcus pneumoniae R6
cuuucauaaaguuuu

SEQ ID NO: 2178697 - RNA, 19 nt, Streptococcus pneumoniae R6
cuuucaguuucauaaucag

SEQ ID NO: 2178698 - RNA, 18 nt, Streptococcus pneumoniae R6
cuuuccuccgauaauuau

SEQ ID NO: 2178699 - RNA, 19 nt, Streptococcus pneumoniae R6
cuuuccuccgauaauuauu

SEQ ID NO: 2178700 - RNA, 16 nt, Streptococcus pneumoniae R6
cuuuccucgauuuguu

SEQ ID NO: 2178701 - RNA, 23 nt, Streptococcus pneumoniae R6
cuucauuuugcacaauauagccu

SEQ ID NO: 2178702 - RNA, 17 nt, Streptococcus pneumoniae R6
cuucauuuugguaauuu

SEQ ID NO: 2178703 - RNA, 21 nt, Streptococcus pneumoniae R6
cuucauuuugguaauuuucaa

SEQ ID NO: 2178704 - RNA, 15 nt, Streptococcus pneumoniae R6
cuucauuuagaacac

SEQ ID NO: 2178705 - RNA, 19 nt, Streptococcus pneumoniae R6
cuucauuuuugccuaaaau

SEQ ID NO: 2178706 - RNA, 14 nt, Streptococcus pneumoniae R6
cuucauuuuuuccu

SEQ ID NO: 2178707 - RNA, 24 nt, Streptococcus pneumoniae R6
cuuccaaaaauucuuacuaccuac

SEQ ID NO: 2178708 - RNA, 22 nt, Streptococcus pneumoniae R6
cuuccaaaauuaaaauguucug

SEQ ID NO: 2178709 - RNA, 16 nt, Streptococcus pneumoniae R6
cuucauguuucauauc

SEQ ID NO: 2178710 - RNA, 16 nt, Streptococcus pneumoniae R6
cuucauuauagaccuu

SEQ ID NO: 2178711 - RNA, 16 nt, Streptococcus pneumoniae R6
cuucauuuaucuucuu

SEQ ID NO: 2178712 - RNA, 17 nt, Streptococcus pneumoniae R6
cuucauucggucaugga

SEQ ID NO: 2178713 - RNA, 13 nt, Streptococcus pneumoniae R6
cuucauuauguga

SEQ ID NO: 2178714 - RNA, 14 nt, Streptococcus pneumoniae R6
cuuccgccaucuug

SEQ ID NO: 2178715 - RNA, 14 nt, Streptococcus pneumoniae R6
cuuccaucuucuca

SEQ ID NO: 2178716 - RNA, 17 nt, Streptococcus pneumoniae R6
cuucccaccauccucca

SEQ ID NO: 2178717 - RNA, 23 nt, Streptococcus pneumoniae R6
cuuccgaaacuagcauccauccc

SEQ ID NO: 2178718 - RNA, 19 nt, Streptococcus pneumoniae R6
cuuccgaauaacucaaaag

SEQ ID NO: 2178719 - RNA, 13 nt, Streptococcus pneumoniae R6
cuuccuccugcca

SEQ ID NO: 2178720 - RNA, 14 nt, Streptococcus pneumoniae R6
cuuccugcaaaacu

SEQ ID NO: 2178721 - RNA, 16 nt, Streptococcus pneumoniae R6
cuuccugcaaaacuag

SEQ ID NO: 2178722 - RNA, 23 nt, Streptococcus pneumoniae R6
cuuccugcaaaucuacuggcaaa

SEQ ID NO: 2178723 - RNA, 19 nt, Streptococcus pneumoniae R6
cuucaggauugauaaaauu

SEQ ID NO: 2178724 - RNA, 22 nt, Streptococcus pneumoniae R6
cuucauauacacuaaacaaaug

SEQ ID NO: 2178725 - RNA, 18 nt, Streptococcus pneumoniae R6
cuucaucaaaugacuaac

SEQ ID NO: 2178726 - RNA, 16 nt, Streptococcus pneumoniae R6
cuucaucaguuccagc

SEQ ID NO: 2178727 - RNA, 21 nt, Streptococcus pneumoniae R6
cuucaucauuuuauucauauc

SEQ ID NO: 2178728 - RNA, 13 nt, Streptococcus pneumoniae R6
cuucaugcuggca

SEQ ID NO: 2178729 - RNA, 21 nt, Streptococcus pneumoniae R6
cuucaugcuggcagaaacugu

SEQ ID NO: 2178730 - RNA, 21 nt, Streptococcus pneumoniae R6
cuucauggacuuuuuugcgaa

SEQ ID NO: 2178731 - RNA, 22 nt, Streptococcus pneumoniae R6
cuucauggaucauuucuucugg

SEQ ID NO: 2178732 - RNA, 23 nt, Streptococcus pneumoniae R6
cuucacuaguauucaucuuauca

SEQ ID NO: 2178733 - RNA, 21 nt, Streptococcus pneumoniae R6
cuucagauucagcuaaaaugu

SEQ ID NO: 2178734 - RNA, 18 nt, Streptococcus pneumoniae R6
cuucaccaaucaaaucaa

SEQ ID NO: 2178735 - RNA, 15 nt, Streptococcus pneumoniae R6
cuucagccuuauauu

SEQ ID NO: 2178736 - RNA, 21 nt, Streptococcus pneumoniae R6
cuuaucuggguuccagaugaa

SEQ ID NO: 2178737 - RNA, 19 nt, Streptococcus pneumoniae R6
cuuaucuguccucgcaaga

SEQ ID NO: 2178738 - RNA, 18 nt, Streptococcus pneumoniae R6
cuuaucuagggcauuaau

SEQ ID NO: 2178739 - RNA, 15 nt, Streptococcus pneumoniae R6
cuuaucuaaaaccuc

SEQ ID NO: 2178740 - RNA, 19 nt, Streptococcus pneumoniae R6
cuuaucuaaaaccucaagg

SEQ ID NO: 2178741 - RNA, 16 nt, Streptococcus pneumoniae R6
cuuaucuaagacugcu

SEQ ID NO: 2178742 - RNA, 18 nt, Streptococcus pneumoniae R6
cuuaucuaagacugcuug

SEQ ID NO: 2178743 - RNA, 18 nt, Streptococcus pneumoniae R6
cuuauuagucaagaguug

SEQ ID NO: 2178744 - RNA, 21 nt, Streptococcus pneumoniae R6
cuucaauuuguuuugggucug

SEQ ID NO: 2178745 - RNA, 23 nt, Streptococcus pneumoniae R6
cuucaauuuguuuugggucuguu

SEQ ID NO: 2178746 - RNA, 18 nt, Streptococcus pneumoniae R6
cuuagcaacuguuuuuuc

SEQ ID NO: 2178747 - RNA, 16 nt, Streptococcus pneumoniae R6
cuuagaucuagauuaa

SEQ ID NO: 2178748 - RNA, 20 nt, Streptococcus pneumoniae R6
cuuagauagauaaaggccaa

SEQ ID NO: 2178749 - RNA, 21 nt, Streptococcus pneumoniae R6
cuuacucuuauuauucucuau

SEQ ID NO: 2178750 - RNA, 12 nt, Streptococcus pneumoniae R6
cuuagcagacuu

SEQ ID NO: 2178751 - RNA, 13 nt, Streptococcus pneumoniae R6
cuuauaauauagg

SEQ ID NO: 2178752 - RNA, 21 nt, Streptococcus pneumoniae R6
cuuauaauauagggcuuuuuu

SEQ ID NO: 2178753 - RNA, 19 nt, Streptococcus pneumoniae R6
cuuauauuuaguacucugu

SEQ ID NO: 2178754 - RNA, 12 nt, Streptococcus pneumoniae R6
cuuauacuuuuc

SEQ ID NO: 2178755 - RNA, 19 nt, Streptococcus pneumoniae R6
cuuauagaaacaucuuauu

SEQ ID NO: 2178756 - RNA, 23 nt, Streptococcus pneumoniae R6
cuuaucaaaaucgauagccaacu

SEQ ID NO: 2178757 - RNA, 14 nt, Streptococcus pneumoniae R6
cuuauauuaaaaaa

SEQ ID NO: 2178758 - RNA, 20 nt, Streptococcus pneumoniae R6
cuuaucaaaucccuagcuca

SEQ ID NO: 2178759 - RNA, 15 nt, Streptococcus pneumoniae R6
cuuaucagaaaauaa

SEQ ID NO: 2178760 - RNA, 22 nt, Streptococcus pneumoniae R6
cuuaucacgaauuucuuguuca

SEQ ID NO: 2178761 - RNA, 21 nt, Streptococcus pneumoniae R6
cuuaucauuauccaugauaaa

SEQ ID NO: 2178762 - RNA, 19 nt, Streptococcus pneumoniae R6
cuuauccaauucuucagca

SEQ ID NO: 2178763 - RNA, 20 nt, Streptococcus pneumoniae R6
cuuaucaggcgugcgcucua

SEQ ID NO: 2178764 - RNA, 16 nt, Streptococcus pneumoniae R6
cuuauccacaucauca

SEQ ID NO: 2178765 - RNA, 18 nt, Streptococcus pneumoniae R6
cuuauccgaacccuguuu

SEQ ID NO: 2178766 - RNA, 17 nt, Streptococcus pneumoniae R6
cuuaauucucuuauugu

SEQ ID NO: 2178767 - RNA, 14 nt, Streptococcus pneumoniae R6
cuuaauucuucaua

SEQ ID NO: 2178768 - RNA, 16 nt, Streptococcus pneumoniae R6
cuuaauuguagcuuua

SEQ ID NO: 2178769 - RNA, 17 nt, Streptococcus pneumoniae R6
cuuaauuguagcuuuau

SEQ ID NO: 2178770 - RNA, 20 nt, Streptococcus pneumoniae R6
cuuaaauaggccucuucaaa

SEQ ID NO: 2178771 - RNA, 19 nt, Streptococcus pneumoniae R6
cuuaaagugggaacuagag

SEQ ID NO: 2178772 - RNA, 23 nt, Streptococcus pneumoniae R6
cuuaaagugggaacuagagaguu

SEQ ID NO: 2178773 - RNA, 13 nt, Streptococcus pneumoniae R6
cuuaaauaaaauu

SEQ ID NO: 2178774 - RNA, 18 nt, Streptococcus pneumoniae R6
cuuaaauaaaauuuuuuu

SEQ ID NO: 2178775 - RNA, 22 nt, Streptococcus pneumoniae R6
cuuaaauaaaauuuuuuucaaa

SEQ ID NO: 2178776 - RNA, 12 nt, Streptococcus pneumoniae R6
cuuaaaguuauu

SEQ ID NO: 2178777 - RNA, 16 nt, Streptococcus pneumoniae R6
cuuacguucauccaua

SEQ ID NO: 2178778 - RNA, 13 nt, Streptococcus pneumoniae R6
cuuacguuccaag

SEQ ID NO: 2178779 - RNA, 22 nt, Streptococcus pneumoniae R6
cuuacguuccaagauuggaucu

SEQ ID NO: 2178780 - RNA, 14 nt, Streptococcus pneumoniae R6
cuuacggucaaagu

SEQ ID NO: 2178781 - RNA, 21 nt, Streptococcus pneumoniae R6
cuuacggaucuagcugagaca

SEQ ID NO: 2178782 - RNA, 18 nt, Streptococcus pneumoniae R6
cuguuggauauaaggauu

SEQ ID NO: 2178783 - RNA, 14 nt, Streptococcus pneumoniae R6
cuguugauauuucc

SEQ ID NO: 2178784 - RNA, 16 nt, Streptococcus pneumoniae R6
cuguucuuguuucaau

SEQ ID NO: 2178785 - RNA, 12 nt, Streptococcus pneumoniae R6
cuguucuuuuuu

SEQ ID NO: 2178786 - RNA, 14 nt, Streptococcus pneumoniae R6
cuguucuauaaaau

SEQ ID NO: 2178787 - RNA, 15 nt, Streptococcus pneumoniae R6
cugucucaggucuag

SEQ ID NO: 2178788 - RNA, 18 nt, Streptococcus pneumoniae R6
cugucucaggucuagcaa

SEQ ID NO: 2178789 - RNA, 16 nt, Streptococcus pneumoniae R6
cugucuaguguuguca

SEQ ID NO: 2178790 - RNA, 15 nt, Streptococcus pneumoniae R6
cugucugcugacuga

SEQ ID NO: 2178791 - RNA, 17 nt, Streptococcus pneumoniae R6
cuguuugaaucaauucu

SEQ ID NO: 2178792 - RNA, 18 nt, Streptococcus pneumoniae R6
cuguuuggccaagguuca

SEQ ID NO: 2178793 - RNA, 21 nt, Streptococcus pneumoniae R6
cuguuuucuuggucauuugag

SEQ ID NO: 2178794 - RNA, 17 nt, Streptococcus pneumoniae R6
cuguuuuguugacuugu

SEQ ID NO: 2178795 - RNA, 16 nt, Streptococcus pneumoniae R6
cuguuuucaaaaagca

SEQ ID NO: 2178796 - RNA, 12 nt, Streptococcus pneumoniae R6
cuguuuuccuuu

SEQ ID NO: 2178797 - RNA, 14 nt, Streptococcus pneumoniae R6
cuguuuauuuuuua

SEQ ID NO: 2178798 - RNA, 14 nt, Streptococcus pneumoniae R6
cuguuucaaaugaa

SEQ ID NO: 2178799 - RNA, 19 nt, Streptococcus pneumoniae R6
cuguuucaaaugaaauauu

SEQ ID NO: 2178800 - RNA, 16 nt, Streptococcus pneumoniae R6
cuguuuccgugugaga

SEQ ID NO: 2178801 - RNA, 15 nt, Streptococcus pneumoniae R6
cuguuucgucuucca

SEQ ID NO: 2178802 - RNA, 23 nt, Streptococcus pneumoniae R6
cuguuucgucuuccauuucuuug

SEQ ID NO: 2178803 - RNA, 14 nt, Streptococcus pneumoniae R6
cuuaaaaaagucca

SEQ ID NO: 2178804 - RNA, 15 nt, Streptococcus pneumoniae R6
cuuaaaaaaguccaa

SEQ ID NO: 2178805 - RNA, 14 nt, Streptococcus pneumoniae R6
cuuaaaacaguguu

SEQ ID NO: 2178806 - RNA, 20 nt, Streptococcus pneumoniae R6
cuuaaaacaguguuuugagc

SEQ ID NO: 2178807 - RNA, 15 nt, Streptococcus pneumoniae R6
cuguuuuuucuuauc

SEQ ID NO: 2178808 - RNA, 20 nt, Streptococcus pneumoniae R6
cuguuuuuucuuaucuugau

SEQ ID NO: 2178809 - RNA, 14 nt, Streptococcus pneumoniae R6
cuuaaaaaaccaau

SEQ ID NO: 2178810 - RNA, 12 nt, Streptococcus pneumoniae R6
cuguuuuuucaa

SEQ ID NO: 2178811 - RNA, 18 nt, Streptococcus pneumoniae R6
cuguuuuuggauuuuguu

SEQ ID NO: 2178812 - RNA, 17 nt, Streptococcus pneumoniae R6
cuguuuuugaagaaaag

SEQ ID NO: 2178813 - RNA, 19 nt, Streptococcus pneumoniae R6
cuuaaacgacuagauaaaa

SEQ ID NO: 2178814 - RNA, 20 nt, Streptococcus pneumoniae R6
cuuaaacgugcuauaucaaa

SEQ ID NO: 2178815 - RNA, 17 nt, Streptococcus pneumoniae R6
cuuaaaauuguuucaug

SEQ ID NO: 2178816 - RNA, 14 nt, Streptococcus pneumoniae R6
cuuaaaauccaguc

SEQ ID NO: 2178817 - RNA, 20 nt, Streptococcus pneumoniae R6
cuuaaaauccagucccuuuu

SEQ ID NO: 2178818 - RNA, 19 nt, Streptococcus pneumoniae R6
cuuaaaagcaaaagaacaa

SEQ ID NO: 2178819 - RNA, 20 nt, Streptococcus pneumoniae R6
cuuaaaagcucgauacucua

SEQ ID NO: 2178820 - RNA, 14 nt, Streptococcus pneumoniae R6
gaauaguguaguug

SEQ ID NO: 2178821 - RNA, 14 nt, Streptococcus pneumoniae R6
gaauagguaguuca

SEQ ID NO: 2178822 - RNA, 19 nt, Streptococcus pneumoniae R6
gaauaggcauccgugauuu

SEQ ID NO: 2178823 - RNA, 13 nt, Streptococcus pneumoniae R6
gaauaguauaagg

SEQ ID NO: 2178824 - RNA, 20 nt, Streptococcus pneumoniae R6
gaauaguaucugaugcugac

SEQ ID NO: 2178825 - RNA, 18 nt, Streptococcus pneumoniae R6
gaauaggacaucauaacu

SEQ ID NO: 2178826 - RNA, 15 nt, Streptococcus pneumoniae R6
gaauaggauaauauu

SEQ ID NO: 2178827 - RNA, 13 nt, Streptococcus pneumoniae R6
gaauagaaacaaa

SEQ ID NO: 2178828 - RNA, 19 nt, Streptococcus pneumoniae R6
gaauagaaacaaaauauau

SEQ ID NO: 2178829 - RNA, 20 nt, Streptococcus pneumoniae R6
gaauagaaaguauagucaau

SEQ ID NO: 2178830 - RNA, 13 nt, Streptococcus pneumoniae R6
gaauagcucaaaa

SEQ ID NO: 2178831 - RNA, 19 nt, Streptococcus pneumoniae R6
gaauagcccacugugauuu

SEQ ID NO: 2178832 - RNA, 18 nt, Streptococcus pneumoniae R6
gaauauuaguaaauagaa

SEQ ID NO: 2178833 - RNA, 15 nt, Streptococcus pneumoniae R6
gaauauguauuucau

SEQ ID NO: 2178834 - RNA, 13 nt, Streptococcus pneumoniae R6
gaauauagaggau

SEQ ID NO: 2178835 - RNA, 13 nt, Streptococcus pneumoniae R6
gaauauauuucuc

SEQ ID NO: 2178836 - RNA, 21 nt, Streptococcus pneumoniae R6
gaauauauucuccagcuauua

SEQ ID NO: 2178837 - RNA, 21 nt, Streptococcus pneumoniae R6
gaauaccauacagaaucuuca

SEQ ID NO: 2178838 - RNA, 14 nt, Streptococcus pneumoniae R6
gaauaauuaaauca

SEQ ID NO: 2178839 - RNA, 15 nt, Streptococcus pneumoniae R6
gaauaauuaaaucau

SEQ ID NO: 2178840 - RNA, 13 nt, Streptococcus pneumoniae R6
gaauaaugcccau

SEQ ID NO: 2178841 - RNA, 16 nt, Streptococcus pneumoniae R6
gaauacaaaaaucuaa

SEQ ID NO: 2178842 - RNA, 23 nt, Streptococcus pneumoniae R6
gaauacucuuucaguuucauuca

SEQ ID NO: 2178843 - RNA, 17 nt, Streptococcus pneumoniae R6
gaauaccugaaaccauu

SEQ ID NO: 2178844 - RNA, 17 nt, Streptococcus pneumoniae R6
gaauaacagccaucaga

SEQ ID NO: 2178845 - RNA, 23 nt, Streptococcus pneumoniae R6
gaauaaauccagcugagauaccu

SEQ ID NO: 2178846 - RNA, 12 nt, Streptococcus pneumoniae R6
gaauaaauagau

SEQ ID NO: 2178847 - RNA, 20 nt, Streptococcus pneumoniae R6
gaauaacucaaaagcuuguu

SEQ ID NO: 2178848 - RNA, 16 nt, Streptococcus pneumoniae R6
gaauaagguaauugaa

SEQ ID NO: 2178849 - RNA, 20 nt, Streptococcus pneumoniae R6
gaaggcuuuaccaaaaaugu

SEQ ID NO: 2178850 - RNA, 22 nt, Streptococcus pneumoniae R6
gaagggcuuuucuaucacucca

SEQ ID NO: 2178851 - RNA, 14 nt, Streptococcus pneumoniae R6
gaaggggcaacucu

SEQ ID NO: 2178852 - RNA, 21 nt, Streptococcus pneumoniae R6
gaaguaauuccuacuucaaau

SEQ ID NO: 2178853 - RNA, 17 nt, Streptococcus pneumoniae R6
gaaguaaaucuucccau

SEQ ID NO: 2178854 - RNA, 18 nt, Streptococcus pneumoniae R6
gaaguaccaaggaagaag

SEQ ID NO: 2178855 - RNA, 23 nt, Streptococcus pneumoniae R6
gaagucaccauaaaucuugaugu

SEQ ID NO: 2178856 - RNA, 19 nt, Streptococcus pneumoniae R6
gaagguuauaccaaaaaaa

SEQ ID NO: 2178857 - RNA, 22 nt, Streptococcus pneumoniae R6
gaagguuucauguggugcuucu

SEQ ID NO: 2178858 - RNA, 12 nt, Streptococcus pneumoniae R6
gaagguuuuuga

SEQ ID NO: 2178859 - RNA, 17 nt, Streptococcus pneumoniae R6
gaaggugguuugaaaau

SEQ ID NO: 2178860 - RNA, 21 nt, Streptococcus pneumoniae R6
gaagguauggccgauaacagc

SEQ ID NO: 2178861 - RNA, 15 nt, Streptococcus pneumoniae R6
gaaggucaagagaaa

SEQ ID NO: 2178862 - RNA, 16 nt, Streptococcus pneumoniae R6
gaaggucaagagaaaa

SEQ ID NO: 2178863 - RNA, 22 nt, Streptococcus pneumoniae R6
gaaggucuuucaagcgaacauc

SEQ ID NO: 2178864 - RNA, 16 nt, Streptococcus pneumoniae R6
gaaggucuuuugucuu

SEQ ID NO: 2178865 - RNA, 17 nt, Streptococcus pneumoniae R6
gaaguuuagauuaaaaa

SEQ ID NO: 2178866 - RNA, 16 nt, Streptococcus pneumoniae R6
gaaguuuaucuugauu

SEQ ID NO: 2178867 - RNA, 15 nt, Streptococcus pneumoniae R6
gaaguuguucuugaa

SEQ ID NO: 2178868 - RNA, 16 nt, Streptococcus pneumoniae R6
gaaguuggaauagucc

SEQ ID NO: 2178869 - RNA, 13 nt, Streptococcus pneumoniae R6
gaaguuggccaac

SEQ ID NO: 2178870 - RNA, 19 nt, Streptococcus pneumoniae R6
gaaguuggccaacuaacca

SEQ ID NO: 2178871 - RNA, 18 nt, Streptococcus pneumoniae R6
gaaguucaguagauuaaa

SEQ ID NO: 2178872 - RNA, 15 nt, Streptococcus pneumoniae R6
gaaguucauuuucuu

SEQ ID NO: 2178873 - RNA, 20 nt, Streptococcus pneumoniae R6
gaagugaaaaagcaagagcu

SEQ ID NO: 2178874 - RNA, 17 nt, Streptococcus pneumoniae R6
gaagucuuguuugagaa

SEQ ID NO: 2178875 - RNA, 16 nt, Streptococcus pneumoniae R6
gaagucuguuauuucu

SEQ ID NO: 2178876 - RNA, 14 nt, Streptococcus pneumoniae R6
gaaguggauuuucu

SEQ ID NO: 2178877 - RNA, 14 nt, Streptococcus pneumoniae R6
gaagugggagaaaa

SEQ ID NO: 2178878 - RNA, 21 nt, Streptococcus pneumoniae R6
gaaguccauagcgucaaagaa

SEQ ID NO: 2178879 - RNA, 16 nt, Streptococcus pneumoniae R6
gaaguccaagcccagu

SEQ ID NO: 2178880 - RNA, 15 nt, Streptococcus pneumoniae R6
gaagucagcuaagcu

SEQ ID NO: 2178881 - RNA, 16 nt, Streptococcus pneumoniae R6
gaagucagcucaaaac

SEQ ID NO: 2178882 - RNA, 22 nt, Streptococcus pneumoniae R6
gaagucagucacauauauaauc

SEQ ID NO: 2178883 - RNA, 16 nt, Streptococcus pneumoniae R6
gaagucgaguuuuuuc

SEQ ID NO: 2178884 - RNA, 20 nt, Streptococcus pneumoniae R6
gaaucgacgcuuucuaagga

SEQ ID NO: 2178885 - RNA, 20 nt, Streptococcus pneumoniae R6
gaauccuaguucaugauuga

SEQ ID NO: 2178886 - RNA, 21 nt, Streptococcus pneumoniae R6
gaauccgcacugucguuccuu

SEQ ID NO: 2178887 - RNA, 22 nt, Streptococcus pneumoniae R6
gaaucccagauaaagcugauuu

SEQ ID NO: 2178888 - RNA, 12 nt, Streptococcus pneumoniae R6
gaaucccaagau

SEQ ID NO: 2178889 - RNA, 12 nt, Streptococcus pneumoniae R6
gaaucccaaaga

SEQ ID NO: 2178890 - RNA, 17 nt, Streptococcus pneumoniae R6
gaaucagauuuuagaac

SEQ ID NO: 2178891 - RNA, 14 nt, Streptococcus pneumoniae R6
gaaucaaucuucaa

SEQ ID NO: 2178892 - RNA, 21 nt, Streptococcus pneumoniae R6
gaaucaacaugagaauacaaa

SEQ ID NO: 2178893 - RNA, 14 nt, Streptococcus pneumoniae R6
gaaucauguaguug

SEQ ID NO: 2178894 - RNA, 14 nt, Streptococcus pneumoniae R6
gaaucauuuccuuc

SEQ ID NO: 2178895 - RNA, 22 nt, Streptococcus pneumoniae R6
gaaucauaggcauaguaccagu

SEQ ID NO: 2178896 - RNA, 17 nt, Streptococcus pneumoniae R6
gaaucuccucaggaacu

SEQ ID NO: 2178897 - RNA, 11 nt, Streptococcus pneumoniae R6
gaaucuggcuu

SEQ ID NO: 2178898 - RNA, 13 nt, Streptococcus pneumoniae R6
gaaugaaauauag

SEQ ID NO: 2178899 - RNA, 12 nt, Streptococcus pneumoniae R6
gaaugaauugcc

SEQ ID NO: 2178900 - RNA, 19 nt, Streptococcus pneumoniae R6
gaaugauauuuucaaaaaa

SEQ ID NO: 2178901 - RNA, 20 nt, Streptococcus pneumoniae R6
gaaugauauuuucaaaaaaa

SEQ ID NO: 2178902 - RNA, 16 nt, Streptococcus pneumoniae R6
gaaugaguucaaagcu

SEQ ID NO: 2178903 - RNA, 13 nt, Streptococcus pneumoniae R6
gaaugauuucucu

SEQ ID NO: 2178904 - RNA, 20 nt, Streptococcus pneumoniae R6
gaaugauuucucuugcaaua

SEQ ID NO: 2178905 - RNA, 22 nt, Streptococcus pneumoniae R6
gaaugauuucuucuuggucugu

SEQ ID NO: 2178906 - RNA, 22 nt, Streptococcus pneumoniae R6
gaaugacuaacccuucuuuuua

SEQ ID NO: 2178907 - RNA, 23 nt, Streptococcus pneumoniae R6
gaaugacuacauuuuuugaaaua

SEQ ID NO: 2178908 - RNA, 18 nt, Streptococcus pneumoniae R6
gaauggccuccuucauua

SEQ ID NO: 2178909 - RNA, 19 nt, Streptococcus pneumoniae R6
gaauguccauaacugcugc

SEQ ID NO: 2178910 - RNA, 18 nt, Streptococcus pneumoniae R6
gaauguggauacuguauu

SEQ ID NO: 2178911 - RNA, 15 nt, Streptococcus pneumoniae R6
gaaugccaaaauucc

SEQ ID NO: 2178912 - RNA, 23 nt, Streptococcus pneumoniae R6
gaaugccuccaagaaagagaaua

SEQ ID NO: 2178913 - RNA, 14 nt, Streptococcus pneumoniae R6
gaaugcucccuucu

SEQ ID NO: 2178914 - RNA, 22 nt, Streptococcus pneumoniae R6
gaaugcuuacuucacuucugua

SEQ ID NO: 2178915 - RNA, 23 nt, Streptococcus pneumoniae R6
gaauggauuuaucaguauauuga

SEQ ID NO: 2178916 - RNA, 14 nt, Streptococcus pneumoniae R6
gaauggccgcagca

SEQ ID NO: 2178917 - RNA, 21 nt, Streptococcus pneumoniae R6
gaaugcuuuuugaaagcagau

SEQ ID NO: 2178918 - RNA, 22 nt, Streptococcus pneumoniae R6
gaauugccugauaacgaagagc

SEQ ID NO: 2178919 - RNA, 19 nt, Streptococcus pneumoniae R6
gaauugauuuaccuuccuc

SEQ ID NO: 2178920 - RNA, 19 nt, Streptococcus pneumoniae R6
gaauucuaaacauuugauu

SEQ ID NO: 2178921 - RNA, 16 nt, Streptococcus pneumoniae R6
gaauucuccaaucaaa

SEQ ID NO: 2178922 - RNA, 15 nt, Streptococcus pneumoniae R6
gaauugaaauaagau

SEQ ID NO: 2178923 - RNA, 13 nt, Streptococcus pneumoniae R6
gaauucuggauuu

SEQ ID NO: 2178924 - RNA, 18 nt, Streptococcus pneumoniae R6
gaauuuaaaaaucuauuu

SEQ ID NO: 2178925 - RNA, 19 nt, Streptococcus pneumoniae R6
gaauuguaggacuuccuuu

SEQ ID NO: 2178926 - RNA, 16 nt, Streptococcus pneumoniae R6
gaauucccuuacucuc

SEQ ID NO: 2178927 - RNA, 14 nt, Streptococcus pneumoniae R6
gaauuauuuccuug

SEQ ID NO: 2178928 - RNA, 18 nt, Streptococcus pneumoniae R6
gaauucaagcaaaacaaa

SEQ ID NO: 2178929 - RNA, 21 nt, Streptococcus pneumoniae R6
gaauucaauugcaggagaaaa

SEQ ID NO: 2178930 - RNA, 22 nt, Streptococcus pneumoniae R6
gaauucaauugcaggagaaaau

SEQ ID NO: 2178931 - RNA, 19 nt, Streptococcus pneumoniae R6
gaauuaagauaaaacuaaa

SEQ ID NO: 2178932 - RNA, 18 nt, Streptococcus pneumoniae R6
gaauuaauggcagugcuu

SEQ ID NO: 2178933 - RNA, 16 nt, Streptococcus pneumoniae R6
gaauuagguugaccau

SEQ ID NO: 2178934 - RNA, 15 nt, Streptococcus pneumoniae R6
gaauuacaugaaacu

SEQ ID NO: 2178935 - RNA, 17 nt, Streptococcus pneumoniae R6
gaaccacacuuucauug

SEQ ID NO: 2178936 - RNA, 18 nt, Streptococcus pneumoniae R6
gaacccccaugacuucgu

SEQ ID NO: 2178937 - RNA, 16 nt, Streptococcus pneumoniae R6
gaaccccaacuuacau

SEQ ID NO: 2178938 - RNA, 17 nt, Streptococcus pneumoniae R6
gaacccuuauuuccugc

SEQ ID NO: 2178939 - RNA, 20 nt, Streptococcus pneumoniae R6
gaacccgcgcaauuaagcag

SEQ ID NO: 2178940 - RNA, 21 nt, Streptococcus pneumoniae R6
gaacccuuuuuggauaaguuu

SEQ ID NO: 2178941 - RNA, 16 nt, Streptococcus pneumoniae R6
gaacgauguuugcagc

SEQ ID NO: 2178942 - RNA, 18 nt, Streptococcus pneumoniae R6
gaacgccuuaaaaaacca

SEQ ID NO: 2178943 - RNA, 23 nt, Streptococcus pneumoniae R6
gaaccucuguauaaauagcuaca

SEQ ID NO: 2178944 - RNA, 16 nt, Streptococcus pneumoniae R6
gaaccugaaaaaauaa

SEQ ID NO: 2178945 - RNA, 15 nt, Streptococcus pneumoniae R6
gaaccuacuguuaga

SEQ ID NO: 2178946 - RNA, 12 nt, Streptococcus pneumoniae R6
gaaccuuucuuc

SEQ ID NO: 2178947 - RNA, 23 nt, Streptococcus pneumoniae R6
gaacgucuaaacuguacaagaac

SEQ ID NO: 2178948 - RNA, 15 nt, Streptococcus pneumoniae R6
gaacguuuuuaaauc

SEQ ID NO: 2178949 - RNA, 17 nt, Streptococcus pneumoniae R6
gaacguuuuuaaaucca

SEQ ID NO: 2178950 - RNA, 16 nt, Streptococcus pneumoniae R6
gaacuauaaaaucuga

SEQ ID NO: 2178951 - RNA, 21 nt, Streptococcus pneumoniae R6
gaacuagcuaacugcuucacu

SEQ ID NO: 2178952 - RNA, 15 nt, Streptococcus pneumoniae R6
gaacuaguaaauugu

SEQ ID NO: 2178953 - RNA, 15 nt, Streptococcus pneumoniae R6
gaacuauuuuauccc

SEQ ID NO: 2178954 - RNA, 17 nt, Streptococcus pneumoniae R6
gaacuauuuuauuuuuu

SEQ ID NO: 2178955 - RNA, 19 nt, Streptococcus pneumoniae R6
gaacuagagaagccaagag

SEQ ID NO: 2178956 - RNA, 23 nt, Streptococcus pneumoniae R6
gaacugcuaccaauucaguaacu

SEQ ID NO: 2178957 - RNA, 22 nt, Streptococcus pneumoniae R6
gaacuuccacuuccagaagaua

SEQ ID NO: 2178958 - RNA, 15 nt, Streptococcus pneumoniae R6
gaacuguaaauuuau

SEQ ID NO: 2178959 - RNA, 17 nt, Streptococcus pneumoniae R6
gaacuguaaauuuauug

SEQ ID NO: 2178960 - RNA, 18 nt, Streptococcus pneumoniae R6
gaacugggugcguacagc

SEQ ID NO: 2178961 - RNA, 18 nt, Streptococcus pneumoniae R6
gaacucuuuccaacucug

SEQ ID NO: 2178962 - RNA, 17 nt, Streptococcus pneumoniae R6
gaacugacgaagucagc

SEQ ID NO: 2178963 - RNA, 17 nt, Streptococcus pneumoniae R6
gaacugacgaagucagu

SEQ ID NO: 2178964 - RNA, 19 nt, Streptococcus pneumoniae R6
gaacuccagauuaucuucc

SEQ ID NO: 2178965 - RNA, 22 nt, Streptococcus pneumoniae R6
gaacuccuuaaauuuuauacaa

SEQ ID NO: 2178966 - RNA, 23 nt, Streptococcus pneumoniae R6
gaagcuuccaauaauagaaaaca

SEQ ID NO: 2178967 - RNA, 14 nt, Streptococcus pneumoniae R6
gaagcuuuaccauc

SEQ ID NO: 2178968 - RNA, 18 nt, Streptococcus pneumoniae R6
gaaggagccagcugaaaa

SEQ ID NO: 2178969 - RNA, 13 nt, Streptococcus pneumoniae R6
gaaggaguugagc

SEQ ID NO: 2178970 - RNA, 15 nt, Streptococcus pneumoniae R6
gaaggaguuucaccu

SEQ ID NO: 2178971 - RNA, 16 nt, Streptococcus pneumoniae R6
gaaggaguuucaccuu

SEQ ID NO: 2178972 - RNA, 23 nt, Streptococcus pneumoniae R6
gaaggaguuucaccuugccaucu

SEQ ID NO: 2178973 - RNA, 16 nt, Streptococcus pneumoniae R6
gaaggauugagaagcc

SEQ ID NO: 2178974 - RNA, 19 nt, Streptococcus pneumoniae R6
gaagcguuuacgaugauuu

SEQ ID NO: 2178975 - RNA, 19 nt, Streptococcus pneumoniae R6
gaagcguucaaucagauag

SEQ ID NO: 2178976 - RNA, 22 nt, Streptococcus pneumoniae R6
gaagcugucuuuaguagucuaa

SEQ ID NO: 2178977 - RNA, 14 nt, Streptococcus pneumoniae R6
gaagcugagcucuu

SEQ ID NO: 2178978 - RNA, 22 nt, Streptococcus pneumoniae R6
gaagccuuguuuccaaggaaag

SEQ ID NO: 2178979 - RNA, 22 nt, Streptococcus pneumoniae R6
gaagcaucaaauccuucagcuu

SEQ ID NO: 2178980 - RNA, 21 nt, Streptococcus pneumoniae R6
gaagccaaaaucaugacaauc

SEQ ID NO: 2178981 - RNA, 13 nt, Streptococcus pneumoniae R6
gaagccaaucaaa

SEQ ID NO: 2178982 - RNA, 13 nt, Streptococcus pneumoniae R6
gaagccaccgcca

SEQ ID NO: 2178983 - RNA, 20 nt, Streptococcus pneumoniae R6
gaagcacacaaaucuucugu

SEQ ID NO: 2178984 - RNA, 15 nt, Streptococcus pneumoniae R6
gaagcaagugacaaa

SEQ ID NO: 2178985 - RNA, 16 nt, Streptococcus pneumoniae R6
gaagcacaugccuucu

SEQ ID NO: 2178986 - RNA, 18 nt, Streptococcus pneumoniae R6
gaagcaaaucaacuggca

SEQ ID NO: 2178987 - RNA, 17 nt, Streptococcus pneumoniae R6
gaagcaaacauucccac

SEQ ID NO: 2178988 - RNA, 15 nt, Streptococcus pneumoniae R6
gaagauuucuuucau

SEQ ID NO: 2178989 - RNA, 16 nt, Streptococcus pneumoniae R6
gaagauuuccugauuu

SEQ ID NO: 2178990 - RNA, 15 nt, Streptococcus pneumoniae R6
gaagauuuaguucug

SEQ ID NO: 2178991 - RNA, 18 nt, Streptococcus pneumoniae R6
gaagauguaaaaguuuau

SEQ ID NO: 2178992 - RNA, 23 nt, Streptococcus pneumoniae R6
gaagauuuacuucuuuuucuccu

SEQ ID NO: 2178993 - RNA, 21 nt, Streptococcus pneumoniae R6
gaagauacugaaucaaaaaga

SEQ ID NO: 2178994 - RNA, 21 nt, Streptococcus pneumoniae R6
gaagaguugggucuggauacu

SEQ ID NO: 2178995 - RNA, 19 nt, Streptococcus pneumoniae R6
gaagagauuuuugaagagu

SEQ ID NO: 2178996 - RNA, 20 nt, Streptococcus pneumoniae R6
gaagagagcuccaaauggca

SEQ ID NO: 2178997 - RNA, 12 nt, Streptococcus pneumoniae R6
gaagagcuucuu

SEQ ID NO: 2178998 - RNA, 12 nt, Streptococcus pneumoniae R6
gaagagggcuuc

SEQ ID NO: 2178999 - RNA, 18 nt, Streptococcus pneumoniae R6
gaagaauuuaaaaaucua

SEQ ID NO: 2179000 - RNA, 21 nt, Streptococcus pneumoniae R6
gaagacgccuaguacauugaa

SEQ ID NO: 2179001 - RNA, 23 nt, Streptococcus pneumoniae R6
gaagaccacgaugaugauuggaa

SEQ ID NO: 2179002 - RNA, 21 nt, Streptococcus pneumoniae R6
gaagacuggaguucaccagua

SEQ ID NO: 2179003 - RNA, 16 nt, Streptococcus pneumoniae R6
gaagacuuuaaaaauu

SEQ ID NO: 2179004 - RNA, 10 nt, Streptococcus pneumoniae R6
gaagaaagcg

SEQ ID NO: 2179005 - RNA, 17 nt, Streptococcus pneumoniae R6
gaagaagcuguaaaucu

SEQ ID NO: 2179006 - RNA, 12 nt, Streptococcus pneumoniae R6
gaagaaggaaga

SEQ ID NO: 2179007 - RNA, 15 nt, Streptococcus pneumoniae R6
gaagaaggaagaguc

SEQ ID NO: 2179008 - RNA, 14 nt, Streptococcus pneumoniae R6
gaagaaaagcuaag

SEQ ID NO: 2179009 - RNA, 16 nt, Streptococcus pneumoniae R6
gaagaaaagcuaagcu

SEQ ID NO: 2179010 - RNA, 20 nt, Streptococcus pneumoniae R6
gaacuugaccuaaaucacuu

SEQ ID NO: 2179011 - RNA, 17 nt, Streptococcus pneumoniae R6
gaaaucucuuuuuucuc

SEQ ID NO: 2179012 - RNA, 14 nt, Streptococcus pneumoniae R6
gaaaucugaaaaau

SEQ ID NO: 2179013 - RNA, 16 nt, Streptococcus pneumoniae R6
gaaaucguuucuaaua

SEQ ID NO: 2179014 - RNA, 21 nt, Streptococcus pneumoniae R6
gaaaucaaggcagugaauuua

SEQ ID NO: 2179015 - RNA, 12 nt, Streptococcus pneumoniae R6
gaaauauuuuuu

SEQ ID NO: 2179016 - RNA, 14 nt, Streptococcus pneumoniae R6
gaaaucagaaaaaa

SEQ ID NO: 2179017 - RNA, 16 nt, Streptococcus pneumoniae R6
gaaaucccauaguagu

SEQ ID NO: 2179018 - RNA, 16 nt, Streptococcus pneumoniae R6
gaaaucccuacaagga

SEQ ID NO: 2179019 - RNA, 14 nt, Streptococcus pneumoniae R6
gaaaucauuugaau

SEQ ID NO: 2179020 - RNA, 23 nt, Streptococcus pneumoniae R6
gaaaucagugugacccaagauag

SEQ ID NO: 2179021 - RNA, 23 nt, Streptococcus pneumoniae R6
gaaauggucggcauucuucucuu

SEQ ID NO: 2179022 - RNA, 18 nt, Streptococcus pneumoniae R6
gaaaugccgauucccaaa

SEQ ID NO: 2179023 - RNA, 18 nt, Streptococcus pneumoniae R6
gaaaugauaauugauuaa

SEQ ID NO: 2179024 - RNA, 20 nt, Streptococcus pneumoniae R6
gaaaugauaauugauuaaga

SEQ ID NO: 2179025 - RNA, 17 nt, Streptococcus pneumoniae R6
gaaaugaucagaccagu

SEQ ID NO: 2179026 - RNA, 19 nt, Streptococcus pneumoniae R6
gaaaugauccaagcuucua

SEQ ID NO: 2179027 - RNA, 14 nt, Streptococcus pneumoniae R6
gaaaucuuugauuu

SEQ ID NO: 2179028 - RNA, 12 nt, Streptococcus pneumoniae R6
gaaauuauuuau

SEQ ID NO: 2179029 - RNA, 14 nt, Streptococcus pneumoniae R6
gaaauuaauuugac

SEQ ID NO: 2179030 - RNA, 22 nt, Streptococcus pneumoniae R6
gaaauuaauuuuacuuuccuga

SEQ ID NO: 2179031 - RNA, 20 nt, Streptococcus pneumoniae R6
gaaauuaaauaugaacaaau

SEQ ID NO: 2179032 - RNA, 16 nt, Streptococcus pneumoniae R6
gaaauucuaauuaaau

SEQ ID NO: 2179033 - RNA, 23 nt, Streptococcus pneumoniae R6
gaaauucgcuuuuuuaaaugcug

SEQ ID NO: 2179034 - RNA, 20 nt, Streptococcus pneumoniae R6
gaaauugaacuuuuucuaac

SEQ ID NO: 2179035 - RNA, 15 nt, Streptococcus pneumoniae R6
gaaauuuucuuuuuc

SEQ ID NO: 2179036 - RNA, 16 nt, Streptococcus pneumoniae R6
gaacaaaauaguucuc

SEQ ID NO: 2179037 - RNA, 22 nt, Streptococcus pneumoniae R6
gaaauuuuagaacuguaaauuu

SEQ ID NO: 2179038 - RNA, 18 nt, Streptococcus pneumoniae R6
gaaauuuuucugcuucuu

SEQ ID NO: 2179039 - RNA, 12 nt, Streptococcus pneumoniae R6
gaaauuucaaca

SEQ ID NO: 2179040 - RNA, 13 nt, Streptococcus pneumoniae R6
gaaauuucaacaa

SEQ ID NO: 2179041 - RNA, 17 nt, Streptococcus pneumoniae R6
gaaauuucugaaacuaa

SEQ ID NO: 2179042 - RNA, 20 nt, Streptococcus pneumoniae R6
gaaauugguuugaauucucc

SEQ ID NO: 2179043 - RNA, 16 nt, Streptococcus pneumoniae R6
gaacacuuccaauaau

SEQ ID NO: 2179044 - RNA, 23 nt, Streptococcus pneumoniae R6
gaacaauaaaacgcauaauauca

SEQ ID NO: 2179045 - RNA, 16 nt, Streptococcus pneumoniae R6
gaacaagacuaccgcu

SEQ ID NO: 2179046 - RNA, 18 nt, Streptococcus pneumoniae R6
gaacaagccuagucuucu

SEQ ID NO: 2179047 - RNA, 24 nt, Streptococcus pneumoniae R6
gaacaaguugugcaguguaugaca

SEQ ID NO: 2179048 - RNA, 15 nt, Streptococcus pneumoniae R6
gaacaccugauuuua

SEQ ID NO: 2179049 - RNA, 16 nt, Streptococcus pneumoniae R6
gaacagugauagcacu

SEQ ID NO: 2179050 - RNA, 20 nt, Streptococcus pneumoniae R6
gaacaguuucggcuguucuu

SEQ ID NO: 2179051 - RNA, 21 nt, Streptococcus pneumoniae R6
gaacaguuucggcuguucuuu

SEQ ID NO: 2179052 - RNA, 19 nt, Streptococcus pneumoniae R6
gaacaguccuuguuuccau

SEQ ID NO: 2179053 - RNA, 14 nt, Streptococcus pneumoniae R6
gaacagcuugagau

SEQ ID NO: 2179054 - RNA, 17 nt, Streptococcus pneumoniae R6
gaacauuacuacuaucc

SEQ ID NO: 2179055 - RNA, 14 nt, Streptococcus pneumoniae R6
gaaccaaugugcag

SEQ ID NO: 2179056 - RNA, 19 nt, Streptococcus pneumoniae R6
gaaccacaacaaaaaaggu

SEQ ID NO: 2179057 - RNA, 15 nt, Streptococcus pneumoniae R6
gaacauuuggaaggc

SEQ ID NO: 2179058 - RNA, 12 nt, Streptococcus pneumoniae R6
gaacaucuccaa

SEQ ID NO: 2179059 - RNA, 12 nt, Streptococcus pneumoniae R6
gaacaucccaag

SEQ ID NO: 2179060 - RNA, 12 nt, Streptococcus pneumoniae R6
gaaagugggcug

SEQ ID NO: 2179061 - RNA, 22 nt, Streptococcus pneumoniae R6
gaaagugggcugauuuugaaaa

SEQ ID NO: 2179062 - RNA, 15 nt, Streptococcus pneumoniae R6
gaaauaaucaaaaua

SEQ ID NO: 2179063 - RNA, 23 nt, Streptococcus pneumoniae R6
gaaauaaucaaaauauguuuucu

SEQ ID NO: 2179064 - RNA, 13 nt, Streptococcus pneumoniae R6
gaaauaagucagc

SEQ ID NO: 2179065 - RNA, 16 nt, Streptococcus pneumoniae R6
gaaauaagauaugaac

SEQ ID NO: 2179066 - RNA, 16 nt, Streptococcus pneumoniae R6
gaaauaagaugugaac

SEQ ID NO: 2179067 - RNA, 22 nt, Streptococcus pneumoniae R6
gaaaguuuuccaaaggaaccaa

SEQ ID NO: 2179068 - RNA, 13 nt, Streptococcus pneumoniae R6
gaaauauuuuagc

SEQ ID NO: 2179069 - RNA, 16 nt, Streptococcus pneumoniae R6
gaaauauuuuaguauu

SEQ ID NO: 2179070 - RNA, 16 nt, Streptococcus pneumoniae R6
gaaauaucgaugcccu

SEQ ID NO: 2179071 - RNA, 20 nt, Streptococcus pneumoniae R6
gaaauaucgcguucgugcca

SEQ ID NO: 2179072 - RNA, 18 nt, Streptococcus pneumoniae R6
gaaauauagaguauuucu

SEQ ID NO: 2179073 - RNA, 19 nt, Streptococcus pneumoniae R6
gaaauauaggccaagauau

SEQ ID NO: 2179074 - RNA, 17 nt, Streptococcus pneumoniae R6
gaaauaguacgaaacaa

SEQ ID NO: 2179075 - RNA, 13 nt, Streptococcus pneumoniae R6
gaaauagaaaaca

SEQ ID NO: 2179076 - RNA, 22 nt, Streptococcus pneumoniae R6
gaaauagcagagacauuagaaa

SEQ ID NO: 2179077 - RNA, 19 nt, Streptococcus pneumoniae R6
gaaauagcauccaccacuu

SEQ ID NO: 2179078 - RNA, 18 nt, Streptococcus pneumoniae R6
gaaaguaagaaucugcau

SEQ ID NO: 2179079 - RNA, 16 nt, Streptococcus pneumoniae R6
gaaagguaaaauauag

SEQ ID NO: 2179080 - RNA, 15 nt, Streptococcus pneumoniae R6
gaaaguagaguccaa

SEQ ID NO: 2179081 - RNA, 19 nt, Streptococcus pneumoniae R6
gaaaguagaguccaaagac

SEQ ID NO: 2179082 - RNA, 20 nt, Streptococcus pneumoniae R6
gaaagucauauuucuucaau

SEQ ID NO: 2179083 - RNA, 21 nt, Streptococcus pneumoniae R6
gaaaguccucauuucaauaga

SEQ ID NO: 2179084 - RNA, 19 nt, Streptococcus pneumoniae R6
gaaagucuaauguaauucu

SEQ ID NO: 2179085 - RNA, 12 nt, Streptococcus pneumoniae R6
gaaaggagaaaa

SEQ ID NO: 2179086 - RNA, 17 nt, Streptococcus pneumoniae R6
gaaaggauaugaggaga

SEQ ID NO: 2179087 - RNA, 23 nt, Streptococcus pneumoniae R6
gaaaggauaugaggagaaagaag

SEQ ID NO: 2179088 - RNA, 14 nt, Streptococcus pneumoniae R6
gaaaggaaaauuga

SEQ ID NO: 2179089 - RNA, 14 nt, Streptococcus pneumoniae R6
gaaaggaaucugcg

SEQ ID NO: 2179090 - RNA, 12 nt, Streptococcus pneumoniae R6
gaaaggaagaga

SEQ ID NO: 2179091 - RNA, 16 nt, Streptococcus pneumoniae R6
gaaaggaagagagcuc

SEQ ID NO: 2179092 - RNA, 13 nt, Streptococcus pneumoniae R6
gaaagcucuucua

SEQ ID NO: 2179093 - RNA, 13 nt, Streptococcus pneumoniae R6
gaaagauuaccaa

SEQ ID NO: 2179094 - RNA, 13 nt, Streptococcus pneumoniae R6
gaaagauauuuug

SEQ ID NO: 2179095 - RNA, 13 nt, Streptococcus pneumoniae R6
gaaagcauagaga

SEQ ID NO: 2179096 - RNA, 22 nt, Streptococcus pneumoniae R6
gaaagcauagagaaaaacagcu

SEQ ID NO: 2179097 - RNA, 14 nt, Streptococcus pneumoniae R6
gaaagcaucuccau

SEQ ID NO: 2179098 - RNA, 15 nt, Streptococcus pneumoniae R6
gaaagcacuugcuuu

SEQ ID NO: 2179099 - RNA, 21 nt, Streptococcus pneumoniae R6
gaaacggcauaaaaucugaau

SEQ ID NO: 2179100 - RNA, 20 nt, Streptococcus pneumoniae R6
gaaacggaggauuuuugaau

SEQ ID NO: 2179101 - RNA, 14 nt, Streptococcus pneumoniae R6
gaaacucuaaacaa

SEQ ID NO: 2179102 - RNA, 23 nt, Streptococcus pneumoniae R6
gaaacucuaaacaaacuccucuc

SEQ ID NO: 2179103 - RNA, 19 nt, Streptococcus pneumoniae R6
gaaacucuagcuagcugua

SEQ ID NO: 2179104 - RNA, 19 nt, Streptococcus pneumoniae R6
gaaacucaaaagaagauug

SEQ ID NO: 2179105 - RNA, 15 nt, Streptococcus pneumoniae R6
gaaacuacuuucaga

SEQ ID NO: 2179106 - RNA, 11 nt, Streptococcus pneumoniae R6
gaaagaaaaac

SEQ ID NO: 2179107 - RNA, 13 nt, Streptococcus pneumoniae R6
gaaagaaaaacug

SEQ ID NO: 2179108 - RNA, 17 nt, Streptococcus pneumoniae R6
gaaagacuagggaaaca

SEQ ID NO: 2179109 - RNA, 14 nt, Streptococcus pneumoniae R6
gaaagacuugauuu

SEQ ID NO: 2179110 - RNA, 20 nt, Streptococcus pneumoniae R6
gaaagaccuguauucauuga

SEQ ID NO: 2179111 - RNA, 15 nt, Streptococcus pneumoniae R6
gaaagaaguuuaaga

SEQ ID NO: 2179112 - RNA, 22 nt, Streptococcus pneumoniae R6
gaaagaagguauucauaaaaua

SEQ ID NO: 2179113 - RNA, 20 nt, Streptococcus pneumoniae R6
gaaagaaccacgguaaaaua

SEQ ID NO: 2179114 - RNA, 22 nt, Streptococcus pneumoniae R6
gaaacaugagguugacuggccu

SEQ ID NO: 2179115 - RNA, 15 nt, Streptococcus pneumoniae R6
gaaacagugaugaga

SEQ ID NO: 2179116 - RNA, 20 nt, Streptococcus pneumoniae R6
gaaacagagguggaaaagca

SEQ ID NO: 2179117 - RNA, 23 nt, Streptococcus pneumoniae R6
gaaacagcaagagcugauagugg

SEQ ID NO: 2179118 - RNA, 21 nt, Streptococcus pneumoniae R6
gaaacagcugcgauaaggaag

SEQ ID NO: 2179119 - RNA, 14 nt, Streptococcus pneumoniae R6
gaaacagcuucagu

SEQ ID NO: 2179120 - RNA, 14 nt, Streptococcus pneumoniae R6
gaaaccaaucucaa

SEQ ID NO: 2179121 - RNA, 19 nt, Streptococcus pneumoniae R6
gaaaccaaucucaaauccu

SEQ ID NO: 2179122 - RNA, 19 nt, Streptococcus pneumoniae R6
gaaacgacggucaugcgaa

SEQ ID NO: 2179123 - RNA, 17 nt, Streptococcus pneumoniae R6
cuuuuuuaauucuuuuu

SEQ ID NO: 2179124 - RNA, 13 nt, Streptococcus pneumoniae R6
cuuuuuuaaaugc

SEQ ID NO: 2179125 - RNA, 18 nt, Streptococcus pneumoniae R6
cuuuuuguuuucuauuuc

SEQ ID NO: 2179126 - RNA, 19 nt, Streptococcus pneumoniae R6
cuuuuugcccuuuuugaaa

SEQ ID NO: 2179127 - RNA, 18 nt, Streptococcus pneumoniae R6
cuuuuugugaauacaaaa

SEQ ID NO: 2179128 - RNA, 17 nt, Streptococcus pneumoniae R6
cuuuuuguccuucuucu

SEQ ID NO: 2179129 - RNA, 22 nt, Streptococcus pneumoniae R6
cuuuuuguauuucuucuucuga

SEQ ID NO: 2179130 - RNA, 20 nt, Streptococcus pneumoniae R6
cuuuuugguaugaaauagcc

SEQ ID NO: 2179131 - RNA, 13 nt, Streptococcus pneumoniae R6
cuuuuuuccagcc

SEQ ID NO: 2179132 - RNA, 20 nt, Streptococcus pneumoniae R6
cuuuuuuaucuuuccuucgc

SEQ ID NO: 2179133 - RNA, 19 nt, Streptococcus pneumoniae R6
cuuuuuuauacuuuuaaua

SEQ ID NO: 2179134 - RNA, 14 nt, Streptococcus pneumoniae R6
cuuuuuuauagaau

SEQ ID NO: 2179135 - RNA, 15 nt, Streptococcus pneumoniae R6
cuuuuuuauaagcaa

SEQ ID NO: 2179136 - RNA, 14 nt, Streptococcus pneumoniae R6
cuuuuuucuaaagc

SEQ ID NO: 2179137 - RNA, 19 nt, Streptococcus pneumoniae R6
cuuuuuugauaucuuccuc

SEQ ID NO: 2179138 - RNA, 20 nt, Streptococcus pneumoniae R6
cuuuuuugauaucuuccuca

SEQ ID NO: 2179139 - RNA, 19 nt, Streptococcus pneumoniae R6
cuuuuuugauauucagagc

SEQ ID NO: 2179140 - RNA, 19 nt, Streptococcus pneumoniae R6
cuuuuuuguauucacaaaa

SEQ ID NO: 2179141 - RNA, 13 nt, Streptococcus pneumoniae R6
cuuuuuuguuuca

SEQ ID NO: 2179142 - RNA, 22 nt, Streptococcus pneumoniae R6
cuuuuuuugaaguuuucaaagu

SEQ ID NO: 2179143 - RNA, 16 nt, Streptococcus pneumoniae R6
gaaaaaaaguaaaucu

SEQ ID NO: 2179144 - RNA, 20 nt, Streptococcus pneumoniae R6
gaaaaaaauuagaaaaagua

SEQ ID NO: 2179145 - RNA, 22 nt, Streptococcus pneumoniae R6
gaaaaaaauuuuauuuaagcaa

SEQ ID NO: 2179146 - RNA, 12 nt, Streptococcus pneumoniae R6
gaaaaaaucuaa

SEQ ID NO: 2179147 - RNA, 13 nt, Streptococcus pneumoniae R6
gaaaaaaucuaac

SEQ ID NO: 2179148 - RNA, 18 nt, Streptococcus pneumoniae R6
gaaaaaagcauaguauca

SEQ ID NO: 2179149 - RNA, 13 nt, Streptococcus pneumoniae R6
gaaaaauuuucaa

SEQ ID NO: 2179150 - RNA, 17 nt, Streptococcus pneumoniae R6
gaaaaauuuucaaaauc

SEQ ID NO: 2179151 - RNA, 22 nt, Streptococcus pneumoniae R6
gaaaaauuaacaaucccuucaa

SEQ ID NO: 2179152 - RNA, 11 nt, Streptococcus pneumoniae R6
gaaaacaauau

SEQ ID NO: 2179153 - RNA, 16 nt, Streptococcus pneumoniae R6
gaaaacagaaaaaucu

SEQ ID NO: 2179154 - RNA, 22 nt, Streptococcus pneumoniae R6
gaaaacaggaguucuuuuacaa

SEQ ID NO: 2179155 - RNA, 19 nt, Streptococcus pneumoniae R6
gaaaacgccugcuuuuugc

SEQ ID NO: 2179156 - RNA, 21 nt, Streptococcus pneumoniae R6
gaaaacgccugcuuuuugcaa

SEQ ID NO: 2179157 - RNA, 13 nt, Streptococcus pneumoniae R6
gaaaaccaaaacu

SEQ ID NO: 2179158 - RNA, 15 nt, Streptococcus pneumoniae R6
gaaaacccaccugaa

SEQ ID NO: 2179159 - RNA, 16 nt, Streptococcus pneumoniae R6
gaaaaagacuugaaau

SEQ ID NO: 2179160 - RNA, 22 nt, Streptococcus pneumoniae R6
gaaaaacuagaauagaaacaaa

SEQ ID NO: 2179161 - RNA, 19 nt, Streptococcus pneumoniae R6
gaaaaagauuuuuuaaaaa

SEQ ID NO: 2179162 - RNA, 15 nt, Streptococcus pneumoniae R6
gaaaaagcgaguaga

SEQ ID NO: 2179163 - RNA, 23 nt, Streptococcus pneumoniae R6
gaaaaaguguuugauaucuauca

SEQ ID NO: 2179164 - RNA, 23 nt, Streptococcus pneumoniae R6
gaaaaaguucucuuucuaaaaua

SEQ ID NO: 2179165 - RNA, 18 nt, Streptococcus pneumoniae R6
gaaaaagucugaaucaaa

SEQ ID NO: 2179166 - RNA, 19 nt, Streptococcus pneumoniae R6
gaaaaaugacaauaaaaua

SEQ ID NO: 2179167 - RNA, 19 nt, Streptococcus pneumoniae R6
gaaaaaugcucucaaauac

SEQ ID NO: 2179168 - RNA, 21 nt, Streptococcus pneumoniae R6
gaaaaaucgaggucuaaaucu

SEQ ID NO: 2179169 - RNA, 18 nt, Streptococcus pneumoniae R6
gaaacaauaaaaucaaac

SEQ ID NO: 2179170 - RNA, 15 nt, Streptococcus pneumoniae R6
gaaacaauugcuaaa

SEQ ID NO: 2179171 - RNA, 20 nt, Streptococcus pneumoniae R6
gaaacaccaccgauagagug

SEQ ID NO: 2179172 - RNA, 20 nt, Streptococcus pneumoniae R6
gaaacaaauaaaucauugau

SEQ ID NO: 2179173 - RNA, 13 nt, Streptococcus pneumoniae R6
gaaaaugugaaau

SEQ ID NO: 2179174 - RNA, 22 nt, Streptococcus pneumoniae R6
gaaaauuuccauuggacagggu

SEQ ID NO: 2179175 - RNA, 18 nt, Streptococcus pneumoniae R6
gaaaauugauuuauagaa

SEQ ID NO: 2179176 - RNA, 19 nt, Streptococcus pneumoniae R6
gaaaauucuaaaggcuuaa

SEQ ID NO: 2179177 - RNA, 19 nt, Streptococcus pneumoniae R6
gaaaauucucuuuucauac

SEQ ID NO: 2179178 - RNA, 14 nt, Streptococcus pneumoniae R6
gaaaauucaaauua

SEQ ID NO: 2179179 - RNA, 17 nt, Streptococcus pneumoniae R6
gaaaaucucuucaaacc

SEQ ID NO: 2179180 - RNA, 19 nt, Streptococcus pneumoniae R6
gaaaaucucuucaaaccau

SEQ ID NO: 2179181 - RNA, 15 nt, Streptococcus pneumoniae R6
gaaaaugaauuugaa

SEQ ID NO: 2179182 - RNA, 18 nt, Streptococcus pneumoniae R6
gaaaaugaggaaaaucuu

SEQ ID NO: 2179183 - RNA, 20 nt, Streptococcus pneumoniae R6
gaaaauauuucgcuuauaaa

SEQ ID NO: 2179184 - RNA, 13 nt, Streptococcus pneumoniae R6
gaaaaucaaagag

SEQ ID NO: 2179185 - RNA, 14 nt, Streptococcus pneumoniae R6
gaaaaucaaagagc

SEQ ID NO: 2179186 - RNA, 15 nt, Streptococcus pneumoniae R6
gaaaaucaaagagca

SEQ ID NO: 2179187 - RNA, 23 nt, Streptococcus pneumoniae R6
gaaaauaguuuuugcaauauuga

SEQ ID NO: 2179188 - RNA, 14 nt, Streptococcus pneumoniae R6
gaaaaucccuccca

SEQ ID NO: 2179189 - RNA, 15 nt, Streptococcus pneumoniae R6
gaaaagucuuauaau

SEQ ID NO: 2179190 - RNA, 18 nt, Streptococcus pneumoniae R6
gaaaaguaaugccaggcc

SEQ ID NO: 2179191 - RNA, 19 nt, Streptococcus pneumoniae R6
gaaaaguuguccgagcagg

SEQ ID NO: 2179192 - RNA, 23 nt, Streptococcus pneumoniae R6
gaaaagucaucuauaaucaauau

SEQ ID NO: 2179193 - RNA, 15 nt, Streptococcus pneumoniae R6
gaaaauagaaaaaau

SEQ ID NO: 2179194 - RNA, 19 nt, Streptococcus pneumoniae R6
gaaaacuucguacaugaga

SEQ ID NO: 2179195 - RNA, 17 nt, Streptococcus pneumoniae R6
gaaaacuugauauuaug

SEQ ID NO: 2179196 - RNA, 19 nt, Streptococcus pneumoniae R6
gaaaacugaugaagucaag

SEQ ID NO: 2179197 - RNA, 20 nt, Streptococcus pneumoniae R6
gaaaagaauuaggaaaacau

SEQ ID NO: 2179198 - RNA, 18 nt, Streptococcus pneumoniae R6
gaaaagcguucaaagacu

SEQ ID NO: 2179199 - RNA, 20 nt, Streptococcus pneumoniae R6
gaaaagcuacaaucuggaga

SEQ ID NO: 2179200 - RNA, 21 nt, Streptococcus pneumoniae R6
gaaaagauggaguguucuaaa

SEQ ID NO: 2179201 - RNA, 18 nt, Streptococcus pneumoniae R6
gaaaagacuuagucuucu

SEQ ID NO: 2179202 - RNA, 15 nt, Streptococcus pneumoniae R6
gaaaagcaagagcug

SEQ ID NO: 2179203 - RNA, 17 nt, Streptococcus pneumoniae R6
gaaaagcaagagcugau

SEQ ID NO: 2179204 - RNA, 18 nt, Streptococcus pneumoniae R6
gaaaagcccuucauaagc

SEQ ID NO: 2179205 - RNA, 18 nt, Streptococcus pneumoniae R6
cuuuuucgcuuggauuuu

SEQ ID NO: 2179206 - RNA, 18 nt, Streptococcus pneumoniae R6
cuuuuuccaaaucuuugg

SEQ ID NO: 2179207 - RNA, 15 nt, Streptococcus pneumoniae R6
cuuuuugauuuuaaa

SEQ ID NO: 2179208 - RNA, 18 nt, Streptococcus pneumoniae R6
cuuuuugaaaaacuagaa

SEQ ID NO: 2179209 - RNA, 20 nt, Streptococcus pneumoniae R6
cuuuuucugauagaagaguc

SEQ ID NO: 2179210 - RNA, 12 nt, Streptococcus pneumoniae R6
cuuuuucuucuu

SEQ ID NO: 2179211 - RNA, 18 nt, Streptococcus pneumoniae R6
cuuuuuacaauuguaaaa

SEQ ID NO: 2179212 - RNA, 19 nt, Streptococcus pneumoniae R6
cuuuuuacaauuguaaaaa

SEQ ID NO: 2179213 - RNA, 20 nt, Streptococcus pneumoniae R6
cuuuuuaaauccgauaauau

SEQ ID NO: 2179214 - RNA, 13 nt, Streptococcus pneumoniae R6
cuuuuuagccacu

SEQ ID NO: 2179215 - RNA, 13 nt, Streptococcus pneumoniae R6
cuuuuuaaaaaau

SEQ ID NO: 2179216 - RNA, 19 nt, Streptococcus pneumoniae R6
cuuuuuaaaaaaucuuuuu

SEQ ID NO: 2179217 - RNA, 14 nt, Streptococcus pneumoniae R6
cuuuuuaaauaaau

SEQ ID NO: 2179218 - RNA, 11 nt, Streptococcus pneumoniae R6
cuuuuuaaacc

SEQ ID NO: 2179219 - RNA, 22 nt, Streptococcus pneumoniae R6
cuuuuucaaauguauuugaaag

SEQ ID NO: 2179220 - RNA, 15 nt, Streptococcus pneumoniae R6
cuuuuuauucuuuuu

SEQ ID NO: 2179221 - RNA, 13 nt, Streptococcus pneumoniae R6
cuuuuuauauaua

SEQ ID NO: 2179222 - RNA, 15 nt, Streptococcus pneumoniae R6
cuuuuuauauauaaa

SEQ ID NO: 2179223 - RNA, 15 nt, Streptococcus pneumoniae R6
cuuuuuauaggcucu

SEQ ID NO: 2179224 - RNA, 22 nt, Streptococcus pneumoniae R6
cuuuuguaaaggguucuacaaa

SEQ ID NO: 2179225 - RNA, 23 nt, Streptococcus pneumoniae R6
cuuuuguacaaagggaugauguu

SEQ ID NO: 2179226 - RNA, 23 nt, Streptococcus pneumoniae R6
cuuuuggacucacuaaaauucua

SEQ ID NO: 2179227 - RNA, 16 nt, Streptococcus pneumoniae R6
cuuuuguucaucauua

SEQ ID NO: 2179228 - RNA, 21 nt, Streptococcus pneumoniae R6
cuuuuguccuauucuuguuuc

SEQ ID NO: 2179229 - RNA, 21 nt, Streptococcus pneumoniae R6
cuuuugugauuuuaaauuuac

SEQ ID NO: 2179230 - RNA, 20 nt, Streptococcus pneumoniae R6
cuuuugugccaauucuuauc

SEQ ID NO: 2179231 - RNA, 15 nt, Streptococcus pneumoniae R6
cuuuugcauaaugag

SEQ ID NO: 2179232 - RNA, 13 nt, Streptococcus pneumoniae R6
cuuuugcagcacc

SEQ ID NO: 2179233 - RNA, 19 nt, Streptococcus pneumoniae R6
cuuuugcgucuucuacaac

SEQ ID NO: 2179234 - RNA, 22 nt, Streptococcus pneumoniae R6
cuuuugauagaugacuucuuaa

SEQ ID NO: 2179235 - RNA, 16 nt, Streptococcus pneumoniae R6
cuuuugacuugcaaaa

SEQ ID NO: 2179236 - RNA, 13 nt, Streptococcus pneumoniae R6
cuuuugaggucac

SEQ ID NO: 2179237 - RNA, 18 nt, Streptococcus pneumoniae R6
cuuuucgaaacucuuuuu

SEQ ID NO: 2179238 - RNA, 22 nt, Streptococcus pneumoniae R6
cuuuuccuuaacaaucuuacca

SEQ ID NO: 2179239 - RNA, 20 nt, Streptococcus pneumoniae R6
cuuuucuaagaugauuuuuc

SEQ ID NO: 2179240 - RNA, 19 nt, Streptococcus pneumoniae R6
cuuuucuguugauauuucc

SEQ ID NO: 2179241 - RNA, 15 nt, Streptococcus pneumoniae R6
cuuuucuuauaguuu

SEQ ID NO: 2179242 - RNA, 17 nt, Streptococcus pneumoniae R6
cuuuucuuauucuuggc

SEQ ID NO: 2179243 - RNA, 15 nt, Streptococcus pneumoniae R6
cuuuucuuuaucuuu

SEQ ID NO: 2179244 - RNA, 16 nt, Streptococcus pneumoniae R6
cuuuugaaaaaaaugu

SEQ ID NO: 2179245 - RNA, 13 nt, Streptococcus pneumoniae R6
cuuuucugaggau

SEQ ID NO: 2179246 - RNA, 16 nt, Streptococcus pneumoniae R6
cuuuucuaucacucca

SEQ ID NO: 2179247 - RNA, 17 nt, Streptococcus pneumoniae R6
cuuuucucuagcuuuua

SEQ ID NO: 2179248 - RNA, 20 nt, Streptococcus pneumoniae R6
cuuuucucuagcuuuuauaa

SEQ ID NO: 2179249 - RNA, 18 nt, Streptococcus pneumoniae R6
cuuucuuuuuauacucau

SEQ ID NO: 2179250 - RNA, 20 nt, Streptococcus pneumoniae R6
cuuucuuuuuauacucaucu

SEQ ID NO: 2179251 - RNA, 13 nt, Streptococcus pneumoniae R6
cuuugucaacugu

SEQ ID NO: 2179252 - RNA, 18 nt, Streptococcus pneumoniae R6
cuuugucaacuguagugg

SEQ ID NO: 2179253 - RNA, 16 nt, Streptococcus pneumoniae R6
cuuucuuuuuuaugga

SEQ ID NO: 2179254 - RNA, 18 nt, Streptococcus pneumoniae R6
cuuucuuuuuuauggaug

SEQ ID NO: 2179255 - RNA, 14 nt, Streptococcus pneumoniae R6
cuuuguuaaaugaa

SEQ ID NO: 2179256 - RNA, 16 nt, Streptococcus pneumoniae R6
cuuuguucacuuuuug

SEQ ID NO: 2179257 - RNA, 13 nt, Streptococcus pneumoniae R6
cuuuguuccacuc

SEQ ID NO: 2179258 - RNA, 16 nt, Streptococcus pneumoniae R6
cuuuguuccacucgcu

SEQ ID NO: 2179259 - RNA, 15 nt, Streptococcus pneumoniae R6
cuuuuaagaaaucau

SEQ ID NO: 2179260 - RNA, 20 nt, Streptococcus pneumoniae R6
cuuuuaaccagacauagaga

SEQ ID NO: 2179261 - RNA, 19 nt, Streptococcus pneumoniae R6
cuuuuaaaauccauaauua

SEQ ID NO: 2179262 - RNA, 17 nt, Streptococcus pneumoniae R6
cuuuuaaauaguuuaaa

SEQ ID NO: 2179263 - RNA, 13 nt, Streptococcus pneumoniae R6
cuuuuaaauauuu

SEQ ID NO: 2179264 - RNA, 21 nt, Streptococcus pneumoniae R6
cuuuguucugaaagugaaaaa

SEQ ID NO: 2179265 - RNA, 12 nt, Streptococcus pneumoniae R6
cuuuucauucca

SEQ ID NO: 2179266 - RNA, 13 nt, Streptococcus pneumoniae R6
cuuuuccaaacau

SEQ ID NO: 2179267 - RNA, 14 nt, Streptococcus pneumoniae R6
cuuuuccaagaccu

SEQ ID NO: 2179268 - RNA, 17 nt, Streptococcus pneumoniae R6
cuuuuccaagucuagca

SEQ ID NO: 2179269 - RNA, 17 nt, Streptococcus pneumoniae R6
cuuuuccaauagauaau

SEQ ID NO: 2179270 - RNA, 21 nt, Streptococcus pneumoniae R6
cuuuuccaauagauaauuuaa

SEQ ID NO: 2179271 - RNA, 12 nt, Streptococcus pneumoniae R6
cuuuuccauugu

SEQ ID NO: 2179272 - RNA, 22 nt, Streptococcus pneumoniae R6
cuuuucaaaguuaacuuuucca

SEQ ID NO: 2179273 - RNA, 22 nt, Streptococcus pneumoniae R6
cuuuucaauacggucaaucaac

SEQ ID NO: 2179274 - RNA, 14 nt, Streptococcus pneumoniae R6
cuuuucaagaacug

SEQ ID NO: 2179275 - RNA, 16 nt, Streptococcus pneumoniae R6
cuuuucaagaacugcu

SEQ ID NO: 2179276 - RNA, 13 nt, Streptococcus pneumoniae R6
cuuuuauuucuug

SEQ ID NO: 2179277 - RNA, 16 nt, Streptococcus pneumoniae R6
cuuuucaaaauaaguc

SEQ ID NO: 2179278 - RNA, 13 nt, Streptococcus pneumoniae R6
cuuuucauuauag

SEQ ID NO: 2179279 - RNA, 12 nt, Streptococcus pneumoniae R6
cuuuucacuuua

SEQ ID NO: 2179280 - RNA, 12 nt, Streptococcus pneumoniae R6
cuuuuacuucug

SEQ ID NO: 2179281 - RNA, 21 nt, Streptococcus pneumoniae R6
cuuuuaccugaaauauacuca

SEQ ID NO: 2179282 - RNA, 21 nt, Streptococcus pneumoniae R6
cuuuuacucuaguuuuuauaa

SEQ ID NO: 2179283 - RNA, 14 nt, Streptococcus pneumoniae R6
cuuuuacucucauu

SEQ ID NO: 2179284 - RNA, 15 nt, Streptococcus pneumoniae R6
cuuuuauccuguucu

SEQ ID NO: 2179285 - RNA, 23 nt, Streptococcus pneumoniae R6
cuuuuaucuagucguuuaaggaa

SEQ ID NO: 2179286 - RNA, 20 nt, Streptococcus pneumoniae R6
aaaaaagaagcagaaaaauu

SEQ ID NO: 2179287 - RNA, 22 nt, Streptococcus pneumoniae R6
aaaaaauuuuauuuaagcaaaa

SEQ ID NO: 2179288 - RNA, 13 nt, Streptococcus pneumoniae R6
aaaaacaaagaga

SEQ ID NO: 2179289 - RNA, 23 nt, Streptococcus pneumoniae R6
aaaaacaaaguauuaaaauaagu

SEQ ID NO: 2179290 - RNA, 14 nt, Streptococcus pneumoniae R6
aaaaaauuucauuu

SEQ ID NO: 2179291 - RNA, 12 nt, Streptococcus pneumoniae R6
aaaaaaacaaua

SEQ ID NO: 2179292 - RNA, 13 nt, Streptococcus pneumoniae R6
aaaaaaagaagca

SEQ ID NO: 2179293 - RNA, 20 nt, Streptococcus pneumoniae R6
aaaaaaagaagcagaaaaau

SEQ ID NO: 2179294 - RNA, 20 nt, Streptococcus pneumoniae R6
aaaaaaccccagcauaaaca

SEQ ID NO: 2179295 - RNA, 23 nt, Streptococcus pneumoniae R6
aaaaaacuacguuuugcuaauca

SEQ ID NO: 2179296 - RNA, 21 nt, Streptococcus pneumoniae R6
aaaaauugcacuuuccucuug

SEQ ID NO: 2179297 - RNA, 22 nt, Streptococcus pneumoniae R6
aaaaauucuuacuaccuacuuu

SEQ ID NO: 2179298 - RNA, 22 nt, Streptococcus pneumoniae R6
aaaaaugcaugagcaugaucau

SEQ ID NO: 2179299 - RNA, 14 nt, Streptococcus pneumoniae R6
aaaaaugaaaaaaa

SEQ ID NO: 2179300 - RNA, 15 nt, Streptococcus pneumoniae R6
aaaaaugaaaaaaau

SEQ ID NO: 2179301 - RNA, 17 nt, Streptococcus pneumoniae R6
aaaaaugacaauaaaau

SEQ ID NO: 2179302 - RNA, 18 nt, Streptococcus pneumoniae R6
aaaaaucuguuaaaaaau

SEQ ID NO: 2179303 - RNA, 19 nt, Streptococcus pneumoniae R6
aaaaaucuguuaaaaaaua

SEQ ID NO: 2179304 - RNA, 13 nt, Streptococcus pneumoniae R6
aaaaauaugcuau

SEQ ID NO: 2179305 - RNA, 16 nt, Streptococcus pneumoniae R6
aaaaaguuuaaaaaaa

SEQ ID NO: 2179306 - RNA, 14 nt, Streptococcus pneumoniae R6
aaaaauaugaugga

SEQ ID NO: 2179307 - RNA, 15 nt, Streptococcus pneumoniae R6
aaaaauaugauggaa

SEQ ID NO: 2179308 - RNA, 20 nt, Streptococcus pneumoniae R6
aaaaauaugauggaagacug

SEQ ID NO: 2179309 - RNA, 22 nt, Streptococcus pneumoniae R6
aaaaaguucucuuucuaaaaua

SEQ ID NO: 2179310 - RNA, 23 nt, Streptococcus pneumoniae R6
aaaaaguguuugauaucuaucaa

SEQ ID NO: 2179311 - RNA, 17 nt, Streptococcus pneumoniae R6
aaaaaguuaaaucuuau

SEQ ID NO: 2179312 - RNA, 19 nt, Streptococcus pneumoniae R6
aaaaaguuaaaucuuauau

SEQ ID NO: 2179313 - RNA, 20 nt, Streptococcus pneumoniae R6
aaaaaguuagacaauuaauu

SEQ ID NO: 2179314 - RNA, 14 nt, Streptococcus pneumoniae R6
aaaaaguucaauuu

SEQ ID NO: 2179315 - RNA, 15 nt, Streptococcus pneumoniae R6
aaaaaguucaauuuc

SEQ ID NO: 2179316 - RNA, 20 nt, Streptococcus pneumoniae R6
aaaaaguguugacaagugaa

SEQ ID NO: 2179317 - RNA, 16 nt, Streptococcus pneumoniae R6
aaaaagugaacaaagc

SEQ ID NO: 2179318 - RNA, 15 nt, Streptococcus pneumoniae R6
aaaaagugaaaggaa

SEQ ID NO: 2179319 - RNA, 14 nt, Streptococcus pneumoniae R6
aaaaaguccucuuu

SEQ ID NO: 2179320 - RNA, 19 nt, Streptococcus pneumoniae R6
aaaaagucuugacaaagaa

SEQ ID NO: 2179321 - RNA, 16 nt, Streptococcus pneumoniae R6
aaaacaguguuuuaag

SEQ ID NO: 2179322 - RNA, 22 nt, Streptococcus pneumoniae R6
aaaacaguguuuugaucugacu

SEQ ID NO: 2179323 - RNA, 16 nt, Streptococcus pneumoniae R6
aaaacaaaaaagaggu

SEQ ID NO: 2179324 - RNA, 22 nt, Streptococcus pneumoniae R6
aaaacaaagagauugcccauca

SEQ ID NO: 2179325 - RNA, 11 nt, Streptococcus pneumoniae R6
aaaacaacuua

SEQ ID NO: 2179326 - RNA, 22 nt, Streptococcus pneumoniae R6
aaaacaacuuauaaaaaacaca

SEQ ID NO: 2179327 - RNA, 17 nt, Streptococcus pneumoniae R6
aaaacagccgaaaggag

SEQ ID NO: 2179328 - RNA, 13 nt, Streptococcus pneumoniae R6
aaaaccuugaaga

SEQ ID NO: 2179329 - RNA, 18 nt, Streptococcus pneumoniae R6
aaaaccuuguuuuaaaau

SEQ ID NO: 2179330 - RNA, 20 nt, Streptococcus pneumoniae R6
aaaaccauucaaaauacuag

SEQ ID NO: 2179331 - RNA, 14 nt, Streptococcus pneumoniae R6
aaaaccaguccugg

SEQ ID NO: 2179332 - RNA, 20 nt, Streptococcus pneumoniae R6
aaaaccagguucuucaauca

SEQ ID NO: 2179333 - RNA, 20 nt, Streptococcus pneumoniae R6
aaaaccccagcauaaacagg

SEQ ID NO: 2179334 - RNA, 14 nt, Streptococcus pneumoniae R6
aaaacccaccugaa

SEQ ID NO: 2179335 - RNA, 17 nt, Streptococcus pneumoniae R6
aaaaacguuuuucaaac

SEQ ID NO: 2179336 - RNA, 19 nt, Streptococcus pneumoniae R6
aaaaacguuuuucaaaccu

SEQ ID NO: 2179337 - RNA, 17 nt, Streptococcus pneumoniae R6
aaaaacuagaauagaaa

SEQ ID NO: 2179338 - RNA, 23 nt, Streptococcus pneumoniae R6
aaaaacuauggcagagaaucguu

SEQ ID NO: 2179339 - RNA, 17 nt, Streptococcus pneumoniae R6
aaaaacuuaaaaaucuu

SEQ ID NO: 2179340 - RNA, 14 nt, Streptococcus pneumoniae R6
aaaaacuuacuaca

SEQ ID NO: 2179341 - RNA, 21 nt, Streptococcus pneumoniae R6
aaaaacugcuuagaaccgaaa

SEQ ID NO: 2179342 - RNA, 23 nt, Streptococcus pneumoniae R6
aaaaacucuccugggaaauucca

SEQ ID NO: 2179343 - RNA, 23 nt, Streptococcus pneumoniae R6
aaaaacucugcuuuucagcagag

SEQ ID NO: 2179344 - RNA, 19 nt, Streptococcus pneumoniae R6
aaaaacucgacuucaggaa

SEQ ID NO: 2179345 - RNA, 15 nt, Streptococcus pneumoniae R6
aaaaacgcauaguau

SEQ ID NO: 2179346 - RNA, 22 nt, Streptococcus pneumoniae R6
aaaaacugcuuagaaccgaaaa

SEQ ID NO: 2179347 - RNA, 14 nt, Streptococcus pneumoniae R6
aaaaacugguuccu

SEQ ID NO: 2179348 - RNA, 22 nt, Streptococcus pneumoniae R6
aaaaacugguuccuuuuuaggu

SEQ ID NO: 2179349 - RNA, 13 nt, Streptococcus pneumoniae R6
aaaaacucuucuu

SEQ ID NO: 2179350 - RNA, 20 nt, Streptococcus pneumoniae R6
aaaaacucuuguccuaaaua

SEQ ID NO: 2179351 - RNA, 18 nt, Streptococcus pneumoniae R6
aaaaacuauggcagagaa

SEQ ID NO: 2179352 - RNA, 16 nt, Streptococcus pneumoniae R6
aaaaacgcauaauauc

SEQ ID NO: 2179353 - RNA, 19 nt, Streptococcus pneumoniae R6
aaaaacgacagauucuacu

SEQ ID NO: 2179354 - RNA, 16 nt, Streptococcus pneumoniae R6
aaaaacacaauuuuag

SEQ ID NO: 2179355 - RNA, 19 nt, Streptococcus pneumoniae R6
aaaaagccuccagauugga

SEQ ID NO: 2179356 - RNA, 19 nt, Streptococcus pneumoniae R6
aaaaagcuauagauaaggu

SEQ ID NO: 2179357 - RNA, 15 nt, Streptococcus pneumoniae R6
aaaaagcuuuaagac

SEQ ID NO: 2179358 - RNA, 12 nt, Streptococcus pneumoniae R6
aaaaaguaaauc

SEQ ID NO: 2179359 - RNA, 11 nt, Streptococcus pneumoniae R6
aaaaaggucau

SEQ ID NO: 2179360 - RNA, 22 nt, Streptococcus pneumoniae R6
aaaaaggaaucagauuuuagaa

SEQ ID NO: 2179361 - RNA, 21 nt, Streptococcus pneumoniae R6
aaaaaggcgauugaaacauga

SEQ ID NO: 2179362 - RNA, 22 nt, Streptococcus pneumoniae R6
aaaaaggcgauugaaacaugag

SEQ ID NO: 2179363 - RNA, 16 nt, Streptococcus pneumoniae R6
aaaaacuugauacuau

SEQ ID NO: 2179364 - RNA, 17 nt, Streptococcus pneumoniae R6
aaaaacuugauacuaug

SEQ ID NO: 2179365 - RNA, 12 nt, Streptococcus pneumoniae R6
aaaaagaaauau

SEQ ID NO: 2179366 - RNA, 18 nt, Streptococcus pneumoniae R6
aaaaagaagcagaaaaau

SEQ ID NO: 2179367 - RNA, 21 nt, Streptococcus pneumoniae R6
aaaaagacuuagcaaaucagc

SEQ ID NO: 2179368 - RNA, 23 nt, Streptococcus pneumoniae R6
aaaaagaucaguucauuuuuccu

SEQ ID NO: 2179369 - RNA, 24 nt, Streptococcus pneumoniae R6
aaaaagagggauucuuauauuaaa

SEQ ID NO: 2179370 - RNA, 14 nt, Streptococcus pneumoniae R6
aaaaucagaaaaac

SEQ ID NO: 2179371 - RNA, 14 nt, Streptococcus pneumoniae R6
aaaaucaaagagca

SEQ ID NO: 2179372 - RNA, 12 nt, Streptococcus pneumoniae R6
aaaaucaaagac

SEQ ID NO: 2179373 - RNA, 14 nt, Streptococcus pneumoniae R6
aaaauauuuuaaac

SEQ ID NO: 2179374 - RNA, 17 nt, Streptococcus pneumoniae R6
aaaaucaugacaaucaa

SEQ ID NO: 2179375 - RNA, 19 nt, Streptococcus pneumoniae R6
aaaaucaucugcaucaaga

SEQ ID NO: 2179376 - RNA, 18 nt, Streptococcus pneumoniae R6
aaaaucauaaacuaucca

SEQ ID NO: 2179377 - RNA, 18 nt, Streptococcus pneumoniae R6
aaaaucauacuuggagaa

SEQ ID NO: 2179378 - RNA, 22 nt, Streptococcus pneumoniae R6
aaaaucauacuuggagaaccua

SEQ ID NO: 2179379 - RNA, 15 nt, Streptococcus pneumoniae R6
aaaaucauagaaaaa

SEQ ID NO: 2179380 - RNA, 19 nt, Streptococcus pneumoniae R6
aaaaucuuuuacuucugaa

SEQ ID NO: 2179381 - RNA, 14 nt, Streptococcus pneumoniae R6
aaaaucuucaaaaa

SEQ ID NO: 2179382 - RNA, 15 nt, Streptococcus pneumoniae R6
aaaaucuucaaaaaa

SEQ ID NO: 2179383 - RNA, 13 nt, Streptococcus pneumoniae R6
aaaaucucuucaa

SEQ ID NO: 2179384 - RNA, 19 nt, Streptococcus pneumoniae R6
aaaaucucuucaaacaacg

SEQ ID NO: 2179385 - RNA, 12 nt, Streptococcus pneumoniae R6
aaaaucucuuua

SEQ ID NO: 2179386 - RNA, 14 nt, Streptococcus pneumoniae R6
aaaaucugaagaaa

SEQ ID NO: 2179387 - RNA, 18 nt, Streptococcus pneumoniae R6
aaaaucuuaaaaauuaca

SEQ ID NO: 2179388 - RNA, 21 nt, Streptococcus pneumoniae R6
aaaaucuggacauuagggucu

SEQ ID NO: 2179389 - RNA, 16 nt, Streptococcus pneumoniae R6
aaaauacaucuaugau

SEQ ID NO: 2179390 - RNA, 19 nt, Streptococcus pneumoniae R6
aaaauacaguauccacauu

SEQ ID NO: 2179391 - RNA, 20 nt, Streptococcus pneumoniae R6
aaaauauuucgcuuauaaac

SEQ ID NO: 2179392 - RNA, 19 nt, Streptococcus pneumoniae R6
aaaauauuucuagaaauua

SEQ ID NO: 2179393 - RNA, 18 nt, Streptococcus pneumoniae R6
aaaauauguuuucuuugc

SEQ ID NO: 2179394 - RNA, 13 nt, Streptococcus pneumoniae R6
aaaauauuagcaa

SEQ ID NO: 2179395 - RNA, 19 nt, Streptococcus pneumoniae R6
aaaauaugcauaauuucca

SEQ ID NO: 2179396 - RNA, 19 nt, Streptococcus pneumoniae R6
aaaauuaaggcgauugcua

SEQ ID NO: 2179397 - RNA, 22 nt, Streptococcus pneumoniae R6
aaaauuacucccauucuucuuu

SEQ ID NO: 2179398 - RNA, 18 nt, Streptococcus pneumoniae R6
aaaauguagucauucgaa

SEQ ID NO: 2179399 - RNA, 12 nt, Streptococcus pneumoniae R6
aaaauguaguua

SEQ ID NO: 2179400 - RNA, 12 nt, Streptococcus pneumoniae R6
aaaaugugaaau

SEQ ID NO: 2179401 - RNA, 15 nt, Streptococcus pneumoniae R6
aaaauguuuuaagaa

SEQ ID NO: 2179402 - RNA, 15 nt, Streptococcus pneumoniae R6
aaaauuaaaaagagu

SEQ ID NO: 2179403 - RNA, 16 nt, Streptococcus pneumoniae R6
aaaaugguuccaaaag

SEQ ID NO: 2179404 - RNA, 20 nt, Streptococcus pneumoniae R6
aaaauggucacugacagcau

SEQ ID NO: 2179405 - RNA, 21 nt, Streptococcus pneumoniae R6
aaaaugaggaaaaucuuccca

SEQ ID NO: 2179406 - RNA, 23 nt, Streptococcus pneumoniae R6
aaaaugagucuaucaaacaggau

SEQ ID NO: 2179407 - RNA, 13 nt, Streptococcus pneumoniae R6
aaaaugaaauuaa

SEQ ID NO: 2179408 - RNA, 20 nt, Streptococcus pneumoniae R6
aaaaugaaauuuuucugcuu

SEQ ID NO: 2179409 - RNA, 22 nt, Streptococcus pneumoniae R6
aaaaugaaaaaaauuagaaaaa

SEQ ID NO: 2179410 - RNA, 13 nt, Streptococcus pneumoniae R6
aaaaugaaaaaaa

SEQ ID NO: 2179411 - RNA, 10 nt, Streptococcus pneumoniae R6
aaaaugaaaa

SEQ ID NO: 2179412 - RNA, 14 nt, Streptococcus pneumoniae R6
aaaaugaaacaaga

SEQ ID NO: 2179413 - RNA, 12 nt, Streptococcus pneumoniae R6
aaaaugaaagag

SEQ ID NO: 2179414 - RNA, 12 nt, Streptococcus pneumoniae R6
aaaaugaaauac

SEQ ID NO: 2179415 - RNA, 15 nt, Streptococcus pneumoniae R6
aaaaugaauuugaaa

SEQ ID NO: 2179416 - RNA, 20 nt, Streptococcus pneumoniae R6
aaaaugagggcauaggcugc

SEQ ID NO: 2179417 - RNA, 14 nt, Streptococcus pneumoniae R6
aaaaguccucguag

SEQ ID NO: 2179418 - RNA, 16 nt, Streptococcus pneumoniae R6
aaaagucguuaaaagc

SEQ ID NO: 2179419 - RNA, 13 nt, Streptococcus pneumoniae R6
aaaagucgaguuc

SEQ ID NO: 2179420 - RNA, 15 nt, Streptococcus pneumoniae R6
aaaagucaggccugc

SEQ ID NO: 2179421 - RNA, 16 nt, Streptococcus pneumoniae R6
aaaaguccaaaagacc

SEQ ID NO: 2179422 - RNA, 17 nt, Streptococcus pneumoniae R6
aaaaguccaaagaugag

SEQ ID NO: 2179423 - RNA, 22 nt, Streptococcus pneumoniae R6
aaaaggcaucuugucaaagagu

SEQ ID NO: 2179424 - RNA, 16 nt, Streptococcus pneumoniae R6
aaaaggaguagaaaau

SEQ ID NO: 2179425 - RNA, 19 nt, Streptococcus pneumoniae R6
aaaagggacuggauuuuaa

SEQ ID NO: 2179426 - RNA, 20 nt, Streptococcus pneumoniae R6
aaaauaacucuguaaucucu

SEQ ID NO: 2179427 - RNA, 14 nt, Streptococcus pneumoniae R6
aaaauaacuucaga

SEQ ID NO: 2179428 - RNA, 23 nt, Streptococcus pneumoniae R6
aaaauaagauauagcauacugaa

SEQ ID NO: 2179429 - RNA, 19 nt, Streptococcus pneumoniae R6
aaaauaauuuuuuucagaa

SEQ ID NO: 2179430 - RNA, 15 nt, Streptococcus pneumoniae R6
aaaauacaaaccaaa

SEQ ID NO: 2179431 - RNA, 13 nt, Streptococcus pneumoniae R6
aaaauaaaaaaau

SEQ ID NO: 2179432 - RNA, 18 nt, Streptococcus pneumoniae R6
aaaagucugaaucaaaaa

SEQ ID NO: 2179433 - RNA, 21 nt, Streptococcus pneumoniae R6
aaaagucugaaucaaaaauga

SEQ ID NO: 2179434 - RNA, 23 nt, Streptococcus pneumoniae R6
aaaagucugggaaaaauuuucaa

SEQ ID NO: 2179435 - RNA, 13 nt, Streptococcus pneumoniae R6
aaaagucuuauaa

SEQ ID NO: 2179436 - RNA, 22 nt, Streptococcus pneumoniae R6
aaaagucuucacaaucaaaaaa

SEQ ID NO: 2179437 - RNA, 19 nt, Streptococcus pneumoniae R6
aaaagucuugacaaagaaa

SEQ ID NO: 2179438 - RNA, 22 nt, Streptococcus pneumoniae R6
aaaagucuugacaaagaaaaaa

SEQ ID NO: 2179439 - RNA, 14 nt, Streptococcus pneumoniae R6
aaaagucuuuaaaa

SEQ ID NO: 2179440 - RNA, 16 nt, Streptococcus pneumoniae R6
aaaagucuuuaaaauc

SEQ ID NO: 2179441 - RNA, 18 nt, Streptococcus pneumoniae R6
aaaaguuguggaaaggau

SEQ ID NO: 2179442 - RNA, 17 nt, Streptococcus pneumoniae R6
aaaaguuuaaaaaaacu

SEQ ID NO: 2179443 - RNA, 19 nt, Streptococcus pneumoniae R6
aaaaguuuaucuagaauuu

SEQ ID NO: 2179444 - RNA, 20 nt, Streptococcus pneumoniae R6
aaaaguuuuagcuucuguau

SEQ ID NO: 2179445 - RNA, 18 nt, Streptococcus pneumoniae R6
aaaaguuuccaaucagau

SEQ ID NO: 2179446 - RNA, 18 nt, Streptococcus pneumoniae R6
aaaacgccugcuuuuugc

SEQ ID NO: 2179447 - RNA, 13 nt, Streptococcus pneumoniae R6
aaaacgaaaggau

SEQ ID NO: 2179448 - RNA, 21 nt, Streptococcus pneumoniae R6
aaaacgacguccagaauacuc

SEQ ID NO: 2179449 - RNA, 17 nt, Streptococcus pneumoniae R6
aaaacgcauaauaccaa

SEQ ID NO: 2179450 - RNA, 16 nt, Streptococcus pneumoniae R6
aaaacgcauaauauca

SEQ ID NO: 2179451 - RNA, 21 nt, Streptococcus pneumoniae R6
aaaacgcauccuaucaaguuc

SEQ ID NO: 2179452 - RNA, 16 nt, Streptococcus pneumoniae R6
aaaaagaaauauauag

SEQ ID NO: 2179453 - RNA, 16 nt, Streptococcus pneumoniae R6
aaaaacuucuggcuua

SEQ ID NO: 2179454 - RNA, 16 nt, Streptococcus pneumoniae R6
aaaagcuaauagagcu

SEQ ID NO: 2179455 - RNA, 14 nt, Streptococcus pneumoniae R6
aaaagcucauuuga

SEQ ID NO: 2179456 - RNA, 16 nt, Streptococcus pneumoniae R6
aaaagcuguauuggug

SEQ ID NO: 2179457 - RNA, 15 nt, Streptococcus pneumoniae R6
aaaagcuguuaaaaa

SEQ ID NO: 2179458 - RNA, 16 nt, Streptococcus pneumoniae R6
aaaagcuuguuuaaaa

SEQ ID NO: 2179459 - RNA, 21 nt, Streptococcus pneumoniae R6
aaaagcuugaguggaaaaacc

SEQ ID NO: 2179460 - RNA, 22 nt, Streptococcus pneumoniae R6
aaaagcuugaguggaaaaaccu

SEQ ID NO: 2179461 - RNA, 23 nt, Streptococcus pneumoniae R6
aaaagcuugaguggaaaaaccuu

SEQ ID NO: 2179462 - RNA, 19 nt, Streptococcus pneumoniae R6
aaaaagaccggauugcucc

SEQ ID NO: 2179463 - RNA, 20 nt, Streptococcus pneumoniae R6
aaaaagaaggauugagaagc

SEQ ID NO: 2179464 - RNA, 14 nt, Streptococcus pneumoniae R6
aaaaagaagcagaa

SEQ ID NO: 2179465 - RNA, 12 nt, Streptococcus pneumoniae R6
aaacagaaaaau

SEQ ID NO: 2179466 - RNA, 15 nt, Streptococcus pneumoniae R6
aaacacugauuucaa

SEQ ID NO: 2179467 - RNA, 11 nt, Streptococcus pneumoniae R6
aaacagcugcg

SEQ ID NO: 2179468 - RNA, 23 nt, Streptococcus pneumoniae R6
aaacauacugaacucaacuuccu

SEQ ID NO: 2179469 - RNA, 20 nt, Streptococcus pneumoniae R6
aaacauaacgggaaucccaa

SEQ ID NO: 2179470 - RNA, 23 nt, Streptococcus pneumoniae R6
aaacaguuagacaauuaauuuau

SEQ ID NO: 2179471 - RNA, 18 nt, Streptococcus pneumoniae R6
aaacaguuacaucaguau

SEQ ID NO: 2179472 - RNA, 19 nt, Streptococcus pneumoniae R6
aaacaguguuuugagcagc

SEQ ID NO: 2179473 - RNA, 20 nt, Streptococcus pneumoniae R6
aaacaguguuuugagcugac

SEQ ID NO: 2179474 - RNA, 23 nt, Streptococcus pneumoniae R6
aaacagucccauaaaacuauaau

SEQ ID NO: 2179475 - RNA, 20 nt, Streptococcus pneumoniae R6
aaacagggcaucuaagcauu

SEQ ID NO: 2179476 - RNA, 21 nt, Streptococcus pneumoniae R6
aaacaggcucggcaauaccgu

SEQ ID NO: 2179477 - RNA, 15 nt, Streptococcus pneumoniae R6
aaacaguaauaaaga

SEQ ID NO: 2179478 - RNA, 18 nt, Streptococcus pneumoniae R6
aaacaguaauaaagacac

SEQ ID NO: 2179479 - RNA, 12 nt, Streptococcus pneumoniae R6
aaacacuguuuu

SEQ ID NO: 2179480 - RNA, 19 nt, Streptococcus pneumoniae R6
aaacacuguuuugagguug

SEQ ID NO: 2179481 - RNA, 15 nt, Streptococcus pneumoniae R6
aaacacuaccaagca

SEQ ID NO: 2179482 - RNA, 16 nt, Streptococcus pneumoniae R6
aaacacauuuuuagaa

SEQ ID NO: 2179483 - RNA, 16 nt, Streptococcus pneumoniae R6
aaacacaaaaaguccu

SEQ ID NO: 2179484 - RNA, 13 nt, Streptococcus pneumoniae R6
aaacacaaaagga

SEQ ID NO: 2179485 - RNA, 14 nt, Streptococcus pneumoniae R6
aaacacacgaagca

SEQ ID NO: 2179486 - RNA, 17 nt, Streptococcus pneumoniae R6
aaaauucuuugaaauca

SEQ ID NO: 2179487 - RNA, 19 nt, Streptococcus pneumoniae R6
aaaauucuuugaaaucaga

SEQ ID NO: 2179488 - RNA, 17 nt, Streptococcus pneumoniae R6
aaaauugauuuauagaa

SEQ ID NO: 2179489 - RNA, 22 nt, Streptococcus pneumoniae R6
aaaauugauuugacuuccaaaa

SEQ ID NO: 2179490 - RNA, 22 nt, Streptococcus pneumoniae R6
aaaauugguguaaauagaaacc

SEQ ID NO: 2179491 - RNA, 17 nt, Streptococcus pneumoniae R6
aaacaauugcuaaaaca

SEQ ID NO: 2179492 - RNA, 21 nt, Streptococcus pneumoniae R6
aaacaaucacggacaggguug

SEQ ID NO: 2179493 - RNA, 18 nt, Streptococcus pneumoniae R6
aaacaauaaaucugucag

SEQ ID NO: 2179494 - RNA, 14 nt, Streptococcus pneumoniae R6
aaacaaguucuuuu

SEQ ID NO: 2179495 - RNA, 14 nt, Streptococcus pneumoniae R6
aaaauuguuaaagu

SEQ ID NO: 2179496 - RNA, 18 nt, Streptococcus pneumoniae R6
aaacaagggcaaaaaaga

SEQ ID NO: 2179497 - RNA, 17 nt, Streptococcus pneumoniae R6
aaacauugauaauagga

SEQ ID NO: 2179498 - RNA, 10 nt, Streptococcus pneumoniae R6
aaacauugug

SEQ ID NO: 2179499 - RNA, 12 nt, Streptococcus pneumoniae R6
aaacauugugag

SEQ ID NO: 2179500 - RNA, 21 nt, Streptococcus pneumoniae R6
aaacauugugagaaauugguu

SEQ ID NO: 2179501 - RNA, 17 nt, Streptococcus pneumoniae R6
aaacauuuauagaaauu

SEQ ID NO: 2179502 - RNA, 18 nt, Streptococcus pneumoniae R6
aaacauuucggauuuuaa

SEQ ID NO: 2179503 - RNA, 17 nt, Streptococcus pneumoniae R6
aaacauuucuauaaauc

SEQ ID NO: 2179504 - RNA, 12 nt, Streptococcus pneumoniae R6
aaacauuugauu

SEQ ID NO: 2179505 - RNA, 13 nt, Streptococcus pneumoniae R6
aaacauuugauuu

SEQ ID NO: 2179506 - RNA, 22 nt, Streptococcus pneumoniae R6
aaacauuugauuuuguaaaaau

SEQ ID NO: 2179507 - RNA, 23 nt, Streptococcus pneumoniae R6
aaacauuugauuuuguaaaaaua

SEQ ID NO: 2179508 - RNA, 17 nt, Streptococcus pneumoniae R6
aaacaucucagaauaau

SEQ ID NO: 2179509 - RNA, 15 nt, Streptococcus pneumoniae R6
aaacaucuaccuauu

SEQ ID NO: 2179510 - RNA, 15 nt, Streptococcus pneumoniae R6
aaacaucgaaagcaa

SEQ ID NO: 2179511 - RNA, 14 nt, Streptococcus pneumoniae R6
aaaccaauuuuaag

SEQ ID NO: 2179512 - RNA, 20 nt, Streptococcus pneumoniae R6
aaaccaaacgacauagguca

SEQ ID NO: 2179513 - RNA, 23 nt, Streptococcus pneumoniae R6
aaaccaaaaaguggaaagagcag

SEQ ID NO: 2179514 - RNA, 21 nt, Streptococcus pneumoniae R6
aaaccaagcaaggucaaaaug

SEQ ID NO: 2179515 - RNA, 20 nt, Streptococcus pneumoniae R6
aaaccauguuuuucaauagc

SEQ ID NO: 2179516 - RNA, 16 nt, Streptococcus pneumoniae R6
aaaccaguccuggaaa

SEQ ID NO: 2179517 - RNA, 23 nt, Streptococcus pneumoniae R6
aaaccaguccuggaaaaacgugg

SEQ ID NO: 2179518 - RNA, 13 nt, Streptococcus pneumoniae R6
aaaccaguucaua

SEQ ID NO: 2179519 - RNA, 16 nt, Streptococcus pneumoniae R6
aacaacaauggaaaug

SEQ ID NO: 2179520 - RNA, 21 nt, Streptococcus pneumoniae R6
aacaacaccgcagucuucaau

SEQ ID NO: 2179521 - RNA, 17 nt, Streptococcus pneumoniae R6
aacaacagcugucgcac

SEQ ID NO: 2179522 - RNA, 21 nt, Streptococcus pneumoniae R6
aacaaaucgauuaggaaagga

SEQ ID NO: 2179523 - RNA, 23 nt, Streptococcus pneumoniae R6
aacaaaucgauugggaaaguaaa

SEQ ID NO: 2179524 - RNA, 14 nt, Streptococcus pneumoniae R6
aacaaauaaaucau

SEQ ID NO: 2179525 - RNA, 15 nt, Streptococcus pneumoniae R6
aacaaauaaaucauu

SEQ ID NO: 2179526 - RNA, 17 nt, Streptococcus pneumoniae R6
aacaaauugauaagagg

SEQ ID NO: 2179527 - RNA, 20 nt, Streptococcus pneumoniae R6
aacaaauuguuauuaagauu

SEQ ID NO: 2179528 - RNA, 22 nt, Streptococcus pneumoniae R6
aacaaaugacuuucuaauuauu

SEQ ID NO: 2179529 - RNA, 21 nt, Streptococcus pneumoniae R6
aacaaaucuuccuagaauaug

SEQ ID NO: 2179530 - RNA, 20 nt, Streptococcus pneumoniae R6
aacaaccgacaagucauggg

SEQ ID NO: 2179531 - RNA, 21 nt, Streptococcus pneumoniae R6
aacaacuuauaaaaaacacaa

SEQ ID NO: 2179532 - RNA, 20 nt, Streptococcus pneumoniae R6
aacaagaccgagaaacaaga

SEQ ID NO: 2179533 - RNA, 13 nt, Streptococcus pneumoniae R6
aacaagaacaaga

SEQ ID NO: 2179534 - RNA, 17 nt, Streptococcus pneumoniae R6
aacaaaagucuucuaac

SEQ ID NO: 2179535 - RNA, 19 nt, Streptococcus pneumoniae R6
aacaaaaucgcuaagaggg

SEQ ID NO: 2179536 - RNA, 21 nt, Streptococcus pneumoniae R6
aacaaaaucgggagauugagu

SEQ ID NO: 2179537 - RNA, 12 nt, Streptococcus pneumoniae R6
aacaaaagagcu

SEQ ID NO: 2179538 - RNA, 13 nt, Streptococcus pneumoniae R6
aacaaaagagcua

SEQ ID NO: 2179539 - RNA, 18 nt, Streptococcus pneumoniae R6
aacaaaauaguucucaac

SEQ ID NO: 2179540 - RNA, 15 nt, Streptococcus pneumoniae R6
aacaaaauuauuaaa

SEQ ID NO: 2179541 - RNA, 22 nt, Streptococcus pneumoniae R6
aacaaaauuauuaaaaucaaaa

SEQ ID NO: 2179542 - RNA, 14 nt, Streptococcus pneumoniae R6
aacaaagaaaaaga

SEQ ID NO: 2179543 - RNA, 16 nt, Streptococcus pneumoniae R6
aacaaaggauuucugc

SEQ ID NO: 2179544 - RNA, 12 nt, Streptococcus pneumoniae R6
aacaaagagguu

SEQ ID NO: 2179545 - RNA, 13 nt, Streptococcus pneumoniae R6
aaauuuuuuucua

SEQ ID NO: 2179546 - RNA, 16 nt, Streptococcus pneumoniae R6
aacaaaaaaugcucug

SEQ ID NO: 2179547 - RNA, 14 nt, Streptococcus pneumoniae R6
aacaaaaaagguca

SEQ ID NO: 2179548 - RNA, 19 nt, Streptococcus pneumoniae R6
aacaaaaauacggucgcuu

SEQ ID NO: 2179549 - RNA, 15 nt, Streptococcus pneumoniae R6
aacaaaaauuugauc

SEQ ID NO: 2179550 - RNA, 22 nt, Streptococcus pneumoniae R6
aacaaaaauuugaucauccaaa

SEQ ID NO: 2179551 - RNA, 20 nt, Streptococcus pneumoniae R6
aaauuuugauaccuucuuua

SEQ ID NO: 2179552 - RNA, 18 nt, Streptococcus pneumoniae R6
aaauuuuguccuuucuuu

SEQ ID NO: 2179553 - RNA, 16 nt, Streptococcus pneumoniae R6
aaauugaauaaaguca

SEQ ID NO: 2179554 - RNA, 16 nt, Streptococcus pneumoniae R6
aaauugaucuagcucu

SEQ ID NO: 2179555 - RNA, 20 nt, Streptococcus pneumoniae R6
aaauugauaauagcacuuaa

SEQ ID NO: 2179556 - RNA, 18 nt, Streptococcus pneumoniae R6
aaauugagucuuuuucca

SEQ ID NO: 2179557 - RNA, 14 nt, Streptococcus pneumoniae R6
aaauugacuuucuu

SEQ ID NO: 2179558 - RNA, 19 nt, Streptococcus pneumoniae R6
aaauucaaauuaauuucua

SEQ ID NO: 2179559 - RNA, 17 nt, Streptococcus pneumoniae R6
aaauuccaaauuagaaa

SEQ ID NO: 2179560 - RNA, 19 nt, Streptococcus pneumoniae R6
aaauuccaaauuagaaaaa

SEQ ID NO: 2179561 - RNA, 17 nt, Streptococcus pneumoniae R6
aaauugcgauuuugcca

SEQ ID NO: 2179562 - RNA, 19 nt, Streptococcus pneumoniae R6
aaauugauuaggaaauuca

SEQ ID NO: 2179563 - RNA, 13 nt, Streptococcus pneumoniae R6
aaauugauuuaua

SEQ ID NO: 2179564 - RNA, 22 nt, Streptococcus pneumoniae R6
aaauugauuugaauuccaaaau

SEQ ID NO: 2179565 - RNA, 21 nt, Streptococcus pneumoniae R6
aaauugauuugacuuccaaaa

SEQ ID NO: 2179566 - RNA, 17 nt, Streptococcus pneumoniae R6
aaauugcacuuuccucu

SEQ ID NO: 2179567 - RNA, 15 nt, Streptococcus pneumoniae R6
aaauugguuuaaaua

SEQ ID NO: 2179568 - RNA, 21 nt, Streptococcus pneumoniae R6
aaauugguguuguuuauuacc

SEQ ID NO: 2179569 - RNA, 21 nt, Streptococcus pneumoniae R6
aaauugguuacgauuguugaa

SEQ ID NO: 2179570 - RNA, 22 nt, Streptococcus pneumoniae R6
aaauugcuuucuucagauuuua

SEQ ID NO: 2179571 - RNA, 15 nt, Streptococcus pneumoniae R6
aaauugcuggagaau

SEQ ID NO: 2179572 - RNA, 22 nt, Streptococcus pneumoniae R6
aaauuugugauacgugaacaag

SEQ ID NO: 2179573 - RNA, 19 nt, Streptococcus pneumoniae R6
aaauuuuaucuuugaaaua

SEQ ID NO: 2179574 - RNA, 17 nt, Streptococcus pneumoniae R6
aaauuugaccauuucaa

SEQ ID NO: 2179575 - RNA, 10 nt, Streptococcus pneumoniae R6
aaauuugacu

SEQ ID NO: 2179576 - RNA, 21 nt, Streptococcus pneumoniae R6
aaauuugacuaaaaacucuuc

SEQ ID NO: 2179577 - RNA, 23 nt, Streptococcus pneumoniae R6
aaauuugacuaaaaacucuucuu

SEQ ID NO: 2179578 - RNA, 20 nt, Streptococcus pneumoniae R6
aaauuucgauugucaucauc

SEQ ID NO: 2179579 - RNA, 21 nt, Streptococcus pneumoniae R6
aaauuuccugcaaguuuaugc

SEQ ID NO: 2179580 - RNA, 15 nt, Streptococcus pneumoniae R6
aaauuucgaaaaaug

SEQ ID NO: 2179581 - RNA, 18 nt, Streptococcus pneumoniae R6
aaauuucguccuuucuuu

SEQ ID NO: 2179582 - RNA, 21 nt, Streptococcus pneumoniae R6
aaauuucuccgguuccuuauu

SEQ ID NO: 2179583 - RNA, 15 nt, Streptococcus pneumoniae R6
aaauuucugaaacua

SEQ ID NO: 2179584 - RNA, 17 nt, Streptococcus pneumoniae R6
aaauuucugaaacuaag

SEQ ID NO: 2179585 - RNA, 14 nt, Streptococcus pneumoniae R6
aaauuucauccuca

SEQ ID NO: 2179586 - RNA, 19 nt, Streptococcus pneumoniae R6
aaauuuauugguauuaaua

SEQ ID NO: 2179587 - RNA, 12 nt, Streptococcus pneumoniae R6
aaauuucaacaa

SEQ ID NO: 2179588 - RNA, 14 nt, Streptococcus pneumoniae R6
aaauuucaacaaaa

SEQ ID NO: 2179589 - RNA, 11 nt, Streptococcus pneumoniae R6
aaauuuacuua

SEQ ID NO: 2179590 - RNA, 20 nt, Streptococcus pneumoniae R6
aaauuuauaauauaaacuuu

SEQ ID NO: 2179591 - RNA, 20 nt, Streptococcus pneumoniae R6
aaauuuaaaagauacuaaca

SEQ ID NO: 2179592 - RNA, 15 nt, Streptococcus pneumoniae R6
aaauuguuaaaguuc

SEQ ID NO: 2179593 - RNA, 21 nt, Streptococcus pneumoniae R6
aaauugucuaagcgaaacaac

SEQ ID NO: 2179594 - RNA, 19 nt, Streptococcus pneumoniae R6
aaauugugcaguuuucauu

SEQ ID NO: 2179595 - RNA, 22 nt, Streptococcus pneumoniae R6
aaauugugcaguuuucauucua

SEQ ID NO: 2179596 - RNA, 18 nt, Streptococcus pneumoniae R6
aaauccgaagaaggccaa

SEQ ID NO: 2179597 - RNA, 20 nt, Streptococcus pneumoniae R6
aaauccgacuucaauaaaau

SEQ ID NO: 2179598 - RNA, 19 nt, Streptococcus pneumoniae R6
aaauccguuuuuugaaguu

SEQ ID NO: 2179599 - RNA, 21 nt, Streptococcus pneumoniae R6
aaauccguuuuuugaaguuuu

SEQ ID NO: 2179600 - RNA, 22 nt, Streptococcus pneumoniae R6
aaauccgcuugggaaaccaaac

SEQ ID NO: 2179601 - RNA, 19 nt, Streptococcus pneumoniae R6
aaauccgguguaagggaag

SEQ ID NO: 2179602 - RNA, 19 nt, Streptococcus pneumoniae R6
aaauccuaguggaaaagau

SEQ ID NO: 2179603 - RNA, 20 nt, Streptococcus pneumoniae R6
aaauccuaguggaaaagaug

SEQ ID NO: 2179604 - RNA, 20 nt, Streptococcus pneumoniae R6
aaauccucuacaugagccag

SEQ ID NO: 2179605 - RNA, 22 nt, Streptococcus pneumoniae R6
aaauccucugaguauuuagcaa

SEQ ID NO: 2179606 - RNA, 23 nt, Streptococcus pneumoniae R6
aaauccucugaguauuuagcaac

SEQ ID NO: 2179607 - RNA, 17 nt, Streptococcus pneumoniae R6
aaauccucugucacaaa

SEQ ID NO: 2179608 - RNA, 22 nt, Streptococcus pneumoniae R6
aaauccuuuuuucuuuacucuu

SEQ ID NO: 2179609 - RNA, 17 nt, Streptococcus pneumoniae R6
aaaucgaaacuccauaa

SEQ ID NO: 2179610 - RNA, 16 nt, Streptococcus pneumoniae R6
aaauccugcaaagaua

SEQ ID NO: 2179611 - RNA, 19 nt, Streptococcus pneumoniae R6
aaauccugcaaagauaggg

SEQ ID NO: 2179612 - RNA, 17 nt, Streptococcus pneumoniae R6
aaaucccauaguagucu

SEQ ID NO: 2179613 - RNA, 14 nt, Streptococcus pneumoniae R6
aaaucccaugacaa

SEQ ID NO: 2179614 - RNA, 21 nt, Streptococcus pneumoniae R6
aaaucccaugacaaucauuuc

SEQ ID NO: 2179615 - RNA, 15 nt, Streptococcus pneumoniae R6
aaaucccaaguaaau

SEQ ID NO: 2179616 - RNA, 22 nt, Streptococcus pneumoniae R6
aaauccauaguaaacuucuucu

SEQ ID NO: 2179617 - RNA, 18 nt, Streptococcus pneumoniae R6
aaauccaugauccuucau

SEQ ID NO: 2179618 - RNA, 20 nt, Streptococcus pneumoniae R6
aaauccacuugggaaaccaa

SEQ ID NO: 2179619 - RNA, 21 nt, Streptococcus pneumoniae R6
aaauccacuugggaaaccaaa

SEQ ID NO: 2179620 - RNA, 22 nt, Streptococcus pneumoniae R6
aaauccacuugggaaaccaaac

SEQ ID NO: 2179621 - RNA, 20 nt, Streptococcus pneumoniae R6
aaauauuagcaaaaaagcaa

SEQ ID NO: 2179622 - RNA, 19 nt, Streptococcus pneumoniae R6
aaaucauuuucuugauuug

SEQ ID NO: 2179623 - RNA, 13 nt, Streptococcus pneumoniae R6
aaaucauuuugac

SEQ ID NO: 2179624 - RNA, 22 nt, Streptococcus pneumoniae R6
aaauaugggcuuacaucaaaaa

SEQ ID NO: 2179625 - RNA, 14 nt, Streptococcus pneumoniae R6
aaaugaggaaaauc

SEQ ID NO: 2179626 - RNA, 12 nt, Streptococcus pneumoniae R6
aaaugagaaauu

SEQ ID NO: 2179627 - RNA, 23 nt, Streptococcus pneumoniae R6
aaaugagagauucauucugcuag

SEQ ID NO: 2179628 - RNA, 22 nt, Streptococcus pneumoniae R6
aaaugagauaagcgauuuuaua

SEQ ID NO: 2179629 - RNA, 14 nt, Streptococcus pneumoniae R6
aaaugaauuugaaa

SEQ ID NO: 2179630 - RNA, 23 nt, Streptococcus pneumoniae R6
aaaugaauuugaaacaaugaaaa

SEQ ID NO: 2179631 - RNA, 24 nt, Streptococcus pneumoniae R6
aaaugaauuugaaacaaugaaaau

SEQ ID NO: 2179632 - RNA, 13 nt, Streptococcus pneumoniae R6
aaaucuuugauuu

SEQ ID NO: 2179633 - RNA, 22 nt, Streptococcus pneumoniae R6
aaaucuuuggaggcaauacguu

SEQ ID NO: 2179634 - RNA, 17 nt, Streptococcus pneumoniae R6
aaaucuuguugagcaua

SEQ ID NO: 2179635 - RNA, 22 nt, Streptococcus pneumoniae R6
aaaucuucuggcacagaaacac

SEQ ID NO: 2179636 - RNA, 20 nt, Streptococcus pneumoniae R6
aaaucuucuguguuugaaca

SEQ ID NO: 2179637 - RNA, 17 nt, Streptococcus pneumoniae R6
aaaucuuuaaggcacua

SEQ ID NO: 2179638 - RNA, 19 nt, Streptococcus pneumoniae R6
aaaucguagucuuucacca

SEQ ID NO: 2179639 - RNA, 21 nt, Streptococcus pneumoniae R6
aaaucugaagaaagcaauuuu

SEQ ID NO: 2179640 - RNA, 14 nt, Streptococcus pneumoniae R6
aaaugcaagacaca

SEQ ID NO: 2179641 - RNA, 15 nt, Streptococcus pneumoniae R6
aaaugauaauugauu

SEQ ID NO: 2179642 - RNA, 24 nt, Streptococcus pneumoniae R6
aaaugaguaugaaaagagaauuuu

SEQ ID NO: 2179643 - RNA, 12 nt, Streptococcus pneumoniae R6
aaauggcaugag

SEQ ID NO: 2179644 - RNA, 16 nt, Streptococcus pneumoniae R6
aaauggcaugaggaga

SEQ ID NO: 2179645 - RNA, 23 nt, Streptococcus pneumoniae R6
aaaugucuuggcagaaagguaag

SEQ ID NO: 2179646 - RNA, 17 nt, Streptococcus pneumoniae R6
aaauguauuugaaaggg

SEQ ID NO: 2179647 - RNA, 22 nt, Streptococcus pneumoniae R6
aaauguuuucucauagccauaa

SEQ ID NO: 2179648 - RNA, 17 nt, Streptococcus pneumoniae R6
aaauguaggcuacagaa

SEQ ID NO: 2179649 - RNA, 22 nt, Streptococcus pneumoniae R6
aaauguaguuaauugauaaggu

SEQ ID NO: 2179650 - RNA, 19 nt, Streptococcus pneumoniae R6
aaauguaguuggauuucca

SEQ ID NO: 2179651 - RNA, 16 nt, Streptococcus pneumoniae R6
aaaugguuccaaaagg

SEQ ID NO: 2179652 - RNA, 18 nt, Streptococcus pneumoniae R6
aaaugguuccaaaaggca

SEQ ID NO: 2179653 - RNA, 13 nt, Streptococcus pneumoniae R6
aaaaagauuugaa

SEQ ID NO: 2179654 - RNA, 14 nt, Streptococcus pneumoniae R6
aaaaagauuugaaa

SEQ ID NO: 2179655 - RNA, 18 nt, Streptococcus pneumoniae R6
aaaaagauuugaaacuaa

SEQ ID NO: 2179656 - RNA, 16 nt, Streptococcus pneumoniae R6
aaaaagauuuuuuaaa

SEQ ID NO: 2179657 - RNA, 21 nt, Streptococcus pneumoniae R6
aaaaagacuugaaauacuaaa

SEQ ID NO: 2179658 - RNA, 14 nt, Streptococcus pneumoniae R6
aaauuaaaaagagu

SEQ ID NO: 2179659 - RNA, 21 nt, Streptococcus pneumoniae R6
aaaaagauaagguucaaaaaa

SEQ ID NO: 2179660 - RNA, 20 nt, Streptococcus pneumoniae R6
aaaaagagggauucuuauau

SEQ ID NO: 2179661 - RNA, 17 nt, Streptococcus pneumoniae R6
aaauuauagucuuuuca

SEQ ID NO: 2179662 - RNA, 22 nt, Streptococcus pneumoniae R6
aaauuauagucuuuucacuuua

SEQ ID NO: 2179663 - RNA, 15 nt, Streptococcus pneumoniae R6
aaauuauaaauuauu

SEQ ID NO: 2179664 - RNA, 19 nt, Streptococcus pneumoniae R6
aaauuaguuuuuagaagcu

SEQ ID NO: 2179665 - RNA, 23 nt, Streptococcus pneumoniae R6
aaauuaguuuuuagaagcuucuu

SEQ ID NO: 2179666 - RNA, 16 nt, Streptococcus pneumoniae R6
aaauuauaaaacgcau

SEQ ID NO: 2179667 - RNA, 21 nt, Streptococcus pneumoniae R6
aaauuauuuugcgcauguaaa

SEQ ID NO: 2179668 - RNA, 22 nt, Streptococcus pneumoniae R6
aaauucaaacucaaauuuacca

SEQ ID NO: 2179669 - RNA, 13 nt, Streptococcus pneumoniae R6
aaauuauuucuuu

SEQ ID NO: 2179670 - RNA, 18 nt, Streptococcus pneumoniae R6
aaauuagcucaaaacacu

SEQ ID NO: 2179671 - RNA, 21 nt, Streptococcus pneumoniae R6
aaauuagggauacuccauaaa

SEQ ID NO: 2179672 - RNA, 16 nt, Streptococcus pneumoniae R6
aaauuagaaaaagacu

SEQ ID NO: 2179673 - RNA, 23 nt, Streptococcus pneumoniae R6
aaauuagaaaaagacuugaaaua

SEQ ID NO: 2179674 - RNA, 12 nt, Streptococcus pneumoniae R6
aaaguaagagaa

SEQ ID NO: 2179675 - RNA, 14 nt, Streptococcus pneumoniae R6
aaaguaaucucuaa

SEQ ID NO: 2179676 - RNA, 15 nt, Streptococcus pneumoniae R6
aaaguacuuuuaaua

SEQ ID NO: 2179677 - RNA, 22 nt, Streptococcus pneumoniae R6
aaaguacuuuuaauauacuuga

SEQ ID NO: 2179678 - RNA, 17 nt, Streptococcus pneumoniae R6
aaaguacuugagaaucu

SEQ ID NO: 2179679 - RNA, 13 nt, Streptococcus pneumoniae R6
aaaguauacucua

SEQ ID NO: 2179680 - RNA, 21 nt, Streptococcus pneumoniae R6
aaaguaguaacuuuuucagga

SEQ ID NO: 2179681 - RNA, 19 nt, Streptococcus pneumoniae R6
aaaguagcucuuuuguuaa

SEQ ID NO: 2179682 - RNA, 23 nt, Streptococcus pneumoniae R6
aaaguagcgcccuuguucuccaa

SEQ ID NO: 2179683 - RNA, 18 nt, Streptococcus pneumoniae R6
aaaguagaguccaaagac

SEQ ID NO: 2179684 - RNA, 22 nt, Streptococcus pneumoniae R6
aaagucugaaucaaaaaugaag

SEQ ID NO: 2179685 - RNA, 21 nt, Streptococcus pneumoniae R6
aaagucuaauguaauucucaa

SEQ ID NO: 2179686 - RNA, 13 nt, Streptococcus pneumoniae R6
aaagugaaaaagu

SEQ ID NO: 2179687 - RNA, 16 nt, Streptococcus pneumoniae R6
aaagugaaaaaguaag

SEQ ID NO: 2179688 - RNA, 17 nt, Streptococcus pneumoniae R6
aaagucuugacaaagaa

SEQ ID NO: 2179689 - RNA, 13 nt, Streptococcus pneumoniae R6
aaagucuuuaaaa

SEQ ID NO: 2179690 - RNA, 14 nt, Streptococcus pneumoniae R6
aaagucuuuaaaau

SEQ ID NO: 2179691 - RNA, 20 nt, Streptococcus pneumoniae R6
aaagucuuuaaaaucugaaa

SEQ ID NO: 2179692 - RNA, 18 nt, Streptococcus pneumoniae R6
aaagucuuuaaaauuaua

SEQ ID NO: 2179693 - RNA, 12 nt, Streptococcus pneumoniae R6
aaagugaaagga

SEQ ID NO: 2179694 - RNA, 13 nt, Streptococcus pneumoniae R6
aaagugaaaggaa

SEQ ID NO: 2179695 - RNA, 20 nt, Streptococcus pneumoniae R6
aaagugcaaauaagaaaucu

SEQ ID NO: 2179696 - RNA, 17 nt, Streptococcus pneumoniae R6
aaagugagauauauuga

SEQ ID NO: 2179697 - RNA, 16 nt, Streptococcus pneumoniae R6
aaaguuaaaaaaacua

SEQ ID NO: 2179698 - RNA, 14 nt, Streptococcus pneumoniae R6
aaagugucagauag

SEQ ID NO: 2179699 - RNA, 20 nt, Streptococcus pneumoniae R6
aaagugguguuacgauuuca

SEQ ID NO: 2179700 - RNA, 20 nt, Streptococcus pneumoniae R6
aaagugguaucauauaaaua

SEQ ID NO: 2179701 - RNA, 21 nt, Streptococcus pneumoniae R6
aaaguggucguuuuucaugaa

SEQ ID NO: 2179702 - RNA, 15 nt, Streptococcus pneumoniae R6
aaaguggguuuuaac

SEQ ID NO: 2179703 - RNA, 16 nt, Streptococcus pneumoniae R6
aaaguggguuuuaacu

SEQ ID NO: 2179704 - RNA, 19 nt, Streptococcus pneumoniae R6
aaaguggguuuuaacuaca

SEQ ID NO: 2179705 - RNA, 15 nt, Streptococcus pneumoniae R6
aaagugggaacuaga

SEQ ID NO: 2179706 - RNA, 16 nt, Streptococcus pneumoniae R6
aaaguggaaagagcag

SEQ ID NO: 2179707 - RNA, 16 nt, Streptococcus pneumoniae R6
aaaguggauuuuucuu

SEQ ID NO: 2179708 - RNA, 18 nt, Streptococcus pneumoniae R6
aaauaaaaaaauuuggaa

SEQ ID NO: 2179709 - RNA, 21 nt, Streptococcus pneumoniae R6
aaaguuuuugguaauuuucuu

SEQ ID NO: 2179710 - RNA, 15 nt, Streptococcus pneumoniae R6
aaaguuuucuuuguu

SEQ ID NO: 2179711 - RNA, 12 nt, Streptococcus pneumoniae R6
aaauaaaacaaa

SEQ ID NO: 2179712 - RNA, 23 nt, Streptococcus pneumoniae R6
aaaguucggccguugauuuaaca

SEQ ID NO: 2179713 - RNA, 22 nt, Streptococcus pneumoniae R6
aaaguucucuuucuaaaauagu

SEQ ID NO: 2179714 - RNA, 12 nt, Streptococcus pneumoniae R6
aaaguucuuccc

SEQ ID NO: 2179715 - RNA, 14 nt, Streptococcus pneumoniae R6
aaaguucuuccccu

SEQ ID NO: 2179716 - RNA, 15 nt, Streptococcus pneumoniae R6
aaaguugaagacacu

SEQ ID NO: 2179717 - RNA, 19 nt, Streptococcus pneumoniae R6
aaaguuaugaaaaagauuu

SEQ ID NO: 2179718 - RNA, 16 nt, Streptococcus pneumoniae R6
aaaguucaauuucacu

SEQ ID NO: 2179719 - RNA, 22 nt, Streptococcus pneumoniae R6
aaaguuaaucucuccuuaucaa

SEQ ID NO: 2179720 - RNA, 14 nt, Streptococcus pneumoniae R6
aaaguuagaaauaa

SEQ ID NO: 2179721 - RNA, 20 nt, Streptococcus pneumoniae R6
aaaguuaguugaguuguuau

SEQ ID NO: 2179722 - RNA, 14 nt, Streptococcus pneumoniae R6
aaaguuuaaaaaaa

SEQ ID NO: 2179723 - RNA, 16 nt, Streptococcus pneumoniae R6
aaaguuuaaaaaaacu

SEQ ID NO: 2179724 - RNA, 18 nt, Streptococcus pneumoniae R6
aaaguuguccgagcagga

SEQ ID NO: 2179725 - RNA, 20 nt, Streptococcus pneumoniae R6
aaauaauuaguucagaauuu

SEQ ID NO: 2179726 - RNA, 20 nt, Streptococcus pneumoniae R6
aaauaauuuugauucagauu

SEQ ID NO: 2179727 - RNA, 13 nt, Streptococcus pneumoniae R6
aaauaaagcaaau

SEQ ID NO: 2179728 - RNA, 14 nt, Streptococcus pneumoniae R6
aaauaaagcaaauc

SEQ ID NO: 2179729 - RNA, 13 nt, Streptococcus pneumoniae R6
aaauaauuaaaau

SEQ ID NO: 2179730 - RNA, 17 nt, Streptococcus pneumoniae R6
aaauacaaaccaaacga

SEQ ID NO: 2179731 - RNA, 13 nt, Streptococcus pneumoniae R6
aaauacaaaaaca

SEQ ID NO: 2179732 - RNA, 19 nt, Streptococcus pneumoniae R6
aaauacaccuaauccacuc

SEQ ID NO: 2179733 - RNA, 16 nt, Streptococcus pneumoniae R6
aaauaccaaguucauu

SEQ ID NO: 2179734 - RNA, 12 nt, Streptococcus pneumoniae R6
aaauagaaaaaa

SEQ ID NO: 2179735 - RNA, 13 nt, Streptococcus pneumoniae R6
aaauagaaaaaau

SEQ ID NO: 2179736 - RNA, 15 nt, Streptococcus pneumoniae R6
aaauacgcaaaauca

SEQ ID NO: 2179737 - RNA, 14 nt, Streptococcus pneumoniae R6
aaauagaagauuuc

SEQ ID NO: 2179738 - RNA, 13 nt, Streptococcus pneumoniae R6
aaauagaaaacaa

SEQ ID NO: 2179739 - RNA, 15 nt, Streptococcus pneumoniae R6
aaauagaaaacaaaa

SEQ ID NO: 2179740 - RNA, 14 nt, Streptococcus pneumoniae R6
aaauaucuauccua

SEQ ID NO: 2179741 - RNA, 16 nt, Streptococcus pneumoniae R6
aaauaucugcacucuc

SEQ ID NO: 2179742 - RNA, 18 nt, Streptococcus pneumoniae R6
aaauaucugcacucucau

SEQ ID NO: 2179743 - RNA, 18 nt, Streptococcus pneumoniae R6
aaauauaguaaaaugaaa

SEQ ID NO: 2179744 - RNA, 14 nt, Streptococcus pneumoniae R6
aaauauagcaauaa

SEQ ID NO: 2179745 - RNA, 16 nt, Streptococcus pneumoniae R6
aaauaguuuaaaacau

SEQ ID NO: 2179746 - RNA, 15 nt, Streptococcus pneumoniae R6
aaagaccaugaggaa

SEQ ID NO: 2179747 - RNA, 17 nt, Streptococcus pneumoniae R6
aaagaccaguucaucau

SEQ ID NO: 2179748 - RNA, 17 nt, Streptococcus pneumoniae R6
aaagaccauagcaaagg

SEQ ID NO: 2179749 - RNA, 15 nt, Streptococcus pneumoniae R6
aaagaggaaaucuuu

SEQ ID NO: 2179750 - RNA, 13 nt, Streptococcus pneumoniae R6
aaagaggaagagg

SEQ ID NO: 2179751 - RNA, 20 nt, Streptococcus pneumoniae R6
aaagaggcgaugaucucucu

SEQ ID NO: 2179752 - RNA, 21 nt, Streptococcus pneumoniae R6
aaagaggcgaugaucucucug

SEQ ID NO: 2179753 - RNA, 17 nt, Streptococcus pneumoniae R6
aaagaggagucuuauag

SEQ ID NO: 2179754 - RNA, 18 nt, Streptococcus pneumoniae R6
aaagaggagguaaauccc

SEQ ID NO: 2179755 - RNA, 16 nt, Streptococcus pneumoniae R6
aaagacagucugaaaa

SEQ ID NO: 2179756 - RNA, 18 nt, Streptococcus pneumoniae R6
aaagacagucugaaaaag

SEQ ID NO: 2179757 - RNA, 21 nt, Streptococcus pneumoniae R6
aaagacagucugaaaaagagg

SEQ ID NO: 2179758 - RNA, 19 nt, Streptococcus pneumoniae R6
aaagacagucugaaaaaua

SEQ ID NO: 2179759 - RNA, 19 nt, Streptococcus pneumoniae R6
aaagacaauguucuuuucu

SEQ ID NO: 2179760 - RNA, 18 nt, Streptococcus pneumoniae R6
aaagacacauggaaggcc

SEQ ID NO: 2179761 - RNA, 24 nt, Streptococcus pneumoniae R6
aaagaccaccucaucuugauagau

SEQ ID NO: 2179762 - RNA, 20 nt, Streptococcus pneumoniae R6
aaagagucuggaacaaaaua

SEQ ID NO: 2179763 - RNA, 21 nt, Streptococcus pneumoniae R6
aaagaggucgaagccauccuu

SEQ ID NO: 2179764 - RNA, 14 nt, Streptococcus pneumoniae R6
aaagaguagaaauu

SEQ ID NO: 2179765 - RNA, 17 nt, Streptococcus pneumoniae R6
aaagagucaagacaagg

SEQ ID NO: 2179766 - RNA, 17 nt, Streptococcus pneumoniae R6
aaagagucccuuagaaa

SEQ ID NO: 2179767 - RNA, 19 nt, Streptococcus pneumoniae R6
aaagagucccuuagaaaaa

SEQ ID NO: 2179768 - RNA, 20 nt, Streptococcus pneumoniae R6
aaagagucccuuagaaaaac

SEQ ID NO: 2179769 - RNA, 21 nt, Streptococcus pneumoniae R6
aaagagucccuuagaaaaacg

SEQ ID NO: 2179770 - RNA, 22 nt, Streptococcus pneumoniae R6
aaagagucccuuagaaaaacga

SEQ ID NO: 2179771 - RNA, 21 nt, Streptococcus pneumoniae R6
aaagauuaaucuucaaauuuu

SEQ ID NO: 2179772 - RNA, 15 nt, Streptococcus pneumoniae R6
aaagaugaagcaauc

SEQ ID NO: 2179773 - RNA, 15 nt, Streptococcus pneumoniae R6
aaagaugagaggaga

SEQ ID NO: 2179774 - RNA, 15 nt, Streptococcus pneumoniae R6
aaagauggaaaaacu

SEQ ID NO: 2179775 - RNA, 16 nt, Streptococcus pneumoniae R6
aaagauguuagaaaaa

SEQ ID NO: 2179776 - RNA, 23 nt, Streptococcus pneumoniae R6
aaagcaacuuacuccggcggagc

SEQ ID NO: 2179777 - RNA, 13 nt, Streptococcus pneumoniae R6
aaagaaaaaacaa

SEQ ID NO: 2179778 - RNA, 16 nt, Streptococcus pneumoniae R6
aaagaaacucuaaaca

SEQ ID NO: 2179779 - RNA, 14 nt, Streptococcus pneumoniae R6
aaagaaacuuggca

SEQ ID NO: 2179780 - RNA, 13 nt, Streptococcus pneumoniae R6
aaagaaagauucc

SEQ ID NO: 2179781 - RNA, 19 nt, Streptococcus pneumoniae R6
aaaccuccaaaguagcuug

SEQ ID NO: 2179782 - RNA, 13 nt, Streptococcus pneumoniae R6
aaaccucaaggca

SEQ ID NO: 2179783 - RNA, 18 nt, Streptococcus pneumoniae R6
aaacuuuuuaguuuuuga

SEQ ID NO: 2179784 - RNA, 13 nt, Streptococcus pneumoniae R6
aaacuuuuucucu

SEQ ID NO: 2179785 - RNA, 12 nt, Streptococcus pneumoniae R6
aaagaauccauc

SEQ ID NO: 2179786 - RNA, 15 nt, Streptococcus pneumoniae R6
aaagaauccaucuga

SEQ ID NO: 2179787 - RNA, 18 nt, Streptococcus pneumoniae R6
aaagaauccaucugauaa

SEQ ID NO: 2179788 - RNA, 19 nt, Streptococcus pneumoniae R6
aaagaauccaucugauaaa

SEQ ID NO: 2179789 - RNA, 15 nt, Streptococcus pneumoniae R6
aaagaagagguuguu

SEQ ID NO: 2179790 - RNA, 15 nt, Streptococcus pneumoniae R6
aaagaagcagaaaaa

SEQ ID NO: 2179791 - RNA, 13 nt, Streptococcus pneumoniae R6
aaagaaugcucag

SEQ ID NO: 2179792 - RNA, 16 nt, Streptococcus pneumoniae R6
aaagaaugcucagaca

SEQ ID NO: 2179793 - RNA, 13 nt, Streptococcus pneumoniae R6
aaagaauuugaaa

SEQ ID NO: 2179794 - RNA, 16 nt, Streptococcus pneumoniae R6
aaagaauuugaaaaaa

SEQ ID NO: 2179795 - RNA, 16 nt, Streptococcus pneumoniae R6
aaagaaauagaaaaca

SEQ ID NO: 2179796 - RNA, 14 nt, Streptococcus pneumoniae R6
aaagaacaaaaaau

SEQ ID NO: 2179797 - RNA, 23 nt, Streptococcus pneumoniae R6
aaagaaauuauucuuaucuuugg

SEQ ID NO: 2179798 - RNA, 18 nt, Streptococcus pneumoniae R6
aaagaaccaguacuuuca

SEQ ID NO: 2179799 - RNA, 20 nt, Streptococcus pneumoniae R6
aaagaaccaguacuuucaac

SEQ ID NO: 2179800 - RNA, 20 nt, Streptococcus pneumoniae R6
aaaggucaucagcagagaaa

SEQ ID NO: 2179801 - RNA, 23 nt, Streptococcus pneumoniae R6
aaaggucaucagcagagaaagaa

SEQ ID NO: 2179802 - RNA, 14 nt, Streptococcus pneumoniae R6
aaaggucucuucuu

SEQ ID NO: 2179803 - RNA, 13 nt, Streptococcus pneumoniae R6
aaaguaaaauuaa

SEQ ID NO: 2179804 - RNA, 17 nt, Streptococcus pneumoniae R6
aaaguaaaauuaauuuc

SEQ ID NO: 2179805 - RNA, 20 nt, Streptococcus pneumoniae R6
aaaggcuauagucaaaggga

SEQ ID NO: 2179806 - RNA, 14 nt, Streptococcus pneumoniae R6
aaagguaacuccuu

SEQ ID NO: 2179807 - RNA, 20 nt, Streptococcus pneumoniae R6
aaaggcuuugcgcuugauaa

SEQ ID NO: 2179808 - RNA, 14 nt, Streptococcus pneumoniae R6
aaaggaaaacuucc

SEQ ID NO: 2179809 - RNA, 14 nt, Streptococcus pneumoniae R6
aaagcuuuuuucuu

SEQ ID NO: 2179810 - RNA, 14 nt, Streptococcus pneumoniae R6
aaaggaaaauugau

SEQ ID NO: 2179811 - RNA, 17 nt, Streptococcus pneumoniae R6
aaaggaaaauugauuua

SEQ ID NO: 2179812 - RNA, 16 nt, Streptococcus pneumoniae R6
aaaggaaaccuaauca

SEQ ID NO: 2179813 - RNA, 21 nt, Streptococcus pneumoniae R6
aaagcugacgcgguuugaaga

SEQ ID NO: 2179814 - RNA, 22 nt, Streptococcus pneumoniae R6
aaagcuucucggacuuuuucca

SEQ ID NO: 2179815 - RNA, 20 nt, Streptococcus pneumoniae R6
aaagcuucuguuucuagucc

SEQ ID NO: 2179816 - RNA, 17 nt, Streptococcus pneumoniae R6
aaaggaguagaaaauga

SEQ ID NO: 2179817 - RNA, 19 nt, Streptococcus pneumoniae R6
aaaggauagacacaauggu

SEQ ID NO: 2179818 - RNA, 23 nt, Streptococcus pneumoniae R6
aaaggacuugaguaaugaacuca

SEQ ID NO: 2179819 - RNA, 13 nt, Streptococcus pneumoniae R6
aaaggagaaaaaa

SEQ ID NO: 2179820 - RNA, 14 nt, Streptococcus pneumoniae R6
aaaggagaaaaaau

SEQ ID NO: 2179821 - RNA, 20 nt, Streptococcus pneumoniae R6
aaaggagaagauuucagaaa

SEQ ID NO: 2179822 - RNA, 21 nt, Streptococcus pneumoniae R6
aaaggagaggagaauuuuuga

SEQ ID NO: 2179823 - RNA, 18 nt, Streptococcus pneumoniae R6
aaaggagcgauugaagau

SEQ ID NO: 2179824 - RNA, 13 nt, Streptococcus pneumoniae R6
aaaggauuauaaa

SEQ ID NO: 2179825 - RNA, 14 nt, Streptococcus pneumoniae R6
aaaggauaugagga

SEQ ID NO: 2179826 - RNA, 15 nt, Streptococcus pneumoniae R6
aaaggauaugaggag

SEQ ID NO: 2179827 - RNA, 16 nt, Streptococcus pneumoniae R6
aaaggauugagccagg

SEQ ID NO: 2179828 - RNA, 17 nt, Streptococcus pneumoniae R6
aaaggauuuaguucugu

SEQ ID NO: 2179829 - RNA, 19 nt, Streptococcus pneumoniae R6
aaagcgaccguauuuuugu

SEQ ID NO: 2179830 - RNA, 15 nt, Streptococcus pneumoniae R6
aaagccuugcuuucu

SEQ ID NO: 2179831 - RNA, 14 nt, Streptococcus pneumoniae R6
aaagcgaaaggaga

SEQ ID NO: 2179832 - RNA, 19 nt, Streptococcus pneumoniae R6
aaagcgaaaggagaaaaau

SEQ ID NO: 2179833 - RNA, 21 nt, Streptococcus pneumoniae R6
aaagcgaacaaccgacaaguc

SEQ ID NO: 2179834 - RNA, 17 nt, Streptococcus pneumoniae R6
aaagcgaagaucuagaa

SEQ ID NO: 2179835 - RNA, 19 nt, Streptococcus pneumoniae R6
aaagccuuccuugauucgg

SEQ ID NO: 2179836 - RNA, 19 nt, Streptococcus pneumoniae R6
aaagcaguacuuugagcaa

SEQ ID NO: 2179837 - RNA, 18 nt, Streptococcus pneumoniae R6
aaagcaggaguuuucccu

SEQ ID NO: 2179838 - RNA, 21 nt, Streptococcus pneumoniae R6
aaagcauagagaaaaacagcu

SEQ ID NO: 2179839 - RNA, 13 nt, Streptococcus pneumoniae R6
aaagcuccauaca

SEQ ID NO: 2179840 - RNA, 21 nt, Streptococcus pneumoniae R6
aaagcuccauacacuggaugu

SEQ ID NO: 2179841 - RNA, 16 nt, Streptococcus pneumoniae R6
aaagcucgauacucua

SEQ ID NO: 2179842 - RNA, 15 nt, Streptococcus pneumoniae R6
aaagcgauaaaaauc

SEQ ID NO: 2179843 - RNA, 17 nt, Streptococcus pneumoniae R6
aacagcuggaaucacau

SEQ ID NO: 2179844 - RNA, 17 nt, Streptococcus pneumoniae R6
aacagcugucgcaccug

SEQ ID NO: 2179845 - RNA, 17 nt, Streptococcus pneumoniae R6
aacagcugcgauaagga

SEQ ID NO: 2179846 - RNA, 18 nt, Streptococcus pneumoniae R6
aacagcugcgauaaggaa

SEQ ID NO: 2179847 - RNA, 20 nt, Streptococcus pneumoniae R6
aacagcugcgauaaggaagu

SEQ ID NO: 2179848 - RNA, 19 nt, Streptococcus pneumoniae R6
aacagcugcgauuuuagca

SEQ ID NO: 2179849 - RNA, 15 nt, Streptococcus pneumoniae R6
aacagcuaaagacag

SEQ ID NO: 2179850 - RNA, 16 nt, Streptococcus pneumoniae R6
aacagcuaaagcaccu

SEQ ID NO: 2179851 - RNA, 17 nt, Streptococcus pneumoniae R6
aacagcuaaagcaccug

SEQ ID NO: 2179852 - RNA, 14 nt, Streptococcus pneumoniae R6
aacagcuacaccag

SEQ ID NO: 2179853 - RNA, 15 nt, Streptococcus pneumoniae R6
aacaagggcaaaaaa

SEQ ID NO: 2179854 - RNA, 22 nt, Streptococcus pneumoniae R6
aacaagggcaaaaaagaaacca

SEQ ID NO: 2179855 - RNA, 21 nt, Streptococcus pneumoniae R6
aacaggauauuucuccaaagc

SEQ ID NO: 2179856 - RNA, 17 nt, Streptococcus pneumoniae R6
aacaucagaaaacgcau

SEQ ID NO: 2179857 - RNA, 16 nt, Streptococcus pneumoniae R6
aacauagcagauaggu

SEQ ID NO: 2179858 - RNA, 23 nt, Streptococcus pneumoniae R6
aacauaaguuguaguacugaaca

SEQ ID NO: 2179859 - RNA, 12 nt, Streptococcus pneumoniae R6
aacauaacugcu

SEQ ID NO: 2179860 - RNA, 19 nt, Streptococcus pneumoniae R6
aacauaacugcuaaaagau

SEQ ID NO: 2179861 - RNA, 21 nt, Streptococcus pneumoniae R6
aacauaacugcuaaaagauuu

SEQ ID NO: 2179862 - RNA, 22 nt, Streptococcus pneumoniae R6
aacaguguuuuaagcugacuuc

SEQ ID NO: 2179863 - RNA, 23 nt, Streptococcus pneumoniae R6
aacaguguuuugaggcugcagau

SEQ ID NO: 2179864 - RNA, 22 nt, Streptococcus pneumoniae R6
aacaguguuuugaucugacuuc

SEQ ID NO: 2179865 - RNA, 13 nt, Streptococcus pneumoniae R6
aacaguuaugaua

SEQ ID NO: 2179866 - RNA, 20 nt, Streptococcus pneumoniae R6
aacagugcuagaaauugacu

SEQ ID NO: 2179867 - RNA, 19 nt, Streptococcus pneumoniae R6
aacagucccauaaaacuau

SEQ ID NO: 2179868 - RNA, 13 nt, Streptococcus pneumoniae R6
aacagucaggaua

SEQ ID NO: 2179869 - RNA, 18 nt, Streptococcus pneumoniae R6
aaccaaaaaguggaaaga

SEQ ID NO: 2179870 - RNA, 14 nt, Streptococcus pneumoniae R6
aaccaaaaucauac

SEQ ID NO: 2179871 - RNA, 14 nt, Streptococcus pneumoniae R6
aaccaaacucacga

SEQ ID NO: 2179872 - RNA, 14 nt, Streptococcus pneumoniae R6
aaccaaaggaagcu

SEQ ID NO: 2179873 - RNA, 13 nt, Streptococcus pneumoniae R6
aaccacauaguca

SEQ ID NO: 2179874 - RNA, 18 nt, Streptococcus pneumoniae R6
aaccacuuaacaacugau

SEQ ID NO: 2179875 - RNA, 16 nt, Streptococcus pneumoniae R6
aacauuuuccagauug

SEQ ID NO: 2179876 - RNA, 19 nt, Streptococcus pneumoniae R6
aacauuugauuuuguaaaa

SEQ ID NO: 2179877 - RNA, 22 nt, Streptococcus pneumoniae R6
aacauuucggauuuuaaaaugc

SEQ ID NO: 2179878 - RNA, 22 nt, Streptococcus pneumoniae R6
aacaucucuaucaggaaaguca

SEQ ID NO: 2179879 - RNA, 21 nt, Streptococcus pneumoniae R6
aacaucucuuguuuaagagca

SEQ ID NO: 2179880 - RNA, 12 nt, Streptococcus pneumoniae R6
aacaucuccaac

SEQ ID NO: 2179881 - RNA, 16 nt, Streptococcus pneumoniae R6
aacaucuccaacugca

SEQ ID NO: 2179882 - RNA, 23 nt, Streptococcus pneumoniae R6
aaccauaccuacgguaaggcgac

SEQ ID NO: 2179883 - RNA, 22 nt, Streptococcus pneumoniae R6
aaccauacauacgguaaggcga

SEQ ID NO: 2179884 - RNA, 18 nt, Streptococcus pneumoniae R6
aaccaguugaguguugaa

SEQ ID NO: 2179885 - RNA, 14 nt, Streptococcus pneumoniae R6
aaccaguugccaua

SEQ ID NO: 2179886 - RNA, 17 nt, Streptococcus pneumoniae R6
aaccccgauaacagccg

SEQ ID NO: 2179887 - RNA, 22 nt, Streptococcus pneumoniae R6
aaccagcugcguaguagauugg

SEQ ID NO: 2179888 - RNA, 12 nt, Streptococcus pneumoniae R6
aaccaggaaacc

SEQ ID NO: 2179889 - RNA, 17 nt, Streptococcus pneumoniae R6
aaccaggaaaccagcug

SEQ ID NO: 2179890 - RNA, 14 nt, Streptococcus pneumoniae R6
aaccaguccuggaa

SEQ ID NO: 2179891 - RNA, 21 nt, Streptococcus pneumoniae R6
aaccaguccuggaaaaacgug

SEQ ID NO: 2179892 - RNA, 16 nt, Streptococcus pneumoniae R6
aaccaguccuugaaaa

SEQ ID NO: 2179893 - RNA, 21 nt, Streptococcus pneumoniae R6
aaccaguccuugaaaaacgug

SEQ ID NO: 2179894 - RNA, 18 nt, Streptococcus pneumoniae R6
aaccagccuguuuucaua

SEQ ID NO: 2179895 - RNA, 18 nt, Streptococcus pneumoniae R6
aaccagaucuuagaagca

SEQ ID NO: 2179896 - RNA, 22 nt, Streptococcus pneumoniae R6
aaccuuuuugcgcaauuugacg

SEQ ID NO: 2179897 - RNA, 15 nt, Streptococcus pneumoniae R6
aaccuuugagaaaaa

SEQ ID NO: 2179898 - RNA, 20 nt, Streptococcus pneumoniae R6
aaccuuucuucauagcagca

SEQ ID NO: 2179899 - RNA, 16 nt, Streptococcus pneumoniae R6
aacgaaccuuggcuug

SEQ ID NO: 2179900 - RNA, 17 nt, Streptococcus pneumoniae R6
aacgaacgccuuaaaaa

SEQ ID NO: 2179901 - RNA, 12 nt, Streptococcus pneumoniae R6
aacgaagaagga

SEQ ID NO: 2179902 - RNA, 19 nt, Streptococcus pneumoniae R6
aaccuugcuucuuuccuua

SEQ ID NO: 2179903 - RNA, 19 nt, Streptococcus pneumoniae R6
aaccuuggcuugcucuccc

SEQ ID NO: 2179904 - RNA, 15 nt, Streptococcus pneumoniae R6
aaccuuguuuuaaaa

SEQ ID NO: 2179905 - RNA, 21 nt, Streptococcus pneumoniae R6
aaccuugucuucuccuaaaau

SEQ ID NO: 2179906 - RNA, 12 nt, Streptococcus pneumoniae R6
aaccuuguggaa

SEQ ID NO: 2179907 - RNA, 17 nt, Streptococcus pneumoniae R6
aaccuucccacaauaaa

SEQ ID NO: 2179908 - RNA, 13 nt, Streptococcus pneumoniae R6
aaccuuaaaacag

SEQ ID NO: 2179909 - RNA, 14 nt, Streptococcus pneumoniae R6
aaccuuaaaacagu

SEQ ID NO: 2179910 - RNA, 16 nt, Streptococcus pneumoniae R6
aaccuuaaaacagugu

SEQ ID NO: 2179911 - RNA, 16 nt, Streptococcus pneumoniae R6
aaccuuaaucaaauua

SEQ ID NO: 2179912 - RNA, 17 nt, Streptococcus pneumoniae R6
aaccuuaaucaaauuau

SEQ ID NO: 2179913 - RNA, 17 nt, Streptococcus pneumoniae R6
aaccuuaccgaugaugu

SEQ ID NO: 2179914 - RNA, 21 nt, Streptococcus pneumoniae R6
aaccugcuuuagauuguccuc

SEQ ID NO: 2179915 - RNA, 15 nt, Streptococcus pneumoniae R6
aaccugaaaaaauaa

SEQ ID NO: 2179916 - RNA, 15 nt, Streptococcus pneumoniae R6
aaccugaaucuccuc

SEQ ID NO: 2179917 - RNA, 22 nt, Streptococcus pneumoniae R6
aaccugauuggccgcaagcagc

SEQ ID NO: 2179918 - RNA, 14 nt, Streptococcus pneumoniae R6
aaccugcacauugg

SEQ ID NO: 2179919 - RNA, 15 nt, Streptococcus pneumoniae R6
aaccucaaaaacaug

SEQ ID NO: 2179920 - RNA, 23 nt, Streptococcus pneumoniae R6
aaccucgagaaagguaacuccuu

SEQ ID NO: 2179921 - RNA, 17 nt, Streptococcus pneumoniae R6
aaccucgauaugaauaa

SEQ ID NO: 2179922 - RNA, 21 nt, Streptococcus pneumoniae R6
aaccucagaauccuuauuuuc

SEQ ID NO: 2179923 - RNA, 23 nt, Streptococcus pneumoniae R6
aaccucagaauccuuauuuucua

SEQ ID NO: 2179924 - RNA, 13 nt, Streptococcus pneumoniae R6
aaccucaaagcag

SEQ ID NO: 2179925 - RNA, 13 nt, Streptococcus pneumoniae R6
aaccucaaaacaa

SEQ ID NO: 2179926 - RNA, 13 nt, Streptococcus pneumoniae R6
aaccucaaaacag

SEQ ID NO: 2179927 - RNA, 14 nt, Streptococcus pneumoniae R6
aaccucaaaacagu

SEQ ID NO: 2179928 - RNA, 15 nt, Streptococcus pneumoniae R6
aaccucaaaacagug

SEQ ID NO: 2179929 - RNA, 12 nt, Streptococcus pneumoniae R6
aaccucaaaacc

SEQ ID NO: 2179930 - RNA, 14 nt, Streptococcus pneumoniae R6
aaccucaaaaccau

SEQ ID NO: 2179931 - RNA, 15 nt, Streptococcus pneumoniae R6
aaccucaaaaccaug

SEQ ID NO: 2179932 - RNA, 18 nt, Streptococcus pneumoniae R6
aaccguucaagguaugaa

SEQ ID NO: 2179933 - RNA, 18 nt, Streptococcus pneumoniae R6
aacgcauaauauugagug

SEQ ID NO: 2179934 - RNA, 15 nt, Streptococcus pneumoniae R6
aacgauagauccuuc

SEQ ID NO: 2179935 - RNA, 16 nt, Streptococcus pneumoniae R6
aacgaguaaaagauaa

SEQ ID NO: 2179936 - RNA, 16 nt, Streptococcus pneumoniae R6
aacgacagaagaagug

SEQ ID NO: 2179937 - RNA, 13 nt, Streptococcus pneumoniae R6
aacgaauccaacu

SEQ ID NO: 2179938 - RNA, 21 nt, Streptococcus pneumoniae R6
aacgaagcuagaaauggcagc

SEQ ID NO: 2179939 - RNA, 22 nt, Streptococcus pneumoniae R6
aacgaacuauaaaaucugaaga

SEQ ID NO: 2179940 - RNA, 21 nt, Streptococcus pneumoniae R6
aacgcucuucuggcagauaga

SEQ ID NO: 2179941 - RNA, 14 nt, Streptococcus pneumoniae R6
aacggcauaaaauc

SEQ ID NO: 2179942 - RNA, 17 nt, Streptococcus pneumoniae R6
aacuucuaaggaaaaag

SEQ ID NO: 2179943 - RNA, 16 nt, Streptococcus pneumoniae R6
aacuucguacaugaga

SEQ ID NO: 2179944 - RNA, 15 nt, Streptococcus pneumoniae R6
aacuuccauguugua

SEQ ID NO: 2179945 - RNA, 19 nt, Streptococcus pneumoniae R6
aacuuccauguuguagucu

SEQ ID NO: 2179946 - RNA, 16 nt, Streptococcus pneumoniae R6
aacuucagauuaguaa

SEQ ID NO: 2179947 - RNA, 17 nt, Streptococcus pneumoniae R6
aacuucaggauuuuuac

SEQ ID NO: 2179948 - RNA, 16 nt, Streptococcus pneumoniae R6
aacugaucccuccauu

SEQ ID NO: 2179949 - RNA, 16 nt, Streptococcus pneumoniae R6
aacugccccccaaaag

SEQ ID NO: 2179950 - RNA, 18 nt, Streptococcus pneumoniae R6
aacugccccccaaaaguu

SEQ ID NO: 2179951 - RNA, 18 nt, Streptococcus pneumoniae R6
aacugcgacguuuucucc

SEQ ID NO: 2179952 - RNA, 20 nt, Streptococcus pneumoniae R6
aacugcgacguuuucuccuu

SEQ ID NO: 2179953 - RNA, 19 nt, Streptococcus pneumoniae R6
aacugccugguaaagacuc

SEQ ID NO: 2179954 - RNA, 11 nt, Streptococcus pneumoniae R6
aacuguagugg

SEQ ID NO: 2179955 - RNA, 17 nt, Streptococcus pneumoniae R6
aacuguaguggguugaa

SEQ ID NO: 2179956 - RNA, 22 nt, Streptococcus pneumoniae R6
aacuguaguggguugaaaaaaa

SEQ ID NO: 2179957 - RNA, 21 nt, Streptococcus pneumoniae R6
aacuguaguggguugaagaaa

SEQ ID NO: 2179958 - RNA, 15 nt, Streptococcus pneumoniae R6
aacuguaugagaaac

SEQ ID NO: 2179959 - RNA, 15 nt, Streptococcus pneumoniae R6
aacuguaaaguagca

SEQ ID NO: 2179960 - RNA, 19 nt, Streptococcus pneumoniae R6
aacuguaaaguagcaaaac

SEQ ID NO: 2179961 - RNA, 17 nt, Streptococcus pneumoniae R6
aacuguauugaccaaag

SEQ ID NO: 2179962 - RNA, 16 nt, Streptococcus pneumoniae R6
aacuguccacaaagau

SEQ ID NO: 2179963 - RNA, 16 nt, Streptococcus pneumoniae R6
aacuuuaccaaaaccu

SEQ ID NO: 2179964 - RNA, 20 nt, Streptococcus pneumoniae R6
aacuuguuuacguuuuaaaa

SEQ ID NO: 2179965 - RNA, 13 nt, Streptococcus pneumoniae R6
aacuuuauaauau

SEQ ID NO: 2179966 - RNA, 21 nt, Streptococcus pneumoniae R6
aacuuuaguuugaguugcguc

SEQ ID NO: 2179967 - RNA, 17 nt, Streptococcus pneumoniae R6
aacuuucccuucgucug

SEQ ID NO: 2179968 - RNA, 17 nt, Streptococcus pneumoniae R6
aacuuucuuuuuuucca

SEQ ID NO: 2179969 - RNA, 17 nt, Streptococcus pneumoniae R6
aagaaaccaaucagacu

SEQ ID NO: 2179970 - RNA, 16 nt, Streptococcus pneumoniae R6
aacuuuuaacgcaugu

SEQ ID NO: 2179971 - RNA, 19 nt, Streptococcus pneumoniae R6
aacuuuuaacuucagcuuu

SEQ ID NO: 2179972 - RNA, 15 nt, Streptococcus pneumoniae R6
aacuuugguuauaaa

SEQ ID NO: 2179973 - RNA, 22 nt, Streptococcus pneumoniae R6
aacuuugguuauaaaaaacaaa

SEQ ID NO: 2179974 - RNA, 16 nt, Streptococcus pneumoniae R6
aacuuuuuaguuuuug

SEQ ID NO: 2179975 - RNA, 14 nt, Streptococcus pneumoniae R6
aacucauagcagau

SEQ ID NO: 2179976 - RNA, 16 nt, Streptococcus pneumoniae R6
aacucaucuuggucag

SEQ ID NO: 2179977 - RNA, 21 nt, Streptococcus pneumoniae R6
aacuccaaacgcgauacaaua

SEQ ID NO: 2179978 - RNA, 17 nt, Streptococcus pneumoniae R6
aacucaauuaagaaauu

SEQ ID NO: 2179979 - RNA, 15 nt, Streptococcus pneumoniae R6
aacucaguuaaaauc

SEQ ID NO: 2179980 - RNA, 13 nt, Streptococcus pneumoniae R6
aacucagaccgau

SEQ ID NO: 2179981 - RNA, 19 nt, Streptococcus pneumoniae R6
aacuauccagagcauucuu

SEQ ID NO: 2179982 - RNA, 21 nt, Streptococcus pneumoniae R6
aacuauccagagcauucuuuu

SEQ ID NO: 2179983 - RNA, 22 nt, Streptococcus pneumoniae R6
aacuauccagagcauucuuuug

SEQ ID NO: 2179984 - RNA, 17 nt, Streptococcus pneumoniae R6
aacuaugaacugguuuu

SEQ ID NO: 2179985 - RNA, 17 nt, Streptococcus pneumoniae R6
aacuauucuuuuucuac

SEQ ID NO: 2179986 - RNA, 22 nt, Streptococcus pneumoniae R6
aacucaaggucgcauaggcaau

SEQ ID NO: 2179987 - RNA, 16 nt, Streptococcus pneumoniae R6
aacggcuaguuuuuag

SEQ ID NO: 2179988 - RNA, 21 nt, Streptococcus pneumoniae R6
aacucugcacguguaaugaca

SEQ ID NO: 2179989 - RNA, 19 nt, Streptococcus pneumoniae R6
aacucuguaaucucuagcc

SEQ ID NO: 2179990 - RNA, 19 nt, Streptococcus pneumoniae R6
aacugacgaagucaguaac

SEQ ID NO: 2179991 - RNA, 20 nt, Streptococcus pneumoniae R6
aacucuaaauugaauaaagu

SEQ ID NO: 2179992 - RNA, 21 nt, Streptococcus pneumoniae R6
aacucuaucaggaaagucaaa

SEQ ID NO: 2179993 - RNA, 14 nt, Streptococcus pneumoniae R6
aacucuagcuagcu

SEQ ID NO: 2179994 - RNA, 14 nt, Streptococcus pneumoniae R6
aacucuagcuuuuu

SEQ ID NO: 2179995 - RNA, 23 nt, Streptococcus pneumoniae R6
aacucuagcuuuuuaauuuugag

SEQ ID NO: 2179996 - RNA, 17 nt, Streptococcus pneumoniae R6
aacucucuaguucccac

SEQ ID NO: 2179997 - RNA, 15 nt, Streptococcus pneumoniae R6
aacucuccaauauca

SEQ ID NO: 2179998 - RNA, 15 nt, Streptococcus pneumoniae R6
aacucucauuaaaac

SEQ ID NO: 2179999 - RNA, 16 nt, Streptococcus pneumoniae R6
aacucgcgacaacagc

SEQ ID NO: 2180000 - RNA, 20 nt, Streptococcus pneumoniae R6
aacucuaaacaaacuccucu

SEQ ID NO: 2180001 - RNA, 19 nt, Streptococcus pneumoniae R6
aacucccugaugauucaag

SEQ ID NO: 2180002 - RNA, 19 nt, Streptococcus pneumoniae R6
aacucccuguuccaaagaa

SEQ ID NO: 2180003 - RNA, 22 nt, Streptococcus pneumoniae R6
aacucccuguuccaaagaagua

SEQ ID NO: 2180004 - RNA, 21 nt, Streptococcus pneumoniae R6
aacuccagugaaaacaggagu

SEQ ID NO: 2180005 - RNA, 19 nt, Streptococcus pneumoniae R6
aacuccagauuaucuuccu

SEQ ID NO: 2180006 - RNA, 14 nt, Streptococcus pneumoniae R6
aagacuugaaauac

SEQ ID NO: 2180007 - RNA, 21 nt, Streptococcus pneumoniae R6
aagacuugaaauacuaaaaaa

SEQ ID NO: 2180008 - RNA, 22 nt, Streptococcus pneumoniae R6
aagacuugaccggagaaagaau

SEQ ID NO: 2180009 - RNA, 15 nt, Streptococcus pneumoniae R6
aagacuuuaaaaauu

SEQ ID NO: 2180010 - RNA, 19 nt, Streptococcus pneumoniae R6
aagacuuuaaaaauuuuuu

SEQ ID NO: 2180011 - RNA, 18 nt, Streptococcus pneumoniae R6
aagacuuucaauucuuca

SEQ ID NO: 2180012 - RNA, 19 nt, Streptococcus pneumoniae R6
aagacuuguuagcugauuu

SEQ ID NO: 2180013 - RNA, 20 nt, Streptococcus pneumoniae R6
aagacuuguuagcugauuuu

SEQ ID NO: 2180014 - RNA, 15 nt, Streptococcus pneumoniae R6
aagacuuuuuucuau

SEQ ID NO: 2180015 - RNA, 22 nt, Streptococcus pneumoniae R6
aagacuuagcaaaucagcuaag

SEQ ID NO: 2180016 - RNA, 22 nt, Streptococcus pneumoniae R6
aagacuggugagauaaaacguu

SEQ ID NO: 2180017 - RNA, 13 nt, Streptococcus pneumoniae R6
aagagaaaaccaa

SEQ ID NO: 2180018 - RNA, 18 nt, Streptococcus pneumoniae R6
aagagaaaaccaaaacuc

SEQ ID NO: 2180019 - RNA, 15 nt, Streptococcus pneumoniae R6
aagagaacuucacgu

SEQ ID NO: 2180020 - RNA, 13 nt, Streptococcus pneumoniae R6
aagagaaacucaa

SEQ ID NO: 2180021 - RNA, 14 nt, Streptococcus pneumoniae R6
aagacucuugcccu

SEQ ID NO: 2180022 - RNA, 14 nt, Streptococcus pneumoniae R6
aagacuagacuugc

SEQ ID NO: 2180023 - RNA, 22 nt, Streptococcus pneumoniae R6
aagaccuuugaaaacugaacaa

SEQ ID NO: 2180024 - RNA, 16 nt, Streptococcus pneumoniae R6
aagaccaugaggaaac

SEQ ID NO: 2180025 - RNA, 16 nt, Streptococcus pneumoniae R6
aagaccucaauaugcu

SEQ ID NO: 2180026 - RNA, 14 nt, Streptococcus pneumoniae R6
aagaccgagaguuc

SEQ ID NO: 2180027 - RNA, 20 nt, Streptococcus pneumoniae R6
aagaaauagaaaacaaaaag

SEQ ID NO: 2180028 - RNA, 19 nt, Streptococcus pneumoniae R6
aagaaaucauacaccucuu

SEQ ID NO: 2180029 - RNA, 13 nt, Streptococcus pneumoniae R6
aagaaaucaucca

SEQ ID NO: 2180030 - RNA, 13 nt, Streptococcus pneumoniae R6
aagaaauccaaac

SEQ ID NO: 2180031 - RNA, 16 nt, Streptococcus pneumoniae R6
aagaaauaugacugua

SEQ ID NO: 2180032 - RNA, 14 nt, Streptococcus pneumoniae R6
aagaaauaguuuag

SEQ ID NO: 2180033 - RNA, 20 nt, Streptococcus pneumoniae R6
aagaauuuaaaaaucuauuu

SEQ ID NO: 2180034 - RNA, 20 nt, Streptococcus pneumoniae R6
aagaaugcucagacaauuuc

SEQ ID NO: 2180035 - RNA, 22 nt, Streptococcus pneumoniae R6
aagaauugaaagucuuggaaaa

SEQ ID NO: 2180036 - RNA, 22 nt, Streptococcus pneumoniae R6
aagaaugggauacuaucuccuu

SEQ ID NO: 2180037 - RNA, 16 nt, Streptococcus pneumoniae R6
aagaaugagugcugua

SEQ ID NO: 2180038 - RNA, 18 nt, Streptococcus pneumoniae R6
aagaaugaacaucccaag

SEQ ID NO: 2180039 - RNA, 14 nt, Streptococcus pneumoniae R6
aagaaucuuuucua

SEQ ID NO: 2180040 - RNA, 22 nt, Streptococcus pneumoniae R6
aagaaucuuuucuauuuuauag

SEQ ID NO: 2180041 - RNA, 18 nt, Streptococcus pneumoniae R6
aagaaucgucagaggaag

SEQ ID NO: 2180042 - RNA, 13 nt, Streptococcus pneumoniae R6
aagaaucugcaug

SEQ ID NO: 2180043 - RNA, 15 nt, Streptococcus pneumoniae R6
aagaauuugauuauu

SEQ ID NO: 2180044 - RNA, 15 nt, Streptococcus pneumoniae R6
aagacaaaucauuuu

SEQ ID NO: 2180045 - RNA, 17 nt, Streptococcus pneumoniae R6
aagacacauggaaggcc

SEQ ID NO: 2180046 - RNA, 12 nt, Streptococcus pneumoniae R6
aagacaauguuc

SEQ ID NO: 2180047 - RNA, 19 nt, Streptococcus pneumoniae R6
aagacaauguucuuuucuc

SEQ ID NO: 2180048 - RNA, 14 nt, Streptococcus pneumoniae R6
aagaccaaagaaaa

SEQ ID NO: 2180049 - RNA, 18 nt, Streptococcus pneumoniae R6
aagaccaaagaaaaacuc

SEQ ID NO: 2180050 - RNA, 15 nt, Streptococcus pneumoniae R6
aagaccaccucaucu

SEQ ID NO: 2180051 - RNA, 19 nt, Streptococcus pneumoniae R6
aagacaucuucucaggcuu

SEQ ID NO: 2180052 - RNA, 14 nt, Streptococcus pneumoniae R6
aagacaguugcauu

SEQ ID NO: 2180053 - RNA, 23 nt, Streptococcus pneumoniae R6
aagacagggccuuagcagacuuc

SEQ ID NO: 2180054 - RNA, 18 nt, Streptococcus pneumoniae R6
aagacagucugaaaaaua

SEQ ID NO: 2180055 - RNA, 17 nt, Streptococcus pneumoniae R6
aagacaucauauaaaua

SEQ ID NO: 2180056 - RNA, 13 nt, Streptococcus pneumoniae R6
aagauauuaagaa

SEQ ID NO: 2180057 - RNA, 21 nt, Streptococcus pneumoniae R6
aagauauugccgauaucacca

SEQ ID NO: 2180058 - RNA, 20 nt, Streptococcus pneumoniae R6
aagauaguaaaggacaccag

SEQ ID NO: 2180059 - RNA, 13 nt, Streptococcus pneumoniae R6
aagauaucacuca

SEQ ID NO: 2180060 - RNA, 17 nt, Streptococcus pneumoniae R6
aagauagucgauaaaaa

SEQ ID NO: 2180061 - RNA, 18 nt, Streptococcus pneumoniae R6
aagauauagccuguaaaa

SEQ ID NO: 2180062 - RNA, 12 nt, Streptococcus pneumoniae R6
aagauaguaaag

SEQ ID NO: 2180063 - RNA, 17 nt, Streptococcus pneumoniae R6
aagauagggcugaagga

SEQ ID NO: 2180064 - RNA, 22 nt, Streptococcus pneumoniae R6
aagauagcugugaagcguucca

SEQ ID NO: 2180065 - RNA, 19 nt, Streptococcus pneumoniae R6
aagauaggaaucccuggag

SEQ ID NO: 2180066 - RNA, 21 nt, Streptococcus pneumoniae R6
aagauagagguuauucaaaaa

SEQ ID NO: 2180067 - RNA, 16 nt, Streptococcus pneumoniae R6
aagauagccaugaacg

SEQ ID NO: 2180068 - RNA, 13 nt, Streptococcus pneumoniae R6
aagauagaaccca

SEQ ID NO: 2180069 - RNA, 17 nt, Streptococcus pneumoniae R6
aagauacuuagauuuuc

SEQ ID NO: 2180070 - RNA, 15 nt, Streptococcus pneumoniae R6
aagauacugaaucaa

SEQ ID NO: 2180071 - RNA, 22 nt, Streptococcus pneumoniae R6
aagauagagagcuccaaagaag

SEQ ID NO: 2180072 - RNA, 18 nt, Streptococcus pneumoniae R6
aagauacaaauuuauacu

SEQ ID NO: 2180073 - RNA, 20 nt, Streptococcus pneumoniae R6
aagauacgaauauccucuuc

SEQ ID NO: 2180074 - RNA, 23 nt, Streptococcus pneumoniae R6
aagauacgaauauccucuucacu

SEQ ID NO: 2180075 - RNA, 13 nt, Streptococcus pneumoniae R6
aagaguuucauga

SEQ ID NO: 2180076 - RNA, 14 nt, Streptococcus pneumoniae R6
aagaguuucaugag

SEQ ID NO: 2180077 - RNA, 20 nt, Streptococcus pneumoniae R6
aagaguuucgaaaagaauua

SEQ ID NO: 2180078 - RNA, 22 nt, Streptococcus pneumoniae R6
aagaguuaauggccaccuucaa

SEQ ID NO: 2180079 - RNA, 20 nt, Streptococcus pneumoniae R6
aagaguugccuaaaacucca

SEQ ID NO: 2180080 - RNA, 23 nt, Streptococcus pneumoniae R6
aagaguugcuugucaucuuccaa

SEQ ID NO: 2180081 - RNA, 17 nt, Streptococcus pneumoniae R6
aagaguugggcagaagu

SEQ ID NO: 2180082 - RNA, 17 nt, Streptococcus pneumoniae R6
aagaguugguagguaua

SEQ ID NO: 2180083 - RNA, 21 nt, Streptococcus pneumoniae R6
aagagucuccucaaaaacagg

SEQ ID NO: 2180084 - RNA, 21 nt, Streptococcus pneumoniae R6
aagagucccuuagaaaaacga

SEQ ID NO: 2180085 - RNA, 20 nt, Streptococcus pneumoniae R6
aagagucaagacaaggauaa

SEQ ID NO: 2180086 - RNA, 18 nt, Streptococcus pneumoniae R6
aagagucgaggaaauccc

SEQ ID NO: 2180087 - RNA, 20 nt, Streptococcus pneumoniae R6
aagauaaggccugauaagau

SEQ ID NO: 2180088 - RNA, 23 nt, Streptococcus pneumoniae R6
aagauaaggccugauaagaugac

SEQ ID NO: 2180089 - RNA, 23 nt, Streptococcus pneumoniae R6
aagauaacaguuuuuaauuuuuc

SEQ ID NO: 2180090 - RNA, 22 nt, Streptococcus pneumoniae R6
aagauaauagcgaugaagagag

SEQ ID NO: 2180091 - RNA, 17 nt, Streptococcus pneumoniae R6
aagauaaaguggucuuu

SEQ ID NO: 2180092 - RNA, 16 nt, Streptococcus pneumoniae R6
aagaguuuucugauuu

SEQ ID NO: 2180093 - RNA, 17 nt, Streptococcus pneumoniae R6
aagagccacucuuuauu

SEQ ID NO: 2180094 - RNA, 19 nt, Streptococcus pneumoniae R6
aagagccagaaaaaucccu

SEQ ID NO: 2180095 - RNA, 15 nt, Streptococcus pneumoniae R6
aagagcaucugccgc

SEQ ID NO: 2180096 - RNA, 15 nt, Streptococcus pneumoniae R6
aagagcaaaaacaau

SEQ ID NO: 2180097 - RNA, 16 nt, Streptococcus pneumoniae R6
aagagcaaaaacaauu

SEQ ID NO: 2180098 - RNA, 15 nt, Streptococcus pneumoniae R6
aagagcaaacuagga

SEQ ID NO: 2180099 - RNA, 17 nt, Streptococcus pneumoniae R6
aagagauuuucaaagag

SEQ ID NO: 2180100 - RNA, 14 nt, Streptococcus pneumoniae R6
aagagauuuucgaa

SEQ ID NO: 2180101 - RNA, 23 nt, Streptococcus pneumoniae R6
aagagauuuucgaagaguauaaa

SEQ ID NO: 2180102 - RNA, 22 nt, Streptococcus pneumoniae R6
aagagauguugacuuaaugaau

SEQ ID NO: 2180103 - RNA, 21 nt, Streptococcus pneumoniae R6
aagagauugcccaucauuccu

SEQ ID NO: 2180104 - RNA, 20 nt, Streptococcus pneumoniae R6
aagagaugagagauaaauau

SEQ ID NO: 2180105 - RNA, 13 nt, Streptococcus pneumoniae R6
aagagaguuacaa

SEQ ID NO: 2180106 - RNA, 16 nt, Streptococcus pneumoniae R6
aagagaguuacaaacu

SEQ ID NO: 2180107 - RNA, 22 nt, Streptococcus pneumoniae R6
aagagaguuacggguuuuaaac

SEQ ID NO: 2180108 - RNA, 21 nt, Streptococcus pneumoniae R6
aagagaccuuucauaaaguuu

SEQ ID NO: 2180109 - RNA, 16 nt, Streptococcus pneumoniae R6
aagagacucuuuaaga

SEQ ID NO: 2180110 - RNA, 18 nt, Streptococcus pneumoniae R6
aagaggugcgagccucuu

SEQ ID NO: 2180111 - RNA, 15 nt, Streptococcus pneumoniae R6
aagaguaaacuagaa

SEQ ID NO: 2180112 - RNA, 16 nt, Streptococcus pneumoniae R6
aagaguacagucuuug

SEQ ID NO: 2180113 - RNA, 17 nt, Streptococcus pneumoniae R6
aagaguacagucuuugc

SEQ ID NO: 2180114 - RNA, 21 nt, Streptococcus pneumoniae R6
aagaguacgaacaaguugugc

SEQ ID NO: 2180115 - RNA, 21 nt, Streptococcus pneumoniae R6
aagaguauuagccuuccauau

SEQ ID NO: 2180116 - RNA, 16 nt, Streptococcus pneumoniae R6
aagaguauaaaaucaa

SEQ ID NO: 2180117 - RNA, 15 nt, Streptococcus pneumoniae R6
aagaguauaaaauuu

SEQ ID NO: 2180118 - RNA, 19 nt, Streptococcus pneumoniae R6
aagaggagguaaaucccaa

SEQ ID NO: 2180119 - RNA, 20 nt, Streptococcus pneumoniae R6
aagagggcuucaaucucugc

SEQ ID NO: 2180120 - RNA, 22 nt, Streptococcus pneumoniae R6
aagagggcuucuucaacagcug

SEQ ID NO: 2180121 - RNA, 14 nt, Streptococcus pneumoniae R6
aagagcuucuuuug

SEQ ID NO: 2180122 - RNA, 15 nt, Streptococcus pneumoniae R6
aagagccucauaaaa

SEQ ID NO: 2180123 - RNA, 14 nt, Streptococcus pneumoniae R6
aauaaaucucugga

SEQ ID NO: 2180124 - RNA, 19 nt, Streptococcus pneumoniae R6
aauaaaucuuacugauaua

SEQ ID NO: 2180125 - RNA, 16 nt, Streptococcus pneumoniae R6
aauaaaugcaaagcca

SEQ ID NO: 2180126 - RNA, 19 nt, Streptococcus pneumoniae R6
aauaaaucauugauaguaa

SEQ ID NO: 2180127 - RNA, 18 nt, Streptococcus pneumoniae R6
aaguuuaauguccaugcu

SEQ ID NO: 2180128 - RNA, 19 nt, Streptococcus pneumoniae R6
aaguuuaauguccaugcuu

SEQ ID NO: 2180129 - RNA, 19 nt, Streptococcus pneumoniae R6
aaguugauucaugacaucu

SEQ ID NO: 2180130 - RNA, 15 nt, Streptococcus pneumoniae R6
aaguuguacaagaaa

SEQ ID NO: 2180131 - RNA, 19 nt, Streptococcus pneumoniae R6
aaguuguaguacugaacaa

SEQ ID NO: 2180132 - RNA, 22 nt, Streptococcus pneumoniae R6
aaguuguaguacugaacaauga

SEQ ID NO: 2180133 - RNA, 13 nt, Streptococcus pneumoniae R6
aaguuggucagga

SEQ ID NO: 2180134 - RNA, 17 nt, Streptococcus pneumoniae R6
aaguuguucuugaaguc

SEQ ID NO: 2180135 - RNA, 23 nt, Streptococcus pneumoniae R6
aaguuuaacccacuuaucauuau

SEQ ID NO: 2180136 - RNA, 15 nt, Streptococcus pneumoniae R6
aaguuuaaaaaaacu

SEQ ID NO: 2180137 - RNA, 11 nt, Streptococcus pneumoniae R6
aauaagaauac

SEQ ID NO: 2180138 - RNA, 20 nt, Streptococcus pneumoniae R6
aauaagaaagaccauagcaa

SEQ ID NO: 2180139 - RNA, 18 nt, Streptococcus pneumoniae R6
aauaagauaugaacaaau

SEQ ID NO: 2180140 - RNA, 17 nt, Streptococcus pneumoniae R6
aauaagaugagaacaaa

SEQ ID NO: 2180141 - RNA, 21 nt, Streptococcus pneumoniae R6
aauaagaugcgaacaaaucaa

SEQ ID NO: 2180142 - RNA, 14 nt, Streptococcus pneumoniae R6
aauaaccaucauuu

SEQ ID NO: 2180143 - RNA, 23 nt, Streptococcus pneumoniae R6
aauaacauuuccucgaagcaaga

SEQ ID NO: 2180144 - RNA, 22 nt, Streptococcus pneumoniae R6
aauaaccacuagcagccacuuu

SEQ ID NO: 2180145 - RNA, 17 nt, Streptococcus pneumoniae R6
aauaacuguaauuucuu

SEQ ID NO: 2180146 - RNA, 22 nt, Streptococcus pneumoniae R6
aauaacucucaucuaucuauuu

SEQ ID NO: 2180147 - RNA, 20 nt, Streptococcus pneumoniae R6
aauaaguucaacaaaucaga

SEQ ID NO: 2180148 - RNA, 18 nt, Streptococcus pneumoniae R6
aauaagggcaaagaaaag

SEQ ID NO: 2180149 - RNA, 23 nt, Streptococcus pneumoniae R6
aauaaguaguguuagauuaggaa

SEQ ID NO: 2180150 - RNA, 14 nt, Streptococcus pneumoniae R6
aauaaguccgaaaa

SEQ ID NO: 2180151 - RNA, 18 nt, Streptococcus pneumoniae R6
aauaaguccgaaaaauuu

SEQ ID NO: 2180152 - RNA, 22 nt, Streptococcus pneumoniae R6
aauaaguccgaaaaauuucucu

SEQ ID NO: 2180153 - RNA, 13 nt, Streptococcus pneumoniae R6
aauaaggaaaaca

SEQ ID NO: 2180154 - RNA, 17 nt, Streptococcus pneumoniae R6
aauaagguaauugaaga

SEQ ID NO: 2180155 - RNA, 17 nt, Streptococcus pneumoniae R6
aaaaagugguaucauau

SEQ ID NO: 2180156 - RNA, 22 nt, Streptococcus pneumoniae R6
aaaaagugguaucauauaaaua

SEQ ID NO: 2180157 - RNA, 22 nt, Streptococcus pneumoniae R6
aaaaaguguuugauaucuauca

SEQ ID NO: 2180158 - RNA, 21 nt, Streptococcus pneumoniae R6
aauaagauuccacguuucuaa

SEQ ID NO: 2180159 - RNA, 15 nt, Streptococcus pneumoniae R6
aaaaaguggaaagag

SEQ ID NO: 2180160 - RNA, 18 nt, Streptococcus pneumoniae R6
aaaaaguggaaagagcag

SEQ ID NO: 2180161 - RNA, 20 nt, Streptococcus pneumoniae R6
aauaagccgaagccaaucaa

SEQ ID NO: 2180162 - RNA, 14 nt, Streptococcus pneumoniae R6
aaaaauaaaucuau

SEQ ID NO: 2180163 - RNA, 22 nt, Streptococcus pneumoniae R6
aaaaauaaauaaaacucuugaa

SEQ ID NO: 2180164 - RNA, 14 nt, Streptococcus pneumoniae R6
aauaagcuuugaaa

SEQ ID NO: 2180165 - RNA, 20 nt, Streptococcus pneumoniae R6
aauaagcuuugaaaauucca

SEQ ID NO: 2180166 - RNA, 16 nt, Streptococcus pneumoniae R6
aaaaaguuuauauuau

SEQ ID NO: 2180167 - RNA, 16 nt, Streptococcus pneumoniae R6
aaaaauaaaaaaauuu

SEQ ID NO: 2180168 - RNA, 13 nt, Streptococcus pneumoniae R6
aaaaauaaaaaag

SEQ ID NO: 2180169 - RNA, 15 nt, Streptococcus pneumoniae R6
aaaaauaaaaaagag

SEQ ID NO: 2180170 - RNA, 22 nt, Streptococcus pneumoniae R6
aaaaaucccgucucaugaaagg

SEQ ID NO: 2180171 - RNA, 12 nt, Streptococcus pneumoniae R6
aaaaauccccca

SEQ ID NO: 2180172 - RNA, 14 nt, Streptococcus pneumoniae R6
aaaaaucguaaaaa

SEQ ID NO: 2180173 - RNA, 15 nt, Streptococcus pneumoniae R6
aaaaaucuaacuuuu

SEQ ID NO: 2180174 - RNA, 18 nt, Streptococcus pneumoniae R6
aaaaaucuucaaaaaagu

SEQ ID NO: 2180175 - RNA, 12 nt, Streptococcus pneumoniae R6
aaaaaucuauuu

SEQ ID NO: 2180176 - RNA, 17 nt, Streptococcus pneumoniae R6
aaaaaucuagucaucag

SEQ ID NO: 2180177 - RNA, 19 nt, Streptococcus pneumoniae R6
aaaaaugaagcaaacauuc

SEQ ID NO: 2180178 - RNA, 14 nt, Streptococcus pneumoniae R6
aauaauuucuuuuu

SEQ ID NO: 2180179 - RNA, 23 nt, Streptococcus pneumoniae R6
aauacaaaaaagccaaauccgcu

SEQ ID NO: 2180180 - RNA, 13 nt, Streptococcus pneumoniae R6
aauacaaaaaaua

SEQ ID NO: 2180181 - RNA, 12 nt, Streptococcus pneumoniae R6
aauacaaaaaua

SEQ ID NO: 2180182 - RNA, 21 nt, Streptococcus pneumoniae R6
aauaauuuugauucagauuca

SEQ ID NO: 2180183 - RNA, 13 nt, Streptococcus pneumoniae R6
aauaauuuuaacu

SEQ ID NO: 2180184 - RNA, 20 nt, Streptococcus pneumoniae R6
aauaaugaagacaucauaua

SEQ ID NO: 2180185 - RNA, 19 nt, Streptococcus pneumoniae R6
aaaaauaggcagaacaaga

SEQ ID NO: 2180186 - RNA, 23 nt, Streptococcus pneumoniae R6
aaaaauagcccuucggauaaaau

SEQ ID NO: 2180187 - RNA, 15 nt, Streptococcus pneumoniae R6
aaaaauagaaauaaa

SEQ ID NO: 2180188 - RNA, 12 nt, Streptococcus pneumoniae R6
aauaauacacuu

SEQ ID NO: 2180189 - RNA, 14 nt, Streptococcus pneumoniae R6
aauaauacaaaaaa

SEQ ID NO: 2180190 - RNA, 15 nt, Streptococcus pneumoniae R6
aauaauacaaaaaau

SEQ ID NO: 2180191 - RNA, 21 nt, Streptococcus pneumoniae R6
aaaaauauaaaaaccuaucau

SEQ ID NO: 2180192 - RNA, 20 nt, Streptococcus pneumoniae R6
aauaauagaaaacagacaaa

SEQ ID NO: 2180193 - RNA, 17 nt, Streptococcus pneumoniae R6
aaaaauaguauaccaca

SEQ ID NO: 2180194 - RNA, 17 nt, Streptococcus pneumoniae R6
aaaaauagggaaauccu

SEQ ID NO: 2180195 - RNA, 15 nt, Streptococcus pneumoniae R6
aauaccaaagaaguc

SEQ ID NO: 2180196 - RNA, 18 nt, Streptococcus pneumoniae R6
aauaccaaggcaucacga

SEQ ID NO: 2180197 - RNA, 17 nt, Streptococcus pneumoniae R6
aauaccaauaaaucgcu

SEQ ID NO: 2180198 - RNA, 17 nt, Streptococcus pneumoniae R6
aauacaugcaaguagaa

SEQ ID NO: 2180199 - RNA, 14 nt, Streptococcus pneumoniae R6
aauacagauaaaaa

SEQ ID NO: 2180200 - RNA, 15 nt, Streptococcus pneumoniae R6
aauacagauaaaaau

SEQ ID NO: 2180201 - RNA, 16 nt, Streptococcus pneumoniae R6
aauacagauaaaaauc

SEQ ID NO: 2180202 - RNA, 14 nt, Streptococcus pneumoniae R6
aauacagaagaaaa

SEQ ID NO: 2180203 - RNA, 15 nt, Streptococcus pneumoniae R6
aaaaaugcaaagacc

SEQ ID NO: 2180204 - RNA, 14 nt, Streptococcus pneumoniae R6
aaaaaugauaauag

SEQ ID NO: 2180205 - RNA, 18 nt, Streptococcus pneumoniae R6
aaaaaugauaauagauau

SEQ ID NO: 2180206 - RNA, 16 nt, Streptococcus pneumoniae R6
aauaccguuaaagcau

SEQ ID NO: 2180207 - RNA, 18 nt, Streptococcus pneumoniae R6
aauagcgaguaggcugga

SEQ ID NO: 2180208 - RNA, 22 nt, Streptococcus pneumoniae R6
aauagcgauagauguuuucaaa

SEQ ID NO: 2180209 - RNA, 14 nt, Streptococcus pneumoniae R6
aauagcaaggauga

SEQ ID NO: 2180210 - RNA, 15 nt, Streptococcus pneumoniae R6
aauagcaaggaugag

SEQ ID NO: 2180211 - RNA, 13 nt, Streptococcus pneumoniae R6
aauagcuuaaaau

SEQ ID NO: 2180212 - RNA, 23 nt, Streptococcus pneumoniae R6
aauagcuaguagggaaaccacua

SEQ ID NO: 2180213 - RNA, 15 nt, Streptococcus pneumoniae R6
aauagcuacagucau

SEQ ID NO: 2180214 - RNA, 24 nt, Streptococcus pneumoniae R6
aauagacuauaucauauagauaaa

SEQ ID NO: 2180215 - RNA, 20 nt, Streptococcus pneumoniae R6
aauagauguuaagcuccaau

SEQ ID NO: 2180216 - RNA, 22 nt, Streptococcus pneumoniae R6
aauaccuuauccaauucuucag

SEQ ID NO: 2180217 - RNA, 20 nt, Streptococcus pneumoniae R6
aauagaaguggauuuucuuc

SEQ ID NO: 2180218 - RNA, 16 nt, Streptococcus pneumoniae R6
aauagaagauuuccuc

SEQ ID NO: 2180219 - RNA, 17 nt, Streptococcus pneumoniae R6
aauagguacaaaaauau

SEQ ID NO: 2180220 - RNA, 17 nt, Streptococcus pneumoniae R6
aauagguggauaaaagu

SEQ ID NO: 2180221 - RNA, 12 nt, Streptococcus pneumoniae R6
aauaguacacuu

SEQ ID NO: 2180222 - RNA, 20 nt, Streptococcus pneumoniae R6
aauaguacgaaacaauugcu

SEQ ID NO: 2180223 - RNA, 15 nt, Streptococcus pneumoniae R6
aauaggcauaauacu

SEQ ID NO: 2180224 - RNA, 19 nt, Streptococcus pneumoniae R6
aauagcuuguuccaauuga

SEQ ID NO: 2180225 - RNA, 16 nt, Streptococcus pneumoniae R6
aauaggaaucaaccaa

SEQ ID NO: 2180226 - RNA, 15 nt, Streptococcus pneumoniae R6
aauaggacaucauaa

SEQ ID NO: 2180227 - RNA, 22 nt, Streptococcus pneumoniae R6
aauaguuaucguaauuaaaguu

SEQ ID NO: 2180228 - RNA, 21 nt, Streptococcus pneumoniae R6
aauaguucacugaacuauuuu

SEQ ID NO: 2180229 - RNA, 21 nt, Streptococcus pneumoniae R6
aauaguucagugaacuauuuu

SEQ ID NO: 2180230 - RNA, 21 nt, Streptococcus pneumoniae R6
aauauauuuauuauaaaauuu

SEQ ID NO: 2180231 - RNA, 14 nt, Streptococcus pneumoniae R6
aauauauucuccag

SEQ ID NO: 2180232 - RNA, 20 nt, Streptococcus pneumoniae R6
aauaucaaggauuuuuugaa

SEQ ID NO: 2180233 - RNA, 17 nt, Streptococcus pneumoniae R6
aauaucaagguuuuugc

SEQ ID NO: 2180234 - RNA, 22 nt, Streptococcus pneumoniae R6
aauaucaagauaagaaaaaaca

SEQ ID NO: 2180235 - RNA, 23 nt, Streptococcus pneumoniae R6
aauaucaagauaagaaaaaacag

SEQ ID NO: 2180236 - RNA, 19 nt, Streptococcus pneumoniae R6
aauauauuucucaauagca

SEQ ID NO: 2180237 - RNA, 20 nt, Streptococcus pneumoniae R6
aauauauuucucaauagcac

SEQ ID NO: 2180238 - RNA, 19 nt, Streptococcus pneumoniae R6
aauaucaaaaaaagaaguu

SEQ ID NO: 2180239 - RNA, 14 nt, Streptococcus pneumoniae R6
aauauauaaaaaau

SEQ ID NO: 2180240 - RNA, 15 nt, Streptococcus pneumoniae R6
aauauauaaaaaaua

SEQ ID NO: 2180241 - RNA, 17 nt, Streptococcus pneumoniae R6
aauauauaaaaaauaua

SEQ ID NO: 2180242 - RNA, 12 nt, Streptococcus pneumoniae R6
aauauaguaaaa

SEQ ID NO: 2180243 - RNA, 16 nt, Streptococcus pneumoniae R6
aauauaguaaaaugaa

SEQ ID NO: 2180244 - RNA, 19 nt, Streptococcus pneumoniae R6
aauauagugaaauuaacaa

SEQ ID NO: 2180245 - RNA, 21 nt, Streptococcus pneumoniae R6
aauauagugaaauuaacaaaa

SEQ ID NO: 2180246 - RNA, 23 nt, Streptococcus pneumoniae R6
aauauagucuacaauagcuuguu

SEQ ID NO: 2180247 - RNA, 13 nt, Streptococcus pneumoniae R6
aauauacaaaaaa

SEQ ID NO: 2180248 - RNA, 16 nt, Streptococcus pneumoniae R6
aauauaauuguaggaa

SEQ ID NO: 2180249 - RNA, 23 nt, Streptococcus pneumoniae R6
aauauaauagauugaaacuagaa

SEQ ID NO: 2180250 - RNA, 14 nt, Streptococcus pneumoniae R6
aauauaauaaacua

SEQ ID NO: 2180251 - RNA, 17 nt, Streptococcus pneumoniae R6
aauauagaggauauuuc

SEQ ID NO: 2180252 - RNA, 19 nt, Streptococcus pneumoniae R6
aauauagauggucaaaaua

SEQ ID NO: 2180253 - RNA, 20 nt, Streptococcus pneumoniae R6
aauauacuugauauaguuaa

SEQ ID NO: 2180254 - RNA, 23 nt, Streptococcus pneumoniae R6
aauaucuucggauuuuucuuuua

SEQ ID NO: 2180255 - RNA, 13 nt, Streptococcus pneumoniae R6
aauaugaacaaaa

SEQ ID NO: 2180256 - RNA, 22 nt, Streptococcus pneumoniae R6
aauaucugcacucucauucauc

SEQ ID NO: 2180257 - RNA, 17 nt, Streptococcus pneumoniae R6
aauaucuggacuuauau

SEQ ID NO: 2180258 - RNA, 22 nt, Streptococcus pneumoniae R6
aauaucuauccuaucuucuaga

SEQ ID NO: 2180259 - RNA, 18 nt, Streptococcus pneumoniae R6
aauaucaucgauuuuuuc

SEQ ID NO: 2180260 - RNA, 16 nt, Streptococcus pneumoniae R6
aauaucaggugugaaa

SEQ ID NO: 2180261 - RNA, 15 nt, Streptococcus pneumoniae R6
aauaucagccagagc

SEQ ID NO: 2180262 - RNA, 23 nt, Streptococcus pneumoniae R6
aauauccccugaaugaauugccu

SEQ ID NO: 2180263 - RNA, 18 nt, Streptococcus pneumoniae R6
aauauccuuauauaucca

SEQ ID NO: 2180264 - RNA, 13 nt, Streptococcus pneumoniae R6
aauauccucuuca

SEQ ID NO: 2180265 - RNA, 15 nt, Streptococcus pneumoniae R6
aaguagagauaagug

SEQ ID NO: 2180266 - RNA, 16 nt, Streptococcus pneumoniae R6
aaguagcaaaacacua

SEQ ID NO: 2180267 - RNA, 17 nt, Streptococcus pneumoniae R6
aaguacgagucaaguca

SEQ ID NO: 2180268 - RNA, 15 nt, Streptococcus pneumoniae R6
aaggggcucuuuguc

SEQ ID NO: 2180269 - RNA, 18 nt, Streptococcus pneumoniae R6
aagguuuuucaaaaaccu

SEQ ID NO: 2180270 - RNA, 22 nt, Streptococcus pneumoniae R6
aagguuuuugaaagucauauuu

SEQ ID NO: 2180271 - RNA, 17 nt, Streptococcus pneumoniae R6
aaguaaaauacaaacca

SEQ ID NO: 2180272 - RNA, 13 nt, Streptococcus pneumoniae R6
aaguaaagaguca

SEQ ID NO: 2180273 - RNA, 19 nt, Streptococcus pneumoniae R6
aagggcguugacaaucuuu

SEQ ID NO: 2180274 - RNA, 20 nt, Streptococcus pneumoniae R6
aagggcuuuucuaucacucc

SEQ ID NO: 2180275 - RNA, 19 nt, Streptococcus pneumoniae R6
aagggcuuuuuugacguau

SEQ ID NO: 2180276 - RNA, 14 nt, Streptococcus pneumoniae R6
aaguauuaaaauaa

SEQ ID NO: 2180277 - RNA, 19 nt, Streptococcus pneumoniae R6
aaguauuaaaauaaguuca

SEQ ID NO: 2180278 - RNA, 15 nt, Streptococcus pneumoniae R6
aaguauuguaagaau

SEQ ID NO: 2180279 - RNA, 17 nt, Streptococcus pneumoniae R6
aaguauuguaagaauuu

SEQ ID NO: 2180280 - RNA, 20 nt, Streptococcus pneumoniae R6
aaguauuguaagaauuugau

SEQ ID NO: 2180281 - RNA, 21 nt, Streptococcus pneumoniae R6
aaguauuguaagaauuugauu

SEQ ID NO: 2180282 - RNA, 17 nt, Streptococcus pneumoniae R6
aagucaaagccaaucaa

SEQ ID NO: 2180283 - RNA, 23 nt, Streptococcus pneumoniae R6
aagucaaauuaauuuauagaaaa

SEQ ID NO: 2180284 - RNA, 11 nt, Streptococcus pneumoniae R6
aagucaacacc

SEQ ID NO: 2180285 - RNA, 15 nt, Streptococcus pneumoniae R6
aagucaacaucucuu

SEQ ID NO: 2180286 - RNA, 17 nt, Streptococcus pneumoniae R6
aagucaacaucucuugu

SEQ ID NO: 2180287 - RNA, 21 nt, Streptococcus pneumoniae R6
aagucagcuaagcucgagaaa

SEQ ID NO: 2180288 - RNA, 22 nt, Streptococcus pneumoniae R6
aagucagcuaagcucgagaaag

SEQ ID NO: 2180289 - RNA, 21 nt, Streptococcus pneumoniae R6
aagucagcuaggcucgagaaa

SEQ ID NO: 2180290 - RNA, 22 nt, Streptococcus pneumoniae R6
aagucagcuaggcucgagaaag

SEQ ID NO: 2180291 - RNA, 16 nt, Streptococcus pneumoniae R6
aagucagcucaaaaca

SEQ ID NO: 2180292 - RNA, 19 nt, Streptococcus pneumoniae R6
aagucagcucaaaacacug

SEQ ID NO: 2180293 - RNA, 22 nt, Streptococcus pneumoniae R6
aagucagcucaaaacacuguuu

SEQ ID NO: 2180294 - RNA, 18 nt, Streptococcus pneumoniae R6
aagucagcucaaaacaug

SEQ ID NO: 2180295 - RNA, 17 nt, Streptococcus pneumoniae R6
aaguaggacgauaaaaa

SEQ ID NO: 2180296 - RNA, 21 nt, Streptococcus pneumoniae R6
aaguaggucccaucauagccg

SEQ ID NO: 2180297 - RNA, 20 nt, Streptococcus pneumoniae R6
aaguaguguuagauuaggaa

SEQ ID NO: 2180298 - RNA, 17 nt, Streptococcus pneumoniae R6
aaguaucuacuuugaaa

SEQ ID NO: 2180299 - RNA, 20 nt, Streptococcus pneumoniae R6
aaguauacucuaauugaaaa

SEQ ID NO: 2180300 - RNA, 19 nt, Streptococcus pneumoniae R6
aaguauagucaauuaguuu

SEQ ID NO: 2180301 - RNA, 23 nt, Streptococcus pneumoniae R6
aaguauagucaauuaguuuaaga

SEQ ID NO: 2180302 - RNA, 13 nt, Streptococcus pneumoniae R6
aaguccgaaaaau

SEQ ID NO: 2180303 - RNA, 17 nt, Streptococcus pneumoniae R6
aaguccgaauaggauuu

SEQ ID NO: 2180304 - RNA, 23 nt, Streptococcus pneumoniae R6
aaguccauagcgucaaagaaggc

SEQ ID NO: 2180305 - RNA, 22 nt, Streptococcus pneumoniae R6
aaguccauauuagggcaaauaa

SEQ ID NO: 2180306 - RNA, 20 nt, Streptococcus pneumoniae R6
aaguccaucguuaaucggag

SEQ ID NO: 2180307 - RNA, 17 nt, Streptococcus pneumoniae R6
aaguccauaaugucuuc

SEQ ID NO: 2180308 - RNA, 18 nt, Streptococcus pneumoniae R6
aaguccauaaugucuucu

SEQ ID NO: 2180309 - RNA, 22 nt, Streptococcus pneumoniae R6
aaguccauaaugucuucugcuc

SEQ ID NO: 2180310 - RNA, 22 nt, Streptococcus pneumoniae R6
aaguccuucccaucucgugaau

SEQ ID NO: 2180311 - RNA, 15 nt, Streptococcus pneumoniae R6
aaguccguuuucacc

SEQ ID NO: 2180312 - RNA, 21 nt, Streptococcus pneumoniae R6
aaguccucauuucaauagaaa

SEQ ID NO: 2180313 - RNA, 17 nt, Streptococcus pneumoniae R6
aaguccagaggacugcu

SEQ ID NO: 2180314 - RNA, 15 nt, Streptococcus pneumoniae R6
aagucauacuuucuc

SEQ ID NO: 2180315 - RNA, 13 nt, Streptococcus pneumoniae R6
aagucauaggcuu

SEQ ID NO: 2180316 - RNA, 19 nt, Streptococcus pneumoniae R6
aagucauaggcuugcucac

SEQ ID NO: 2180317 - RNA, 14 nt, Streptococcus pneumoniae R6
aagucaucaaaaau

SEQ ID NO: 2180318 - RNA, 16 nt, Streptococcus pneumoniae R6
aagucaucaaaaauag

SEQ ID NO: 2180319 - RNA, 23 nt, Streptococcus pneumoniae R6
aagucaucaaaaauagaaauaaa

SEQ ID NO: 2180320 - RNA, 14 nt, Streptococcus pneumoniae R6
aagucaucaaaauc

SEQ ID NO: 2180321 - RNA, 15 nt, Streptococcus pneumoniae R6
aagucauaaacaucu

SEQ ID NO: 2180322 - RNA, 21 nt, Streptococcus pneumoniae R6
aagucaucuaucaaaagaugu

SEQ ID NO: 2180323 - RNA, 23 nt, Streptococcus pneumoniae R6
aagucaugggcgaugaagagaua

SEQ ID NO: 2180324 - RNA, 21 nt, Streptococcus pneumoniae R6
aagucgaguucauguuucgga

SEQ ID NO: 2180325 - RNA, 20 nt, Streptococcus pneumoniae R6
aagugaaaguggcugugaua

SEQ ID NO: 2180326 - RNA, 14 nt, Streptococcus pneumoniae R6
aagugaaaggaaga

SEQ ID NO: 2180327 - RNA, 18 nt, Streptococcus pneumoniae R6
aagugacagucgcaaaga

SEQ ID NO: 2180328 - RNA, 22 nt, Streptococcus pneumoniae R6
aagugacagucgcaaagaggaa

SEQ ID NO: 2180329 - RNA, 14 nt, Streptococcus pneumoniae R6
aagugacauaugau

SEQ ID NO: 2180330 - RNA, 23 nt, Streptococcus pneumoniae R6
aagugacauaugauugucuccuu

SEQ ID NO: 2180331 - RNA, 21 nt, Streptococcus pneumoniae R6
aagucugacgcuggaaauaag

SEQ ID NO: 2180332 - RNA, 14 nt, Streptococcus pneumoniae R6
aagucucagcaguc

SEQ ID NO: 2180333 - RNA, 22 nt, Streptococcus pneumoniae R6
aagugcguugauaaucuuaucu

SEQ ID NO: 2180334 - RNA, 15 nt, Streptococcus pneumoniae R6
aaguuaaaaaaacua

SEQ ID NO: 2180335 - RNA, 16 nt, Streptococcus pneumoniae R6
aaguuaaaaaaacuau

SEQ ID NO: 2180336 - RNA, 12 nt, Streptococcus pneumoniae R6
aaguuaaaaaac

SEQ ID NO: 2180337 - RNA, 19 nt, Streptococcus pneumoniae R6
aaguguuguaaagucuaug

SEQ ID NO: 2180338 - RNA, 16 nt, Streptococcus pneumoniae R6
aaguguugaaaacccu

SEQ ID NO: 2180339 - RNA, 17 nt, Streptococcus pneumoniae R6
aaguguugaaaacccuu

SEQ ID NO: 2180340 - RNA, 23 nt, Streptococcus pneumoniae R6
aaguguuacuaucaaugauuuau

SEQ ID NO: 2180341 - RNA, 22 nt, Streptococcus pneumoniae R6
aaguuaugaaaaagauuuuuua

SEQ ID NO: 2180342 - RNA, 13 nt, Streptococcus pneumoniae R6
aaguuacucuauu

SEQ ID NO: 2180343 - RNA, 22 nt, Streptococcus pneumoniae R6
aaguuauuucuccuaaagaaaa

SEQ ID NO: 2180344 - RNA, 23 nt, Streptococcus pneumoniae R6
aaguuauuucuccuaaagaaaaa

SEQ ID NO: 2180345 - RNA, 18 nt, Streptococcus pneumoniae R6
aaguuaaguuuuuugacu

SEQ ID NO: 2180346 - RNA, 23 nt, Streptococcus pneumoniae R6
aaguuaaucucuccuuaucaaaa

SEQ ID NO: 2180347 - RNA, 19 nt, Streptococcus pneumoniae R6
aaguugacgaaguuguucu

SEQ ID NO: 2180348 - RNA, 14 nt, Streptococcus pneumoniae R6
aaguugaaagauua

SEQ ID NO: 2180349 - RNA, 14 nt, Streptococcus pneumoniae R6
aaguucauuuucuu

SEQ ID NO: 2180350 - RNA, 16 nt, Streptococcus pneumoniae R6
aaguucauuuucuuua

SEQ ID NO: 2180351 - RNA, 20 nt, Streptococcus pneumoniae R6
aaguucauuuucuuuacuuc

SEQ ID NO: 2180352 - RNA, 21 nt, Streptococcus pneumoniae R6
aaguucauuuucuuuacuucu

SEQ ID NO: 2180353 - RNA, 16 nt, Streptococcus pneumoniae R6
aaguucaucuucaaaa

SEQ ID NO: 2180354 - RNA, 18 nt, Streptococcus pneumoniae R6
aaguucacguaaauugcc

SEQ ID NO: 2180355 - RNA, 17 nt, Streptococcus pneumoniae R6
aaguucacucaaaccug

SEQ ID NO: 2180356 - RNA, 16 nt, Streptococcus pneumoniae R6
aaggcuagguaagucc

SEQ ID NO: 2180357 - RNA, 21 nt, Streptococcus pneumoniae R6
aaggcuauagucaaagggaaa

SEQ ID NO: 2180358 - RNA, 13 nt, Streptococcus pneumoniae R6
aaggcugaaauug

SEQ ID NO: 2180359 - RNA, 19 nt, Streptococcus pneumoniae R6
aaggcugcgcaacacacug

SEQ ID NO: 2180360 - RNA, 23 nt, Streptococcus pneumoniae R6
aaggcugcgcaacacacuguuuu

SEQ ID NO: 2180361 - RNA, 16 nt, Streptococcus pneumoniae R6
aaggcuggucgagaag

SEQ ID NO: 2180362 - RNA, 23 nt, Streptococcus pneumoniae R6
aaggcuuuauucuuaaauccaca

SEQ ID NO: 2180363 - RNA, 19 nt, Streptococcus pneumoniae R6
aaggcuugaguauaugggu

SEQ ID NO: 2180364 - RNA, 13 nt, Streptococcus pneumoniae R6
aaggcuuugaaca

SEQ ID NO: 2180365 - RNA, 17 nt, Streptococcus pneumoniae R6
aaggcuuuaccaaaaau

SEQ ID NO: 2180366 - RNA, 14 nt, Streptococcus pneumoniae R6
aaggcagauuucaa

SEQ ID NO: 2180367 - RNA, 21 nt, Streptococcus pneumoniae R6
aaggcaguacuuugagcaacc

SEQ ID NO: 2180368 - RNA, 17 nt, Streptococcus pneumoniae R6
aaggcacuagcuccaaa

SEQ ID NO: 2180369 - RNA, 23 nt, Streptococcus pneumoniae R6
aaggcacuagcuccaaacauaac

SEQ ID NO: 2180370 - RNA, 16 nt, Streptococcus pneumoniae R6
aaggcauaaacuugca

SEQ ID NO: 2180371 - RNA, 21 nt, Streptococcus pneumoniae R6
aaggcaugggccccagcuucg

SEQ ID NO: 2180372 - RNA, 20 nt, Streptococcus pneumoniae R6
aaggcaucuugucaaagagu

SEQ ID NO: 2180373 - RNA, 17 nt, Streptococcus pneumoniae R6
aaggaaugccaaagaca

SEQ ID NO: 2180374 - RNA, 13 nt, Streptococcus pneumoniae R6
aaggaauuuuaga

SEQ ID NO: 2180375 - RNA, 21 nt, Streptococcus pneumoniae R6
aaggacaaauuuuguccuuuc

SEQ ID NO: 2180376 - RNA, 19 nt, Streptococcus pneumoniae R6
aaggaagauguaaaaguuu

SEQ ID NO: 2180377 - RNA, 21 nt, Streptococcus pneumoniae R6
aaggaagcacacaaaucuucu

SEQ ID NO: 2180378 - RNA, 13 nt, Streptococcus pneumoniae R6
aaggaaguugagu

SEQ ID NO: 2180379 - RNA, 21 nt, Streptococcus pneumoniae R6
aaggaaguuguguucauuguu

SEQ ID NO: 2180380 - RNA, 13 nt, Streptococcus pneumoniae R6
aaggaugacaaua

SEQ ID NO: 2180381 - RNA, 23 nt, Streptococcus pneumoniae R6
aaggaucuagcgcaaagcuaaau

SEQ ID NO: 2180382 - RNA, 16 nt, Streptococcus pneumoniae R6
aaggacacgcuucuuu

SEQ ID NO: 2180383 - RNA, 22 nt, Streptococcus pneumoniae R6
aaggacuccaccauaguguuuc

SEQ ID NO: 2180384 - RNA, 23 nt, Streptococcus pneumoniae R6
aagcuuuaugcuuggugagaaag

SEQ ID NO: 2180385 - RNA, 20 nt, Streptococcus pneumoniae R6
aagcuuuaagacagaugaca

SEQ ID NO: 2180386 - RNA, 20 nt, Streptococcus pneumoniae R6
aagcuuguuguugugauaaa

SEQ ID NO: 2180387 - RNA, 18 nt, Streptococcus pneumoniae R6
aagcuuguuuaaaaucuc

SEQ ID NO: 2180388 - RNA, 24 nt, Streptococcus pneumoniae R6
aagcuuguuuaaaaucucuuuauu

SEQ ID NO: 2180389 - RNA, 18 nt, Streptococcus pneumoniae R6
aagcuugaguggaaaaac

SEQ ID NO: 2180390 - RNA, 20 nt, Streptococcus pneumoniae R6
aagcuugaguggaaaaaccu

SEQ ID NO: 2180391 - RNA, 17 nt, Streptococcus pneumoniae R6
aagcuuccgguaaaguu

SEQ ID NO: 2180392 - RNA, 20 nt, Streptococcus pneumoniae R6
aagcucaucuaauguuuuua

SEQ ID NO: 2180393 - RNA, 21 nt, Streptococcus pneumoniae R6
aagcuccaauuuauuuguuua

SEQ ID NO: 2180394 - RNA, 19 nt, Streptococcus pneumoniae R6
aagcuggcuaauaauucca

SEQ ID NO: 2180395 - RNA, 16 nt, Streptococcus pneumoniae R6
aagcuggcuugagguc

SEQ ID NO: 2180396 - RNA, 15 nt, Streptococcus pneumoniae R6
aagcuaguacauucu

SEQ ID NO: 2180397 - RNA, 20 nt, Streptococcus pneumoniae R6
aagcuagucgcagguugcuc

SEQ ID NO: 2180398 - RNA, 21 nt, Streptococcus pneumoniae R6
aagcuagauuuaaaacuguga

SEQ ID NO: 2180399 - RNA, 22 nt, Streptococcus pneumoniae R6
aagcuagauuuaaaacugugau

SEQ ID NO: 2180400 - RNA, 19 nt, Streptococcus pneumoniae R6
aagcuagccgcagguugcu

SEQ ID NO: 2180401 - RNA, 19 nt, Streptococcus pneumoniae R6
aagcuagccguagguugcu

SEQ ID NO: 2180402 - RNA, 22 nt, Streptococcus pneumoniae R6
aagcuauccuggcguaguaaau

SEQ ID NO: 2180403 - RNA, 21 nt, Streptococcus pneumoniae R6
aagcuauagauaaggucaucu

SEQ ID NO: 2180404 - RNA, 13 nt, Streptococcus pneumoniae R6
aagcuacuauaaa

SEQ ID NO: 2180405 - RNA, 18 nt, Streptococcus pneumoniae R6
aagcuacuauaaaagagg

SEQ ID NO: 2180406 - RNA, 21 nt, Streptococcus pneumoniae R6
aagcuacuauaaaagaggagg

SEQ ID NO: 2180407 - RNA, 22 nt, Streptococcus pneumoniae R6
aagcuacuauaaaagaggaggu

SEQ ID NO: 2180408 - RNA, 14 nt, Streptococcus pneumoniae R6
aagcuacauagaga

SEQ ID NO: 2180409 - RNA, 14 nt, Streptococcus pneumoniae R6
aagaucaguucauu

SEQ ID NO: 2180410 - RNA, 17 nt, Streptococcus pneumoniae R6
aagaucuagaaaggaca

SEQ ID NO: 2180411 - RNA, 17 nt, Streptococcus pneumoniae R6
aagccggcuugucuuug

SEQ ID NO: 2180412 - RNA, 14 nt, Streptococcus pneumoniae R6
aagccuucuguugg

SEQ ID NO: 2180413 - RNA, 13 nt, Streptococcus pneumoniae R6
aagccuucauccu

SEQ ID NO: 2180414 - RNA, 16 nt, Streptococcus pneumoniae R6
aagccuauucccugag

SEQ ID NO: 2180415 - RNA, 17 nt, Streptococcus pneumoniae R6
aagccucuuuauccauc

SEQ ID NO: 2180416 - RNA, 23 nt, Streptococcus pneumoniae R6
aagcgaugauaagaaucguguug

SEQ ID NO: 2180417 - RNA, 18 nt, Streptococcus pneumoniae R6
aagcgagguuuuuaaagg

SEQ ID NO: 2180418 - RNA, 16 nt, Streptococcus pneumoniae R6
aagcgauaaaaauccg

SEQ ID NO: 2180419 - RNA, 14 nt, Streptococcus pneumoniae R6
aagcgaaacaaccg

SEQ ID NO: 2180420 - RNA, 23 nt, Streptococcus pneumoniae R6
aagccuuuaucugcccaaagaca

SEQ ID NO: 2180421 - RNA, 22 nt, Streptococcus pneumoniae R6
aagccuuguuuccaaggaaagu

SEQ ID NO: 2180422 - RNA, 15 nt, Streptococcus pneumoniae R6
aauuuuuuucagaaa

SEQ ID NO: 2180423 - RNA, 22 nt, Streptococcus pneumoniae R6
acaacucuuauacuuuucucuu

SEQ ID NO: 2180424 - RNA, 14 nt, Streptococcus pneumoniae R6
acaacuuauaaaaa

SEQ ID NO: 2180425 - RNA, 20 nt, Streptococcus pneumoniae R6
acaacuuauaaaaaacacaa

SEQ ID NO: 2180426 - RNA, 14 nt, Streptococcus pneumoniae R6
acaagaaaagugca

SEQ ID NO: 2180427 - RNA, 19 nt, Streptococcus pneumoniae R6
acaauaacacccuuguaaa

SEQ ID NO: 2180428 - RNA, 15 nt, Streptococcus pneumoniae R6
acaauaaaucuguca

SEQ ID NO: 2180429 - RNA, 22 nt, Streptococcus pneumoniae R6
acaauagcuuguuccaauugau

SEQ ID NO: 2180430 - RNA, 23 nt, Streptococcus pneumoniae R6
acaauagcuuguuccaauugauu

SEQ ID NO: 2180431 - RNA, 17 nt, Streptococcus pneumoniae R6
acaaguauuguaagaau

SEQ ID NO: 2180432 - RNA, 18 nt, Streptococcus pneumoniae R6
acaaguauuguaagaauu

SEQ ID NO: 2180433 - RNA, 16 nt, Streptococcus pneumoniae R6
acaagucagcucaaag

SEQ ID NO: 2180434 - RNA, 22 nt, Streptococcus pneumoniae R6
acaagucuuaaaaucacaaaaa

SEQ ID NO: 2180435 - RNA, 12 nt, Streptococcus pneumoniae R6
acaauaaagaua

SEQ ID NO: 2180436 - RNA, 21 nt, Streptococcus pneumoniae R6
acaauaaagauaagcgcuagc

SEQ ID NO: 2180437 - RNA, 14 nt, Streptococcus pneumoniae R6
acaauaaagguguu

SEQ ID NO: 2180438 - RNA, 23 nt, Streptococcus pneumoniae R6
acaauaaagguguucaauccacu

SEQ ID NO: 2180439 - RNA, 20 nt, Streptococcus pneumoniae R6
acaauaaaacgcauaguaca

SEQ ID NO: 2180440 - RNA, 19 nt, Streptococcus pneumoniae R6
acaauaaaacgcaucauau

SEQ ID NO: 2180441 - RNA, 22 nt, Streptococcus pneumoniae R6
acaauaaaacgcaucauaucaa

SEQ ID NO: 2180442 - RNA, 22 nt, Streptococcus pneumoniae R6
acaagaacucucggucuuguuu

SEQ ID NO: 2180443 - RNA, 22 nt, Streptococcus pneumoniae R6
acaagacaaaagagccucauaa

SEQ ID NO: 2180444 - RNA, 12 nt, Streptococcus pneumoniae R6
acaagagcaagg

SEQ ID NO: 2180445 - RNA, 14 nt, Streptococcus pneumoniae R6
acaagagcaaggaa

SEQ ID NO: 2180446 - RNA, 19 nt, Streptococcus pneumoniae R6
acaagaguucuagcuuccc

SEQ ID NO: 2180447 - RNA, 13 nt, Streptococcus pneumoniae R6
acaagauaggaga

SEQ ID NO: 2180448 - RNA, 21 nt, Streptococcus pneumoniae R6
acaaugguuagaaaaucaagu

SEQ ID NO: 2180449 - RNA, 17 nt, Streptococcus pneumoniae R6
acaauguagccaucauc

SEQ ID NO: 2180450 - RNA, 18 nt, Streptococcus pneumoniae R6
acaauguaauauuggcua

SEQ ID NO: 2180451 - RNA, 17 nt, Streptococcus pneumoniae R6
acaauguaccugcaaau

SEQ ID NO: 2180452 - RNA, 17 nt, Streptococcus pneumoniae R6
acaaugcuguuucuaua

SEQ ID NO: 2180453 - RNA, 13 nt, Streptococcus pneumoniae R6
acaaucuuaaagu

SEQ ID NO: 2180454 - RNA, 22 nt, Streptococcus pneumoniae R6
acaaucuuaccaaccucagaau

SEQ ID NO: 2180455 - RNA, 12 nt, Streptococcus pneumoniae R6
acaaucuuuucu

SEQ ID NO: 2180456 - RNA, 13 nt, Streptococcus pneumoniae R6
acaaucuuuucuu

SEQ ID NO: 2180457 - RNA, 15 nt, Streptococcus pneumoniae R6
acaaucuuuucuuua

SEQ ID NO: 2180458 - RNA, 17 nt, Streptococcus pneumoniae R6
acaaucuuuucuuuauc

SEQ ID NO: 2180459 - RNA, 14 nt, Streptococcus pneumoniae R6
acaaugaaaaaaac

SEQ ID NO: 2180460 - RNA, 15 nt, Streptococcus pneumoniae R6
acaaugaaaaaaaca

SEQ ID NO: 2180461 - RNA, 16 nt, Streptococcus pneumoniae R6
acaaugaaaaaaacaa

SEQ ID NO: 2180462 - RNA, 14 nt, Streptococcus pneumoniae R6
acaauauagccuaa

SEQ ID NO: 2180463 - RNA, 18 nt, Streptococcus pneumoniae R6
acaauuauauaaaccaaa

SEQ ID NO: 2180464 - RNA, 15 nt, Streptococcus pneumoniae R6
acaauuaggaacuuu

SEQ ID NO: 2180465 - RNA, 17 nt, Streptococcus pneumoniae R6
acaauugcucuucugaa

SEQ ID NO: 2180466 - RNA, 14 nt, Streptococcus pneumoniae R6
acaauuggaaauaa

SEQ ID NO: 2180467 - RNA, 15 nt, Streptococcus pneumoniae R6
acaauuggaaauaac

SEQ ID NO: 2180468 - RNA, 19 nt, Streptococcus pneumoniae R6
acaauuguaaaaagaggga

SEQ ID NO: 2180469 - RNA, 22 nt, Streptococcus pneumoniae R6
acaauuaagguuuuaccuucaa

SEQ ID NO: 2180470 - RNA, 15 nt, Streptococcus pneumoniae R6
acaauguuuuagaaa

SEQ ID NO: 2180471 - RNA, 21 nt, Streptococcus pneumoniae R6
acaauguuuuagaaaucacag

SEQ ID NO: 2180472 - RNA, 21 nt, Streptococcus pneumoniae R6
acaauguuuugaucugacuuc

SEQ ID NO: 2180473 - RNA, 21 nt, Streptococcus pneumoniae R6
acaaugugcucagaaacaaga

SEQ ID NO: 2180474 - RNA, 22 nt, Streptococcus pneumoniae R6
acaaugugcucagaaacaagaa

SEQ ID NO: 2180475 - RNA, 16 nt, Streptococcus pneumoniae R6
acaauguucuuuucuc

SEQ ID NO: 2180476 - RNA, 23 nt, Streptococcus pneumoniae R6
acaauguucuuuucucuagcuuu

SEQ ID NO: 2180477 - RNA, 19 nt, Streptococcus pneumoniae R6
acaaugucuaaaucuuuaa

SEQ ID NO: 2180478 - RNA, 14 nt, Streptococcus pneumoniae R6
acaauuucauuucu

SEQ ID NO: 2180479 - RNA, 15 nt, Streptococcus pneumoniae R6
acaauuuaaccaaac

SEQ ID NO: 2180480 - RNA, 18 nt, Streptococcus pneumoniae R6
acaauuuaaccaaaccaa

SEQ ID NO: 2180481 - RNA, 13 nt, Streptococcus pneumoniae R6
acaauuucucgug

SEQ ID NO: 2180482 - RNA, 21 nt, Streptococcus pneumoniae R6
acacacgaagcauaucagaca

SEQ ID NO: 2180483 - RNA, 23 nt, Streptococcus pneumoniae R6
acacagcuguguuccucuuuuug

SEQ ID NO: 2180484 - RNA, 19 nt, Streptococcus pneumoniae R6
acacaggaauacuaaaaua

SEQ ID NO: 2180485 - RNA, 19 nt, Streptococcus pneumoniae R6
acaccacuuuuggucagag

SEQ ID NO: 2180486 - RNA, 23 nt, Streptococcus pneumoniae R6
acacauaguaguaaacacacuau

SEQ ID NO: 2180487 - RNA, 17 nt, Streptococcus pneumoniae R6
acacaguuuugagguug

SEQ ID NO: 2180488 - RNA, 14 nt, Streptococcus pneumoniae R6
acacaguguacaua

SEQ ID NO: 2180489 - RNA, 16 nt, Streptococcus pneumoniae R6
acaccaguauucuuuu

SEQ ID NO: 2180490 - RNA, 17 nt, Streptococcus pneumoniae R6
acaccaguauucuuuuu

SEQ ID NO: 2180491 - RNA, 20 nt, Streptococcus pneumoniae R6
acaccaguauucuuuuuaaa

SEQ ID NO: 2180492 - RNA, 19 nt, Streptococcus pneumoniae R6
acaccaucauagucuuuau

SEQ ID NO: 2180493 - RNA, 20 nt, Streptococcus pneumoniae R6
acagccaugguguguaguug

SEQ ID NO: 2180494 - RNA, 18 nt, Streptococcus pneumoniae R6
acagcauuggaggcaaac

SEQ ID NO: 2180495 - RNA, 19 nt, Streptococcus pneumoniae R6
acagcauuggaggcaaacu

SEQ ID NO: 2180496 - RNA, 16 nt, Streptococcus pneumoniae R6
acagcuguaucaauug

SEQ ID NO: 2180497 - RNA, 18 nt, Streptococcus pneumoniae R6
acagcugucgcaccugac

SEQ ID NO: 2180498 - RNA, 21 nt, Streptococcus pneumoniae R6
acagaguauuaaauugcgauu

SEQ ID NO: 2180499 - RNA, 13 nt, Streptococcus pneumoniae R6
acagauaagagca

SEQ ID NO: 2180500 - RNA, 14 nt, Streptococcus pneumoniae R6
acagauaagagcaa

SEQ ID NO: 2180501 - RNA, 21 nt, Streptococcus pneumoniae R6
acagauaagagcaacaaauau

SEQ ID NO: 2180502 - RNA, 15 nt, Streptococcus pneumoniae R6
acagaggcuggacaa

SEQ ID NO: 2180503 - RNA, 19 nt, Streptococcus pneumoniae R6
acagaugagcgaauaguau

SEQ ID NO: 2180504 - RNA, 13 nt, Streptococcus pneumoniae R6
acagauagaaggu

SEQ ID NO: 2180505 - RNA, 14 nt, Streptococcus pneumoniae R6
acagauuucuuaga

SEQ ID NO: 2180506 - RNA, 21 nt, Streptococcus pneumoniae R6
acagauuugaaaacugaugaa

SEQ ID NO: 2180507 - RNA, 22 nt, Streptococcus pneumoniae R6
acagauucuacucuguuuucac

SEQ ID NO: 2180508 - RNA, 21 nt, Streptococcus pneumoniae R6
acagauucaucagggcaaagg

SEQ ID NO: 2180509 - RNA, 18 nt, Streptococcus pneumoniae R6
acagcauagaaguuuccu

SEQ ID NO: 2180510 - RNA, 14 nt, Streptococcus pneumoniae R6
acagcaccuuuugc

SEQ ID NO: 2180511 - RNA, 14 nt, Streptococcus pneumoniae R6
acacucaaaucaaa

SEQ ID NO: 2180512 - RNA, 23 nt, Streptococcus pneumoniae R6
acacugauuucaaggcauuuuuu

SEQ ID NO: 2180513 - RNA, 15 nt, Streptococcus pneumoniae R6
acacuguuuugaggu

SEQ ID NO: 2180514 - RNA, 17 nt, Streptococcus pneumoniae R6
acacuguuuuaagguug

SEQ ID NO: 2180515 - RNA, 14 nt, Streptococcus pneumoniae R6
acacuuccaauaau

SEQ ID NO: 2180516 - RNA, 16 nt, Streptococcus pneumoniae R6
acacuuccaauaaugu

SEQ ID NO: 2180517 - RNA, 22 nt, Streptococcus pneumoniae R6
acacuagacagugaaaucauac

SEQ ID NO: 2180518 - RNA, 16 nt, Streptococcus pneumoniae R6
acacuagaugcaucug

SEQ ID NO: 2180519 - RNA, 15 nt, Streptococcus pneumoniae R6
acacuaaacaaauga

SEQ ID NO: 2180520 - RNA, 21 nt, Streptococcus pneumoniae R6
acaccgagaaaggcgacauca

SEQ ID NO: 2180521 - RNA, 19 nt, Streptococcus pneumoniae R6
acaccgacagcaaggucaa

SEQ ID NO: 2180522 - RNA, 18 nt, Streptococcus pneumoniae R6
acagagaaagucagcugg

SEQ ID NO: 2180523 - RNA, 16 nt, Streptococcus pneumoniae R6
acagacgauuaaacuu

SEQ ID NO: 2180524 - RNA, 14 nt, Streptococcus pneumoniae R6
acagacauaugaaa

SEQ ID NO: 2180525 - RNA, 18 nt, Streptococcus pneumoniae R6
acagaaucuucauauaca

SEQ ID NO: 2180526 - RNA, 20 nt, Streptococcus pneumoniae R6
acagaaucccagauaaagcu

SEQ ID NO: 2180527 - RNA, 13 nt, Streptococcus pneumoniae R6
acagaagauaggc

SEQ ID NO: 2180528 - RNA, 18 nt, Streptococcus pneumoniae R6
acagaagauugauaggau

SEQ ID NO: 2180529 - RNA, 17 nt, Streptococcus pneumoniae R6
acagaagcuuuaccauc

SEQ ID NO: 2180530 - RNA, 17 nt, Streptococcus pneumoniae R6
acagaagaagugacagu

SEQ ID NO: 2180531 - RNA, 20 nt, Streptococcus pneumoniae R6
acagaagaagugacagucgc

SEQ ID NO: 2180532 - RNA, 18 nt, Streptococcus pneumoniae R6
acacuuguaaagaguaca

SEQ ID NO: 2180533 - RNA, 15 nt, Streptococcus pneumoniae R6
acacuugccuaaaca

SEQ ID NO: 2180534 - RNA, 20 nt, Streptococcus pneumoniae R6
acacuucugcuucuaaaaca

SEQ ID NO: 2180535 - RNA, 23 nt, Streptococcus pneumoniae R6
acacuucugcuucuaaaacauug

SEQ ID NO: 2180536 - RNA, 14 nt, Streptococcus pneumoniae R6
acacuugacaaaga

SEQ ID NO: 2180537 - RNA, 13 nt, Streptococcus pneumoniae R6
acagaaccuugga

SEQ ID NO: 2180538 - RNA, 15 nt, Streptococcus pneumoniae R6
acagaaccuuggaaa

SEQ ID NO: 2180539 - RNA, 16 nt, Streptococcus pneumoniae R6
acauccacgagaaaga

SEQ ID NO: 2180540 - RNA, 14 nt, Streptococcus pneumoniae R6
acaucauauaaaua

SEQ ID NO: 2180541 - RNA, 17 nt, Streptococcus pneumoniae R6
acaucacuguuuuuuau

SEQ ID NO: 2180542 - RNA, 18 nt, Streptococcus pneumoniae R6
acaucaaaaacagccgaa

SEQ ID NO: 2180543 - RNA, 20 nt, Streptococcus pneumoniae R6
acauaugaaaucuuuuugau

SEQ ID NO: 2180544 - RNA, 20 nt, Streptococcus pneumoniae R6
acauauuucuagaaauuaau

SEQ ID NO: 2180545 - RNA, 21 nt, Streptococcus pneumoniae R6
acauauuucuagaaauuaauu

SEQ ID NO: 2180546 - RNA, 14 nt, Streptococcus pneumoniae R6
acauauuuucaaaa

SEQ ID NO: 2180547 - RNA, 17 nt, Streptococcus pneumoniae R6
acauaugauugucuccu

SEQ ID NO: 2180548 - RNA, 17 nt, Streptococcus pneumoniae R6
acauauauucaacgaaa

SEQ ID NO: 2180549 - RNA, 20 nt, Streptococcus pneumoniae R6
acauauacacuuaaauucau

SEQ ID NO: 2180550 - RNA, 23 nt, Streptococcus pneumoniae R6
acauauacacuuaaauucauaua

SEQ ID NO: 2180551 - RNA, 22 nt, Streptococcus pneumoniae R6
acauacgcauacuaauagcacc

SEQ ID NO: 2180552 - RNA, 15 nt, Streptococcus pneumoniae R6
acauagagagacagc

SEQ ID NO: 2180553 - RNA, 21 nt, Streptococcus pneumoniae R6
acauagaaaaugguuccaaaa

SEQ ID NO: 2180554 - RNA, 15 nt, Streptococcus pneumoniae R6
acauacuuuaucuuc

SEQ ID NO: 2180555 - RNA, 22 nt, Streptococcus pneumoniae R6
acauacuuuaucuucuauugca

SEQ ID NO: 2180556 - RNA, 17 nt, Streptococcus pneumoniae R6
acaggccaauacagaua

SEQ ID NO: 2180557 - RNA, 15 nt, Streptococcus pneumoniae R6
acauaauuuuagugc

SEQ ID NO: 2180558 - RNA, 15 nt, Streptococcus pneumoniae R6
acauaauuuaaaaua

SEQ ID NO: 2180559 - RNA, 18 nt, Streptococcus pneumoniae R6
acauaccaccaaguacag

SEQ ID NO: 2180560 - RNA, 16 nt, Streptococcus pneumoniae R6
acauacaacuuaaaaa

SEQ ID NO: 2180561 - RNA, 16 nt, Streptococcus pneumoniae R6
acauuuauagaaauua

SEQ ID NO: 2180562 - RNA, 19 nt, Streptococcus pneumoniae R6
acauuuaucuauaaacaaa

SEQ ID NO: 2180563 - RNA, 22 nt, Streptococcus pneumoniae R6
acauugguucuuuuuacuuaua

SEQ ID NO: 2180564 - RNA, 21 nt, Streptococcus pneumoniae R6
acauucucccgcccuuuuuuc

SEQ ID NO: 2180565 - RNA, 14 nt, Streptococcus pneumoniae R6
acauucuaaaacgc

SEQ ID NO: 2180566 - RNA, 16 nt, Streptococcus pneumoniae R6
acauucuaaaacgcau

SEQ ID NO: 2180567 - RNA, 15 nt, Streptococcus pneumoniae R6
acauucgaaugauau

SEQ ID NO: 2180568 - RNA, 14 nt, Streptococcus pneumoniae R6
acauucccaaacaa

SEQ ID NO: 2180569 - RNA, 16 nt, Streptococcus pneumoniae R6
acauucccaaacaaaa

SEQ ID NO: 2180570 - RNA, 17 nt, Streptococcus pneumoniae R6
acauucccaaacaaaaa

SEQ ID NO: 2180571 - RNA, 18 nt, Streptococcus pneumoniae R6
acauucccaaacaaaaaa

SEQ ID NO: 2180572 - RNA, 18 nt, Streptococcus pneumoniae R6
acauguuuugagcugacu

SEQ ID NO: 2180573 - RNA, 14 nt, Streptococcus pneumoniae R6
acauuauccaugaa

SEQ ID NO: 2180574 - RNA, 18 nt, Streptococcus pneumoniae R6
acauuauugauuccguca

SEQ ID NO: 2180575 - RNA, 19 nt, Streptococcus pneumoniae R6
acauuauugauuccgucau

SEQ ID NO: 2180576 - RNA, 19 nt, Streptococcus pneumoniae R6
acauuaugcguuuuuguga

SEQ ID NO: 2180577 - RNA, 20 nt, Streptococcus pneumoniae R6
acauuaugcguuuuugugau

SEQ ID NO: 2180578 - RNA, 19 nt, Streptococcus pneumoniae R6
acaugcuguuagaagacuu

SEQ ID NO: 2180579 - RNA, 21 nt, Streptococcus pneumoniae R6
acauggaaauuauaaaaccau

SEQ ID NO: 2180580 - RNA, 19 nt, Streptococcus pneumoniae R6
acauggcgccauuuggccc

SEQ ID NO: 2180581 - RNA, 12 nt, Streptococcus pneumoniae R6
acaugaaacugu

SEQ ID NO: 2180582 - RNA, 14 nt, Streptococcus pneumoniae R6
acaucuuuugauag

SEQ ID NO: 2180583 - RNA, 13 nt, Streptococcus pneumoniae R6
acaucuugaaguu

SEQ ID NO: 2180584 - RNA, 20 nt, Streptococcus pneumoniae R6
acaucuuggaguugauucau

SEQ ID NO: 2180585 - RNA, 16 nt, Streptococcus pneumoniae R6
acaucgaaguuguguu

SEQ ID NO: 2180586 - RNA, 23 nt, Streptococcus pneumoniae R6
acaucgaaguuguguuugaccac

SEQ ID NO: 2180587 - RNA, 22 nt, Streptococcus pneumoniae R6
accaaguucuaaauaaucucca

SEQ ID NO: 2180588 - RNA, 15 nt, Streptococcus pneumoniae R6
accaaguaaaucuac

SEQ ID NO: 2180589 - RNA, 15 nt, Streptococcus pneumoniae R6
accaagucugcaugc

SEQ ID NO: 2180590 - RNA, 22 nt, Streptococcus pneumoniae R6
accaagucaucaaaaauagaaa

SEQ ID NO: 2180591 - RNA, 19 nt, Streptococcus pneumoniae R6
accaaggcuuugagggcug

SEQ ID NO: 2180592 - RNA, 20 nt, Streptococcus pneumoniae R6
accaagcgguagaugaagca

SEQ ID NO: 2180593 - RNA, 19 nt, Streptococcus pneumoniae R6
accaacuccucucuccucc

SEQ ID NO: 2180594 - RNA, 21 nt, Streptococcus pneumoniae R6
accaacuacuaaaccaauaau

SEQ ID NO: 2180595 - RNA, 17 nt, Streptococcus pneumoniae R6
acauuucuauaaaucaa

SEQ ID NO: 2180596 - RNA, 17 nt, Streptococcus pneumoniae R6
acauuuccauguaaaau

SEQ ID NO: 2180597 - RNA, 19 nt, Streptococcus pneumoniae R6
acauuuccauguaaaauua

SEQ ID NO: 2180598 - RNA, 23 nt, Streptococcus pneumoniae R6
acauuucggauuuuaaaaugcca

SEQ ID NO: 2180599 - RNA, 14 nt, Streptococcus pneumoniae R6
accaaucaaucguc

SEQ ID NO: 2180600 - RNA, 20 nt, Streptococcus pneumoniae R6
accaaucauuuggaaaacaa

SEQ ID NO: 2180601 - RNA, 12 nt, Streptococcus pneumoniae R6
accaaucaaauc

SEQ ID NO: 2180602 - RNA, 15 nt, Streptococcus pneumoniae R6
accaaucaaaucaau

SEQ ID NO: 2180603 - RNA, 17 nt, Streptococcus pneumoniae R6
accaauaauaaaacuuu

SEQ ID NO: 2180604 - RNA, 15 nt, Streptococcus pneumoniae R6
accaauacuacaaua

SEQ ID NO: 2180605 - RNA, 16 nt, Streptococcus pneumoniae R6
accaauacuacaauaa

SEQ ID NO: 2180606 - RNA, 21 nt, Streptococcus pneumoniae R6
accaaugagaaacuuagcgaa

SEQ ID NO: 2180607 - RNA, 22 nt, Streptococcus pneumoniae R6
accaaugagaaacuuagcgaaa

SEQ ID NO: 2180608 - RNA, 14 nt, Streptococcus pneumoniae R6
accaaucuuuucca

SEQ ID NO: 2180609 - RNA, 23 nt, Streptococcus pneumoniae R6
accaaucguaaacugagcaaaac

SEQ ID NO: 2180610 - RNA, 22 nt, Streptococcus pneumoniae R6
accaaucucaaauccuugaaga

SEQ ID NO: 2180611 - RNA, 22 nt, Streptococcus pneumoniae R6
accaauucagguggguuuucug

SEQ ID NO: 2180612 - RNA, 14 nt, Streptococcus pneumoniae R6
accaauucaguaac

SEQ ID NO: 2180613 - RNA, 18 nt, Streptococcus pneumoniae R6
accaauguucaagacauc

SEQ ID NO: 2180614 - RNA, 13 nt, Streptococcus pneumoniae R6
accaauuuuuccu

SEQ ID NO: 2180615 - RNA, 17 nt, Streptococcus pneumoniae R6
accaauuucuuaauagc

SEQ ID NO: 2180616 - RNA, 13 nt, Streptococcus pneumoniae R6
accacaaaagaga

SEQ ID NO: 2180617 - RNA, 15 nt, Streptococcus pneumoniae R6
accacaaaagagaaa

SEQ ID NO: 2180618 - RNA, 18 nt, Streptococcus pneumoniae R6
accacagcguuucuauau

SEQ ID NO: 2180619 - RNA, 13 nt, Streptococcus pneumoniae R6
accacaggagcug

SEQ ID NO: 2180620 - RNA, 18 nt, Streptococcus pneumoniae R6
accaccaaucauuuggaa

SEQ ID NO: 2180621 - RNA, 18 nt, Streptococcus pneumoniae R6
accacaugacauuauuuu

SEQ ID NO: 2180622 - RNA, 15 nt, Streptococcus pneumoniae R6
accaccuacuguggu

SEQ ID NO: 2180623 - RNA, 17 nt, Streptococcus pneumoniae R6
accaccugcaacaauac

SEQ ID NO: 2180624 - RNA, 23 nt, Streptococcus pneumoniae R6
accaccuuuaaauccugcaaaga

SEQ ID NO: 2180625 - RNA, 14 nt, Streptococcus pneumoniae R6
accaccuuugagau

SEQ ID NO: 2180626 - RNA, 15 nt, Streptococcus pneumoniae R6
accaccuuccuuggu

SEQ ID NO: 2180627 - RNA, 14 nt, Streptococcus pneumoniae R6
accacgaagcugac

SEQ ID NO: 2180628 - RNA, 22 nt, Streptococcus pneumoniae R6
accacuagcauaaugauuucaa

SEQ ID NO: 2180629 - RNA, 18 nt, Streptococcus pneumoniae R6
accacuagugaauuuggu

SEQ ID NO: 2180630 - RNA, 19 nt, Streptococcus pneumoniae R6
accacuagugaauuugguu

SEQ ID NO: 2180631 - RNA, 17 nt, Streptococcus pneumoniae R6
accacggcagacagaga

SEQ ID NO: 2180632 - RNA, 14 nt, Streptococcus pneumoniae R6
accacguuccuugg

SEQ ID NO: 2180633 - RNA, 17 nt, Streptococcus pneumoniae R6
accacguauaauucuaa

SEQ ID NO: 2180634 - RNA, 16 nt, Streptococcus pneumoniae R6
accacgguaaaauacu

SEQ ID NO: 2180635 - RNA, 18 nt, Streptococcus pneumoniae R6
aauuucagaaaucuucuc

SEQ ID NO: 2180636 - RNA, 16 nt, Streptococcus pneumoniae R6
aauuucagaagaaaaa

SEQ ID NO: 2180637 - RNA, 19 nt, Streptococcus pneumoniae R6
aauuucagaagaaaaaaag

SEQ ID NO: 2180638 - RNA, 19 nt, Streptococcus pneumoniae R6
aauuucacuauauugcaag

SEQ ID NO: 2180639 - RNA, 17 nt, Streptococcus pneumoniae R6
aauuucaggagaaaaug

SEQ ID NO: 2180640 - RNA, 21 nt, Streptococcus pneumoniae R6
aauuucauauuuucagauaac

SEQ ID NO: 2180641 - RNA, 18 nt, Streptococcus pneumoniae R6
aauuucaugacagauuca

SEQ ID NO: 2180642 - RNA, 11 nt, Streptococcus pneumoniae R6
aauuucauuuc

SEQ ID NO: 2180643 - RNA, 17 nt, Streptococcus pneumoniae R6
aauuucauuucuuccga

SEQ ID NO: 2180644 - RNA, 11 nt, Streptococcus pneumoniae R6
aauuucauuuu

SEQ ID NO: 2180645 - RNA, 12 nt, Streptococcus pneumoniae R6
aauuucccauuu

SEQ ID NO: 2180646 - RNA, 15 nt, Streptococcus pneumoniae R6
aauuuccauaccaaa

SEQ ID NO: 2180647 - RNA, 23 nt, Streptococcus pneumoniae R6
aauuuccauaucuuuagggaaau

SEQ ID NO: 2180648 - RNA, 14 nt, Streptococcus pneumoniae R6
aauuucugaaacua

SEQ ID NO: 2180649 - RNA, 19 nt, Streptococcus pneumoniae R6
aauuucugaaaucaacaca

SEQ ID NO: 2180650 - RNA, 23 nt, Streptococcus pneumoniae R6
aauuucugccauauguccuucau

SEQ ID NO: 2180651 - RNA, 20 nt, Streptococcus pneumoniae R6
aauuucuauuuuaaaaauag

SEQ ID NO: 2180652 - RNA, 15 nt, Streptococcus pneumoniae R6
aauuucucaaaaaag

SEQ ID NO: 2180653 - RNA, 20 nt, Streptococcus pneumoniae R6
aauuucucaaaaaaguuaaa

SEQ ID NO: 2180654 - RNA, 18 nt, Streptococcus pneumoniae R6
aauuucuauaaauguuuu

SEQ ID NO: 2180655 - RNA, 13 nt, Streptococcus pneumoniae R6
aauuucuagaaau

SEQ ID NO: 2180656 - RNA, 19 nt, Streptococcus pneumoniae R6
aauuucuagaaauauuuua

SEQ ID NO: 2180657 - RNA, 17 nt, Streptococcus pneumoniae R6
aauuucuagcaaaguuu

SEQ ID NO: 2180658 - RNA, 20 nt, Streptococcus pneumoniae R6
aauuucuagcaaaguuuuag

SEQ ID NO: 2180659 - RNA, 13 nt, Streptococcus pneumoniae R6
aauuucuccgguu

SEQ ID NO: 2180660 - RNA, 21 nt, Streptococcus pneumoniae R6
aauuucucuaaaucuucuaau

SEQ ID NO: 2180661 - RNA, 13 nt, Streptococcus pneumoniae R6
aauuucgaaaaau

SEQ ID NO: 2180662 - RNA, 18 nt, Streptococcus pneumoniae R6
aauuucuacaaauguuuu

SEQ ID NO: 2180663 - RNA, 15 nt, Streptococcus pneumoniae R6
aauuucgauugucau

SEQ ID NO: 2180664 - RNA, 22 nt, Streptococcus pneumoniae R6
aauuucgcuauuuaaacugauu

SEQ ID NO: 2180665 - RNA, 14 nt, Streptococcus pneumoniae R6
aauuuacuauacuu

SEQ ID NO: 2180666 - RNA, 15 nt, Streptococcus pneumoniae R6
aauuuacuuaaaauu

SEQ ID NO: 2180667 - RNA, 14 nt, Streptococcus pneumoniae R6
aauuuagaaauaga

SEQ ID NO: 2180668 - RNA, 12 nt, Streptococcus pneumoniae R6
aauugcuaaaac

SEQ ID NO: 2180669 - RNA, 22 nt, Streptococcus pneumoniae R6
aauugcgcggguucaauacaaa

SEQ ID NO: 2180670 - RNA, 14 nt, Streptococcus pneumoniae R6
aauuuaaagagauu

SEQ ID NO: 2180671 - RNA, 16 nt, Streptococcus pneumoniae R6
aauuuacguccuugga

SEQ ID NO: 2180672 - RNA, 18 nt, Streptococcus pneumoniae R6
aauuuaucuccuacuucc

SEQ ID NO: 2180673 - RNA, 14 nt, Streptococcus pneumoniae R6
aauuuauccgaaga

SEQ ID NO: 2180674 - RNA, 17 nt, Streptococcus pneumoniae R6
aauuuauccgaagauuu

SEQ ID NO: 2180675 - RNA, 16 nt, Streptococcus pneumoniae R6
aauuucaaaguagaua

SEQ ID NO: 2180676 - RNA, 12 nt, Streptococcus pneumoniae R6
aauuucaaaauc

SEQ ID NO: 2180677 - RNA, 18 nt, Streptococcus pneumoniae R6
aauuuauugguauuaaua

SEQ ID NO: 2180678 - RNA, 22 nt, Streptococcus pneumoniae R6
aauuuauugguauuaauaauuu

SEQ ID NO: 2180679 - RNA, 22 nt, Streptococcus pneumoniae R6
aauuuuaucaauccugaagaau

SEQ ID NO: 2180680 - RNA, 23 nt, Streptococcus pneumoniae R6
aauuuuaucaauccugaagaaug

SEQ ID NO: 2180681 - RNA, 17 nt, Streptococcus pneumoniae R6
aauuuuaguagaaaaug

SEQ ID NO: 2180682 - RNA, 16 nt, Streptococcus pneumoniae R6
aauuuuacuucuuccc

SEQ ID NO: 2180683 - RNA, 18 nt, Streptococcus pneumoniae R6
aauuuuagaagguuuuug

SEQ ID NO: 2180684 - RNA, 13 nt, Streptococcus pneumoniae R6
aauuuucaaaaau

SEQ ID NO: 2180685 - RNA, 22 nt, Streptococcus pneumoniae R6
aauuuucaaaaaucauuauauu

SEQ ID NO: 2180686 - RNA, 17 nt, Streptococcus pneumoniae R6
aauuuuucugcaaaaaa

SEQ ID NO: 2180687 - RNA, 18 nt, Streptococcus pneumoniae R6
aauuuuucauuuaauaua

SEQ ID NO: 2180688 - RNA, 12 nt, Streptococcus pneumoniae R6
aauuuucuaccg

SEQ ID NO: 2180689 - RNA, 12 nt, Streptococcus pneumoniae R6
aauuuucuuuuu

SEQ ID NO: 2180690 - RNA, 21 nt, Streptococcus pneumoniae R6
aauuuugacucggccuucuuu

SEQ ID NO: 2180691 - RNA, 22 nt, Streptococcus pneumoniae R6
aauuuugacucggccuucuuuu

SEQ ID NO: 2180692 - RNA, 17 nt, Streptococcus pneumoniae R6
aauuuugauucagauuc

SEQ ID NO: 2180693 - RNA, 16 nt, Streptococcus pneumoniae R6
aauuuugucucugaaa

SEQ ID NO: 2180694 - RNA, 20 nt, Streptococcus pneumoniae R6
aauuugaugauuuggcgaug

SEQ ID NO: 2180695 - RNA, 13 nt, Streptococcus pneumoniae R6
aauuugauauaua

SEQ ID NO: 2180696 - RNA, 15 nt, Streptococcus pneumoniae R6
aauuugauauauaaa

SEQ ID NO: 2180697 - RNA, 13 nt, Streptococcus pneumoniae R6
aauuuggaaaaua

SEQ ID NO: 2180698 - RNA, 14 nt, Streptococcus pneumoniae R6
aauuugcuacaaau

SEQ ID NO: 2180699 - RNA, 14 nt, Streptococcus pneumoniae R6
aauuucuuuucauu

SEQ ID NO: 2180700 - RNA, 16 nt, Streptococcus pneumoniae R6
aauuucuuuucauucc

SEQ ID NO: 2180701 - RNA, 22 nt, Streptococcus pneumoniae R6
aauuucuuuagcauaauagcag

SEQ ID NO: 2180702 - RNA, 15 nt, Streptococcus pneumoniae R6
aauuucuuuauauaa

SEQ ID NO: 2180703 - RNA, 15 nt, Streptococcus pneumoniae R6
aauuugaauuuucua

SEQ ID NO: 2180704 - RNA, 14 nt, Streptococcus pneumoniae R6
aauuugaaaaucuu

SEQ ID NO: 2180705 - RNA, 23 nt, Streptococcus pneumoniae R6
aauuucuuuuuguguuaaaucau

SEQ ID NO: 2180706 - RNA, 17 nt, Streptococcus pneumoniae R6
aauuugaaaaaaauuuu

SEQ ID NO: 2180707 - RNA, 15 nt, Streptococcus pneumoniae R6
aauuugacuaaaaac

SEQ ID NO: 2180708 - RNA, 17 nt, Streptococcus pneumoniae R6
aauuugacuguccuuau

SEQ ID NO: 2180709 - RNA, 18 nt, Streptococcus pneumoniae R6
aauuugacuguccuuauc

SEQ ID NO: 2180710 - RNA, 20 nt, Streptococcus pneumoniae R6
aauuugaaccugcuuuaaga

SEQ ID NO: 2180711 - RNA, 18 nt, Streptococcus pneumoniae R6
aauuugacgauaaaagua

SEQ ID NO: 2180712 - RNA, 15 nt, Streptococcus pneumoniae R6
aauuugaccauuuca

SEQ ID NO: 2180713 - RNA, 15 nt, Streptococcus pneumoniae R6
aauuuuacaaauacc

SEQ ID NO: 2180714 - RNA, 16 nt, Streptococcus pneumoniae R6
aauuuuacaaauacca

SEQ ID NO: 2180715 - RNA, 19 nt, Streptococcus pneumoniae R6
aauuuuacaaauaccauaa

SEQ ID NO: 2180716 - RNA, 23 nt, Streptococcus pneumoniae R6
aauuuuacaaauaccauaaacua

SEQ ID NO: 2180717 - RNA, 18 nt, Streptococcus pneumoniae R6
aauuuuaaauuuuucugc

SEQ ID NO: 2180718 - RNA, 19 nt, Streptococcus pneumoniae R6
aauuuguucguauccuauu

SEQ ID NO: 2180719 - RNA, 10 nt, Streptococcus pneumoniae R6
aauuuuaaaa

SEQ ID NO: 2180720 - RNA, 13 nt, Streptococcus pneumoniae R6
aauuuguaaaguu

SEQ ID NO: 2180721 - RNA, 23 nt, Streptococcus pneumoniae R6
aauuuggugcuaaguccuugaug

SEQ ID NO: 2180722 - RNA, 16 nt, Streptococcus pneumoniae R6
aauuuguuuucaagug

SEQ ID NO: 2180723 - RNA, 14 nt, Streptococcus pneumoniae R6
aauuaggcucuuug

SEQ ID NO: 2180724 - RNA, 17 nt, Streptococcus pneumoniae R6
aauuaguucagaauuuu

SEQ ID NO: 2180725 - RNA, 18 nt, Streptococcus pneumoniae R6
aauuaguucagaauuuuc

SEQ ID NO: 2180726 - RNA, 15 nt, Streptococcus pneumoniae R6
aauuaguuuuggcua

SEQ ID NO: 2180727 - RNA, 14 nt, Streptococcus pneumoniae R6
aauuauuuucaaaa

SEQ ID NO: 2180728 - RNA, 16 nt, Streptococcus pneumoniae R6
aauuauuuucaaaaua

SEQ ID NO: 2180729 - RNA, 18 nt, Streptococcus pneumoniae R6
aauuauguuuuugaauaa

SEQ ID NO: 2180730 - RNA, 23 nt, Streptococcus pneumoniae R6
aauuauguaaauaaauaucaaaa

SEQ ID NO: 2180731 - RNA, 21 nt, Streptococcus pneumoniae R6
aauuaugggagcaagcuccua

SEQ ID NO: 2180732 - RNA, 22 nt, Streptococcus pneumoniae R6
aauuacucccauucuucuuuuc

SEQ ID NO: 2180733 - RNA, 22 nt, Streptococcus pneumoniae R6
aauuacugauuggugucaaaaa

SEQ ID NO: 2180734 - RNA, 14 nt, Streptococcus pneumoniae R6
aauuagaaaaaaau

SEQ ID NO: 2180735 - RNA, 20 nt, Streptococcus pneumoniae R6
aauuagaaaaaaauuuuuaa

SEQ ID NO: 2180736 - RNA, 16 nt, Streptococcus pneumoniae R6
aauuagaaaaagacuu

SEQ ID NO: 2180737 - RNA, 15 nt, Streptococcus pneumoniae R6
aauuagaaaauucaa

SEQ ID NO: 2180738 - RNA, 17 nt, Streptococcus pneumoniae R6
aauuagcucaaaacacu

SEQ ID NO: 2180739 - RNA, 17 nt, Streptococcus pneumoniae R6
aauguauuaagaacucu

SEQ ID NO: 2180740 - RNA, 22 nt, Streptococcus pneumoniae R6
aauuaaguuuuacggaucugaa

SEQ ID NO: 2180741 - RNA, 20 nt, Streptococcus pneumoniae R6
aauguaguuggauuuccacu

SEQ ID NO: 2180742 - RNA, 12 nt, Streptococcus pneumoniae R6
aauguacugccc

SEQ ID NO: 2180743 - RNA, 21 nt, Streptococcus pneumoniae R6
aauguacugcccccaaacagu

SEQ ID NO: 2180744 - RNA, 21 nt, Streptococcus pneumoniae R6
aaugguaucugcuaaaacaaa

SEQ ID NO: 2180745 - RNA, 13 nt, Streptococcus pneumoniae R6
aaugguaugucuc

SEQ ID NO: 2180746 - RNA, 21 nt, Streptococcus pneumoniae R6
aaugguaugucucgacuggua

SEQ ID NO: 2180747 - RNA, 22 nt, Streptococcus pneumoniae R6
aauuacaugaaacuguggaaaa

SEQ ID NO: 2180748 - RNA, 17 nt, Streptococcus pneumoniae R6
aauuaauuugaauuuuc

SEQ ID NO: 2180749 - RNA, 18 nt, Streptococcus pneumoniae R6
aauuaauuugacuuuucu

SEQ ID NO: 2180750 - RNA, 19 nt, Streptococcus pneumoniae R6
aauuaauuuauagaaaaau

SEQ ID NO: 2180751 - RNA, 18 nt, Streptococcus pneumoniae R6
aauuaauuuauagaaaua

SEQ ID NO: 2180752 - RNA, 21 nt, Streptococcus pneumoniae R6
aauuaauuuauagaaauauuu

SEQ ID NO: 2180753 - RNA, 21 nt, Streptococcus pneumoniae R6
aauuaauuuauccgaagauuu

SEQ ID NO: 2180754 - RNA, 19 nt, Streptococcus pneumoniae R6
aauuaauuuauuuaaucau

SEQ ID NO: 2180755 - RNA, 21 nt, Streptococcus pneumoniae R6
aauuaauuuauuuaaucauuu

SEQ ID NO: 2180756 - RNA, 13 nt, Streptococcus pneumoniae R6
aauuaaucagaau

SEQ ID NO: 2180757 - RNA, 14 nt, Streptococcus pneumoniae R6
aauugcaaauuuag

SEQ ID NO: 2180758 - RNA, 18 nt, Streptococcus pneumoniae R6
aauugcgauuuugccaag

SEQ ID NO: 2180759 - RNA, 19 nt, Streptococcus pneumoniae R6
aauugauuaagugauuuaa

SEQ ID NO: 2180760 - RNA, 19 nt, Streptococcus pneumoniae R6
aauugauuuaccuuccuca

SEQ ID NO: 2180761 - RNA, 20 nt, Streptococcus pneumoniae R6
aauugauuuauagaaauguu

SEQ ID NO: 2180762 - RNA, 20 nt, Streptococcus pneumoniae R6
aauugauaagaggauuuuaa

SEQ ID NO: 2180763 - RNA, 24 nt, Streptococcus pneumoniae R6
aauugauaagaggauuuuaaagua

SEQ ID NO: 2180764 - RNA, 16 nt, Streptococcus pneumoniae R6
aauugauaaggacagg

SEQ ID NO: 2180765 - RNA, 17 nt, Streptococcus pneumoniae R6
aauugauaauaguaugu

SEQ ID NO: 2180766 - RNA, 18 nt, Streptococcus pneumoniae R6
aaaaauuuuuuucuaauu

SEQ ID NO: 2180767 - RNA, 21 nt, Streptococcus pneumoniae R6
aaaaauuuuuuucuaauuaaa

SEQ ID NO: 2180768 - RNA, 22 nt, Streptococcus pneumoniae R6
aaaaauuuuuuucuaauuaaau

SEQ ID NO: 2180769 - RNA, 13 nt, Streptococcus pneumoniae R6
aauugacugucaa

SEQ ID NO: 2180770 - RNA, 17 nt, Streptococcus pneumoniae R6
aauugacgaagaaacca

SEQ ID NO: 2180771 - RNA, 20 nt, Streptococcus pneumoniae R6
aauugacgaagaaaccaagc

SEQ ID NO: 2180772 - RNA, 17 nt, Streptococcus pneumoniae R6
aauugacauggaaauua

SEQ ID NO: 2180773 - RNA, 20 nt, Streptococcus pneumoniae R6
aauucuuugaaaucagaaaa

SEQ ID NO: 2180774 - RNA, 21 nt, Streptococcus pneumoniae R6
aauucuuugaaaucagaaaaa

SEQ ID NO: 2180775 - RNA, 22 nt, Streptococcus pneumoniae R6
aauucuuugaaaucagaaaaaa

SEQ ID NO: 2180776 - RNA, 23 nt, Streptococcus pneumoniae R6
aauucuucuucugaaaagacgua

SEQ ID NO: 2180777 - RNA, 13 nt, Streptococcus pneumoniae R6
aauucuucuguuu

SEQ ID NO: 2180778 - RNA, 20 nt, Streptococcus pneumoniae R6
aauucuucuguuucugcaac

SEQ ID NO: 2180779 - RNA, 23 nt, Streptococcus pneumoniae R6
aauucuuggaucuuagguugguu

SEQ ID NO: 2180780 - RNA, 22 nt, Streptococcus pneumoniae R6
aauucuugguugccuuuuugaa

SEQ ID NO: 2180781 - RNA, 13 nt, Streptococcus pneumoniae R6
aauucuuccuuug

SEQ ID NO: 2180782 - RNA, 19 nt, Streptococcus pneumoniae R6
aauucuuccuacugauauc

SEQ ID NO: 2180783 - RNA, 14 nt, Streptococcus pneumoniae R6
aauucuucagcacu

SEQ ID NO: 2180784 - RNA, 16 nt, Streptococcus pneumoniae R6
aauucuucauagaguu

SEQ ID NO: 2180785 - RNA, 15 nt, Streptococcus pneumoniae R6
aauucuaauuaaaua

SEQ ID NO: 2180786 - RNA, 14 nt, Streptococcus pneumoniae R6
aauucggcuugguu

SEQ ID NO: 2180787 - RNA, 20 nt, Streptococcus pneumoniae R6
aauucgcuuuuuuaaaugcu

SEQ ID NO: 2180788 - RNA, 19 nt, Streptococcus pneumoniae R6
aauucaagaaugacacgua

SEQ ID NO: 2180789 - RNA, 18 nt, Streptococcus pneumoniae R6
aauucaagcaaaacaaau

SEQ ID NO: 2180790 - RNA, 14 nt, Streptococcus pneumoniae R6
aauucaauguuuac

SEQ ID NO: 2180791 - RNA, 11 nt, Streptococcus pneumoniae R6
aauucaauuau

SEQ ID NO: 2180792 - RNA, 20 nt, Streptococcus pneumoniae R6
aauuauuuuuuaucuaguau

SEQ ID NO: 2180793 - RNA, 23 nt, Streptococcus pneumoniae R6
aauucaaaugaauuucuacaaau

SEQ ID NO: 2180794 - RNA, 13 nt, Streptococcus pneumoniae R6
aauucaaacucaa

SEQ ID NO: 2180795 - RNA, 15 nt, Streptococcus pneumoniae R6
aauucaaacucaaau

SEQ ID NO: 2180796 - RNA, 20 nt, Streptococcus pneumoniae R6
aauucaaaguggguuuuaac

SEQ ID NO: 2180797 - RNA, 16 nt, Streptococcus pneumoniae R6
aauuccuacuucaaau

SEQ ID NO: 2180798 - RNA, 23 nt, Streptococcus pneumoniae R6
aauucccuuuuugauuuuaaaug

SEQ ID NO: 2180799 - RNA, 19 nt, Streptococcus pneumoniae R6
aauucccuuauccacauca

SEQ ID NO: 2180800 - RNA, 16 nt, Streptococcus pneumoniae R6
aauucccuuccuauca

SEQ ID NO: 2180801 - RNA, 21 nt, Streptococcus pneumoniae R6
aauucccucugacgagaaaua

SEQ ID NO: 2180802 - RNA, 22 nt, Streptococcus pneumoniae R6
aaugaaagaaacucuaaacaaa

SEQ ID NO: 2180803 - RNA, 15 nt, Streptococcus pneumoniae R6
aaugaacaucccaag

SEQ ID NO: 2180804 - RNA, 14 nt, Streptococcus pneumoniae R6
aaugaaauuaaaua

SEQ ID NO: 2180805 - RNA, 15 nt, Streptococcus pneumoniae R6
aaugaaauuaaauau

SEQ ID NO: 2180806 - RNA, 16 nt, Streptococcus pneumoniae R6
aaugaaauuaaauaug

SEQ ID NO: 2180807 - RNA, 14 nt, Streptococcus pneumoniae R6
aaugaagcaaacau

SEQ ID NO: 2180808 - RNA, 17 nt, Streptococcus pneumoniae R6
aaugaauuugaaacaau

SEQ ID NO: 2180809 - RNA, 22 nt, Streptococcus pneumoniae R6
aaugaauuugaaacaaugaaaa

SEQ ID NO: 2180810 - RNA, 15 nt, Streptococcus pneumoniae R6
aaucuuuagcaccac

SEQ ID NO: 2180811 - RNA, 23 nt, Streptococcus pneumoniae R6
aaucuuuaagauacuugauuuuu

SEQ ID NO: 2180812 - RNA, 20 nt, Streptococcus pneumoniae R6
aaucuuuaagguacuugauu

SEQ ID NO: 2180813 - RNA, 16 nt, Streptococcus pneumoniae R6
aaucuugucuaaaaau

SEQ ID NO: 2180814 - RNA, 17 nt, Streptococcus pneumoniae R6
aaucuugucuaaaaaua

SEQ ID NO: 2180815 - RNA, 24 nt, Streptococcus pneumoniae R6
aaucuugucuaaaaauagggaaau

SEQ ID NO: 2180816 - RNA, 22 nt, Streptococcus pneumoniae R6
aaucucuaacaaugcuuuagaa

SEQ ID NO: 2180817 - RNA, 13 nt, Streptococcus pneumoniae R6
aaugaaaaucaaa

SEQ ID NO: 2180818 - RNA, 16 nt, Streptococcus pneumoniae R6
aaugaaaaucaaagag

SEQ ID NO: 2180819 - RNA, 20 nt, Streptococcus pneumoniae R6
aaugaaaaucaaagaguaaa

SEQ ID NO: 2180820 - RNA, 14 nt, Streptococcus pneumoniae R6
aaucuuuuacuucu

SEQ ID NO: 2180821 - RNA, 14 nt, Streptococcus pneumoniae R6
aaucuuucugcauc

SEQ ID NO: 2180822 - RNA, 17 nt, Streptococcus pneumoniae R6
aaugagccacuauuuau

SEQ ID NO: 2180823 - RNA, 21 nt, Streptococcus pneumoniae R6
aaugagauaagcgauuuuaua

SEQ ID NO: 2180824 - RNA, 19 nt, Streptococcus pneumoniae R6
aaugacuuguguuuuuccu

SEQ ID NO: 2180825 - RNA, 18 nt, Streptococcus pneumoniae R6
aaugagucagggaaaaaa

SEQ ID NO: 2180826 - RNA, 14 nt, Streptococcus pneumoniae R6
aaugaguccgaaaa

SEQ ID NO: 2180827 - RNA, 17 nt, Streptococcus pneumoniae R6
aaugagucuaucaaaca

SEQ ID NO: 2180828 - RNA, 15 nt, Streptococcus pneumoniae R6
aaugagcuuccagua

SEQ ID NO: 2180829 - RNA, 14 nt, Streptococcus pneumoniae R6
aaugaguaagaacu

SEQ ID NO: 2180830 - RNA, 17 nt, Streptococcus pneumoniae R6
aaugauaccuugaucaa

SEQ ID NO: 2180831 - RNA, 17 nt, Streptococcus pneumoniae R6
aaugauaauugauuaag

SEQ ID NO: 2180832 - RNA, 13 nt, Streptococcus pneumoniae R6
aaugacaauuuuu

SEQ ID NO: 2180833 - RNA, 16 nt, Streptococcus pneumoniae R6
aaugacaaauccauuc

SEQ ID NO: 2180834 - RNA, 19 nt, Streptococcus pneumoniae R6
aaugacagugauuaaaacu

SEQ ID NO: 2180835 - RNA, 15 nt, Streptococcus pneumoniae R6
aaugauaucugguau

SEQ ID NO: 2180836 - RNA, 23 nt, Streptococcus pneumoniae R6
aaugauaugguauuuaaaaccuc

SEQ ID NO: 2180837 - RNA, 15 nt, Streptococcus pneumoniae R6
aaugaucaagaugag

SEQ ID NO: 2180838 - RNA, 14 nt, Streptococcus pneumoniae R6
aaugauauuuucaa

SEQ ID NO: 2180839 - RNA, 12 nt, Streptococcus pneumoniae R6
aaugaucagacc

SEQ ID NO: 2180840 - RNA, 13 nt, Streptococcus pneumoniae R6
aaugaucagacca

SEQ ID NO: 2180841 - RNA, 14 nt, Streptococcus pneumoniae R6
aaugaucagaccag

SEQ ID NO: 2180842 - RNA, 15 nt, Streptococcus pneumoniae R6
aaugauuagauuuag

SEQ ID NO: 2180843 - RNA, 13 nt, Streptococcus pneumoniae R6
aaugcaguaaauc

SEQ ID NO: 2180844 - RNA, 16 nt, Streptococcus pneumoniae R6
aaugcaguaaaucaua

SEQ ID NO: 2180845 - RNA, 15 nt, Streptococcus pneumoniae R6
aaugauucugaaaua

SEQ ID NO: 2180846 - RNA, 17 nt, Streptococcus pneumoniae R6
aaugcauacgaaaagua

SEQ ID NO: 2180847 - RNA, 16 nt, Streptococcus pneumoniae R6
aauggauugaaauaag

SEQ ID NO: 2180848 - RNA, 17 nt, Streptococcus pneumoniae R6
aauggauugaaauaaga

SEQ ID NO: 2180849 - RNA, 18 nt, Streptococcus pneumoniae R6
aauggauugaaauaagau

SEQ ID NO: 2180850 - RNA, 17 nt, Streptococcus pneumoniae R6
aauggcaaaaaauugag

SEQ ID NO: 2180851 - RNA, 20 nt, Streptococcus pneumoniae R6
aauggaugaaucugccagau

SEQ ID NO: 2180852 - RNA, 16 nt, Streptococcus pneumoniae R6
aauggcggcauucaag

SEQ ID NO: 2180853 - RNA, 22 nt, Streptococcus pneumoniae R6
aauggcuucauuaugaguggca

SEQ ID NO: 2180854 - RNA, 18 nt, Streptococcus pneumoniae R6
aauggcuccuguacccaa

SEQ ID NO: 2180855 - RNA, 19 nt, Streptococcus pneumoniae R6
aaugcuaauuuagaaauag

SEQ ID NO: 2180856 - RNA, 12 nt, Streptococcus pneumoniae R6
aaugcucagaca

SEQ ID NO: 2180857 - RNA, 16 nt, Streptococcus pneumoniae R6
aaugcucagacaauuu

SEQ ID NO: 2180858 - RNA, 22 nt, Streptococcus pneumoniae R6
aaugcuccaauacaaauuguaa

SEQ ID NO: 2180859 - RNA, 18 nt, Streptococcus pneumoniae R6
aaugccuguuccaacauu

SEQ ID NO: 2180860 - RNA, 15 nt, Streptococcus pneumoniae R6
aauccagucccuuuu

SEQ ID NO: 2180861 - RNA, 15 nt, Streptococcus pneumoniae R6
aauccaauugaggaa

SEQ ID NO: 2180862 - RNA, 10 nt, Streptococcus pneumoniae R6
aauccacacu

SEQ ID NO: 2180863 - RNA, 21 nt, Streptococcus pneumoniae R6
aaucauucugaacuaaaaaau

SEQ ID NO: 2180864 - RNA, 13 nt, Streptococcus pneumoniae R6
aaucauugcuauc

SEQ ID NO: 2180865 - RNA, 12 nt, Streptococcus pneumoniae R6
aauccaacucuu

SEQ ID NO: 2180866 - RNA, 21 nt, Streptococcus pneumoniae R6
aaucaucucaucgacuuguuu

SEQ ID NO: 2180867 - RNA, 15 nt, Streptococcus pneumoniae R6
aaucauuaaaauaac

SEQ ID NO: 2180868 - RNA, 13 nt, Streptococcus pneumoniae R6
aaucaucugcauc

SEQ ID NO: 2180869 - RNA, 15 nt, Streptococcus pneumoniae R6
aaucaucauaaaaau

SEQ ID NO: 2180870 - RNA, 20 nt, Streptococcus pneumoniae R6
aauaugaguucuucaacaau

SEQ ID NO: 2180871 - RNA, 16 nt, Streptococcus pneumoniae R6
aauaugaacaaaaccu

SEQ ID NO: 2180872 - RNA, 17 nt, Streptococcus pneumoniae R6
aauaugaacaaauugau

SEQ ID NO: 2180873 - RNA, 17 nt, Streptococcus pneumoniae R6
aaucagguguucaaaaa

SEQ ID NO: 2180874 - RNA, 20 nt, Streptococcus pneumoniae R6
aaucaggccuacaauuggaa

SEQ ID NO: 2180875 - RNA, 16 nt, Streptococcus pneumoniae R6
aaucaggccagaugac

SEQ ID NO: 2180876 - RNA, 23 nt, Streptococcus pneumoniae R6
aaucagcucucugauuuucagag

SEQ ID NO: 2180877 - RNA, 16 nt, Streptococcus pneumoniae R6
aaucauacugccaaga

SEQ ID NO: 2180878 - RNA, 15 nt, Streptococcus pneumoniae R6
aaucauagaaaaaag

SEQ ID NO: 2180879 - RNA, 20 nt, Streptococcus pneumoniae R6
aaucauagacuuaauugucu

SEQ ID NO: 2180880 - RNA, 14 nt, Streptococcus pneumoniae R6
aaucauacaccucu

SEQ ID NO: 2180881 - RNA, 24 nt, Streptococcus pneumoniae R6
aaucauacaccucuucugaugcaa

SEQ ID NO: 2180882 - RNA, 18 nt, Streptococcus pneumoniae R6
aaucaguuuuuucacaaa

SEQ ID NO: 2180883 - RNA, 16 nt, Streptococcus pneumoniae R6
aaucauaucaucaauc

SEQ ID NO: 2180884 - RNA, 14 nt, Streptococcus pneumoniae R6
aaaaaugucauaau

SEQ ID NO: 2180885 - RNA, 18 nt, Streptococcus pneumoniae R6
aaaaauguuuuaagaagu

SEQ ID NO: 2180886 - RNA, 13 nt, Streptococcus pneumoniae R6
aaaaauuaugcuu

SEQ ID NO: 2180887 - RNA, 16 nt, Streptococcus pneumoniae R6
aaucguuucaaaaaau

SEQ ID NO: 2180888 - RNA, 20 nt, Streptococcus pneumoniae R6
aaucuaacccuaagugucug

SEQ ID NO: 2180889 - RNA, 14 nt, Streptococcus pneumoniae R6
aaucuagucaucag

SEQ ID NO: 2180890 - RNA, 16 nt, Streptococcus pneumoniae R6
aaucuagucaucagaa

SEQ ID NO: 2180891 - RNA, 17 nt, Streptococcus pneumoniae R6
aaucuagucaucagaaa

SEQ ID NO: 2180892 - RNA, 14 nt, Streptococcus pneumoniae R6
aaucuccucuaccu

SEQ ID NO: 2180893 - RNA, 14 nt, Streptococcus pneumoniae R6
aaucuccucaggaa

SEQ ID NO: 2180894 - RNA, 15 nt, Streptococcus pneumoniae R6
aaucgggaucugaua

SEQ ID NO: 2180895 - RNA, 22 nt, Streptococcus pneumoniae R6
aaucguacuguggccagucauu

SEQ ID NO: 2180896 - RNA, 21 nt, Streptococcus pneumoniae R6
aaucguagucuuucaccacuu

SEQ ID NO: 2180897 - RNA, 18 nt, Streptococcus pneumoniae R6
aaucguugcaccugaacg

SEQ ID NO: 2180898 - RNA, 13 nt, Streptococcus pneumoniae R6
aaucguuccagcg

SEQ ID NO: 2180899 - RNA, 14 nt, Streptococcus pneumoniae R6
aaucgcuuuuguaa

SEQ ID NO: 2180900 - RNA, 12 nt, Streptococcus pneumoniae R6
aaucggagaugg

SEQ ID NO: 2180901 - RNA, 23 nt, Streptococcus pneumoniae R6
aauccauaguaaacuucuucuuc

SEQ ID NO: 2180902 - RNA, 13 nt, Streptococcus pneumoniae R6
aauccccaaggga

SEQ ID NO: 2180903 - RNA, 17 nt, Streptococcus pneumoniae R6
aaucccaugacaaucau

SEQ ID NO: 2180904 - RNA, 21 nt, Streptococcus pneumoniae R6
aauccuggucuuuuuuagcuc

SEQ ID NO: 2180905 - RNA, 18 nt, Streptococcus pneumoniae R6
aauccuguacggauuggu

SEQ ID NO: 2180906 - RNA, 14 nt, Streptococcus pneumoniae R6
aauccugcaaagau

SEQ ID NO: 2180907 - RNA, 17 nt, Streptococcus pneumoniae R6
aauccugaagaauggga

SEQ ID NO: 2180908 - RNA, 12 nt, Streptococcus pneumoniae R6
aauccuuuuuuc

SEQ ID NO: 2180909 - RNA, 19 nt, Streptococcus pneumoniae R6
aaaaauuugaucauccaaa

SEQ ID NO: 2180910 - RNA, 14 nt, Streptococcus pneumoniae R6
aaaaauuuuuaaag

SEQ ID NO: 2180911 - RNA, 19 nt, Streptococcus pneumoniae R6
acugagauggauuuuccuu

SEQ ID NO: 2180912 - RNA, 21 nt, Streptococcus pneumoniae R6
acucuuuuuucauguauucca

SEQ ID NO: 2180913 - RNA, 22 nt, Streptococcus pneumoniae R6
acucuuuagaaaucaaaaagca

SEQ ID NO: 2180914 - RNA, 18 nt, Streptococcus pneumoniae R6
acucuuucgaagucugau

SEQ ID NO: 2180915 - RNA, 20 nt, Streptococcus pneumoniae R6
acugauuuacaaauauucac

SEQ ID NO: 2180916 - RNA, 10 nt, Streptococcus pneumoniae R6
acugauaaaa

SEQ ID NO: 2180917 - RNA, 14 nt, Streptococcus pneumoniae R6
acugauaaaacuga

SEQ ID NO: 2180918 - RNA, 17 nt, Streptococcus pneumoniae R6
acugaucaaaaaauuuc

SEQ ID NO: 2180919 - RNA, 19 nt, Streptococcus pneumoniae R6
acugaucccuccauuucau

SEQ ID NO: 2180920 - RNA, 15 nt, Streptococcus pneumoniae R6
acugcaucugguucu

SEQ ID NO: 2180921 - RNA, 17 nt, Streptococcus pneumoniae R6
acugcaucugguucuag

SEQ ID NO: 2180922 - RNA, 12 nt, Streptococcus pneumoniae R6
acugccuugagg

SEQ ID NO: 2180923 - RNA, 23 nt, Streptococcus pneumoniae R6
acugcgauuggggauugauuuuc

SEQ ID NO: 2180924 - RNA, 23 nt, Streptococcus pneumoniae R6
acugcuggauagaguagucuggg

SEQ ID NO: 2180925 - RNA, 13 nt, Streptococcus pneumoniae R6
acugcugccacug

SEQ ID NO: 2180926 - RNA, 16 nt, Streptococcus pneumoniae R6
acuggagaguugugaa

SEQ ID NO: 2180927 - RNA, 12 nt, Streptococcus pneumoniae R6
acuggaccaagu

SEQ ID NO: 2180928 - RNA, 23 nt, Streptococcus pneumoniae R6
acuggaccaaguuuaaggauagc

SEQ ID NO: 2180929 - RNA, 17 nt, Streptococcus pneumoniae R6
acuggagaaggagauga

SEQ ID NO: 2180930 - RNA, 20 nt, Streptococcus pneumoniae R6
acuggagaauugacaaucuc

SEQ ID NO: 2180931 - RNA, 15 nt, Streptococcus pneumoniae R6
acuggaauggcaacc

SEQ ID NO: 2180932 - RNA, 16 nt, Streptococcus pneumoniae R6
acugcuuuuucaauca

SEQ ID NO: 2180933 - RNA, 13 nt, Streptococcus pneumoniae R6
acuccuacaaagc

SEQ ID NO: 2180934 - RNA, 14 nt, Streptococcus pneumoniae R6
acuauuugaguaac

SEQ ID NO: 2180935 - RNA, 16 nt, Streptococcus pneumoniae R6
acuauuucuuauuuca

SEQ ID NO: 2180936 - RNA, 16 nt, Streptococcus pneumoniae R6
acuauuuuccaaaaau

SEQ ID NO: 2180937 - RNA, 13 nt, Streptococcus pneumoniae R6
acuauuuuuguca

SEQ ID NO: 2180938 - RNA, 14 nt, Streptococcus pneumoniae R6
acucaaaagaagau

SEQ ID NO: 2180939 - RNA, 22 nt, Streptococcus pneumoniae R6
acucccaucgcgaccaagagca

SEQ ID NO: 2180940 - RNA, 17 nt, Streptococcus pneumoniae R6
acuccucucaguucuga

SEQ ID NO: 2180941 - RNA, 23 nt, Streptococcus pneumoniae R6
acucgaaccaccgaccucacgcu

SEQ ID NO: 2180942 - RNA, 20 nt, Streptococcus pneumoniae R6
acucgaacuagagaagccaa

SEQ ID NO: 2180943 - RNA, 22 nt, Streptococcus pneumoniae R6
acucuaaccauuauagcauucu

SEQ ID NO: 2180944 - RNA, 14 nt, Streptococcus pneumoniae R6
acucuacagauuuc

SEQ ID NO: 2180945 - RNA, 21 nt, Streptococcus pneumoniae R6
acucuccuuagucucaaaauc

SEQ ID NO: 2180946 - RNA, 22 nt, Streptococcus pneumoniae R6
acucuccuccauaaaaagaccg

SEQ ID NO: 2180947 - RNA, 16 nt, Streptococcus pneumoniae R6
acucucggucuuguuu

SEQ ID NO: 2180948 - RNA, 21 nt, Streptococcus pneumoniae R6
acucucggucuuguuuuuuau

SEQ ID NO: 2180949 - RNA, 14 nt, Streptococcus pneumoniae R6
acucuguuuucacc

SEQ ID NO: 2180950 - RNA, 15 nt, Streptococcus pneumoniae R6
acucuggguguuucu

SEQ ID NO: 2180951 - RNA, 21 nt, Streptococcus pneumoniae R6
acucuggcaauuuaucuccua

SEQ ID NO: 2180952 - RNA, 18 nt, Streptococcus pneumoniae R6
acucuuagucuuuauuuu

SEQ ID NO: 2180953 - RNA, 17 nt, Streptococcus pneumoniae R6
acucuucaagguuuuau

SEQ ID NO: 2180954 - RNA, 12 nt, Streptococcus pneumoniae R6
acucuucaaaaa

SEQ ID NO: 2180955 - RNA, 15 nt, Streptococcus pneumoniae R6
acucuuguucaaagu

SEQ ID NO: 2180956 - RNA, 16 nt, Streptococcus pneumoniae R6
acucuuguucugccua

SEQ ID NO: 2180957 - RNA, 17 nt, Streptococcus pneumoniae R6
acucuuggaagaaaucc

SEQ ID NO: 2180958 - RNA, 19 nt, Streptococcus pneumoniae R6
acucuucgaaaaucucugc

SEQ ID NO: 2180959 - RNA, 23 nt, Streptococcus pneumoniae R6
acucuucgaaaaucucugcaaac

SEQ ID NO: 2180960 - RNA, 18 nt, Streptococcus pneumoniae R6
acuucgauguuacagaca

SEQ ID NO: 2180961 - RNA, 17 nt, Streptococcus pneumoniae R6
acuuccuguaagaacuu

SEQ ID NO: 2180962 - RNA, 20 nt, Streptococcus pneumoniae R6
acuuccuuuucuacugaaau

SEQ ID NO: 2180963 - RNA, 13 nt, Streptococcus pneumoniae R6
acuuccuuuucuu

SEQ ID NO: 2180964 - RNA, 16 nt, Streptococcus pneumoniae R6
acuuccuuuucuuauc

SEQ ID NO: 2180965 - RNA, 14 nt, Streptococcus pneumoniae R6
acuuccuuuuuaaa

SEQ ID NO: 2180966 - RNA, 14 nt, Streptococcus pneumoniae R6
acuuccuuaccauc

SEQ ID NO: 2180967 - RNA, 18 nt, Streptococcus pneumoniae R6
acuucccacccauauuuu

SEQ ID NO: 2180968 - RNA, 22 nt, Streptococcus pneumoniae R6
acuuccauguuguagucugcug

SEQ ID NO: 2180969 - RNA, 16 nt, Streptococcus pneumoniae R6
acuuccacuuccagaa

SEQ ID NO: 2180970 - RNA, 21 nt, Streptococcus pneumoniae R6
acuuccaauucgguugguuuu

SEQ ID NO: 2180971 - RNA, 11 nt, Streptococcus pneumoniae R6
acuucuguaag

SEQ ID NO: 2180972 - RNA, 18 nt, Streptococcus pneumoniae R6
acuucuguaagucauuuu

SEQ ID NO: 2180973 - RNA, 22 nt, Streptococcus pneumoniae R6
acuucuguaagucauuuucuuu

SEQ ID NO: 2180974 - RNA, 18 nt, Streptococcus pneumoniae R6
acuucugucuauuugcuu

SEQ ID NO: 2180975 - RNA, 17 nt, Streptococcus pneumoniae R6
acuucugcuucuaaaac

SEQ ID NO: 2180976 - RNA, 17 nt, Streptococcus pneumoniae R6
acuucugcuugauuaag

SEQ ID NO: 2180977 - RNA, 13 nt, Streptococcus pneumoniae R6
acuucugcaauua

SEQ ID NO: 2180978 - RNA, 22 nt, Streptococcus pneumoniae R6
acuucugagguuaaaaucuuuu

SEQ ID NO: 2180979 - RNA, 15 nt, Streptococcus pneumoniae R6
acuucgucacauucc

SEQ ID NO: 2180980 - RNA, 21 nt, Streptococcus pneumoniae R6
acuucguucacccuugcuuuu

SEQ ID NO: 2180981 - RNA, 20 nt, Streptococcus pneumoniae R6
acuucgucagucuuaucugc

SEQ ID NO: 2180982 - RNA, 15 nt, Streptococcus pneumoniae R6
acuucgucaguucua

SEQ ID NO: 2180983 - RNA, 13 nt, Streptococcus pneumoniae R6
acuucgucaguuu

SEQ ID NO: 2180984 - RNA, 20 nt, Streptococcus pneumoniae R6
acuucgucaguuucaucuac

SEQ ID NO: 2180985 - RNA, 20 nt, Streptococcus pneumoniae R6
acuucgucguaaccuucuuc

SEQ ID NO: 2180986 - RNA, 21 nt, Streptococcus pneumoniae R6
acuucgucguaaccuucuucu

SEQ ID NO: 2180987 - RNA, 17 nt, Streptococcus pneumoniae R6
acuucuaaaacauuguu

SEQ ID NO: 2180988 - RNA, 15 nt, Streptococcus pneumoniae R6
acuugauaaaaguua

SEQ ID NO: 2180989 - RNA, 16 nt, Streptococcus pneumoniae R6
acuugauaaaaguuau

SEQ ID NO: 2180990 - RNA, 15 nt, Streptococcus pneumoniae R6
acuugagcaaacuga

SEQ ID NO: 2180991 - RNA, 18 nt, Streptococcus pneumoniae R6
acuugagacuguuugaga

SEQ ID NO: 2180992 - RNA, 23 nt, Streptococcus pneumoniae R6
acuugaccuaaaucacuuaguug

SEQ ID NO: 2180993 - RNA, 18 nt, Streptococcus pneumoniae R6
acuugaccuguuuucaca

SEQ ID NO: 2180994 - RNA, 15 nt, Streptococcus pneumoniae R6
acuucuuuuugauuu

SEQ ID NO: 2180995 - RNA, 16 nt, Streptococcus pneumoniae R6
acuucuuuuugauuua

SEQ ID NO: 2180996 - RNA, 12 nt, Streptococcus pneumoniae R6
acuucuuuuuug

SEQ ID NO: 2180997 - RNA, 20 nt, Streptococcus pneumoniae R6
acuucuuuuuugagaugaga

SEQ ID NO: 2180998 - RNA, 15 nt, Streptococcus pneumoniae R6
acuucuuuuuuugau

SEQ ID NO: 2180999 - RNA, 17 nt, Streptococcus pneumoniae R6
acuugaaucugaugaac

SEQ ID NO: 2181000 - RNA, 12 nt, Streptococcus pneumoniae R6
acuugaaaugau

SEQ ID NO: 2181001 - RNA, 13 nt, Streptococcus pneumoniae R6
acuucuucuucca

SEQ ID NO: 2181002 - RNA, 18 nt, Streptococcus pneumoniae R6
acuucuucuuccauaucg

SEQ ID NO: 2181003 - RNA, 16 nt, Streptococcus pneumoniae R6
acuucuuauuagcaac

SEQ ID NO: 2181004 - RNA, 13 nt, Streptococcus pneumoniae R6
acuucuuccccag

SEQ ID NO: 2181005 - RNA, 21 nt, Streptococcus pneumoniae R6
acuucuuugguugcuacaucu

SEQ ID NO: 2181006 - RNA, 23 nt, Streptococcus pneumoniae R6
acuucuuuaacuacuugauaaaa

SEQ ID NO: 2181007 - RNA, 21 nt, Streptococcus pneumoniae R6
acuucuugucgauauaagaau

SEQ ID NO: 2181008 - RNA, 20 nt, Streptococcus pneumoniae R6
acuucacgaaugacagcauc

SEQ ID NO: 2181009 - RNA, 15 nt, Streptococcus pneumoniae R6
acuucacgagccaag

SEQ ID NO: 2181010 - RNA, 16 nt, Streptococcus pneumoniae R6
acuucagcuccaccca

SEQ ID NO: 2181011 - RNA, 14 nt, Streptococcus pneumoniae R6
acuucagcuuuuuu

SEQ ID NO: 2181012 - RNA, 15 nt, Streptococcus pneumoniae R6
acuucagcuuuuuug

SEQ ID NO: 2181013 - RNA, 15 nt, Streptococcus pneumoniae R6
acuucaggaaaaaau

SEQ ID NO: 2181014 - RNA, 16 nt, Streptococcus pneumoniae R6
acuucaggauuuuuac

SEQ ID NO: 2181015 - RNA, 15 nt, Streptococcus pneumoniae R6
acuucaaccuuacca

SEQ ID NO: 2181016 - RNA, 21 nt, Streptococcus pneumoniae R6
acuucaaauccuuuauuuuca

SEQ ID NO: 2181017 - RNA, 16 nt, Streptococcus pneumoniae R6
acuucaauaaaauaua

SEQ ID NO: 2181018 - RNA, 19 nt, Streptococcus pneumoniae R6
acuucaagaacuuuaacuu

SEQ ID NO: 2181019 - RNA, 20 nt, Streptococcus pneumoniae R6
acuuacuuaacccuuuuuau

SEQ ID NO: 2181020 - RNA, 15 nt, Streptococcus pneumoniae R6
acuuaugaagaaauu

SEQ ID NO: 2181021 - RNA, 21 nt, Streptococcus pneumoniae R6
acuuauccuuuuuuacuucau

SEQ ID NO: 2181022 - RNA, 20 nt, Streptococcus pneumoniae R6
acuggauuguauagugaauu

SEQ ID NO: 2181023 - RNA, 20 nt, Streptococcus pneumoniae R6
acugucuugccaaccagguu

SEQ ID NO: 2181024 - RNA, 14 nt, Streptococcus pneumoniae R6
acugugauuucuaa

SEQ ID NO: 2181025 - RNA, 20 nt, Streptococcus pneumoniae R6
acugugauuucuaaaacauu

SEQ ID NO: 2181026 - RNA, 15 nt, Streptococcus pneumoniae R6
acuuaaaaaucuuca

SEQ ID NO: 2181027 - RNA, 14 nt, Streptococcus pneumoniae R6
acuuaacccauuca

SEQ ID NO: 2181028 - RNA, 14 nt, Streptococcus pneumoniae R6
acuuaaauuuuugu

SEQ ID NO: 2181029 - RNA, 21 nt, Streptococcus pneumoniae R6
acuuaaauugguguuguuuau

SEQ ID NO: 2181030 - RNA, 19 nt, Streptococcus pneumoniae R6
acuuacgacauccuauuua

SEQ ID NO: 2181031 - RNA, 23 nt, Streptococcus pneumoniae R6
acuuacuauucacucaaaucaua

SEQ ID NO: 2181032 - RNA, 17 nt, Streptococcus pneumoniae R6
acuaacccuagaaaacc

SEQ ID NO: 2181033 - RNA, 14 nt, Streptococcus pneumoniae R6
acuaacucaucaaa

SEQ ID NO: 2181034 - RNA, 16 nt, Streptococcus pneumoniae R6
acuaacgccaaauccu

SEQ ID NO: 2181035 - RNA, 23 nt, Streptococcus pneumoniae R6
acuaaauuccaaauuagaaaaag

SEQ ID NO: 2181036 - RNA, 16 nt, Streptococcus pneumoniae R6
acuaacaauuaugcuu

SEQ ID NO: 2181037 - RNA, 19 nt, Streptococcus pneumoniae R6
acuaacaauuaugcuuaaa

SEQ ID NO: 2181038 - RNA, 14 nt, Streptococcus pneumoniae R6
acuaaguuagaaua

SEQ ID NO: 2181039 - RNA, 21 nt, Streptococcus pneumoniae R6
acuaaguuccuguuguaauuu

SEQ ID NO: 2181040 - RNA, 16 nt, Streptococcus pneumoniae R6
acuaagccuacacaga

SEQ ID NO: 2181041 - RNA, 20 nt, Streptococcus pneumoniae R6
acuaagauagagguuauuca

SEQ ID NO: 2181042 - RNA, 12 nt, Streptococcus pneumoniae R6
acuaagcaugau

SEQ ID NO: 2181043 - RNA, 20 nt, Streptococcus pneumoniae R6
acuaagauuuguuuuucaaa

SEQ ID NO: 2181044 - RNA, 21 nt, Streptococcus pneumoniae R6
acuaagauuuguuuuucaaag

SEQ ID NO: 2181045 - RNA, 13 nt, Streptococcus pneumoniae R6
acuacaguugaca

SEQ ID NO: 2181046 - RNA, 15 nt, Streptococcus pneumoniae R6
acuacaguugacaaa

SEQ ID NO: 2181047 - RNA, 16 nt, Streptococcus pneumoniae R6
acuacaguugacaaag

SEQ ID NO: 2181048 - RNA, 18 nt, Streptococcus pneumoniae R6
acuacaguugacaaagag

SEQ ID NO: 2181049 - RNA, 21 nt, Streptococcus pneumoniae R6
acuacaguugacaaagagcca

SEQ ID NO: 2181050 - RNA, 22 nt, Streptococcus pneumoniae R6
acuacaguugacaaagagccaa

SEQ ID NO: 2181051 - RNA, 22 nt, Streptococcus pneumoniae R6
acuacaguugacaaagagccua

SEQ ID NO: 2181052 - RNA, 17 nt, Streptococcus pneumoniae R6
acuaaugcccuuuuuug

SEQ ID NO: 2181053 - RNA, 19 nt, Streptococcus pneumoniae R6
acuaaugcccuuuuuuguu

SEQ ID NO: 2181054 - RNA, 19 nt, Streptococcus pneumoniae R6
acuaauauaguugucgcuu

SEQ ID NO: 2181055 - RNA, 18 nt, Streptococcus pneumoniae R6
acuaauacauuuuguaaa

SEQ ID NO: 2181056 - RNA, 17 nt, Streptococcus pneumoniae R6
acuagaaugcuuuguga

SEQ ID NO: 2181057 - RNA, 18 nt, Streptococcus pneumoniae R6
acuagaaugcuuugugaa

SEQ ID NO: 2181058 - RNA, 18 nt, Streptococcus pneumoniae R6
acuagaaugcuuuuugaa

SEQ ID NO: 2181059 - RNA, 22 nt, Streptococcus pneumoniae R6
acuaccgcuucagcgauuucuu

SEQ ID NO: 2181060 - RNA, 13 nt, Streptococcus pneumoniae R6
acuacauuuuuug

SEQ ID NO: 2181061 - RNA, 18 nt, Streptococcus pneumoniae R6
acuacauuuuuugaaaua

SEQ ID NO: 2181062 - RNA, 13 nt, Streptococcus pneumoniae R6
acuauaauaaaau

SEQ ID NO: 2181063 - RNA, 18 nt, Streptococcus pneumoniae R6
acuauaauaaaaugaaau

SEQ ID NO: 2181064 - RNA, 17 nt, Streptococcus pneumoniae R6
acuauaacagagaagaa

SEQ ID NO: 2181065 - RNA, 20 nt, Streptococcus pneumoniae R6
acuagcuaacugcuucacua

SEQ ID NO: 2181066 - RNA, 12 nt, Streptococcus pneumoniae R6
acuauaaaacau

SEQ ID NO: 2181067 - RNA, 12 nt, Streptococcus pneumoniae R6
acuauaaaaaag

SEQ ID NO: 2181068 - RNA, 16 nt, Streptococcus pneumoniae R6
acuauaaaaaagugaa

SEQ ID NO: 2181069 - RNA, 19 nt, Streptococcus pneumoniae R6
acuauaaaaaagugaacaa

SEQ ID NO: 2181070 - RNA, 15 nt, Streptococcus pneumoniae R6
acuagauaaaagaau

SEQ ID NO: 2181071 - RNA, 17 nt, Streptococcus pneumoniae R6
acuagauucuauuuuuu

SEQ ID NO: 2181072 - RNA, 19 nt, Streptococcus pneumoniae R6
acuagauucuauuuuuuau

SEQ ID NO: 2181073 - RNA, 22 nt, Streptococcus pneumoniae R6
acuagcgagggaaacagccaau

SEQ ID NO: 2181074 - RNA, 20 nt, Streptococcus pneumoniae R6
acuauauaucaugcuuuacu

SEQ ID NO: 2181075 - RNA, 14 nt, Streptococcus pneumoniae R6
acuauauaugcaca

SEQ ID NO: 2181076 - RNA, 21 nt, Streptococcus pneumoniae R6
acuauaucauauagauaaaaa

SEQ ID NO: 2181077 - RNA, 22 nt, Streptococcus pneumoniae R6
acuauaguuugcaaauuauuua

SEQ ID NO: 2181078 - RNA, 17 nt, Streptococcus pneumoniae R6
acuauaguagauugaaa

SEQ ID NO: 2181079 - RNA, 20 nt, Streptococcus pneumoniae R6
acuauaguagauugaaacua

SEQ ID NO: 2181080 - RNA, 21 nt, Streptococcus pneumoniae R6
acuauaguagcucagaagucg

SEQ ID NO: 2181081 - RNA, 23 nt, Streptococcus pneumoniae R6
acuauauuucuauacuuuuucuu

SEQ ID NO: 2181082 - RNA, 23 nt, Streptococcus pneumoniae R6
acuauauuucuuaauuguagcuu

SEQ ID NO: 2181083 - RNA, 18 nt, Streptococcus pneumoniae R6
acuauauugcaagagaaa

SEQ ID NO: 2181084 - RNA, 19 nt, Streptococcus pneumoniae R6
acuauauugcaagagaaau

SEQ ID NO: 2181085 - RNA, 20 nt, Streptococcus pneumoniae R6
acuauacuuuuuuaauuuaa

SEQ ID NO: 2181086 - RNA, 17 nt, Streptococcus pneumoniae R6
acuauagaaaaaagucu

SEQ ID NO: 2181087 - RNA, 21 nt, Streptococcus pneumoniae R6
acuauagccaucucuacuccu

SEQ ID NO: 2181088 - RNA, 20 nt, Streptococcus pneumoniae R6
acuauagcguuuugaaacua

SEQ ID NO: 2181089 - RNA, 15 nt, Streptococcus pneumoniae R6
acuaucaaugauuua

SEQ ID NO: 2181090 - RNA, 16 nt, Streptococcus pneumoniae R6
acuaucaaugauuuau

SEQ ID NO: 2181091 - RNA, 19 nt, Streptococcus pneumoniae R6
acuaucaauuauaauaaaa

SEQ ID NO: 2181092 - RNA, 14 nt, Streptococcus pneumoniae R6
acuauuucagauuc

SEQ ID NO: 2181093 - RNA, 21 nt, Streptococcus pneumoniae R6
acuauuguagauuauaugcua

SEQ ID NO: 2181094 - RNA, 17 nt, Streptococcus pneumoniae R6
acuauugaugaacugcu

SEQ ID NO: 2181095 - RNA, 18 nt, Streptococcus pneumoniae R6
acuauuguuauuuuucuu

SEQ ID NO: 2181096 - RNA, 21 nt, Streptococcus pneumoniae R6
acuauuguuauuuuucuuuuu

SEQ ID NO: 2181097 - RNA, 15 nt, Streptococcus pneumoniae R6
acgucuuuucgucca

SEQ ID NO: 2181098 - RNA, 19 nt, Streptococcus pneumoniae R6
acgucuucaauaccaaaga

SEQ ID NO: 2181099 - RNA, 13 nt, Streptococcus pneumoniae R6
acguugaauagcu

SEQ ID NO: 2181100 - RNA, 22 nt, Streptococcus pneumoniae R6
acguucuucaagagcuuuaaua

SEQ ID NO: 2181101 - RNA, 17 nt, Streptococcus pneumoniae R6
acguucugucaaaccau

SEQ ID NO: 2181102 - RNA, 15 nt, Streptococcus pneumoniae R6
acgugcucaaaacac

SEQ ID NO: 2181103 - RNA, 17 nt, Streptococcus pneumoniae R6
acgugcucaaaacacug

SEQ ID NO: 2181104 - RNA, 20 nt, Streptococcus pneumoniae R6
acguuuaaagacaguugcau

SEQ ID NO: 2181105 - RNA, 13 nt, Streptococcus pneumoniae R6
acguuguuuucca

SEQ ID NO: 2181106 - RNA, 21 nt, Streptococcus pneumoniae R6
acguuuuaggacauaaaucga

SEQ ID NO: 2181107 - RNA, 16 nt, Streptococcus pneumoniae R6
acguuguuaaaucaac

SEQ ID NO: 2181108 - RNA, 19 nt, Streptococcus pneumoniae R6
acguuguucaagccuuauu

SEQ ID NO: 2181109 - RNA, 18 nt, Streptococcus pneumoniae R6
acguugcuuauacucaau

SEQ ID NO: 2181110 - RNA, 16 nt, Streptococcus pneumoniae R6
acuaaaucuucggaua

SEQ ID NO: 2181111 - RNA, 22 nt, Streptococcus pneumoniae R6
acuaaaucuucggauaaauuaa

SEQ ID NO: 2181112 - RNA, 16 nt, Streptococcus pneumoniae R6
acuaaauauaagauuu

SEQ ID NO: 2181113 - RNA, 22 nt, Streptococcus pneumoniae R6
acuaaagguugaugaguaaguu

SEQ ID NO: 2181114 - RNA, 18 nt, Streptococcus pneumoniae R6
acuaaaguguaaugcuau

SEQ ID NO: 2181115 - RNA, 18 nt, Streptococcus pneumoniae R6
acuaaauacaaaaacaaa

SEQ ID NO: 2181116 - RNA, 23 nt, Streptococcus pneumoniae R6
acuaaauacaaaaacaaagagau

SEQ ID NO: 2181117 - RNA, 19 nt, Streptococcus pneumoniae R6
acuaaauaccuuauccaau

SEQ ID NO: 2181118 - RNA, 15 nt, Streptococcus pneumoniae R6
acuaaacgugauaaa

SEQ ID NO: 2181119 - RNA, 18 nt, Streptococcus pneumoniae R6
acuaaagcuuuuuucuuu

SEQ ID NO: 2181120 - RNA, 15 nt, Streptococcus pneumoniae R6
acuaaaccaauaaua

SEQ ID NO: 2181121 - RNA, 17 nt, Streptococcus pneumoniae R6
acuaaaccaauaauaaa

SEQ ID NO: 2181122 - RNA, 21 nt, Streptococcus pneumoniae R6
acuaaacaagggauuuuucug

SEQ ID NO: 2181123 - RNA, 16 nt, Streptococcus pneumoniae R6
acuaaaaccuucuaau

SEQ ID NO: 2181124 - RNA, 16 nt, Streptococcus pneumoniae R6
acguuuuuacuacuuu

SEQ ID NO: 2181125 - RNA, 17 nt, Streptococcus pneumoniae R6
acguuuuuacuacuuuu

SEQ ID NO: 2181126 - RNA, 15 nt, Streptococcus pneumoniae R6
acguuuuuugauuuu

SEQ ID NO: 2181127 - RNA, 12 nt, Streptococcus pneumoniae R6
acgcuacuccua

SEQ ID NO: 2181128 - RNA, 17 nt, Streptococcus pneumoniae R6
acgcuacuccuaagaau

SEQ ID NO: 2181129 - RNA, 15 nt, Streptococcus pneumoniae R6
acgcugacgugguuu

SEQ ID NO: 2181130 - RNA, 20 nt, Streptococcus pneumoniae R6
acggagaggacaaguuaaau

SEQ ID NO: 2181131 - RNA, 22 nt, Streptococcus pneumoniae R6
acggagaacaauauuacguccu

SEQ ID NO: 2181132 - RNA, 20 nt, Streptococcus pneumoniae R6
acggacgguagcgacuuucu

SEQ ID NO: 2181133 - RNA, 14 nt, Streptococcus pneumoniae R6
acggaucuugaacu

SEQ ID NO: 2181134 - RNA, 19 nt, Streptococcus pneumoniae R6
acggaucugaagcuuuauu

SEQ ID NO: 2181135 - RNA, 22 nt, Streptococcus pneumoniae R6
acggcaaaaagcccuugaauua

SEQ ID NO: 2181136 - RNA, 14 nt, Streptococcus pneumoniae R6
acggugaucuucgc

SEQ ID NO: 2181137 - RNA, 19 nt, Streptococcus pneumoniae R6
acgguuuaccaauuuuucc

SEQ ID NO: 2181138 - RNA, 21 nt, Streptococcus pneumoniae R6
acguaaaagucauacuuucuc

SEQ ID NO: 2181139 - RNA, 18 nt, Streptococcus pneumoniae R6
acguaacauauuuucaaa

SEQ ID NO: 2181140 - RNA, 16 nt, Streptococcus pneumoniae R6
acguacaacagcuaca

SEQ ID NO: 2181141 - RNA, 18 nt, Streptococcus pneumoniae R6
acguacaguaucaagguu

SEQ ID NO: 2181142 - RNA, 18 nt, Streptococcus pneumoniae R6
acggcuuuuaguaaaaau

SEQ ID NO: 2181143 - RNA, 14 nt, Streptococcus pneumoniae R6
acggcuaauaccag

SEQ ID NO: 2181144 - RNA, 15 nt, Streptococcus pneumoniae R6
acggcaaggcaaagc

SEQ ID NO: 2181145 - RNA, 16 nt, Streptococcus pneumoniae R6
accucuacaauaacac

SEQ ID NO: 2181146 - RNA, 15 nt, Streptococcus pneumoniae R6
accugaaucuccuca

SEQ ID NO: 2181147 - RNA, 16 nt, Streptococcus pneumoniae R6
accugaaucuccucag

SEQ ID NO: 2181148 - RNA, 17 nt, Streptococcus pneumoniae R6
accucuggaucuuccgu

SEQ ID NO: 2181149 - RNA, 22 nt, Streptococcus pneumoniae R6
accucuuccgaggucaucauua

SEQ ID NO: 2181150 - RNA, 21 nt, Streptococcus pneumoniae R6
accucuguauaaauagcuaca

SEQ ID NO: 2181151 - RNA, 16 nt, Streptococcus pneumoniae R6
accucuuucuuucuca

SEQ ID NO: 2181152 - RNA, 20 nt, Streptococcus pneumoniae R6
accucuuucuuucucacuua

SEQ ID NO: 2181153 - RNA, 17 nt, Streptococcus pneumoniae R6
accucuugaaguucauu

SEQ ID NO: 2181154 - RNA, 19 nt, Streptococcus pneumoniae R6
accucuugaaguucauuuu

SEQ ID NO: 2181155 - RNA, 23 nt, Streptococcus pneumoniae R6
accucuugaaguucauuuucuuu

SEQ ID NO: 2181156 - RNA, 16 nt, Streptococcus pneumoniae R6
accucacuuaauacuu

SEQ ID NO: 2181157 - RNA, 16 nt, Streptococcus pneumoniae R6
accucauaucucuugu

SEQ ID NO: 2181158 - RNA, 14 nt, Streptococcus pneumoniae R6
accucauaucuguc

SEQ ID NO: 2181159 - RNA, 22 nt, Streptococcus pneumoniae R6
accuccucgagcaguuccauca

SEQ ID NO: 2181160 - RNA, 18 nt, Streptococcus pneumoniae R6
accuccgccuccagagaa

SEQ ID NO: 2181161 - RNA, 20 nt, Streptococcus pneumoniae R6
accuagcgaauaaguuuuaa

SEQ ID NO: 2181162 - RNA, 20 nt, Streptococcus pneumoniae R6
accuaguccaagacguucaa

SEQ ID NO: 2181163 - RNA, 19 nt, Streptococcus pneumoniae R6
accuaguacaaagaauaaa

SEQ ID NO: 2181164 - RNA, 21 nt, Streptococcus pneumoniae R6
acgaaaaguaggacgauaaaa

SEQ ID NO: 2181165 - RNA, 11 nt, Streptococcus pneumoniae R6
acgaacaaaaa

SEQ ID NO: 2181166 - RNA, 22 nt, Streptococcus pneumoniae R6
accuugaucggaagcuacagag

SEQ ID NO: 2181167 - RNA, 11 nt, Streptococcus pneumoniae R6
accuugcaaaa

SEQ ID NO: 2181168 - RNA, 19 nt, Streptococcus pneumoniae R6
accuugccaucugcuucau

SEQ ID NO: 2181169 - RNA, 15 nt, Streptococcus pneumoniae R6
accuugaucuuccau

SEQ ID NO: 2181170 - RNA, 17 nt, Streptococcus pneumoniae R6
accuugaucaaucaugu

SEQ ID NO: 2181171 - RNA, 15 nt, Streptococcus pneumoniae R6
accuuccucaacaaa

SEQ ID NO: 2181172 - RNA, 22 nt, Streptococcus pneumoniae R6
accuuaucacgaauuucuuguu

SEQ ID NO: 2181173 - RNA, 15 nt, Streptococcus pneumoniae R6
accuuacucuacaga

SEQ ID NO: 2181174 - RNA, 21 nt, Streptococcus pneumoniae R6
accuuacucuacagauuucag

SEQ ID NO: 2181175 - RNA, 22 nt, Streptococcus pneumoniae R6
accuuaaacuuguaagucaagu

SEQ ID NO: 2181176 - RNA, 13 nt, Streptococcus pneumoniae R6
accuuaaaacagu

SEQ ID NO: 2181177 - RNA, 22 nt, Streptococcus pneumoniae R6
accuuaaaacaguguuuugagc

SEQ ID NO: 2181178 - RNA, 19 nt, Streptococcus pneumoniae R6
accugauaguuuaguuauu

SEQ ID NO: 2181179 - RNA, 12 nt, Streptococcus pneumoniae R6
accuuaaaacag

SEQ ID NO: 2181180 - RNA, 17 nt, Streptococcus pneumoniae R6
acgauuuuuucuuuguu

SEQ ID NO: 2181181 - RNA, 17 nt, Streptococcus pneumoniae R6
acgauuuucucuuuguc

SEQ ID NO: 2181182 - RNA, 21 nt, Streptococcus pneumoniae R6
acgauuuucucuuuguccuuu

SEQ ID NO: 2181183 - RNA, 22 nt, Streptococcus pneumoniae R6
acgauuuucucuuuguccuuua

SEQ ID NO: 2181184 - RNA, 21 nt, Streptococcus pneumoniae R6
acgauuaucuaacaauaagau

SEQ ID NO: 2181185 - RNA, 17 nt, Streptococcus pneumoniae R6
acgauucaucaagagac

SEQ ID NO: 2181186 - RNA, 20 nt, Streptococcus pneumoniae R6
acgauuaaaaguaagagaaa

SEQ ID NO: 2181187 - RNA, 21 nt, Streptococcus pneumoniae R6
acgauuaaaaguaagagaaac

SEQ ID NO: 2181188 - RNA, 20 nt, Streptococcus pneumoniae R6
acgauuaaauaguucuucca

SEQ ID NO: 2181189 - RNA, 14 nt, Streptococcus pneumoniae R6
acgauguugaugau

SEQ ID NO: 2181190 - RNA, 19 nt, Streptococcus pneumoniae R6
acgauuggggauuuuuagu

SEQ ID NO: 2181191 - RNA, 19 nt, Streptococcus pneumoniae R6
acgaugaugauuggaauga

SEQ ID NO: 2181192 - RNA, 22 nt, Streptococcus pneumoniae R6
acgaugacaagguguguugcuu

SEQ ID NO: 2181193 - RNA, 15 nt, Streptococcus pneumoniae R6
acgaugcuuuucuug

SEQ ID NO: 2181194 - RNA, 14 nt, Streptococcus pneumoniae R6
acgauguccauuga

SEQ ID NO: 2181195 - RNA, 17 nt, Streptococcus pneumoniae R6
acgaggaggagaaaaag

SEQ ID NO: 2181196 - RNA, 17 nt, Streptococcus pneumoniae R6
acgauaccaucauaggc

SEQ ID NO: 2181197 - RNA, 16 nt, Streptococcus pneumoniae R6
acgauaaucugggcua

SEQ ID NO: 2181198 - RNA, 15 nt, Streptococcus pneumoniae R6
acgauagauccuuca

SEQ ID NO: 2181199 - RNA, 15 nt, Streptococcus pneumoniae R6
acgaagcugacauga

SEQ ID NO: 2181200 - RNA, 19 nt, Streptococcus pneumoniae R6
acgaagcauaucagacaua

SEQ ID NO: 2181201 - RNA, 18 nt, Streptococcus pneumoniae R6
acgaagaaggaagaguca

SEQ ID NO: 2181202 - RNA, 23 nt, Streptococcus pneumoniae R6
acgaacugcgacguuuucuccuu

SEQ ID NO: 2181203 - RNA, 21 nt, Streptococcus pneumoniae R6
acgaacgccuuaaaaaaccaa

SEQ ID NO: 2181204 - RNA, 20 nt, Streptococcus pneumoniae R6
acgaacuccacugaaucguu

SEQ ID NO: 2181205 - RNA, 21 nt, Streptococcus pneumoniae R6
acgaagucaguaaccauacau

SEQ ID NO: 2181206 - RNA, 23 nt, Streptococcus pneumoniae R6
acgaaguccuuguuugagcucuu

SEQ ID NO: 2181207 - RNA, 23 nt, Streptococcus pneumoniae R6
acgaaguuguucuugaaguccuu

SEQ ID NO: 2181208 - RNA, 19 nt, Streptococcus pneumoniae R6
acgcaugauaucaaacuuu

SEQ ID NO: 2181209 - RNA, 18 nt, Streptococcus pneumoniae R6
acgcaugucguucaaggu

SEQ ID NO: 2181210 - RNA, 21 nt, Streptococcus pneumoniae R6
acgcauaauaucaaguuuuca

SEQ ID NO: 2181211 - RNA, 19 nt, Streptococcus pneumoniae R6
acgcauaagcaauuuuuua

SEQ ID NO: 2181212 - RNA, 22 nt, Streptococcus pneumoniae R6
acgcauaguaucagguauugaa

SEQ ID NO: 2181213 - RNA, 20 nt, Streptococcus pneumoniae R6
acgcauaguugcauuaaaau

SEQ ID NO: 2181214 - RNA, 16 nt, Streptococcus pneumoniae R6
acgccaaaaccucuaa

SEQ ID NO: 2181215 - RNA, 15 nt, Streptococcus pneumoniae R6
accgcagucuucaau

SEQ ID NO: 2181216 - RNA, 20 nt, Streptococcus pneumoniae R6
accgacuucugagcuacuau

SEQ ID NO: 2181217 - RNA, 15 nt, Streptococcus pneumoniae R6
acccucguuaucauu

SEQ ID NO: 2181218 - RNA, 18 nt, Streptococcus pneumoniae R6
acccucguuaucauucca

SEQ ID NO: 2181219 - RNA, 14 nt, Streptococcus pneumoniae R6
accgaucucaucuu

SEQ ID NO: 2181220 - RNA, 15 nt, Streptococcus pneumoniae R6
accgaucucaucuuc

SEQ ID NO: 2181221 - RNA, 15 nt, Streptococcus pneumoniae R6
accgaugauguucau

SEQ ID NO: 2181222 - RNA, 12 nt, Streptococcus pneumoniae R6
accggagaaaga

SEQ ID NO: 2181223 - RNA, 14 nt, Streptococcus pneumoniae R6
accagaaccaugac

SEQ ID NO: 2181224 - RNA, 14 nt, Streptococcus pneumoniae R6
accagaaaaucauu

SEQ ID NO: 2181225 - RNA, 18 nt, Streptococcus pneumoniae R6
accagaaaguacccaugu

SEQ ID NO: 2181226 - RNA, 15 nt, Streptococcus pneumoniae R6
accauagagcggacu

SEQ ID NO: 2181227 - RNA, 17 nt, Streptococcus pneumoniae R6
accauacagaaucuuca

SEQ ID NO: 2181228 - RNA, 14 nt, Streptococcus pneumoniae R6
accauacauugauu

SEQ ID NO: 2181229 - RNA, 16 nt, Streptococcus pneumoniae R6
accaucaaaauagugu

SEQ ID NO: 2181230 - RNA, 20 nt, Streptococcus pneumoniae R6
accaucaaaauagugugacc

SEQ ID NO: 2181231 - RNA, 21 nt, Streptococcus pneumoniae R6
accaugcggaugcaugccauu

SEQ ID NO: 2181232 - RNA, 19 nt, Streptococcus pneumoniae R6
accaugaggaaacgcucgg

SEQ ID NO: 2181233 - RNA, 17 nt, Streptococcus pneumoniae R6
accaugagguaagagaa

SEQ ID NO: 2181234 - RNA, 14 nt, Streptococcus pneumoniae R6
accauugacuugga

SEQ ID NO: 2181235 - RNA, 22 nt, Streptococcus pneumoniae R6
accauugacuuggaaccagccu

SEQ ID NO: 2181236 - RNA, 15 nt, Streptococcus pneumoniae R6
accauugucacaauu

SEQ ID NO: 2181237 - RNA, 14 nt, Streptococcus pneumoniae R6
accauuuccaucuc

SEQ ID NO: 2181238 - RNA, 14 nt, Streptococcus pneumoniae R6
accauuauagcauu

SEQ ID NO: 2181239 - RNA, 21 nt, Streptococcus pneumoniae R6
accauuauagcauucuucuca

SEQ ID NO: 2181240 - RNA, 17 nt, Streptococcus pneumoniae R6
accauuauaguuuaagu

SEQ ID NO: 2181241 - RNA, 18 nt, Streptococcus pneumoniae R6
accauguuuuucaauagc

SEQ ID NO: 2181242 - RNA, 14 nt, Streptococcus pneumoniae R6
accauuuuccaaga

SEQ ID NO: 2181243 - RNA, 21 nt, Streptococcus pneumoniae R6
accauuuuccaagacuuucaa

SEQ ID NO: 2181244 - RNA, 19 nt, Streptococcus pneumoniae R6
accauuuucguccaaguca

SEQ ID NO: 2181245 - RNA, 19 nt, Streptococcus pneumoniae R6
acccaaaacacaaaaaguc

SEQ ID NO: 2181246 - RNA, 23 nt, Streptococcus pneumoniae R6
acccaaauggauagaucuuuacu

SEQ ID NO: 2181247 - RNA, 19 nt, Streptococcus pneumoniae R6
acccaaguaaucugcaccu

SEQ ID NO: 2181248 - RNA, 15 nt, Streptococcus pneumoniae R6
acccaagcuuuaugc

SEQ ID NO: 2181249 - RNA, 13 nt, Streptococcus pneumoniae R6
acccacaaagaua

SEQ ID NO: 2181250 - RNA, 20 nt, Streptococcus pneumoniae R6
acccccaagaaugggcuccc

SEQ ID NO: 2181251 - RNA, 13 nt, Streptococcus pneumoniae R6
acccauauuuuuc

SEQ ID NO: 2181252 - RNA, 20 nt, Streptococcus pneumoniae R6
acccgcgcaauuaagcaggu

SEQ ID NO: 2181253 - RNA, 15 nt, Streptococcus pneumoniae R6
agaaagacuugaccg

SEQ ID NO: 2181254 - RNA, 12 nt, Streptococcus pneumoniae R6
agaaagaaguuu

SEQ ID NO: 2181255 - RNA, 13 nt, Streptococcus pneumoniae R6
agaaagaaaacaa

SEQ ID NO: 2181256 - RNA, 15 nt, Streptococcus pneumoniae R6
agaaagauuuucaaa

SEQ ID NO: 2181257 - RNA, 14 nt, Streptococcus pneumoniae R6
agaaagaaaaacug

SEQ ID NO: 2181258 - RNA, 20 nt, Streptococcus pneumoniae R6
agaaacuuagcgaaauucca

SEQ ID NO: 2181259 - RNA, 15 nt, Streptococcus pneumoniae R6
agaaacucuaaacaa

SEQ ID NO: 2181260 - RNA, 13 nt, Streptococcus pneumoniae R6
agaaacucuaaau

SEQ ID NO: 2181261 - RNA, 14 nt, Streptococcus pneumoniae R6
agaaagguuuuaaa

SEQ ID NO: 2181262 - RNA, 16 nt, Streptococcus pneumoniae R6
agaaaggcgacaucau

SEQ ID NO: 2181263 - RNA, 14 nt, Streptococcus pneumoniae R6
agaaaggagcagau

SEQ ID NO: 2181264 - RNA, 18 nt, Streptococcus pneumoniae R6
agaaaggacaaauuucgu

SEQ ID NO: 2181265 - RNA, 22 nt, Streptococcus pneumoniae R6
agaaaggacaaauuucguccuu

SEQ ID NO: 2181266 - RNA, 22 nt, Streptococcus pneumoniae R6
agaaaggacaaauuuuguccuu

SEQ ID NO: 2181267 - RNA, 14 nt, Streptococcus pneumoniae R6
agaaagcuagucgc

SEQ ID NO: 2181268 - RNA, 20 nt, Streptococcus pneumoniae R6
agaaagcugauagaggaguu

SEQ ID NO: 2181269 - RNA, 12 nt, Streptococcus pneumoniae R6
agaaaguuuuuu

SEQ ID NO: 2181270 - RNA, 23 nt, Streptococcus pneumoniae R6
agaaaguagaguccaaagaccau

SEQ ID NO: 2181271 - RNA, 21 nt, Streptococcus pneumoniae R6
agaaaguggucguuuuucaug

SEQ ID NO: 2181272 - RNA, 15 nt, Streptococcus pneumoniae R6
agaaaguuaaaaaaa

SEQ ID NO: 2181273 - RNA, 14 nt, Streptococcus pneumoniae R6
acuugaugaaaaaa

SEQ ID NO: 2181274 - RNA, 19 nt, Streptococcus pneumoniae R6
acuugaguaaugaacucag

SEQ ID NO: 2181275 - RNA, 14 nt, Streptococcus pneumoniae R6
acuugcaagaaagu

SEQ ID NO: 2181276 - RNA, 15 nt, Streptococcus pneumoniae R6
acuugcaaaaagacu

SEQ ID NO: 2181277 - RNA, 17 nt, Streptococcus pneumoniae R6
acuugcaaaaagacuua

SEQ ID NO: 2181278 - RNA, 22 nt, Streptococcus pneumoniae R6
acuugauuuaugccauauagca

SEQ ID NO: 2181279 - RNA, 13 nt, Streptococcus pneumoniae R6
acuuuuuaaaaaa

SEQ ID NO: 2181280 - RNA, 12 nt, Streptococcus pneumoniae R6
acuuuuuaaagu

SEQ ID NO: 2181281 - RNA, 23 nt, Streptococcus pneumoniae R6
acuuuuguccuauucuuguuuca

SEQ ID NO: 2181282 - RNA, 13 nt, Streptococcus pneumoniae R6
agaaaaaugcaaa

SEQ ID NO: 2181283 - RNA, 15 nt, Streptococcus pneumoniae R6
agaaaacagaaaaau

SEQ ID NO: 2181284 - RNA, 19 nt, Streptococcus pneumoniae R6
agaaaaauuucauuuucua

SEQ ID NO: 2181285 - RNA, 17 nt, Streptococcus pneumoniae R6
agaaaaacucuuguccu

SEQ ID NO: 2181286 - RNA, 17 nt, Streptococcus pneumoniae R6
agaaaccaaucagacua

SEQ ID NO: 2181287 - RNA, 15 nt, Streptococcus pneumoniae R6
agaaacaucuuauua

SEQ ID NO: 2181288 - RNA, 19 nt, Streptococcus pneumoniae R6
agaaacaucuuauuaucaa

SEQ ID NO: 2181289 - RNA, 14 nt, Streptococcus pneumoniae R6
agaaacagcuccug

SEQ ID NO: 2181290 - RNA, 21 nt, Streptococcus pneumoniae R6
agaaacagcuccugaaauaag

SEQ ID NO: 2181291 - RNA, 20 nt, Streptococcus pneumoniae R6
agaaaaggaguagaaaauga

SEQ ID NO: 2181292 - RNA, 13 nt, Streptococcus pneumoniae R6
agaaaauaaaauu

SEQ ID NO: 2181293 - RNA, 14 nt, Streptococcus pneumoniae R6
agaaaauaaaauuc

SEQ ID NO: 2181294 - RNA, 16 nt, Streptococcus pneumoniae R6
agaaaauaaaauuccu

SEQ ID NO: 2181295 - RNA, 19 nt, Streptococcus pneumoniae R6
agaaaacuaguuuaaauca

SEQ ID NO: 2181296 - RNA, 16 nt, Streptococcus pneumoniae R6
agaaaaccaaaacuca

SEQ ID NO: 2181297 - RNA, 14 nt, Streptococcus pneumoniae R6
agaaaacagacaaa

SEQ ID NO: 2181298 - RNA, 12 nt, Streptococcus pneumoniae R6
agaaaagcaaaa

SEQ ID NO: 2181299 - RNA, 13 nt, Streptococcus pneumoniae R6
agaaaagcaaaau

SEQ ID NO: 2181300 - RNA, 18 nt, Streptococcus pneumoniae R6
agaaggaggauuggguaa

SEQ ID NO: 2181301 - RNA, 22 nt, Streptococcus pneumoniae R6
agaaggaauucaagcaaaacaa

SEQ ID NO: 2181302 - RNA, 13 nt, Streptococcus pneumoniae R6
agaaggauuuccu

SEQ ID NO: 2181303 - RNA, 14 nt, Streptococcus pneumoniae R6
agaaggauuuccua

SEQ ID NO: 2181304 - RNA, 16 nt, Streptococcus pneumoniae R6
agaaggauugagaagc

SEQ ID NO: 2181305 - RNA, 14 nt, Streptococcus pneumoniae R6
agaagcuccuuuag

SEQ ID NO: 2181306 - RNA, 18 nt, Streptococcus pneumoniae R6
agaagcaagugacaaaga

SEQ ID NO: 2181307 - RNA, 19 nt, Streptococcus pneumoniae R6
agaagcaccaguugcaguc

SEQ ID NO: 2181308 - RNA, 22 nt, Streptococcus pneumoniae R6
agaagcaggguuaguugguuau

SEQ ID NO: 2181309 - RNA, 15 nt, Streptococcus pneumoniae R6
agaagcauagaggga

SEQ ID NO: 2181310 - RNA, 18 nt, Streptococcus pneumoniae R6
agaagcauagagggauuu

SEQ ID NO: 2181311 - RNA, 13 nt, Streptococcus pneumoniae R6
agaagcguagagg

SEQ ID NO: 2181312 - RNA, 17 nt, Streptococcus pneumoniae R6
agaacuccagauuaucu

SEQ ID NO: 2181313 - RNA, 14 nt, Streptococcus pneumoniae R6
agaacuaaaucuuc

SEQ ID NO: 2181314 - RNA, 19 nt, Streptococcus pneumoniae R6
agaaccccgauaacagccg

SEQ ID NO: 2181315 - RNA, 18 nt, Streptococcus pneumoniae R6
agaacaauccaaauaagu

SEQ ID NO: 2181316 - RNA, 22 nt, Streptococcus pneumoniae R6
agaacaccuagcgccuguucua

SEQ ID NO: 2181317 - RNA, 23 nt, Streptococcus pneumoniae R6
agaacaaugacucccauaaaaau

SEQ ID NO: 2181318 - RNA, 14 nt, Streptococcus pneumoniae R6
agaacccuuauuuc

SEQ ID NO: 2181319 - RNA, 17 nt, Streptococcus pneumoniae R6
agaacagucaggauagu

SEQ ID NO: 2181320 - RNA, 21 nt, Streptococcus pneumoniae R6
agaaauaauauccgauagcau

SEQ ID NO: 2181321 - RNA, 14 nt, Streptococcus pneumoniae R6
agaaaucaaaaagc

SEQ ID NO: 2181322 - RNA, 11 nt, Streptococcus pneumoniae R6
agaaauauuua

SEQ ID NO: 2181323 - RNA, 18 nt, Streptococcus pneumoniae R6
aaaacaauguuuugaucu

SEQ ID NO: 2181324 - RNA, 14 nt, Streptococcus pneumoniae R6
agaaauucccucug

SEQ ID NO: 2181325 - RNA, 16 nt, Streptococcus pneumoniae R6
agaaauugauauaaug

SEQ ID NO: 2181326 - RNA, 23 nt, Streptococcus pneumoniae R6
agaaauugcggcugauuuuggug

SEQ ID NO: 2181327 - RNA, 13 nt, Streptococcus pneumoniae R6
agaaauugguuug

SEQ ID NO: 2181328 - RNA, 14 nt, Streptococcus pneumoniae R6
agaaauugacugga

SEQ ID NO: 2181329 - RNA, 16 nt, Streptococcus pneumoniae R6
agaaauugaaguaaua

SEQ ID NO: 2181330 - RNA, 15 nt, Streptococcus pneumoniae R6
aaaacacauuuugaa

SEQ ID NO: 2181331 - RNA, 23 nt, Streptococcus pneumoniae R6
agaaauuaauuugaauuuucuaa

SEQ ID NO: 2181332 - RNA, 15 nt, Streptococcus pneumoniae R6
agaaauuaauuuuac

SEQ ID NO: 2181333 - RNA, 17 nt, Streptococcus pneumoniae R6
agaaauuaauuuuacuu

SEQ ID NO: 2181334 - RNA, 14 nt, Streptococcus pneumoniae R6
agacacuaagaaga

SEQ ID NO: 2181335 - RNA, 15 nt, Streptococcus pneumoniae R6
agacacuaagaagac

SEQ ID NO: 2181336 - RNA, 19 nt, Streptococcus pneumoniae R6
agacacucaacaagcugua

SEQ ID NO: 2181337 - RNA, 22 nt, Streptococcus pneumoniae R6
agacacuuaggguuagauuauu

SEQ ID NO: 2181338 - RNA, 17 nt, Streptococcus pneumoniae R6
agacagaaaaaaucuaa

SEQ ID NO: 2181339 - RNA, 22 nt, Streptococcus pneumoniae R6
agacagaaacgaaccuuggcuu

SEQ ID NO: 2181340 - RNA, 22 nt, Streptococcus pneumoniae R6
agacagcugaguggauuuuucg

SEQ ID NO: 2181341 - RNA, 21 nt, Streptococcus pneumoniae R6
agacagcuuguugcuuuucuu

SEQ ID NO: 2181342 - RNA, 12 nt, Streptococcus pneumoniae R6
agacagcaccaa

SEQ ID NO: 2181343 - RNA, 21 nt, Streptococcus pneumoniae R6
agacagauuugacguuuccuu

SEQ ID NO: 2181344 - RNA, 17 nt, Streptococcus pneumoniae R6
agacagaugacaaaucu

SEQ ID NO: 2181345 - RNA, 16 nt, Streptococcus pneumoniae R6
agacacaugaguagca

SEQ ID NO: 2181346 - RNA, 13 nt, Streptococcus pneumoniae R6
agacaauuuucau

SEQ ID NO: 2181347 - RNA, 18 nt, Streptococcus pneumoniae R6
agacaauguucuuuucuc

SEQ ID NO: 2181348 - RNA, 19 nt, Streptococcus pneumoniae R6
agacaacuccuugaaucau

SEQ ID NO: 2181349 - RNA, 12 nt, Streptococcus pneumoniae R6
agacaaaucauu

SEQ ID NO: 2181350 - RNA, 21 nt, Streptococcus pneumoniae R6
agaauuuuccggcucuuuguc

SEQ ID NO: 2181351 - RNA, 16 nt, Streptococcus pneumoniae R6
agaauuuaacucuuuu

SEQ ID NO: 2181352 - RNA, 17 nt, Streptococcus pneumoniae R6
agaauuggcuaaagagu

SEQ ID NO: 2181353 - RNA, 22 nt, Streptococcus pneumoniae R6
agaauuggcuaaagaguugggu

SEQ ID NO: 2181354 - RNA, 18 nt, Streptococcus pneumoniae R6
agaauugcuuuaaucugc

SEQ ID NO: 2181355 - RNA, 16 nt, Streptococcus pneumoniae R6
agaauuaagauaaaac

SEQ ID NO: 2181356 - RNA, 16 nt, Streptococcus pneumoniae R6
agaauguuaugcaacu

SEQ ID NO: 2181357 - RNA, 12 nt, Streptococcus pneumoniae R6
agaaugaacauc

SEQ ID NO: 2181358 - RNA, 13 nt, Streptococcus pneumoniae R6
agaaugaacaugu

SEQ ID NO: 2181359 - RNA, 21 nt, Streptococcus pneumoniae R6
agaaugauaugggauuuucau

SEQ ID NO: 2181360 - RNA, 12 nt, Streptococcus pneumoniae R6
agaagguuuuug

SEQ ID NO: 2181361 - RNA, 19 nt, Streptococcus pneumoniae R6
agaagguuuuugaaaguca

SEQ ID NO: 2181362 - RNA, 20 nt, Streptococcus pneumoniae R6
agaaggcugguugaaaaccu

SEQ ID NO: 2181363 - RNA, 14 nt, Streptococcus pneumoniae R6
agaaggcuucuugu

SEQ ID NO: 2181364 - RNA, 16 nt, Streptococcus pneumoniae R6
agaaggcuucuugugg

SEQ ID NO: 2181365 - RNA, 16 nt, Streptococcus pneumoniae R6
agaaggcuuuaccaaa

SEQ ID NO: 2181366 - RNA, 17 nt, Streptococcus pneumoniae R6
agaauccugccaauggu

SEQ ID NO: 2181367 - RNA, 15 nt, Streptococcus pneumoniae R6
agaaucccaaagaag

SEQ ID NO: 2181368 - RNA, 16 nt, Streptococcus pneumoniae R6
agaaucccaaagaagg

SEQ ID NO: 2181369 - RNA, 13 nt, Streptococcus pneumoniae R6
agaaucccagaua

SEQ ID NO: 2181370 - RNA, 15 nt, Streptococcus pneumoniae R6
agaaucccagauaaa

SEQ ID NO: 2181371 - RNA, 17 nt, Streptococcus pneumoniae R6
agaaucccagauaaagc

SEQ ID NO: 2181372 - RNA, 23 nt, Streptococcus pneumoniae R6
agaaguccauagcgucaaagaag

SEQ ID NO: 2181373 - RNA, 15 nt, Streptococcus pneumoniae R6
agaauccaauucaaa

SEQ ID NO: 2181374 - RNA, 14 nt, Streptococcus pneumoniae R6
agaccggauugcuc

SEQ ID NO: 2181375 - RNA, 18 nt, Streptococcus pneumoniae R6
aaaacagccgaggguacu

SEQ ID NO: 2181376 - RNA, 20 nt, Streptococcus pneumoniae R6
agaccuguauucauugaaaa

SEQ ID NO: 2181377 - RNA, 15 nt, Streptococcus pneumoniae R6
agaccugccaugcug

SEQ ID NO: 2181378 - RNA, 20 nt, Streptococcus pneumoniae R6
aaaacaggaguucuuuuaca

SEQ ID NO: 2181379 - RNA, 12 nt, Streptococcus pneumoniae R6
aaaacaguguuu

SEQ ID NO: 2181380 - RNA, 22 nt, Streptococcus pneumoniae R6
aaaacaguguuuuaagcugacu

SEQ ID NO: 2181381 - RNA, 22 nt, Streptococcus pneumoniae R6
aaaacaguguuuugagcugacu

SEQ ID NO: 2181382 - RNA, 15 nt, Streptococcus pneumoniae R6
aaaacaguuacauca

SEQ ID NO: 2181383 - RNA, 14 nt, Streptococcus pneumoniae R6
aaaacauaauuuua

SEQ ID NO: 2181384 - RNA, 15 nt, Streptococcus pneumoniae R6
aaaacauaauuuuag

SEQ ID NO: 2181385 - RNA, 20 nt, Streptococcus pneumoniae R6
agacgauuccaaacaacaau

SEQ ID NO: 2181386 - RNA, 19 nt, Streptococcus pneumoniae R6
agacaucgauagauuuuuc

SEQ ID NO: 2181387 - RNA, 19 nt, Streptococcus pneumoniae R6
agacauuucacgcgcauuc

SEQ ID NO: 2181388 - RNA, 15 nt, Streptococcus pneumoniae R6
agacauaaucaagau

SEQ ID NO: 2181389 - RNA, 18 nt, Streptococcus pneumoniae R6
agacauagucaagcucuu

SEQ ID NO: 2181390 - RNA, 15 nt, Streptococcus pneumoniae R6
agacaucauauaaau

SEQ ID NO: 2181391 - RNA, 16 nt, Streptococcus pneumoniae R6
agacaucauauaaaua

SEQ ID NO: 2181392 - RNA, 19 nt, Streptococcus pneumoniae R6
agacauaugaaaucuuuuu

SEQ ID NO: 2181393 - RNA, 17 nt, Streptococcus pneumoniae R6
agacagucugaaaaaga

SEQ ID NO: 2181394 - RNA, 18 nt, Streptococcus pneumoniae R6
agacagucugaaaaagag

SEQ ID NO: 2181395 - RNA, 16 nt, Streptococcus pneumoniae R6
agacagugaaaucaua

SEQ ID NO: 2181396 - RNA, 20 nt, Streptococcus pneumoniae R6
agacaggcuuggauuuaaaa

SEQ ID NO: 2181397 - RNA, 16 nt, Streptococcus pneumoniae R6
agacagggccuuagca

SEQ ID NO: 2181398 - RNA, 22 nt, Streptococcus pneumoniae R6
agaccauggcgugggucaucaa

SEQ ID NO: 2181399 - RNA, 14 nt, Streptococcus pneumoniae R6
agaccaguuucuuc

SEQ ID NO: 2181400 - RNA, 15 nt, Streptococcus pneumoniae R6
agaccaguuucuucu

SEQ ID NO: 2181401 - RNA, 17 nt, Streptococcus pneumoniae R6
agaccaguuucuucuuu

SEQ ID NO: 2181402 - RNA, 18 nt, Streptococcus pneumoniae R6
agaccaguuucuucuuuc

SEQ ID NO: 2181403 - RNA, 23 nt, Streptococcus pneumoniae R6
agaccaaguucuuuucauaaaga

SEQ ID NO: 2181404 - RNA, 13 nt, Streptococcus pneumoniae R6
agaccaagaacuc

SEQ ID NO: 2181405 - RNA, 20 nt, Streptococcus pneumoniae R6
aaaacaugaaguaaauauuu

SEQ ID NO: 2181406 - RNA, 14 nt, Streptococcus pneumoniae R6
agagcugauaguga

SEQ ID NO: 2181407 - RNA, 12 nt, Streptococcus pneumoniae R6
agagcugccauu

SEQ ID NO: 2181408 - RNA, 23 nt, Streptococcus pneumoniae R6
agagcugcugcuuccauuuccac

SEQ ID NO: 2181409 - RNA, 12 nt, Streptococcus pneumoniae R6
agagcgauaaaa

SEQ ID NO: 2181410 - RNA, 22 nt, Streptococcus pneumoniae R6
agagcgauaaaaauccuuuuuu

SEQ ID NO: 2181411 - RNA, 18 nt, Streptococcus pneumoniae R6
agagcgacuuuuucugau

SEQ ID NO: 2181412 - RNA, 20 nt, Streptococcus pneumoniae R6
agagccuuuuuaaagauaua

SEQ ID NO: 2181413 - RNA, 22 nt, Streptococcus pneumoniae R6
agagcaccaaccaagcgcucga

SEQ ID NO: 2181414 - RNA, 13 nt, Streptococcus pneumoniae R6
agagcacugcuag

SEQ ID NO: 2181415 - RNA, 11 nt, Streptococcus pneumoniae R6
agagcaaggaa

SEQ ID NO: 2181416 - RNA, 18 nt, Streptococcus pneumoniae R6
agagaugagagauaaaua

SEQ ID NO: 2181417 - RNA, 19 nt, Streptococcus pneumoniae R6
agagaugagagauaaauau

SEQ ID NO: 2181418 - RNA, 18 nt, Streptococcus pneumoniae R6
agagaucuagauuuggaa

SEQ ID NO: 2181419 - RNA, 13 nt, Streptococcus pneumoniae R6
agacuaacuucuu

SEQ ID NO: 2181420 - RNA, 18 nt, Streptococcus pneumoniae R6
agacuaacuucuuauuag

SEQ ID NO: 2181421 - RNA, 20 nt, Streptococcus pneumoniae R6
agacuaacuucuuauuagca

SEQ ID NO: 2181422 - RNA, 21 nt, Streptococcus pneumoniae R6
agacuaacuucuuauuagcaa

SEQ ID NO: 2181423 - RNA, 16 nt, Streptococcus pneumoniae R6
agacuaaggagaguca

SEQ ID NO: 2181424 - RNA, 17 nt, Streptococcus pneumoniae R6
agaggccuauuuaccau

SEQ ID NO: 2181425 - RNA, 13 nt, Streptococcus pneumoniae R6
agagggcaaggau

SEQ ID NO: 2181426 - RNA, 22 nt, Streptococcus pneumoniae R6
agaggguggaaagacuggugag

SEQ ID NO: 2181427 - RNA, 23 nt, Streptococcus pneumoniae R6
agagggcugcguugaggacaggu

SEQ ID NO: 2181428 - RNA, 14 nt, Streptococcus pneumoniae R6
agagggcuguguca

SEQ ID NO: 2181429 - RNA, 15 nt, Streptococcus pneumoniae R6
agaggggugcugaga

SEQ ID NO: 2181430 - RNA, 15 nt, Streptococcus pneumoniae R6
agaguaagaaagcag

SEQ ID NO: 2181431 - RNA, 20 nt, Streptococcus pneumoniae R6
agaguaaacuagaaagcuag

SEQ ID NO: 2181432 - RNA, 15 nt, Streptococcus pneumoniae R6
agagguugcuacagg

SEQ ID NO: 2181433 - RNA, 17 nt, Streptococcus pneumoniae R6
agaggugccaguacaau

SEQ ID NO: 2181434 - RNA, 22 nt, Streptococcus pneumoniae R6
agaggugccaguacaauagcua

SEQ ID NO: 2181435 - RNA, 17 nt, Streptococcus pneumoniae R6
agagguggaaaagcaag

SEQ ID NO: 2181436 - RNA, 12 nt, Streptococcus pneumoniae R6
aaaaccaaaaag

SEQ ID NO: 2181437 - RNA, 21 nt, Streptococcus pneumoniae R6
aaaaccaaaaaguggaaagag

SEQ ID NO: 2181438 - RNA, 11 nt, Streptococcus pneumoniae R6
aaaacauugug

SEQ ID NO: 2181439 - RNA, 22 nt, Streptococcus pneumoniae R6
aaaacauugugagaaauugguu

SEQ ID NO: 2181440 - RNA, 11 nt, Streptococcus pneumoniae R6
aaaacauucuu

SEQ ID NO: 2181441 - RNA, 16 nt, Streptococcus pneumoniae R6
aaaaccaaaacucaag

SEQ ID NO: 2181442 - RNA, 22 nt, Streptococcus pneumoniae R6
agagcuucuuuuggauuuucaa

SEQ ID NO: 2181443 - RNA, 23 nt, Streptococcus pneumoniae R6
agagcuuuaauagaaagugacac

SEQ ID NO: 2181444 - RNA, 23 nt, Streptococcus pneumoniae R6
agagcuuugcuuuccucagcagg

SEQ ID NO: 2181445 - RNA, 20 nt, Streptococcus pneumoniae R6
agaggagaauuuuugagaug

SEQ ID NO: 2181446 - RNA, 20 nt, Streptococcus pneumoniae R6
agaggaggauagaaguagag

SEQ ID NO: 2181447 - RNA, 21 nt, Streptococcus pneumoniae R6
agaggagucuuauaguaacga

SEQ ID NO: 2181448 - RNA, 13 nt, Streptococcus pneumoniae R6
agaggagugauaa

SEQ ID NO: 2181449 - RNA, 22 nt, Streptococcus pneumoniae R6
agaggagguaaaucccaaguaa

SEQ ID NO: 2181450 - RNA, 23 nt, Streptococcus pneumoniae R6
agaggaugaaccugcuuuagauu

SEQ ID NO: 2181451 - RNA, 14 nt, Streptococcus pneumoniae R6
agaggcaaugacaa

SEQ ID NO: 2181452 - RNA, 15 nt, Streptococcus pneumoniae R6
agauaugaacaaauc

SEQ ID NO: 2181453 - RNA, 14 nt, Streptococcus pneumoniae R6
agauauuauuucaa

SEQ ID NO: 2181454 - RNA, 22 nt, Streptococcus pneumoniae R6
agauauuauuucaaagaacauc

SEQ ID NO: 2181455 - RNA, 20 nt, Streptococcus pneumoniae R6
agauauuguucuaguuuuuu

SEQ ID NO: 2181456 - RNA, 13 nt, Streptococcus pneumoniae R6
agauaucucuuug

SEQ ID NO: 2181457 - RNA, 23 nt, Streptococcus pneumoniae R6
agauaucgccugcggcugcagcu

SEQ ID NO: 2181458 - RNA, 24 nt, Streptococcus pneumoniae R6
agauaucgccugcggcugcagcug

SEQ ID NO: 2181459 - RNA, 14 nt, Streptococcus pneumoniae R6
agauaucacucauc

SEQ ID NO: 2181460 - RNA, 15 nt, Streptococcus pneumoniae R6
agauagcgcugggcu

SEQ ID NO: 2181461 - RNA, 20 nt, Streptococcus pneumoniae R6
agauauagccuguaaaaagu

SEQ ID NO: 2181462 - RNA, 22 nt, Streptococcus pneumoniae R6
agauauagccuguaaaaaguga

SEQ ID NO: 2181463 - RNA, 21 nt, Streptococcus pneumoniae R6
agaucaugacugagagcuaca

SEQ ID NO: 2181464 - RNA, 18 nt, Streptococcus pneumoniae R6
agaucaguucauuuuucc

SEQ ID NO: 2181465 - RNA, 20 nt, Streptococcus pneumoniae R6
agaucaguucauuuuuccuu

SEQ ID NO: 2181466 - RNA, 15 nt, Streptococcus pneumoniae R6
agauacugaaucaaa

SEQ ID NO: 2181467 - RNA, 20 nt, Streptococcus pneumoniae R6
agauacugaaucaaaaagac

SEQ ID NO: 2181468 - RNA, 15 nt, Streptococcus pneumoniae R6
agauacuccaaaaca

SEQ ID NO: 2181469 - RNA, 16 nt, Streptococcus pneumoniae R6
agauagauaaaggcca

SEQ ID NO: 2181470 - RNA, 21 nt, Streptococcus pneumoniae R6
agauagagcuaacuuuuccuu

SEQ ID NO: 2181471 - RNA, 20 nt, Streptococcus pneumoniae R6
agauagagacauaaucaaga

SEQ ID NO: 2181472 - RNA, 20 nt, Streptococcus pneumoniae R6
agauagaaggucaagagaaa

SEQ ID NO: 2181473 - RNA, 16 nt, Streptococcus pneumoniae R6
agauagaauagcagau

SEQ ID NO: 2181474 - RNA, 18 nt, Streptococcus pneumoniae R6
agauaagguucaaaaaau

SEQ ID NO: 2181475 - RNA, 17 nt, Streptococcus pneumoniae R6
agauaaggcaucuuaac

SEQ ID NO: 2181476 - RNA, 19 nt, Streptococcus pneumoniae R6
agauaaggccugauaagau

SEQ ID NO: 2181477 - RNA, 20 nt, Streptococcus pneumoniae R6
agauaaggccugauaagaug

SEQ ID NO: 2181478 - RNA, 14 nt, Streptococcus pneumoniae R6
agauacgaugacga

SEQ ID NO: 2181479 - RNA, 20 nt, Streptococcus pneumoniae R6
agauaccugguucagcagag

SEQ ID NO: 2181480 - RNA, 17 nt, Streptococcus pneumoniae R6
agauaccuuuuccuuca

SEQ ID NO: 2181481 - RNA, 14 nt, Streptococcus pneumoniae R6
agauaauaaauagu

SEQ ID NO: 2181482 - RNA, 20 nt, Streptococcus pneumoniae R6
agauaauaauugacgaagaa

SEQ ID NO: 2181483 - RNA, 12 nt, Streptococcus pneumoniae R6
agauaauacaau

SEQ ID NO: 2181484 - RNA, 19 nt, Streptococcus pneumoniae R6
agauaaguggcaaaaauau

SEQ ID NO: 2181485 - RNA, 21 nt, Streptococcus pneumoniae R6
agauaaguggcaaaaauauca

SEQ ID NO: 2181486 - RNA, 15 nt, Streptococcus pneumoniae R6
agauaaguuugguuu

SEQ ID NO: 2181487 - RNA, 19 nt, Streptococcus pneumoniae R6
agauaagauagucgauaaa

SEQ ID NO: 2181488 - RNA, 15 nt, Streptococcus pneumoniae R6
agauaaaauugauaa

SEQ ID NO: 2181489 - RNA, 16 nt, Streptococcus pneumoniae R6
agaguuggaugucauu

SEQ ID NO: 2181490 - RNA, 19 nt, Streptococcus pneumoniae R6
agaguugcuugucaucuuc

SEQ ID NO: 2181491 - RNA, 16 nt, Streptococcus pneumoniae R6
agaguuacaaacucuc

SEQ ID NO: 2181492 - RNA, 19 nt, Streptococcus pneumoniae R6
agaguuacaaacucucauu

SEQ ID NO: 2181493 - RNA, 15 nt, Streptococcus pneumoniae R6
agaguugaggcaaga

SEQ ID NO: 2181494 - RNA, 22 nt, Streptococcus pneumoniae R6
agaguugaaugccuccaagaaa

SEQ ID NO: 2181495 - RNA, 15 nt, Streptococcus pneumoniae R6
agaguucguaguaaa

SEQ ID NO: 2181496 - RNA, 15 nt, Streptococcus pneumoniae R6
agaguagagagaaag

SEQ ID NO: 2181497 - RNA, 16 nt, Streptococcus pneumoniae R6
agaguagagagaaagg

SEQ ID NO: 2181498 - RNA, 16 nt, Streptococcus pneumoniae R6
agaguagucuguucua

SEQ ID NO: 2181499 - RNA, 22 nt, Streptococcus pneumoniae R6
agaguagucuguucuauaaaau

SEQ ID NO: 2181500 - RNA, 17 nt, Streptococcus pneumoniae R6
agaguacuaaauauaag

SEQ ID NO: 2181501 - RNA, 23 nt, Streptococcus pneumoniae R6
agaugacaaaucuaagucaaaua

SEQ ID NO: 2181502 - RNA, 18 nt, Streptococcus pneumoniae R6
agaugacuucuuaaucaa

SEQ ID NO: 2181503 - RNA, 21 nt, Streptococcus pneumoniae R6
agaugacuucuuaaucaauua

SEQ ID NO: 2181504 - RNA, 17 nt, Streptococcus pneumoniae R6
agaugagcgauugaaau

SEQ ID NO: 2181505 - RNA, 20 nt, Streptococcus pneumoniae R6
agaugagacgagcaguucca

SEQ ID NO: 2181506 - RNA, 22 nt, Streptococcus pneumoniae R6
agaugagacuugcaagaaagua

SEQ ID NO: 2181507 - RNA, 13 nt, Streptococcus pneumoniae R6
agaugagaggaga

SEQ ID NO: 2181508 - RNA, 23 nt, Streptococcus pneumoniae R6
aaaaccccagcauaaacagggca

SEQ ID NO: 2181509 - RNA, 18 nt, Streptococcus pneumoniae R6
aaaaccauucaaaauacu

SEQ ID NO: 2181510 - RNA, 20 nt, Streptococcus pneumoniae R6
agaugaguguaaaaagaaag

SEQ ID NO: 2181511 - RNA, 23 nt, Streptococcus pneumoniae R6
agauggaguguucuaaaauaagu

SEQ ID NO: 2181512 - RNA, 12 nt, Streptococcus pneumoniae R6
agauuagaauug

SEQ ID NO: 2181513 - RNA, 14 nt, Streptococcus pneumoniae R6
agauucaacaucac

SEQ ID NO: 2181514 - RNA, 15 nt, Streptococcus pneumoniae R6
agauucaacaucacu

SEQ ID NO: 2181515 - RNA, 14 nt, Streptococcus pneumoniae R6
agauucauucugcu

SEQ ID NO: 2181516 - RNA, 21 nt, Streptococcus pneumoniae R6
agauucaucagggcaaaggua

SEQ ID NO: 2181517 - RNA, 19 nt, Streptococcus pneumoniae R6
agauguuauuuacuguuuu

SEQ ID NO: 2181518 - RNA, 17 nt, Streptococcus pneumoniae R6
agauguucuuugaaaua

SEQ ID NO: 2181519 - RNA, 13 nt, Streptococcus pneumoniae R6
agauuacaaaaaa

SEQ ID NO: 2181520 - RNA, 22 nt, Streptococcus pneumoniae R6
agauuaggaauuagaguuucau

SEQ ID NO: 2181521 - RNA, 14 nt, Streptococcus pneumoniae R6
agauuacugauaaa

SEQ ID NO: 2181522 - RNA, 15 nt, Streptococcus pneumoniae R6
agauuacugauaaaa

SEQ ID NO: 2181523 - RNA, 17 nt, Streptococcus pneumoniae R6
agauuacugauaaaacu

SEQ ID NO: 2181524 - RNA, 23 nt, Streptococcus pneumoniae R6
agauuacuguuguugagaccgac

SEQ ID NO: 2181525 - RNA, 17 nt, Streptococcus pneumoniae R6
agauugagaucucuuag

SEQ ID NO: 2181526 - RNA, 19 nt, Streptococcus pneumoniae R6
agauugauaaaggcagauu

SEQ ID NO: 2181527 - RNA, 16 nt, Streptococcus pneumoniae R6
agauugaguucucguu

SEQ ID NO: 2181528 - RNA, 23 nt, Streptococcus pneumoniae R6
agauugcgauacuguuauagaag

SEQ ID NO: 2181529 - RNA, 21 nt, Streptococcus pneumoniae R6
agauugccuugcucuguucug

SEQ ID NO: 2181530 - RNA, 16 nt, Streptococcus pneumoniae R6
agauugcacgcuagca

SEQ ID NO: 2181531 - RNA, 21 nt, Streptococcus pneumoniae R6
agauucugugguaaugcuuuc

SEQ ID NO: 2181532 - RNA, 16 nt, Streptococcus pneumoniae R6
agauugaaauagaaua

SEQ ID NO: 2181533 - RNA, 14 nt, Streptococcus pneumoniae R6
agauucuucugguu

SEQ ID NO: 2181534 - RNA, 20 nt, Streptococcus pneumoniae R6
agauucuauuuuuuauaaua

SEQ ID NO: 2181535 - RNA, 17 nt, Streptococcus pneumoniae R6
agauucggauaaguuuu

SEQ ID NO: 2181536 - RNA, 17 nt, Streptococcus pneumoniae R6
agauuccugaaauaaaa

SEQ ID NO: 2181537 - RNA, 20 nt, Streptococcus pneumoniae R6
agauuuauacucuucgaaaa

SEQ ID NO: 2181538 - RNA, 23 nt, Streptococcus pneumoniae R6
agauuuauacucuucgaaaaucu

SEQ ID NO: 2181539 - RNA, 21 nt, Streptococcus pneumoniae R6
agauuucacgguaauuguuuu

SEQ ID NO: 2181540 - RNA, 21 nt, Streptococcus pneumoniae R6
agauuuaaaaucguagucuuu

SEQ ID NO: 2181541 - RNA, 17 nt, Streptococcus pneumoniae R6
agauuuacuuccuuuuc

SEQ ID NO: 2181542 - RNA, 12 nt, Streptococcus pneumoniae R6
agauuuaaucug

SEQ ID NO: 2181543 - RNA, 12 nt, Streptococcus pneumoniae R6
agauuuaguucu

SEQ ID NO: 2181544 - RNA, 13 nt, Streptococcus pneumoniae R6
agauuggauaaaa

SEQ ID NO: 2181545 - RNA, 18 nt, Streptococcus pneumoniae R6
agauugcucaaaacacug

SEQ ID NO: 2181546 - RNA, 18 nt, Streptococcus pneumoniae R6
agauuguaaaggaugaca

SEQ ID NO: 2181547 - RNA, 14 nt, Streptococcus pneumoniae R6
agauuugaaacuaa

SEQ ID NO: 2181548 - RNA, 14 nt, Streptococcus pneumoniae R6
agauuugucaaauu

SEQ ID NO: 2181549 - RNA, 15 nt, Streptococcus pneumoniae R6
agauuuggaaacuca

SEQ ID NO: 2181550 - RNA, 24 nt, Streptococcus pneumoniae R6
agauuugugaaucaucacuaguaa

SEQ ID NO: 2181551 - RNA, 14 nt, Streptococcus pneumoniae R6
agauuuguuuuuca

SEQ ID NO: 2181552 - RNA, 18 nt, Streptococcus pneumoniae R6
agauuuguugauagagua

SEQ ID NO: 2181553 - RNA, 16 nt, Streptococcus pneumoniae R6
agauuuucaaaaaaag

SEQ ID NO: 2181554 - RNA, 14 nt, Streptococcus pneumoniae R6
agauuuucaaagag

SEQ ID NO: 2181555 - RNA, 13 nt, Streptococcus pneumoniae R6
agauuuuggaaga

SEQ ID NO: 2181556 - RNA, 21 nt, Streptococcus pneumoniae R6
agauuuuccucauuuucuagu

SEQ ID NO: 2181557 - RNA, 21 nt, Streptococcus pneumoniae R6
agauuuuucaaggugaaguuc

SEQ ID NO: 2181558 - RNA, 13 nt, Streptococcus pneumoniae R6
agauuuugaagau

SEQ ID NO: 2181559 - RNA, 20 nt, Streptococcus pneumoniae R6
agauuuuuggaaaaaauaaa

SEQ ID NO: 2181560 - RNA, 15 nt, Streptococcus pneumoniae R6
agauuuuuuaaaaag

SEQ ID NO: 2181561 - RNA, 15 nt, Streptococcus pneumoniae R6
agcaaaucagcuaag

SEQ ID NO: 2181562 - RNA, 21 nt, Streptococcus pneumoniae R6
agcaaaguuuuaggaacugga

SEQ ID NO: 2181563 - RNA, 17 nt, Streptococcus pneumoniae R6
agcaacacgaccuucaa

SEQ ID NO: 2181564 - RNA, 13 nt, Streptococcus pneumoniae R6
agcaacagaugag

SEQ ID NO: 2181565 - RNA, 19 nt, Streptococcus pneumoniae R6
agcaacagcuggaaucaca

SEQ ID NO: 2181566 - RNA, 19 nt, Streptococcus pneumoniae R6
agcaaaaaauuaugcuuaa

SEQ ID NO: 2181567 - RNA, 14 nt, Streptococcus pneumoniae R6
agcaaaagaacaag

SEQ ID NO: 2181568 - RNA, 20 nt, Streptococcus pneumoniae R6
agccccagcuaggagagcua

SEQ ID NO: 2181569 - RNA, 18 nt, Streptococcus pneumoniae R6
agccccuaugcuuuccuu

SEQ ID NO: 2181570 - RNA, 14 nt, Streptococcus pneumoniae R6
agcccgagcucaaa

SEQ ID NO: 2181571 - RNA, 14 nt, Streptococcus pneumoniae R6
agccauaaaaauaa

SEQ ID NO: 2181572 - RNA, 18 nt, Streptococcus pneumoniae R6
agcccaaccagcuguauc

SEQ ID NO: 2181573 - RNA, 14 nt, Streptococcus pneumoniae R6
agccaccgccagaa

SEQ ID NO: 2181574 - RNA, 13 nt, Streptococcus pneumoniae R6
agccagagcacca

SEQ ID NO: 2181575 - RNA, 16 nt, Streptococcus pneumoniae R6
agccagagcaccaacc

SEQ ID NO: 2181576 - RNA, 17 nt, Streptococcus pneumoniae R6
agccagagcaccaacca

SEQ ID NO: 2181577 - RNA, 18 nt, Streptococcus pneumoniae R6
agccagcgccuaaagacg

SEQ ID NO: 2181578 - RNA, 21 nt, Streptococcus pneumoniae R6
agcauggaaccaaaguuccuc

SEQ ID NO: 2181579 - RNA, 13 nt, Streptococcus pneumoniae R6
agccaagacuuuu

SEQ ID NO: 2181580 - RNA, 18 nt, Streptococcus pneumoniae R6
agccaagcuaguacauuc

SEQ ID NO: 2181581 - RNA, 18 nt, Streptococcus pneumoniae R6
agccaaggaagucuuguu

SEQ ID NO: 2181582 - RNA, 22 nt, Streptococcus pneumoniae R6
agccaacucauacuuucuaucu

SEQ ID NO: 2181583 - RNA, 17 nt, Streptococcus pneumoniae R6
agcacuauuguuauuuu

SEQ ID NO: 2181584 - RNA, 20 nt, Streptococcus pneumoniae R6
agcacuauuguuauuuuucu

SEQ ID NO: 2181585 - RNA, 18 nt, Streptococcus pneumoniae R6
agcacguuuuucuucuuu

SEQ ID NO: 2181586 - RNA, 23 nt, Streptococcus pneumoniae R6
agcaccuguggcuguuuuggcaa

SEQ ID NO: 2181587 - RNA, 17 nt, Streptococcus pneumoniae R6
agcagaaaaauuucauu

SEQ ID NO: 2181588 - RNA, 23 nt, Streptococcus pneumoniae R6
agcagaaaaauuucauuuucuac

SEQ ID NO: 2181589 - RNA, 19 nt, Streptococcus pneumoniae R6
agcagaacaaugacuccca

SEQ ID NO: 2181590 - RNA, 20 nt, Streptococcus pneumoniae R6
agcagaugaguguaaaaaga

SEQ ID NO: 2181591 - RNA, 23 nt, Streptococcus pneumoniae R6
agcagaugaguguaaaaagaaag

SEQ ID NO: 2181592 - RNA, 17 nt, Streptococcus pneumoniae R6
agcagauugaaauaaga

SEQ ID NO: 2181593 - RNA, 18 nt, Streptococcus pneumoniae R6
agcagauugaaauaagau

SEQ ID NO: 2181594 - RNA, 15 nt, Streptococcus pneumoniae R6
agcagauagccagcc

SEQ ID NO: 2181595 - RNA, 17 nt, Streptococcus pneumoniae R6
agcagauagccagccua

SEQ ID NO: 2181596 - RNA, 18 nt, Streptococcus pneumoniae R6
agcagauaaguuugguuu

SEQ ID NO: 2181597 - RNA, 21 nt, Streptococcus pneumoniae R6
agcagauaaguuugguuuuuu

SEQ ID NO: 2181598 - RNA, 17 nt, Streptococcus pneumoniae R6
agcagaggcaaugacaa

SEQ ID NO: 2181599 - RNA, 15 nt, Streptococcus pneumoniae R6
agcaguccaaggaga

SEQ ID NO: 2181600 - RNA, 11 nt, Streptococcus pneumoniae R6
agcagucugcg

SEQ ID NO: 2181601 - RNA, 19 nt, Streptococcus pneumoniae R6
agcauaaugauuucaagac

SEQ ID NO: 2181602 - RNA, 17 nt, Streptococcus pneumoniae R6
agcauaggggaauaucg

SEQ ID NO: 2181603 - RNA, 13 nt, Streptococcus pneumoniae R6
agcauagagaaaa

SEQ ID NO: 2181604 - RNA, 18 nt, Streptococcus pneumoniae R6
agcauagagaaaaacagc

SEQ ID NO: 2181605 - RNA, 13 nt, Streptococcus pneumoniae R6
agcaucuuguguu

SEQ ID NO: 2181606 - RNA, 21 nt, Streptococcus pneumoniae R6
agcaugaagcgguccaauccu

SEQ ID NO: 2181607 - RNA, 17 nt, Streptococcus pneumoniae R6
agcaucuaaaugaucca

SEQ ID NO: 2181608 - RNA, 18 nt, Streptococcus pneumoniae R6
agcaucaggaaagacuag

SEQ ID NO: 2181609 - RNA, 14 nt, Streptococcus pneumoniae R6
agcaguaaucacug

SEQ ID NO: 2181610 - RNA, 15 nt, Streptococcus pneumoniae R6
agcaguaaucacugc

SEQ ID NO: 2181611 - RNA, 19 nt, Streptococcus pneumoniae R6
agcaguaaucacugcagca

SEQ ID NO: 2181612 - RNA, 15 nt, Streptococcus pneumoniae R6
agcaguaacuucugu

SEQ ID NO: 2181613 - RNA, 20 nt, Streptococcus pneumoniae R6
agcaguaacuucugucuauu

SEQ ID NO: 2181614 - RNA, 21 nt, Streptococcus pneumoniae R6
agcaguaacuucugucuauuu

SEQ ID NO: 2181615 - RNA, 18 nt, Streptococcus pneumoniae R6
agcagcggacucuuaauc

SEQ ID NO: 2181616 - RNA, 14 nt, Streptococcus pneumoniae R6
agcagcgguuccau

SEQ ID NO: 2181617 - RNA, 14 nt, Streptococcus pneumoniae R6
agcgaugaagagag

SEQ ID NO: 2181618 - RNA, 12 nt, Streptococcus pneumoniae R6
agcgauagaugu

SEQ ID NO: 2181619 - RNA, 15 nt, Streptococcus pneumoniae R6
agcgacuauaaaaaa

SEQ ID NO: 2181620 - RNA, 22 nt, Streptococcus pneumoniae R6
agcgacuauaaaaaagugaaca

SEQ ID NO: 2181621 - RNA, 22 nt, Streptococcus pneumoniae R6
agcgacuuucuucgaaauucca

SEQ ID NO: 2181622 - RNA, 15 nt, Streptococcus pneumoniae R6
agcgacuuuuucuga

SEQ ID NO: 2181623 - RNA, 15 nt, Streptococcus pneumoniae R6
agccuuuuucuucuu

SEQ ID NO: 2181624 - RNA, 17 nt, Streptococcus pneumoniae R6
agcgaaaggagaaaaaa

SEQ ID NO: 2181625 - RNA, 18 nt, Streptococcus pneumoniae R6
agcgaaaggagaaaaaua

SEQ ID NO: 2181626 - RNA, 17 nt, Streptococcus pneumoniae R6
agccuuuccuuaaguga

SEQ ID NO: 2181627 - RNA, 15 nt, Streptococcus pneumoniae R6
agcgauugaaacagc

SEQ ID NO: 2181628 - RNA, 18 nt, Streptococcus pneumoniae R6
agcgauugaaacagcugc

SEQ ID NO: 2181629 - RNA, 19 nt, Streptococcus pneumoniae R6
agcgauuuccuugagcgaa

SEQ ID NO: 2181630 - RNA, 15 nt, Streptococcus pneumoniae R6
agcgccuuaagaaca

SEQ ID NO: 2181631 - RNA, 16 nt, Streptococcus pneumoniae R6
agcgcguuugagcuca

SEQ ID NO: 2181632 - RNA, 15 nt, Streptococcus pneumoniae R6
agcgguucagcucaa

SEQ ID NO: 2181633 - RNA, 20 nt, Streptococcus pneumoniae R6
agcgguucagcucaacugcg

SEQ ID NO: 2181634 - RNA, 21 nt, Streptococcus pneumoniae R6
agcucaaugaaaaucaaagag

SEQ ID NO: 2181635 - RNA, 13 nt, Streptococcus pneumoniae R6
agcucagcauuuu

SEQ ID NO: 2181636 - RNA, 20 nt, Streptococcus pneumoniae R6
agcucaucuaauguuuuuau

SEQ ID NO: 2181637 - RNA, 18 nt, Streptococcus pneumoniae R6
agcuccaaagaagauaau

SEQ ID NO: 2181638 - RNA, 23 nt, Streptococcus pneumoniae R6
agcucauccuuugcauccacauc

SEQ ID NO: 2181639 - RNA, 18 nt, Streptococcus pneumoniae R6
agcuaugaauaugaguuc

SEQ ID NO: 2181640 - RNA, 14 nt, Streptococcus pneumoniae R6
agcuagucuacuug

SEQ ID NO: 2181641 - RNA, 20 nt, Streptococcus pneumoniae R6
agcuagucucagcuugcuca

SEQ ID NO: 2181642 - RNA, 13 nt, Streptococcus pneumoniae R6
agcuauaagccca

SEQ ID NO: 2181643 - RNA, 14 nt, Streptococcus pneumoniae R6
agcuauaagcccaa

SEQ ID NO: 2181644 - RNA, 19 nt, Streptococcus pneumoniae R6
agcuauaagcccaaaucau

SEQ ID NO: 2181645 - RNA, 16 nt, Streptococcus pneumoniae R6
agcuauuagaccugcc

SEQ ID NO: 2181646 - RNA, 20 nt, Streptococcus pneumoniae R6
agcuauuaagaaaaaugauu

SEQ ID NO: 2181647 - RNA, 15 nt, Streptococcus pneumoniae R6
agcuauuucuugcuu

SEQ ID NO: 2181648 - RNA, 16 nt, Streptococcus pneumoniae R6
agcuauuucuugcuua

SEQ ID NO: 2181649 - RNA, 13 nt, Streptococcus pneumoniae R6
agcucaaaacacu

SEQ ID NO: 2181650 - RNA, 14 nt, Streptococcus pneumoniae R6
agcucaaaacacug

SEQ ID NO: 2181651 - RNA, 20 nt, Streptococcus pneumoniae R6
agcucaaaacacuguuuuaa

SEQ ID NO: 2181652 - RNA, 23 nt, Streptococcus pneumoniae R6
agcucaaaacacuguuuuaaggu

SEQ ID NO: 2181653 - RNA, 12 nt, Streptococcus pneumoniae R6
agcucaaaagcu

SEQ ID NO: 2181654 - RNA, 17 nt, Streptococcus pneumoniae R6
agcucaaaaguuuaucu

SEQ ID NO: 2181655 - RNA, 15 nt, Streptococcus pneumoniae R6
agcguuggcugucau

SEQ ID NO: 2181656 - RNA, 19 nt, Streptococcus pneumoniae R6
agcguuuugaaacuagaau

SEQ ID NO: 2181657 - RNA, 20 nt, Streptococcus pneumoniae R6
agcuaaagaugaugguuagg

SEQ ID NO: 2181658 - RNA, 12 nt, Streptococcus pneumoniae R6
agcuaaaagcaa

SEQ ID NO: 2181659 - RNA, 16 nt, Streptococcus pneumoniae R6
agcuaaaagcaaagca

SEQ ID NO: 2181660 - RNA, 12 nt, Streptococcus pneumoniae R6
agcuacaaucug

SEQ ID NO: 2181661 - RNA, 22 nt, Streptococcus pneumoniae R6
agcuaaggaggcaaagaaaaaa

SEQ ID NO: 2181662 - RNA, 18 nt, Streptococcus pneumoniae R6
agcuacguucugucaaac

SEQ ID NO: 2181663 - RNA, 21 nt, Streptococcus pneumoniae R6
agcuacgcgcccaaguuaaaa

SEQ ID NO: 2181664 - RNA, 16 nt, Streptococcus pneumoniae R6
agcuacuauaaaagag

SEQ ID NO: 2181665 - RNA, 19 nt, Streptococcus pneumoniae R6
agcuaggagacucuugagg

SEQ ID NO: 2181666 - RNA, 18 nt, Streptococcus pneumoniae R6
agcuaggauagcuugaac

SEQ ID NO: 2181667 - RNA, 16 nt, Streptococcus pneumoniae R6
agcuagggauuugaua

SEQ ID NO: 2181668 - RNA, 16 nt, Streptococcus pneumoniae R6
agcuagcaacagauga

SEQ ID NO: 2181669 - RNA, 15 nt, Streptococcus pneumoniae R6
agcuagaguuucaau

SEQ ID NO: 2181670 - RNA, 13 nt, Streptococcus pneumoniae R6
agguuucaaaacg

SEQ ID NO: 2181671 - RNA, 16 nt, Streptococcus pneumoniae R6
agguuuccaaaccaac

SEQ ID NO: 2181672 - RNA, 18 nt, Streptococcus pneumoniae R6
agguuugauuaguccauu

SEQ ID NO: 2181673 - RNA, 20 nt, Streptococcus pneumoniae R6
agguuugcuauuguccaacu

SEQ ID NO: 2181674 - RNA, 16 nt, Streptococcus pneumoniae R6
aguaaaaugaaauaag

SEQ ID NO: 2181675 - RNA, 16 nt, Streptococcus pneumoniae R6
aguaaaccuucccaca

SEQ ID NO: 2181676 - RNA, 17 nt, Streptococcus pneumoniae R6
aguaaaauacaaaccaa

SEQ ID NO: 2181677 - RNA, 22 nt, Streptococcus pneumoniae R6
agguuguuagauuauguaagau

SEQ ID NO: 2181678 - RNA, 18 nt, Streptococcus pneumoniae R6
agguuguggauagaacug

SEQ ID NO: 2181679 - RNA, 14 nt, Streptococcus pneumoniae R6
agguuguggaugaa

SEQ ID NO: 2181680 - RNA, 19 nt, Streptococcus pneumoniae R6
agguuguggauggaacuga

SEQ ID NO: 2181681 - RNA, 17 nt, Streptococcus pneumoniae R6
agguuguagaugaaacu

SEQ ID NO: 2181682 - RNA, 19 nt, Streptococcus pneumoniae R6
agguuguagauggaacuga

SEQ ID NO: 2181683 - RNA, 18 nt, Streptococcus pneumoniae R6
agguugcucaaagcacug

SEQ ID NO: 2181684 - RNA, 17 nt, Streptococcus pneumoniae R6
agguugcucaaaguacu

SEQ ID NO: 2181685 - RNA, 18 nt, Streptococcus pneumoniae R6
agguugcucaaaguacug

SEQ ID NO: 2181686 - RNA, 20 nt, Streptococcus pneumoniae R6
agguugcagauaaagcugac

SEQ ID NO: 2181687 - RNA, 17 nt, Streptococcus pneumoniae R6
agguugcauagaccaag

SEQ ID NO: 2181688 - RNA, 18 nt, Streptococcus pneumoniae R6
agguugcauagaccaaga

SEQ ID NO: 2181689 - RNA, 15 nt, Streptococcus pneumoniae R6
aguaaacuucuucuu

SEQ ID NO: 2181690 - RNA, 18 nt, Streptococcus pneumoniae R6
aguaaacuucuucuucca

SEQ ID NO: 2181691 - RNA, 16 nt, Streptococcus pneumoniae R6
aguaacaucaauaacc

SEQ ID NO: 2181692 - RNA, 17 nt, Streptococcus pneumoniae R6
aguaacaucaauaacca

SEQ ID NO: 2181693 - RNA, 14 nt, Streptococcus pneumoniae R6
aguaacaccucuuc

SEQ ID NO: 2181694 - RNA, 14 nt, Streptococcus pneumoniae R6
aguaaccaccuacu

SEQ ID NO: 2181695 - RNA, 13 nt, Streptococcus pneumoniae R6
aguaauuuuguga

SEQ ID NO: 2181696 - RNA, 19 nt, Streptococcus pneumoniae R6
aguaauuuugugauaaaau

SEQ ID NO: 2181697 - RNA, 16 nt, Streptococcus pneumoniae R6
aguacauucuuugaca

SEQ ID NO: 2181698 - RNA, 18 nt, Streptococcus pneumoniae R6
aguacauugaaauuaaaa

SEQ ID NO: 2181699 - RNA, 16 nt, Streptococcus pneumoniae R6
aguacaaaagcacuca

SEQ ID NO: 2181700 - RNA, 19 nt, Streptococcus pneumoniae R6
aguacaaaagcacucaaua

SEQ ID NO: 2181701 - RNA, 16 nt, Streptococcus pneumoniae R6
aguaccaaggaagaag

SEQ ID NO: 2181702 - RNA, 20 nt, Streptococcus pneumoniae R6
aguaaucugcaccugauuuc

SEQ ID NO: 2181703 - RNA, 21 nt, Streptococcus pneumoniae R6
aguaauuccacacagaaagca

SEQ ID NO: 2181704 - RNA, 16 nt, Streptococcus pneumoniae R6
aguaaucauuauccaa

SEQ ID NO: 2181705 - RNA, 12 nt, Streptococcus pneumoniae R6
aguauucaagag

SEQ ID NO: 2181706 - RNA, 21 nt, Streptococcus pneumoniae R6
aguauucguucugucugcuga

SEQ ID NO: 2181707 - RNA, 23 nt, Streptococcus pneumoniae R6
aguauuuagcaaccauuuucuca

SEQ ID NO: 2181708 - RNA, 13 nt, Streptococcus pneumoniae R6
aguauuuauaaac

SEQ ID NO: 2181709 - RNA, 23 nt, Streptococcus pneumoniae R6
aguauuaaauugcgauuuugcca

SEQ ID NO: 2181710 - RNA, 13 nt, Streptococcus pneumoniae R6
aguauuaaaauaa

SEQ ID NO: 2181711 - RNA, 21 nt, Streptococcus pneumoniae R6
aguauuaaaauaaguucaaca

SEQ ID NO: 2181712 - RNA, 23 nt, Streptococcus pneumoniae R6
aguauuaaucacuaauuaucuau

SEQ ID NO: 2181713 - RNA, 19 nt, Streptococcus pneumoniae R6
aguauuagagguuugcuua

SEQ ID NO: 2181714 - RNA, 16 nt, Streptococcus pneumoniae R6
aguauuagccauagca

SEQ ID NO: 2181715 - RNA, 19 nt, Streptococcus pneumoniae R6
aguauuagccauagcaaga

SEQ ID NO: 2181716 - RNA, 14 nt, Streptococcus pneumoniae R6
aguauuauucuuca

SEQ ID NO: 2181717 - RNA, 18 nt, Streptococcus pneumoniae R6
aguauuauucuucaucug

SEQ ID NO: 2181718 - RNA, 14 nt, Streptococcus pneumoniae R6
aguauuauuucauu

SEQ ID NO: 2181719 - RNA, 22 nt, Streptococcus pneumoniae R6
aguaucagguguugaaacaccu

SEQ ID NO: 2181720 - RNA, 19 nt, Streptococcus pneumoniae R6
aguauccaucacaguuuac

SEQ ID NO: 2181721 - RNA, 20 nt, Streptococcus pneumoniae R6
aguauccaucacaguuuaca

SEQ ID NO: 2181722 - RNA, 13 nt, Streptococcus pneumoniae R6
aguaugaaaagag

SEQ ID NO: 2181723 - RNA, 21 nt, Streptococcus pneumoniae R6
aguaugaguuaccuaaauuau

SEQ ID NO: 2181724 - RNA, 12 nt, Streptococcus pneumoniae R6
aguaucuacuuu

SEQ ID NO: 2181725 - RNA, 22 nt, Streptococcus pneumoniae R6
aguauaaaucuuccuaggauaa

SEQ ID NO: 2181726 - RNA, 16 nt, Streptococcus pneumoniae R6
aguauaagauacaaau

SEQ ID NO: 2181727 - RNA, 19 nt, Streptococcus pneumoniae R6
aguauaagauauacuaaaa

SEQ ID NO: 2181728 - RNA, 19 nt, Streptococcus pneumoniae R6
aguauaagguaauuuucug

SEQ ID NO: 2181729 - RNA, 22 nt, Streptococcus pneumoniae R6
aguauaagguaauuuucuggca

SEQ ID NO: 2181730 - RNA, 18 nt, Streptococcus pneumoniae R6
aguauaagguuacuuuau

SEQ ID NO: 2181731 - RNA, 18 nt, Streptococcus pneumoniae R6
aguauacucuaauugaaa

SEQ ID NO: 2181732 - RNA, 23 nt, Streptococcus pneumoniae R6
aguauaccacacuaaauuuagau

SEQ ID NO: 2181733 - RNA, 13 nt, Streptococcus pneumoniae R6
aguaucaaaugac

SEQ ID NO: 2181734 - RNA, 18 nt, Streptococcus pneumoniae R6
aguaucaagcuauaguua

SEQ ID NO: 2181735 - RNA, 14 nt, Streptococcus pneumoniae R6
aguauauugaaaug

SEQ ID NO: 2181736 - RNA, 15 nt, Streptococcus pneumoniae R6
aguauauugaaauga

SEQ ID NO: 2181737 - RNA, 19 nt, Streptococcus pneumoniae R6
aguauauugaaaugaaaua

SEQ ID NO: 2181738 - RNA, 19 nt, Streptococcus pneumoniae R6
aguagauugaaacuagaau

SEQ ID NO: 2181739 - RNA, 14 nt, Streptococcus pneumoniae R6
aguagauugaaaua

SEQ ID NO: 2181740 - RNA, 17 nt, Streptococcus pneumoniae R6
aguagauugaaauaaga

SEQ ID NO: 2181741 - RNA, 22 nt, Streptococcus pneumoniae R6
aguagauaauauacccuuguag

SEQ ID NO: 2181742 - RNA, 16 nt, Streptococcus pneumoniae R6
aguaccaguuaccauu

SEQ ID NO: 2181743 - RNA, 14 nt, Streptococcus pneumoniae R6
aguaggaaggaaga

SEQ ID NO: 2181744 - RNA, 17 nt, Streptococcus pneumoniae R6
aguaggacgauaaaaac

SEQ ID NO: 2181745 - RNA, 20 nt, Streptococcus pneumoniae R6
aguaggccaaacuugaaaug

SEQ ID NO: 2181746 - RNA, 19 nt, Streptococcus pneumoniae R6
aguagggaaaccacuagca

SEQ ID NO: 2181747 - RNA, 14 nt, Streptococcus pneumoniae R6
aguaguaaccaccu

SEQ ID NO: 2181748 - RNA, 13 nt, Streptococcus pneumoniae R6
aguaguagcugaa

SEQ ID NO: 2181749 - RNA, 15 nt, Streptococcus pneumoniae R6
aguaguauuuacuaa

SEQ ID NO: 2181750 - RNA, 14 nt, Streptococcus pneumoniae R6
aguaguaacuuuuu

SEQ ID NO: 2181751 - RNA, 21 nt, Streptococcus pneumoniae R6
aguagucuguucuauaaaaua

SEQ ID NO: 2181752 - RNA, 15 nt, Streptococcus pneumoniae R6
aguagucuuuuuguu

SEQ ID NO: 2181753 - RNA, 13 nt, Streptococcus pneumoniae R6
aguaguuggcuug

SEQ ID NO: 2181754 - RNA, 19 nt, Streptococcus pneumoniae R6
aguaguuggcuugucuuuu

SEQ ID NO: 2181755 - RNA, 14 nt, Streptococcus pneumoniae R6
aguauaaaaucaaa

SEQ ID NO: 2181756 - RNA, 16 nt, Streptococcus pneumoniae R6
aguauaaaauuuugac

SEQ ID NO: 2181757 - RNA, 23 nt, Streptococcus pneumoniae R6
aguaguuucagcgauuuccuuga

SEQ ID NO: 2181758 - RNA, 18 nt, Streptococcus pneumoniae R6
aguauaaaaccuugaaga

SEQ ID NO: 2181759 - RNA, 22 nt, Streptococcus pneumoniae R6
aguauaaaaccuugaagaguug

SEQ ID NO: 2181760 - RNA, 16 nt, Streptococcus pneumoniae R6
agggagccugugguga

SEQ ID NO: 2181761 - RNA, 22 nt, Streptococcus pneumoniae R6
agggcaaaaaagggacaaaacu

SEQ ID NO: 2181762 - RNA, 23 nt, Streptococcus pneumoniae R6
agggauuuuucuggcucuuuguc

SEQ ID NO: 2181763 - RNA, 18 nt, Streptococcus pneumoniae R6
agggauucuuauauuaaa

SEQ ID NO: 2181764 - RNA, 20 nt, Streptococcus pneumoniae R6
agggauucuuauauuaaaaa

SEQ ID NO: 2181765 - RNA, 15 nt, Streptococcus pneumoniae R6
agggcaaauaaaaag

SEQ ID NO: 2181766 - RNA, 16 nt, Streptococcus pneumoniae R6
agggcaaauaaaaagc

SEQ ID NO: 2181767 - RNA, 17 nt, Streptococcus pneumoniae R6
agggauuuggccuguag

SEQ ID NO: 2181768 - RNA, 14 nt, Streptococcus pneumoniae R6
aggcuuuaaaugcu

SEQ ID NO: 2181769 - RNA, 15 nt, Streptococcus pneumoniae R6
aggcuuguucacuuu

SEQ ID NO: 2181770 - RNA, 12 nt, Streptococcus pneumoniae R6
aggcuuucaacu

SEQ ID NO: 2181771 - RNA, 15 nt, Streptococcus pneumoniae R6
aggcuuucaacugcu

SEQ ID NO: 2181772 - RNA, 21 nt, Streptococcus pneumoniae R6
aggcuuucaacugcuuuuuca

SEQ ID NO: 2181773 - RNA, 18 nt, Streptococcus pneumoniae R6
agggaaauccuagauaca

SEQ ID NO: 2181774 - RNA, 16 nt, Streptococcus pneumoniae R6
agggaaaccacuagca

SEQ ID NO: 2181775 - RNA, 11 nt, Streptococcus pneumoniae R6
agggaaagaag

SEQ ID NO: 2181776 - RNA, 20 nt, Streptococcus pneumoniae R6
agggaaagaagguauucaua

SEQ ID NO: 2181777 - RNA, 18 nt, Streptococcus pneumoniae R6
agggaaaaguggucugga

SEQ ID NO: 2181778 - RNA, 14 nt, Streptococcus pneumoniae R6
aggcuuuuucucau

SEQ ID NO: 2181779 - RNA, 16 nt, Streptococcus pneumoniae R6
aggggcucuuugucaa

SEQ ID NO: 2181780 - RNA, 19 nt, Streptococcus pneumoniae R6
agggcuaggcuaacacuug

SEQ ID NO: 2181781 - RNA, 16 nt, Streptococcus pneumoniae R6
agggcugcaaaauuuu

SEQ ID NO: 2181782 - RNA, 13 nt, Streptococcus pneumoniae R6
agggcugaacgac

SEQ ID NO: 2181783 - RNA, 19 nt, Streptococcus pneumoniae R6
agggcugaacgacucacuu

SEQ ID NO: 2181784 - RNA, 17 nt, Streptococcus pneumoniae R6
agggcuucaaucucugc

SEQ ID NO: 2181785 - RNA, 18 nt, Streptococcus pneumoniae R6
aggggcaucuugaauagc

SEQ ID NO: 2181786 - RNA, 15 nt, Streptococcus pneumoniae R6
agggcauuuugaccu

SEQ ID NO: 2181787 - RNA, 21 nt, Streptococcus pneumoniae R6
agggcaccaaacuuaggaagc

SEQ ID NO: 2181788 - RNA, 13 nt, Streptococcus pneumoniae R6
agguggaaaagca

SEQ ID NO: 2181789 - RNA, 15 nt, Streptococcus pneumoniae R6
aggugcuuauuucac

SEQ ID NO: 2181790 - RNA, 17 nt, Streptococcus pneumoniae R6
aggugauuuaccauagu

SEQ ID NO: 2181791 - RNA, 19 nt, Streptococcus pneumoniae R6
aggugcagagagauaaaua

SEQ ID NO: 2181792 - RNA, 13 nt, Streptococcus pneumoniae R6
aggucauguagau

SEQ ID NO: 2181793 - RNA, 16 nt, Streptococcus pneumoniae R6
aggucaucagcagaga

SEQ ID NO: 2181794 - RNA, 18 nt, Streptococcus pneumoniae R6
aggucaucagcagagaaa

SEQ ID NO: 2181795 - RNA, 15 nt, Streptococcus pneumoniae R6
aggucauaaagaggu

SEQ ID NO: 2181796 - RNA, 16 nt, Streptococcus pneumoniae R6
aggucauuugaaucau

SEQ ID NO: 2181797 - RNA, 13 nt, Streptococcus pneumoniae R6
agguccaaccaga

SEQ ID NO: 2181798 - RNA, 20 nt, Streptococcus pneumoniae R6
agguccaaguuugcaaaguu

SEQ ID NO: 2181799 - RNA, 18 nt, Streptococcus pneumoniae R6
aggucgcugugauaaugg

SEQ ID NO: 2181800 - RNA, 22 nt, Streptococcus pneumoniae R6
agguaauuuucuggcagauaga

SEQ ID NO: 2181801 - RNA, 15 nt, Streptococcus pneumoniae R6
agguaauuaugaaau

SEQ ID NO: 2181802 - RNA, 16 nt, Streptococcus pneumoniae R6
agguaauuaugaaauu

SEQ ID NO: 2181803 - RNA, 20 nt, Streptococcus pneumoniae R6
agguaauuaugaaauuuaaa

SEQ ID NO: 2181804 - RNA, 22 nt, Streptococcus pneumoniae R6
agguacuugauuuaugccauau

SEQ ID NO: 2181805 - RNA, 15 nt, Streptococcus pneumoniae R6
agguagcuuagaaau

SEQ ID NO: 2181806 - RNA, 16 nt, Streptococcus pneumoniae R6
agguagcuuagaaaua

SEQ ID NO: 2181807 - RNA, 15 nt, Streptococcus pneumoniae R6
agguaguauuuagau

SEQ ID NO: 2181808 - RNA, 13 nt, Streptococcus pneumoniae R6
agggugaagaguu

SEQ ID NO: 2181809 - RNA, 15 nt, Streptococcus pneumoniae R6
agggugacaguaaaa

SEQ ID NO: 2181810 - RNA, 22 nt, Streptococcus pneumoniae R6
aggguauaaaacuuaugagcua

SEQ ID NO: 2181811 - RNA, 19 nt, Streptococcus pneumoniae R6
aggccacaaaugcuucuuu

SEQ ID NO: 2181812 - RNA, 23 nt, Streptococcus pneumoniae R6
aggccacaaaugcuucuuugaua

SEQ ID NO: 2181813 - RNA, 21 nt, Streptococcus pneumoniae R6
aggcauugcgcuugauaaguu

SEQ ID NO: 2181814 - RNA, 16 nt, Streptococcus pneumoniae R6
aggcauugugcuugau

SEQ ID NO: 2181815 - RNA, 15 nt, Streptococcus pneumoniae R6
aggccaaacuugaaa

SEQ ID NO: 2181816 - RNA, 16 nt, Streptococcus pneumoniae R6
aggccaagucuuuucg

SEQ ID NO: 2181817 - RNA, 19 nt, Streptococcus pneumoniae R6
aggcaucuugucaaagagu

SEQ ID NO: 2181818 - RNA, 17 nt, Streptococcus pneumoniae R6
aggcaucuuaacauucu

SEQ ID NO: 2181819 - RNA, 17 nt, Streptococcus pneumoniae R6
aggcaugggccccagcu

SEQ ID NO: 2181820 - RNA, 21 nt, Streptococcus pneumoniae R6
aggcaacaaaguaaccaucug

SEQ ID NO: 2181821 - RNA, 18 nt, Streptococcus pneumoniae R6
aggauuuuugcuucugau

SEQ ID NO: 2181822 - RNA, 13 nt, Streptococcus pneumoniae R6
aggauuuugugaa

SEQ ID NO: 2181823 - RNA, 19 nt, Streptococcus pneumoniae R6
aggauuuuguucuuuuuca

SEQ ID NO: 2181824 - RNA, 20 nt, Streptococcus pneumoniae R6
aggauuuuugaauauuagua

SEQ ID NO: 2181825 - RNA, 23 nt, Streptococcus pneumoniae R6
aggauuucuuugaaaucuuguug

SEQ ID NO: 2181826 - RNA, 14 nt, Streptococcus pneumoniae R6
aggauuucucuauu

SEQ ID NO: 2181827 - RNA, 14 nt, Streptococcus pneumoniae R6
aggauuucugcuuu

SEQ ID NO: 2181828 - RNA, 15 nt, Streptococcus pneumoniae R6
aggauuuccuaguag

SEQ ID NO: 2181829 - RNA, 15 nt, Streptococcus pneumoniae R6
aggauugcccuagcu

SEQ ID NO: 2181830 - RNA, 13 nt, Streptococcus pneumoniae R6
aggauuguucaga

SEQ ID NO: 2181831 - RNA, 19 nt, Streptococcus pneumoniae R6
aggauugguaaauucuuca

SEQ ID NO: 2181832 - RNA, 22 nt, Streptococcus pneumoniae R6
aggauuuaggacuaaauacaaa

SEQ ID NO: 2181833 - RNA, 15 nt, Streptococcus pneumoniae R6
aggauuuauuuuucu

SEQ ID NO: 2181834 - RNA, 17 nt, Streptococcus pneumoniae R6
aggauuuauuuuucuuu

SEQ ID NO: 2181835 - RNA, 14 nt, Streptococcus pneumoniae R6
aggagcuuuuggga

SEQ ID NO: 2181836 - RNA, 20 nt, Streptococcus pneumoniae R6
aggagcaguugauggagcug

SEQ ID NO: 2181837 - RNA, 14 nt, Streptococcus pneumoniae R6
aggagccaagauag

SEQ ID NO: 2181838 - RNA, 14 nt, Streptococcus pneumoniae R6
aggagccagcugaa

SEQ ID NO: 2181839 - RNA, 18 nt, Streptococcus pneumoniae R6
aggcgaaaucauuugaau

SEQ ID NO: 2181840 - RNA, 14 nt, Streptococcus pneumoniae R6
aggccuaaggcugu

SEQ ID NO: 2181841 - RNA, 18 nt, Streptococcus pneumoniae R6
aggccuuguggaagaagu

SEQ ID NO: 2181842 - RNA, 12 nt, Streptococcus pneumoniae R6
aggccuuggccu

SEQ ID NO: 2181843 - RNA, 13 nt, Streptococcus pneumoniae R6
aggcgaaaagcua

SEQ ID NO: 2181844 - RNA, 17 nt, Streptococcus pneumoniae R6
aggccgagucaaaauuc

SEQ ID NO: 2181845 - RNA, 22 nt, Streptococcus pneumoniae R6
aggcccccuuguaguucucaau

SEQ ID NO: 2181846 - RNA, 21 nt, Streptococcus pneumoniae R6
agcugcugcuuccauuuccac

SEQ ID NO: 2181847 - RNA, 15 nt, Streptococcus pneumoniae R6
agcugccccaccugc

SEQ ID NO: 2181848 - RNA, 14 nt, Streptococcus pneumoniae R6
agcuccaucuccaa

SEQ ID NO: 2181849 - RNA, 18 nt, Streptococcus pneumoniae R6
agcuccaucuccaacugc

SEQ ID NO: 2181850 - RNA, 19 nt, Streptococcus pneumoniae R6
agcuccauacacuggaugu

SEQ ID NO: 2181851 - RNA, 21 nt, Streptococcus pneumoniae R6
agcugugcuuugagcaaccua

SEQ ID NO: 2181852 - RNA, 23 nt, Streptococcus pneumoniae R6
agcugucgcaccugacuccauag

SEQ ID NO: 2181853 - RNA, 15 nt, Streptococcus pneumoniae R6
agcugucaagaaauu

SEQ ID NO: 2181854 - RNA, 19 nt, Streptococcus pneumoniae R6
agcugucaaaucauccgaa

SEQ ID NO: 2181855 - RNA, 16 nt, Streptococcus pneumoniae R6
agcuguaaaucuagga

SEQ ID NO: 2181856 - RNA, 18 nt, Streptococcus pneumoniae R6
agcuggucaagaagcgaa

SEQ ID NO: 2181857 - RNA, 14 nt, Streptococcus pneumoniae R6
agcuggaagaauuu

SEQ ID NO: 2181858 - RNA, 18 nt, Streptococcus pneumoniae R6
agcuucauuuaucuucuu

SEQ ID NO: 2181859 - RNA, 21 nt, Streptococcus pneumoniae R6
agcuucaucaguuccagcaaa

SEQ ID NO: 2181860 - RNA, 18 nt, Streptococcus pneumoniae R6
agcuuccaucugcagccu

SEQ ID NO: 2181861 - RNA, 20 nt, Streptococcus pneumoniae R6
agcuuccaguagcgcuugau

SEQ ID NO: 2181862 - RNA, 18 nt, Streptococcus pneumoniae R6
agcuugguaagagucacu

SEQ ID NO: 2181863 - RNA, 17 nt, Streptococcus pneumoniae R6
agcuugguaaugcucca

SEQ ID NO: 2181864 - RNA, 22 nt, Streptococcus pneumoniae R6
agcuugguaaugcuccaauaca

SEQ ID NO: 2181865 - RNA, 20 nt, Streptococcus pneumoniae R6
agcuugaguaaauaaaacaa

SEQ ID NO: 2181866 - RNA, 16 nt, Streptococcus pneumoniae R6
agcuugaguggaaaaa

SEQ ID NO: 2181867 - RNA, 16 nt, Streptococcus pneumoniae R6
agcuugcaauucuuua

SEQ ID NO: 2181868 - RNA, 13 nt, Streptococcus pneumoniae R6
aggacuuuuuuac

SEQ ID NO: 2181869 - RNA, 13 nt, Streptococcus pneumoniae R6
aggagaaaaaaua

SEQ ID NO: 2181870 - RNA, 20 nt, Streptococcus pneumoniae R6
aggagaaaaagaaguaaauc

SEQ ID NO: 2181871 - RNA, 22 nt, Streptococcus pneumoniae R6
aggacuugaguaaugaacucag

SEQ ID NO: 2181872 - RNA, 13 nt, Streptococcus pneumoniae R6
aggaccaaauaua

SEQ ID NO: 2181873 - RNA, 22 nt, Streptococcus pneumoniae R6
aggacauaaaucgaucauauuu

SEQ ID NO: 2181874 - RNA, 22 nt, Streptococcus pneumoniae R6
aggacauagaaaaugguuccaa

SEQ ID NO: 2181875 - RNA, 13 nt, Streptococcus pneumoniae R6
aggagaaucaaca

SEQ ID NO: 2181876 - RNA, 17 nt, Streptococcus pneumoniae R6
aggagaccagcuacaaa

SEQ ID NO: 2181877 - RNA, 13 nt, Streptococcus pneumoniae R6
aggagaauuuuug

SEQ ID NO: 2181878 - RNA, 16 nt, Streptococcus pneumoniae R6
aggagauuggaaacca

SEQ ID NO: 2181879 - RNA, 13 nt, Streptococcus pneumoniae R6
aggacagcaagaa

SEQ ID NO: 2181880 - RNA, 13 nt, Streptococcus pneumoniae R6
aggacaggugcuu

SEQ ID NO: 2181881 - RNA, 17 nt, Streptococcus pneumoniae R6
aggacaaguuaaauaau

SEQ ID NO: 2181882 - RNA, 23 nt, Streptococcus pneumoniae R6
aggacaaauuucguccuuucuuu

SEQ ID NO: 2181883 - RNA, 17 nt, Streptococcus pneumoniae R6
aggaagucuuguuugag

SEQ ID NO: 2181884 - RNA, 17 nt, Streptococcus pneumoniae R6
aggaauucauuuacuga

SEQ ID NO: 2181885 - RNA, 14 nt, Streptococcus pneumoniae R6
aggaagguuauuug

SEQ ID NO: 2181886 - RNA, 14 nt, Streptococcus pneumoniae R6
aggaagguuuuaaa

SEQ ID NO: 2181887 - RNA, 16 nt, Streptococcus pneumoniae R6
aggaagguuuuaaaga

SEQ ID NO: 2181888 - RNA, 17 nt, Streptococcus pneumoniae R6
aggaaguaccaaggaag

SEQ ID NO: 2181889 - RNA, 18 nt, Streptococcus pneumoniae R6
aggaaagucggaaggcau

SEQ ID NO: 2181890 - RNA, 12 nt, Streptococcus pneumoniae R6
aggaaagucaaa

SEQ ID NO: 2181891 - RNA, 18 nt, Streptococcus pneumoniae R6
aggaaagucaaacaaugu

SEQ ID NO: 2181892 - RNA, 17 nt, Streptococcus pneumoniae R6
aggaaagucaaauuaau

SEQ ID NO: 2181893 - RNA, 14 nt, Streptococcus pneumoniae R6
aggaacaauaaaac

SEQ ID NO: 2181894 - RNA, 15 nt, Streptococcus pneumoniae R6
agcuuugcuuuccuc

SEQ ID NO: 2181895 - RNA, 19 nt, Streptococcus pneumoniae R6
aggaaagaggguauaaaac

SEQ ID NO: 2181896 - RNA, 16 nt, Streptococcus pneumoniae R6
aggaaaggaaaauuga

SEQ ID NO: 2181897 - RNA, 17 nt, Streptococcus pneumoniae R6
aggaaagcauaggggcu

SEQ ID NO: 2181898 - RNA, 12 nt, Streptococcus pneumoniae R6
aggaagaaagag

SEQ ID NO: 2181899 - RNA, 20 nt, Streptococcus pneumoniae R6
aggaagcaguccaaggagaa

SEQ ID NO: 2181900 - RNA, 16 nt, Streptococcus pneumoniae R6
aggaagcccuuuauga

SEQ ID NO: 2181901 - RNA, 17 nt, Streptococcus pneumoniae R6
aggaagcuagccgcagg

SEQ ID NO: 2181902 - RNA, 22 nt, Streptococcus pneumoniae R6
aggaagccuucuuuuccaccaa

SEQ ID NO: 2181903 - RNA, 18 nt, Streptococcus pneumoniae R6
aggaagcgaugauaagaa

SEQ ID NO: 2181904 - RNA, 15 nt, Streptococcus pneumoniae R6
aggaagauuuauacu

SEQ ID NO: 2181905 - RNA, 22 nt, Streptococcus pneumoniae R6
aggaacgauguuugcagcacca

SEQ ID NO: 2181906 - RNA, 22 nt, Streptococcus pneumoniae R6
aggaacggcuaguuuuuaggau

SEQ ID NO: 2181907 - RNA, 20 nt, Streptococcus pneumoniae R6
auaacaucugcuauaauagu

SEQ ID NO: 2181908 - RNA, 23 nt, Streptococcus pneumoniae R6
auaacaucugcuauaauaguaag

SEQ ID NO: 2181909 - RNA, 16 nt, Streptococcus pneumoniae R6
auaaccaaguucuaaa

SEQ ID NO: 2181910 - RNA, 14 nt, Streptococcus pneumoniae R6
auaacagcauuucc

SEQ ID NO: 2181911 - RNA, 13 nt, Streptococcus pneumoniae R6
auaacacuauuaa

SEQ ID NO: 2181912 - RNA, 18 nt, Streptococcus pneumoniae R6
auaacacgagaaacaaua

SEQ ID NO: 2181913 - RNA, 13 nt, Streptococcus pneumoniae R6
auaacagagaaga

SEQ ID NO: 2181914 - RNA, 16 nt, Streptococcus pneumoniae R6
auaaaucgaucauauu

SEQ ID NO: 2181915 - RNA, 15 nt, Streptococcus pneumoniae R6
auaaauccagcugag

SEQ ID NO: 2181916 - RNA, 17 nt, Streptococcus pneumoniae R6
auaacaaaccaagaaua

SEQ ID NO: 2181917 - RNA, 13 nt, Streptococcus pneumoniae R6
auaaccuuaauca

SEQ ID NO: 2181918 - RNA, 20 nt, Streptococcus pneumoniae R6
auaaccuuccacccagaaau

SEQ ID NO: 2181919 - RNA, 16 nt, Streptococcus pneumoniae R6
auaacuucagauuagu

SEQ ID NO: 2181920 - RNA, 18 nt, Streptococcus pneumoniae R6
auaagaaaggauauaaau

SEQ ID NO: 2181921 - RNA, 21 nt, Streptococcus pneumoniae R6
auaacugcgauacgaucugaa

SEQ ID NO: 2181922 - RNA, 22 nt, Streptococcus pneumoniae R6
auaacugcuaaaagauuucuau

SEQ ID NO: 2181923 - RNA, 14 nt, Streptococcus pneumoniae R6
auaacugcuagaaa

SEQ ID NO: 2181924 - RNA, 20 nt, Streptococcus pneumoniae R6
auaacccaccaagucaucaa

SEQ ID NO: 2181925 - RNA, 22 nt, Streptococcus pneumoniae R6
auaaacgcaagcaacaaaaacg

SEQ ID NO: 2181926 - RNA, 14 nt, Streptococcus pneumoniae R6
auaaagguguucaa

SEQ ID NO: 2181927 - RNA, 13 nt, Streptococcus pneumoniae R6
auaaaguauuaua

SEQ ID NO: 2181928 - RNA, 18 nt, Streptococcus pneumoniae R6
auaaaguauuauaauaua

SEQ ID NO: 2181929 - RNA, 13 nt, Streptococcus pneumoniae R6
auaaauauagaaa

SEQ ID NO: 2181930 - RNA, 18 nt, Streptococcus pneumoniae R6
auaaauauaguaaaauga

SEQ ID NO: 2181931 - RNA, 19 nt, Streptococcus pneumoniae R6
auaaauaucaaaaaaagaa

SEQ ID NO: 2181932 - RNA, 14 nt, Streptococcus pneumoniae R6
auaaauacaacagg

SEQ ID NO: 2181933 - RNA, 17 nt, Streptococcus pneumoniae R6
auaaacaagggcaaaaa

SEQ ID NO: 2181934 - RNA, 18 nt, Streptococcus pneumoniae R6
auaaacaagggcaaaaaa

SEQ ID NO: 2181935 - RNA, 19 nt, Streptococcus pneumoniae R6
auaaacaagggcaaaaaag

SEQ ID NO: 2181936 - RNA, 21 nt, Streptococcus pneumoniae R6
auaaacaagggcaaaaaagaa

SEQ ID NO: 2181937 - RNA, 17 nt, Streptococcus pneumoniae R6
auaaaauuuuuuucaaa

SEQ ID NO: 2181938 - RNA, 21 nt, Streptococcus pneumoniae R6
auaaaauuugaacaaauuaau

SEQ ID NO: 2181939 - RNA, 15 nt, Streptococcus pneumoniae R6
auaaaccaaaggaag

SEQ ID NO: 2181940 - RNA, 21 nt, Streptococcus pneumoniae R6
auaaaauuccuuuaaaaacaa

SEQ ID NO: 2181941 - RNA, 20 nt, Streptococcus pneumoniae R6
auaaaauucgcgaaguuuau

SEQ ID NO: 2181942 - RNA, 13 nt, Streptococcus pneumoniae R6
auaaaauuuaaaa

SEQ ID NO: 2181943 - RNA, 18 nt, Streptococcus pneumoniae R6
auaaaauuuaaaaauaga

SEQ ID NO: 2181944 - RNA, 19 nt, Streptococcus pneumoniae R6
auaaaauugaauugcuuau

SEQ ID NO: 2181945 - RNA, 15 nt, Streptococcus pneumoniae R6
aguuuuauuuuugau

SEQ ID NO: 2181946 - RNA, 16 nt, Streptococcus pneumoniae R6
aguuuucaaugauaaa

SEQ ID NO: 2181947 - RNA, 13 nt, Streptococcus pneumoniae R6
aguuuucacaccu

SEQ ID NO: 2181948 - RNA, 12 nt, Streptococcus pneumoniae R6
aguuuucauucu

SEQ ID NO: 2181949 - RNA, 21 nt, Streptococcus pneumoniae R6
aguuuuaucaguaaucucaaa

SEQ ID NO: 2181950 - RNA, 17 nt, Streptococcus pneumoniae R6
aguuuucaaaguuccua

SEQ ID NO: 2181951 - RNA, 14 nt, Streptococcus pneumoniae R6
aguuuucaaaguuu

SEQ ID NO: 2181952 - RNA, 14 nt, Streptococcus pneumoniae R6
aguuuuagaugaga

SEQ ID NO: 2181953 - RNA, 16 nt, Streptococcus pneumoniae R6
aguuuuagauugcuuu

SEQ ID NO: 2181954 - RNA, 23 nt, Streptococcus pneumoniae R6
aguuuuaggacauaaauaugauc

SEQ ID NO: 2181955 - RNA, 13 nt, Streptococcus pneumoniae R6
auaaaaucaaauu

SEQ ID NO: 2181956 - RNA, 22 nt, Streptococcus pneumoniae R6
auaaaauauaguagauugaaau

SEQ ID NO: 2181957 - RNA, 18 nt, Streptococcus pneumoniae R6
auaaaauacccucuauca

SEQ ID NO: 2181958 - RNA, 18 nt, Streptococcus pneumoniae R6
auaaaaucagguguucaa

SEQ ID NO: 2181959 - RNA, 11 nt, Streptococcus pneumoniae R6
auaaaaugaaa

SEQ ID NO: 2181960 - RNA, 16 nt, Streptococcus pneumoniae R6
auaaaaugaaauaaga

SEQ ID NO: 2181961 - RNA, 22 nt, Streptococcus pneumoniae R6
auaaaaucugaagaaagcaauu

SEQ ID NO: 2181962 - RNA, 18 nt, Streptococcus pneumoniae R6
auaaaauccgaggggcua

SEQ ID NO: 2181963 - RNA, 16 nt, Streptococcus pneumoniae R6
auaauaaaacuuuuaa

SEQ ID NO: 2181964 - RNA, 18 nt, Streptococcus pneumoniae R6
auaauaaaacuuuuaaaa

SEQ ID NO: 2181965 - RNA, 13 nt, Streptococcus pneumoniae R6
auaaguuugguuu

SEQ ID NO: 2181966 - RNA, 13 nt, Streptococcus pneumoniae R6
auaauaaauaguu

SEQ ID NO: 2181967 - RNA, 15 nt, Streptococcus pneumoniae R6
auaauaaauaguuau

SEQ ID NO: 2181968 - RNA, 20 nt, Streptococcus pneumoniae R6
auaauaaaaugaaauaauaa

SEQ ID NO: 2181969 - RNA, 24 nt, Streptococcus pneumoniae R6
auaauaccagcaaucaaauucauu

SEQ ID NO: 2181970 - RNA, 16 nt, Streptococcus pneumoniae R6
auaauacaaaaaauag

SEQ ID NO: 2181971 - RNA, 17 nt, Streptococcus pneumoniae R6
auaauacaaaaaauagu

SEQ ID NO: 2181972 - RNA, 22 nt, Streptococcus pneumoniae R6
auaaguuguaguacugaacaau

SEQ ID NO: 2181973 - RNA, 12 nt, Streptococcus pneumoniae R6
auaaguuugaug

SEQ ID NO: 2181974 - RNA, 13 nt, Streptococcus pneumoniae R6
auaaguuuagaau

SEQ ID NO: 2181975 - RNA, 18 nt, Streptococcus pneumoniae R6
auaaguuagaauauguaa

SEQ ID NO: 2181976 - RNA, 22 nt, Streptococcus pneumoniae R6
auaagaaucccucuuuuuacaa

SEQ ID NO: 2181977 - RNA, 17 nt, Streptococcus pneumoniae R6
auaagucuuugauuuug

SEQ ID NO: 2181978 - RNA, 20 nt, Streptococcus pneumoniae R6
auaagucuuugauuuugaga

SEQ ID NO: 2181979 - RNA, 19 nt, Streptococcus pneumoniae R6
auaagaauaucaagauaag

SEQ ID NO: 2181980 - RNA, 22 nt, Streptococcus pneumoniae R6
auaagaauaucugagauaguau

SEQ ID NO: 2181981 - RNA, 19 nt, Streptococcus pneumoniae R6
auaagaaauaguuuagaua

SEQ ID NO: 2181982 - RNA, 12 nt, Streptococcus pneumoniae R6
auaaugagcugu

SEQ ID NO: 2181983 - RNA, 15 nt, Streptococcus pneumoniae R6
auaaugauuucaaga

SEQ ID NO: 2181984 - RNA, 15 nt, Streptococcus pneumoniae R6
auaaugcuuugaaca

SEQ ID NO: 2181985 - RNA, 15 nt, Streptococcus pneumoniae R6
auaaucgcaagguag

SEQ ID NO: 2181986 - RNA, 12 nt, Streptococcus pneumoniae R6
auaaucuuaucu

SEQ ID NO: 2181987 - RNA, 16 nt, Streptococcus pneumoniae R6
auaauauaauaaacua

SEQ ID NO: 2181988 - RNA, 13 nt, Streptococcus pneumoniae R6
auaauaguaagag

SEQ ID NO: 2181989 - RNA, 18 nt, Streptococcus pneumoniae R6
auaauaguaugucugaau

SEQ ID NO: 2181990 - RNA, 14 nt, Streptococcus pneumoniae R6
auaauagucucuug

SEQ ID NO: 2181991 - RNA, 20 nt, Streptococcus pneumoniae R6
auaauauauagguuuugcua

SEQ ID NO: 2181992 - RNA, 15 nt, Streptococcus pneumoniae R6
auaauauaggucaga

SEQ ID NO: 2181993 - RNA, 18 nt, Streptococcus pneumoniae R6
auaauugcuugagcaauc

SEQ ID NO: 2181994 - RNA, 18 nt, Streptococcus pneumoniae R6
auaauuguaaacaaaaau

SEQ ID NO: 2181995 - RNA, 15 nt, Streptococcus pneumoniae R6
auaauuguaggaaag

SEQ ID NO: 2181996 - RNA, 23 nt, Streptococcus pneumoniae R6
auaauuuauccaaaggauuuagu

SEQ ID NO: 2181997 - RNA, 23 nt, Streptococcus pneumoniae R6
auaauguaaggugcaaaaaccuu

SEQ ID NO: 2181998 - RNA, 21 nt, Streptococcus pneumoniae R6
auaaugguugucguccccuuc

SEQ ID NO: 2181999 - RNA, 23 nt, Streptococcus pneumoniae R6
auaaugguugucguccccuucaa

SEQ ID NO: 2182000 - RNA, 15 nt, Streptococcus pneumoniae R6
auaaugguuauaucu

SEQ ID NO: 2182001 - RNA, 20 nt, Streptococcus pneumoniae R6
auaaugguuauaucugcuac

SEQ ID NO: 2182002 - RNA, 21 nt, Streptococcus pneumoniae R6
auaauugacgaagaaaccaag

SEQ ID NO: 2182003 - RNA, 15 nt, Streptococcus pneumoniae R6
auaauuuuguuaaga

SEQ ID NO: 2182004 - RNA, 21 nt, Streptococcus pneumoniae R6
auaauuuuguuaagacacuuu

SEQ ID NO: 2182005 - RNA, 13 nt, Streptococcus pneumoniae R6
auacaaaaccaaa

SEQ ID NO: 2182006 - RNA, 12 nt, Streptococcus pneumoniae R6
auacaaaaauag

SEQ ID NO: 2182007 - RNA, 17 nt, Streptococcus pneumoniae R6
auacaaaaacaaagaga

SEQ ID NO: 2182008 - RNA, 22 nt, Streptococcus pneumoniae R6
auaauuuccaugucaauuuuua

SEQ ID NO: 2182009 - RNA, 17 nt, Streptococcus pneumoniae R6
auaauuuuaguagaaaa

SEQ ID NO: 2182010 - RNA, 22 nt, Streptococcus pneumoniae R6
auacaccuaauccacucagaca

SEQ ID NO: 2182011 - RNA, 13 nt, Streptococcus pneumoniae R6
auacaccucuucu

SEQ ID NO: 2182012 - RNA, 24 nt, Streptococcus pneumoniae R6
auacacuucuacuauacgacaugc

SEQ ID NO: 2182013 - RNA, 15 nt, Streptococcus pneumoniae R6
auacagauaaaaauc

SEQ ID NO: 2182014 - RNA, 15 nt, Streptococcus pneumoniae R6
auacagauaaaaccu

SEQ ID NO: 2182015 - RNA, 22 nt, Streptococcus pneumoniae R6
auacagacugcaaggcaagacu

SEQ ID NO: 2182016 - RNA, 15 nt, Streptococcus pneumoniae R6
auacagagaaaguca

SEQ ID NO: 2182017 - RNA, 15 nt, Streptococcus pneumoniae R6
auacaauauauccaa

SEQ ID NO: 2182018 - RNA, 15 nt, Streptococcus pneumoniae R6
auacaaguucaucuu

SEQ ID NO: 2182019 - RNA, 16 nt, Streptococcus pneumoniae R6
auacaaguucaucuuc

SEQ ID NO: 2182020 - RNA, 13 nt, Streptococcus pneumoniae R6
auacacacuuaaa

SEQ ID NO: 2182021 - RNA, 21 nt, Streptococcus pneumoniae R6
auacacacuuaaauugguguu

SEQ ID NO: 2182022 - RNA, 12 nt, Streptococcus pneumoniae R6
auacacauccag

SEQ ID NO: 2182023 - RNA, 23 nt, Streptococcus pneumoniae R6
auacaaaguauuuuuucuuccca

SEQ ID NO: 2182024 - RNA, 22 nt, Streptococcus pneumoniae R6
auacaaauuuauacuaauacau

SEQ ID NO: 2182025 - RNA, 18 nt, Streptococcus pneumoniae R6
auacaagcugccaaagca

SEQ ID NO: 2182026 - RNA, 23 nt, Streptococcus pneumoniae R6
agucugcgccuagcuuucuaguu

SEQ ID NO: 2182027 - RNA, 19 nt, Streptococcus pneumoniae R6
agucugcugccaauugcuc

SEQ ID NO: 2182028 - RNA, 20 nt, Streptococcus pneumoniae R6
agucugaaaaagaggaugaa

SEQ ID NO: 2182029 - RNA, 22 nt, Streptococcus pneumoniae R6
agucugacgcuggaaauaagaa

SEQ ID NO: 2182030 - RNA, 13 nt, Streptococcus pneumoniae R6
agucuuuaaaauu

SEQ ID NO: 2182031 - RNA, 13 nt, Streptococcus pneumoniae R6
agucuuugauuuu

SEQ ID NO: 2182032 - RNA, 16 nt, Streptococcus pneumoniae R6
agucuuugauuuugag

SEQ ID NO: 2182033 - RNA, 18 nt, Streptococcus pneumoniae R6
agugaaaaaguaagaguu

SEQ ID NO: 2182034 - RNA, 22 nt, Streptococcus pneumoniae R6
agucucuccagcgagcaaacga

SEQ ID NO: 2182035 - RNA, 22 nt, Streptococcus pneumoniae R6
agucucugucccaucauuucuu

SEQ ID NO: 2182036 - RNA, 16 nt, Streptococcus pneumoniae R6
agucuccucaaaaaca

SEQ ID NO: 2182037 - RNA, 17 nt, Streptococcus pneumoniae R6
agucuccucaaaaacag

SEQ ID NO: 2182038 - RNA, 13 nt, Streptococcus pneumoniae R6
agucggaaucuuu

SEQ ID NO: 2182039 - RNA, 16 nt, Streptococcus pneumoniae R6
agucgaggaaaucccu

SEQ ID NO: 2182040 - RNA, 13 nt, Streptococcus pneumoniae R6
aguccuaugauug

SEQ ID NO: 2182041 - RNA, 12 nt, Streptococcus pneumoniae R6
aguccucuuucc

SEQ ID NO: 2182042 - RNA, 16 nt, Streptococcus pneumoniae R6
aguccugaaaaucauc

SEQ ID NO: 2182043 - RNA, 20 nt, Streptococcus pneumoniae R6
agucgaagcuuccaauaaua

SEQ ID NO: 2182044 - RNA, 13 nt, Streptococcus pneumoniae R6
agucaaaaagaag

SEQ ID NO: 2182045 - RNA, 13 nt, Streptococcus pneumoniae R6
aguauuuuaaaac

SEQ ID NO: 2182046 - RNA, 17 nt, Streptococcus pneumoniae R6
agucaaacguuuaacug

SEQ ID NO: 2182047 - RNA, 13 nt, Streptococcus pneumoniae R6
agucaaagaguuu

SEQ ID NO: 2182048 - RNA, 14 nt, Streptococcus pneumoniae R6
agucaaagaguuuu

SEQ ID NO: 2182049 - RNA, 15 nt, Streptococcus pneumoniae R6
agucaaagccaauca

SEQ ID NO: 2182050 - RNA, 20 nt, Streptococcus pneumoniae R6
agucaaaucgauuucuaaaa

SEQ ID NO: 2182051 - RNA, 20 nt, Streptococcus pneumoniae R6
agucaaaucgauuucuaaca

SEQ ID NO: 2182052 - RNA, 12 nt, Streptococcus pneumoniae R6
agucaaauuaau

SEQ ID NO: 2182053 - RNA, 20 nt, Streptococcus pneumoniae R6
agucaaauuaauuuauagaa

SEQ ID NO: 2182054 - RNA, 22 nt, Streptococcus pneumoniae R6
agucaaauuaauuuauagaaau

SEQ ID NO: 2182055 - RNA, 13 nt, Streptococcus pneumoniae R6
agucaaaauucuu

SEQ ID NO: 2182056 - RNA, 16 nt, Streptococcus pneumoniae R6
agucaaaauucuuuga

SEQ ID NO: 2182057 - RNA, 23 nt, Streptococcus pneumoniae R6
agucaaaauucuuugaaaucaga

SEQ ID NO: 2182058 - RNA, 18 nt, Streptococcus pneumoniae R6
agugauaucuugaaggau

SEQ ID NO: 2182059 - RNA, 18 nt, Streptococcus pneumoniae R6
agugaaguguuuaggcaa

SEQ ID NO: 2182060 - RNA, 20 nt, Streptococcus pneumoniae R6
agugauuggagauacuuuuu

SEQ ID NO: 2182061 - RNA, 18 nt, Streptococcus pneumoniae R6
agugauggguucagaaua

SEQ ID NO: 2182062 - RNA, 22 nt, Streptococcus pneumoniae R6
agugcagcuuguuguuaaacaa

SEQ ID NO: 2182063 - RNA, 19 nt, Streptococcus pneumoniae R6
aguggauuuuuaagaaaga

SEQ ID NO: 2182064 - RNA, 20 nt, Streptococcus pneumoniae R6
aguggauuggcucaaucaau

SEQ ID NO: 2182065 - RNA, 14 nt, Streptococcus pneumoniae R6
aguggguugaagaa

SEQ ID NO: 2182066 - RNA, 22 nt, Streptococcus pneumoniae R6
agugguaucauauaaauauaga

SEQ ID NO: 2182067 - RNA, 17 nt, Streptococcus pneumoniae R6
aguggguggguaaagga

SEQ ID NO: 2182068 - RNA, 22 nt, Streptococcus pneumoniae R6
aguguauaagguucauuagaac

SEQ ID NO: 2182069 - RNA, 23 nt, Streptococcus pneumoniae R6
aguguauaagguucauuagaaca

SEQ ID NO: 2182070 - RNA, 15 nt, Streptococcus pneumoniae R6
agugguguuucaagu

SEQ ID NO: 2182071 - RNA, 17 nt, Streptococcus pneumoniae R6
aguugugaauuucauua

SEQ ID NO: 2182072 - RNA, 15 nt, Streptococcus pneumoniae R6
aguugccucagauuc

SEQ ID NO: 2182073 - RNA, 19 nt, Streptococcus pneumoniae R6
aguugccucagauucugac

SEQ ID NO: 2182074 - RNA, 22 nt, Streptococcus pneumoniae R6
aguugccucagauucugacaau

SEQ ID NO: 2182075 - RNA, 14 nt, Streptococcus pneumoniae R6
aguugcauuaaaau

SEQ ID NO: 2182076 - RNA, 14 nt, Streptococcus pneumoniae R6
aguuguacaagaaa

SEQ ID NO: 2182077 - RNA, 19 nt, Streptococcus pneumoniae R6
aguuguacaagaaaagugc

SEQ ID NO: 2182078 - RNA, 16 nt, Streptococcus pneumoniae R6
aguuuagauaaaacua

SEQ ID NO: 2182079 - RNA, 18 nt, Streptococcus pneumoniae R6
aguuuaucuagaauuucu

SEQ ID NO: 2182080 - RNA, 18 nt, Streptococcus pneumoniae R6
aguuuaucucacacaaag

SEQ ID NO: 2182081 - RNA, 13 nt, Streptococcus pneumoniae R6
aguuuaucucuug

SEQ ID NO: 2182082 - RNA, 21 nt, Streptococcus pneumoniae R6
aguuucaauauacuauaguag

SEQ ID NO: 2182083 - RNA, 12 nt, Streptococcus pneumoniae R6
aguuuaaaacau

SEQ ID NO: 2182084 - RNA, 22 nt, Streptococcus pneumoniae R6
aguuuaaacucagguuucucua

SEQ ID NO: 2182085 - RNA, 18 nt, Streptococcus pneumoniae R6
aguuguuugacgucugua

SEQ ID NO: 2182086 - RNA, 12 nt, Streptococcus pneumoniae R6
aguuguuuucua

SEQ ID NO: 2182087 - RNA, 19 nt, Streptococcus pneumoniae R6
aguuuacaauuagccuuca

SEQ ID NO: 2182088 - RNA, 20 nt, Streptococcus pneumoniae R6
aguuuuacggaucugaagcu

SEQ ID NO: 2182089 - RNA, 14 nt, Streptococcus pneumoniae R6
aguuuuaaucucaa

SEQ ID NO: 2182090 - RNA, 23 nt, Streptococcus pneumoniae R6
aguuuuaaucucaaaagaaagca

SEQ ID NO: 2182091 - RNA, 15 nt, Streptococcus pneumoniae R6
aguuugucuuucauu

SEQ ID NO: 2182092 - RNA, 20 nt, Streptococcus pneumoniae R6
aguuuggcgaugauuuccuu

SEQ ID NO: 2182093 - RNA, 22 nt, Streptococcus pneumoniae R6
aguuugcucuuugauuuucauu

SEQ ID NO: 2182094 - RNA, 15 nt, Streptococcus pneumoniae R6
aguuuguaucuuccu

SEQ ID NO: 2182095 - RNA, 18 nt, Streptococcus pneumoniae R6
aguuugaucaauugucug

SEQ ID NO: 2182096 - RNA, 17 nt, Streptococcus pneumoniae R6
aguuugaugagauuauu

SEQ ID NO: 2182097 - RNA, 19 nt, Streptococcus pneumoniae R6
aguuugcuuuuugauuuuu

SEQ ID NO: 2182098 - RNA, 16 nt, Streptococcus pneumoniae R6
aguuugauuucuggau

SEQ ID NO: 2182099 - RNA, 21 nt, Streptococcus pneumoniae R6
aguuucagcgaccaucauuuu

SEQ ID NO: 2182100 - RNA, 15 nt, Streptococcus pneumoniae R6
aguuucaauuugaua

SEQ ID NO: 2182101 - RNA, 16 nt, Streptococcus pneumoniae R6
aguuucaauuguagau

SEQ ID NO: 2182102 - RNA, 15 nt, Streptococcus pneumoniae R6
aguuuccccugccaa

SEQ ID NO: 2182103 - RNA, 17 nt, Streptococcus pneumoniae R6
aguuuccagucaucuga

SEQ ID NO: 2182104 - RNA, 17 nt, Streptococcus pneumoniae R6
aguuucauccacaaccu

SEQ ID NO: 2182105 - RNA, 22 nt, Streptococcus pneumoniae R6
aguuucauccacaaccucaaaa

SEQ ID NO: 2182106 - RNA, 17 nt, Streptococcus pneumoniae R6
aguuucaucuacaaccu

SEQ ID NO: 2182107 - RNA, 21 nt, Streptococcus pneumoniae R6
aguuucaucuacaaccucaaa

SEQ ID NO: 2182108 - RNA, 19 nt, Streptococcus pneumoniae R6
aguuucgcccaaccacuuc

SEQ ID NO: 2182109 - RNA, 23 nt, Streptococcus pneumoniae R6
aguuuccgaauaccugaaaccau

SEQ ID NO: 2182110 - RNA, 15 nt, Streptococcus pneumoniae R6
aguuuccgcaagauu

SEQ ID NO: 2182111 - RNA, 16 nt, Streptococcus pneumoniae R6
aguuucggcuguucuu

SEQ ID NO: 2182112 - RNA, 18 nt, Streptococcus pneumoniae R6
aguuucggcaccaauaca

SEQ ID NO: 2182113 - RNA, 20 nt, Streptococcus pneumoniae R6
aguuucucuacuaacucaaa

SEQ ID NO: 2182114 - RNA, 19 nt, Streptococcus pneumoniae R6
aguuucugggucucagucu

SEQ ID NO: 2182115 - RNA, 15 nt, Streptococcus pneumoniae R6
aguucuggaugccau

SEQ ID NO: 2182116 - RNA, 14 nt, Streptococcus pneumoniae R6
aguucuguacugca

SEQ ID NO: 2182117 - RNA, 21 nt, Streptococcus pneumoniae R6
aguucuucccaccauccucca

SEQ ID NO: 2182118 - RNA, 12 nt, Streptococcus pneumoniae R6
aguucucuuucu

SEQ ID NO: 2182119 - RNA, 18 nt, Streptococcus pneumoniae R6
aguucucuuucuaaaaua

SEQ ID NO: 2182120 - RNA, 15 nt, Streptococcus pneumoniae R6
aguucucaggaauua

SEQ ID NO: 2182121 - RNA, 20 nt, Streptococcus pneumoniae R6
aguugauaugagagauuucu

SEQ ID NO: 2182122 - RNA, 15 nt, Streptococcus pneumoniae R6
aguugauagaaagca

SEQ ID NO: 2182123 - RNA, 13 nt, Streptococcus pneumoniae R6
aguugauagaguu

SEQ ID NO: 2182124 - RNA, 18 nt, Streptococcus pneumoniae R6
aguucuucuaguugguuu

SEQ ID NO: 2182125 - RNA, 13 nt, Streptococcus pneumoniae R6
aguucuugaaaug

SEQ ID NO: 2182126 - RNA, 14 nt, Streptococcus pneumoniae R6
aguuccaucaaucu

SEQ ID NO: 2182127 - RNA, 20 nt, Streptococcus pneumoniae R6
aguuccauccacaaccuuaa

SEQ ID NO: 2182128 - RNA, 23 nt, Streptococcus pneumoniae R6
aguucauuuuuuaugguguuuua

SEQ ID NO: 2182129 - RNA, 14 nt, Streptococcus pneumoniae R6
aguuccaaacuuag

SEQ ID NO: 2182130 - RNA, 13 nt, Streptococcus pneumoniae R6
aguucauuuuucc

SEQ ID NO: 2182131 - RNA, 15 nt, Streptococcus pneumoniae R6
aguucauuuuuccuu

SEQ ID NO: 2182132 - RNA, 12 nt, Streptococcus pneumoniae R6
aguucauuuucu

SEQ ID NO: 2182133 - RNA, 22 nt, Streptococcus pneumoniae R6
aguucauuuucuuuacuucuga

SEQ ID NO: 2182134 - RNA, 12 nt, Streptococcus pneumoniae R6
aguucuaucuac

SEQ ID NO: 2182135 - RNA, 14 nt, Streptococcus pneumoniae R6
aguucuaucuacaa

SEQ ID NO: 2182136 - RNA, 18 nt, Streptococcus pneumoniae R6
aguucuaucuacaaccuc

SEQ ID NO: 2182137 - RNA, 12 nt, Streptococcus pneumoniae R6
aguucuaucugc

SEQ ID NO: 2182138 - RNA, 21 nt, Streptococcus pneumoniae R6
aguucuaucugcaaccucaaa

SEQ ID NO: 2182139 - RNA, 22 nt, Streptococcus pneumoniae R6
aguucuaucugcaaccuuaaaa

SEQ ID NO: 2182140 - RNA, 14 nt, Streptococcus pneumoniae R6
aguucgugccaauc

SEQ ID NO: 2182141 - RNA, 15 nt, Streptococcus pneumoniae R6
agugucauaguccug

SEQ ID NO: 2182142 - RNA, 16 nt, Streptococcus pneumoniae R6
agugguucacuggcau

SEQ ID NO: 2182143 - RNA, 22 nt, Streptococcus pneumoniae R6
aguuaaucuacgcuuuaaaaau

SEQ ID NO: 2182144 - RNA, 17 nt, Streptococcus pneumoniae R6
aguuacucaggauaaaa

SEQ ID NO: 2182145 - RNA, 16 nt, Streptococcus pneumoniae R6
aguuacggguuuuaaa

SEQ ID NO: 2182146 - RNA, 21 nt, Streptococcus pneumoniae R6
aguuacaaacucucauuaaaa

SEQ ID NO: 2182147 - RNA, 19 nt, Streptococcus pneumoniae R6
aguuaccuaaauuaugaug

SEQ ID NO: 2182148 - RNA, 17 nt, Streptococcus pneumoniae R6
aguuaucguaauuaaag

SEQ ID NO: 2182149 - RNA, 22 nt, Streptococcus pneumoniae R6
aguuaucguaauuaaaguuaau

SEQ ID NO: 2182150 - RNA, 20 nt, Streptococcus pneumoniae R6
aguuauuaacagcaaaaagg

SEQ ID NO: 2182151 - RNA, 14 nt, Streptococcus pneumoniae R6
aguuaugauauauu

SEQ ID NO: 2182152 - RNA, 23 nt, Streptococcus pneumoniae R6
aguuaugaaaaagauuuuuuaaa

SEQ ID NO: 2182153 - RNA, 14 nt, Streptococcus pneumoniae R6
aguucacucaaacc

SEQ ID NO: 2182154 - RNA, 14 nt, Streptococcus pneumoniae R6
aguucacugaacua

SEQ ID NO: 2182155 - RNA, 15 nt, Streptococcus pneumoniae R6
aguucagaauuuucu

SEQ ID NO: 2182156 - RNA, 17 nt, Streptococcus pneumoniae R6
aguucagaauuuucuua

SEQ ID NO: 2182157 - RNA, 20 nt, Streptococcus pneumoniae R6
aguucauguuucggaucaua

SEQ ID NO: 2182158 - RNA, 18 nt, Streptococcus pneumoniae R6
aucuuccuacauauguaa

SEQ ID NO: 2182159 - RNA, 17 nt, Streptococcus pneumoniae R6
aucuuccuaggauaaag

SEQ ID NO: 2182160 - RNA, 20 nt, Streptococcus pneumoniae R6
aucuuccuaggauaaagcaa

SEQ ID NO: 2182161 - RNA, 11 nt, Streptococcus pneumoniae R6
aucuuccuuga

SEQ ID NO: 2182162 - RNA, 22 nt, Streptococcus pneumoniae R6
aucuucgcaacugucuuaucca

SEQ ID NO: 2182163 - RNA, 16 nt, Streptococcus pneumoniae R6
aucuucggauaaauua

SEQ ID NO: 2182164 - RNA, 12 nt, Streptococcus pneumoniae R6
aucuucuaaauu

SEQ ID NO: 2182165 - RNA, 13 nt, Streptococcus pneumoniae R6
aucuucuaaauua

SEQ ID NO: 2182166 - RNA, 16 nt, Streptococcus pneumoniae R6
aucuucggauuuuucu

SEQ ID NO: 2182167 - RNA, 17 nt, Streptococcus pneumoniae R6
aucuuuuauuugaguaa

SEQ ID NO: 2182168 - RNA, 18 nt, Streptococcus pneumoniae R6
aucuuuuauuuuuauaac

SEQ ID NO: 2182169 - RNA, 15 nt, Streptococcus pneumoniae R6
aucuuuuacuucuga

SEQ ID NO: 2182170 - RNA, 16 nt, Streptococcus pneumoniae R6
aucuuuuacuucugaa

SEQ ID NO: 2182171 - RNA, 12 nt, Streptococcus pneumoniae R6
augaaaaaguuu

SEQ ID NO: 2182172 - RNA, 21 nt, Streptococcus pneumoniae R6
augaaaaagauuuuuuaaaaa

SEQ ID NO: 2182173 - RNA, 18 nt, Streptococcus pneumoniae R6
augaaaugagaaauuaug

SEQ ID NO: 2182174 - RNA, 15 nt, Streptococcus pneumoniae R6
augaaauacugaugu

SEQ ID NO: 2182175 - RNA, 22 nt, Streptococcus pneumoniae R6
augaaauaaaauuugaacaaau

SEQ ID NO: 2182176 - RNA, 14 nt, Streptococcus pneumoniae R6
augaaaaucaaaga

SEQ ID NO: 2182177 - RNA, 16 nt, Streptococcus pneumoniae R6
augaaaaucauagaaa

SEQ ID NO: 2182178 - RNA, 22 nt, Streptococcus pneumoniae R6
augaaaaucccucccauuuugu

SEQ ID NO: 2182179 - RNA, 22 nt, Streptococcus pneumoniae R6
augaaaaggcagauucucuauc

SEQ ID NO: 2182180 - RNA, 14 nt, Streptococcus pneumoniae R6
augaaauuuaaaaa

SEQ ID NO: 2182181 - RNA, 16 nt, Streptococcus pneumoniae R6
augaaauuuaaaaaga

SEQ ID NO: 2182182 - RNA, 17 nt, Streptococcus pneumoniae R6
augaaauuuaaaaagaa

SEQ ID NO: 2182183 - RNA, 19 nt, Streptococcus pneumoniae R6
augaaauuuuucugcuucu

SEQ ID NO: 2182184 - RNA, 18 nt, Streptococcus pneumoniae R6
augaacaaaucaauugcu

SEQ ID NO: 2182185 - RNA, 23 nt, Streptococcus pneumoniae R6
augaacacuagaggggugauuuu

SEQ ID NO: 2182186 - RNA, 17 nt, Streptococcus pneumoniae R6
augaaccugcuuaagau

SEQ ID NO: 2182187 - RNA, 21 nt, Streptococcus pneumoniae R6
augaaccucuucauucaaaga

SEQ ID NO: 2182188 - RNA, 20 nt, Streptococcus pneumoniae R6
augaaggaguugcuccaugc

SEQ ID NO: 2182189 - RNA, 16 nt, Streptococcus pneumoniae R6
augaaucugaaucaaa

SEQ ID NO: 2182190 - RNA, 21 nt, Streptococcus pneumoniae R6
augaaucugccagauuccuga

SEQ ID NO: 2182191 - RNA, 14 nt, Streptococcus pneumoniae R6
augaaguguuguaa

SEQ ID NO: 2182192 - RNA, 14 nt, Streptococcus pneumoniae R6
augaaguaaauauu

SEQ ID NO: 2182193 - RNA, 15 nt, Streptococcus pneumoniae R6
augaaguaaauguga

SEQ ID NO: 2182194 - RNA, 23 nt, Streptococcus pneumoniae R6
augaaggucuuuugucuugcuug

SEQ ID NO: 2182195 - RNA, 17 nt, Streptococcus pneumoniae R6
augacaaaaauaguaua

SEQ ID NO: 2182196 - RNA, 18 nt, Streptococcus pneumoniae R6
augacaaaacguucccaa

SEQ ID NO: 2182197 - RNA, 13 nt, Streptococcus pneumoniae R6
augaauuucuaca

SEQ ID NO: 2182198 - RNA, 15 nt, Streptococcus pneumoniae R6
augaauuugaaacaa

SEQ ID NO: 2182199 - RNA, 23 nt, Streptococcus pneumoniae R6
augaauuuacguugaauagcugc

SEQ ID NO: 2182200 - RNA, 18 nt, Streptococcus pneumoniae R6
augacuggacggugaucu

SEQ ID NO: 2182201 - RNA, 18 nt, Streptococcus pneumoniae R6
augacuguuaaucaugau

SEQ ID NO: 2182202 - RNA, 13 nt, Streptococcus pneumoniae R6
augacuucuuaau

SEQ ID NO: 2182203 - RNA, 16 nt, Streptococcus pneumoniae R6
augacuauaccacucu

SEQ ID NO: 2182204 - RNA, 12 nt, Streptococcus pneumoniae R6
augacugagagc

SEQ ID NO: 2182205 - RNA, 14 nt, Streptococcus pneumoniae R6
augacugagagcua

SEQ ID NO: 2182206 - RNA, 17 nt, Streptococcus pneumoniae R6
augacagugauuaaaac

SEQ ID NO: 2182207 - RNA, 20 nt, Streptococcus pneumoniae R6
augacagugauuaaaacugc

SEQ ID NO: 2182208 - RNA, 19 nt, Streptococcus pneumoniae R6
augacuuuuaagaaaucau

SEQ ID NO: 2182209 - RNA, 17 nt, Streptococcus pneumoniae R6
augacuuucuaauuauu

SEQ ID NO: 2182210 - RNA, 20 nt, Streptococcus pneumoniae R6
augacuuucuaauuauuuca

SEQ ID NO: 2182211 - RNA, 22 nt, Streptococcus pneumoniae R6
augacuuguguuuuuccuuuga

SEQ ID NO: 2182212 - RNA, 22 nt, Streptococcus pneumoniae R6
augagcuggaagaauuuaaaaa

SEQ ID NO: 2182213 - RNA, 21 nt, Streptococcus pneumoniae R6
augaggaaaaucuucccacaa

SEQ ID NO: 2182214 - RNA, 23 nt, Streptococcus pneumoniae R6
augaggaaaaucuucccacaaua

SEQ ID NO: 2182215 - RNA, 18 nt, Streptococcus pneumoniae R6
augagcuagguucaacaa

SEQ ID NO: 2182216 - RNA, 18 nt, Streptococcus pneumoniae R6
augagcgucuuucuuauc

SEQ ID NO: 2182217 - RNA, 22 nt, Streptococcus pneumoniae R6
augagcuccguacgcuccugaa

SEQ ID NO: 2182218 - RNA, 15 nt, Streptococcus pneumoniae R6
augaguccgaaaaau

SEQ ID NO: 2182219 - RNA, 21 nt, Streptococcus pneumoniae R6
augaguccgaaaaauuucuca

SEQ ID NO: 2182220 - RNA, 21 nt, Streptococcus pneumoniae R6
augagucuaucaaacaggaug

SEQ ID NO: 2182221 - RNA, 19 nt, Streptococcus pneumoniae R6
augaguauaagguuacuuu

SEQ ID NO: 2182222 - RNA, 22 nt, Streptococcus pneumoniae R6
augaguauaagguuacuuuaua

SEQ ID NO: 2182223 - RNA, 23 nt, Streptococcus pneumoniae R6
augagguaagagaacuucacguu

SEQ ID NO: 2182224 - RNA, 16 nt, Streptococcus pneumoniae R6
augaggagaaagaaga

SEQ ID NO: 2182225 - RNA, 15 nt, Streptococcus pneumoniae R6
augaguuugcuuuug

SEQ ID NO: 2182226 - RNA, 20 nt, Streptococcus pneumoniae R6
augaguggagccccuugaua

SEQ ID NO: 2182227 - RNA, 17 nt, Streptococcus pneumoniae R6
augaguggcaggaauau

SEQ ID NO: 2182228 - RNA, 22 nt, Streptococcus pneumoniae R6
augauaaugguaucacauucaa

SEQ ID NO: 2182229 - RNA, 16 nt, Streptococcus pneumoniae R6
augauaauugauuaag

SEQ ID NO: 2182230 - RNA, 14 nt, Streptococcus pneumoniae R6
augauacccaaaau

SEQ ID NO: 2182231 - RNA, 14 nt, Streptococcus pneumoniae R6
augauacgcucagc

SEQ ID NO: 2182232 - RNA, 20 nt, Streptococcus pneumoniae R6
augauauacacacuuaaauu

SEQ ID NO: 2182233 - RNA, 22 nt, Streptococcus pneumoniae R6
augauagcuagcgcaucaacau

SEQ ID NO: 2182234 - RNA, 15 nt, Streptococcus pneumoniae R6
augauauuuucaaaa

SEQ ID NO: 2182235 - RNA, 19 nt, Streptococcus pneumoniae R6
augauaucugguauauuuu

SEQ ID NO: 2182236 - RNA, 15 nt, Streptococcus pneumoniae R6
augauccuucauucg

SEQ ID NO: 2182237 - RNA, 15 nt, Streptococcus pneumoniae R6
aucucuuuauugguu

SEQ ID NO: 2182238 - RNA, 18 nt, Streptococcus pneumoniae R6
aucucuuuauugguuaaa

SEQ ID NO: 2182239 - RNA, 23 nt, Streptococcus pneumoniae R6
aucucuuugaaggugauaaucau

SEQ ID NO: 2182240 - RNA, 15 nt, Streptococcus pneumoniae R6
aucucuuugaggucu

SEQ ID NO: 2182241 - RNA, 15 nt, Streptococcus pneumoniae R6
aucucuuuccacacu

SEQ ID NO: 2182242 - RNA, 20 nt, Streptococcus pneumoniae R6
aucucuggaucuacuuuuuu

SEQ ID NO: 2182243 - RNA, 17 nt, Streptococcus pneumoniae R6
aucucuuguaacccaaa

SEQ ID NO: 2182244 - RNA, 13 nt, Streptococcus pneumoniae R6
aucucucugcgga

SEQ ID NO: 2182245 - RNA, 21 nt, Streptococcus pneumoniae R6
aucucugauaauauuuucuuu

SEQ ID NO: 2182246 - RNA, 12 nt, Streptococcus pneumoniae R6
aucucauuugau

SEQ ID NO: 2182247 - RNA, 19 nt, Streptococcus pneumoniae R6
aucuccaaccaucaaaaua

SEQ ID NO: 2182248 - RNA, 21 nt, Streptococcus pneumoniae R6
aucuccaacugcuguuguuac

SEQ ID NO: 2182249 - RNA, 14 nt, Streptococcus pneumoniae R6
aucucaucuucacu

SEQ ID NO: 2182250 - RNA, 20 nt, Streptococcus pneumoniae R6
aucuccagaccaccuuccuu

SEQ ID NO: 2182251 - RNA, 13 nt, Streptococcus pneumoniae R6
aucuccuacuucc

SEQ ID NO: 2182252 - RNA, 19 nt, Streptococcus pneumoniae R6
aucuccuacuucccaccca

SEQ ID NO: 2182253 - RNA, 11 nt, Streptococcus pneumoniae R6
aucuccuuggc

SEQ ID NO: 2182254 - RNA, 13 nt, Streptococcus pneumoniae R6
aucuagauaguac

SEQ ID NO: 2182255 - RNA, 16 nt, Streptococcus pneumoniae R6
aucuagauaguaccau

SEQ ID NO: 2182256 - RNA, 12 nt, Streptococcus pneumoniae R6
aucuacaaccuc

SEQ ID NO: 2182257 - RNA, 18 nt, Streptococcus pneumoniae R6
aucuacaaccucaaaaca

SEQ ID NO: 2182258 - RNA, 18 nt, Streptococcus pneumoniae R6
aucuacaaccucaaaacc

SEQ ID NO: 2182259 - RNA, 19 nt, Streptococcus pneumoniae R6
aucuacaaccucaaaacca

SEQ ID NO: 2182260 - RNA, 12 nt, Streptococcus pneumoniae R6
aucuacaaccuu

SEQ ID NO: 2182261 - RNA, 16 nt, Streptococcus pneumoniae R6
aucuacaaccuuaaaa

SEQ ID NO: 2182262 - RNA, 19 nt, Streptococcus pneumoniae R6
aucuacaaccuuaaaacag

SEQ ID NO: 2182263 - RNA, 14 nt, Streptococcus pneumoniae R6
aucuacaauugaaa

SEQ ID NO: 2182264 - RNA, 22 nt, Streptococcus pneumoniae R6
aucgucaagcaguaauauagga

SEQ ID NO: 2182265 - RNA, 23 nt, Streptococcus pneumoniae R6
aucgucaagcaguaauauaggag

SEQ ID NO: 2182266 - RNA, 17 nt, Streptococcus pneumoniae R6
aucguauguuguagcag

SEQ ID NO: 2182267 - RNA, 18 nt, Streptococcus pneumoniae R6
aucguaucuuuggacaua

SEQ ID NO: 2182268 - RNA, 22 nt, Streptococcus pneumoniae R6
aucgucaucaccaaucuuacca

SEQ ID NO: 2182269 - RNA, 20 nt, Streptococcus pneumoniae R6
aucucacguaacauauuuuc

SEQ ID NO: 2182270 - RNA, 14 nt, Streptococcus pneumoniae R6
aucuauccauuugg

SEQ ID NO: 2182271 - RNA, 16 nt, Streptococcus pneumoniae R6
aucuaucaaaagaugu

SEQ ID NO: 2182272 - RNA, 17 nt, Streptococcus pneumoniae R6
aucuaucaaaagauguu

SEQ ID NO: 2182273 - RNA, 15 nt, Streptococcus pneumoniae R6
aucuaucuauuuuua

SEQ ID NO: 2182274 - RNA, 21 nt, Streptococcus pneumoniae R6
aucuauagcuuuuuauauaua

SEQ ID NO: 2182275 - RNA, 12 nt, Streptococcus pneumoniae R6
aucuagucauca

SEQ ID NO: 2182276 - RNA, 13 nt, Streptococcus pneumoniae R6
aucuagucaucag

SEQ ID NO: 2182277 - RNA, 15 nt, Streptococcus pneumoniae R6
aucuagucguuuaag

SEQ ID NO: 2182278 - RNA, 13 nt, Streptococcus pneumoniae R6
aucuagauuugga

SEQ ID NO: 2182279 - RNA, 17 nt, Streptococcus pneumoniae R6
aucuagcucccuuaguu

SEQ ID NO: 2182280 - RNA, 18 nt, Streptococcus pneumoniae R6
aucuagcugagacaggga

SEQ ID NO: 2182281 - RNA, 21 nt, Streptococcus pneumoniae R6
aucuucagcagcuaaaaacac

SEQ ID NO: 2182282 - RNA, 13 nt, Streptococcus pneumoniae R6
aucuuccauaucu

SEQ ID NO: 2182283 - RNA, 17 nt, Streptococcus pneumoniae R6
aucuucccacaauaaaa

SEQ ID NO: 2182284 - RNA, 21 nt, Streptococcus pneumoniae R6
aucuucccacaauaaaaagca

SEQ ID NO: 2182285 - RNA, 17 nt, Streptococcus pneumoniae R6
aucuuacuguccuucuu

SEQ ID NO: 2182286 - RNA, 15 nt, Streptococcus pneumoniae R6
aucuuagcaaagaua

SEQ ID NO: 2182287 - RNA, 21 nt, Streptococcus pneumoniae R6
aucuuaggaacacguaaauua

SEQ ID NO: 2182288 - RNA, 22 nt, Streptococcus pneumoniae R6
aucuuaguuaaaauaaguuaga

SEQ ID NO: 2182289 - RNA, 23 nt, Streptococcus pneumoniae R6
aucuuagguugguugcuuccucc

SEQ ID NO: 2182290 - RNA, 19 nt, Streptococcus pneumoniae R6
aucuuaguaguuuguauaa

SEQ ID NO: 2182291 - RNA, 23 nt, Streptococcus pneumoniae R6
aucuuaguaguuuguauaauccc

SEQ ID NO: 2182292 - RNA, 15 nt, Streptococcus pneumoniae R6
aucuuagucaaaaca

SEQ ID NO: 2182293 - RNA, 16 nt, Streptococcus pneumoniae R6
aucuuagucaaaacaa

SEQ ID NO: 2182294 - RNA, 19 nt, Streptococcus pneumoniae R6
aucuuauagcgacuauaaa

SEQ ID NO: 2182295 - RNA, 13 nt, Streptococcus pneumoniae R6
aucuuaucucuau

SEQ ID NO: 2182296 - RNA, 14 nt, Streptococcus pneumoniae R6
aucuucaaaaucaa

SEQ ID NO: 2182297 - RNA, 18 nt, Streptococcus pneumoniae R6
aucuucaaaaucaaagaa

SEQ ID NO: 2182298 - RNA, 14 nt, Streptococcus pneumoniae R6
aucuuauugauuuu

SEQ ID NO: 2182299 - RNA, 15 nt, Streptococcus pneumoniae R6
aucuuauugauuuuu

SEQ ID NO: 2182300 - RNA, 19 nt, Streptococcus pneumoniae R6
aucuuauuucaauucacua

SEQ ID NO: 2182301 - RNA, 16 nt, Streptococcus pneumoniae R6
aucuucaaaaaagugu

SEQ ID NO: 2182302 - RNA, 17 nt, Streptococcus pneumoniae R6
aucugaauguuucccuu

SEQ ID NO: 2182303 - RNA, 13 nt, Streptococcus pneumoniae R6
aucugaaucaaaa

SEQ ID NO: 2182304 - RNA, 15 nt, Streptococcus pneumoniae R6
aucugaaucaaaauu

SEQ ID NO: 2182305 - RNA, 11 nt, Streptococcus pneumoniae R6
aucugaagcuu

SEQ ID NO: 2182306 - RNA, 14 nt, Streptococcus pneumoniae R6
aucuggauuuucaa

SEQ ID NO: 2182307 - RNA, 14 nt, Streptococcus pneumoniae R6
aucuggauuuucag

SEQ ID NO: 2182308 - RNA, 20 nt, Streptococcus pneumoniae R6
aucuggauuuucagccucua

SEQ ID NO: 2182309 - RNA, 14 nt, Streptococcus pneumoniae R6
aucugcuaaaacaa

SEQ ID NO: 2182310 - RNA, 18 nt, Streptococcus pneumoniae R6
aucuuaaauuuucgagau

SEQ ID NO: 2182311 - RNA, 12 nt, Streptococcus pneumoniae R6
aucuuaaaguua

SEQ ID NO: 2182312 - RNA, 19 nt, Streptococcus pneumoniae R6
aucuguuuuaaacguucaa

SEQ ID NO: 2182313 - RNA, 20 nt, Streptococcus pneumoniae R6
aucuguuuguauuguuuuau

SEQ ID NO: 2182314 - RNA, 15 nt, Streptococcus pneumoniae R6
aucuguuuaaauuca

SEQ ID NO: 2182315 - RNA, 16 nt, Streptococcus pneumoniae R6
aucuguauuuggcauu

SEQ ID NO: 2182316 - RNA, 21 nt, Streptococcus pneumoniae R6
aucugucacaauccagccugc

SEQ ID NO: 2182317 - RNA, 23 nt, Streptococcus pneumoniae R6
aucuggcuuucuguaaucuuacc

SEQ ID NO: 2182318 - RNA, 16 nt, Streptococcus pneumoniae R6
aucuggcgucuuaccu

SEQ ID NO: 2182319 - RNA, 18 nt, Streptococcus pneumoniae R6
aucauuauccaugauaaa

SEQ ID NO: 2182320 - RNA, 19 nt, Streptococcus pneumoniae R6
aaaagaaaccaaucagacu

SEQ ID NO: 2182321 - RNA, 20 nt, Streptococcus pneumoniae R6
aucauuucuucuggaaguuc

SEQ ID NO: 2182322 - RNA, 18 nt, Streptococcus pneumoniae R6
aucauuugaaucaaaaau

SEQ ID NO: 2182323 - RNA, 16 nt, Streptococcus pneumoniae R6
aucauuuggaaaacaa

SEQ ID NO: 2182324 - RNA, 13 nt, Streptococcus pneumoniae R6
aucauuuccauug

SEQ ID NO: 2182325 - RNA, 18 nt, Streptococcus pneumoniae R6
aucauuuccauuguuguu

SEQ ID NO: 2182326 - RNA, 23 nt, Streptococcus pneumoniae R6
aucauuuccauuguuguuucuug

SEQ ID NO: 2182327 - RNA, 20 nt, Streptococcus pneumoniae R6
aaaacuuacaaugucuaaau

SEQ ID NO: 2182328 - RNA, 14 nt, Streptococcus pneumoniae R6
aaaacuuacuacac

SEQ ID NO: 2182329 - RNA, 17 nt, Streptococcus pneumoniae R6
aaaacuuucauaaugga

SEQ ID NO: 2182330 - RNA, 19 nt, Streptococcus pneumoniae R6
aaaacuuuuuaaaaaaucu

SEQ ID NO: 2182331 - RNA, 12 nt, Streptococcus pneumoniae R6
aaaacuuuuaaa

SEQ ID NO: 2182332 - RNA, 15 nt, Streptococcus pneumoniae R6
aaaacuuuuaaaauc

SEQ ID NO: 2182333 - RNA, 15 nt, Streptococcus pneumoniae R6
aucauguuucaacau

SEQ ID NO: 2182334 - RNA, 14 nt, Streptococcus pneumoniae R6
aucauguuuuuaag

SEQ ID NO: 2182335 - RNA, 15 nt, Streptococcus pneumoniae R6
aucauuaaaauaacu

SEQ ID NO: 2182336 - RNA, 19 nt, Streptococcus pneumoniae R6
aucauuaaagaccaaagaa

SEQ ID NO: 2182337 - RNA, 15 nt, Streptococcus pneumoniae R6
aaaacuaauuuagag

SEQ ID NO: 2182338 - RNA, 23 nt, Streptococcus pneumoniae R6
aaaacuaauuuagagaaugaaau

SEQ ID NO: 2182339 - RNA, 13 nt, Streptococcus pneumoniae R6
auccaaucuauuu

SEQ ID NO: 2182340 - RNA, 20 nt, Streptococcus pneumoniae R6
auccaaguuuggcagacacc

SEQ ID NO: 2182341 - RNA, 22 nt, Streptococcus pneumoniae R6
auccaaguuuggcagacaccaa

SEQ ID NO: 2182342 - RNA, 20 nt, Streptococcus pneumoniae R6
auccaagcgucugaggcaac

SEQ ID NO: 2182343 - RNA, 19 nt, Streptococcus pneumoniae R6
auccaagcuucuacagaug

SEQ ID NO: 2182344 - RNA, 13 nt, Streptococcus pneumoniae R6
aucauuuuauuca

SEQ ID NO: 2182345 - RNA, 15 nt, Streptococcus pneumoniae R6
aucauuuuauucaua

SEQ ID NO: 2182346 - RNA, 21 nt, Streptococcus pneumoniae R6
aucauuuuauucauaucccca

SEQ ID NO: 2182347 - RNA, 16 nt, Streptococcus pneumoniae R6
auccaaaagcaggagu

SEQ ID NO: 2182348 - RNA, 12 nt, Streptococcus pneumoniae R6
auccagaaaugg

SEQ ID NO: 2182349 - RNA, 23 nt, Streptococcus pneumoniae R6
auccagaaauggaaguuucaaaa

SEQ ID NO: 2182350 - RNA, 18 nt, Streptococcus pneumoniae R6
auccacuugugucauaau

SEQ ID NO: 2182351 - RNA, 18 nt, Streptococcus pneumoniae R6
auccacuugggaaaccaa

SEQ ID NO: 2182352 - RNA, 19 nt, Streptococcus pneumoniae R6
auccacuugggaaaccaaa

SEQ ID NO: 2182353 - RNA, 23 nt, Streptococcus pneumoniae R6
auccacuugggaaaccaaacgga

SEQ ID NO: 2182354 - RNA, 14 nt, Streptococcus pneumoniae R6
auccacccccaaga

SEQ ID NO: 2182355 - RNA, 19 nt, Streptococcus pneumoniae R6
auccagccuucauaaaagu

SEQ ID NO: 2182356 - RNA, 18 nt, Streptococcus pneumoniae R6
auccagcaggagaaaguu

SEQ ID NO: 2182357 - RNA, 14 nt, Streptococcus pneumoniae R6
auccauucuuuuuu

SEQ ID NO: 2182358 - RNA, 13 nt, Streptococcus pneumoniae R6
auccauucuuaaa

SEQ ID NO: 2182359 - RNA, 16 nt, Streptococcus pneumoniae R6
auccauucuuaaaauu

SEQ ID NO: 2182360 - RNA, 14 nt, Streptococcus pneumoniae R6
auccauucacaaca

SEQ ID NO: 2182361 - RNA, 12 nt, Streptococcus pneumoniae R6
auccauuauaca

SEQ ID NO: 2182362 - RNA, 20 nt, Streptococcus pneumoniae R6
auccauuuguuuaaagacga

SEQ ID NO: 2182363 - RNA, 22 nt, Streptococcus pneumoniae R6
auccauuuggguaggucuuuuu

SEQ ID NO: 2182364 - RNA, 13 nt, Streptococcus pneumoniae R6
aucccaguggcua

SEQ ID NO: 2182365 - RNA, 22 nt, Streptococcus pneumoniae R6
aucccuacaaggaagccuucuu

SEQ ID NO: 2182366 - RNA, 18 nt, Streptococcus pneumoniae R6
aucccucuuuuuacaauu

SEQ ID NO: 2182367 - RNA, 22 nt, Streptococcus pneumoniae R6
aucccucuuuuuacaauuguaa

SEQ ID NO: 2182368 - RNA, 23 nt, Streptococcus pneumoniae R6
aucccucuuuuuacaauuguaaa

SEQ ID NO: 2182369 - RNA, 14 nt, Streptococcus pneumoniae R6
aucccuccauuuca

SEQ ID NO: 2182370 - RNA, 15 nt, Streptococcus pneumoniae R6
aucccuccauuucau

SEQ ID NO: 2182371 - RNA, 17 nt, Streptococcus pneumoniae R6
auccgaagaaggccaaa

SEQ ID NO: 2182372 - RNA, 14 nt, Streptococcus pneumoniae R6
aucccuuuaccauu

SEQ ID NO: 2182373 - RNA, 18 nt, Streptococcus pneumoniae R6
aucccuuguuccaagaug

SEQ ID NO: 2182374 - RNA, 16 nt, Streptococcus pneumoniae R6
aucccucggcuuuuuu

SEQ ID NO: 2182375 - RNA, 15 nt, Streptococcus pneumoniae R6
aucgcuaucaauggu

SEQ ID NO: 2182376 - RNA, 14 nt, Streptococcus pneumoniae R6
aucgcuaagagggu

SEQ ID NO: 2182377 - RNA, 15 nt, Streptococcus pneumoniae R6
aucguaaaaaagucu

SEQ ID NO: 2182378 - RNA, 20 nt, Streptococcus pneumoniae R6
aucgguuuaucucccauacc

SEQ ID NO: 2182379 - RNA, 17 nt, Streptococcus pneumoniae R6
aucgguaggaugacaac

SEQ ID NO: 2182380 - RNA, 21 nt, Streptococcus pneumoniae R6
auccuugaugcgauugauuuc

SEQ ID NO: 2182381 - RNA, 18 nt, Streptococcus pneumoniae R6
auccugccccugaugagc

SEQ ID NO: 2182382 - RNA, 21 nt, Streptococcus pneumoniae R6
auccugcgaaaucuuugauuu

SEQ ID NO: 2182383 - RNA, 22 nt, Streptococcus pneumoniae R6
auccugcgaaaucuuugauuuc

SEQ ID NO: 2182384 - RNA, 23 nt, Streptococcus pneumoniae R6
auccgcuugggaaaccaaacgga

SEQ ID NO: 2182385 - RNA, 22 nt, Streptococcus pneumoniae R6
auccgcuaucuuauugauuuuu

SEQ ID NO: 2182386 - RNA, 22 nt, Streptococcus pneumoniae R6
aucgccaaaucaucaaauugaa

SEQ ID NO: 2182387 - RNA, 15 nt, Streptococcus pneumoniae R6
aucgaucauauuuau

SEQ ID NO: 2182388 - RNA, 14 nt, Streptococcus pneumoniae R6
aucgauagauuuuu

SEQ ID NO: 2182389 - RNA, 14 nt, Streptococcus pneumoniae R6
aucgauaccuucag

SEQ ID NO: 2182390 - RNA, 18 nt, Streptococcus pneumoniae R6
aucgauacgauuaggaac

SEQ ID NO: 2182391 - RNA, 13 nt, Streptococcus pneumoniae R6
aucgacuacuaaa

SEQ ID NO: 2182392 - RNA, 17 nt, Streptococcus pneumoniae R6
aucgacgcuuucuaagg

SEQ ID NO: 2182393 - RNA, 20 nt, Streptococcus pneumoniae R6
aucgacaagauacccacaaa

SEQ ID NO: 2182394 - RNA, 12 nt, Streptococcus pneumoniae R6
auacgcccucca

SEQ ID NO: 2182395 - RNA, 14 nt, Streptococcus pneumoniae R6
auacgaucugaaau

SEQ ID NO: 2182396 - RNA, 16 nt, Streptococcus pneumoniae R6
auacgaucugaaauaa

SEQ ID NO: 2182397 - RNA, 13 nt, Streptococcus pneumoniae R6
auaccuuuuccuu

SEQ ID NO: 2182398 - RNA, 21 nt, Streptococcus pneumoniae R6
auaccuuuuccuucauuucca

SEQ ID NO: 2182399 - RNA, 13 nt, Streptococcus pneumoniae R6
auacgaaucuggu

SEQ ID NO: 2182400 - RNA, 20 nt, Streptococcus pneumoniae R6
auacgacgauuccguuugag

SEQ ID NO: 2182401 - RNA, 18 nt, Streptococcus pneumoniae R6
auacgaccaaucuuuucc

SEQ ID NO: 2182402 - RNA, 15 nt, Streptococcus pneumoniae R6
auacgauaaaaauca

SEQ ID NO: 2182403 - RNA, 14 nt, Streptococcus pneumoniae R6
auaccugaaaccau

SEQ ID NO: 2182404 - RNA, 18 nt, Streptococcus pneumoniae R6
auacuugaaucuggcuuu

SEQ ID NO: 2182405 - RNA, 12 nt, Streptococcus pneumoniae R6
auacuuacucuu

SEQ ID NO: 2182406 - RNA, 13 nt, Streptococcus pneumoniae R6
auacuuauccuuu

SEQ ID NO: 2182407 - RNA, 20 nt, Streptococcus pneumoniae R6
auacuuauccuuuuuuacuu

SEQ ID NO: 2182408 - RNA, 21 nt, Streptococcus pneumoniae R6
auacugcccugaaaucccaua

SEQ ID NO: 2182409 - RNA, 19 nt, Streptococcus pneumoniae R6
auacugcucgguaaaacau

SEQ ID NO: 2182410 - RNA, 18 nt, Streptococcus pneumoniae R6
auacucugugaaaaucau

SEQ ID NO: 2182411 - RNA, 15 nt, Streptococcus pneumoniae R6
auacucuaauugaaa

SEQ ID NO: 2182412 - RNA, 12 nt, Streptococcus pneumoniae R6
auacucaaugaa

SEQ ID NO: 2182413 - RNA, 13 nt, Streptococcus pneumoniae R6
auacucaaugaaa

SEQ ID NO: 2182414 - RNA, 21 nt, Streptococcus pneumoniae R6
auacucaucuguuuucaaaaa

SEQ ID NO: 2182415 - RNA, 12 nt, Streptococcus pneumoniae R6
auacucaucugc

SEQ ID NO: 2182416 - RNA, 17 nt, Streptococcus pneumoniae R6
auacucaucugcuuuca

SEQ ID NO: 2182417 - RNA, 21 nt, Streptococcus pneumoniae R6
auacucaucugcuuucaaaaa

SEQ ID NO: 2182418 - RNA, 14 nt, Streptococcus pneumoniae R6
auacuccaaaacau

SEQ ID NO: 2182419 - RNA, 13 nt, Streptococcus pneumoniae R6
auacuauuuuugu

SEQ ID NO: 2182420 - RNA, 16 nt, Streptococcus pneumoniae R6
auacuauuuuugucau

SEQ ID NO: 2182421 - RNA, 20 nt, Streptococcus pneumoniae R6
auacuaugcguuuuauugug

SEQ ID NO: 2182422 - RNA, 15 nt, Streptococcus pneumoniae R6
auacuaugcuuuuua

SEQ ID NO: 2182423 - RNA, 15 nt, Streptococcus pneumoniae R6
auacuaugcuuuuuu

SEQ ID NO: 2182424 - RNA, 16 nt, Streptococcus pneumoniae R6
auacuagucuuucuuc

SEQ ID NO: 2182425 - RNA, 17 nt, Streptococcus pneumoniae R6
auacuagauucuauuuu

SEQ ID NO: 2182426 - RNA, 15 nt, Streptococcus pneumoniae R6
auacgcucagcugau

SEQ ID NO: 2182427 - RNA, 15 nt, Streptococcus pneumoniae R6
auagcaaggaugagg

SEQ ID NO: 2182428 - RNA, 20 nt, Streptococcus pneumoniae R6
auagcacaugacaaauucuc

SEQ ID NO: 2182429 - RNA, 14 nt, Streptococcus pneumoniae R6
auagcauauuuuua

SEQ ID NO: 2182430 - RNA, 18 nt, Streptococcus pneumoniae R6
auagcauauuuuuagugg

SEQ ID NO: 2182431 - RNA, 22 nt, Streptococcus pneumoniae R6
auagcauccccuaggagaugag

SEQ ID NO: 2182432 - RNA, 15 nt, Streptococcus pneumoniae R6
auagcagaaaaauga

SEQ ID NO: 2182433 - RNA, 18 nt, Streptococcus pneumoniae R6
auagcagagacauuagaa

SEQ ID NO: 2182434 - RNA, 21 nt, Streptococcus pneumoniae R6
auagcagagacauuagaaauu

SEQ ID NO: 2182435 - RNA, 16 nt, Streptococcus pneumoniae R6
auagcagauagccagc

SEQ ID NO: 2182436 - RNA, 16 nt, Streptococcus pneumoniae R6
auagcuaaaccuuauu

SEQ ID NO: 2182437 - RNA, 14 nt, Streptococcus pneumoniae R6
auagcguuuugaaa

SEQ ID NO: 2182438 - RNA, 19 nt, Streptococcus pneumoniae R6
auagcgugcccaaaaauua

SEQ ID NO: 2182439 - RNA, 14 nt, Streptococcus pneumoniae R6
auagcgauagaugu

SEQ ID NO: 2182440 - RNA, 15 nt, Streptococcus pneumoniae R6
auagcgacuauaaaa

SEQ ID NO: 2182441 - RNA, 15 nt, Streptococcus pneumoniae R6
auagcauuuggaaga

SEQ ID NO: 2182442 - RNA, 16 nt, Streptococcus pneumoniae R6
auagcauucuucucag

SEQ ID NO: 2182443 - RNA, 15 nt, Streptococcus pneumoniae R6
auagccaagaccaau

SEQ ID NO: 2182444 - RNA, 16 nt, Streptococcus pneumoniae R6
auagccauaaaacauu

SEQ ID NO: 2182445 - RNA, 15 nt, Streptococcus pneumoniae R6
auagaugcuugaauu

SEQ ID NO: 2182446 - RNA, 18 nt, Streptococcus pneumoniae R6
auagaugcuugaauuccc

SEQ ID NO: 2182447 - RNA, 17 nt, Streptococcus pneumoniae R6
auagaugguauccaaaa

SEQ ID NO: 2182448 - RNA, 19 nt, Streptococcus pneumoniae R6
auagaugaucgagcagauu

SEQ ID NO: 2182449 - RNA, 17 nt, Streptococcus pneumoniae R6
auagauguuuucaaaaa

SEQ ID NO: 2182450 - RNA, 22 nt, Streptococcus pneumoniae R6
auagauucaacgaacuauaaaa

SEQ ID NO: 2182451 - RNA, 15 nt, Streptococcus pneumoniae R6
auagauacaaaacca

SEQ ID NO: 2182452 - RNA, 13 nt, Streptococcus pneumoniae R6
auagauaccuugu

SEQ ID NO: 2182453 - RNA, 23 nt, Streptococcus pneumoniae R6
auagagugacagggccuuuugca

SEQ ID NO: 2182454 - RNA, 15 nt, Streptococcus pneumoniae R6
auagauaaaaaacaa

SEQ ID NO: 2182455 - RNA, 13 nt, Streptococcus pneumoniae R6
auagaguguuauc

SEQ ID NO: 2182456 - RNA, 14 nt, Streptococcus pneumoniae R6
auagaucugauagu

SEQ ID NO: 2182457 - RNA, 22 nt, Streptococcus pneumoniae R6
auagauccaagcauaacagcau

SEQ ID NO: 2182458 - RNA, 18 nt, Streptococcus pneumoniae R6
auagauccuucaaauccu

SEQ ID NO: 2182459 - RNA, 21 nt, Streptococcus pneumoniae R6
auagaaaaggaguagaaaaug

SEQ ID NO: 2182460 - RNA, 12 nt, Streptococcus pneumoniae R6
auagaaaacaaa

SEQ ID NO: 2182461 - RNA, 15 nt, Streptococcus pneumoniae R6
auagaaaacaaaaag

SEQ ID NO: 2182462 - RNA, 22 nt, Streptococcus pneumoniae R6
auagaaaacaacuuauaaaaaa

SEQ ID NO: 2182463 - RNA, 12 nt, Streptococcus pneumoniae R6
auagaaaaaauc

SEQ ID NO: 2182464 - RNA, 22 nt, Streptococcus pneumoniae R6
auagaaaaaucccccaagcauu

SEQ ID NO: 2182465 - RNA, 24 nt, Streptococcus pneumoniae R6
auacuuuuucaguuuuagauugcu

SEQ ID NO: 2182466 - RNA, 18 nt, Streptococcus pneumoniae R6
auacuuuuucuuccuuuc

SEQ ID NO: 2182467 - RNA, 13 nt, Streptococcus pneumoniae R6
auacuuuucucuu

SEQ ID NO: 2182468 - RNA, 16 nt, Streptococcus pneumoniae R6
auacuuuuaauauuuc

SEQ ID NO: 2182469 - RNA, 19 nt, Streptococcus pneumoniae R6
auagacuuccugcaaaacu

SEQ ID NO: 2182470 - RNA, 21 nt, Streptococcus pneumoniae R6
auagagguuauucaaaaacau

SEQ ID NO: 2182471 - RNA, 14 nt, Streptococcus pneumoniae R6
auagaaaccagcua

SEQ ID NO: 2182472 - RNA, 15 nt, Streptococcus pneumoniae R6
auagacuucccagcc

SEQ ID NO: 2182473 - RNA, 17 nt, Streptococcus pneumoniae R6
auagacuauauugauua

SEQ ID NO: 2182474 - RNA, 18 nt, Streptococcus pneumoniae R6
auagacuauauugauuau

SEQ ID NO: 2182475 - RNA, 21 nt, Streptococcus pneumoniae R6
auagacuaucuaaaauagaag

SEQ ID NO: 2182476 - RNA, 20 nt, Streptococcus pneumoniae R6
auagacucaggauguuauag

SEQ ID NO: 2182477 - RNA, 20 nt, Streptococcus pneumoniae R6
auaguucucaaccacaaaaa

SEQ ID NO: 2182478 - RNA, 13 nt, Streptococcus pneumoniae R6
auaguucuuccaa

SEQ ID NO: 2182479 - RNA, 20 nt, Streptococcus pneumoniae R6
auaguucuuccaauuucuuu

SEQ ID NO: 2182480 - RNA, 15 nt, Streptococcus pneumoniae R6
auaguugaaaucaag

SEQ ID NO: 2182481 - RNA, 16 nt, Streptococcus pneumoniae R6
auaguugcauuaaaau

SEQ ID NO: 2182482 - RNA, 14 nt, Streptococcus pneumoniae R6
auaguuuaaaacau

SEQ ID NO: 2182483 - RNA, 14 nt, Streptococcus pneumoniae R6
auaguuucauaacu

SEQ ID NO: 2182484 - RNA, 13 nt, Streptococcus pneumoniae R6
auaguuuugauua

SEQ ID NO: 2182485 - RNA, 23 nt, Streptococcus pneumoniae R6
auaguuuugauuauuuuuuaaca

SEQ ID NO: 2182486 - RNA, 15 nt, Streptococcus pneumoniae R6
auaguuugucuuuca

SEQ ID NO: 2182487 - RNA, 13 nt, Streptococcus pneumoniae R6
auaguuuucacua

SEQ ID NO: 2182488 - RNA, 23 nt, Streptococcus pneumoniae R6
auauaaagagcacugcuagcauc

SEQ ID NO: 2182489 - RNA, 19 nt, Streptococcus pneumoniae R6
auauaaaaaagcaagacca

SEQ ID NO: 2182490 - RNA, 12 nt, Streptococcus pneumoniae R6
auauaaaaagac

SEQ ID NO: 2182491 - RNA, 13 nt, Streptococcus pneumoniae R6
auauaaaaagacc

SEQ ID NO: 2182492 - RNA, 22 nt, Streptococcus pneumoniae R6
auaguggaccgaaucugaaaua

SEQ ID NO: 2182493 - RNA, 12 nt, Streptococcus pneumoniae R6
auaguucguuga

SEQ ID NO: 2182494 - RNA, 14 nt, Streptococcus pneumoniae R6
auagugagauuuuu

SEQ ID NO: 2182495 - RNA, 15 nt, Streptococcus pneumoniae R6
auagcuccaucucca

SEQ ID NO: 2182496 - RNA, 22 nt, Streptococcus pneumoniae R6
auagcuccaucuccaacugcug

SEQ ID NO: 2182497 - RNA, 18 nt, Streptococcus pneumoniae R6
auagcugcggcuuucuuc

SEQ ID NO: 2182498 - RNA, 22 nt, Streptococcus pneumoniae R6
auagcugcggcuuucuucacau

SEQ ID NO: 2182499 - RNA, 15 nt, Streptococcus pneumoniae R6
auagcugcagcugag

SEQ ID NO: 2182500 - RNA, 14 nt, Streptococcus pneumoniae R6
auagcuacagucau

SEQ ID NO: 2182501 - RNA, 22 nt, Streptococcus pneumoniae R6
auagcuacagucauuguucuug

SEQ ID NO: 2182502 - RNA, 21 nt, Streptococcus pneumoniae R6
auauaccaacuacuaaaccaa

SEQ ID NO: 2182503 - RNA, 18 nt, Streptococcus pneumoniae R6
auauaauggcuucauuau

SEQ ID NO: 2182504 - RNA, 16 nt, Streptococcus pneumoniae R6
auauaaggaccaaaua

SEQ ID NO: 2182505 - RNA, 16 nt, Streptococcus pneumoniae R6
auauaagaagcauaga

SEQ ID NO: 2182506 - RNA, 13 nt, Streptococcus pneumoniae R6
auauaagaauauc

SEQ ID NO: 2182507 - RNA, 12 nt, Streptococcus pneumoniae R6
auauaaggauug

SEQ ID NO: 2182508 - RNA, 17 nt, Streptococcus pneumoniae R6
auauaagguaggaguga

SEQ ID NO: 2182509 - RNA, 19 nt, Streptococcus pneumoniae R6
auauaucugcagaauacuc

SEQ ID NO: 2182510 - RNA, 17 nt, Streptococcus pneumoniae R6
auauauccauucuuaaa

SEQ ID NO: 2182511 - RNA, 12 nt, Streptococcus pneumoniae R6
auauagaccaac

SEQ ID NO: 2182512 - RNA, 13 nt, Streptococcus pneumoniae R6
auauacuugauau

SEQ ID NO: 2182513 - RNA, 18 nt, Streptococcus pneumoniae R6
auauacugcgauagaauc

SEQ ID NO: 2182514 - RNA, 20 nt, Streptococcus pneumoniae R6
auauacguuuucuugugaga

SEQ ID NO: 2182515 - RNA, 22 nt, Streptococcus pneumoniae R6
auauauuggguaaagauauuuu

SEQ ID NO: 2182516 - RNA, 16 nt, Streptococcus pneumoniae R6
auaucaaaaaaagaag

SEQ ID NO: 2182517 - RNA, 18 nt, Streptococcus pneumoniae R6
auaucaaaaaaagaaguu

SEQ ID NO: 2182518 - RNA, 17 nt, Streptococcus pneumoniae R6
auauccagcuuucuagc

SEQ ID NO: 2182519 - RNA, 20 nt, Streptococcus pneumoniae R6
auauccagcuuucuagccug

SEQ ID NO: 2182520 - RNA, 17 nt, Streptococcus pneumoniae R6
auaucauauagauaaaa

SEQ ID NO: 2182521 - RNA, 21 nt, Streptococcus pneumoniae R6
auaucauauagauaaaaaaca

SEQ ID NO: 2182522 - RNA, 17 nt, Streptococcus pneumoniae R6
auaucauaaugagcucc

SEQ ID NO: 2182523 - RNA, 19 nt, Streptococcus pneumoniae R6
auaucauaacacuauuaaa

SEQ ID NO: 2182524 - RNA, 21 nt, Streptococcus pneumoniae R6
auauccuuguucaugcaggaa

SEQ ID NO: 2182525 - RNA, 22 nt, Streptococcus pneumoniae R6
auauccuuuuccaagaccuuaa

SEQ ID NO: 2182526 - RNA, 19 nt, Streptococcus pneumoniae R6
auaucuaccugcaccagau

SEQ ID NO: 2182527 - RNA, 16 nt, Streptococcus pneumoniae R6
auaucuaucaaacacu

SEQ ID NO: 2182528 - RNA, 17 nt, Streptococcus pneumoniae R6
auaucuaauacccauuu

SEQ ID NO: 2182529 - RNA, 16 nt, Streptococcus pneumoniae R6
auaucuagguaaaaau

SEQ ID NO: 2182530 - RNA, 18 nt, Streptococcus pneumoniae R6
auaucuaauugauuuaaa

SEQ ID NO: 2182531 - RNA, 13 nt, Streptococcus pneumoniae R6
auaucugcuucca

SEQ ID NO: 2182532 - RNA, 16 nt, Streptococcus pneumoniae R6
auaucuggcauuccug

SEQ ID NO: 2182533 - RNA, 18 nt, Streptococcus pneumoniae R6
auaucugagguaggaguc

SEQ ID NO: 2182534 - RNA, 16 nt, Streptococcus pneumoniae R6
auaucugauauuauac

SEQ ID NO: 2182535 - RNA, 11 nt, Streptococcus pneumoniae R6
auaucugaaag

SEQ ID NO: 2182536 - RNA, 18 nt, Streptococcus pneumoniae R6
auaucugaaaguuuaucu

SEQ ID NO: 2182537 - RNA, 23 nt, Streptococcus pneumoniae R6
auaucugaaaguuuaucucuugc

SEQ ID NO: 2182538 - RNA, 16 nt, Streptococcus pneumoniae R6
auaugaacaaaaccug

SEQ ID NO: 2182539 - RNA, 13 nt, Streptococcus pneumoniae R6
auaugaaguuuau

SEQ ID NO: 2182540 - RNA, 14 nt, Streptococcus pneumoniae R6
auaucuuuagugau

SEQ ID NO: 2182541 - RNA, 18 nt, Streptococcus pneumoniae R6
auaucuucugcuugcauc

SEQ ID NO: 2182542 - RNA, 19 nt, Streptococcus pneumoniae R6
auaucuuauuucaauccau

SEQ ID NO: 2182543 - RNA, 13 nt, Streptococcus pneumoniae R6
auaucuuccucag

SEQ ID NO: 2182544 - RNA, 17 nt, Streptococcus pneumoniae R6
auaucuucggauuuuuc

SEQ ID NO: 2182545 - RNA, 15 nt, Streptococcus pneumoniae R6
auaugaggagaaaga

SEQ ID NO: 2182546 - RNA, 16 nt, Streptococcus pneumoniae R6
auaugaggagaaagaa

SEQ ID NO: 2182547 - RNA, 14 nt, Streptococcus pneumoniae R6
aucaucacuaguaa

SEQ ID NO: 2182548 - RNA, 13 nt, Streptococcus pneumoniae R6
aucauauuuucug

SEQ ID NO: 2182549 - RNA, 23 nt, Streptococcus pneumoniae R6
aucaucagggaguuguuuuuuau

SEQ ID NO: 2182550 - RNA, 14 nt, Streptococcus pneumoniae R6
aucaucauaaaaau

SEQ ID NO: 2182551 - RNA, 19 nt, Streptococcus pneumoniae R6
aucaucaaauugaaauaag

SEQ ID NO: 2182552 - RNA, 20 nt, Streptococcus pneumoniae R6
aucauccaccuugcaaaaaa

SEQ ID NO: 2182553 - RNA, 17 nt, Streptococcus pneumoniae R6
aucauccagauuuuucu

SEQ ID NO: 2182554 - RNA, 20 nt, Streptococcus pneumoniae R6
aucauccagauuuuucuggg

SEQ ID NO: 2182555 - RNA, 19 nt, Streptococcus pneumoniae R6
aaaacguuuuucaaaccuu

SEQ ID NO: 2182556 - RNA, 18 nt, Streptococcus pneumoniae R6
aaaacgcauaauauugag

SEQ ID NO: 2182557 - RNA, 22 nt, Streptococcus pneumoniae R6
aaaacgauaauagcgauugaau

SEQ ID NO: 2182558 - RNA, 15 nt, Streptococcus pneumoniae R6
aucaggaaagucaaa

SEQ ID NO: 2182559 - RNA, 18 nt, Streptococcus pneumoniae R6
aucaggaaagucaaauua

SEQ ID NO: 2182560 - RNA, 21 nt, Streptococcus pneumoniae R6
aucaggaaagucaaauuaauu

SEQ ID NO: 2182561 - RNA, 14 nt, Streptococcus pneumoniae R6
aucaggaaaucuuc

SEQ ID NO: 2182562 - RNA, 14 nt, Streptococcus pneumoniae R6
aucaggaaggucac

SEQ ID NO: 2182563 - RNA, 20 nt, Streptococcus pneumoniae R6
aucaggaaggucacuuuuuu

SEQ ID NO: 2182564 - RNA, 21 nt, Streptococcus pneumoniae R6
aucaggaauaaauccagcuga

SEQ ID NO: 2182565 - RNA, 15 nt, Streptococcus pneumoniae R6
aucaggccuacaauu

SEQ ID NO: 2182566 - RNA, 21 nt, Streptococcus pneumoniae R6
aucaguuacauccaaacgaau

SEQ ID NO: 2182567 - RNA, 20 nt, Streptococcus pneumoniae R6
aucauaaacuauccagagca

SEQ ID NO: 2182568 - RNA, 20 nt, Streptococcus pneumoniae R6
aucauaacacuauuaaaguu

SEQ ID NO: 2182569 - RNA, 14 nt, Streptococcus pneumoniae R6
aucauaagauuaau

SEQ ID NO: 2182570 - RNA, 22 nt, Streptococcus pneumoniae R6
aucauaucaagguuuuucaaaa

SEQ ID NO: 2182571 - RNA, 22 nt, Streptococcus pneumoniae R6
aucauaucaagguuuuugaaaa

SEQ ID NO: 2182572 - RNA, 13 nt, Streptococcus pneumoniae R6
aucauauaaauaa

SEQ ID NO: 2182573 - RNA, 16 nt, Streptococcus pneumoniae R6
aucauaguacaauacc

SEQ ID NO: 2182574 - RNA, 23 nt, Streptococcus pneumoniae R6
aucagacuauaauauaauaaacu

SEQ ID NO: 2182575 - RNA, 15 nt, Streptococcus pneumoniae R6
aucagacuguuuuuc

SEQ ID NO: 2182576 - RNA, 21 nt, Streptococcus pneumoniae R6
aucagacuguuuuucuugaga

SEQ ID NO: 2182577 - RNA, 15 nt, Streptococcus pneumoniae R6
aucagauaagcaccu

SEQ ID NO: 2182578 - RNA, 15 nt, Streptococcus pneumoniae R6
aucagauuuuagaac

SEQ ID NO: 2182579 - RNA, 11 nt, Streptococcus pneumoniae R6
aucacuuucug

SEQ ID NO: 2182580 - RNA, 12 nt, Streptococcus pneumoniae R6
aucacuuucugc

SEQ ID NO: 2182581 - RNA, 13 nt, Streptococcus pneumoniae R6
aucacuuucugca

SEQ ID NO: 2182582 - RNA, 22 nt, Streptococcus pneumoniae R6
aucagaaaaaaggcauccaauc

SEQ ID NO: 2182583 - RNA, 19 nt, Streptococcus pneumoniae R6
aucagaauggguuaaaauu

SEQ ID NO: 2182584 - RNA, 24 nt, Streptococcus pneumoniae R6
aucagaccaguuucuucuuucacu

SEQ ID NO: 2182585 - RNA, 13 nt, Streptococcus pneumoniae R6
aucacuugaccaa

SEQ ID NO: 2182586 - RNA, 20 nt, Streptococcus pneumoniae R6
aucacgcuaaguagaaaguu

SEQ ID NO: 2182587 - RNA, 22 nt, Streptococcus pneumoniae R6
aucacgcuaaguagaaaguuaa

SEQ ID NO: 2182588 - RNA, 14 nt, Streptococcus pneumoniae R6
aucacgcuuuucuu

SEQ ID NO: 2182589 - RNA, 16 nt, Streptococcus pneumoniae R6
aucacggaauuuuucg

SEQ ID NO: 2182590 - RNA, 20 nt, Streptococcus pneumoniae R6
aucaccuaguccaagacguu

SEQ ID NO: 2182591 - RNA, 17 nt, Streptococcus pneumoniae R6
aucaccuccuucuccaa

SEQ ID NO: 2182592 - RNA, 20 nt, Streptococcus pneumoniae R6
aucacgacuuucugauagau

SEQ ID NO: 2182593 - RNA, 17 nt, Streptococcus pneumoniae R6
aucaccguccccaaaaa

SEQ ID NO: 2182594 - RNA, 19 nt, Streptococcus pneumoniae R6
aucaccguccccaaaaaua

SEQ ID NO: 2182595 - RNA, 21 nt, Streptococcus pneumoniae R6
aucaccguccccaaaaauacu

SEQ ID NO: 2182596 - RNA, 14 nt, Streptococcus pneumoniae R6
aucaaaauaaagca

SEQ ID NO: 2182597 - RNA, 12 nt, Streptococcus pneumoniae R6
aucaaaagaugu

SEQ ID NO: 2182598 - RNA, 17 nt, Streptococcus pneumoniae R6
aucaaaagauguuagaa

SEQ ID NO: 2182599 - RNA, 15 nt, Streptococcus pneumoniae R6
aucaaaauauagcaa

SEQ ID NO: 2182600 - RNA, 18 nt, Streptococcus pneumoniae R6
aucaaaauauagcaauaa

SEQ ID NO: 2182601 - RNA, 20 nt, Streptococcus pneumoniae R6
aucaaaauauagcaauaaga

SEQ ID NO: 2182602 - RNA, 19 nt, Streptococcus pneumoniae R6
aucaaaauauguuuucuuu

SEQ ID NO: 2182603 - RNA, 14 nt, Streptococcus pneumoniae R6
aucaaaaucaauga

SEQ ID NO: 2182604 - RNA, 16 nt, Streptococcus pneumoniae R6
aucaaaaucacagacc

SEQ ID NO: 2182605 - RNA, 20 nt, Streptococcus pneumoniae R6
aucaagagucuccucaaaaa

SEQ ID NO: 2182606 - RNA, 14 nt, Streptococcus pneumoniae R6
aucaagauagcugu

SEQ ID NO: 2182607 - RNA, 20 nt, Streptococcus pneumoniae R6
aucaagauagcugugaagcg

SEQ ID NO: 2182608 - RNA, 23 nt, Streptococcus pneumoniae R6
aucaagaugagacuugcaagaaa

SEQ ID NO: 2182609 - RNA, 15 nt, Streptococcus pneumoniae R6
aucaagcaaaucaaa

SEQ ID NO: 2182610 - RNA, 18 nt, Streptococcus pneumoniae R6
aucaagcaaaucaaagcu

SEQ ID NO: 2182611 - RNA, 14 nt, Streptococcus pneumoniae R6
aucaaccuuucuca

SEQ ID NO: 2182612 - RNA, 19 nt, Streptococcus pneumoniae R6
aucaaccuuucucagauaa

SEQ ID NO: 2182613 - RNA, 23 nt, Streptococcus pneumoniae R6
aucaaccuuucucagauaauaau

SEQ ID NO: 2182614 - RNA, 15 nt, Streptococcus pneumoniae R6
aucaaccgugcaguc

SEQ ID NO: 2182615 - RNA, 14 nt, Streptococcus pneumoniae R6
aucaaccucacuua

SEQ ID NO: 2182616 - RNA, 13 nt, Streptococcus pneumoniae R6
aucaacaguaacg

SEQ ID NO: 2182617 - RNA, 15 nt, Streptococcus pneumoniae R6
aucaaucaagauaca

SEQ ID NO: 2182618 - RNA, 14 nt, Streptococcus pneumoniae R6
aucaauaucaaaac

SEQ ID NO: 2182619 - RNA, 23 nt, Streptococcus pneumoniae R6
aucaauagaaguggauuuucuuc

SEQ ID NO: 2182620 - RNA, 23 nt, Streptococcus pneumoniae R6
aucaauauuagaugauuuuucug

SEQ ID NO: 2182621 - RNA, 19 nt, Streptococcus pneumoniae R6
aucaaugauuuauuuguuu

SEQ ID NO: 2182622 - RNA, 18 nt, Streptococcus pneumoniae R6
aucaaugagucagggaaa

SEQ ID NO: 2182623 - RNA, 22 nt, Streptococcus pneumoniae R6
aucaaucguccuugauuuagaa

SEQ ID NO: 2182624 - RNA, 17 nt, Streptococcus pneumoniae R6
aucaauccugaagaaug

SEQ ID NO: 2182625 - RNA, 17 nt, Streptococcus pneumoniae R6
aucaaucuucaaaaucu

SEQ ID NO: 2182626 - RNA, 22 nt, Streptococcus pneumoniae R6
aucaaucuucaaaaucucagcu

SEQ ID NO: 2182627 - RNA, 22 nt, Streptococcus pneumoniae R6
aucaaucucugcaauuucuaau

SEQ ID NO: 2182628 - RNA, 16 nt, Streptococcus pneumoniae R6
aucaaucguuucaagu

SEQ ID NO: 2182629 - RNA, 19 nt, Streptococcus pneumoniae R6
aucaauacccccuuaaaac

SEQ ID NO: 2182630 - RNA, 22 nt, Streptococcus pneumoniae R6
aucaauacccccuuaaaaccau

SEQ ID NO: 2182631 - RNA, 23 nt, Streptococcus pneumoniae R6
aucaauacccccuuaaaaccaug

SEQ ID NO: 2182632 - RNA, 23 nt, Streptococcus pneumoniae R6
aucaagugaguuaggagccaagu

SEQ ID NO: 2182633 - RNA, 16 nt, Streptococcus pneumoniae R6
aucaaguuuuugcaca

SEQ ID NO: 2182634 - RNA, 24 nt, Streptococcus pneumoniae R6
aucaauaacacgagaaacaauaaa

SEQ ID NO: 2182635 - RNA, 15 nt, Streptococcus pneumoniae R6
aucaagcuuucacua

SEQ ID NO: 2182636 - RNA, 17 nt, Streptococcus pneumoniae R6
aucaaguaggcucaucc

SEQ ID NO: 2182637 - RNA, 15 nt, Streptococcus pneumoniae R6
aucaagguuuuagaa

SEQ ID NO: 2182638 - RNA, 17 nt, Streptococcus pneumoniae R6
aucaagguuuuucugua

SEQ ID NO: 2182639 - RNA, 19 nt, Streptococcus pneumoniae R6
aucaagguuuuucuguacu

SEQ ID NO: 2182640 - RNA, 16 nt, Streptococcus pneumoniae R6
aucaagguuuuugaaa

SEQ ID NO: 2182641 - RNA, 16 nt, Streptococcus pneumoniae R6
auauuucaagaauuaa

SEQ ID NO: 2182642 - RNA, 19 nt, Streptococcus pneumoniae R6
auauuucaagaauuaagug

SEQ ID NO: 2182643 - RNA, 14 nt, Streptococcus pneumoniae R6
auauuguuaauggu

SEQ ID NO: 2182644 - RNA, 16 nt, Streptococcus pneumoniae R6
auauuguuuuaauaua

SEQ ID NO: 2182645 - RNA, 22 nt, Streptococcus pneumoniae R6
aucaaaaccaguccuugaaaaa

SEQ ID NO: 2182646 - RNA, 13 nt, Streptococcus pneumoniae R6
aucaaaaauuggu

SEQ ID NO: 2182647 - RNA, 23 nt, Streptococcus pneumoniae R6
auauuuucugggaagacugucaa

SEQ ID NO: 2182648 - RNA, 15 nt, Streptococcus pneumoniae R6
auauuuucaaaaaaa

SEQ ID NO: 2182649 - RNA, 23 nt, Streptococcus pneumoniae R6
auauuuucaaaacugguccagag

SEQ ID NO: 2182650 - RNA, 22 nt, Streptococcus pneumoniae R6
auauuuucagauaaccaucuca

SEQ ID NO: 2182651 - RNA, 18 nt, Streptococcus pneumoniae R6
auauuuggcauauuuuua

SEQ ID NO: 2182652 - RNA, 19 nt, Streptococcus pneumoniae R6
auauuuggcauauuuuuag

SEQ ID NO: 2182653 - RNA, 15 nt, Streptococcus pneumoniae R6
auaugauugucuccu

SEQ ID NO: 2182654 - RNA, 13 nt, Streptococcus pneumoniae R6
auaugauggaaga

SEQ ID NO: 2182655 - RNA, 18 nt, Streptococcus pneumoniae R6
auaugcaauuucuuuaua

SEQ ID NO: 2182656 - RNA, 13 nt, Streptococcus pneumoniae R6
auauucaccacau

SEQ ID NO: 2182657 - RNA, 22 nt, Streptococcus pneumoniae R6
auauucaccacaugacauuauu

SEQ ID NO: 2182658 - RNA, 18 nt, Streptococcus pneumoniae R6
auauucaauuauccauau

SEQ ID NO: 2182659 - RNA, 18 nt, Streptococcus pneumoniae R6
auauucaauucuuuaaca

SEQ ID NO: 2182660 - RNA, 19 nt, Streptococcus pneumoniae R6
auauucaacgaaaauaauu

SEQ ID NO: 2182661 - RNA, 19 nt, Streptococcus pneumoniae R6
auauucagagcgauaaaaa

SEQ ID NO: 2182662 - RNA, 14 nt, Streptococcus pneumoniae R6
auauugauauuuau

SEQ ID NO: 2182663 - RNA, 16 nt, Streptococcus pneumoniae R6
auauugaguaauuccc

SEQ ID NO: 2182664 - RNA, 17 nt, Streptococcus pneumoniae R6
auauugaaaugaaauaa

SEQ ID NO: 2182665 - RNA, 22 nt, Streptococcus pneumoniae R6
auauugaaaugaaauaaaauuu

SEQ ID NO: 2182666 - RNA, 19 nt, Streptococcus pneumoniae R6
auauugaaacuagaauaau

SEQ ID NO: 2182667 - RNA, 14 nt, Streptococcus pneumoniae R6
auauugcaagagaa

SEQ ID NO: 2182668 - RNA, 15 nt, Streptococcus pneumoniae R6
auauugcaagagaaa

SEQ ID NO: 2182669 - RNA, 14 nt, Streptococcus pneumoniae R6
auuacaaucauaga

SEQ ID NO: 2182670 - RNA, 22 nt, Streptococcus pneumoniae R6
auuacacaaucguuucaaaaaa

SEQ ID NO: 2182671 - RNA, 18 nt, Streptococcus pneumoniae R6
auuacagaacauuuuaau

SEQ ID NO: 2182672 - RNA, 20 nt, Streptococcus pneumoniae R6
auuaauuugacuuuucuaau

SEQ ID NO: 2182673 - RNA, 19 nt, Streptococcus pneumoniae R6
auuaauuuucguacaauau

SEQ ID NO: 2182674 - RNA, 15 nt, Streptococcus pneumoniae R6
auuaauuuauagaaa

SEQ ID NO: 2182675 - RNA, 14 nt, Streptococcus pneumoniae R6
auuaauuucuagaa

SEQ ID NO: 2182676 - RNA, 15 nt, Streptococcus pneumoniae R6
auuaauuucuagaaa

SEQ ID NO: 2182677 - RNA, 15 nt, Streptococcus pneumoniae R6
auuaauuuauuuaau

SEQ ID NO: 2182678 - RNA, 22 nt, Streptococcus pneumoniae R6
auuaauuucagaaaucuucucu

SEQ ID NO: 2182679 - RNA, 13 nt, Streptococcus pneumoniae R6
auuaauuucauua

SEQ ID NO: 2182680 - RNA, 15 nt, Streptococcus pneumoniae R6
auuaauuucauuacu

SEQ ID NO: 2182681 - RNA, 18 nt, Streptococcus pneumoniae R6
auuaauccccauuugcuu

SEQ ID NO: 2182682 - RNA, 18 nt, Streptococcus pneumoniae R6
aaaagcaggaguuuuccc

SEQ ID NO: 2182683 - RNA, 18 nt, Streptococcus pneumoniae R6
aaaagcauaguaucaggu

SEQ ID NO: 2182684 - RNA, 21 nt, Streptococcus pneumoniae R6
aaaagcauucuaguccaucuc

SEQ ID NO: 2182685 - RNA, 21 nt, Streptococcus pneumoniae R6
aaaagcauucuauuccaucuc

SEQ ID NO: 2182686 - RNA, 23 nt, Streptococcus pneumoniae R6
auuaaguccuucccaucucguga

SEQ ID NO: 2182687 - RNA, 14 nt, Streptococcus pneumoniae R6
auuaagugauuuaa

SEQ ID NO: 2182688 - RNA, 15 nt, Streptococcus pneumoniae R6
auuaagugauuuaaa

SEQ ID NO: 2182689 - RNA, 11 nt, Streptococcus pneumoniae R6
auuaaguaauc

SEQ ID NO: 2182690 - RNA, 18 nt, Streptococcus pneumoniae R6
auuaagguuuuaccuuca

SEQ ID NO: 2182691 - RNA, 12 nt, Streptococcus pneumoniae R6
auuaaauuuuuu

SEQ ID NO: 2182692 - RNA, 12 nt, Streptococcus pneumoniae R6
auuaacaaaaag

SEQ ID NO: 2182693 - RNA, 12 nt, Streptococcus pneumoniae R6
auuaacaaaaga

SEQ ID NO: 2182694 - RNA, 14 nt, Streptococcus pneumoniae R6
auuaacaaaagagc

SEQ ID NO: 2182695 - RNA, 13 nt, Streptococcus pneumoniae R6
auuaacagcaaaa

SEQ ID NO: 2182696 - RNA, 14 nt, Streptococcus pneumoniae R6
auuaaaaggcucau

SEQ ID NO: 2182697 - RNA, 23 nt, Streptococcus pneumoniae R6
auuaaaaguuuccccugccaacu

SEQ ID NO: 2182698 - RNA, 21 nt, Streptococcus pneumoniae R6
auuaaaauaacucaauuaaga

SEQ ID NO: 2182699 - RNA, 17 nt, Streptococcus pneumoniae R6
auuaaaaugcaagacac

SEQ ID NO: 2182700 - RNA, 15 nt, Streptococcus pneumoniae R6
auuaaacaaaaagaa

SEQ ID NO: 2182701 - RNA, 20 nt, Streptococcus pneumoniae R6
auguuuccugcaaagaguug

SEQ ID NO: 2182702 - RNA, 16 nt, Streptococcus pneumoniae R6
auguuuuucuccuauu

SEQ ID NO: 2182703 - RNA, 13 nt, Streptococcus pneumoniae R6
auuaaaccuucca

SEQ ID NO: 2182704 - RNA, 21 nt, Streptococcus pneumoniae R6
auuaaauaugaacaaaucaau

SEQ ID NO: 2182705 - RNA, 15 nt, Streptococcus pneumoniae R6
auguugcaaauuuau

SEQ ID NO: 2182706 - RNA, 16 nt, Streptococcus pneumoniae R6
auguucaaagauuuua

SEQ ID NO: 2182707 - RNA, 17 nt, Streptococcus pneumoniae R6
auguucaaagauuuuau

SEQ ID NO: 2182708 - RNA, 20 nt, Streptococcus pneumoniae R6
auguucaaagcgauaaaaau

SEQ ID NO: 2182709 - RNA, 14 nt, Streptococcus pneumoniae R6
auguccgccuuuga

SEQ ID NO: 2182710 - RNA, 17 nt, Streptococcus pneumoniae R6
auguccuggauagacau

SEQ ID NO: 2182711 - RNA, 21 nt, Streptococcus pneumoniae R6
auguccuggauagacaucgua

SEQ ID NO: 2182712 - RNA, 17 nt, Streptococcus pneumoniae R6
auguccuugauagcaga

SEQ ID NO: 2182713 - RNA, 21 nt, Streptococcus pneumoniae R6
auguccuugauagcagaauuu

SEQ ID NO: 2182714 - RNA, 23 nt, Streptococcus pneumoniae R6
auguuucccuugcuagucauaac

SEQ ID NO: 2182715 - RNA, 21 nt, Streptococcus pneumoniae R6
auguuucggaucauauuuucu

SEQ ID NO: 2182716 - RNA, 19 nt, Streptococcus pneumoniae R6
auguuucaagucuuccgaa

SEQ ID NO: 2182717 - RNA, 18 nt, Streptococcus pneumoniae R6
auguuucaacaugucagc

SEQ ID NO: 2182718 - RNA, 21 nt, Streptococcus pneumoniae R6
auguuuacucaguauuuggau

SEQ ID NO: 2182719 - RNA, 15 nt, Streptococcus pneumoniae R6
auuauacaucuuccc

SEQ ID NO: 2182720 - RNA, 22 nt, Streptococcus pneumoniae R6
auuauacaucuucccacaauaa

SEQ ID NO: 2182721 - RNA, 17 nt, Streptococcus pneumoniae R6
auuauacuauaaaacaa

SEQ ID NO: 2182722 - RNA, 22 nt, Streptococcus pneumoniae R6
auuauacuauaaaacaauagcu

SEQ ID NO: 2182723 - RNA, 12 nt, Streptococcus pneumoniae R6
auuauagaaaug

SEQ ID NO: 2182724 - RNA, 16 nt, Streptococcus pneumoniae R6
auuauacucuuagaaa

SEQ ID NO: 2182725 - RNA, 17 nt, Streptococcus pneumoniae R6
auuauacucuuuagaaa

SEQ ID NO: 2182726 - RNA, 19 nt, Streptococcus pneumoniae R6
auuauacucuuuagaaauc

SEQ ID NO: 2182727 - RNA, 14 nt, Streptococcus pneumoniae R6
auuauacaccauuu

SEQ ID NO: 2182728 - RNA, 23 nt, Streptococcus pneumoniae R6
auuauaauaaaaugaaauaagaa

SEQ ID NO: 2182729 - RNA, 20 nt, Streptococcus pneumoniae R6
auuauaaucguuuaaaacac

SEQ ID NO: 2182730 - RNA, 15 nt, Streptococcus pneumoniae R6
auuauaagacuuuuc

SEQ ID NO: 2182731 - RNA, 15 nt, Streptococcus pneumoniae R6
auuauaaaauuuaau

SEQ ID NO: 2182732 - RNA, 15 nt, Streptococcus pneumoniae R6
auuaguuuuuagaag

SEQ ID NO: 2182733 - RNA, 18 nt, Streptococcus pneumoniae R6
auuaguuuuuagaagcuu

SEQ ID NO: 2182734 - RNA, 14 nt, Streptococcus pneumoniae R6
auuagguugaccau

SEQ ID NO: 2182735 - RNA, 20 nt, Streptococcus pneumoniae R6
auuaggggggcuauucuucg

SEQ ID NO: 2182736 - RNA, 15 nt, Streptococcus pneumoniae R6
auuagcucaaaacac

SEQ ID NO: 2182737 - RNA, 19 nt, Streptococcus pneumoniae R6
auuagcucgauugaggucg

SEQ ID NO: 2182738 - RNA, 16 nt, Streptococcus pneumoniae R6
auuagcugauuauguu

SEQ ID NO: 2182739 - RNA, 18 nt, Streptococcus pneumoniae R6
aaaagcucgauacucuaa

SEQ ID NO: 2182740 - RNA, 23 nt, Streptococcus pneumoniae R6
auuaggaaaggaaaauugauuua

SEQ ID NO: 2182741 - RNA, 12 nt, Streptococcus pneumoniae R6
auuaggauagau

SEQ ID NO: 2182742 - RNA, 15 nt, Streptococcus pneumoniae R6
auuaggauagauacc

SEQ ID NO: 2182743 - RNA, 23 nt, Streptococcus pneumoniae R6
auuaucauaguacaauaccuuuc

SEQ ID NO: 2182744 - RNA, 22 nt, Streptococcus pneumoniae R6
auuaucagcguaauagucuaau

SEQ ID NO: 2182745 - RNA, 16 nt, Streptococcus pneumoniae R6
auuaucacuacuauaa

SEQ ID NO: 2182746 - RNA, 22 nt, Streptococcus pneumoniae R6
auuauccaugaaaaaugcauga

SEQ ID NO: 2182747 - RNA, 18 nt, Streptococcus pneumoniae R6
auuauccaacagagaaaa

SEQ ID NO: 2182748 - RNA, 16 nt, Streptococcus pneumoniae R6
auuauuacaacaauaa

SEQ ID NO: 2182749 - RNA, 14 nt, Streptococcus pneumoniae R6
auuauuaauauaua

SEQ ID NO: 2182750 - RNA, 17 nt, Streptococcus pneumoniae R6
auuaucuuuccauucaa

SEQ ID NO: 2182751 - RNA, 22 nt, Streptococcus pneumoniae R6
auuaucuuuccauucaaauuua

SEQ ID NO: 2182752 - RNA, 15 nt, Streptococcus pneumoniae R6
auuaugaaaaccaag

SEQ ID NO: 2182753 - RNA, 19 nt, Streptococcus pneumoniae R6
auuaugaaauuuaaaaaga

SEQ ID NO: 2182754 - RNA, 14 nt, Streptococcus pneumoniae R6
auuaugauuuaaac

SEQ ID NO: 2182755 - RNA, 15 nt, Streptococcus pneumoniae R6
aaaaggcauccaauc

SEQ ID NO: 2182756 - RNA, 21 nt, Streptococcus pneumoniae R6
auucaaugugggaaacagauu

SEQ ID NO: 2182757 - RNA, 16 nt, Streptococcus pneumoniae R6
auucaauguuuacuca

SEQ ID NO: 2182758 - RNA, 19 nt, Streptococcus pneumoniae R6
aaaaggcucauaaauggag

SEQ ID NO: 2182759 - RNA, 13 nt, Streptococcus pneumoniae R6
auucaauucuuua

SEQ ID NO: 2182760 - RNA, 17 nt, Streptococcus pneumoniae R6
auucaauucuuuaacaa

SEQ ID NO: 2182761 - RNA, 21 nt, Streptococcus pneumoniae R6
auucaauugcaggagaaaaug

SEQ ID NO: 2182762 - RNA, 19 nt, Streptococcus pneumoniae R6
auucaaaugaauuucuaca

SEQ ID NO: 2182763 - RNA, 17 nt, Streptococcus pneumoniae R6
auuauugauuccgucau

SEQ ID NO: 2182764 - RNA, 15 nt, Streptococcus pneumoniae R6
auucaaucgcuauua

SEQ ID NO: 2182765 - RNA, 12 nt, Streptococcus pneumoniae R6
auucaacaucac

SEQ ID NO: 2182766 - RNA, 18 nt, Streptococcus pneumoniae R6
auucaacaucacuuggua

SEQ ID NO: 2182767 - RNA, 17 nt, Streptococcus pneumoniae R6
auucaaauuuagcugua

SEQ ID NO: 2182768 - RNA, 22 nt, Streptococcus pneumoniae R6
auucaaauuuagcuguaucauu

SEQ ID NO: 2182769 - RNA, 20 nt, Streptococcus pneumoniae R6
auucaggugauuuaccauag

SEQ ID NO: 2182770 - RNA, 18 nt, Streptococcus pneumoniae R6
auucagguggguuuucug

SEQ ID NO: 2182771 - RNA, 14 nt, Streptococcus pneumoniae R6
auucacgaacauga

SEQ ID NO: 2182772 - RNA, 14 nt, Streptococcus pneumoniae R6
auucaccuaaccaa

SEQ ID NO: 2182773 - RNA, 17 nt, Streptococcus pneumoniae R6
auucaccuaaccaaaua

SEQ ID NO: 2182774 - RNA, 20 nt, Streptococcus pneumoniae R6
auucacugagaucuucuucu

SEQ ID NO: 2182775 - RNA, 17 nt, Streptococcus pneumoniae R6
auucacuagccccagcu

SEQ ID NO: 2182776 - RNA, 16 nt, Streptococcus pneumoniae R6
auucacuauaacuugu

SEQ ID NO: 2182777 - RNA, 14 nt, Streptococcus pneumoniae R6
auggcaugaggaga

SEQ ID NO: 2182778 - RNA, 20 nt, Streptococcus pneumoniae R6
auggccagauaauucucuaa

SEQ ID NO: 2182779 - RNA, 21 nt, Streptococcus pneumoniae R6
augcuggcggaaguuggucuc

SEQ ID NO: 2182780 - RNA, 15 nt, Streptococcus pneumoniae R6
augcugacgugguuu

SEQ ID NO: 2182781 - RNA, 15 nt, Streptococcus pneumoniae R6
auggcacaaaagguu

SEQ ID NO: 2182782 - RNA, 18 nt, Streptococcus pneumoniae R6
auggcaauaaacaucucg

SEQ ID NO: 2182783 - RNA, 19 nt, Streptococcus pneumoniae R6
auggcaacguuaaagaguu

SEQ ID NO: 2182784 - RNA, 20 nt, Streptococcus pneumoniae R6
auggcaacuuuuccaauaga

SEQ ID NO: 2182785 - RNA, 19 nt, Streptococcus pneumoniae R6
auggcaagaucaaguucaa

SEQ ID NO: 2182786 - RNA, 17 nt, Streptococcus pneumoniae R6
auggauuuuauugucuu

SEQ ID NO: 2182787 - RNA, 21 nt, Streptococcus pneumoniae R6
auggcaaaaaauugagaaaga

SEQ ID NO: 2182788 - RNA, 21 nt, Streptococcus pneumoniae R6
auggauuuauaguaaaaugaa

SEQ ID NO: 2182789 - RNA, 19 nt, Streptococcus pneumoniae R6
augggagcuaacucaaguu

SEQ ID NO: 2182790 - RNA, 18 nt, Streptococcus pneumoniae R6
auggcuuguguucugcuc

SEQ ID NO: 2182791 - RNA, 15 nt, Streptococcus pneumoniae R6
auggucacagaacca

SEQ ID NO: 2182792 - RNA, 19 nt, Streptococcus pneumoniae R6
auggucacagaaccaucuu

SEQ ID NO: 2182793 - RNA, 21 nt, Streptococcus pneumoniae R6
augguauuuaaaaccuccaaa

SEQ ID NO: 2182794 - RNA, 13 nt, Streptococcus pneumoniae R6
augguauucauua

SEQ ID NO: 2182795 - RNA, 17 nt, Streptococcus pneumoniae R6
augguauuuguaaaauu

SEQ ID NO: 2182796 - RNA, 16 nt, Streptococcus pneumoniae R6
auggucaaaauauuug

SEQ ID NO: 2182797 - RNA, 16 nt, Streptococcus pneumoniae R6
auggggggacauaaaa

SEQ ID NO: 2182798 - RNA, 15 nt, Streptococcus pneumoniae R6
augggccaaaucauc

SEQ ID NO: 2182799 - RNA, 20 nt, Streptococcus pneumoniae R6
augggcaucaacagcuccau

SEQ ID NO: 2182800 - RNA, 16 nt, Streptococcus pneumoniae R6
augguuucagucaaua

SEQ ID NO: 2182801 - RNA, 18 nt, Streptococcus pneumoniae R6
auguagcgcuugaaacuc

SEQ ID NO: 2182802 - RNA, 22 nt, Streptococcus pneumoniae R6
auguaggccgucucacacggaa

SEQ ID NO: 2182803 - RNA, 16 nt, Streptococcus pneumoniae R6
auguaggcuacagaag

SEQ ID NO: 2182804 - RNA, 16 nt, Streptococcus pneumoniae R6
auguaggcuagcaaca

SEQ ID NO: 2182805 - RNA, 14 nt, Streptococcus pneumoniae R6
auguacuggauaaa

SEQ ID NO: 2182806 - RNA, 14 nt, Streptococcus pneumoniae R6
auguagccacucug

SEQ ID NO: 2182807 - RNA, 17 nt, Streptococcus pneumoniae R6
auguagccacucuggca

SEQ ID NO: 2182808 - RNA, 17 nt, Streptococcus pneumoniae R6
auguaauucucaagcug

SEQ ID NO: 2182809 - RNA, 14 nt, Streptococcus pneumoniae R6
aaaagauguuagaa

SEQ ID NO: 2182810 - RNA, 21 nt, Streptococcus pneumoniae R6
aaaagauggaguguucuaaaa

SEQ ID NO: 2182811 - RNA, 21 nt, Streptococcus pneumoniae R6
aaaagauuucuauaaauucau

SEQ ID NO: 2182812 - RNA, 16 nt, Streptococcus pneumoniae R6
aaaagauuugaaacua

SEQ ID NO: 2182813 - RNA, 21 nt, Streptococcus pneumoniae R6
auguauggacgaagugcuucu

SEQ ID NO: 2182814 - RNA, 15 nt, Streptococcus pneumoniae R6
aaaagauuuuuuaaa

SEQ ID NO: 2182815 - RNA, 17 nt, Streptococcus pneumoniae R6
aaaagauuuuuuaaaaa

SEQ ID NO: 2182816 - RNA, 19 nt, Streptococcus pneumoniae R6
aaaagcaagagcugauaga

SEQ ID NO: 2182817 - RNA, 24 nt, Streptococcus pneumoniae R6
aaaagcaagagcugauagagauua

SEQ ID NO: 2182818 - RNA, 21 nt, Streptococcus pneumoniae R6
auguauaauggauugaaauaa

SEQ ID NO: 2182819 - RNA, 15 nt, Streptococcus pneumoniae R6
auguagucaaucaaa

SEQ ID NO: 2182820 - RNA, 17 nt, Streptococcus pneumoniae R6
auguagucauucgaaug

SEQ ID NO: 2182821 - RNA, 20 nt, Streptococcus pneumoniae R6
auguaguucaaaacugccuu

SEQ ID NO: 2182822 - RNA, 15 nt, Streptococcus pneumoniae R6
aaaagauagagacua

SEQ ID NO: 2182823 - RNA, 14 nt, Streptococcus pneumoniae R6
aaaagauaagauag

SEQ ID NO: 2182824 - RNA, 21 nt, Streptococcus pneumoniae R6
aaaagauaagguucaaaaaau

SEQ ID NO: 2182825 - RNA, 18 nt, Streptococcus pneumoniae R6
augucauguuagaaaaau

SEQ ID NO: 2182826 - RNA, 21 nt, Streptococcus pneumoniae R6
augucauguuagaaaaaugca

SEQ ID NO: 2182827 - RNA, 18 nt, Streptococcus pneumoniae R6
auguccauaacugcugcu

SEQ ID NO: 2182828 - RNA, 22 nt, Streptococcus pneumoniae R6
auguauugaaucuagaauaguc

SEQ ID NO: 2182829 - RNA, 19 nt, Streptococcus pneumoniae R6
auguaugguuacugacuuc

SEQ ID NO: 2182830 - RNA, 23 nt, Streptococcus pneumoniae R6
augcgauagaugaucgagcagau

SEQ ID NO: 2182831 - RNA, 23 nt, Streptococcus pneumoniae R6
augcggauaaaccaccagagugg

SEQ ID NO: 2182832 - RNA, 23 nt, Streptococcus pneumoniae R6
augcguacuguuauagauucaac

SEQ ID NO: 2182833 - RNA, 23 nt, Streptococcus pneumoniae R6
augcguuuucuaauuguaaagac

SEQ ID NO: 2182834 - RNA, 12 nt, Streptococcus pneumoniae R6
augcguuuuugu

SEQ ID NO: 2182835 - RNA, 18 nt, Streptococcus pneumoniae R6
augcguuuuugugauuuu

SEQ ID NO: 2182836 - RNA, 22 nt, Streptococcus pneumoniae R6
augcguuuuuucugauuucaaa

SEQ ID NO: 2182837 - RNA, 15 nt, Streptococcus pneumoniae R6
augcguuuuaucaua

SEQ ID NO: 2182838 - RNA, 15 nt, Streptococcus pneumoniae R6
augcuaauuuagaaa

SEQ ID NO: 2182839 - RNA, 17 nt, Streptococcus pneumoniae R6
augcuaauuuagaaaua

SEQ ID NO: 2182840 - RNA, 19 nt, Streptococcus pneumoniae R6
augcuaauuuagaaauaga

SEQ ID NO: 2182841 - RNA, 14 nt, Streptococcus pneumoniae R6
aaaagacaucagau

SEQ ID NO: 2182842 - RNA, 21 nt, Streptococcus pneumoniae R6
augcuagacucuuauuucuca

SEQ ID NO: 2182843 - RNA, 17 nt, Streptococcus pneumoniae R6
aaaagaccguuugaaaa

SEQ ID NO: 2182844 - RNA, 21 nt, Streptococcus pneumoniae R6
aaaagagaauuuuccggcucu

SEQ ID NO: 2182845 - RNA, 13 nt, Streptococcus pneumoniae R6
aaaagacuugaaa

SEQ ID NO: 2182846 - RNA, 18 nt, Streptococcus pneumoniae R6
aaaagacuugaaauacua

SEQ ID NO: 2182847 - RNA, 20 nt, Streptococcus pneumoniae R6
aaaagacuugaaauacuaaa

SEQ ID NO: 2182848 - RNA, 21 nt, Streptococcus pneumoniae R6
aaaagagggauucuuauauua

SEQ ID NO: 2182849 - RNA, 20 nt, Streptococcus pneumoniae R6
aaaagagggauuuuguauuu

SEQ ID NO: 2182850 - RNA, 22 nt, Streptococcus pneumoniae R6
aaaagaggagguaaaucccaag

SEQ ID NO: 2182851 - RNA, 23 nt, Streptococcus pneumoniae R6
aaaagaggaugaaccugcuuuag

SEQ ID NO: 2182852 - RNA, 16 nt, Streptococcus pneumoniae R6
aaaagagcaagaacuu

SEQ ID NO: 2182853 - RNA, 14 nt, Streptococcus pneumoniae R6
aaaagaguuucgaa

SEQ ID NO: 2182854 - RNA, 21 nt, Streptococcus pneumoniae R6
augcuccaauacaaauuguaa

SEQ ID NO: 2182855 - RNA, 19 nt, Streptococcus pneumoniae R6
augcugacaagucauccau

SEQ ID NO: 2182856 - RNA, 18 nt, Streptococcus pneumoniae R6
augcugaccgcaaaagcu

SEQ ID NO: 2182857 - RNA, 12 nt, Streptococcus pneumoniae R6
augccaaagaaa

SEQ ID NO: 2182858 - RNA, 14 nt, Streptococcus pneumoniae R6
augccaaagaaauu

SEQ ID NO: 2182859 - RNA, 12 nt, Streptococcus pneumoniae R6
augccagccuua

SEQ ID NO: 2182860 - RNA, 14 nt, Streptococcus pneumoniae R6
augccagucaguuu

SEQ ID NO: 2182861 - RNA, 14 nt, Streptococcus pneumoniae R6
augcccaagagacu

SEQ ID NO: 2182862 - RNA, 16 nt, Streptococcus pneumoniae R6
augcccaugaaaagau

SEQ ID NO: 2182863 - RNA, 13 nt, Streptococcus pneumoniae R6
auuuagauaguac

SEQ ID NO: 2182864 - RNA, 19 nt, Streptococcus pneumoniae R6
auuuagaucaucaaccuca

SEQ ID NO: 2182865 - RNA, 13 nt, Streptococcus pneumoniae R6
auuuagcuguauc

SEQ ID NO: 2182866 - RNA, 22 nt, Streptococcus pneumoniae R6
auuuaggacuaaauacaaaaac

SEQ ID NO: 2182867 - RNA, 17 nt, Streptococcus pneumoniae R6
auuuacuuggauucuuu

SEQ ID NO: 2182868 - RNA, 16 nt, Streptococcus pneumoniae R6
auuuacuuccuuuucu

SEQ ID NO: 2182869 - RNA, 14 nt, Streptococcus pneumoniae R6
auuuacuucuuuuu

SEQ ID NO: 2182870 - RNA, 17 nt, Streptococcus pneumoniae R6
auuuacuucuuuuucuc

SEQ ID NO: 2182871 - RNA, 23 nt, Streptococcus pneumoniae R6
auuuacuucuuuuucuccuaaaa

SEQ ID NO: 2182872 - RNA, 14 nt, Streptococcus pneumoniae R6
auuuacuguuuuag

SEQ ID NO: 2182873 - RNA, 16 nt, Streptococcus pneumoniae R6
auuuacuguuuuagcg

SEQ ID NO: 2182874 - RNA, 18 nt, Streptococcus pneumoniae R6
auuuacguugaauagcug

SEQ ID NO: 2182875 - RNA, 16 nt, Streptococcus pneumoniae R6
auuuacggaugcgauu

SEQ ID NO: 2182876 - RNA, 11 nt, Streptococcus pneumoniae R6
auuuaccaaaa

SEQ ID NO: 2182877 - RNA, 17 nt, Streptococcus pneumoniae R6
auugugcaguuuucauu

SEQ ID NO: 2182878 - RNA, 14 nt, Streptococcus pneumoniae R6
auugugccccugau

SEQ ID NO: 2182879 - RNA, 18 nt, Streptococcus pneumoniae R6
auuuaaaaauagauuuuu

SEQ ID NO: 2182880 - RNA, 23 nt, Streptococcus pneumoniae R6
auuuaaaaauguugcauuuuuua

SEQ ID NO: 2182881 - RNA, 21 nt, Streptococcus pneumoniae R6
auuuaaaacugugauauaaua

SEQ ID NO: 2182882 - RNA, 22 nt, Streptococcus pneumoniae R6
auuguuuuuaaaggaauuuuau

SEQ ID NO: 2182883 - RNA, 22 nt, Streptococcus pneumoniae R6
auuguuuuuuacauagaauaau

SEQ ID NO: 2182884 - RNA, 13 nt, Streptococcus pneumoniae R6
auuuaaaaagaaa

SEQ ID NO: 2182885 - RNA, 24 nt, Streptococcus pneumoniae R6
auuuaaaaucguagucuuucacca

SEQ ID NO: 2182886 - RNA, 22 nt, Streptococcus pneumoniae R6
auuuaagauaaguuccaucugg

SEQ ID NO: 2182887 - RNA, 16 nt, Streptococcus pneumoniae R6
auuuaagucaaagcca

SEQ ID NO: 2182888 - RNA, 14 nt, Streptococcus pneumoniae R6
auuuaauuagaaaa

SEQ ID NO: 2182889 - RNA, 16 nt, Streptococcus pneumoniae R6
auuuaauuagaaaaaa

SEQ ID NO: 2182890 - RNA, 17 nt, Streptococcus pneumoniae R6
auuuaauuagaaaaaaa

SEQ ID NO: 2182891 - RNA, 18 nt, Streptococcus pneumoniae R6
auuuaauuagaaaaaaau

SEQ ID NO: 2182892 - RNA, 19 nt, Streptococcus pneumoniae R6
auuuaauccacuauaauaa

SEQ ID NO: 2182893 - RNA, 21 nt, Streptococcus pneumoniae R6
auuuaaucauguaccuaagau

SEQ ID NO: 2182894 - RNA, 21 nt, Streptococcus pneumoniae R6
auuuaaucauuuaauaaugaa

SEQ ID NO: 2182895 - RNA, 20 nt, Streptococcus pneumoniae R6
auuuaauccaaaguaaaaua

SEQ ID NO: 2182896 - RNA, 14 nt, Streptococcus pneumoniae R6
auuggguaaagaua

SEQ ID NO: 2182897 - RNA, 13 nt, Streptococcus pneumoniae R6
auuggggauugau

SEQ ID NO: 2182898 - RNA, 13 nt, Streptococcus pneumoniae R6
auuggaucuggga

SEQ ID NO: 2182899 - RNA, 19 nt, Streptococcus pneumoniae R6
auuggcaggcguuuuuuga

SEQ ID NO: 2182900 - RNA, 23 nt, Streptococcus pneumoniae R6
auuggcaaagggagguaaagaua

SEQ ID NO: 2182901 - RNA, 16 nt, Streptococcus pneumoniae R6
aaaaguacuuucagaa

SEQ ID NO: 2182902 - RNA, 21 nt, Streptococcus pneumoniae R6
auuguauagugaauugaaaua

SEQ ID NO: 2182903 - RNA, 14 nt, Streptococcus pneumoniae R6
auuguauccuaaau

SEQ ID NO: 2182904 - RNA, 19 nt, Streptococcus pneumoniae R6
auugucaguugaaaaggca

SEQ ID NO: 2182905 - RNA, 21 nt, Streptococcus pneumoniae R6
auugucaguugaaaaggcauc

SEQ ID NO: 2182906 - RNA, 16 nt, Streptococcus pneumoniae R6
auugguaaauucuuca

SEQ ID NO: 2182907 - RNA, 23 nt, Streptococcus pneumoniae R6
auugguaaauucuucauacucaa

SEQ ID NO: 2182908 - RNA, 20 nt, Streptococcus pneumoniae R6
auuggucagauuguaaagga

SEQ ID NO: 2182909 - RNA, 13 nt, Streptococcus pneumoniae R6
aaaaggucaguug

SEQ ID NO: 2182910 - RNA, 17 nt, Streptococcus pneumoniae R6
auuggucgcuucaaguu

SEQ ID NO: 2182911 - RNA, 15 nt, Streptococcus pneumoniae R6
auuggucgcuuccaa

SEQ ID NO: 2182912 - RNA, 22 nt, Streptococcus pneumoniae R6
auuggucgcuuccaauuuuugc

SEQ ID NO: 2182913 - RNA, 13 nt, Streptococcus pneumoniae R6
aaaaguaaaaagg

SEQ ID NO: 2182914 - RNA, 24 nt, Streptococcus pneumoniae R6
aaaagguucuuuuauccuguucuu

SEQ ID NO: 2182915 - RNA, 20 nt, Streptococcus pneumoniae R6
auugcuaucuaggcugacaa

SEQ ID NO: 2182916 - RNA, 20 nt, Streptococcus pneumoniae R6
auugcgcggguucaauacaa

SEQ ID NO: 2182917 - RNA, 18 nt, Streptococcus pneumoniae R6
auugcucuugacucguca

SEQ ID NO: 2182918 - RNA, 16 nt, Streptococcus pneumoniae R6
auugcuucaucuuuca

SEQ ID NO: 2182919 - RNA, 16 nt, Streptococcus pneumoniae R6
auugcuuuaaucugcu

SEQ ID NO: 2182920 - RNA, 20 nt, Streptococcus pneumoniae R6
auugcuuucuucagauuuua

SEQ ID NO: 2182921 - RNA, 22 nt, Streptococcus pneumoniae R6
auugcuuucuucagauuuuaua

SEQ ID NO: 2182922 - RNA, 21 nt, Streptococcus pneumoniae R6
auugauauaaagagcacugcu

SEQ ID NO: 2182923 - RNA, 19 nt, Streptococcus pneumoniae R6
auugauauuuauagaaaau

SEQ ID NO: 2182924 - RNA, 13 nt, Streptococcus pneumoniae R6
auugauagccauu

SEQ ID NO: 2182925 - RNA, 14 nt, Streptococcus pneumoniae R6
auugauuauccuuu

SEQ ID NO: 2182926 - RNA, 20 nt, Streptococcus pneumoniae R6
auugauuauuacaacaauaa

SEQ ID NO: 2182927 - RNA, 14 nt, Streptococcus pneumoniae R6
auugauuaggaaau

SEQ ID NO: 2182928 - RNA, 15 nt, Streptococcus pneumoniae R6
auugauaaaauuuaa

SEQ ID NO: 2182929 - RNA, 23 nt, Streptococcus pneumoniae R6
auugauaaaauuuaaaaauagau

SEQ ID NO: 2182930 - RNA, 23 nt, Streptococcus pneumoniae R6
auugaguuuuuugacuucaauca

SEQ ID NO: 2182931 - RNA, 21 nt, Streptococcus pneumoniae R6
auugauaagaggauuuuaaag

SEQ ID NO: 2182932 - RNA, 19 nt, Streptococcus pneumoniae R6
auugauuuucaucaucaca

SEQ ID NO: 2182933 - RNA, 22 nt, Streptococcus pneumoniae R6
auugauuugaaugccaaaauuc

SEQ ID NO: 2182934 - RNA, 23 nt, Streptococcus pneumoniae R6
auugauuccgucauguucauuug

SEQ ID NO: 2182935 - RNA, 15 nt, Streptococcus pneumoniae R6
auugauugagaaauc

SEQ ID NO: 2182936 - RNA, 22 nt, Streptococcus pneumoniae R6
auugauuuuucugagucuguga

SEQ ID NO: 2182937 - RNA, 20 nt, Streptococcus pneumoniae R6
auugacauaccaccaaguac

SEQ ID NO: 2182938 - RNA, 17 nt, Streptococcus pneumoniae R6
auugacagaaccuugga

SEQ ID NO: 2182939 - RNA, 18 nt, Streptococcus pneumoniae R6
auugacuauagcagauug

SEQ ID NO: 2182940 - RNA, 22 nt, Streptococcus pneumoniae R6
auugaauaaagucaacagaguu

SEQ ID NO: 2182941 - RNA, 23 nt, Streptococcus pneumoniae R6
auugaauuucaagaaugaaaguu

SEQ ID NO: 2182942 - RNA, 19 nt, Streptococcus pneumoniae R6
auugacugcccagacacuu

SEQ ID NO: 2182943 - RNA, 14 nt, Streptococcus pneumoniae R6
auugagaagccaaa

SEQ ID NO: 2182944 - RNA, 15 nt, Streptococcus pneumoniae R6
auugagaaagaugau

SEQ ID NO: 2182945 - RNA, 20 nt, Streptococcus pneumoniae R6
auugagaaaguuaaaaaaac

SEQ ID NO: 2182946 - RNA, 15 nt, Streptococcus pneumoniae R6
auugacuuuugaaaa

SEQ ID NO: 2182947 - RNA, 19 nt, Streptococcus pneumoniae R6
auugagagcgacuuuuucu

SEQ ID NO: 2182948 - RNA, 16 nt, Streptococcus pneumoniae R6
auugagacgacuacuu

SEQ ID NO: 2182949 - RNA, 21 nt, Streptococcus pneumoniae R6
auugaggaaguaccaaggaag

SEQ ID NO: 2182950 - RNA, 15 nt, Streptococcus pneumoniae R6
auugaggacaauagc

SEQ ID NO: 2182951 - RNA, 15 nt, Streptococcus pneumoniae R6
auugagguccaaguu

SEQ ID NO: 2182952 - RNA, 15 nt, Streptococcus pneumoniae R6
auucucagguuuuuc

SEQ ID NO: 2182953 - RNA, 17 nt, Streptococcus pneumoniae R6
auucuaguuucaauaua

SEQ ID NO: 2182954 - RNA, 15 nt, Streptococcus pneumoniae R6
auucuaguccaucuc

SEQ ID NO: 2182955 - RNA, 16 nt, Streptococcus pneumoniae R6
auucuaguccaucucc

SEQ ID NO: 2182956 - RNA, 20 nt, Streptococcus pneumoniae R6
auucuaggcuaucgauauca

SEQ ID NO: 2182957 - RNA, 12 nt, Streptococcus pneumoniae R6
auucuuaaaauu

SEQ ID NO: 2182958 - RNA, 19 nt, Streptococcus pneumoniae R6
auucugucacaacugaacg

SEQ ID NO: 2182959 - RNA, 21 nt, Streptococcus pneumoniae R6
auucugugguaaugcuuucca

SEQ ID NO: 2182960 - RNA, 20 nt, Streptococcus pneumoniae R6
auugaaagucuuggaaaaug

SEQ ID NO: 2182961 - RNA, 17 nt, Streptococcus pneumoniae R6
auugaaauaagaaauag

SEQ ID NO: 2182962 - RNA, 17 nt, Streptococcus pneumoniae R6
auucuuuuuaaauaaau

SEQ ID NO: 2182963 - RNA, 13 nt, Streptococcus pneumoniae R6
auucuuugaaauc

SEQ ID NO: 2182964 - RNA, 18 nt, Streptococcus pneumoniae R6
auucuuuccuuuuacagu

SEQ ID NO: 2182965 - RNA, 14 nt, Streptococcus pneumoniae R6
auucuucauagagu

SEQ ID NO: 2182966 - RNA, 17 nt, Streptococcus pneumoniae R6
auucuuacuaccuacuu

SEQ ID NO: 2182967 - RNA, 12 nt, Streptococcus pneumoniae R6
auucuuauauua

SEQ ID NO: 2182968 - RNA, 18 nt, Streptococcus pneumoniae R6
auucuuauuucaaaaaau

SEQ ID NO: 2182969 - RNA, 16 nt, Streptococcus pneumoniae R6
auucuuauuucauuuu

SEQ ID NO: 2182970 - RNA, 14 nt, Streptococcus pneumoniae R6
auucuacuuuuuca

SEQ ID NO: 2182971 - RNA, 14 nt, Streptococcus pneumoniae R6
auucuaaauucaau

SEQ ID NO: 2182972 - RNA, 15 nt, Streptococcus pneumoniae R6
auucguuugaagcug

SEQ ID NO: 2182973 - RNA, 16 nt, Streptococcus pneumoniae R6
auucgcuuuuuuaaau

SEQ ID NO: 2182974 - RNA, 21 nt, Streptococcus pneumoniae R6
auucgcuuuuuuaaaugcugu

SEQ ID NO: 2182975 - RNA, 23 nt, Streptococcus pneumoniae R6
auucggaaagccaaaucaauuuc

SEQ ID NO: 2182976 - RNA, 20 nt, Streptococcus pneumoniae R6
auucgaaaaucaaagugcaa

SEQ ID NO: 2182977 - RNA, 20 nt, Streptococcus pneumoniae R6
auucgaaugauauuuucaaa

SEQ ID NO: 2182978 - RNA, 19 nt, Streptococcus pneumoniae R6
auucgaugguugucccugg

SEQ ID NO: 2182979 - RNA, 16 nt, Streptococcus pneumoniae R6
auucgauuacaaucau

SEQ ID NO: 2182980 - RNA, 15 nt, Streptococcus pneumoniae R6
auucgaugaaucauu

SEQ ID NO: 2182981 - RNA, 17 nt, Streptococcus pneumoniae R6
auucgaugaaucauuuc

SEQ ID NO: 2182982 - RNA, 16 nt, Streptococcus pneumoniae R6
auucgaucugauauau

SEQ ID NO: 2182983 - RNA, 20 nt, Streptococcus pneumoniae R6
auucgaucugauauauuuuc

SEQ ID NO: 2182984 - RNA, 17 nt, Streptococcus pneumoniae R6
auucccuuaaaguggga

SEQ ID NO: 2182985 - RNA, 16 nt, Streptococcus pneumoniae R6
auucccuuguagaaaa

SEQ ID NO: 2182986 - RNA, 17 nt, Streptococcus pneumoniae R6
auucccuuguagaaaag

SEQ ID NO: 2182987 - RNA, 17 nt, Streptococcus pneumoniae R6
auuccgacucugaaguc

SEQ ID NO: 2182988 - RNA, 13 nt, Streptococcus pneumoniae R6
auucccuuaucca

SEQ ID NO: 2182989 - RNA, 13 nt, Streptococcus pneumoniae R6
auucauaaagugc

SEQ ID NO: 2182990 - RNA, 14 nt, Streptococcus pneumoniae R6
auucauaaagugcu

SEQ ID NO: 2182991 - RNA, 12 nt, Streptococcus pneumoniae R6
auuccagacacu

SEQ ID NO: 2182992 - RNA, 15 nt, Streptococcus pneumoniae R6
auuccagcuucuugg

SEQ ID NO: 2182993 - RNA, 13 nt, Streptococcus pneumoniae R6
auuuucuucuuua

SEQ ID NO: 2182994 - RNA, 22 nt, Streptococcus pneumoniae R6
auuuucuucuuuauaauauuua

SEQ ID NO: 2182995 - RNA, 13 nt, Streptococcus pneumoniae R6
auuuucuuuacuu

SEQ ID NO: 2182996 - RNA, 18 nt, Streptococcus pneumoniae R6
auuuucuuuacuucugag

SEQ ID NO: 2182997 - RNA, 13 nt, Streptococcus pneumoniae R6
auuuucuuuaaaa

SEQ ID NO: 2182998 - RNA, 15 nt, Streptococcus pneumoniae R6
auuuugaaaaugaau

SEQ ID NO: 2182999 - RNA, 18 nt, Streptococcus pneumoniae R6
auuuucuuugauuuuaau

SEQ ID NO: 2183000 - RNA, 11 nt, Streptococcus pneumoniae R6
auuuugaaaug

SEQ ID NO: 2183001 - RNA, 13 nt, Streptococcus pneumoniae R6
auuuugaaaauuu

SEQ ID NO: 2183002 - RNA, 18 nt, Streptococcus pneumoniae R6
auuuugaagauuguuucg

SEQ ID NO: 2183003 - RNA, 17 nt, Streptococcus pneumoniae R6
auuuugacauucuaaaa

SEQ ID NO: 2183004 - RNA, 22 nt, Streptococcus pneumoniae R6
auuuugaccaccgagcaagaga

SEQ ID NO: 2183005 - RNA, 14 nt, Streptococcus pneumoniae R6
auuuugcacaauau

SEQ ID NO: 2183006 - RNA, 18 nt, Streptococcus pneumoniae R6
auuuuuacaguauuuaua

SEQ ID NO: 2183007 - RNA, 22 nt, Streptococcus pneumoniae R6
auuuuuaggaagguuauuugga

SEQ ID NO: 2183008 - RNA, 20 nt, Streptococcus pneumoniae R6
auuuuuacuuuauuuucuca

SEQ ID NO: 2183009 - RNA, 21 nt, Streptococcus pneumoniae R6
auuuuuacuuuauuuucucau

SEQ ID NO: 2183010 - RNA, 22 nt, Streptococcus pneumoniae R6
auuuuuagaaggauaaauuuua

SEQ ID NO: 2183011 - RNA, 23 nt, Streptococcus pneumoniae R6
auuuuuagaaggauaaauuuuau

SEQ ID NO: 2183012 - RNA, 14 nt, Streptococcus pneumoniae R6
auuuuguaaaaaag

SEQ ID NO: 2183013 - RNA, 16 nt, Streptococcus pneumoniae R6
auuuugguaauuuuca

SEQ ID NO: 2183014 - RNA, 20 nt, Streptococcus pneumoniae R6
auuuugguaauuuucaagaa

SEQ ID NO: 2183015 - RNA, 16 nt, Streptococcus pneumoniae R6
auuuuaucuuugaaau

SEQ ID NO: 2183016 - RNA, 13 nt, Streptococcus pneumoniae R6
auuuuaaagaaau

SEQ ID NO: 2183017 - RNA, 14 nt, Streptococcus pneumoniae R6
auuuuaaagaaaua

SEQ ID NO: 2183018 - RNA, 15 nt, Streptococcus pneumoniae R6
auuuuaaagaaauag

SEQ ID NO: 2183019 - RNA, 14 nt, Streptococcus pneumoniae R6
auuuuaaagacuuu

SEQ ID NO: 2183020 - RNA, 15 nt, Streptococcus pneumoniae R6
auuuuaaagacuuuu

SEQ ID NO: 2183021 - RNA, 19 nt, Streptococcus pneumoniae R6
auuuuaaagacuuuuuucu

SEQ ID NO: 2183022 - RNA, 14 nt, Streptococcus pneumoniae R6
auuuuauucauauc

SEQ ID NO: 2183023 - RNA, 19 nt, Streptococcus pneumoniae R6
auuuuauugucauuuuucu

SEQ ID NO: 2183024 - RNA, 13 nt, Streptococcus pneumoniae R6
auuuucagagggc

SEQ ID NO: 2183025 - RNA, 12 nt, Streptococcus pneumoniae R6
auuuucuuaaaa

SEQ ID NO: 2183026 - RNA, 11 nt, Streptococcus pneumoniae R6
auuuucuuauc

SEQ ID NO: 2183027 - RNA, 12 nt, Streptococcus pneumoniae R6
auuuucucuuug

SEQ ID NO: 2183028 - RNA, 23 nt, Streptococcus pneumoniae R6
auuuucucuuuguccuuuagaaa

SEQ ID NO: 2183029 - RNA, 16 nt, Streptococcus pneumoniae R6
auuuuccuaaucaauu

SEQ ID NO: 2183030 - RNA, 16 nt, Streptococcus pneumoniae R6
auuuuccaagacuuuc

SEQ ID NO: 2183031 - RNA, 16 nt, Streptococcus pneumoniae R6
auuuucagcaccugaa

SEQ ID NO: 2183032 - RNA, 20 nt, Streptococcus pneumoniae R6
caaaaacauaauuuuaguag

SEQ ID NO: 2183033 - RNA, 15 nt, Streptococcus pneumoniae R6
caaaaacaggacaaa

SEQ ID NO: 2183034 - RNA, 18 nt, Streptococcus pneumoniae R6
caaaaacaggacaaaucg

SEQ ID NO: 2183035 - RNA, 20 nt, Streptococcus pneumoniae R6
caaaaaggaguuaccuuucu

SEQ ID NO: 2183036 - RNA, 12 nt, Streptococcus pneumoniae R6
caaaaauauaau

SEQ ID NO: 2183037 - RNA, 18 nt, Streptococcus pneumoniae R6
caaaaauauaauggucug

SEQ ID NO: 2183038 - RNA, 16 nt, Streptococcus pneumoniae R6
caaaaauaucauuaag

SEQ ID NO: 2183039 - RNA, 14 nt, Streptococcus pneumoniae R6
caaaaaguccucuu

SEQ ID NO: 2183040 - RNA, 17 nt, Streptococcus pneumoniae R6
caaaaaucauuauauuu

SEQ ID NO: 2183041 - RNA, 15 nt, Streptococcus pneumoniae R6
caaaaccaaacucac

SEQ ID NO: 2183042 - RNA, 22 nt, Streptococcus pneumoniae R6
caaaaccaaacucacgaagaua

SEQ ID NO: 2183043 - RNA, 22 nt, Streptococcus pneumoniae R6
caaaacaguguuuugagcacgu

SEQ ID NO: 2183044 - RNA, 21 nt, Streptococcus pneumoniae R6
caaaacaguguuuugagcuga

SEQ ID NO: 2183045 - RNA, 15 nt, Streptococcus pneumoniae R6
caaaacacaaaaagu

SEQ ID NO: 2183046 - RNA, 16 nt, Streptococcus pneumoniae R6
caaaacacaaaaaguc

SEQ ID NO: 2183047 - RNA, 17 nt, Streptococcus pneumoniae R6
caaaacacuguuuuaag

SEQ ID NO: 2183048 - RNA, 19 nt, Streptococcus pneumoniae R6
caaaacacuguuuuaaggu

SEQ ID NO: 2183049 - RNA, 22 nt, Streptococcus pneumoniae R6
caaaacacuguuuugagcugac

SEQ ID NO: 2183050 - RNA, 23 nt, Streptococcus pneumoniae R6
caaaacacuguuuugagguugca

SEQ ID NO: 2183051 - RNA, 15 nt, Streptococcus pneumoniae R6
auuuuuuucaaacaa

SEQ ID NO: 2183052 - RNA, 17 nt, Streptococcus pneumoniae R6
caaaaaaauucuucaca

SEQ ID NO: 2183053 - RNA, 12 nt, Streptococcus pneumoniae R6
caaaaaagaaac

SEQ ID NO: 2183054 - RNA, 22 nt, Streptococcus pneumoniae R6
caaaaaagagguugucuguaac

SEQ ID NO: 2183055 - RNA, 20 nt, Streptococcus pneumoniae R6
auuuuuggcugauuucuugg

SEQ ID NO: 2183056 - RNA, 14 nt, Streptococcus pneumoniae R6
auuuuuggaaaaaa

SEQ ID NO: 2183057 - RNA, 23 nt, Streptococcus pneumoniae R6
auuuuuuaacauacuguuuuccu

SEQ ID NO: 2183058 - RNA, 16 nt, Streptococcus pneumoniae R6
auuuuuugcaucaacu

SEQ ID NO: 2183059 - RNA, 18 nt, Streptococcus pneumoniae R6
auuuuuucuguaaaauca

SEQ ID NO: 2183060 - RNA, 17 nt, Streptococcus pneumoniae R6
auuuuuugaaucaauuu

SEQ ID NO: 2183061 - RNA, 19 nt, Streptococcus pneumoniae R6
auuuuuugaaauaagaaua

SEQ ID NO: 2183062 - RNA, 14 nt, Streptococcus pneumoniae R6
auuuuuauugagua

SEQ ID NO: 2183063 - RNA, 22 nt, Streptococcus pneumoniae R6
auuuguaucaccaagcauuuuc

SEQ ID NO: 2183064 - RNA, 22 nt, Streptococcus pneumoniae R6
auuugucaaauugcuuaaaaua

SEQ ID NO: 2183065 - RNA, 15 nt, Streptococcus pneumoniae R6
auuugucauucagau

SEQ ID NO: 2183066 - RNA, 22 nt, Streptococcus pneumoniae R6
auuugugauacgugaacaaguc

SEQ ID NO: 2183067 - RNA, 18 nt, Streptococcus pneumoniae R6
auuuguucuguucuuauu

SEQ ID NO: 2183068 - RNA, 21 nt, Streptococcus pneumoniae R6
auuugcuuuucuuuuuuauag

SEQ ID NO: 2183069 - RNA, 23 nt, Streptococcus pneumoniae R6
auuuggagcaagugguucuccaa

SEQ ID NO: 2183070 - RNA, 17 nt, Streptococcus pneumoniae R6
auuugcuucaucauuuu

SEQ ID NO: 2183071 - RNA, 19 nt, Streptococcus pneumoniae R6
auuugcuucaucauuuuau

SEQ ID NO: 2183072 - RNA, 20 nt, Streptococcus pneumoniae R6
auuugguuuuuggcaauuuu

SEQ ID NO: 2183073 - RNA, 22 nt, Streptococcus pneumoniae R6
auuugguuuuuggcaauuuuug

SEQ ID NO: 2183074 - RNA, 23 nt, Streptococcus pneumoniae R6
auuugguuuuuggcaauuuuuga

SEQ ID NO: 2183075 - RNA, 21 nt, Streptococcus pneumoniae R6
auuuguaaaauugguguugga

SEQ ID NO: 2183076 - RNA, 16 nt, Streptococcus pneumoniae R6
auuuggguaggucuuu

SEQ ID NO: 2183077 - RNA, 21 nt, Streptococcus pneumoniae R6
auuugggcaaucgccaauucu

SEQ ID NO: 2183078 - RNA, 21 nt, Streptococcus pneumoniae R6
auuugacuggagaguugugaa

SEQ ID NO: 2183079 - RNA, 18 nt, Streptococcus pneumoniae R6
auuugaugcugcauuucu

SEQ ID NO: 2183080 - RNA, 17 nt, Streptococcus pneumoniae R6
auuugacguuuccuucu

SEQ ID NO: 2183081 - RNA, 18 nt, Streptococcus pneumoniae R6
auuugacguuuccuucua

SEQ ID NO: 2183082 - RNA, 17 nt, Streptococcus pneumoniae R6
auuugacauaaucgcug

SEQ ID NO: 2183083 - RNA, 17 nt, Streptococcus pneumoniae R6
auuugacgaacaaaaag

SEQ ID NO: 2183084 - RNA, 22 nt, Streptococcus pneumoniae R6
auuugacgaacggguucuucca

SEQ ID NO: 2183085 - RNA, 15 nt, Streptococcus pneumoniae R6
auuucuuuugauggu

SEQ ID NO: 2183086 - RNA, 21 nt, Streptococcus pneumoniae R6
auuucuuuuacucucauucuu

SEQ ID NO: 2183087 - RNA, 21 nt, Streptococcus pneumoniae R6
auuucuuuagucccauuuuca

SEQ ID NO: 2183088 - RNA, 15 nt, Streptococcus pneumoniae R6
auuucuuuauauaaa

SEQ ID NO: 2183089 - RNA, 19 nt, Streptococcus pneumoniae R6
auuucuuuauauaaaaaga

SEQ ID NO: 2183090 - RNA, 14 nt, Streptococcus pneumoniae R6
auuucuuugaaauc

SEQ ID NO: 2183091 - RNA, 18 nt, Streptococcus pneumoniae R6
auuucuugugcugacauu

SEQ ID NO: 2183092 - RNA, 12 nt, Streptococcus pneumoniae R6
auuucuuuaaaa

SEQ ID NO: 2183093 - RNA, 17 nt, Streptococcus pneumoniae R6
auuugauuuuguaaaaa

SEQ ID NO: 2183094 - RNA, 16 nt, Streptococcus pneumoniae R6
auuugcacuuugauuu

SEQ ID NO: 2183095 - RNA, 15 nt, Streptococcus pneumoniae R6
auuugccagaaaaag

SEQ ID NO: 2183096 - RNA, 18 nt, Streptococcus pneumoniae R6
auuugcaucccuugaaua

SEQ ID NO: 2183097 - RNA, 15 nt, Streptococcus pneumoniae R6
auuugcaucaaucuc

SEQ ID NO: 2183098 - RNA, 14 nt, Streptococcus pneumoniae R6
auuugcgcgcuuga

SEQ ID NO: 2183099 - RNA, 18 nt, Streptococcus pneumoniae R6
auuugcgcgcuugaauga

SEQ ID NO: 2183100 - RNA, 21 nt, Streptococcus pneumoniae R6
auuugccuaugaaaugagaaa

SEQ ID NO: 2183101 - RNA, 22 nt, Streptococcus pneumoniae R6
auuuaguacucuguaaaacucu

SEQ ID NO: 2183102 - RNA, 14 nt, Streptococcus pneumoniae R6
auuucacuauguuu

SEQ ID NO: 2183103 - RNA, 22 nt, Streptococcus pneumoniae R6
auuucacuauguuuuaggaggu

SEQ ID NO: 2183104 - RNA, 20 nt, Streptococcus pneumoniae R6
auuucacuccacuauaaaac

SEQ ID NO: 2183105 - RNA, 14 nt, Streptococcus pneumoniae R6
auuucaagaacucc

SEQ ID NO: 2183106 - RNA, 22 nt, Streptococcus pneumoniae R6
auuucaagaaguugucugucuu

SEQ ID NO: 2183107 - RNA, 12 nt, Streptococcus pneumoniae R6
auuucaagaauu

SEQ ID NO: 2183108 - RNA, 18 nt, Streptococcus pneumoniae R6
auuucaagaccauuucca

SEQ ID NO: 2183109 - RNA, 19 nt, Streptococcus pneumoniae R6
auuuauaaaucuucuaaau

SEQ ID NO: 2183110 - RNA, 20 nt, Streptococcus pneumoniae R6
auuuauaaaucuucuaaauu

SEQ ID NO: 2183111 - RNA, 13 nt, Streptococcus pneumoniae R6
auuucacuuguau

SEQ ID NO: 2183112 - RNA, 16 nt, Streptococcus pneumoniae R6
auuucagaaaucuucu

SEQ ID NO: 2183113 - RNA, 17 nt, Streptococcus pneumoniae R6
auuucaguugccucaga

SEQ ID NO: 2183114 - RNA, 16 nt, Streptococcus pneumoniae R6
auuucaguuucgccug

SEQ ID NO: 2183115 - RNA, 21 nt, Streptococcus pneumoniae R6
auuucaguuccccaaaaagua

SEQ ID NO: 2183116 - RNA, 22 nt, Streptococcus pneumoniae R6
auuucaguuccccaaaaaguag

SEQ ID NO: 2183117 - RNA, 17 nt, Streptococcus pneumoniae R6
auuucauacgauaaaaa

SEQ ID NO: 2183118 - RNA, 18 nt, Streptococcus pneumoniae R6
auuucauacgauaaaaau

SEQ ID NO: 2183119 - RNA, 23 nt, Streptococcus pneumoniae R6
auuucauagcuaaucaagcgguu

SEQ ID NO: 2183120 - RNA, 14 nt, Streptococcus pneumoniae R6
auuucauuaaaugg

SEQ ID NO: 2183121 - RNA, 22 nt, Streptococcus pneumoniae R6
auuucauuaaauggaauaguau

SEQ ID NO: 2183122 - RNA, 21 nt, Streptococcus pneumoniae R6
auuucauuacagaacauuuua

SEQ ID NO: 2183123 - RNA, 23 nt, Streptococcus pneumoniae R6
auuucaugguucgggauaaaaua

SEQ ID NO: 2183124 - RNA, 13 nt, Streptococcus pneumoniae R6
auuucauauuuuc

SEQ ID NO: 2183125 - RNA, 16 nt, Streptococcus pneumoniae R6
auuuccucaauguuuu

SEQ ID NO: 2183126 - RNA, 18 nt, Streptococcus pneumoniae R6
auuuccucaauguuuuau

SEQ ID NO: 2183127 - RNA, 20 nt, Streptococcus pneumoniae R6
auuuccuagccuauuuuuua

SEQ ID NO: 2183128 - RNA, 17 nt, Streptococcus pneumoniae R6
auuuccuaguagaucau

SEQ ID NO: 2183129 - RNA, 15 nt, Streptococcus pneumoniae R6
auuuccuucguuuuc

SEQ ID NO: 2183130 - RNA, 22 nt, Streptococcus pneumoniae R6
auuuccuucgcacuuauuuuau

SEQ ID NO: 2183131 - RNA, 21 nt, Streptococcus pneumoniae R6
auuuccaaaaaguaggcauaa

SEQ ID NO: 2183132 - RNA, 13 nt, Streptococcus pneumoniae R6
auuucauuuuaau

SEQ ID NO: 2183133 - RNA, 18 nt, Streptococcus pneumoniae R6
auuucauuuuaauauaua

SEQ ID NO: 2183134 - RNA, 21 nt, Streptococcus pneumoniae R6
auuucauuuggcuauaaaaaa

SEQ ID NO: 2183135 - RNA, 22 nt, Streptococcus pneumoniae R6
auuucauuccaucauaaaaaua

SEQ ID NO: 2183136 - RNA, 16 nt, Streptococcus pneumoniae R6
auuuccaaucuucucc

SEQ ID NO: 2183137 - RNA, 19 nt, Streptococcus pneumoniae R6
auuucauuuucuacuaaaa

SEQ ID NO: 2183138 - RNA, 12 nt, Streptococcus pneumoniae R6
auuucgauaaag

SEQ ID NO: 2183139 - RNA, 22 nt, Streptococcus pneumoniae R6
auuucuaauacaagcucaucuu

SEQ ID NO: 2183140 - RNA, 17 nt, Streptococcus pneumoniae R6
auuucuaacaauauuuu

SEQ ID NO: 2183141 - RNA, 13 nt, Streptococcus pneumoniae R6
auuucuaacauau

SEQ ID NO: 2183142 - RNA, 16 nt, Streptococcus pneumoniae R6
auuucuaacauauuuc

SEQ ID NO: 2183143 - RNA, 15 nt, Streptococcus pneumoniae R6
auuucuaugauaaaa

SEQ ID NO: 2183144 - RNA, 17 nt, Streptococcus pneumoniae R6
auuucuauuuuaaaaau

SEQ ID NO: 2183145 - RNA, 19 nt, Streptococcus pneumoniae R6
auuucuagcaaaguuuuag

SEQ ID NO: 2183146 - RNA, 20 nt, Streptococcus pneumoniae R6
auuucuauaaaucaauuuuc

SEQ ID NO: 2183147 - RNA, 18 nt, Streptococcus pneumoniae R6
auuucuauaaauucauuu

SEQ ID NO: 2183148 - RNA, 17 nt, Streptococcus pneumoniae R6
auuucuauacuuuuucu

SEQ ID NO: 2183149 - RNA, 18 nt, Streptococcus pneumoniae R6
auuucuaguuuugguuuu

SEQ ID NO: 2183150 - RNA, 22 nt, Streptococcus pneumoniae R6
auuucuauaggucguguauaga

SEQ ID NO: 2183151 - RNA, 13 nt, Streptococcus pneumoniae R6
auuucuacaaaug

SEQ ID NO: 2183152 - RNA, 19 nt, Streptococcus pneumoniae R6
auuucuacaaauguuuuag

SEQ ID NO: 2183153 - RNA, 19 nt, Streptococcus pneumoniae R6
auuucuacuguauacuuuu

SEQ ID NO: 2183154 - RNA, 22 nt, Streptococcus pneumoniae R6
auuucuacuguauacuuuuuca

SEQ ID NO: 2183155 - RNA, 13 nt, Streptococcus pneumoniae R6
auuucuagaaaua

SEQ ID NO: 2183156 - RNA, 14 nt, Streptococcus pneumoniae R6
auuucuagaaauua

SEQ ID NO: 2183157 - RNA, 15 nt, Streptococcus pneumoniae R6
auuucuagaaauuaa

SEQ ID NO: 2183158 - RNA, 23 nt, Streptococcus pneumoniae R6
cacaaaguggagguguucuauca

SEQ ID NO: 2183159 - RNA, 15 nt, Streptococcus pneumoniae R6
cacaaaugagauaag

SEQ ID NO: 2183160 - RNA, 21 nt, Streptococcus pneumoniae R6
cacaaaugagauaagcgauuu

SEQ ID NO: 2183161 - RNA, 22 nt, Streptococcus pneumoniae R6
cacaaugguuagaaaaucaagu

SEQ ID NO: 2183162 - RNA, 24 nt, Streptococcus pneumoniae R6
cacagaccuguccaacagacucau

SEQ ID NO: 2183163 - RNA, 21 nt, Streptococcus pneumoniae R6
cacagugggcuauuccauauu

SEQ ID NO: 2183164 - RNA, 13 nt, Streptococcus pneumoniae R6
caauuuuuccuuu

SEQ ID NO: 2183165 - RNA, 21 nt, Streptococcus pneumoniae R6
caauuuuucggccaccugauc

SEQ ID NO: 2183166 - RNA, 13 nt, Streptococcus pneumoniae R6
caauuuuugaaag

SEQ ID NO: 2183167 - RNA, 16 nt, Streptococcus pneumoniae R6
caauuuuuuauagaca

SEQ ID NO: 2183168 - RNA, 17 nt, Streptococcus pneumoniae R6
cacaaaaaguccucuuu

SEQ ID NO: 2183169 - RNA, 21 nt, Streptococcus pneumoniae R6
cacaaaaaguggauuuuucuu

SEQ ID NO: 2183170 - RNA, 15 nt, Streptococcus pneumoniae R6
cacaaaaucaggaaa

SEQ ID NO: 2183171 - RNA, 16 nt, Streptococcus pneumoniae R6
cacaaaaucaggaaau

SEQ ID NO: 2183172 - RNA, 19 nt, Streptococcus pneumoniae R6
cacaaaaucaggaaaucuu

SEQ ID NO: 2183173 - RNA, 20 nt, Streptococcus pneumoniae R6
cacaaacaaggugaacuuga

SEQ ID NO: 2183174 - RNA, 15 nt, Streptococcus pneumoniae R6
caauuguuuauaaaa

SEQ ID NO: 2183175 - RNA, 19 nt, Streptococcus pneumoniae R6
caauuguuuauaaaauaac

SEQ ID NO: 2183176 - RNA, 19 nt, Streptococcus pneumoniae R6
caauugugcauaagaaacu

SEQ ID NO: 2183177 - RNA, 11 nt, Streptococcus pneumoniae R6
caauuuuccuu

SEQ ID NO: 2183178 - RNA, 17 nt, Streptococcus pneumoniae R6
caauuuuacuucuuccc

SEQ ID NO: 2183179 - RNA, 17 nt, Streptococcus pneumoniae R6
caauuuuaggagaaaaa

SEQ ID NO: 2183180 - RNA, 17 nt, Streptococcus pneumoniae R6
caauuuuauacucaucu

SEQ ID NO: 2183181 - RNA, 19 nt, Streptococcus pneumoniae R6
caauuuuauacucaucugu

SEQ ID NO: 2183182 - RNA, 19 nt, Streptococcus pneumoniae R6
caauuuuaccauucuucau

SEQ ID NO: 2183183 - RNA, 22 nt, Streptococcus pneumoniae R6
caauuuuaaccagaucuuagaa

SEQ ID NO: 2183184 - RNA, 16 nt, Streptococcus pneumoniae R6
caauuuguuuucaagu

SEQ ID NO: 2183185 - RNA, 13 nt, Streptococcus pneumoniae R6
caauuuugaaaga

SEQ ID NO: 2183186 - RNA, 16 nt, Streptococcus pneumoniae R6
caauuuugaaagauuc

SEQ ID NO: 2183187 - RNA, 16 nt, Streptococcus pneumoniae R6
caauguuuuagaaaua

SEQ ID NO: 2183188 - RNA, 20 nt, Streptococcus pneumoniae R6
caauguuuugaucugacuuc

SEQ ID NO: 2183189 - RNA, 22 nt, Streptococcus pneumoniae R6
caauguuuugaucugacuucgu

SEQ ID NO: 2183190 - RNA, 23 nt, Streptococcus pneumoniae R6
caauguuuugaucugacuucguc

SEQ ID NO: 2183191 - RNA, 23 nt, Streptococcus pneumoniae R6
caauuaagguuuuaccuucaagu

SEQ ID NO: 2183192 - RNA, 14 nt, Streptococcus pneumoniae R6
caauuaauuuaucc

SEQ ID NO: 2183193 - RNA, 21 nt, Streptococcus pneumoniae R6
caauuaauuuauccgaaggau

SEQ ID NO: 2183194 - RNA, 14 nt, Streptococcus pneumoniae R6
caauuaauucuaaa

SEQ ID NO: 2183195 - RNA, 20 nt, Streptococcus pneumoniae R6
caauuagccuucauuacuua

SEQ ID NO: 2183196 - RNA, 22 nt, Streptococcus pneumoniae R6
caauuagcaagaaauugauaua

SEQ ID NO: 2183197 - RNA, 24 nt, Streptococcus pneumoniae R6
caauuagcaagaaauugauauaau

SEQ ID NO: 2183198 - RNA, 22 nt, Streptococcus pneumoniae R6
caauuauaauaaaaugaaauaa

SEQ ID NO: 2183199 - RNA, 12 nt, Streptococcus pneumoniae R6
caauuauauaaa

SEQ ID NO: 2183200 - RNA, 19 nt, Streptococcus pneumoniae R6
caauugacuauagcagauu

SEQ ID NO: 2183201 - RNA, 18 nt, Streptococcus pneumoniae R6
caauugauuugaaugcca

SEQ ID NO: 2183202 - RNA, 16 nt, Streptococcus pneumoniae R6
caauucacuauaguuu

SEQ ID NO: 2183203 - RNA, 19 nt, Streptococcus pneumoniae R6
caauucuuuagcagaugcu

SEQ ID NO: 2183204 - RNA, 17 nt, Streptococcus pneumoniae R6
cacaugccuucuucgau

SEQ ID NO: 2183205 - RNA, 19 nt, Streptococcus pneumoniae R6
cacaugacaaauucuccac

SEQ ID NO: 2183206 - RNA, 22 nt, Streptococcus pneumoniae R6
cacaugacaaauucuccacaga

SEQ ID NO: 2183207 - RNA, 13 nt, Streptococcus pneumoniae R6
cacaucuacuucu

SEQ ID NO: 2183208 - RNA, 14 nt, Streptococcus pneumoniae R6
cacaucuacuucua

SEQ ID NO: 2183209 - RNA, 15 nt, Streptococcus pneumoniae R6
caccaaggucauaaa

SEQ ID NO: 2183210 - RNA, 11 nt, Streptococcus pneumoniae R6
caccaauacag

SEQ ID NO: 2183211 - RNA, 14 nt, Streptococcus pneumoniae R6
caccaauacagcuu

SEQ ID NO: 2183212 - RNA, 14 nt, Streptococcus pneumoniae R6
caccaagucaucaa

SEQ ID NO: 2183213 - RNA, 19 nt, Streptococcus pneumoniae R6
caccaagucaucaaaaaua

SEQ ID NO: 2183214 - RNA, 16 nt, Streptococcus pneumoniae R6
cacauucguuccuuua

SEQ ID NO: 2183215 - RNA, 20 nt, Streptococcus pneumoniae R6
cacauucguuccuuuaaaau

SEQ ID NO: 2183216 - RNA, 17 nt, Streptococcus pneumoniae R6
cacauugaaaaugugaa

SEQ ID NO: 2183217 - RNA, 16 nt, Streptococcus pneumoniae R6
caccaccugcaacaau

SEQ ID NO: 2183218 - RNA, 18 nt, Streptococcus pneumoniae R6
caccaccugccacaacua

SEQ ID NO: 2183219 - RNA, 16 nt, Streptococcus pneumoniae R6
caccaauuuuacaaau

SEQ ID NO: 2183220 - RNA, 18 nt, Streptococcus pneumoniae R6
caccaauuuuaccuuuca

SEQ ID NO: 2183221 - RNA, 14 nt, Streptococcus pneumoniae R6
caccaaucaaauca

SEQ ID NO: 2183222 - RNA, 13 nt, Streptococcus pneumoniae R6
caccaaucugccc

SEQ ID NO: 2183223 - RNA, 18 nt, Streptococcus pneumoniae R6
caccauaguguuucucug

SEQ ID NO: 2183224 - RNA, 11 nt, Streptococcus pneumoniae R6
aaaauaaaaaa

SEQ ID NO: 2183225 - RNA, 14 nt, Streptococcus pneumoniae R6
caccaggagccaag

SEQ ID NO: 2183226 - RNA, 16 nt, Streptococcus pneumoniae R6
caccaggagccaagau

SEQ ID NO: 2183227 - RNA, 21 nt, Streptococcus pneumoniae R6
caccaggagccaagauaggaa

SEQ ID NO: 2183228 - RNA, 13 nt, Streptococcus pneumoniae R6
aaaaguuuaaaaa

SEQ ID NO: 2183229 - RNA, 13 nt, Streptococcus pneumoniae R6
aaaaguuuaucua

SEQ ID NO: 2183230 - RNA, 16 nt, Streptococcus pneumoniae R6
aaaaguuuaucuagaa

SEQ ID NO: 2183231 - RNA, 15 nt, Streptococcus pneumoniae R6
aaaaguucaauuuca

SEQ ID NO: 2183232 - RNA, 23 nt, Streptococcus pneumoniae R6
aaaaguucucuuucuaaaauagu

SEQ ID NO: 2183233 - RNA, 17 nt, Streptococcus pneumoniae R6
aaaaguuagacaaauaa

SEQ ID NO: 2183234 - RNA, 22 nt, Streptococcus pneumoniae R6
aaaaguuagacaaauaauuuau

SEQ ID NO: 2183235 - RNA, 15 nt, Streptococcus pneumoniae R6
caccgaauuuuucaa

SEQ ID NO: 2183236 - RNA, 18 nt, Streptococcus pneumoniae R6
caccgaaggcuugcucug

SEQ ID NO: 2183237 - RNA, 21 nt, Streptococcus pneumoniae R6
caccgaaggcuugcucuguca

SEQ ID NO: 2183238 - RNA, 13 nt, Streptococcus pneumoniae R6
caccgaagucagu

SEQ ID NO: 2183239 - RNA, 13 nt, Streptococcus pneumoniae R6
caccugcaauaau

SEQ ID NO: 2183240 - RNA, 12 nt, Streptococcus pneumoniae R6
caccugauuuua

SEQ ID NO: 2183241 - RNA, 14 nt, Streptococcus pneumoniae R6
caccugcagcgauu

SEQ ID NO: 2183242 - RNA, 17 nt, Streptococcus pneumoniae R6
caccuccgccuccagag

SEQ ID NO: 2183243 - RNA, 18 nt, Streptococcus pneumoniae R6
caccuccgccuccagaga

SEQ ID NO: 2183244 - RNA, 14 nt, Streptococcus pneumoniae R6
caccuccuucucca

SEQ ID NO: 2183245 - RNA, 15 nt, Streptococcus pneumoniae R6
caccuccuucuccag

SEQ ID NO: 2183246 - RNA, 22 nt, Streptococcus pneumoniae R6
aaaauaaguuagaauauguaag

SEQ ID NO: 2183247 - RNA, 23 nt, Streptococcus pneumoniae R6
aaaauaaguuagaauauguaagu

SEQ ID NO: 2183248 - RNA, 17 nt, Streptococcus pneumoniae R6
aaaauaaguucaacaaa

SEQ ID NO: 2183249 - RNA, 13 nt, Streptococcus pneumoniae R6
aaaauaaucaaaa

SEQ ID NO: 2183250 - RNA, 15 nt, Streptococcus pneumoniae R6
caccguaauuuccuc

SEQ ID NO: 2183251 - RNA, 17 nt, Streptococcus pneumoniae R6
caccguaauuuccucug

SEQ ID NO: 2183252 - RNA, 13 nt, Streptococcus pneumoniae R6
caccuuuucucaa

SEQ ID NO: 2183253 - RNA, 22 nt, Streptococcus pneumoniae R6
caccuuuguauggaaacucaaa

SEQ ID NO: 2183254 - RNA, 23 nt, Streptococcus pneumoniae R6
caccuuuguauggaaacucaaaa

SEQ ID NO: 2183255 - RNA, 18 nt, Streptococcus pneumoniae R6
cacgaaucaauuucuuca

SEQ ID NO: 2183256 - RNA, 13 nt, Streptococcus pneumoniae R6
cacgaauaaccaa

SEQ ID NO: 2183257 - RNA, 15 nt, Streptococcus pneumoniae R6
cacgaaguccuuguu

SEQ ID NO: 2183258 - RNA, 15 nt, Streptococcus pneumoniae R6
cacggcuaauaccag

SEQ ID NO: 2183259 - RNA, 22 nt, Streptococcus pneumoniae R6
cacggaauuuuucgacugugau

SEQ ID NO: 2183260 - RNA, 17 nt, Streptococcus pneumoniae R6
cacgguauuuaagauaa

SEQ ID NO: 2183261 - RNA, 13 nt, Streptococcus pneumoniae R6
cacgguaaaauac

SEQ ID NO: 2183262 - RNA, 16 nt, Streptococcus pneumoniae R6
cacguaacauauuuuc

SEQ ID NO: 2183263 - RNA, 20 nt, Streptococcus pneumoniae R6
cacgguuuguauugaacccg

SEQ ID NO: 2183264 - RNA, 20 nt, Streptococcus pneumoniae R6
cacguccaucgaugauuggu

SEQ ID NO: 2183265 - RNA, 13 nt, Streptococcus pneumoniae R6
cacguccuagcuc

SEQ ID NO: 2183266 - RNA, 22 nt, Streptococcus pneumoniae R6
cacgucaacgucgccuugccgu

SEQ ID NO: 2183267 - RNA, 16 nt, Streptococcus pneumoniae R6
cacgucagcuuuaucu

SEQ ID NO: 2183268 - RNA, 20 nt, Streptococcus pneumoniae R6
caaaauucugucuuagacuu

SEQ ID NO: 2183269 - RNA, 20 nt, Streptococcus pneumoniae R6
caaaaugauugaaaggauug

SEQ ID NO: 2183270 - RNA, 12 nt, Streptococcus pneumoniae R6
caaaaugaaaag

SEQ ID NO: 2183271 - RNA, 22 nt, Streptococcus pneumoniae R6
caaaaugaggguccgaaccaca

SEQ ID NO: 2183272 - RNA, 15 nt, Streptococcus pneumoniae R6
caaaaucaugacaau

SEQ ID NO: 2183273 - RNA, 23 nt, Streptococcus pneumoniae R6
caaaaucaugacaaucaagaccc

SEQ ID NO: 2183274 - RNA, 17 nt, Streptococcus pneumoniae R6
caaaaucauaaacuauc

SEQ ID NO: 2183275 - RNA, 22 nt, Streptococcus pneumoniae R6
caaaaucauacuuagcuaauuu

SEQ ID NO: 2183276 - RNA, 14 nt, Streptococcus pneumoniae R6
caaaaucauagcau

SEQ ID NO: 2183277 - RNA, 20 nt, Streptococcus pneumoniae R6
caaaaucauagcauagauga

SEQ ID NO: 2183278 - RNA, 14 nt, Streptococcus pneumoniae R6
caaaaguuuaucua

SEQ ID NO: 2183279 - RNA, 14 nt, Streptococcus pneumoniae R6
caaaauaaaaacau

SEQ ID NO: 2183280 - RNA, 20 nt, Streptococcus pneumoniae R6
caaaaguuagaaauaaaacu

SEQ ID NO: 2183281 - RNA, 17 nt, Streptococcus pneumoniae R6
caaaaguuagacaaaua

SEQ ID NO: 2183282 - RNA, 20 nt, Streptococcus pneumoniae R6
caaaaguuagauuuuuucug

SEQ ID NO: 2183283 - RNA, 20 nt, Streptococcus pneumoniae R6
caaaaccaguccuggaaaaa

SEQ ID NO: 2183284 - RNA, 17 nt, Streptococcus pneumoniae R6
caaaaccauucaaaaua

SEQ ID NO: 2183285 - RNA, 15 nt, Streptococcus pneumoniae R6
caaaauaaagcaaau

SEQ ID NO: 2183286 - RNA, 12 nt, Streptococcus pneumoniae R6
caaaaucaauga

SEQ ID NO: 2183287 - RNA, 15 nt, Streptococcus pneumoniae R6
caaaaucaaugacaa

SEQ ID NO: 2183288 - RNA, 20 nt, Streptococcus pneumoniae R6
caaaaucaggaaaucuucuc

SEQ ID NO: 2183289 - RNA, 13 nt, Streptococcus pneumoniae R6
caaaaucaaagac

SEQ ID NO: 2183290 - RNA, 15 nt, Streptococcus pneumoniae R6
caaacauugugagga

SEQ ID NO: 2183291 - RNA, 10 nt, Streptococcus pneumoniae R6
caaacauugu

SEQ ID NO: 2183292 - RNA, 16 nt, Streptococcus pneumoniae R6
caaacuaggaaaccag

SEQ ID NO: 2183293 - RNA, 16 nt, Streptococcus pneumoniae R6
caaacgagaaaacgau

SEQ ID NO: 2183294 - RNA, 19 nt, Streptococcus pneumoniae R6
caaacauucccacaauaaa

SEQ ID NO: 2183295 - RNA, 15 nt, Streptococcus pneumoniae R6
caaacaucuggcuca

SEQ ID NO: 2183296 - RNA, 20 nt, Streptococcus pneumoniae R6
caaacaggauguguaaaaaa

SEQ ID NO: 2183297 - RNA, 21 nt, Streptococcus pneumoniae R6
caaacaggauguguaaaaaag

SEQ ID NO: 2183298 - RNA, 23 nt, Streptococcus pneumoniae R6
caaacaggauguguaaaaaagua

SEQ ID NO: 2183299 - RNA, 17 nt, Streptococcus pneumoniae R6
caaaguggagguguucu

SEQ ID NO: 2183300 - RNA, 18 nt, Streptococcus pneumoniae R6
caaaguggguuuuaacua

SEQ ID NO: 2183301 - RNA, 23 nt, Streptococcus pneumoniae R6
caaaguggguuuuaacuacauag

SEQ ID NO: 2183302 - RNA, 16 nt, Streptococcus pneumoniae R6
caaagguuugauuagu

SEQ ID NO: 2183303 - RNA, 18 nt, Streptococcus pneumoniae R6
caaagguuugauuagucc

SEQ ID NO: 2183304 - RNA, 14 nt, Streptococcus pneumoniae R6
caaagguugcuuga

SEQ ID NO: 2183305 - RNA, 19 nt, Streptococcus pneumoniae R6
caaagguugcuugauagua

SEQ ID NO: 2183306 - RNA, 21 nt, Streptococcus pneumoniae R6
caaaggugcagagagauaaau

SEQ ID NO: 2183307 - RNA, 18 nt, Streptococcus pneumoniae R6
caaaggucucuucuucug

SEQ ID NO: 2183308 - RNA, 16 nt, Streptococcus pneumoniae R6
caaaggugaagccuuc

SEQ ID NO: 2183309 - RNA, 18 nt, Streptococcus pneumoniae R6
caaaguuaaguauccauc

SEQ ID NO: 2183310 - RNA, 22 nt, Streptococcus pneumoniae R6
caaaguucgaaaggcuuuauuc

SEQ ID NO: 2183311 - RNA, 19 nt, Streptococcus pneumoniae R6
caaaguuccacccauggca

SEQ ID NO: 2183312 - RNA, 14 nt, Streptococcus pneumoniae R6
caaaguuccgaaaa

SEQ ID NO: 2183313 - RNA, 17 nt, Streptococcus pneumoniae R6
caaaguuccuaaaacca

SEQ ID NO: 2183314 - RNA, 21 nt, Streptococcus pneumoniae R6
caaauaaacggacaaaacugu

SEQ ID NO: 2183315 - RNA, 13 nt, Streptococcus pneumoniae R6
caaauaauaugua

SEQ ID NO: 2183316 - RNA, 14 nt, Streptococcus pneumoniae R6
caaauaagaaaucu

SEQ ID NO: 2183317 - RNA, 21 nt, Streptococcus pneumoniae R6
caaauaagaaaccgucaucag

SEQ ID NO: 2183318 - RNA, 14 nt, Streptococcus pneumoniae R6
caaauaagaaagac

SEQ ID NO: 2183319 - RNA, 16 nt, Streptococcus pneumoniae R6
caaauaagaaagacca

SEQ ID NO: 2183320 - RNA, 23 nt, Streptococcus pneumoniae R6
caaauaaaucauugauaguaaca

SEQ ID NO: 2183321 - RNA, 15 nt, Streptococcus pneumoniae R6
caaauagaagauuuc

SEQ ID NO: 2183322 - RNA, 15 nt, Streptococcus pneumoniae R6
caaauaauuuaucca

SEQ ID NO: 2183323 - RNA, 21 nt, Streptococcus pneumoniae R6
caaauaauuuauccaaaggau

SEQ ID NO: 2183324 - RNA, 18 nt, Streptococcus pneumoniae R6
caaacugaauccgcacug

SEQ ID NO: 2183325 - RNA, 17 nt, Streptococcus pneumoniae R6
caaagaguucccugcuc

SEQ ID NO: 2183326 - RNA, 18 nt, Streptococcus pneumoniae R6
caaagaguucccugcucu

SEQ ID NO: 2183327 - RNA, 23 nt, Streptococcus pneumoniae R6
caaagagccgggauuuuuuagcu

SEQ ID NO: 2183328 - RNA, 16 nt, Streptococcus pneumoniae R6
caaagagccauaaaaa

SEQ ID NO: 2183329 - RNA, 19 nt, Streptococcus pneumoniae R6
caaagagccauaaaaauaa

SEQ ID NO: 2183330 - RNA, 21 nt, Streptococcus pneumoniae R6
caaagagccauaaaaauaacu

SEQ ID NO: 2183331 - RNA, 13 nt, Streptococcus pneumoniae R6
caaagauaaaauu

SEQ ID NO: 2183332 - RNA, 14 nt, Streptococcus pneumoniae R6
caaagagagcagau

SEQ ID NO: 2183333 - RNA, 20 nt, Streptococcus pneumoniae R6
caaagacuucuugagcuagg

SEQ ID NO: 2183334 - RNA, 15 nt, Streptococcus pneumoniae R6
caaagcuacuuuuuu

SEQ ID NO: 2183335 - RNA, 22 nt, Streptococcus pneumoniae R6
caaagcuaagaaaguaagaauc

SEQ ID NO: 2183336 - RNA, 16 nt, Streptococcus pneumoniae R6
caaagcucaagaguuc

SEQ ID NO: 2183337 - RNA, 16 nt, Streptococcus pneumoniae R6
caaagcucccaaauua

SEQ ID NO: 2183338 - RNA, 17 nt, Streptococcus pneumoniae R6
caaaggaaccaaaugau

SEQ ID NO: 2183339 - RNA, 16 nt, Streptococcus pneumoniae R6
caaagggcaaaucuuu

SEQ ID NO: 2183340 - RNA, 22 nt, Streptococcus pneumoniae R6
caaagguaauccaauugaggaa

SEQ ID NO: 2183341 - RNA, 17 nt, Streptococcus pneumoniae R6
caaaggucauuuuccac

SEQ ID NO: 2183342 - RNA, 16 nt, Streptococcus pneumoniae R6
caaagccaaucaaaaa

SEQ ID NO: 2183343 - RNA, 17 nt, Streptococcus pneumoniae R6
caaagcagaugcaaaag

SEQ ID NO: 2183344 - RNA, 12 nt, Streptococcus pneumoniae R6
caaagauaucau

SEQ ID NO: 2183345 - RNA, 19 nt, Streptococcus pneumoniae R6
caaauagcccauaaagaga

SEQ ID NO: 2183346 - RNA, 22 nt, Streptococcus pneumoniae R6
caaauagcccauaaagagaggu

SEQ ID NO: 2183347 - RNA, 18 nt, Streptococcus pneumoniae R6
caaauuaauuuauagaaa

SEQ ID NO: 2183348 - RNA, 20 nt, Streptococcus pneumoniae R6
caaauuaauuuauagaaaua

SEQ ID NO: 2183349 - RNA, 20 nt, Streptococcus pneumoniae R6
caaauuauuuacagaaagaa

SEQ ID NO: 2183350 - RNA, 22 nt, Streptococcus pneumoniae R6
caaauuauuuacagaaagaaca

SEQ ID NO: 2183351 - RNA, 15 nt, Streptococcus pneumoniae R6
caaauuugaaaaucu

SEQ ID NO: 2183352 - RNA, 22 nt, Streptococcus pneumoniae R6
caaauugauuaggaaauucaaa

SEQ ID NO: 2183353 - RNA, 15 nt, Streptococcus pneumoniae R6
caaauugaaauaaga

SEQ ID NO: 2183354 - RNA, 19 nt, Streptococcus pneumoniae R6
caaauugaaauaagaaaua

SEQ ID NO: 2183355 - RNA, 21 nt, Streptococcus pneumoniae R6
caacaaaaaaggucaucagca

SEQ ID NO: 2183356 - RNA, 23 nt, Streptococcus pneumoniae R6
caacaaaaaaggucaucagcaga

SEQ ID NO: 2183357 - RNA, 13 nt, Streptococcus pneumoniae R6
caaauuuuguccu

SEQ ID NO: 2183358 - RNA, 13 nt, Streptococcus pneumoniae R6
caaauuuucuuua

SEQ ID NO: 2183359 - RNA, 19 nt, Streptococcus pneumoniae R6
caaauuuucuuuacuauag

SEQ ID NO: 2183360 - RNA, 14 nt, Streptococcus pneumoniae R6
caaauuugaccauu

SEQ ID NO: 2183361 - RNA, 15 nt, Streptococcus pneumoniae R6
caaauuugacuaaaa

SEQ ID NO: 2183362 - RNA, 16 nt, Streptococcus pneumoniae R6
caacaauaagagaauu

SEQ ID NO: 2183363 - RNA, 14 nt, Streptococcus pneumoniae R6
caacacaccuuguc

SEQ ID NO: 2183364 - RNA, 18 nt, Streptococcus pneumoniae R6
caacaauucuuggaucuu

SEQ ID NO: 2183365 - RNA, 21 nt, Streptococcus pneumoniae R6
caacaaucguaaccaauuucu

SEQ ID NO: 2183366 - RNA, 23 nt, Streptococcus pneumoniae R6
caacaccugucaagaccauggcg

SEQ ID NO: 2183367 - RNA, 18 nt, Streptococcus pneumoniae R6
caacagaaauaaccccau

SEQ ID NO: 2183368 - RNA, 13 nt, Streptococcus pneumoniae R6
caacagagaaaau

SEQ ID NO: 2183369 - RNA, 15 nt, Streptococcus pneumoniae R6
caacagcuccauaac

SEQ ID NO: 2183370 - RNA, 20 nt, Streptococcus pneumoniae R6
caacgaguguauuguacuuu

SEQ ID NO: 2183371 - RNA, 17 nt, Streptococcus pneumoniae R6
caaccuuucucagauaa

SEQ ID NO: 2183372 - RNA, 19 nt, Streptococcus pneumoniae R6
caaccuuucucagauaaua

SEQ ID NO: 2183373 - RNA, 23 nt, Streptococcus pneumoniae R6
caaccuuucucagauaauaauug

SEQ ID NO: 2183374 - RNA, 17 nt, Streptococcus pneumoniae R6
caaccugaaucuccuca

SEQ ID NO: 2183375 - RNA, 17 nt, Streptococcus pneumoniae R6
caaccugcgacuagcuu

SEQ ID NO: 2183376 - RNA, 21 nt, Streptococcus pneumoniae R6
caacaggauuuuguucuuuuu

SEQ ID NO: 2183377 - RNA, 14 nt, Streptococcus pneumoniae R6
caacauaaguugua

SEQ ID NO: 2183378 - RNA, 15 nt, Streptococcus pneumoniae R6
caaccaagucugcau

SEQ ID NO: 2183379 - RNA, 14 nt, Streptococcus pneumoniae R6
caaccaacuuuucc

SEQ ID NO: 2183380 - RNA, 17 nt, Streptococcus pneumoniae R6
caaccacguuccuuggc

SEQ ID NO: 2183381 - RNA, 22 nt, Streptococcus pneumoniae R6
caauauucuccgaagucaagcc

SEQ ID NO: 2183382 - RNA, 19 nt, Streptococcus pneumoniae R6
caauauucucuagaaaucu

SEQ ID NO: 2183383 - RNA, 24 nt, Streptococcus pneumoniae R6
caaucccuuuuuaagauuuuaccu

SEQ ID NO: 2183384 - RNA, 22 nt, Streptococcus pneumoniae R6
caaucccuagcuuuuuccucau

SEQ ID NO: 2183385 - RNA, 18 nt, Streptococcus pneumoniae R6
caaucauuucaaagccuu

SEQ ID NO: 2183386 - RNA, 19 nt, Streptococcus pneumoniae R6
caaucauuucaguugccuc

SEQ ID NO: 2183387 - RNA, 15 nt, Streptococcus pneumoniae R6
caaucauuuggaaaa

SEQ ID NO: 2183388 - RNA, 20 nt, Streptococcus pneumoniae R6
caauccguucugagauaggu

SEQ ID NO: 2183389 - RNA, 17 nt, Streptococcus pneumoniae R6
caauccguuugugugaa

SEQ ID NO: 2183390 - RNA, 17 nt, Streptococcus pneumoniae R6
caaucucgguagauacc

SEQ ID NO: 2183391 - RNA, 20 nt, Streptococcus pneumoniae R6
caaucucugcaauuucuaau

SEQ ID NO: 2183392 - RNA, 15 nt, Streptococcus pneumoniae R6
caaucucuuccaaag

SEQ ID NO: 2183393 - RNA, 15 nt, Streptococcus pneumoniae R6
caaucgggaucugau

SEQ ID NO: 2183394 - RNA, 12 nt, Streptococcus pneumoniae R6
caaugagccaag

SEQ ID NO: 2183395 - RNA, 16 nt, Streptococcus pneumoniae R6
caaugauagacauuuc

SEQ ID NO: 2183396 - RNA, 11 nt, Streptococcus pneumoniae R6
caaucuugucg

SEQ ID NO: 2183397 - RNA, 16 nt, Streptococcus pneumoniae R6
caaugaaaaucaaaga

SEQ ID NO: 2183398 - RNA, 17 nt, Streptococcus pneumoniae R6
caaugaaaaucaaagag

SEQ ID NO: 2183399 - RNA, 19 nt, Streptococcus pneumoniae R6
caaugaaaaucaaagagca

SEQ ID NO: 2183400 - RNA, 17 nt, Streptococcus pneumoniae R6
caaugaaaaucauagaa

SEQ ID NO: 2183401 - RNA, 14 nt, Streptococcus pneumoniae R6
caaugaaaaaaaca

SEQ ID NO: 2183402 - RNA, 13 nt, Streptococcus pneumoniae R6
caaugaaaagaac

SEQ ID NO: 2183403 - RNA, 15 nt, Streptococcus pneumoniae R6
caaucuuuuccaacu

SEQ ID NO: 2183404 - RNA, 21 nt, Streptococcus pneumoniae R6
caaugcggaccaaauccccau

SEQ ID NO: 2183405 - RNA, 21 nt, Streptococcus pneumoniae R6
caaguaaaaucaggauuuuuu

SEQ ID NO: 2183406 - RNA, 23 nt, Streptococcus pneumoniae R6
caagguuuuugaacaccugauag

SEQ ID NO: 2183407 - RNA, 15 nt, Streptococcus pneumoniae R6
caagguuucacagaa

SEQ ID NO: 2183408 - RNA, 16 nt, Streptococcus pneumoniae R6
caaguucuuccacuca

SEQ ID NO: 2183409 - RNA, 19 nt, Streptococcus pneumoniae R6
caaguucuuuucauaaaga

SEQ ID NO: 2183410 - RNA, 13 nt, Streptococcus pneumoniae R6
caauaacaaaguc

SEQ ID NO: 2183411 - RNA, 18 nt, Streptococcus pneumoniae R6
caaguugcuugaaaacuc

SEQ ID NO: 2183412 - RNA, 14 nt, Streptococcus pneumoniae R6
caaguuuaaggaua

SEQ ID NO: 2183413 - RNA, 17 nt, Streptococcus pneumoniae R6
caaguuuaaggauagcu

SEQ ID NO: 2183414 - RNA, 22 nt, Streptococcus pneumoniae R6
caaguuuaccauucaauucugg

SEQ ID NO: 2183415 - RNA, 16 nt, Streptococcus pneumoniae R6
caaguuguuugacguc

SEQ ID NO: 2183416 - RNA, 23 nt, Streptococcus pneumoniae R6
caauaacacccuuguaaauaacu

SEQ ID NO: 2183417 - RNA, 19 nt, Streptococcus pneumoniae R6
caauaacacgagaaacaau

SEQ ID NO: 2183418 - RNA, 14 nt, Streptococcus pneumoniae R6
caauaauucaccua

SEQ ID NO: 2183419 - RNA, 16 nt, Streptococcus pneumoniae R6
caauaggcggacaccu

SEQ ID NO: 2183420 - RNA, 14 nt, Streptococcus pneumoniae R6
caauagcuuguucc

SEQ ID NO: 2183421 - RNA, 16 nt, Streptococcus pneumoniae R6
caauagcuaauagaac

SEQ ID NO: 2183422 - RNA, 11 nt, Streptococcus pneumoniae R6
caauaguucau

SEQ ID NO: 2183423 - RNA, 17 nt, Streptococcus pneumoniae R6
caauacccccuuaaaac

SEQ ID NO: 2183424 - RNA, 13 nt, Streptococcus pneumoniae R6
caauacuucaaca

SEQ ID NO: 2183425 - RNA, 14 nt, Streptococcus pneumoniae R6
caauacuuuccaau

SEQ ID NO: 2183426 - RNA, 13 nt, Streptococcus pneumoniae R6
caauacuuuuucg

SEQ ID NO: 2183427 - RNA, 23 nt, Streptococcus pneumoniae R6
caaggaagaagcuguaaaucuag

SEQ ID NO: 2183428 - RNA, 17 nt, Streptococcus pneumoniae R6
caaggacuggagaagga

SEQ ID NO: 2183429 - RNA, 15 nt, Streptococcus pneumoniae R6
caaggacauugacuu

SEQ ID NO: 2183430 - RNA, 15 nt, Streptococcus pneumoniae R6
caagggaaaaugaaa

SEQ ID NO: 2183431 - RNA, 23 nt, Streptococcus pneumoniae R6
caaggagaaccaggaaaccagcu

SEQ ID NO: 2183432 - RNA, 14 nt, Streptococcus pneumoniae R6
caagguucauuucu

SEQ ID NO: 2183433 - RNA, 16 nt, Streptococcus pneumoniae R6
caagguuuuagaauau

SEQ ID NO: 2183434 - RNA, 19 nt, Streptococcus pneumoniae R6
caagguguguugcuuuuug

SEQ ID NO: 2183435 - RNA, 13 nt, Streptococcus pneumoniae R6
caagguagcaaca

SEQ ID NO: 2183436 - RNA, 16 nt, Streptococcus pneumoniae R6
caaggucaaaaugaug

SEQ ID NO: 2183437 - RNA, 16 nt, Streptococcus pneumoniae R6
caagguagagacagaa

SEQ ID NO: 2183438 - RNA, 17 nt, Streptococcus pneumoniae R6
caagggcaaaaaagaaa

SEQ ID NO: 2183439 - RNA, 11 nt, Streptococcus pneumoniae R6
caagagcuuua

SEQ ID NO: 2183440 - RNA, 17 nt, Streptococcus pneumoniae R6
caagagcuuuaauagaa

SEQ ID NO: 2183441 - RNA, 15 nt, Streptococcus pneumoniae R6
caagagccuuuuuaa

SEQ ID NO: 2183442 - RNA, 19 nt, Streptococcus pneumoniae R6
caagcaaucucuuccaaag

SEQ ID NO: 2183443 - RNA, 16 nt, Streptococcus pneumoniae R6
caagcaagucuagacu

SEQ ID NO: 2183444 - RNA, 13 nt, Streptococcus pneumoniae R6
caagcaacaaaaa

SEQ ID NO: 2183445 - RNA, 15 nt, Streptococcus pneumoniae R6
caagcaacaaaaacg

SEQ ID NO: 2183446 - RNA, 22 nt, Streptococcus pneumoniae R6
caagauuuccugagaugacaac

SEQ ID NO: 2183447 - RNA, 22 nt, Streptococcus pneumoniae R6
caagcgucugaggcaacaaagu

SEQ ID NO: 2183448 - RNA, 17 nt, Streptococcus pneumoniae R6
caagccauaagaaagga

SEQ ID NO: 2183449 - RNA, 17 nt, Streptococcus pneumoniae R6
caagcccaucaauaccc

SEQ ID NO: 2183450 - RNA, 22 nt, Streptococcus pneumoniae R6
caacuuuaguccacgguaaaua

SEQ ID NO: 2183451 - RNA, 13 nt, Streptococcus pneumoniae R6
caacuucuuuuuu

SEQ ID NO: 2183452 - RNA, 14 nt, Streptococcus pneumoniae R6
caagaacaagacaa

SEQ ID NO: 2183453 - RNA, 17 nt, Streptococcus pneumoniae R6
caagaacaauuucacaa

SEQ ID NO: 2183454 - RNA, 18 nt, Streptococcus pneumoniae R6
caagaacuuuaacuugaa

SEQ ID NO: 2183455 - RNA, 15 nt, Streptococcus pneumoniae R6
caagaacucuucugg

SEQ ID NO: 2183456 - RNA, 22 nt, Streptococcus pneumoniae R6
caagaacugcuaccaauucagu

SEQ ID NO: 2183457 - RNA, 19 nt, Streptococcus pneumoniae R6
caagacuaccgcuccuaau

SEQ ID NO: 2183458 - RNA, 18 nt, Streptococcus pneumoniae R6
caagacguucaaagauau

SEQ ID NO: 2183459 - RNA, 16 nt, Streptococcus pneumoniae R6
caagacgaagcugaca

SEQ ID NO: 2183460 - RNA, 22 nt, Streptococcus pneumoniae R6
caagaagagcuugguaagaguc

SEQ ID NO: 2183461 - RNA, 13 nt, Streptococcus pneumoniae R6
caagaagagggcu

SEQ ID NO: 2183462 - RNA, 17 nt, Streptococcus pneumoniae R6
caacuaaccaacuucuu

SEQ ID NO: 2183463 - RNA, 20 nt, Streptococcus pneumoniae R6
caacuacuaaaccaauaaua

SEQ ID NO: 2183464 - RNA, 14 nt, Streptococcus pneumoniae R6
caacuccucucucc

SEQ ID NO: 2183465 - RNA, 20 nt, Streptococcus pneumoniae R6
caacuccucucuccuccccu

SEQ ID NO: 2183466 - RNA, 20 nt, Streptococcus pneumoniae R6
caacugaucccuccauuuca

SEQ ID NO: 2183467 - RNA, 14 nt, Streptococcus pneumoniae R6
caacugcaaagaua

SEQ ID NO: 2183468 - RNA, 19 nt, Streptococcus pneumoniae R6
caacuguaguggguugaag

SEQ ID NO: 2183469 - RNA, 21 nt, Streptococcus pneumoniae R6
caacugggaagauuucuuuca

SEQ ID NO: 2183470 - RNA, 15 nt, Streptococcus pneumoniae R6
cagccgacuauacuc

SEQ ID NO: 2183471 - RNA, 14 nt, Streptococcus pneumoniae R6
cagccucuuucuug

SEQ ID NO: 2183472 - RNA, 19 nt, Streptococcus pneumoniae R6
cagccucuugaguaauucu

SEQ ID NO: 2183473 - RNA, 14 nt, Streptococcus pneumoniae R6
cagcauacagagaa

SEQ ID NO: 2183474 - RNA, 12 nt, Streptococcus pneumoniae R6
cagcagugguuu

SEQ ID NO: 2183475 - RNA, 22 nt, Streptococcus pneumoniae R6
cagcagugguuuagaagucuca

SEQ ID NO: 2183476 - RNA, 13 nt, Streptococcus pneumoniae R6
cagcagagaagca

SEQ ID NO: 2183477 - RNA, 14 nt, Streptococcus pneumoniae R6
aaaaugcucucaaa

SEQ ID NO: 2183478 - RNA, 21 nt, Streptococcus pneumoniae R6
aaaaugaauuugaaacaauga

SEQ ID NO: 2183479 - RNA, 24 nt, Streptococcus pneumoniae R6
cagcaagaguugauagagcugaua

SEQ ID NO: 2183480 - RNA, 11 nt, Streptococcus pneumoniae R6
cagauaagacu

SEQ ID NO: 2183481 - RNA, 15 nt, Streptococcus pneumoniae R6
cagauaaggagcgaa

SEQ ID NO: 2183482 - RNA, 22 nt, Streptococcus pneumoniae R6
cagauaauaauugacgaagaaa

SEQ ID NO: 2183483 - RNA, 15 nt, Streptococcus pneumoniae R6
cagaugcaaaaguca

SEQ ID NO: 2183484 - RNA, 21 nt, Streptococcus pneumoniae R6
cagaugaguguaaaaagaaag

SEQ ID NO: 2183485 - RNA, 12 nt, Streptococcus pneumoniae R6
cagaugacugga

SEQ ID NO: 2183486 - RNA, 16 nt, Streptococcus pneumoniae R6
cagaugacaaaucuaa

SEQ ID NO: 2183487 - RNA, 13 nt, Streptococcus pneumoniae R6
cagauuuugaaga

SEQ ID NO: 2183488 - RNA, 14 nt, Streptococcus pneumoniae R6
aaaaugaaaaaaau

SEQ ID NO: 2183489 - RNA, 16 nt, Streptococcus pneumoniae R6
aaaaugaaaaaaauua

SEQ ID NO: 2183490 - RNA, 14 nt, Streptococcus pneumoniae R6
aaaaugaaauacau

SEQ ID NO: 2183491 - RNA, 13 nt, Streptococcus pneumoniae R6
cagauuuuaaaga

SEQ ID NO: 2183492 - RNA, 22 nt, Streptococcus pneumoniae R6
cagauuuauggucuuuuaacca

SEQ ID NO: 2183493 - RNA, 20 nt, Streptococcus pneumoniae R6
cagauuuaacuauaguagau

SEQ ID NO: 2183494 - RNA, 22 nt, Streptococcus pneumoniae R6
cagauugucgguagaacgauaa

SEQ ID NO: 2183495 - RNA, 14 nt, Streptococcus pneumoniae R6
cagauugucuaggg

SEQ ID NO: 2183496 - RNA, 20 nt, Streptococcus pneumoniae R6
cagauuguaaaggaugacaa

SEQ ID NO: 2183497 - RNA, 13 nt, Streptococcus pneumoniae R6
cagauuguccuca

SEQ ID NO: 2183498 - RNA, 15 nt, Streptococcus pneumoniae R6
cagauuaguaauuca

SEQ ID NO: 2183499 - RNA, 22 nt, Streptococcus pneumoniae R6
aaaaucugauuccuuuuuucua

SEQ ID NO: 2183500 - RNA, 12 nt, Streptococcus pneumoniae R6
aaaaucugaaaa

SEQ ID NO: 2183501 - RNA, 18 nt, Streptococcus pneumoniae R6
aaaaucugaagaaagcaa

SEQ ID NO: 2183502 - RNA, 19 nt, Streptococcus pneumoniae R6
aaaaucugaagaaagcaau

SEQ ID NO: 2183503 - RNA, 14 nt, Streptococcus pneumoniae R6
cagaugcuugcauu

SEQ ID NO: 2183504 - RNA, 15 nt, Streptococcus pneumoniae R6
cagaugcugcauuuu

SEQ ID NO: 2183505 - RNA, 16 nt, Streptococcus pneumoniae R6
cagaggagaugaauug

SEQ ID NO: 2183506 - RNA, 14 nt, Streptococcus pneumoniae R6
cagaggcacuugau

SEQ ID NO: 2183507 - RNA, 14 nt, Streptococcus pneumoniae R6
cagaguggauuugg

SEQ ID NO: 2183508 - RNA, 22 nt, Streptococcus pneumoniae R6
aaaaucauagagcaaacuagga

SEQ ID NO: 2183509 - RNA, 20 nt, Streptococcus pneumoniae R6
cagagacuuuaaacauacug

SEQ ID NO: 2183510 - RNA, 17 nt, Streptococcus pneumoniae R6
aaaaucaggucuuauag

SEQ ID NO: 2183511 - RNA, 23 nt, Streptococcus pneumoniae R6
aaaaucaggucuuauagaaacau

SEQ ID NO: 2183512 - RNA, 16 nt, Streptococcus pneumoniae R6
aaaaucaggaaaucuu

SEQ ID NO: 2183513 - RNA, 16 nt, Streptococcus pneumoniae R6
aaaaucaggaagguca

SEQ ID NO: 2183514 - RNA, 20 nt, Streptococcus pneumoniae R6
aaaaucaggaaggucacuuu

SEQ ID NO: 2183515 - RNA, 18 nt, Streptococcus pneumoniae R6
cagagacgcagaggugga

SEQ ID NO: 2183516 - RNA, 21 nt, Streptococcus pneumoniae R6
cagagacgcagagguggaaug

SEQ ID NO: 2183517 - RNA, 12 nt, Streptococcus pneumoniae R6
aaaaucauugcu

SEQ ID NO: 2183518 - RNA, 15 nt, Streptococcus pneumoniae R6
aaaaucauuauauuu

SEQ ID NO: 2183519 - RNA, 21 nt, Streptococcus pneumoniae R6
aaaauccacuugggaaaccaa

SEQ ID NO: 2183520 - RNA, 22 nt, Streptococcus pneumoniae R6
aaaauccacuugggaaaccaaa

SEQ ID NO: 2183521 - RNA, 23 nt, Streptococcus pneumoniae R6
aaaauccacuugggaaaccaaac

SEQ ID NO: 2183522 - RNA, 15 nt, Streptococcus pneumoniae R6
cagagcaccaaccaa

SEQ ID NO: 2183523 - RNA, 13 nt, Streptococcus pneumoniae R6
cagagaaagaaaa

SEQ ID NO: 2183524 - RNA, 15 nt, Streptococcus pneumoniae R6
cagagaaagaaaaca

SEQ ID NO: 2183525 - RNA, 12 nt, Streptococcus pneumoniae R6
aaaaucaaagag

SEQ ID NO: 2183526 - RNA, 16 nt, Streptococcus pneumoniae R6
aaaaucaaagagcaaa

SEQ ID NO: 2183527 - RNA, 13 nt, Streptococcus pneumoniae R6
aaaaucaaaaagg

SEQ ID NO: 2183528 - RNA, 14 nt, Streptococcus pneumoniae R6
aaaaucaaacaaaa

SEQ ID NO: 2183529 - RNA, 13 nt, Streptococcus pneumoniae R6
aaaauauuuggaa

SEQ ID NO: 2183530 - RNA, 16 nt, Streptococcus pneumoniae R6
aaaauauuuggagcaa

SEQ ID NO: 2183531 - RNA, 15 nt, Streptococcus pneumoniae R6
aaaauauuucuagaa

SEQ ID NO: 2183532 - RNA, 16 nt, Streptococcus pneumoniae R6
aaaauauuucuagaaa

SEQ ID NO: 2183533 - RNA, 20 nt, Streptococcus pneumoniae R6
aaaauauuucuagaaauuaa

SEQ ID NO: 2183534 - RNA, 13 nt, Streptococcus pneumoniae R6
cagacuucuuuuu

SEQ ID NO: 2183535 - RNA, 19 nt, Streptococcus pneumoniae R6
cagacuauaauauaauaaa

SEQ ID NO: 2183536 - RNA, 22 nt, Streptococcus pneumoniae R6
cagacuagguuagucaaaaaga

SEQ ID NO: 2183537 - RNA, 14 nt, Streptococcus pneumoniae R6
cagaccaccuuccu

SEQ ID NO: 2183538 - RNA, 15 nt, Streptococcus pneumoniae R6
cagaaauuuucuuag

SEQ ID NO: 2183539 - RNA, 18 nt, Streptococcus pneumoniae R6
cagaacacuuccaauaau

SEQ ID NO: 2183540 - RNA, 19 nt, Streptococcus pneumoniae R6
cagaauuuaacucuuuuuu

SEQ ID NO: 2183541 - RNA, 14 nt, Streptococcus pneumoniae R6
cagacagcugagug

SEQ ID NO: 2183542 - RNA, 22 nt, Streptococcus pneumoniae R6
cagacauaugaaaucuuuuuga

SEQ ID NO: 2183543 - RNA, 20 nt, Streptococcus pneumoniae R6
cagacauaacacccugcaug

SEQ ID NO: 2183544 - RNA, 13 nt, Streptococcus pneumoniae R6
cacuuuuuuauag

SEQ ID NO: 2183545 - RNA, 12 nt, Streptococcus pneumoniae R6
cacuuuuuucuu

SEQ ID NO: 2183546 - RNA, 20 nt, Streptococcus pneumoniae R6
cagaaaaacgcauaaaauca

SEQ ID NO: 2183547 - RNA, 20 nt, Streptococcus pneumoniae R6
cagaaaugcccaauucuuga

SEQ ID NO: 2183548 - RNA, 18 nt, Streptococcus pneumoniae R6
cagaaaugaguaagaacu

SEQ ID NO: 2183549 - RNA, 22 nt, Streptococcus pneumoniae R6
cagaaaugaguaagaacucaaa

SEQ ID NO: 2183550 - RNA, 22 nt, Streptococcus pneumoniae R6
cagaaauaauauccgauagcau

SEQ ID NO: 2183551 - RNA, 21 nt, Streptococcus pneumoniae R6
cacuuuccucuugauuuuuuu

SEQ ID NO: 2183552 - RNA, 21 nt, Streptococcus pneumoniae R6
cagcuccgauguauuugaggu

SEQ ID NO: 2183553 - RNA, 12 nt, Streptococcus pneumoniae R6
cagcuccugaaa

SEQ ID NO: 2183554 - RNA, 18 nt, Streptococcus pneumoniae R6
aaaauugauuuauagaaa

SEQ ID NO: 2183555 - RNA, 17 nt, Streptococcus pneumoniae R6
aaaauuguugucccuuu

SEQ ID NO: 2183556 - RNA, 19 nt, Streptococcus pneumoniae R6
cagcuauuaagaaaaauga

SEQ ID NO: 2183557 - RNA, 12 nt, Streptococcus pneumoniae R6
cagcucaaaaca

SEQ ID NO: 2183558 - RNA, 13 nt, Streptococcus pneumoniae R6
cagcucaaaacac

SEQ ID NO: 2183559 - RNA, 17 nt, Streptococcus pneumoniae R6
cagcucaaaacacuguu

SEQ ID NO: 2183560 - RNA, 16 nt, Streptococcus pneumoniae R6
cagcucaaaacagugu

SEQ ID NO: 2183561 - RNA, 16 nt, Streptococcus pneumoniae R6
cagcuaacucugcugc

SEQ ID NO: 2183562 - RNA, 15 nt, Streptococcus pneumoniae R6
cagcuaagccuuuuu

SEQ ID NO: 2183563 - RNA, 18 nt, Streptococcus pneumoniae R6
cagcuaagccuuuuucuu

SEQ ID NO: 2183564 - RNA, 14 nt, Streptococcus pneumoniae R6
cagcucucugauuu

SEQ ID NO: 2183565 - RNA, 23 nt, Streptococcus pneumoniae R6
cagcucucugauuuucagagggc

SEQ ID NO: 2183566 - RNA, 21 nt, Streptococcus pneumoniae R6
cagcuguaucgaccucuacca

SEQ ID NO: 2183567 - RNA, 15 nt, Streptococcus pneumoniae R6
cagcugucgcaccug

SEQ ID NO: 2183568 - RNA, 14 nt, Streptococcus pneumoniae R6
cagcuuaagugcgu

SEQ ID NO: 2183569 - RNA, 13 nt, Streptococcus pneumoniae R6
cagcuucuuuuua

SEQ ID NO: 2183570 - RNA, 16 nt, Streptococcus pneumoniae R6
cagcuucuuuuuauau

SEQ ID NO: 2183571 - RNA, 21 nt, Streptococcus pneumoniae R6
cagcuucuuuuuauauauaaa

SEQ ID NO: 2183572 - RNA, 20 nt, Streptococcus pneumoniae R6
cagcuuucuagccuguauga

SEQ ID NO: 2183573 - RNA, 18 nt, Streptococcus pneumoniae R6
cagcuuuuuuggcagauu

SEQ ID NO: 2183574 - RNA, 19 nt, Streptococcus pneumoniae R6
cagcuuuuuuggcagauuu

SEQ ID NO: 2183575 - RNA, 13 nt, Streptococcus pneumoniae R6
aaaauuuggaaaa

SEQ ID NO: 2183576 - RNA, 16 nt, Streptococcus pneumoniae R6
aaaauuugacuccaga

SEQ ID NO: 2183577 - RNA, 14 nt, Streptococcus pneumoniae R6
caggaauauugagu

SEQ ID NO: 2183578 - RNA, 22 nt, Streptococcus pneumoniae R6
caggaauaaauccagcugagau

SEQ ID NO: 2183579 - RNA, 16 nt, Streptococcus pneumoniae R6
caggaaguuuuuucuc

SEQ ID NO: 2183580 - RNA, 15 nt, Streptococcus pneumoniae R6
caggaagucuauuau

SEQ ID NO: 2183581 - RNA, 21 nt, Streptococcus pneumoniae R6
caggaagucuauuauauauau

SEQ ID NO: 2183582 - RNA, 17 nt, Streptococcus pneumoniae R6
caggaagucuauuauuu

SEQ ID NO: 2183583 - RNA, 21 nt, Streptococcus pneumoniae R6
caggaaggucacuuuuuucuu

SEQ ID NO: 2183584 - RNA, 21 nt, Streptococcus pneumoniae R6
caggagcaguugauggagcug

SEQ ID NO: 2183585 - RNA, 23 nt, Streptococcus pneumoniae R6
caggagcaguugauggagcuggu

SEQ ID NO: 2183586 - RNA, 23 nt, Streptococcus pneumoniae R6
caggagcacuugaugaaaaaaag

SEQ ID NO: 2183587 - RNA, 17 nt, Streptococcus pneumoniae R6
caggacuaaauccaaaa

SEQ ID NO: 2183588 - RNA, 18 nt, Streptococcus pneumoniae R6
caggacuaaauccaaaag

SEQ ID NO: 2183589 - RNA, 14 nt, Streptococcus pneumoniae R6
caggagaaaaugaa

SEQ ID NO: 2183590 - RNA, 22 nt, Streptococcus pneumoniae R6
caggagaaaaugaaauaauacu

SEQ ID NO: 2183591 - RNA, 20 nt, Streptococcus pneumoniae R6
aaaauuuuauuuaagcaaaa

SEQ ID NO: 2183592 - RNA, 22 nt, Streptococcus pneumoniae R6
aaaauuuuauuuaagcaaaaaa

SEQ ID NO: 2183593 - RNA, 13 nt, Streptococcus pneumoniae R6
aaaauuuucaaaa

SEQ ID NO: 2183594 - RNA, 18 nt, Streptococcus pneumoniae R6
aaaauuuucaaaaucaga

SEQ ID NO: 2183595 - RNA, 20 nt, Streptococcus pneumoniae R6
aaaauuuugacauucuaaaa

SEQ ID NO: 2183596 - RNA, 11 nt, Streptococcus pneumoniae R6
aaaauuuuuaa

SEQ ID NO: 2183597 - RNA, 13 nt, Streptococcus pneumoniae R6
aaaauuuuuaaag

SEQ ID NO: 2183598 - RNA, 11 nt, Streptococcus pneumoniae R6
aaaauuuuucc

SEQ ID NO: 2183599 - RNA, 15 nt, Streptococcus pneumoniae R6
caggauauuucucca

SEQ ID NO: 2183600 - RNA, 14 nt, Streptococcus pneumoniae R6
caggcaugggcagg

SEQ ID NO: 2183601 - RNA, 22 nt, Streptococcus pneumoniae R6
caggcaugggcagggucaucuc

SEQ ID NO: 2183602 - RNA, 20 nt, Streptococcus pneumoniae R6
cagugaagguauuuugacgu

SEQ ID NO: 2183603 - RNA, 19 nt, Streptococcus pneumoniae R6
cagugaaggcuuuaaaugc

SEQ ID NO: 2183604 - RNA, 22 nt, Streptococcus pneumoniae R6
cagugaaggcuuuaaaugcugg

SEQ ID NO: 2183605 - RNA, 22 nt, Streptococcus pneumoniae R6
cagucuucaugacggcucauaa

SEQ ID NO: 2183606 - RNA, 18 nt, Streptococcus pneumoniae R6
cagugaaaacaggaguuc

SEQ ID NO: 2183607 - RNA, 14 nt, Streptococcus pneumoniae R6
cagucuuuuugcug

SEQ ID NO: 2183608 - RNA, 20 nt, Streptococcus pneumoniae R6
cagucugguucccagcaugg

SEQ ID NO: 2183609 - RNA, 15 nt, Streptococcus pneumoniae R6
cagugauguuaagug

SEQ ID NO: 2183610 - RNA, 22 nt, Streptococcus pneumoniae R6
cagugauguuaagugcuucuuu

SEQ ID NO: 2183611 - RNA, 12 nt, Streptococcus pneumoniae R6
cagugauuaaaa

SEQ ID NO: 2183612 - RNA, 15 nt, Streptococcus pneumoniae R6
cagugauuaaaacug

SEQ ID NO: 2183613 - RNA, 18 nt, Streptococcus pneumoniae R6
cagugacuugugugcugg

SEQ ID NO: 2183614 - RNA, 16 nt, Streptococcus pneumoniae R6
cagugagaagaagggc

SEQ ID NO: 2183615 - RNA, 12 nt, Streptococcus pneumoniae R6
cagucugaaaaa

SEQ ID NO: 2183616 - RNA, 13 nt, Streptococcus pneumoniae R6
cagucugaaaaag

SEQ ID NO: 2183617 - RNA, 17 nt, Streptococcus pneumoniae R6
cagucugaaaaagagga

SEQ ID NO: 2183618 - RNA, 13 nt, Streptococcus pneumoniae R6
cagucugaaaaau

SEQ ID NO: 2183619 - RNA, 18 nt, Streptococcus pneumoniae R6
cagucugaaaaauaggau

SEQ ID NO: 2183620 - RNA, 21 nt, Streptococcus pneumoniae R6
cagucugaaaaauaggaugaa

SEQ ID NO: 2183621 - RNA, 21 nt, Streptococcus pneumoniae R6
cagucucuguauaggucuggc

SEQ ID NO: 2183622 - RNA, 12 nt, Streptococcus pneumoniae R6
cagucuccuagu

SEQ ID NO: 2183623 - RNA, 16 nt, Streptococcus pneumoniae R6
cagucuccuagucuac

SEQ ID NO: 2183624 - RNA, 23 nt, Streptococcus pneumoniae R6
cagucguuucaagauaaggaauu

SEQ ID NO: 2183625 - RNA, 15 nt, Streptococcus pneumoniae R6
cagucucaccugcuu

SEQ ID NO: 2183626 - RNA, 18 nt, Streptococcus pneumoniae R6
cagucgcaaagaggaaga

SEQ ID NO: 2183627 - RNA, 23 nt, Streptococcus pneumoniae R6
caguccuuguaugacaucuugaa

SEQ ID NO: 2183628 - RNA, 22 nt, Streptococcus pneumoniae R6
caguccucccuuguuuuuauau

SEQ ID NO: 2183629 - RNA, 14 nt, Streptococcus pneumoniae R6
caguauucuuuuua

SEQ ID NO: 2183630 - RNA, 15 nt, Streptococcus pneumoniae R6
caguauuucauuaca

SEQ ID NO: 2183631 - RNA, 14 nt, Streptococcus pneumoniae R6
cagucaaaucgauu

SEQ ID NO: 2183632 - RNA, 13 nt, Streptococcus pneumoniae R6
cagucacugucuu

SEQ ID NO: 2183633 - RNA, 18 nt, Streptococcus pneumoniae R6
cagucauuaccaguggca

SEQ ID NO: 2183634 - RNA, 17 nt, Streptococcus pneumoniae R6
caguccacguuuuucca

SEQ ID NO: 2183635 - RNA, 17 nt, Streptococcus pneumoniae R6
caguacuagacaauuuu

SEQ ID NO: 2183636 - RNA, 13 nt, Streptococcus pneumoniae R6
caguacuuuuucu

SEQ ID NO: 2183637 - RNA, 17 nt, Streptococcus pneumoniae R6
caguagaaaaagucuga

SEQ ID NO: 2183638 - RNA, 16 nt, Streptococcus pneumoniae R6
caguacuuucaacucc

SEQ ID NO: 2183639 - RNA, 23 nt, Streptococcus pneumoniae R6
caguacgcaucgacuacuaaaac

SEQ ID NO: 2183640 - RNA, 19 nt, Streptococcus pneumoniae R6
caguaccggagaaauauug

SEQ ID NO: 2183641 - RNA, 18 nt, Streptococcus pneumoniae R6
caguauauugaaaugaaa

SEQ ID NO: 2183642 - RNA, 19 nt, Streptococcus pneumoniae R6
caguauauugaaaugaaau

SEQ ID NO: 2183643 - RNA, 17 nt, Streptococcus pneumoniae R6
caguaguuggcuugucu

SEQ ID NO: 2183644 - RNA, 14 nt, Streptococcus pneumoniae R6
caggugcuuaaaua

SEQ ID NO: 2183645 - RNA, 15 nt, Streptococcus pneumoniae R6
caggugcuuaaauag

SEQ ID NO: 2183646 - RNA, 22 nt, Streptococcus pneumoniae R6
caggucgguuuuauuaaguaga

SEQ ID NO: 2183647 - RNA, 19 nt, Streptococcus pneumoniae R6
cagggguaacgucuuuucg

SEQ ID NO: 2183648 - RNA, 14 nt, Streptococcus pneumoniae R6
cagguugcucaaaa

SEQ ID NO: 2183649 - RNA, 18 nt, Streptococcus pneumoniae R6
cagguugcucaaaacacu

SEQ ID NO: 2183650 - RNA, 16 nt, Streptococcus pneumoniae R6
cagguucgauuccugc

SEQ ID NO: 2183651 - RNA, 13 nt, Streptococcus pneumoniae R6
aaacaacaaugga

SEQ ID NO: 2183652 - RNA, 20 nt, Streptococcus pneumoniae R6
aaacaaccaauuucuuaaua

SEQ ID NO: 2183653 - RNA, 16 nt, Streptococcus pneumoniae R6
aaacaaccgauaagaa

SEQ ID NO: 2183654 - RNA, 13 nt, Streptococcus pneumoniae R6
cagguuucacauc

SEQ ID NO: 2183655 - RNA, 23 nt, Streptococcus pneumoniae R6
aaacaaauuguuauuaagauuac

SEQ ID NO: 2183656 - RNA, 14 nt, Streptococcus pneumoniae R6
aaacaaagucugaa

SEQ ID NO: 2183657 - RNA, 12 nt, Streptococcus pneumoniae R6
caguaaaaaauc

SEQ ID NO: 2183658 - RNA, 20 nt, Streptococcus pneumoniae R6
caguaaaaaaaacauauauu

SEQ ID NO: 2183659 - RNA, 12 nt, Streptococcus pneumoniae R6
caguaauaaaga

SEQ ID NO: 2183660 - RNA, 18 nt, Streptococcus pneumoniae R6
caguaaucucaaaacagu

SEQ ID NO: 2183661 - RNA, 19 nt, Streptococcus pneumoniae R6
caguacacaggaauacuaa

SEQ ID NO: 2183662 - RNA, 11 nt, Streptococcus pneumoniae R6
caguacaaacc

SEQ ID NO: 2183663 - RNA, 15 nt, Streptococcus pneumoniae R6
caguacaccuaaaac

SEQ ID NO: 2183664 - RNA, 14 nt, Streptococcus pneumoniae R6
caguaaccauacau

SEQ ID NO: 2183665 - RNA, 15 nt, Streptococcus pneumoniae R6
caguaagauacagac

SEQ ID NO: 2183666 - RNA, 16 nt, Streptococcus pneumoniae R6
caguaacuucugucua

SEQ ID NO: 2183667 - RNA, 21 nt, Streptococcus pneumoniae R6
caguaacugauccaguuggag

SEQ ID NO: 2183668 - RNA, 12 nt, Streptococcus pneumoniae R6
cauugauauggu

SEQ ID NO: 2183669 - RNA, 18 nt, Streptococcus pneumoniae R6
cauugauauaaagagcac

SEQ ID NO: 2183670 - RNA, 11 nt, Streptococcus pneumoniae R6
cauugaguaua

SEQ ID NO: 2183671 - RNA, 17 nt, Streptococcus pneumoniae R6
cauugaguauaagauau

SEQ ID NO: 2183672 - RNA, 20 nt, Streptococcus pneumoniae R6
cauugaguauuaauuaggaa

SEQ ID NO: 2183673 - RNA, 14 nt, Streptococcus pneumoniae R6
cauugaggacaaua

SEQ ID NO: 2183674 - RNA, 13 nt, Streptococcus pneumoniae R6
cauuuucuuaaaa

SEQ ID NO: 2183675 - RNA, 12 nt, Streptococcus pneumoniae R6
cauuuucuuuua

SEQ ID NO: 2183676 - RNA, 17 nt, Streptococcus pneumoniae R6
cauuuugaccuguugau

SEQ ID NO: 2183677 - RNA, 13 nt, Streptococcus pneumoniae R6
cauuuugugaaaa

SEQ ID NO: 2183678 - RNA, 18 nt, Streptococcus pneumoniae R6
cauuuugcgauauaguga

SEQ ID NO: 2183679 - RNA, 14 nt, Streptococcus pneumoniae R6
cauuuuucaaauca

SEQ ID NO: 2183680 - RNA, 17 nt, Streptococcus pneumoniae R6
cauuuuucgaaauuuau

SEQ ID NO: 2183681 - RNA, 18 nt, Streptococcus pneumoniae R6
cauuuuuccauauaaaaa

SEQ ID NO: 2183682 - RNA, 12 nt, Streptococcus pneumoniae R6
cauuuuuuaaaa

SEQ ID NO: 2183683 - RNA, 19 nt, Streptococcus pneumoniae R6
cauuuuugccuaaaauuca

SEQ ID NO: 2183684 - RNA, 18 nt, Streptococcus pneumoniae R6
ccaaaaaaacuccaaacg

SEQ ID NO: 2183685 - RNA, 18 nt, Streptococcus pneumoniae R6
cauuuuuuauugcaauuu

SEQ ID NO: 2183686 - RNA, 18 nt, Streptococcus pneumoniae R6
ccaaaagcagaggcaaug

SEQ ID NO: 2183687 - RNA, 18 nt, Streptococcus pneumoniae R6
ccaaaagucgaguucaug

SEQ ID NO: 2183688 - RNA, 21 nt, Streptococcus pneumoniae R6
ccaaaaguuagauuuuuucug

SEQ ID NO: 2183689 - RNA, 23 nt, Streptococcus pneumoniae R6
ccaaaaucaugacaaucaagacc

SEQ ID NO: 2183690 - RNA, 16 nt, Streptococcus pneumoniae R6
ccaaaauccuugacca

SEQ ID NO: 2183691 - RNA, 15 nt, Streptococcus pneumoniae R6
ccaaaacacaaaaag

SEQ ID NO: 2183692 - RNA, 17 nt, Streptococcus pneumoniae R6
ccaaaaauucuuacuac

SEQ ID NO: 2183693 - RNA, 17 nt, Streptococcus pneumoniae R6
ccaaaaccaaucaauuu

SEQ ID NO: 2183694 - RNA, 23 nt, Streptococcus pneumoniae R6
ccaaaacaucugguuuaauccau

SEQ ID NO: 2183695 - RNA, 21 nt, Streptococcus pneumoniae R6
ccaaaaaaguuagacaauuaa

SEQ ID NO: 2183696 - RNA, 23 nt, Streptococcus pneumoniae R6
ccaaaaaaguuagacaauuaauu

SEQ ID NO: 2183697 - RNA, 19 nt, Streptococcus pneumoniae R6
ccaaacguggaaacucucg

SEQ ID NO: 2183698 - RNA, 17 nt, Streptococcus pneumoniae R6
ccaaacucgaucugaau

SEQ ID NO: 2183699 - RNA, 18 nt, Streptococcus pneumoniae R6
ccaaacucgaucugaaug

SEQ ID NO: 2183700 - RNA, 23 nt, Streptococcus pneumoniae R6
ccaaacgucugcggcggaaacaa

SEQ ID NO: 2183701 - RNA, 17 nt, Streptococcus pneumoniae R6
ccaaacacgaaaccagu

SEQ ID NO: 2183702 - RNA, 19 nt, Streptococcus pneumoniae R6
ccaaacaacaauacuuucc

SEQ ID NO: 2183703 - RNA, 17 nt, Streptococcus pneumoniae R6
ccaaaauuaaaauguuc

SEQ ID NO: 2183704 - RNA, 12 nt, Streptococcus pneumoniae R6
ccaaacagucuc

SEQ ID NO: 2183705 - RNA, 19 nt, Streptococcus pneumoniae R6
ccaaacaucaccagcaugg

SEQ ID NO: 2183706 - RNA, 17 nt, Streptococcus pneumoniae R6
ccaacuucuuuuuuuga

SEQ ID NO: 2183707 - RNA, 22 nt, Streptococcus pneumoniae R6
ccaacgugaguagucauaccaa

SEQ ID NO: 2183708 - RNA, 14 nt, Streptococcus pneumoniae R6
ccaacuuuuccuug

SEQ ID NO: 2183709 - RNA, 13 nt, Streptococcus pneumoniae R6
ccaagaccuuaaa

SEQ ID NO: 2183710 - RNA, 15 nt, Streptococcus pneumoniae R6
ccaagaccaauccua

SEQ ID NO: 2183711 - RNA, 23 nt, Streptococcus pneumoniae R6
ccaagccagcauuuucaaagaag

SEQ ID NO: 2183712 - RNA, 17 nt, Streptococcus pneumoniae R6
ccaagcccaucaauacc

SEQ ID NO: 2183713 - RNA, 21 nt, Streptococcus pneumoniae R6
ccaagcccucagccaguucag

SEQ ID NO: 2183714 - RNA, 22 nt, Streptococcus pneumoniae R6
ccaagcgcucgaugucuuggau

SEQ ID NO: 2183715 - RNA, 20 nt, Streptococcus pneumoniae R6
ccaagguucauuucuucuau

SEQ ID NO: 2183716 - RNA, 18 nt, Streptococcus pneumoniae R6
ccaaggucugacaggcua

SEQ ID NO: 2183717 - RNA, 12 nt, Streptococcus pneumoniae R6
ccaaacuugaaa

SEQ ID NO: 2183718 - RNA, 19 nt, Streptococcus pneumoniae R6
ccaaacuuaguauccuuga

SEQ ID NO: 2183719 - RNA, 15 nt, Streptococcus pneumoniae R6
ccaaagaaauuauuc

SEQ ID NO: 2183720 - RNA, 22 nt, Streptococcus pneumoniae R6
ccaaagacagguuucacaucaa

SEQ ID NO: 2183721 - RNA, 21 nt, Streptococcus pneumoniae R6
ccaaaguuacuugauugcaaa

SEQ ID NO: 2183722 - RNA, 16 nt, Streptococcus pneumoniae R6
ccaaagcaucaaucaa

SEQ ID NO: 2183723 - RNA, 21 nt, Streptococcus pneumoniae R6
ccaaauaauagacuuccugca

SEQ ID NO: 2183724 - RNA, 22 nt, Streptococcus pneumoniae R6
ccaaauacuuguagcaaucuuc

SEQ ID NO: 2183725 - RNA, 19 nt, Streptococcus pneumoniae R6
ccaaauggauagaucuuua

SEQ ID NO: 2183726 - RNA, 21 nt, Streptococcus pneumoniae R6
ccaacauuaacgaucaaucaa

SEQ ID NO: 2183727 - RNA, 13 nt, Streptococcus pneumoniae R6
ccaacagagaaaa

SEQ ID NO: 2183728 - RNA, 23 nt, Streptococcus pneumoniae R6
ccaacagagaaaauucuaaaggc

SEQ ID NO: 2183729 - RNA, 15 nt, Streptococcus pneumoniae R6
ccaaccagcuguauc

SEQ ID NO: 2183730 - RNA, 17 nt, Streptococcus pneumoniae R6
ccaaauuucauauuuuc

SEQ ID NO: 2183731 - RNA, 16 nt, Streptococcus pneumoniae R6
ccaacaauucuuggau

SEQ ID NO: 2183732 - RNA, 14 nt, Streptococcus pneumoniae R6
ccaccuuuucucaa

SEQ ID NO: 2183733 - RNA, 22 nt, Streptococcus pneumoniae R6
ccaccuucaucucucuauaaua

SEQ ID NO: 2183734 - RNA, 13 nt, Streptococcus pneumoniae R6
ccaccuucaacaa

SEQ ID NO: 2183735 - RNA, 17 nt, Streptococcus pneumoniae R6
ccacccauauuuuuccu

SEQ ID NO: 2183736 - RNA, 19 nt, Streptococcus pneumoniae R6
ccaccaagucaucaaaaau

SEQ ID NO: 2183737 - RNA, 19 nt, Streptococcus pneumoniae R6
ccaauaauaaaacuuuuaa

SEQ ID NO: 2183738 - RNA, 20 nt, Streptococcus pneumoniae R6
ccaauaauagaaaacagaca

SEQ ID NO: 2183739 - RNA, 18 nt, Streptococcus pneumoniae R6
ccaaguaaauuagggaua

SEQ ID NO: 2183740 - RNA, 22 nt, Streptococcus pneumoniae R6
ccaauaaauguuucauuuuuga

SEQ ID NO: 2183741 - RNA, 16 nt, Streptococcus pneumoniae R6
ccaaguaaucugcacc

SEQ ID NO: 2183742 - RNA, 23 nt, Streptococcus pneumoniae R6
ccacaaaaaguggauuuuucuuc

SEQ ID NO: 2183743 - RNA, 20 nt, Streptococcus pneumoniae R6
ccaauucugcuuuuaaauag

SEQ ID NO: 2183744 - RNA, 14 nt, Streptococcus pneumoniae R6
ccacaacaaaaaag

SEQ ID NO: 2183745 - RNA, 17 nt, Streptococcus pneumoniae R6
ccacaaccuuaaaacag

SEQ ID NO: 2183746 - RNA, 17 nt, Streptococcus pneumoniae R6
ccacaaccucaaaacag

SEQ ID NO: 2183747 - RNA, 12 nt, Streptococcus pneumoniae R6
ccacaauaaaac

SEQ ID NO: 2183748 - RNA, 15 nt, Streptococcus pneumoniae R6
ccaccaaacaucugg

SEQ ID NO: 2183749 - RNA, 17 nt, Streptococcus pneumoniae R6
ccacaucugccauauca

SEQ ID NO: 2183750 - RNA, 16 nt, Streptococcus pneumoniae R6
ccacauagucagaacc

SEQ ID NO: 2183751 - RNA, 22 nt, Streptococcus pneumoniae R6
ccacuuccugcaaaucuacugg

SEQ ID NO: 2183752 - RNA, 18 nt, Streptococcus pneumoniae R6
ccacugugauuucuaaaa

SEQ ID NO: 2183753 - RNA, 22 nt, Streptococcus pneumoniae R6
ccacugcaucugguucuagcag

SEQ ID NO: 2183754 - RNA, 13 nt, Streptococcus pneumoniae R6
ccagaaaaaguca

SEQ ID NO: 2183755 - RNA, 20 nt, Streptococcus pneumoniae R6
ccagaaaaagucaauaauau

SEQ ID NO: 2183756 - RNA, 13 nt, Streptococcus pneumoniae R6
ccagaaaaauccc

SEQ ID NO: 2183757 - RNA, 23 nt, Streptococcus pneumoniae R6
ccacuuuuuauccgucacgauuu

SEQ ID NO: 2183758 - RNA, 18 nt, Streptococcus pneumoniae R6
ccagaaauugaucuagcu

SEQ ID NO: 2183759 - RNA, 18 nt, Streptococcus pneumoniae R6
ccagaacuuccacuucca

SEQ ID NO: 2183760 - RNA, 14 nt, Streptococcus pneumoniae R6
ccagaacuucaaua

SEQ ID NO: 2183761 - RNA, 23 nt, Streptococcus pneumoniae R6
ccagagaagccaccgccagaacu

SEQ ID NO: 2183762 - RNA, 16 nt, Streptococcus pneumoniae R6
ccagagcaccaaccaa

SEQ ID NO: 2183763 - RNA, 12 nt, Streptococcus pneumoniae R6
ccagaggacugc

SEQ ID NO: 2183764 - RNA, 15 nt, Streptococcus pneumoniae R6
ccagagcuuuucaau

SEQ ID NO: 2183765 - RNA, 12 nt, Streptococcus pneumoniae R6
ccagagccuuga

SEQ ID NO: 2183766 - RNA, 18 nt, Streptococcus pneumoniae R6
ccagacccugcacaaaga

SEQ ID NO: 2183767 - RNA, 15 nt, Streptococcus pneumoniae R6
ccagacauaacaccc

SEQ ID NO: 2183768 - RNA, 16 nt, Streptococcus pneumoniae R6
ccagacauaacacccu

SEQ ID NO: 2183769 - RNA, 21 nt, Streptococcus pneumoniae R6
ccagacauagagagggucugc

SEQ ID NO: 2183770 - RNA, 15 nt, Streptococcus pneumoniae R6
ccagauagaauagca

SEQ ID NO: 2183771 - RNA, 17 nt, Streptococcus pneumoniae R6
ccagauagacauuuucu

SEQ ID NO: 2183772 - RNA, 23 nt, Streptococcus pneumoniae R6
ccagauagagcuaacuuuuccuu

SEQ ID NO: 2183773 - RNA, 18 nt, Streptococcus pneumoniae R6
ccagauaaagcugauuuu

SEQ ID NO: 2183774 - RNA, 20 nt, Streptococcus pneumoniae R6
ccagauaaagcugauuuuuu

SEQ ID NO: 2183775 - RNA, 16 nt, Streptococcus pneumoniae R6
ccagauuccugaaaua

SEQ ID NO: 2183776 - RNA, 14 nt, Streptococcus pneumoniae R6
ccagccaagacacu

SEQ ID NO: 2183777 - RNA, 16 nt, Streptococcus pneumoniae R6
ccagccaaucgcuuuu

SEQ ID NO: 2183778 - RNA, 21 nt, Streptococcus pneumoniae R6
ccagccaauguauuaagaacu

SEQ ID NO: 2183779 - RNA, 16 nt, Streptococcus pneumoniae R6
cauacuuuaucuucua

SEQ ID NO: 2183780 - RNA, 21 nt, Streptococcus pneumoniae R6
cauacuuggugcccaaauacu

SEQ ID NO: 2183781 - RNA, 24 nt, Streptococcus pneumoniae R6
cauacuuggagaaccuagaggaau

SEQ ID NO: 2183782 - RNA, 20 nt, Streptococcus pneumoniae R6
cauacuuagcuaauuuucua

SEQ ID NO: 2183783 - RNA, 17 nt, Streptococcus pneumoniae R6
cauacugcccugaaauc

SEQ ID NO: 2183784 - RNA, 21 nt, Streptococcus pneumoniae R6
cauagauuuuuauuauuuccu

SEQ ID NO: 2183785 - RNA, 16 nt, Streptococcus pneumoniae R6
cauagcagcaauugau

SEQ ID NO: 2183786 - RNA, 15 nt, Streptococcus pneumoniae R6
cauagaugacaaagu

SEQ ID NO: 2183787 - RNA, 17 nt, Streptococcus pneumoniae R6
cauagagcggacuaggc

SEQ ID NO: 2183788 - RNA, 15 nt, Streptococcus pneumoniae R6
cauagacuucccagc

SEQ ID NO: 2183789 - RNA, 16 nt, Streptococcus pneumoniae R6
cauagacuuuacaaca

SEQ ID NO: 2183790 - RNA, 15 nt, Streptococcus pneumoniae R6
cauagaaguuuccuc

SEQ ID NO: 2183791 - RNA, 15 nt, Streptococcus pneumoniae R6
cauagaaauuuuuac

SEQ ID NO: 2183792 - RNA, 18 nt, Streptococcus pneumoniae R6
cauagaaauauuuacuuc

SEQ ID NO: 2183793 - RNA, 22 nt, Streptococcus pneumoniae R6
cauaggccuuguggaagaaguu

SEQ ID NO: 2183794 - RNA, 19 nt, Streptococcus pneumoniae R6
cauaggccaagucuuuucg

SEQ ID NO: 2183795 - RNA, 23 nt, Streptococcus pneumoniae R6
cauaggcuugcucacgggucaug

SEQ ID NO: 2183796 - RNA, 18 nt, Streptococcus pneumoniae R6
cauaguaaaacgcauaau

SEQ ID NO: 2183797 - RNA, 17 nt, Streptococcus pneumoniae R6
cauaguacaauaccuuu

SEQ ID NO: 2183798 - RNA, 18 nt, Streptococcus pneumoniae R6
cauaguaccaguuaccau

SEQ ID NO: 2183799 - RNA, 15 nt, Streptococcus pneumoniae R6
cauauaaaucuccag

SEQ ID NO: 2183800 - RNA, 16 nt, Streptococcus pneumoniae R6
cauauaaauauagaaa

SEQ ID NO: 2183801 - RNA, 14 nt, Streptococcus pneumoniae R6
cauagccauaaaac

SEQ ID NO: 2183802 - RNA, 20 nt, Streptococcus pneumoniae R6
cauagccauaaaacauuucc

SEQ ID NO: 2183803 - RNA, 17 nt, Streptococcus pneumoniae R6
cauagccgacuccaugc

SEQ ID NO: 2183804 - RNA, 16 nt, Streptococcus pneumoniae R6
cauagccaucuuuuga

SEQ ID NO: 2183805 - RNA, 15 nt, Streptococcus pneumoniae R6
cauagcgucaaagaa

SEQ ID NO: 2183806 - RNA, 16 nt, Streptococcus pneumoniae R6
cauagcgucaaagaag

SEQ ID NO: 2183807 - RNA, 16 nt, Streptococcus pneumoniae R6
cauaggcauaguacca

SEQ ID NO: 2183808 - RNA, 15 nt, Streptococcus pneumoniae R6
cauaggaaguugagc

SEQ ID NO: 2183809 - RNA, 21 nt, Streptococcus pneumoniae R6
cauagcgugcccaaaaauuac

SEQ ID NO: 2183810 - RNA, 16 nt, Streptococcus pneumoniae R6
cauagcuggucaagaa

SEQ ID NO: 2183811 - RNA, 18 nt, Streptococcus pneumoniae R6
cauagcuggucaagaagc

SEQ ID NO: 2183812 - RNA, 20 nt, Streptococcus pneumoniae R6
cauauuuguugcucuuaucu

SEQ ID NO: 2183813 - RNA, 13 nt, Streptococcus pneumoniae R6
cauauuuucaaaa

SEQ ID NO: 2183814 - RNA, 14 nt, Streptococcus pneumoniae R6
cauauuuucuacac

SEQ ID NO: 2183815 - RNA, 15 nt, Streptococcus pneumoniae R6
cauauuuucaaaacu

SEQ ID NO: 2183816 - RNA, 17 nt, Streptococcus pneumoniae R6
cauauuuucaaaacugg

SEQ ID NO: 2183817 - RNA, 18 nt, Streptococcus pneumoniae R6
cauauuuucaaaacuggu

SEQ ID NO: 2183818 - RNA, 14 nt, Streptococcus pneumoniae R6
cauauuuuuccuuc

SEQ ID NO: 2183819 - RNA, 12 nt, Streptococcus pneumoniae R6
caucaacagcuc

SEQ ID NO: 2183820 - RNA, 18 nt, Streptococcus pneumoniae R6
caucaaauccuucagcuu

SEQ ID NO: 2183821 - RNA, 22 nt, Streptococcus pneumoniae R6
caucaaauugaaauaagaaaua

SEQ ID NO: 2183822 - RNA, 21 nt, Streptococcus pneumoniae R6
caucaaaucacguacaacagc

SEQ ID NO: 2183823 - RNA, 15 nt, Streptococcus pneumoniae R6
cauauugauauuuau

SEQ ID NO: 2183824 - RNA, 15 nt, Streptococcus pneumoniae R6
cauauuccacauuca

SEQ ID NO: 2183825 - RNA, 18 nt, Streptococcus pneumoniae R6
cauaucaagguuuuucaa

SEQ ID NO: 2183826 - RNA, 22 nt, Streptococcus pneumoniae R6
caucacuuucugcaauggcaau

SEQ ID NO: 2183827 - RNA, 14 nt, Streptococcus pneumoniae R6
caucacuagcuugg

SEQ ID NO: 2183828 - RNA, 16 nt, Streptococcus pneumoniae R6
caucagaaaaaaggca

SEQ ID NO: 2183829 - RNA, 19 nt, Streptococcus pneumoniae R6
caucagcagagaaagaaaa

SEQ ID NO: 2183830 - RNA, 19 nt, Streptococcus pneumoniae R6
caucacgaaaauauuugga

SEQ ID NO: 2183831 - RNA, 20 nt, Streptococcus pneumoniae R6
caucaauacccccuuaaaac

SEQ ID NO: 2183832 - RNA, 22 nt, Streptococcus pneumoniae R6
caucaauacccccuuaaaacca

SEQ ID NO: 2183833 - RNA, 13 nt, Streptococcus pneumoniae R6
caucaauaaccau

SEQ ID NO: 2183834 - RNA, 14 nt, Streptococcus pneumoniae R6
caucaauaaccauc

SEQ ID NO: 2183835 - RNA, 17 nt, Streptococcus pneumoniae R6
caucaauaaccaucauu

SEQ ID NO: 2183836 - RNA, 18 nt, Streptococcus pneumoniae R6
caucaauaaccaucauuu

SEQ ID NO: 2183837 - RNA, 14 nt, Streptococcus pneumoniae R6
caucacacuagcaa

SEQ ID NO: 2183838 - RNA, 16 nt, Streptococcus pneumoniae R6
caucgcccauggccau

SEQ ID NO: 2183839 - RNA, 18 nt, Streptococcus pneumoniae R6
caucgcccaauuuaugua

SEQ ID NO: 2183840 - RNA, 23 nt, Streptococcus pneumoniae R6
caucgcccaauuuauguaaucaa

SEQ ID NO: 2183841 - RNA, 18 nt, Streptococcus pneumoniae R6
caucgagauggaguuccu

SEQ ID NO: 2183842 - RNA, 22 nt, Streptococcus pneumoniae R6
cauccuuuucuguacuuagcca

SEQ ID NO: 2183843 - RNA, 21 nt, Streptococcus pneumoniae R6
cauccuuugcauccacaucca

SEQ ID NO: 2183844 - RNA, 14 nt, Streptococcus pneumoniae R6
cauccgcaucucgg

SEQ ID NO: 2183845 - RNA, 14 nt, Streptococcus pneumoniae R6
caucgcuuggaagu

SEQ ID NO: 2183846 - RNA, 17 nt, Streptococcus pneumoniae R6
cauccaguaccaugggu

SEQ ID NO: 2183847 - RNA, 21 nt, Streptococcus pneumoniae R6
cauccauauaaaucuccagac

SEQ ID NO: 2183848 - RNA, 22 nt, Streptococcus pneumoniae R6
cauccaucccauuuauauaaaa

SEQ ID NO: 2183849 - RNA, 13 nt, Streptococcus pneumoniae R6
cauccauucuuuu

SEQ ID NO: 2183850 - RNA, 14 nt, Streptococcus pneumoniae R6
cauccauucuuuuu

SEQ ID NO: 2183851 - RNA, 18 nt, Streptococcus pneumoniae R6
caucccaguggcuaaagu

SEQ ID NO: 2183852 - RNA, 14 nt, Streptococcus pneumoniae R6
cauccccagugauu

SEQ ID NO: 2183853 - RNA, 19 nt, Streptococcus pneumoniae R6
caucccgcccaucaugcuu

SEQ ID NO: 2183854 - RNA, 18 nt, Streptococcus pneumoniae R6
cauccccucaaccugaau

SEQ ID NO: 2183855 - RNA, 12 nt, Streptococcus pneumoniae R6
caucauuaacaa

SEQ ID NO: 2183856 - RNA, 19 nt, Streptococcus pneumoniae R6
cauccacaaccucaaaaca

SEQ ID NO: 2183857 - RNA, 21 nt, Streptococcus pneumoniae R6
cauccacaaccucaaaacagu

SEQ ID NO: 2183858 - RNA, 16 nt, Streptococcus pneumoniae R6
cauccagauuuuucug

SEQ ID NO: 2183859 - RNA, 13 nt, Streptococcus pneumoniae R6
caucuugacgaua

SEQ ID NO: 2183860 - RNA, 22 nt, Streptococcus pneumoniae R6
caucuuguaaccgauauuuccu

SEQ ID NO: 2183861 - RNA, 22 nt, Streptococcus pneumoniae R6
caucguuaaucggagacggacu

SEQ ID NO: 2183862 - RNA, 13 nt, Streptococcus pneumoniae R6
caucuuuggucaa

SEQ ID NO: 2183863 - RNA, 17 nt, Streptococcus pneumoniae R6
caugaaaaaugcaugag

SEQ ID NO: 2183864 - RNA, 17 nt, Streptococcus pneumoniae R6
caugacaaauucuccac

SEQ ID NO: 2183865 - RNA, 14 nt, Streptococcus pneumoniae R6
caugacaucuucca

SEQ ID NO: 2183866 - RNA, 16 nt, Streptococcus pneumoniae R6
caugaguuuucaaccu

SEQ ID NO: 2183867 - RNA, 17 nt, Streptococcus pneumoniae R6
caugaguuuuucaccag

SEQ ID NO: 2183868 - RNA, 20 nt, Streptococcus pneumoniae R6
caugacgcauaguugcauua

SEQ ID NO: 2183869 - RNA, 17 nt, Streptococcus pneumoniae R6
caugagaauacaaaaau

SEQ ID NO: 2183870 - RNA, 21 nt, Streptococcus pneumoniae R6
caugagccacaacuuuuaaau

SEQ ID NO: 2183871 - RNA, 15 nt, Streptococcus pneumoniae R6
caugacgucguaacc

SEQ ID NO: 2183872 - RNA, 20 nt, Streptococcus pneumoniae R6
caugacuucgucguaaccuu

SEQ ID NO: 2183873 - RNA, 13 nt, Streptococcus pneumoniae R6
caugccaagaaag

SEQ ID NO: 2183874 - RNA, 21 nt, Streptococcus pneumoniae R6
caugccagauggacugaccac

SEQ ID NO: 2183875 - RNA, 13 nt, Streptococcus pneumoniae R6
caugauuggucaa

SEQ ID NO: 2183876 - RNA, 19 nt, Streptococcus pneumoniae R6
caugcaaaaaaaaugaaaa

SEQ ID NO: 2183877 - RNA, 20 nt, Streptococcus pneumoniae R6
caugcaaaaaaaaugaaaaa

SEQ ID NO: 2183878 - RNA, 12 nt, Streptococcus pneumoniae R6
caugauagaugg

SEQ ID NO: 2183879 - RNA, 17 nt, Streptococcus pneumoniae R6
caugauaucaaacuuuu

SEQ ID NO: 2183880 - RNA, 19 nt, Streptococcus pneumoniae R6
caugauaucaaacuuuuua

SEQ ID NO: 2183881 - RNA, 20 nt, Streptococcus pneumoniae R6
caugauaucaaacuuuuuag

SEQ ID NO: 2183882 - RNA, 23 nt, Streptococcus pneumoniae R6
caugauugagaaaguuaaaaaaa

SEQ ID NO: 2183883 - RNA, 16 nt, Streptococcus pneumoniae R6
caugggcuucuguaau

SEQ ID NO: 2183884 - RNA, 16 nt, Streptococcus pneumoniae R6
caugggcgaugaagag

SEQ ID NO: 2183885 - RNA, 16 nt, Streptococcus pneumoniae R6
caugcguuggaacgau

SEQ ID NO: 2183886 - RNA, 18 nt, Streptococcus pneumoniae R6
cauguucauguucgaucu

SEQ ID NO: 2183887 - RNA, 20 nt, Streptococcus pneumoniae R6
cauguucgaucuaaggaaga

SEQ ID NO: 2183888 - RNA, 15 nt, Streptococcus pneumoniae R6
cauguagucaaucaa

SEQ ID NO: 2183889 - RNA, 24 nt, Streptococcus pneumoniae R6
cauguaggccgucucacacggaaa

SEQ ID NO: 2183890 - RNA, 19 nt, Streptococcus pneumoniae R6
cauguauggacgaagugcu

SEQ ID NO: 2183891 - RNA, 14 nt, Streptococcus pneumoniae R6
cauguuuucucaau

SEQ ID NO: 2183892 - RNA, 19 nt, Streptococcus pneumoniae R6
cauguuuugagcugacuuc

SEQ ID NO: 2183893 - RNA, 13 nt, Streptococcus pneumoniae R6
cauguuucaacau

SEQ ID NO: 2183894 - RNA, 14 nt, Streptococcus pneumoniae R6
cauuaacuggcuug

SEQ ID NO: 2183895 - RNA, 12 nt, Streptococcus pneumoniae R6
cauuacacaaau

SEQ ID NO: 2183896 - RNA, 14 nt, Streptococcus pneumoniae R6
cauuauuaugaaaa

SEQ ID NO: 2183897 - RNA, 20 nt, Streptococcus pneumoniae R6
cauuaucuaauaccaaggca

SEQ ID NO: 2183898 - RNA, 16 nt, Streptococcus pneumoniae R6
cauuaugcguuuuugu

SEQ ID NO: 2183899 - RNA, 19 nt, Streptococcus pneumoniae R6
cauuauccauaauaauaac

SEQ ID NO: 2183900 - RNA, 14 nt, Streptococcus pneumoniae R6
cauucacuacuuug

SEQ ID NO: 2183901 - RNA, 20 nt, Streptococcus pneumoniae R6
cauucacaacaucuucugua

SEQ ID NO: 2183902 - RNA, 22 nt, Streptococcus pneumoniae R6
cauuccagacagcuucaagagg

SEQ ID NO: 2183903 - RNA, 18 nt, Streptococcus pneumoniae R6
cauugacucuaacuguau

SEQ ID NO: 2183904 - RNA, 15 nt, Streptococcus pneumoniae R6
cauugacaucuguga

SEQ ID NO: 2183905 - RNA, 15 nt, Streptococcus pneumoniae R6
cauugacagauugca

SEQ ID NO: 2183906 - RNA, 15 nt, Streptococcus pneumoniae R6
cauugaaaaaauauc

SEQ ID NO: 2183907 - RNA, 18 nt, Streptococcus pneumoniae R6
cauugaaaaugugaaaua

SEQ ID NO: 2183908 - RNA, 23 nt, Streptococcus pneumoniae R6
cauucuucucuugaaaaugaaag

SEQ ID NO: 2183909 - RNA, 15 nt, Streptococcus pneumoniae R6
cauucuaguccaucu

SEQ ID NO: 2183910 - RNA, 23 nt, Streptococcus pneumoniae R6
cauucuacaucauugucaaacaa

SEQ ID NO: 2183911 - RNA, 15 nt, Streptococcus pneumoniae R6
cauucuacuauauau

SEQ ID NO: 2183912 - RNA, 16 nt, Streptococcus pneumoniae R6
cauucccaaacaaaaa

SEQ ID NO: 2183913 - RNA, 16 nt, Streptococcus pneumoniae R6
cauuccaucauaaaaa

SEQ ID NO: 2183914 - RNA, 18 nt, Streptococcus pneumoniae R6
cauucuccaguagaucac

SEQ ID NO: 2183915 - RNA, 21 nt, Streptococcus pneumoniae R6
cauucuccaguagaucacuga

SEQ ID NO: 2183916 - RNA, 22 nt, Streptococcus pneumoniae R6
cauucuccaguagaucacugaa

SEQ ID NO: 2183917 - RNA, 18 nt, Streptococcus pneumoniae R6
cauucucccgcccuuuuu

SEQ ID NO: 2183918 - RNA, 22 nt, Streptococcus pneumoniae R6
cauucucccgcccuuuuuucuc

SEQ ID NO: 2183919 - RNA, 18 nt, Streptococcus pneumoniae R6
cauucuauuccaucuccg

SEQ ID NO: 2183920 - RNA, 14 nt, Streptococcus pneumoniae R6
cauucugcuagacu

SEQ ID NO: 2183921 - RNA, 20 nt, Streptococcus pneumoniae R6
ccuggaaucagaacacuucc

SEQ ID NO: 2183922 - RNA, 22 nt, Streptococcus pneumoniae R6
ccugcuuuuucaagcauuuuuu

SEQ ID NO: 2183923 - RNA, 21 nt, Streptococcus pneumoniae R6
ccuggcauaagucauaacauu

SEQ ID NO: 2183924 - RNA, 22 nt, Streptococcus pneumoniae R6
ccuggcaauacuucaacaaaug

SEQ ID NO: 2183925 - RNA, 12 nt, Streptococcus pneumoniae R6
ccugggacaucu

SEQ ID NO: 2183926 - RNA, 20 nt, Streptococcus pneumoniae R6
ccuguaagaacuuuuuaaag

SEQ ID NO: 2183927 - RNA, 13 nt, Streptococcus pneumoniae R6
ccuggucuuauuu

SEQ ID NO: 2183928 - RNA, 17 nt, Streptococcus pneumoniae R6
ccugcugcuaaggauuu

SEQ ID NO: 2183929 - RNA, 22 nt, Streptococcus pneumoniae R6
ccugcuccaaauauugcucaua

SEQ ID NO: 2183930 - RNA, 14 nt, Streptococcus pneumoniae R6
ccugccugaucuug

SEQ ID NO: 2183931 - RNA, 10 nt, Streptococcus pneumoniae R6
ccugccugug

SEQ ID NO: 2183932 - RNA, 17 nt, Streptococcus pneumoniae R6
ccugcgacuagcuuucu

SEQ ID NO: 2183933 - RNA, 14 nt, Streptococcus pneumoniae R6
ccugcauacguuca

SEQ ID NO: 2183934 - RNA, 14 nt, Streptococcus pneumoniae R6
ccugcaguucccac

SEQ ID NO: 2183935 - RNA, 18 nt, Streptococcus pneumoniae R6
ccugccccugaugagcca

SEQ ID NO: 2183936 - RNA, 21 nt, Streptococcus pneumoniae R6
ccucggcuguuuuuucuuauc

SEQ ID NO: 2183937 - RNA, 19 nt, Streptococcus pneumoniae R6
ccuuauuuucuacucuuuc

SEQ ID NO: 2183938 - RNA, 15 nt, Streptococcus pneumoniae R6
ccuuauugaugaugu

SEQ ID NO: 2183939 - RNA, 16 nt, Streptococcus pneumoniae R6
ccuucaauggaguaaa

SEQ ID NO: 2183940 - RNA, 19 nt, Streptococcus pneumoniae R6
ccuucaacggcaccuucua

SEQ ID NO: 2183941 - RNA, 16 nt, Streptococcus pneumoniae R6
ccuucaagggcagaca

SEQ ID NO: 2183942 - RNA, 18 nt, Streptococcus pneumoniae R6
ccuucaagggcagacaua

SEQ ID NO: 2183943 - RNA, 23 nt, Streptococcus pneumoniae R6
ccuuaauccacuugguugcaccu

SEQ ID NO: 2183944 - RNA, 21 nt, Streptococcus pneumoniae R6
ccuguacccaaguaaucugca

SEQ ID NO: 2183945 - RNA, 13 nt, Streptococcus pneumoniae R6
ccuuaugcauaau

SEQ ID NO: 2183946 - RNA, 20 nt, Streptococcus pneumoniae R6
ccuuccuugauucggccacu

SEQ ID NO: 2183947 - RNA, 12 nt, Streptococcus pneumoniae R6
ccuucuucuugg

SEQ ID NO: 2183948 - RNA, 19 nt, Streptococcus pneumoniae R6
ccuucuuucucaaacauug

SEQ ID NO: 2183949 - RNA, 18 nt, Streptococcus pneumoniae R6
ccuugaagaguugccccu

SEQ ID NO: 2183950 - RNA, 19 nt, Streptococcus pneumoniae R6
ccuugaagaguugccccuu

SEQ ID NO: 2183951 - RNA, 20 nt, Streptococcus pneumoniae R6
ccuuuguccauuaugauaua

SEQ ID NO: 2183952 - RNA, 18 nt, Streptococcus pneumoniae R6
ccuuuccuaaucgauuug

SEQ ID NO: 2183953 - RNA, 18 nt, Streptococcus pneumoniae R6
ccuuucggcuguuuuuga

SEQ ID NO: 2183954 - RNA, 16 nt, Streptococcus pneumoniae R6
ccuuuaaaaugaauuc

SEQ ID NO: 2183955 - RNA, 13 nt, Streptococcus pneumoniae R6
ccuuuaaaaacaa

SEQ ID NO: 2183956 - RNA, 17 nt, Streptococcus pneumoniae R6
ccuuguuugagcucuuu

SEQ ID NO: 2183957 - RNA, 13 nt, Streptococcus pneumoniae R6
ccuuuauuuuuuu

SEQ ID NO: 2183958 - RNA, 16 nt, Streptococcus pneumoniae R6
ccuuuauuuucaagcg

SEQ ID NO: 2183959 - RNA, 23 nt, Streptococcus pneumoniae R6
ccuuucaauagcauauuuuuagu

SEQ ID NO: 2183960 - RNA, 15 nt, Streptococcus pneumoniae R6
ccuuucaaaccgcca

SEQ ID NO: 2183961 - RNA, 13 nt, Streptococcus pneumoniae R6
ccuuuauaagcaa

SEQ ID NO: 2183962 - RNA, 21 nt, Streptococcus pneumoniae R6
ccuuguuucuaaaacauugug

SEQ ID NO: 2183963 - RNA, 23 nt, Streptococcus pneumoniae R6
ccuuguuucuaaaacauugugag

SEQ ID NO: 2183964 - RNA, 16 nt, Streptococcus pneumoniae R6
ccuuguagaaaagcaa

SEQ ID NO: 2183965 - RNA, 20 nt, Streptococcus pneumoniae R6
ccuuguagaaaagcaaaaug

SEQ ID NO: 2183966 - RNA, 21 nt, Streptococcus pneumoniae R6
ccuuguagaaaagcaaaaugg

SEQ ID NO: 2183967 - RNA, 20 nt, Streptococcus pneumoniae R6
ccuugaccaaguccucaauu

SEQ ID NO: 2183968 - RNA, 12 nt, Streptococcus pneumoniae R6
ccuuggacuugg

SEQ ID NO: 2183969 - RNA, 19 nt, Streptococcus pneumoniae R6
ccuuggagggagcaaccac

SEQ ID NO: 2183970 - RNA, 12 nt, Streptococcus pneumoniae R6
cgaccucagacu

SEQ ID NO: 2183971 - RNA, 20 nt, Streptococcus pneumoniae R6
cgacgauaaggacgguagca

SEQ ID NO: 2183972 - RNA, 13 nt, Streptococcus pneumoniae R6
cgacgaucaugag

SEQ ID NO: 2183973 - RNA, 17 nt, Streptococcus pneumoniae R6
cgaccaagagcaaaaac

SEQ ID NO: 2183974 - RNA, 17 nt, Streptococcus pneumoniae R6
cgaccagggaugacaac

SEQ ID NO: 2183975 - RNA, 11 nt, Streptococcus pneumoniae R6
cgaccaucuug

SEQ ID NO: 2183976 - RNA, 17 nt, Streptococcus pneumoniae R6
ccuuuuuaugauauuga

SEQ ID NO: 2183977 - RNA, 17 nt, Streptococcus pneumoniae R6
cgaacuuuggaagaugu

SEQ ID NO: 2183978 - RNA, 18 nt, Streptococcus pneumoniae R6
cgaaguuguguuugacca

SEQ ID NO: 2183979 - RNA, 19 nt, Streptococcus pneumoniae R6
cgaaguuguucuugaaguc

SEQ ID NO: 2183980 - RNA, 14 nt, Streptococcus pneumoniae R6
cgaaguuucaaucg

SEQ ID NO: 2183981 - RNA, 15 nt, Streptococcus pneumoniae R6
cgaagugcuucuggg

SEQ ID NO: 2183982 - RNA, 15 nt, Streptococcus pneumoniae R6
cgaagcuuccaauaa

SEQ ID NO: 2183983 - RNA, 16 nt, Streptococcus pneumoniae R6
cgaaggauuuaguucu

SEQ ID NO: 2183984 - RNA, 20 nt, Streptococcus pneumoniae R6
cgaagcuugcuuccaaaaau

SEQ ID NO: 2183985 - RNA, 15 nt, Streptococcus pneumoniae R6
cgaaugauuucucuu

SEQ ID NO: 2183986 - RNA, 22 nt, Streptococcus pneumoniae R6
cgaaugauauuuucaaaaaaau

SEQ ID NO: 2183987 - RNA, 14 nt, Streptococcus pneumoniae R6
cgaaucucuuucca

SEQ ID NO: 2183988 - RNA, 16 nt, Streptococcus pneumoniae R6
cgacauccuauuuauu

SEQ ID NO: 2183989 - RNA, 23 nt, Streptococcus pneumoniae R6
cgacaucauccguacucaugaca

SEQ ID NO: 2183990 - RNA, 19 nt, Streptococcus pneumoniae R6
cgacacuagaugcaucugc

SEQ ID NO: 2183991 - RNA, 17 nt, Streptococcus pneumoniae R6
cgaauuggauauagucu

SEQ ID NO: 2183992 - RNA, 14 nt, Streptococcus pneumoniae R6
cgaauuucuuguuc

SEQ ID NO: 2183993 - RNA, 23 nt, Streptococcus pneumoniae R6
cgaauuuuuuggcuaaaaagcua

SEQ ID NO: 2183994 - RNA, 14 nt, Streptococcus pneumoniae R6
cgacaauauguauc

SEQ ID NO: 2183995 - RNA, 17 nt, Streptococcus pneumoniae R6
cgacaagauacccacaa

SEQ ID NO: 2183996 - RNA, 19 nt, Streptococcus pneumoniae R6
cgacaagauacccacaaaa

SEQ ID NO: 2183997 - RNA, 16 nt, Streptococcus pneumoniae R6
aaaccuguuugaauca

SEQ ID NO: 2183998 - RNA, 19 nt, Streptococcus pneumoniae R6
aaaccguguucugucaugc

SEQ ID NO: 2183999 - RNA, 18 nt, Streptococcus pneumoniae R6
aaaccgcgucagcuuuau

SEQ ID NO: 2184000 - RNA, 12 nt, Streptococcus pneumoniae R6
aaaccgucauca

SEQ ID NO: 2184001 - RNA, 20 nt, Streptococcus pneumoniae R6
aaaccgcgauuuuuugauac

SEQ ID NO: 2184002 - RNA, 17 nt, Streptococcus pneumoniae R6
ccggaaaauucucuuuu

SEQ ID NO: 2184003 - RNA, 14 nt, Streptococcus pneumoniae R6
ccggaaaccaaagg

SEQ ID NO: 2184004 - RNA, 17 nt, Streptococcus pneumoniae R6
ccgcuucagcgauuucu

SEQ ID NO: 2184005 - RNA, 15 nt, Streptococcus pneumoniae R6
ccuacaauuggaaau

SEQ ID NO: 2184006 - RNA, 21 nt, Streptococcus pneumoniae R6
ccuacaauuggaaauaacaaa

SEQ ID NO: 2184007 - RNA, 21 nt, Streptococcus pneumoniae R6
ccuacaugcuguuagaagacu

SEQ ID NO: 2184008 - RNA, 12 nt, Streptococcus pneumoniae R6
ccuaauuuuuca

SEQ ID NO: 2184009 - RNA, 17 nt, Streptococcus pneumoniae R6
ccuaauuuuucaauauc

SEQ ID NO: 2184010 - RNA, 22 nt, Streptococcus pneumoniae R6
ccuaauccuggucuuuuuuagc

SEQ ID NO: 2184011 - RNA, 13 nt, Streptococcus pneumoniae R6
ccuagaaaaccaa

SEQ ID NO: 2184012 - RNA, 22 nt, Streptococcus pneumoniae R6
ccuagaaaaccaaguauuggca

SEQ ID NO: 2184013 - RNA, 15 nt, Streptococcus pneumoniae R6
ccuacuguuagaaca

SEQ ID NO: 2184014 - RNA, 18 nt, Streptococcus pneumoniae R6
ccuacuucaaauccuuua

SEQ ID NO: 2184015 - RNA, 22 nt, Streptococcus pneumoniae R6
ccuacuucaaauccuuuauuuu

SEQ ID NO: 2184016 - RNA, 17 nt, Streptococcus pneumoniae R6
ccuagaauaugaacauu

SEQ ID NO: 2184017 - RNA, 23 nt, Streptococcus pneumoniae R6
ccuaggcaagcuugaaacaaaua

SEQ ID NO: 2184018 - RNA, 20 nt, Streptococcus pneumoniae R6
ccuagggugacaguaaaaaa

SEQ ID NO: 2184019 - RNA, 22 nt, Streptococcus pneumoniae R6
ccuagcuuucuaguuugcuuuu

SEQ ID NO: 2184020 - RNA, 22 nt, Streptococcus pneumoniae R6
ccuagcucauggcaagcaaguc

SEQ ID NO: 2184021 - RNA, 16 nt, Streptococcus pneumoniae R6
ccuaguuugcucuuug

SEQ ID NO: 2184022 - RNA, 14 nt, Streptococcus pneumoniae R6
ccuauauuucaaga

SEQ ID NO: 2184023 - RNA, 20 nt, Streptococcus pneumoniae R6
ccuauauuauaagacuuuuc

SEQ ID NO: 2184024 - RNA, 21 nt, Streptococcus pneumoniae R6
ccuauauuauaagacuuuucc

SEQ ID NO: 2184025 - RNA, 13 nt, Streptococcus pneumoniae R6
ccuauagaaaaau

SEQ ID NO: 2184026 - RNA, 12 nt, Streptococcus pneumoniae R6
ccuauuccuuuu

SEQ ID NO: 2184027 - RNA, 11 nt, Streptococcus pneumoniae R6
ccuauucugaa

SEQ ID NO: 2184028 - RNA, 15 nt, Streptococcus pneumoniae R6
ccuauccgcaaccuc

SEQ ID NO: 2184029 - RNA, 19 nt, Streptococcus pneumoniae R6
ccuauuuuuuauuucaaau

SEQ ID NO: 2184030 - RNA, 22 nt, Streptococcus pneumoniae R6
ccuauuuuuucggcucuuuguc

SEQ ID NO: 2184031 - RNA, 22 nt, Streptococcus pneumoniae R6
ccuauuuucuucuuuauaauau

SEQ ID NO: 2184032 - RNA, 13 nt, Streptococcus pneumoniae R6
ccuauuuaccaug

SEQ ID NO: 2184033 - RNA, 14 nt, Streptococcus pneumoniae R6
ccuauuuauuacuu

SEQ ID NO: 2184034 - RNA, 17 nt, Streptococcus pneumoniae R6
ccuauuuauuacuucaa

SEQ ID NO: 2184035 - RNA, 14 nt, Streptococcus pneumoniae R6
ccucaaaacagugu

SEQ ID NO: 2184036 - RNA, 16 nt, Streptococcus pneumoniae R6
ccucaaaaccauguuu

SEQ ID NO: 2184037 - RNA, 21 nt, Streptococcus pneumoniae R6
ccucacacggaaguauauucu

SEQ ID NO: 2184038 - RNA, 19 nt, Streptococcus pneumoniae R6
ccucagccaguucagcaua

SEQ ID NO: 2184039 - RNA, 23 nt, Streptococcus pneumoniae R6
ccuccagagaagccaccgccaga

SEQ ID NO: 2184040 - RNA, 16 nt, Streptococcus pneumoniae R6
ccuccuucuccaaucc

SEQ ID NO: 2184041 - RNA, 20 nt, Streptococcus pneumoniae R6
ccucccacuaucuaaaaaaa

SEQ ID NO: 2184042 - RNA, 14 nt, Streptococcus pneumoniae R6
ccuccaguuuuguu

SEQ ID NO: 2184043 - RNA, 18 nt, Streptococcus pneumoniae R6
ccuccauaaacgcaagca

SEQ ID NO: 2184044 - RNA, 16 nt, Streptococcus pneumoniae R6
ccucgauaccuguuaa

SEQ ID NO: 2184045 - RNA, 21 nt, Streptococcus pneumoniae R6
ccucgauaccuguuaagccua

SEQ ID NO: 2184046 - RNA, 22 nt, Streptococcus pneumoniae R6
ccucgagcaguuccaucaaucu

SEQ ID NO: 2184047 - RNA, 13 nt, Streptococcus pneumoniae R6
ccucggcauuccc

SEQ ID NO: 2184048 - RNA, 17 nt, Streptococcus pneumoniae R6
ccguugucuucugcgga

SEQ ID NO: 2184049 - RNA, 14 nt, Streptococcus pneumoniae R6
ccguugaaaucaau

SEQ ID NO: 2184050 - RNA, 21 nt, Streptococcus pneumoniae R6
ccguugaguuuuuuauuuucc

SEQ ID NO: 2184051 - RNA, 14 nt, Streptococcus pneumoniae R6
ccuaagacaaccaa

SEQ ID NO: 2184052 - RNA, 22 nt, Streptococcus pneumoniae R6
ccuaagaauagcgauuuaauca

SEQ ID NO: 2184053 - RNA, 16 nt, Streptococcus pneumoniae R6
ccuaaggcuguuucaa

SEQ ID NO: 2184054 - RNA, 18 nt, Streptococcus pneumoniae R6
ccuaaggcuguuucaaau

SEQ ID NO: 2184055 - RNA, 17 nt, Streptococcus pneumoniae R6
ccuaaguauagacgaaa

SEQ ID NO: 2184056 - RNA, 17 nt, Streptococcus pneumoniae R6
ccguuuuucuccucuaa

SEQ ID NO: 2184057 - RNA, 22 nt, Streptococcus pneumoniae R6
ccguuuuuguaguaaaagaauu

SEQ ID NO: 2184058 - RNA, 19 nt, Streptococcus pneumoniae R6
ccuaaacacuucacuaauu

SEQ ID NO: 2184059 - RNA, 13 nt, Streptococcus pneumoniae R6
ccuaaagaaaaag

SEQ ID NO: 2184060 - RNA, 15 nt, Streptococcus pneumoniae R6
aaacgacggucaugc

SEQ ID NO: 2184061 - RNA, 23 nt, Streptococcus pneumoniae R6
aaacgauaauagcgauugaauau

SEQ ID NO: 2184062 - RNA, 17 nt, Streptococcus pneumoniae R6
aaacgaggacuuagacg

SEQ ID NO: 2184063 - RNA, 14 nt, Streptococcus pneumoniae R6
aaacgagucaagaa

SEQ ID NO: 2184064 - RNA, 22 nt, Streptococcus pneumoniae R6
ccgucucacacggaaacagcuu

SEQ ID NO: 2184065 - RNA, 16 nt, Streptococcus pneumoniae R6
aaaccauucaaaauac

SEQ ID NO: 2184066 - RNA, 20 nt, Streptococcus pneumoniae R6
aaaccauguuuugagcugac

SEQ ID NO: 2184067 - RNA, 17 nt, Streptococcus pneumoniae R6
ccgccgaggauuucacg

SEQ ID NO: 2184068 - RNA, 13 nt, Streptococcus pneumoniae R6
aaaccccaagaaa

SEQ ID NO: 2184069 - RNA, 21 nt, Streptococcus pneumoniae R6
aaaccaguccuggaaaaacgu

SEQ ID NO: 2184070 - RNA, 21 nt, Streptococcus pneumoniae R6
aaaccaguccuugaaaaacgu

SEQ ID NO: 2184071 - RNA, 20 nt, Streptococcus pneumoniae R6
aaaccaguuccuuugucuuu

SEQ ID NO: 2184072 - RNA, 18 nt, Streptococcus pneumoniae R6
aaaccagguucuucaauc

SEQ ID NO: 2184073 - RNA, 23 nt, Streptococcus pneumoniae R6
aaaccaucguguaggggauaaug

SEQ ID NO: 2184074 - RNA, 22 nt, Streptococcus pneumoniae R6
aaaccaucaucagcauaaucug

SEQ ID NO: 2184075 - RNA, 15 nt, Streptococcus pneumoniae R6
ccgcaugacaaaucg

SEQ ID NO: 2184076 - RNA, 13 nt, Streptococcus pneumoniae R6
cccuuagaaaaac

SEQ ID NO: 2184077 - RNA, 15 nt, Streptococcus pneumoniae R6
cccuggggucggcag

SEQ ID NO: 2184078 - RNA, 18 nt, Streptococcus pneumoniae R6
aaacagcgagauugaagc

SEQ ID NO: 2184079 - RNA, 19 nt, Streptococcus pneumoniae R6
aaacagcgagauugaagcu

SEQ ID NO: 2184080 - RNA, 15 nt, Streptococcus pneumoniae R6
aaacagcuaaagaca

SEQ ID NO: 2184081 - RNA, 18 nt, Streptococcus pneumoniae R6
aaacagcuccugaaauaa

SEQ ID NO: 2184082 - RNA, 16 nt, Streptococcus pneumoniae R6
aaacaggaguucuuuu

SEQ ID NO: 2184083 - RNA, 17 nt, Streptococcus pneumoniae R6
aaacaggaguucuuuua

SEQ ID NO: 2184084 - RNA, 20 nt, Streptococcus pneumoniae R6
aaacaggaguucuuuuacaa

SEQ ID NO: 2184085 - RNA, 19 nt, Streptococcus pneumoniae R6
aaacaugguuuugagguug

SEQ ID NO: 2184086 - RNA, 21 nt, Streptococcus pneumoniae R6
aaacauguuuuugagguugua

SEQ ID NO: 2184087 - RNA, 18 nt, Streptococcus pneumoniae R6
ccgaagaguucaauagcu

SEQ ID NO: 2184088 - RNA, 17 nt, Streptococcus pneumoniae R6
ccgaaccacaacaaaaa

SEQ ID NO: 2184089 - RNA, 14 nt, Streptococcus pneumoniae R6
ccgaccuugucucc

SEQ ID NO: 2184090 - RNA, 13 nt, Streptococcus pneumoniae R6
aaacauucccaca

SEQ ID NO: 2184091 - RNA, 15 nt, Streptococcus pneumoniae R6
aaacauucuuagaaa

SEQ ID NO: 2184092 - RNA, 21 nt, Streptococcus pneumoniae R6
aaacauugacuugcuguuuuc

SEQ ID NO: 2184093 - RNA, 22 nt, Streptococcus pneumoniae R6
aaacauugacuugcuguuuucu

SEQ ID NO: 2184094 - RNA, 23 nt, Streptococcus pneumoniae R6
aaacauuguuaaaaauugauuug

SEQ ID NO: 2184095 - RNA, 14 nt, Streptococcus pneumoniae R6
aaacauuguuagaa

SEQ ID NO: 2184096 - RNA, 17 nt, Streptococcus pneumoniae R6
aaaccaccgacaaccca

SEQ ID NO: 2184097 - RNA, 18 nt, Streptococcus pneumoniae R6
aaaccaccgacaacccag

SEQ ID NO: 2184098 - RNA, 18 nt, Streptococcus pneumoniae R6
aaaccacgucagcuuuau

SEQ ID NO: 2184099 - RNA, 17 nt, Streptococcus pneumoniae R6
ccgaccaauucuucucu

SEQ ID NO: 2184100 - RNA, 20 nt, Streptococcus pneumoniae R6
cccuaggcaagcuugaaaca

SEQ ID NO: 2184101 - RNA, 20 nt, Streptococcus pneumoniae R6
cccuaugagagcuuauuuuu

SEQ ID NO: 2184102 - RNA, 21 nt, Streptococcus pneumoniae R6
cccuauccgcaaccucaaaac

SEQ ID NO: 2184103 - RNA, 13 nt, Streptococcus pneumoniae R6
cccuauauucuuu

SEQ ID NO: 2184104 - RNA, 18 nt, Streptococcus pneumoniae R6
cccuaauaauacaaaaaa

SEQ ID NO: 2184105 - RNA, 15 nt, Streptococcus pneumoniae R6
cccguugucuucugc

SEQ ID NO: 2184106 - RNA, 23 nt, Streptococcus pneumoniae R6
cccuccuauagaaaaauccccca

SEQ ID NO: 2184107 - RNA, 23 nt, Streptococcus pneumoniae R6
cccucagaguaagaaagcagcuu

SEQ ID NO: 2184108 - RNA, 21 nt, Streptococcus pneumoniae R6
cccugcaaacuggagcauuuc

SEQ ID NO: 2184109 - RNA, 21 nt, Streptococcus pneumoniae R6
ccccaaaaguuagacagaaaa

SEQ ID NO: 2184110 - RNA, 22 nt, Streptococcus pneumoniae R6
ccccaaaaguuagacagaaaaa

SEQ ID NO: 2184111 - RNA, 23 nt, Streptococcus pneumoniae R6
ccccaaaaguuagauuuuuucug

SEQ ID NO: 2184112 - RNA, 14 nt, Streptococcus pneumoniae R6
cccauuucuucagu

SEQ ID NO: 2184113 - RNA, 19 nt, Streptococcus pneumoniae R6
cccaugucaauucucacuu

SEQ ID NO: 2184114 - RNA, 21 nt, Streptococcus pneumoniae R6
cccaugucaauucucacuuga

SEQ ID NO: 2184115 - RNA, 16 nt, Streptococcus pneumoniae R6
cccaucuuuagcucca

SEQ ID NO: 2184116 - RNA, 14 nt, Streptococcus pneumoniae R6
cccaucucgugaau

SEQ ID NO: 2184117 - RNA, 18 nt, Streptococcus pneumoniae R6
ccccaguuacuuucuagg

SEQ ID NO: 2184118 - RNA, 21 nt, Streptococcus pneumoniae R6
ccccugauaguuaucgucacg

SEQ ID NO: 2184119 - RNA, 14 nt, Streptococcus pneumoniae R6
ccccugaugagcca

SEQ ID NO: 2184120 - RNA, 14 nt, Streptococcus pneumoniae R6
ccccuuuagaacuu

SEQ ID NO: 2184121 - RNA, 23 nt, Streptococcus pneumoniae R6
cccaucgcgaccaagagcaaaaa

SEQ ID NO: 2184122 - RNA, 14 nt, Streptococcus pneumoniae R6
cccaucauuccuga

SEQ ID NO: 2184123 - RNA, 18 nt, Streptococcus pneumoniae R6
cccaucauuccugauaaa

SEQ ID NO: 2184124 - RNA, 17 nt, Streptococcus pneumoniae R6
cccaucauuucuucaac

SEQ ID NO: 2184125 - RNA, 17 nt, Streptococcus pneumoniae R6
cccaucaauacccccuu

SEQ ID NO: 2184126 - RNA, 15 nt, Streptococcus pneumoniae R6
cccauagauuuuuau

SEQ ID NO: 2184127 - RNA, 20 nt, Streptococcus pneumoniae R6
aaacacaguuuugagguugu

SEQ ID NO: 2184128 - RNA, 23 nt, Streptococcus pneumoniae R6
aaacaaugugcucagaaacaaga

SEQ ID NO: 2184129 - RNA, 14 nt, Streptococcus pneumoniae R6
cccauaauaucaua

SEQ ID NO: 2184130 - RNA, 16 nt, Streptococcus pneumoniae R6
aaacaauguucucaua

SEQ ID NO: 2184131 - RNA, 18 nt, Streptococcus pneumoniae R6
aaacaauguucucauauu

SEQ ID NO: 2184132 - RNA, 14 nt, Streptococcus pneumoniae R6
aaacaauugcccaa

SEQ ID NO: 2184133 - RNA, 21 nt, Streptococcus pneumoniae R6
cccauaaaaauugacauggaa

SEQ ID NO: 2184134 - RNA, 24 nt, Streptococcus pneumoniae R6
cccauaaaaauugacauggaaauu

SEQ ID NO: 2184135 - RNA, 13 nt, Streptococcus pneumoniae R6
cccauaaaacuau

SEQ ID NO: 2184136 - RNA, 23 nt, Streptococcus pneumoniae R6
cccaguagcuauuaaagauuuuu

SEQ ID NO: 2184137 - RNA, 19 nt, Streptococcus pneumoniae R6
cccaguacuagacaauuuu

SEQ ID NO: 2184138 - RNA, 22 nt, Streptococcus pneumoniae R6
cccaguacuagacaauuuucau

SEQ ID NO: 2184139 - RNA, 12 nt, Streptococcus pneumoniae R6
cccagccuucag

SEQ ID NO: 2184140 - RNA, 15 nt, Streptococcus pneumoniae R6
cccagccuucagccc

SEQ ID NO: 2184141 - RNA, 17 nt, Streptococcus pneumoniae R6
cccaaguaaucugcacc

SEQ ID NO: 2184142 - RNA, 17 nt, Streptococcus pneumoniae R6
ccauauuuguugcucuu

SEQ ID NO: 2184143 - RNA, 15 nt, Streptococcus pneumoniae R6
aaacaauauuuuuga

SEQ ID NO: 2184144 - RNA, 12 nt, Streptococcus pneumoniae R6
aaacaaugaaaa

SEQ ID NO: 2184145 - RNA, 13 nt, Streptococcus pneumoniae R6
aaacaaugaaaau

SEQ ID NO: 2184146 - RNA, 17 nt, Streptococcus pneumoniae R6
ccauauuagccaagcua

SEQ ID NO: 2184147 - RNA, 17 nt, Streptococcus pneumoniae R6
ccaucauuucuucaaca

SEQ ID NO: 2184148 - RNA, 13 nt, Streptococcus pneumoniae R6
ccaucauuuuuga

SEQ ID NO: 2184149 - RNA, 19 nt, Streptococcus pneumoniae R6
ccauccugaauagugaaga

SEQ ID NO: 2184150 - RNA, 22 nt, Streptococcus pneumoniae R6
ccaugaaaagaucgccaucaua

SEQ ID NO: 2184151 - RNA, 19 nt, Streptococcus pneumoniae R6
ccaugaacgucuaaacugu

SEQ ID NO: 2184152 - RNA, 21 nt, Streptococcus pneumoniae R6
ccaugaccgaguugaggggca

SEQ ID NO: 2184153 - RNA, 19 nt, Streptococcus pneumoniae R6
ccaugacgucguaaccaga

SEQ ID NO: 2184154 - RNA, 19 nt, Streptococcus pneumoniae R6
ccaugacgcauaguugcau

SEQ ID NO: 2184155 - RNA, 17 nt, Streptococcus pneumoniae R6
ccaugagaauguccaua

SEQ ID NO: 2184156 - RNA, 20 nt, Streptococcus pneumoniae R6
ccaugagcgucuuucuuauc

SEQ ID NO: 2184157 - RNA, 22 nt, Streptococcus pneumoniae R6
ccauucgauuuaucuguuugua

SEQ ID NO: 2184158 - RNA, 20 nt, Streptococcus pneumoniae R6
ccauuauagcauucuucuca

SEQ ID NO: 2184159 - RNA, 21 nt, Streptococcus pneumoniae R6
ccauuaaucagauaaacaaug

SEQ ID NO: 2184160 - RNA, 15 nt, Streptococcus pneumoniae R6
ccauuaauucgauuu

SEQ ID NO: 2184161 - RNA, 23 nt, Streptococcus pneumoniae R6
ccauguuuuucuccuauuuucuu

SEQ ID NO: 2184162 - RNA, 19 nt, Streptococcus pneumoniae R6
ccaugguccgggcugacaa

SEQ ID NO: 2184163 - RNA, 18 nt, Streptococcus pneumoniae R6
ccauggcugacaacaagg

SEQ ID NO: 2184164 - RNA, 11 nt, Streptococcus pneumoniae R6
ccauguuauga

SEQ ID NO: 2184165 - RNA, 15 nt, Streptococcus pneumoniae R6
ccaugucguuuccuu

SEQ ID NO: 2184166 - RNA, 22 nt, Streptococcus pneumoniae R6
ccaugucgcaucgucaucacga

SEQ ID NO: 2184167 - RNA, 12 nt, Streptococcus pneumoniae R6
ccauuuuaaagg

SEQ ID NO: 2184168 - RNA, 19 nt, Streptococcus pneumoniae R6
ccauuuucagaaagaaggg

SEQ ID NO: 2184169 - RNA, 14 nt, Streptococcus pneumoniae R6
ccauuugaaagaac

SEQ ID NO: 2184170 - RNA, 16 nt, Streptococcus pneumoniae R6
ccauuucuucaguaua

SEQ ID NO: 2184171 - RNA, 16 nt, Streptococcus pneumoniae R6
cccaagcuuuaugcuu

SEQ ID NO: 2184172 - RNA, 12 nt, Streptococcus pneumoniae R6
ccauuuuuuaaa

SEQ ID NO: 2184173 - RNA, 15 nt, Streptococcus pneumoniae R6
ccauaaaaauaacuu

SEQ ID NO: 2184174 - RNA, 19 nt, Streptococcus pneumoniae R6
ccaguuguggcgacuuccu

SEQ ID NO: 2184175 - RNA, 20 nt, Streptococcus pneumoniae R6
ccaguugccauagcuccuga

SEQ ID NO: 2184176 - RNA, 14 nt, Streptococcus pneumoniae R6
ccauaugauucuuu

SEQ ID NO: 2184177 - RNA, 18 nt, Streptococcus pneumoniae R6
ccauaguaaacuucuucu

SEQ ID NO: 2184178 - RNA, 20 nt, Streptococcus pneumoniae R6
ccauaguaaacuucuucuuc

SEQ ID NO: 2184179 - RNA, 20 nt, Streptococcus pneumoniae R6
ccauagcgucaaagaaggcu

SEQ ID NO: 2184180 - RNA, 18 nt, Streptococcus pneumoniae R6
ccauaggccaagucuuuu

SEQ ID NO: 2184181 - RNA, 13 nt, Streptococcus pneumoniae R6
ccauacgcccucc

SEQ ID NO: 2184182 - RNA, 12 nt, Streptococcus pneumoniae R6
ccaguuaucugc

SEQ ID NO: 2184183 - RNA, 21 nt, Streptococcus pneumoniae R6
ccaguuacuacuggaacaucu

SEQ ID NO: 2184184 - RNA, 18 nt, Streptococcus pneumoniae R6
ccagugcccauaagcuga

SEQ ID NO: 2184185 - RNA, 19 nt, Streptococcus pneumoniae R6
ccagucgucaccguuuuug

SEQ ID NO: 2184186 - RNA, 22 nt, Streptococcus pneumoniae R6
ccaguccuuguaugacaucuug

SEQ ID NO: 2184187 - RNA, 12 nt, Streptococcus pneumoniae R6
ccaguccuggaa

SEQ ID NO: 2184188 - RNA, 20 nt, Streptococcus pneumoniae R6
ccaguacuuucaacuccuua

SEQ ID NO: 2184189 - RNA, 15 nt, Streptococcus pneumoniae R6
ccaguagcgcuugau

SEQ ID NO: 2184190 - RNA, 20 nt, Streptococcus pneumoniae R6
ccaguagcuauuagaccugc

SEQ ID NO: 2184191 - RNA, 13 nt, Streptococcus pneumoniae R6
ccagguuuuucac

SEQ ID NO: 2184192 - RNA, 21 nt, Streptococcus pneumoniae R6
ccagguaauccagaaauggaa

SEQ ID NO: 2184193 - RNA, 22 nt, Streptococcus pneumoniae R6
cgccaguugcugcguuaaaucc

SEQ ID NO: 2184194 - RNA, 15 nt, Streptococcus pneumoniae R6
cgccauuuggcccua

SEQ ID NO: 2184195 - RNA, 22 nt, Streptococcus pneumoniae R6
cgcccaaacauagugaccugga

SEQ ID NO: 2184196 - RNA, 14 nt, Streptococcus pneumoniae R6
cgccccauuucuuc

SEQ ID NO: 2184197 - RNA, 21 nt, Streptococcus pneumoniae R6
cgccgauggaaauauaggcca

SEQ ID NO: 2184198 - RNA, 13 nt, Streptococcus pneumoniae R6
cgcaauuccugcc

SEQ ID NO: 2184199 - RNA, 14 nt, Streptococcus pneumoniae R6
cgcaaguuuuuccc

SEQ ID NO: 2184200 - RNA, 20 nt, Streptococcus pneumoniae R6
cgcaaguccuacccacugug

SEQ ID NO: 2184201 - RNA, 23 nt, Streptococcus pneumoniae R6
cgcaagguuguuagauuauguaa

SEQ ID NO: 2184202 - RNA, 18 nt, Streptococcus pneumoniae R6
cgcaagcagcuaaaagca

SEQ ID NO: 2184203 - RNA, 20 nt, Streptococcus pneumoniae R6
aaacgguguuuugagcaguc

SEQ ID NO: 2184204 - RNA, 21 nt, Streptococcus pneumoniae R6
cgcauaaauacuaucaauaaa

SEQ ID NO: 2184205 - RNA, 22 nt, Streptococcus pneumoniae R6
cgauaacgauagauccuucaaa

SEQ ID NO: 2184206 - RNA, 17 nt, Streptococcus pneumoniae R6
cgauaaggcgaugcuga

SEQ ID NO: 2184207 - RNA, 17 nt, Streptococcus pneumoniae R6
cgauacuguaguuuuuc

SEQ ID NO: 2184208 - RNA, 15 nt, Streptococcus pneumoniae R6
cgauaucagcuagga

SEQ ID NO: 2184209 - RNA, 19 nt, Streptococcus pneumoniae R6
cgaucauccauucuuuuuu

SEQ ID NO: 2184210 - RNA, 22 nt, Streptococcus pneumoniae R6
cgaucgaugcugugacacuaga

SEQ ID NO: 2184211 - RNA, 20 nt, Streptococcus pneumoniae R6
cgaugaccguugacuuccuu

SEQ ID NO: 2184212 - RNA, 15 nt, Streptococcus pneumoniae R6
cgaucugaaauaaag

SEQ ID NO: 2184213 - RNA, 20 nt, Streptococcus pneumoniae R6
cgaucuguucuucuaucuuc

SEQ ID NO: 2184214 - RNA, 22 nt, Streptococcus pneumoniae R6
cgauuaccgccuucuacuuccu

SEQ ID NO: 2184215 - RNA, 17 nt, Streptococcus pneumoniae R6
cgauuacaaucauagac

SEQ ID NO: 2184216 - RNA, 22 nt, Streptococcus pneumoniae R6
cgauuacaaucauagacuuaau

SEQ ID NO: 2184217 - RNA, 21 nt, Streptococcus pneumoniae R6
cgauuaaauaguucuuccaau

SEQ ID NO: 2184218 - RNA, 17 nt, Streptococcus pneumoniae R6
cgauuaaaaguaagaga

SEQ ID NO: 2184219 - RNA, 18 nt, Streptococcus pneumoniae R6
cgauguuugcagcaccag

SEQ ID NO: 2184220 - RNA, 16 nt, Streptococcus pneumoniae R6
cgauuuaaugauaugg

SEQ ID NO: 2184221 - RNA, 15 nt, Streptococcus pneumoniae R6
cgauucccaagucug

SEQ ID NO: 2184222 - RNA, 15 nt, Streptococcus pneumoniae R6
cgauuauuuuuucuc

SEQ ID NO: 2184223 - RNA, 19 nt, Streptococcus pneumoniae R6
cgauuaggggggcuauucu

SEQ ID NO: 2184224 - RNA, 14 nt, Streptococcus pneumoniae R6
cgaugguugucccu

SEQ ID NO: 2184225 - RNA, 21 nt, Streptococcus pneumoniae R6
cgcuacgacguuuaucaauaa

SEQ ID NO: 2184226 - RNA, 13 nt, Streptococcus pneumoniae R6
cgcuauuuaaacu

SEQ ID NO: 2184227 - RNA, 11 nt, Streptococcus pneumoniae R6
cgcguucugca

SEQ ID NO: 2184228 - RNA, 19 nt, Streptococcus pneumoniae R6
cgcuccuaaucucuggcug

SEQ ID NO: 2184229 - RNA, 15 nt, Streptococcus pneumoniae R6
cgcuuccaauuuuug

SEQ ID NO: 2184230 - RNA, 15 nt, Streptococcus pneumoniae R6
cgcuugaaugauaaa

SEQ ID NO: 2184231 - RNA, 23 nt, Streptococcus pneumoniae R6
cgcuugaaugauaaaacauacug

SEQ ID NO: 2184232 - RNA, 19 nt, Streptococcus pneumoniae R6
cgcuucguagucgccaucu

SEQ ID NO: 2184233 - RNA, 15 nt, Streptococcus pneumoniae R6
cgcuuacauaaagua

SEQ ID NO: 2184234 - RNA, 19 nt, Streptococcus pneumoniae R6
cgcuucagcgauuucuuca

SEQ ID NO: 2184235 - RNA, 15 nt, Streptococcus pneumoniae R6
cgcgcaauuaagcag

SEQ ID NO: 2184236 - RNA, 17 nt, Streptococcus pneumoniae R6
cggcaguuuuuucuuuc

SEQ ID NO: 2184237 - RNA, 12 nt, Streptococcus pneumoniae R6
cggcaggcuggu

SEQ ID NO: 2184238 - RNA, 16 nt, Streptococcus pneumoniae R6
cggccaauucuucuuc

SEQ ID NO: 2184239 - RNA, 19 nt, Streptococcus pneumoniae R6
uuuuuuagcucuugcaaua

SEQ ID NO: 2184240 - RNA, 21 nt, Streptococcus pneumoniae R6
uuuuugucuacgauagccguu

SEQ ID NO: 2184241 - RNA, 19 nt, Streptococcus pneumoniae R6
uuuuuguauauuuuucaaa

SEQ ID NO: 2184242 - RNA, 11 nt, Streptococcus pneumoniae R6
uuuuucucaau

SEQ ID NO: 2184243 - RNA, 19 nt, Streptococcus pneumoniae R6
uuuuucucaaucaguuuuu

SEQ ID NO: 2184244 - RNA, 16 nt, Streptococcus pneumoniae R6
uuuuucggcaguuuuu

SEQ ID NO: 2184245 - RNA, 18 nt, Streptococcus pneumoniae R6
uuuuuccuucaucaaagc

SEQ ID NO: 2184246 - RNA, 12 nt, Streptococcus pneumoniae R6
uuuuuccuuuuc

SEQ ID NO: 2184247 - RNA, 22 nt, Streptococcus pneumoniae R6
uuuuuccugaagucgaguuuuu

SEQ ID NO: 2184248 - RNA, 12 nt, Streptococcus pneumoniae R6
uuuuuccagcuu

SEQ ID NO: 2184249 - RNA, 13 nt, Streptococcus pneumoniae R6
uuuugauuuuaaa

SEQ ID NO: 2184250 - RNA, 16 nt, Streptococcus pneumoniae R6
uuuugauuauuuuuua

SEQ ID NO: 2184251 - RNA, 16 nt, Streptococcus pneumoniae R6
uuuugauuagcaaaac

SEQ ID NO: 2184252 - RNA, 13 nt, Streptococcus pneumoniae R6
uuuuucuuuguuc

SEQ ID NO: 2184253 - RNA, 13 nt, Streptococcus pneumoniae R6
uuuuugaacaccu

SEQ ID NO: 2184254 - RNA, 21 nt, Streptococcus pneumoniae R6
uuuuugaaguuuucaaaguuu

SEQ ID NO: 2184255 - RNA, 13 nt, Streptococcus pneumoniae R6
uuuuucuucuucg

SEQ ID NO: 2184256 - RNA, 20 nt, Streptococcus pneumoniae R6
uuuuugaaagucauauuucu

SEQ ID NO: 2184257 - RNA, 22 nt, Streptococcus pneumoniae R6
uuuuugagcaauacuuuuucgu

SEQ ID NO: 2184258 - RNA, 15 nt, Streptococcus pneumoniae R6
uuuuugauuucuucu

SEQ ID NO: 2184259 - RNA, 14 nt, Streptococcus pneumoniae R6
uuuuugauuuuaaa

SEQ ID NO: 2184260 - RNA, 20 nt, Streptococcus pneumoniae R6
uuuuugacaccaaucaguaa

SEQ ID NO: 2184261 - RNA, 13 nt, Streptococcus pneumoniae R6
uuuuugauaugag

SEQ ID NO: 2184262 - RNA, 15 nt, Streptococcus pneumoniae R6
uuuuugauauucaga

SEQ ID NO: 2184263 - RNA, 11 nt, Streptococcus pneumoniae R6
uuuuugauguu

SEQ ID NO: 2184264 - RNA, 21 nt, Streptococcus pneumoniae R6
uuuuugagcagaacaaugacu

SEQ ID NO: 2184265 - RNA, 18 nt, Streptococcus pneumoniae R6
uuuuuggagugauagaaa

SEQ ID NO: 2184266 - RNA, 23 nt, Streptococcus pneumoniae R6
uuuuuggcugauuucuuggaacu

SEQ ID NO: 2184267 - RNA, 17 nt, Streptococcus pneumoniae R6
uuuuugcaagugcucca

SEQ ID NO: 2184268 - RNA, 19 nt, Streptococcus pneumoniae R6
uuuuugcccucuaaauaca

SEQ ID NO: 2184269 - RNA, 16 nt, Streptococcus pneumoniae R6
uuuuugccuaaaauuc

SEQ ID NO: 2184270 - RNA, 17 nt, Streptococcus pneumoniae R6
uuuuugccuaaaauuca

SEQ ID NO: 2184271 - RNA, 14 nt, Streptococcus pneumoniae R6
uuugugaaucauca

SEQ ID NO: 2184272 - RNA, 21 nt, Streptococcus pneumoniae R6
uuugugaaaaacuuaguaaac

SEQ ID NO: 2184273 - RNA, 22 nt, Streptococcus pneumoniae R6
uuugugaaaaacuuaguaaaca

SEQ ID NO: 2184274 - RNA, 13 nt, Streptococcus pneumoniae R6
uuugugauuuuaa

SEQ ID NO: 2184275 - RNA, 22 nt, Streptococcus pneumoniae R6
uuugugcucuuaaacaagagau

SEQ ID NO: 2184276 - RNA, 13 nt, Streptococcus pneumoniae R6
uuugucucugaaa

SEQ ID NO: 2184277 - RNA, 12 nt, Streptococcus pneumoniae R6
uuuguccuucuu

SEQ ID NO: 2184278 - RNA, 13 nt, Streptococcus pneumoniae R6
uuuguuuucaagu

SEQ ID NO: 2184279 - RNA, 18 nt, Streptococcus pneumoniae R6
uuuguuucaagcuugccu

SEQ ID NO: 2184280 - RNA, 17 nt, Streptococcus pneumoniae R6
uuuguuucaauauacua

SEQ ID NO: 2184281 - RNA, 19 nt, Streptococcus pneumoniae R6
uuuguuuaauacucaauga

SEQ ID NO: 2184282 - RNA, 19 nt, Streptococcus pneumoniae R6
uuuguuaguuuaaaauuac

SEQ ID NO: 2184283 - RNA, 21 nt, Streptococcus pneumoniae R6
uuuguuaccaauacaggaaaa

SEQ ID NO: 2184284 - RNA, 21 nt, Streptococcus pneumoniae R6
uuuguucauaucuuauuucaa

SEQ ID NO: 2184285 - RNA, 16 nt, Streptococcus pneumoniae R6
uuuguuccgauuuuau

SEQ ID NO: 2184286 - RNA, 21 nt, Streptococcus pneumoniae R6
uuuguuccgauuuuauuucau

SEQ ID NO: 2184287 - RNA, 17 nt, Streptococcus pneumoniae R6
uuuguucuguucuuauu

SEQ ID NO: 2184288 - RNA, 21 nt, Streptococcus pneumoniae R6
uuuguucuguucuuauuucau

SEQ ID NO: 2184289 - RNA, 11 nt, Streptococcus pneumoniae R6
uuuguucuuuu

SEQ ID NO: 2184290 - RNA, 13 nt, Streptococcus pneumoniae R6
uuuguucuuuuuc

SEQ ID NO: 2184291 - RNA, 17 nt, Streptococcus pneumoniae R6
uuuguucguauccuauu

SEQ ID NO: 2184292 - RNA, 21 nt, Streptococcus pneumoniae R6
uuuguucucaucuuauuucaa

SEQ ID NO: 2184293 - RNA, 19 nt, Streptococcus pneumoniae R6
uuuuaaaaaaucuuuuuca

SEQ ID NO: 2184294 - RNA, 13 nt, Streptococcus pneumoniae R6
uuuguuuuuuccu

SEQ ID NO: 2184295 - RNA, 14 nt, Streptococcus pneumoniae R6
uuuuaaaaauagcu

SEQ ID NO: 2184296 - RNA, 21 nt, Streptococcus pneumoniae R6
uuuuaaaauauuagcaaaaaa

SEQ ID NO: 2184297 - RNA, 17 nt, Streptococcus pneumoniae R6
uuuuaaaauccauaauu

SEQ ID NO: 2184298 - RNA, 12 nt, Streptococcus pneumoniae R6
uuuuaaaaugcc

SEQ ID NO: 2184299 - RNA, 12 nt, Streptococcus pneumoniae R6
uuuuaaagacuu

SEQ ID NO: 2184300 - RNA, 22 nt, Streptococcus pneumoniae R6
uuuuaaaccacgucaguuuuau

SEQ ID NO: 2184301 - RNA, 22 nt, Streptococcus pneumoniae R6
uuuuaaaugaguaugaaaagag

SEQ ID NO: 2184302 - RNA, 14 nt, Streptococcus pneumoniae R6
uuuuaaccagaucu

SEQ ID NO: 2184303 - RNA, 19 nt, Streptococcus pneumoniae R6
uuuuaaccagaucuuagaa

SEQ ID NO: 2184304 - RNA, 15 nt, Streptococcus pneumoniae R6
uuuuaacaaaaauuu

SEQ ID NO: 2184305 - RNA, 13 nt, Streptococcus pneumoniae R6
uuuuaaauuuggu

SEQ ID NO: 2184306 - RNA, 22 nt, Streptococcus pneumoniae R6
uuuuaagguuguggauggaacu

SEQ ID NO: 2184307 - RNA, 16 nt, Streptococcus pneumoniae R6
uuuuaagaaagaucuu

SEQ ID NO: 2184308 - RNA, 13 nt, Streptococcus pneumoniae R6
uuuuaacugucua

SEQ ID NO: 2184309 - RNA, 14 nt, Streptococcus pneumoniae R6
uuuuaagauuuuac

SEQ ID NO: 2184310 - RNA, 17 nt, Streptococcus pneumoniae R6
uuuuaaggacugaaaua

SEQ ID NO: 2184311 - RNA, 18 nt, Streptococcus pneumoniae R6
uuugguugcaccaaguca

SEQ ID NO: 2184312 - RNA, 23 nt, Streptococcus pneumoniae R6
uuugguugcaccaagucauaggc

SEQ ID NO: 2184313 - RNA, 19 nt, Streptococcus pneumoniae R6
uuuggucagcuucuugcau

SEQ ID NO: 2184314 - RNA, 19 nt, Streptococcus pneumoniae R6
uuugguaauuuucaagaau

SEQ ID NO: 2184315 - RNA, 21 nt, Streptococcus pneumoniae R6
uuugggucuguuuuugaagaa

SEQ ID NO: 2184316 - RNA, 14 nt, Streptococcus pneumoniae R6
uuugguaagauuca

SEQ ID NO: 2184317 - RNA, 17 nt, Streptococcus pneumoniae R6
uuuggcgaugauuuccu

SEQ ID NO: 2184318 - RNA, 19 nt, Streptococcus pneumoniae R6
uuuggccaagguucauuuc

SEQ ID NO: 2184319 - RNA, 22 nt, Streptococcus pneumoniae R6
uuuggcuaggcgcuucacuagu

SEQ ID NO: 2184320 - RNA, 22 nt, Streptococcus pneumoniae R6
uuuguaaucuaggaaaacgaua

SEQ ID NO: 2184321 - RNA, 21 nt, Streptococcus pneumoniae R6
uuuguacugccccccaaaaaa

SEQ ID NO: 2184322 - RNA, 14 nt, Streptococcus pneumoniae R6
uuuguacuuguucu

SEQ ID NO: 2184323 - RNA, 12 nt, Streptococcus pneumoniae R6
uuuguaaaaaag

SEQ ID NO: 2184324 - RNA, 16 nt, Streptococcus pneumoniae R6
uuugguuuuucuucag

SEQ ID NO: 2184325 - RNA, 18 nt, Streptococcus pneumoniae R6
uuuguagcaaauucacca

SEQ ID NO: 2184326 - RNA, 18 nt, Streptococcus pneumoniae R6
uuuguaggccacaaaugc

SEQ ID NO: 2184327 - RNA, 18 nt, Streptococcus pneumoniae R6
uuuguauauuuuucaaau

SEQ ID NO: 2184328 - RNA, 22 nt, Streptococcus pneumoniae R6
uuuguaucaccaagcauuuuca

SEQ ID NO: 2184329 - RNA, 12 nt, Streptococcus pneumoniae R6
uuuguauuccac

SEQ ID NO: 2184330 - RNA, 19 nt, Streptococcus pneumoniae R6
uuuguauuucuucuucuga

SEQ ID NO: 2184331 - RNA, 22 nt, Streptococcus pneumoniae R6
uuugcucagcauucucaaugau

SEQ ID NO: 2184332 - RNA, 17 nt, Streptococcus pneumoniae R6
uuugcugguuaaugauu

SEQ ID NO: 2184333 - RNA, 18 nt, Streptococcus pneumoniae R6
uuugcgcuagauccuuuu

SEQ ID NO: 2184334 - RNA, 14 nt, Streptococcus pneumoniae R6
uuugcuaaucaaaa

SEQ ID NO: 2184335 - RNA, 22 nt, Streptococcus pneumoniae R6
uuugcuuuuggcacguguaaug

SEQ ID NO: 2184336 - RNA, 14 nt, Streptococcus pneumoniae R6
uuugcuuaaauaaa

SEQ ID NO: 2184337 - RNA, 22 nt, Streptococcus pneumoniae R6
uuugcuuaaauaaaauuuuuuu

SEQ ID NO: 2184338 - RNA, 14 nt, Streptococcus pneumoniae R6
uuugcuuacagaca

SEQ ID NO: 2184339 - RNA, 15 nt, Streptococcus pneumoniae R6
uuugcuucaucauuu

SEQ ID NO: 2184340 - RNA, 13 nt, Streptococcus pneumoniae R6
uuugcuugaccag

SEQ ID NO: 2184341 - RNA, 13 nt, Streptococcus pneumoniae R6
uuuggcaacugcu

SEQ ID NO: 2184342 - RNA, 14 nt, Streptococcus pneumoniae R6
uuuggauuuuguuu

SEQ ID NO: 2184343 - RNA, 13 nt, Streptococcus pneumoniae R6
uuuggcagauuua

SEQ ID NO: 2184344 - RNA, 15 nt, Streptococcus pneumoniae R6
uuuggauuauuaccu

SEQ ID NO: 2184345 - RNA, 19 nt, Streptococcus pneumoniae R6
uuuucacagaguauuaaau

SEQ ID NO: 2184346 - RNA, 22 nt, Streptococcus pneumoniae R6
uuuucauugaguauuauuucau

SEQ ID NO: 2184347 - RNA, 15 nt, Streptococcus pneumoniae R6
uuuuccaaacauaca

SEQ ID NO: 2184348 - RNA, 16 nt, Streptococcus pneumoniae R6
uuuuccaacucagcca

SEQ ID NO: 2184349 - RNA, 18 nt, Streptococcus pneumoniae R6
uuuucaagaauugcagcc

SEQ ID NO: 2184350 - RNA, 21 nt, Streptococcus pneumoniae R6
uuuucaacccacuacaguuga

SEQ ID NO: 2184351 - RNA, 12 nt, Streptococcus pneumoniae R6
uuuuauuuuuua

SEQ ID NO: 2184352 - RNA, 17 nt, Streptococcus pneumoniae R6
uuuucaagggcuuuuug

SEQ ID NO: 2184353 - RNA, 21 nt, Streptococcus pneumoniae R6
uuuucaaguaggucaaagcug

SEQ ID NO: 2184354 - RNA, 15 nt, Streptococcus pneumoniae R6
uuuucaaucaagaca

SEQ ID NO: 2184355 - RNA, 13 nt, Streptococcus pneumoniae R6
uuuuauuucaaau

SEQ ID NO: 2184356 - RNA, 22 nt, Streptococcus pneumoniae R6
uuuuauuuucccaguagcuauu

SEQ ID NO: 2184357 - RNA, 13 nt, Streptococcus pneumoniae R6
uuuuauuauuaau

SEQ ID NO: 2184358 - RNA, 17 nt, Streptococcus pneumoniae R6
uuuuauuaaguagaaua

SEQ ID NO: 2184359 - RNA, 20 nt, Streptococcus pneumoniae R6
uuuuauguuauccuauucuu

SEQ ID NO: 2184360 - RNA, 16 nt, Streptococcus pneumoniae R6
uuuuauguucuaagaa

SEQ ID NO: 2184361 - RNA, 13 nt, Streptococcus pneumoniae R6
uuuucucaauacu

SEQ ID NO: 2184362 - RNA, 14 nt, Streptococcus pneumoniae R6
uuuucucaauagga

SEQ ID NO: 2184363 - RNA, 19 nt, Streptococcus pneumoniae R6
uuuuccauauaaaaaagca

SEQ ID NO: 2184364 - RNA, 20 nt, Streptococcus pneumoniae R6
uuuucguacaauauuuguug

SEQ ID NO: 2184365 - RNA, 18 nt, Streptococcus pneumoniae R6
uuuucguagcauauccac

SEQ ID NO: 2184366 - RNA, 21 nt, Streptococcus pneumoniae R6
uuuucguaguugguuaccuca

SEQ ID NO: 2184367 - RNA, 20 nt, Streptococcus pneumoniae R6
uuuucgucaccaaauuucau

SEQ ID NO: 2184368 - RNA, 17 nt, Streptococcus pneumoniae R6
uuuugaacaccugauuu

SEQ ID NO: 2184369 - RNA, 20 nt, Streptococcus pneumoniae R6
uuuugaagaauguuuucagc

SEQ ID NO: 2184370 - RNA, 19 nt, Streptococcus pneumoniae R6
uuuugaagauggucuaagc

SEQ ID NO: 2184371 - RNA, 22 nt, Streptococcus pneumoniae R6
uuuugaaauaaucucugaacuu

SEQ ID NO: 2184372 - RNA, 13 nt, Streptococcus pneumoniae R6
uuuugagugguuu

SEQ ID NO: 2184373 - RNA, 19 nt, Streptococcus pneumoniae R6
uuuugaauauuaguaaaua

SEQ ID NO: 2184374 - RNA, 16 nt, Streptococcus pneumoniae R6
uuuugaaguuuucaaa

SEQ ID NO: 2184375 - RNA, 23 nt, Streptococcus pneumoniae R6
uuuucucaucuauuuuuacucaa

SEQ ID NO: 2184376 - RNA, 12 nt, Streptococcus pneumoniae R6
uuuucuguacug

SEQ ID NO: 2184377 - RNA, 22 nt, Streptococcus pneumoniae R6
uuuucuguuuucuucuccgaag

SEQ ID NO: 2184378 - RNA, 16 nt, Streptococcus pneumoniae R6
uuuucuccuauuuucu

SEQ ID NO: 2184379 - RNA, 22 nt, Streptococcus pneumoniae R6
uuuuagauugcuuuccaauaau

SEQ ID NO: 2184380 - RNA, 13 nt, Streptococcus pneumoniae R6
uuuuagauuuuuu

SEQ ID NO: 2184381 - RNA, 20 nt, Streptococcus pneumoniae R6
uuuuagcaaucgcaaucuac

SEQ ID NO: 2184382 - RNA, 13 nt, Streptococcus pneumoniae R6
uuuuacuuuggca

SEQ ID NO: 2184383 - RNA, 14 nt, Streptococcus pneumoniae R6
uuuuacuucuuugg

SEQ ID NO: 2184384 - RNA, 22 nt, Streptococcus pneumoniae R6
uuuuacuuauaauuaaaaguuu

SEQ ID NO: 2184385 - RNA, 15 nt, Streptococcus pneumoniae R6
uuuuacuucugaagu

SEQ ID NO: 2184386 - RNA, 21 nt, Streptococcus pneumoniae R6
uuuuacucuaguuuuuauaau

SEQ ID NO: 2184387 - RNA, 13 nt, Streptococcus pneumoniae R6
uuuuacuaaaaua

SEQ ID NO: 2184388 - RNA, 14 nt, Streptococcus pneumoniae R6
uuuuacaaauacca

SEQ ID NO: 2184389 - RNA, 17 nt, Streptococcus pneumoniae R6
uuuuacaucuguuuuaa

SEQ ID NO: 2184390 - RNA, 19 nt, Streptococcus pneumoniae R6
uuuuacaucuguuuuaaac

SEQ ID NO: 2184391 - RNA, 15 nt, Streptococcus pneumoniae R6
uuuuaauuauuuuca

SEQ ID NO: 2184392 - RNA, 19 nt, Streptococcus pneumoniae R6
uuuuaauuuuucuuuguag

SEQ ID NO: 2184393 - RNA, 19 nt, Streptococcus pneumoniae R6
uuuuaaucgauuauuuuuu

SEQ ID NO: 2184394 - RNA, 23 nt, Streptococcus pneumoniae R6
uuuuauaugauuucaauuuuaaa

SEQ ID NO: 2184395 - RNA, 15 nt, Streptococcus pneumoniae R6
uuuuauauaaaauaa

SEQ ID NO: 2184396 - RNA, 17 nt, Streptococcus pneumoniae R6
uuuuauauaaaauaauu

SEQ ID NO: 2184397 - RNA, 21 nt, Streptococcus pneumoniae R6
uuuuauauaaaauaauuaaaa

SEQ ID NO: 2184398 - RNA, 14 nt, Streptococcus pneumoniae R6
uuuuaucauucugc

SEQ ID NO: 2184399 - RNA, 23 nt, Streptococcus pneumoniae R6
uuuuauauccuaaaaaagagcug

SEQ ID NO: 2184400 - RNA, 14 nt, Streptococcus pneumoniae R6
uuuuaucauagaaa

SEQ ID NO: 2184401 - RNA, 17 nt, Streptococcus pneumoniae R6
uuuuaucgaaaagacuu

SEQ ID NO: 2184402 - RNA, 13 nt, Streptococcus pneumoniae R6
uuuuaucuaguau

SEQ ID NO: 2184403 - RNA, 21 nt, Streptococcus pneumoniae R6
uuuuaugaggugcuuuuugau

SEQ ID NO: 2184404 - RNA, 14 nt, Streptococcus pneumoniae R6
uuuuaugauauaca

SEQ ID NO: 2184405 - RNA, 22 nt, Streptococcus pneumoniae R6
uuuuaugauauacacacuuaaa

SEQ ID NO: 2184406 - RNA, 16 nt, Streptococcus pneumoniae R6
uuuuaguagaaaauga

SEQ ID NO: 2184407 - RNA, 17 nt, Streptococcus pneumoniae R6
uuuuaggcaauaaaaua

SEQ ID NO: 2184408 - RNA, 16 nt, Streptococcus pneumoniae R6
uuuuagggaaaugaaa

SEQ ID NO: 2184409 - RNA, 14 nt, Streptococcus pneumoniae R6
uuuuaguuugcauu

SEQ ID NO: 2184410 - RNA, 21 nt, Streptococcus pneumoniae R6
uuuuaguuugcauuggcuauu

SEQ ID NO: 2184411 - RNA, 18 nt, Streptococcus pneumoniae R6
uuuuauaauguauugaau

SEQ ID NO: 2184412 - RNA, 14 nt, Streptococcus pneumoniae R6
uuuuauaauagaaa

SEQ ID NO: 2184413 - RNA, 13 nt, Streptococcus pneumoniae R6
uuuuauaauauca

SEQ ID NO: 2184414 - RNA, 20 nt, Streptococcus pneumoniae R6
uuuuauacucaaugaaaauc

SEQ ID NO: 2184415 - RNA, 23 nt, Streptococcus pneumoniae R6
uugaacaaauguugaaucauuuu

SEQ ID NO: 2184416 - RNA, 15 nt, Streptococcus pneumoniae R6
uugaaauuuaucaac

SEQ ID NO: 2184417 - RNA, 14 nt, Streptococcus pneumoniae R6
uugaacaccugauu

SEQ ID NO: 2184418 - RNA, 19 nt, Streptococcus pneumoniae R6
uugaagaguauaagucuuu

SEQ ID NO: 2184419 - RNA, 16 nt, Streptococcus pneumoniae R6
uugaagcacuuauaga

SEQ ID NO: 2184420 - RNA, 15 nt, Streptococcus pneumoniae R6
uugaauagauacaaa

SEQ ID NO: 2184421 - RNA, 23 nt, Streptococcus pneumoniae R6
uugaaguucauuuucuuuacuuc

SEQ ID NO: 2184422 - RNA, 14 nt, Streptococcus pneumoniae R6
uugaaguaaagacg

SEQ ID NO: 2184423 - RNA, 19 nt, Streptococcus pneumoniae R6
uugacagaaccuuggaaau

SEQ ID NO: 2184424 - RNA, 19 nt, Streptococcus pneumoniae R6
uugaaucgacgcuuucuaa

SEQ ID NO: 2184425 - RNA, 22 nt, Streptococcus pneumoniae R6
uugaaucuggcuuucaauaugu

SEQ ID NO: 2184426 - RNA, 18 nt, Streptococcus pneumoniae R6
uugaauauggauaauuga

SEQ ID NO: 2184427 - RNA, 20 nt, Streptococcus pneumoniae R6
uugaauauuaguaaauagaa

SEQ ID NO: 2184428 - RNA, 17 nt, Streptococcus pneumoniae R6
uugaccagaaauaaaag

SEQ ID NO: 2184429 - RNA, 14 nt, Streptococcus pneumoniae R6
uugaccaucccagu

SEQ ID NO: 2184430 - RNA, 19 nt, Streptococcus pneumoniae R6
uugacauuguagaggagga

SEQ ID NO: 2184431 - RNA, 19 nt, Streptococcus pneumoniae R6
uugacauacaacuuaaaaa

SEQ ID NO: 2184432 - RNA, 16 nt, Streptococcus pneumoniae R6
uugacauggaaauuau

SEQ ID NO: 2184433 - RNA, 13 nt, Streptococcus pneumoniae R6
uugacauccuuuu

SEQ ID NO: 2184434 - RNA, 20 nt, Streptococcus pneumoniae R6
uugacauccuuuucuguacu

SEQ ID NO: 2184435 - RNA, 23 nt, Streptococcus pneumoniae R6
uucuuucaugaguggagccccuu

SEQ ID NO: 2184436 - RNA, 15 nt, Streptococcus pneumoniae R6
uucuuuauuagucaa

SEQ ID NO: 2184437 - RNA, 13 nt, Streptococcus pneumoniae R6
uucuuuacuucug

SEQ ID NO: 2184438 - RNA, 13 nt, Streptococcus pneumoniae R6
uucuuuagaaaac

SEQ ID NO: 2184439 - RNA, 19 nt, Streptococcus pneumoniae R6
uucuuuaucauuaaagacc

SEQ ID NO: 2184440 - RNA, 18 nt, Streptococcus pneumoniae R6
uucuuucaaaccagcacc

SEQ ID NO: 2184441 - RNA, 13 nt, Streptococcus pneumoniae R6
uucuuuauguuca

SEQ ID NO: 2184442 - RNA, 12 nt, Streptococcus pneumoniae R6
uucuuuaucaag

SEQ ID NO: 2184443 - RNA, 19 nt, Streptococcus pneumoniae R6
uucuuuaaucaagacuuuc

SEQ ID NO: 2184444 - RNA, 16 nt, Streptococcus pneumoniae R6
uucuuguguuuaaaua

SEQ ID NO: 2184445 - RNA, 12 nt, Streptococcus pneumoniae R6
uucuucucuuuu

SEQ ID NO: 2184446 - RNA, 16 nt, Streptococcus pneumoniae R6
uucuuuuauccuguuc

SEQ ID NO: 2184447 - RNA, 18 nt, Streptococcus pneumoniae R6
uucuuuuauccuguucuu

SEQ ID NO: 2184448 - RNA, 21 nt, Streptococcus pneumoniae R6
uucuuuucuguugauauuucc

SEQ ID NO: 2184449 - RNA, 17 nt, Streptococcus pneumoniae R6
uucuuuuggauuuucaa

SEQ ID NO: 2184450 - RNA, 12 nt, Streptococcus pneumoniae R6
uucuuuuuauau

SEQ ID NO: 2184451 - RNA, 10 nt, Streptococcus pneumoniae R6
uugaaaacaa

SEQ ID NO: 2184452 - RNA, 12 nt, Streptococcus pneumoniae R6
uugaaaacaaua

SEQ ID NO: 2184453 - RNA, 17 nt, Streptococcus pneumoniae R6
uugaaaacgguaacaaa

SEQ ID NO: 2184454 - RNA, 21 nt, Streptococcus pneumoniae R6
uugaaaacgguaacaaaacua

SEQ ID NO: 2184455 - RNA, 21 nt, Streptococcus pneumoniae R6
uugaaaaugaauuugaaacaa

SEQ ID NO: 2184456 - RNA, 19 nt, Streptococcus pneumoniae R6
uugaaaauccuaguggaaa

SEQ ID NO: 2184457 - RNA, 15 nt, Streptococcus pneumoniae R6
uugaaaugaaauaaa

SEQ ID NO: 2184458 - RNA, 14 nt, Streptococcus pneumoniae R6
uugaaaucugcuca

SEQ ID NO: 2184459 - RNA, 23 nt, Streptococcus pneumoniae R6
uugagauuggcguguuugucaaa

SEQ ID NO: 2184460 - RNA, 15 nt, Streptococcus pneumoniae R6
uugagcaagaccgau

SEQ ID NO: 2184461 - RNA, 16 nt, Streptococcus pneumoniae R6
uugagcaaguucaaga

SEQ ID NO: 2184462 - RNA, 13 nt, Streptococcus pneumoniae R6
uugagcaaccugc

SEQ ID NO: 2184463 - RNA, 20 nt, Streptococcus pneumoniae R6
uugagagaagcaagugacaa

SEQ ID NO: 2184464 - RNA, 18 nt, Streptococcus pneumoniae R6
uugagagcauuuuucgaa

SEQ ID NO: 2184465 - RNA, 19 nt, Streptococcus pneumoniae R6
uugagaucuuuuucgcuug

SEQ ID NO: 2184466 - RNA, 19 nt, Streptococcus pneumoniae R6
uugacugcccagacacuua

SEQ ID NO: 2184467 - RNA, 19 nt, Streptococcus pneumoniae R6
uugacguugcaaguuccca

SEQ ID NO: 2184468 - RNA, 21 nt, Streptococcus pneumoniae R6
uugacuaaaaacucuucuuuu

SEQ ID NO: 2184469 - RNA, 14 nt, Streptococcus pneumoniae R6
uugacuauauuucu

SEQ ID NO: 2184470 - RNA, 15 nt, Streptococcus pneumoniae R6
uugacuauauuucuu

SEQ ID NO: 2184471 - RNA, 17 nt, Streptococcus pneumoniae R6
uugauauaguuaaaaaa

SEQ ID NO: 2184472 - RNA, 22 nt, Streptococcus pneumoniae R6
uugauacucuucgaaaaucucu

SEQ ID NO: 2184473 - RNA, 12 nt, Streptococcus pneumoniae R6
uugauagcagaa

SEQ ID NO: 2184474 - RNA, 17 nt, Streptococcus pneumoniae R6
uugauagaaagcaaggc

SEQ ID NO: 2184475 - RNA, 18 nt, Streptococcus pneumoniae R6
uugauacuguuaauaaaa

SEQ ID NO: 2184476 - RNA, 19 nt, Streptococcus pneumoniae R6
uugauacuguuaauaaaau

SEQ ID NO: 2184477 - RNA, 17 nt, Streptococcus pneumoniae R6
uugauacuuauccuuuu

SEQ ID NO: 2184478 - RNA, 22 nt, Streptococcus pneumoniae R6
uugauaauaggagcuuuuggga

SEQ ID NO: 2184479 - RNA, 12 nt, Streptococcus pneumoniae R6
uugauaauagua

SEQ ID NO: 2184480 - RNA, 15 nt, Streptococcus pneumoniae R6
uugauaauaccagca

SEQ ID NO: 2184481 - RNA, 19 nt, Streptococcus pneumoniae R6
uugauaauacgaccaaucu

SEQ ID NO: 2184482 - RNA, 14 nt, Streptococcus pneumoniae R6
uugauaaucuuauc

SEQ ID NO: 2184483 - RNA, 13 nt, Streptococcus pneumoniae R6
uugauacaaguuc

SEQ ID NO: 2184484 - RNA, 23 nt, Streptococcus pneumoniae R6
uugagguuguagauagaacugac

SEQ ID NO: 2184485 - RNA, 23 nt, Streptococcus pneumoniae R6
uugagguuguggauagaacugac

SEQ ID NO: 2184486 - RNA, 20 nt, Streptococcus pneumoniae R6
uugagguuguggaugaaacu

SEQ ID NO: 2184487 - RNA, 23 nt, Streptococcus pneumoniae R6
uugagguuguggaugaaacugac

SEQ ID NO: 2184488 - RNA, 21 nt, Streptococcus pneumoniae R6
uugaguaaauaaaacaaaaaa

SEQ ID NO: 2184489 - RNA, 12 nt, Streptococcus pneumoniae R6
uugaggauaaaa

SEQ ID NO: 2184490 - RNA, 16 nt, Streptococcus pneumoniae R6
uugagggcugcaaaau

SEQ ID NO: 2184491 - RNA, 20 nt, Streptococcus pneumoniae R6
uugaggccgauagagccacc

SEQ ID NO: 2184492 - RNA, 20 nt, Streptococcus pneumoniae R6
uugcaccugaacggcuaguc

SEQ ID NO: 2184493 - RNA, 13 nt, Streptococcus pneumoniae R6
uugcaaaguuuuc

SEQ ID NO: 2184494 - RNA, 12 nt, Streptococcus pneumoniae R6
uugcaaaggaga

SEQ ID NO: 2184495 - RNA, 13 nt, Streptococcus pneumoniae R6
uugcaaacuuuuu

SEQ ID NO: 2184496 - RNA, 11 nt, Streptococcus pneumoniae R6
uugauucagua

SEQ ID NO: 2184497 - RNA, 14 nt, Streptococcus pneumoniae R6
uugauuauuuuuua

SEQ ID NO: 2184498 - RNA, 14 nt, Streptococcus pneumoniae R6
uugauucaugacau

SEQ ID NO: 2184499 - RNA, 15 nt, Streptococcus pneumoniae R6
uugauucaugacauc

SEQ ID NO: 2184500 - RNA, 16 nt, Streptococcus pneumoniae R6
uugauucaugacaucu

SEQ ID NO: 2184501 - RNA, 21 nt, Streptococcus pneumoniae R6
uugauucaugacaucuuccaa

SEQ ID NO: 2184502 - RNA, 18 nt, Streptococcus pneumoniae R6
uugauguacuacugcuug

SEQ ID NO: 2184503 - RNA, 22 nt, Streptococcus pneumoniae R6
uugauguucaaagucaucaaaa

SEQ ID NO: 2184504 - RNA, 19 nt, Streptococcus pneumoniae R6
uugaucaauugucugaagu

SEQ ID NO: 2184505 - RNA, 11 nt, Streptococcus pneumoniae R6
uucuuauauua

SEQ ID NO: 2184506 - RNA, 23 nt, Streptococcus pneumoniae R6
uucuuauaaauauaguaaaauga

SEQ ID NO: 2184507 - RNA, 20 nt, Streptococcus pneumoniae R6
uucuuaaccaaguuuguauc

SEQ ID NO: 2184508 - RNA, 15 nt, Streptococcus pneumoniae R6
uucuuaaguuaaauu

SEQ ID NO: 2184509 - RNA, 12 nt, Streptococcus pneumoniae R6
uucugucaugcg

SEQ ID NO: 2184510 - RNA, 15 nt, Streptococcus pneumoniae R6
uucugcuaauuuuau

SEQ ID NO: 2184511 - RNA, 14 nt, Streptococcus pneumoniae R6
uucugcuagacgac

SEQ ID NO: 2184512 - RNA, 21 nt, Streptococcus pneumoniae R6
uucugcuauuaugcuaaagaa

SEQ ID NO: 2184513 - RNA, 22 nt, Streptococcus pneumoniae R6
uucuuaaaugacauuccugucu

SEQ ID NO: 2184514 - RNA, 14 nt, Streptococcus pneumoniae R6
uucuguuucuaguc

SEQ ID NO: 2184515 - RNA, 15 nt, Streptococcus pneumoniae R6
uucucaaugauuuga

SEQ ID NO: 2184516 - RNA, 16 nt, Streptococcus pneumoniae R6
uucucaaucaguuuuu

SEQ ID NO: 2184517 - RNA, 14 nt, Streptococcus pneumoniae R6
uucuccgugaacaa

SEQ ID NO: 2184518 - RNA, 16 nt, Streptococcus pneumoniae R6
uucucuagaaaucucu

SEQ ID NO: 2184519 - RNA, 22 nt, Streptococcus pneumoniae R6
uucucuagaaaucucuuuuuuc

SEQ ID NO: 2184520 - RNA, 22 nt, Streptococcus pneumoniae R6
uucuccgaagacuuuaaaaauu

SEQ ID NO: 2184521 - RNA, 17 nt, Streptococcus pneumoniae R6
uucuccgaggauuuccc

SEQ ID NO: 2184522 - RNA, 14 nt, Streptococcus pneumoniae R6
uucucuauauaguu

SEQ ID NO: 2184523 - RNA, 12 nt, Streptococcus pneumoniae R6
uucucuaucucu

SEQ ID NO: 2184524 - RNA, 14 nt, Streptococcus pneumoniae R6
uucucucuuacuau

SEQ ID NO: 2184525 - RNA, 18 nt, Streptococcus pneumoniae R6
uucucuuucuaaaauagu

SEQ ID NO: 2184526 - RNA, 21 nt, Streptococcus pneumoniae R6
uucucuuguuguuguaauaau

SEQ ID NO: 2184527 - RNA, 16 nt, Streptococcus pneumoniae R6
uucucuugcaauauag

SEQ ID NO: 2184528 - RNA, 13 nt, Streptococcus pneumoniae R6
uucucuuugaaug

SEQ ID NO: 2184529 - RNA, 20 nt, Streptococcus pneumoniae R6
uucucugugaaugccuguuc

SEQ ID NO: 2184530 - RNA, 20 nt, Streptococcus pneumoniae R6
uucucuguuaccacaggagc

SEQ ID NO: 2184531 - RNA, 18 nt, Streptococcus pneumoniae R6
uucucugagaccuuuauu

SEQ ID NO: 2184532 - RNA, 12 nt, Streptococcus pneumoniae R6
uucucugacuuu

SEQ ID NO: 2184533 - RNA, 14 nt, Streptococcus pneumoniae R6
uucugcaaucaagg

SEQ ID NO: 2184534 - RNA, 16 nt, Streptococcus pneumoniae R6
uucugauuuugaaaau

SEQ ID NO: 2184535 - RNA, 22 nt, Streptococcus pneumoniae R6
uucugauuuugaaaauuuuucc

SEQ ID NO: 2184536 - RNA, 15 nt, Streptococcus pneumoniae R6
uucugcaguuucucu

SEQ ID NO: 2184537 - RNA, 20 nt, Streptococcus pneumoniae R6
uucugcaguuucucuacuaa

SEQ ID NO: 2184538 - RNA, 16 nt, Streptococcus pneumoniae R6
uuaucacccaaaacuu

SEQ ID NO: 2184539 - RNA, 18 nt, Streptococcus pneumoniae R6
uuaucacucaguuucuga

SEQ ID NO: 2184540 - RNA, 24 nt, Streptococcus pneumoniae R6
uucgguaguuguuaguucuugaaa

SEQ ID NO: 2184541 - RNA, 13 nt, Streptococcus pneumoniae R6
uucgguauuuuca

SEQ ID NO: 2184542 - RNA, 14 nt, Streptococcus pneumoniae R6
uucguuugaagcug

SEQ ID NO: 2184543 - RNA, 21 nt, Streptococcus pneumoniae R6
uucuaaaaaggcguucaucca

SEQ ID NO: 2184544 - RNA, 16 nt, Streptococcus pneumoniae R6
uucuaaaacauucuua

SEQ ID NO: 2184545 - RNA, 14 nt, Streptococcus pneumoniae R6
uucuaaaacauugu

SEQ ID NO: 2184546 - RNA, 16 nt, Streptococcus pneumoniae R6
uucuaaaacauuguga

SEQ ID NO: 2184547 - RNA, 22 nt, Streptococcus pneumoniae R6
uucuaaaacauuguuaaaaauu

SEQ ID NO: 2184548 - RNA, 14 nt, Streptococcus pneumoniae R6
uucguuuuguuccu

SEQ ID NO: 2184549 - RNA, 14 nt, Streptococcus pneumoniae R6
uucguuuuuacuac

SEQ ID NO: 2184550 - RNA, 14 nt, Streptococcus pneumoniae R6
uucguagcauaucc

SEQ ID NO: 2184551 - RNA, 17 nt, Streptococcus pneumoniae R6
uucguagucgccaucua

SEQ ID NO: 2184552 - RNA, 13 nt, Streptococcus pneumoniae R6
uucgucaaaucca

SEQ ID NO: 2184553 - RNA, 15 nt, Streptococcus pneumoniae R6
uucgucaauaauagc

SEQ ID NO: 2184554 - RNA, 20 nt, Streptococcus pneumoniae R6
uucgucaguucuaucugcaa

SEQ ID NO: 2184555 - RNA, 19 nt, Streptococcus pneumoniae R6
uucgucaguuucauccaca

SEQ ID NO: 2184556 - RNA, 14 nt, Streptococcus pneumoniae R6
uucuauugaaauga

SEQ ID NO: 2184557 - RNA, 15 nt, Streptococcus pneumoniae R6
uucuauuuuaaaaau

SEQ ID NO: 2184558 - RNA, 19 nt, Streptococcus pneumoniae R6
uucuauuucauuuuacuau

SEQ ID NO: 2184559 - RNA, 13 nt, Streptococcus pneumoniae R6
uucucaaaacuag

SEQ ID NO: 2184560 - RNA, 16 nt, Streptococcus pneumoniae R6
uucucaaaacuaguuu

SEQ ID NO: 2184561 - RNA, 13 nt, Streptococcus pneumoniae R6
uucucaaacauug

SEQ ID NO: 2184562 - RNA, 16 nt, Streptococcus pneumoniae R6
uucucaaccacaaaaa

SEQ ID NO: 2184563 - RNA, 15 nt, Streptococcus pneumoniae R6
uucuaucuacaaccu

SEQ ID NO: 2184564 - RNA, 15 nt, Streptococcus pneumoniae R6
uucuaucugcaaccu

SEQ ID NO: 2184565 - RNA, 22 nt, Streptococcus pneumoniae R6
uucuaucugcaaccuuaaaaca

SEQ ID NO: 2184566 - RNA, 14 nt, Streptococcus pneumoniae R6
uucuaucacauugu

SEQ ID NO: 2184567 - RNA, 15 nt, Streptococcus pneumoniae R6
uucuaucagcuuauc

SEQ ID NO: 2184568 - RNA, 17 nt, Streptococcus pneumoniae R6
uucuaucagcuuaucaa

SEQ ID NO: 2184569 - RNA, 15 nt, Streptococcus pneumoniae R6
uucuauccacaaccu

SEQ ID NO: 2184570 - RNA, 19 nt, Streptococcus pneumoniae R6
uucuauccacaaccucaaa

SEQ ID NO: 2184571 - RNA, 18 nt, Streptococcus pneumoniae R6
uucuacuccuuuucuaua

SEQ ID NO: 2184572 - RNA, 21 nt, Streptococcus pneumoniae R6
uucuauaggauuuauuuuucu

SEQ ID NO: 2184573 - RNA, 17 nt, Streptococcus pneumoniae R6
uucuauaggucguguau

SEQ ID NO: 2184574 - RNA, 14 nt, Streptococcus pneumoniae R6
uucuauauuuauau

SEQ ID NO: 2184575 - RNA, 12 nt, Streptococcus pneumoniae R6
uucuaaaauaag

SEQ ID NO: 2184576 - RNA, 22 nt, Streptococcus pneumoniae R6
uucuaaagaauuugaaaaaaau

SEQ ID NO: 2184577 - RNA, 23 nt, Streptococcus pneumoniae R6
uucuaaagaauuugaaaaaaauu

SEQ ID NO: 2184578 - RNA, 18 nt, Streptococcus pneumoniae R6
uucuaaagcaauuuugaa

SEQ ID NO: 2184579 - RNA, 13 nt, Streptococcus pneumoniae R6
uucuaaagaguau

SEQ ID NO: 2184580 - RNA, 13 nt, Streptococcus pneumoniae R6
uucuaaauaaucu

SEQ ID NO: 2184581 - RNA, 16 nt, Streptococcus pneumoniae R6
uuguucguauccuauu

SEQ ID NO: 2184582 - RNA, 15 nt, Streptococcus pneumoniae R6
uuguguuugaccacu

SEQ ID NO: 2184583 - RNA, 20 nt, Streptococcus pneumoniae R6
uuguuaagagguuuuacuaa

SEQ ID NO: 2184584 - RNA, 21 nt, Streptococcus pneumoniae R6
uuguuaauaacucgaucaaca

SEQ ID NO: 2184585 - RNA, 14 nt, Streptococcus pneumoniae R6
uuguuaaacaaggc

SEQ ID NO: 2184586 - RNA, 15 nt, Streptococcus pneumoniae R6
uuguggauagaacug

SEQ ID NO: 2184587 - RNA, 17 nt, Streptococcus pneumoniae R6
uugugcuugauaaguuu

SEQ ID NO: 2184588 - RNA, 17 nt, Streptococcus pneumoniae R6
uugugcacacucagaac

SEQ ID NO: 2184589 - RNA, 15 nt, Streptococcus pneumoniae R6
uugucuauaguuaaa

SEQ ID NO: 2184590 - RNA, 21 nt, Streptococcus pneumoniae R6
uugucucuaaaaauaaaaaag

SEQ ID NO: 2184591 - RNA, 15 nt, Streptococcus pneumoniae R6
uugucccaagaguag

SEQ ID NO: 2184592 - RNA, 15 nt, Streptococcus pneumoniae R6
uuguaucaauuugua

SEQ ID NO: 2184593 - RNA, 21 nt, Streptococcus pneumoniae R6
uuguauagugaauugaaauaa

SEQ ID NO: 2184594 - RNA, 20 nt, Streptococcus pneumoniae R6
uuguaucaccaagcauuuuc

SEQ ID NO: 2184595 - RNA, 16 nt, Streptococcus pneumoniae R6
uugucacgaaccacac

SEQ ID NO: 2184596 - RNA, 22 nt, Streptococcus pneumoniae R6
uuguauggaaacucaaaagaag

SEQ ID NO: 2184597 - RNA, 14 nt, Streptococcus pneumoniae R6
uugucacaaaggau

SEQ ID NO: 2184598 - RNA, 20 nt, Streptococcus pneumoniae R6
uuguauccugaaaagccacg

SEQ ID NO: 2184599 - RNA, 15 nt, Streptococcus pneumoniae R6
uuguaugaaaaguuu

SEQ ID NO: 2184600 - RNA, 16 nt, Streptococcus pneumoniae R6
uuguaugaaaaguuuu

SEQ ID NO: 2184601 - RNA, 17 nt, Streptococcus pneumoniae R6
uuguaugaaaaguuuua

SEQ ID NO: 2184602 - RNA, 14 nt, Streptococcus pneumoniae R6
uuguaugagaggca

SEQ ID NO: 2184603 - RNA, 14 nt, Streptococcus pneumoniae R6
uuguccauaacgag

SEQ ID NO: 2184604 - RNA, 15 nt, Streptococcus pneumoniae R6
uuguccaucuguaau

SEQ ID NO: 2184605 - RNA, 18 nt, Streptococcus pneumoniae R6
uugucaucguuccaguuu

SEQ ID NO: 2184606 - RNA, 13 nt, Streptococcus pneumoniae R6
uugucaucaucuu

SEQ ID NO: 2184607 - RNA, 18 nt, Streptococcus pneumoniae R6
uugucaguaaaaaaaaca

SEQ ID NO: 2184608 - RNA, 14 nt, Streptococcus pneumoniae R6
uuguaagcuagcaa

SEQ ID NO: 2184609 - RNA, 18 nt, Streptococcus pneumoniae R6
uuuaauugguugagauaa

SEQ ID NO: 2184610 - RNA, 14 nt, Streptococcus pneumoniae R6
uuuaauuuaagagu

SEQ ID NO: 2184611 - RNA, 23 nt, Streptococcus pneumoniae R6
uuuaauacucugugaaaaucaua

SEQ ID NO: 2184612 - RNA, 20 nt, Streptococcus pneumoniae R6
uuuaauaauuuuguuaagac

SEQ ID NO: 2184613 - RNA, 16 nt, Streptococcus pneumoniae R6
uuuaauuauuuucaaa

SEQ ID NO: 2184614 - RNA, 13 nt, Streptococcus pneumoniae R6
uuuaaguuuuuug

SEQ ID NO: 2184615 - RNA, 20 nt, Streptococcus pneumoniae R6
uuuaaaaucaaaguagcucu

SEQ ID NO: 2184616 - RNA, 21 nt, Streptococcus pneumoniae R6
uuuaaaagauacuaacacaua

SEQ ID NO: 2184617 - RNA, 16 nt, Streptococcus pneumoniae R6
uuuaaaaucugaaaaa

SEQ ID NO: 2184618 - RNA, 14 nt, Streptococcus pneumoniae R6
uuuaaauccugcaa

SEQ ID NO: 2184619 - RNA, 22 nt, Streptococcus pneumoniae R6
uuuaacaggauauuucuccaaa

SEQ ID NO: 2184620 - RNA, 20 nt, Streptococcus pneumoniae R6
uuuaacauacuguuuuccuu

SEQ ID NO: 2184621 - RNA, 13 nt, Streptococcus pneumoniae R6
uuuaacauuugag

SEQ ID NO: 2184622 - RNA, 21 nt, Streptococcus pneumoniae R6
uuguuuaagagcacaaaauca

SEQ ID NO: 2184623 - RNA, 15 nt, Streptococcus pneumoniae R6
uuguuguaauaauca

SEQ ID NO: 2184624 - RNA, 14 nt, Streptococcus pneumoniae R6
uuguucucuuugca

SEQ ID NO: 2184625 - RNA, 21 nt, Streptococcus pneumoniae R6
uuguucucuuugcauuucauc

SEQ ID NO: 2184626 - RNA, 13 nt, Streptococcus pneumoniae R6
uuguuuucaagug

SEQ ID NO: 2184627 - RNA, 18 nt, Streptococcus pneumoniae R6
uuguuuuaauauaauauc

SEQ ID NO: 2184628 - RNA, 14 nt, Streptococcus pneumoniae R6
uuguuuuuccugau

SEQ ID NO: 2184629 - RNA, 17 nt, Streptococcus pneumoniae R6
uuguuuuuuaucuauau

SEQ ID NO: 2184630 - RNA, 12 nt, Streptococcus pneumoniae R6
uuguuuuuggua

SEQ ID NO: 2184631 - RNA, 17 nt, Streptococcus pneumoniae R6
uugcuguuuauaucuaa

SEQ ID NO: 2184632 - RNA, 20 nt, Streptococcus pneumoniae R6
uugcuguccucaaaaugaaa

SEQ ID NO: 2184633 - RNA, 14 nt, Streptococcus pneumoniae R6
uugcugucuccagu

SEQ ID NO: 2184634 - RNA, 21 nt, Streptococcus pneumoniae R6
uugcuuagucggauggaaaua

SEQ ID NO: 2184635 - RNA, 18 nt, Streptococcus pneumoniae R6
uugcuuaauccucaauca

SEQ ID NO: 2184636 - RNA, 20 nt, Streptococcus pneumoniae R6
uugcuuuccucagcaggagc

SEQ ID NO: 2184637 - RNA, 13 nt, Streptococcus pneumoniae R6
uugcuuucuucag

SEQ ID NO: 2184638 - RNA, 17 nt, Streptococcus pneumoniae R6
uugcucagugauguuaa

SEQ ID NO: 2184639 - RNA, 14 nt, Streptococcus pneumoniae R6
uuggaaugacgaaa

SEQ ID NO: 2184640 - RNA, 20 nt, Streptococcus pneumoniae R6
uuggaaugacgaaacgaaga

SEQ ID NO: 2184641 - RNA, 17 nt, Streptococcus pneumoniae R6
uuggaccagccaaucgc

SEQ ID NO: 2184642 - RNA, 22 nt, Streptococcus pneumoniae R6
uuggacauagccaauaaauguu

SEQ ID NO: 2184643 - RNA, 14 nt, Streptococcus pneumoniae R6
uugcuuuuuuauau

SEQ ID NO: 2184644 - RNA, 18 nt, Streptococcus pneumoniae R6
uugcuuuuugauuucuaa

SEQ ID NO: 2184645 - RNA, 16 nt, Streptococcus pneumoniae R6
uuggagugauagaaaa

SEQ ID NO: 2184646 - RNA, 13 nt, Streptococcus pneumoniae R6
uuggaguuguaau

SEQ ID NO: 2184647 - RNA, 21 nt, Streptococcus pneumoniae R6
uuggaguuguaaucuuagcaa

SEQ ID NO: 2184648 - RNA, 22 nt, Streptococcus pneumoniae R6
uuggaguuguaaucuuagcaaa

SEQ ID NO: 2184649 - RNA, 22 nt, Streptococcus pneumoniae R6
uuggaggcaauacguuuucaaa

SEQ ID NO: 2184650 - RNA, 22 nt, Streptococcus pneumoniae R6
uuggcagccucuuucuugucgu

SEQ ID NO: 2184651 - RNA, 15 nt, Streptococcus pneumoniae R6
uuggcaggcguuuuu

SEQ ID NO: 2184652 - RNA, 21 nt, Streptococcus pneumoniae R6
uuggcaguucuugcucaauca

SEQ ID NO: 2184653 - RNA, 19 nt, Streptococcus pneumoniae R6
uuggcaguugguuauacau

SEQ ID NO: 2184654 - RNA, 19 nt, Streptococcus pneumoniae R6
uugggcaagggcaccaaac

SEQ ID NO: 2184655 - RNA, 19 nt, Streptococcus pneumoniae R6
uuggcguuuugaguuaacu

SEQ ID NO: 2184656 - RNA, 21 nt, Streptococcus pneumoniae R6
uuggcgaauauagacaaaauc

SEQ ID NO: 2184657 - RNA, 15 nt, Streptococcus pneumoniae R6
uugggcgaugaagac

SEQ ID NO: 2184658 - RNA, 16 nt, Streptococcus pneumoniae R6
uugggcagaaguuuug

SEQ ID NO: 2184659 - RNA, 19 nt, Streptococcus pneumoniae R6
uugguaaugcuccaauaca

SEQ ID NO: 2184660 - RNA, 18 nt, Streptococcus pneumoniae R6
uugguguuugguugacca

SEQ ID NO: 2184661 - RNA, 15 nt, Streptococcus pneumoniae R6
uugguguugagaaag

SEQ ID NO: 2184662 - RNA, 23 nt, Streptococcus pneumoniae R6
uuggucagaaugaugauagucau

SEQ ID NO: 2184663 - RNA, 19 nt, Streptococcus pneumoniae R6
uugguauuacuuaccacua

SEQ ID NO: 2184664 - RNA, 21 nt, Streptococcus pneumoniae R6
uugguauucuucgugaaagac

SEQ ID NO: 2184665 - RNA, 21 nt, Streptococcus pneumoniae R6
uugcauuuuuuauugcaauuu

SEQ ID NO: 2184666 - RNA, 12 nt, Streptococcus pneumoniae R6
uugcccuuggcu

SEQ ID NO: 2184667 - RNA, 15 nt, Streptococcus pneumoniae R6
uugccgauaucacca

SEQ ID NO: 2184668 - RNA, 13 nt, Streptococcus pneumoniae R6
uugcaucaaauca

SEQ ID NO: 2184669 - RNA, 21 nt, Streptococcus pneumoniae R6
uugcaugauugagaaaguuaa

SEQ ID NO: 2184670 - RNA, 16 nt, Streptococcus pneumoniae R6
uugcauuucaucuucu

SEQ ID NO: 2184671 - RNA, 14 nt, Streptococcus pneumoniae R6
uugcauuuuaauuu

SEQ ID NO: 2184672 - RNA, 18 nt, Streptococcus pneumoniae R6
uugcauuaaaaaguuuug

SEQ ID NO: 2184673 - RNA, 17 nt, Streptococcus pneumoniae R6
uugcagaugaaagcuga

SEQ ID NO: 2184674 - RNA, 14 nt, Streptococcus pneumoniae R6
uugcagacgaccag

SEQ ID NO: 2184675 - RNA, 13 nt, Streptococcus pneumoniae R6
uugcuaaaacauu

SEQ ID NO: 2184676 - RNA, 14 nt, Streptococcus pneumoniae R6
uugcuaaaacauuu

SEQ ID NO: 2184677 - RNA, 21 nt, Streptococcus pneumoniae R6
uugcuaaaacauuuauagaaa

SEQ ID NO: 2184678 - RNA, 18 nt, Streptococcus pneumoniae R6
uugcucaaaguacagauu

SEQ ID NO: 2184679 - RNA, 20 nt, Streptococcus pneumoniae R6
uugcucaaaguacugccuug

SEQ ID NO: 2184680 - RNA, 18 nt, Streptococcus pneumoniae R6
uugcucagcauucucaau

SEQ ID NO: 2184681 - RNA, 19 nt, Streptococcus pneumoniae R6
uugcucacgggucaugccu

SEQ ID NO: 2184682 - RNA, 18 nt, Streptococcus pneumoniae R6
uugcucaaucaauccaaa

SEQ ID NO: 2184683 - RNA, 13 nt, Streptococcus pneumoniae R6
uugcgauacuguu

SEQ ID NO: 2184684 - RNA, 19 nt, Streptococcus pneumoniae R6
uugcgauaaagcuaaagau

SEQ ID NO: 2184685 - RNA, 16 nt, Streptococcus pneumoniae R6
uuucugauagaagagu

SEQ ID NO: 2184686 - RNA, 20 nt, Streptococcus pneumoniae R6
uuucugauagauuuauuuuu

SEQ ID NO: 2184687 - RNA, 14 nt, Streptococcus pneumoniae R6
uuucugauuucaaa

SEQ ID NO: 2184688 - RNA, 18 nt, Streptococcus pneumoniae R6
uuucugauuucaaagaau

SEQ ID NO: 2184689 - RNA, 23 nt, Streptococcus pneumoniae R6
uuucugcauccaccuucaucucu

SEQ ID NO: 2184690 - RNA, 17 nt, Streptococcus pneumoniae R6
uuucugccauauguccu

SEQ ID NO: 2184691 - RNA, 16 nt, Streptococcus pneumoniae R6
uuucuggauuuccauu

SEQ ID NO: 2184692 - RNA, 22 nt, Streptococcus pneumoniae R6
uuucuggauuuccauuuuccau

SEQ ID NO: 2184693 - RNA, 19 nt, Streptococcus pneumoniae R6
uuucucuauucuuuuuugg

SEQ ID NO: 2184694 - RNA, 16 nt, Streptococcus pneumoniae R6
uuucucggucuuguuu

SEQ ID NO: 2184695 - RNA, 15 nt, Streptococcus pneumoniae R6
uuucugaaaucaaca

SEQ ID NO: 2184696 - RNA, 16 nt, Streptococcus pneumoniae R6
uuucuccuguuucaaa

SEQ ID NO: 2184697 - RNA, 19 nt, Streptococcus pneumoniae R6
uuucuccgaggauuuccca

SEQ ID NO: 2184698 - RNA, 16 nt, Streptococcus pneumoniae R6
uuucuccuauuuucuu

SEQ ID NO: 2184699 - RNA, 21 nt, Streptococcus pneumoniae R6
uuucuccuauuuucuucuuua

SEQ ID NO: 2184700 - RNA, 19 nt, Streptococcus pneumoniae R6
uuucucacuuaauucuuca

SEQ ID NO: 2184701 - RNA, 22 nt, Streptococcus pneumoniae R6
uuucucauagccauaaaacauu

SEQ ID NO: 2184702 - RNA, 17 nt, Streptococcus pneumoniae R6
uuucuccauagauuucu

SEQ ID NO: 2184703 - RNA, 22 nt, Streptococcus pneumoniae R6
uuucuauagaaagcuuacauca

SEQ ID NO: 2184704 - RNA, 21 nt, Streptococcus pneumoniae R6
uuucuauaguagauugaaaua

SEQ ID NO: 2184705 - RNA, 14 nt, Streptococcus pneumoniae R6
uuucuaucacucca

SEQ ID NO: 2184706 - RNA, 12 nt, Streptococcus pneumoniae R6
uuucuauauuua

SEQ ID NO: 2184707 - RNA, 19 nt, Streptococcus pneumoniae R6
uuucuaucuucauuuugca

SEQ ID NO: 2184708 - RNA, 15 nt, Streptococcus pneumoniae R6
uuucucaaucaguuu

SEQ ID NO: 2184709 - RNA, 15 nt, Streptococcus pneumoniae R6
uuucucaaaaaaguu

SEQ ID NO: 2184710 - RNA, 14 nt, Streptococcus pneumoniae R6
uuucguacauaguu

SEQ ID NO: 2184711 - RNA, 13 nt, Streptococcus pneumoniae R6
uuucgucaccaaa

SEQ ID NO: 2184712 - RNA, 14 nt, Streptococcus pneumoniae R6
uuucguuccagacu

SEQ ID NO: 2184713 - RNA, 13 nt, Streptococcus pneumoniae R6
uuucggcuguucu

SEQ ID NO: 2184714 - RNA, 20 nt, Streptococcus pneumoniae R6
uuucgcgauugauuuccaaa

SEQ ID NO: 2184715 - RNA, 18 nt, Streptococcus pneumoniae R6
uuucuaguuugcucuuug

SEQ ID NO: 2184716 - RNA, 19 nt, Streptococcus pneumoniae R6
uuucuaguccaacuguaaa

SEQ ID NO: 2184717 - RNA, 18 nt, Streptococcus pneumoniae R6
uuucuacuguauacuuuu

SEQ ID NO: 2184718 - RNA, 18 nt, Streptococcus pneumoniae R6
uuucuacuccuuuucuau

SEQ ID NO: 2184719 - RNA, 21 nt, Streptococcus pneumoniae R6
uuucuacaauucgcuauuuuu

SEQ ID NO: 2184720 - RNA, 15 nt, Streptococcus pneumoniae R6
uuucuacuaaaauua

SEQ ID NO: 2184721 - RNA, 22 nt, Streptococcus pneumoniae R6
uuucuaaagaauuugaaaaaaa

SEQ ID NO: 2184722 - RNA, 18 nt, Streptococcus pneumoniae R6
uuucuaaagcaauuuuga

SEQ ID NO: 2184723 - RNA, 15 nt, Streptococcus pneumoniae R6
uuucuaaaacauugu

SEQ ID NO: 2184724 - RNA, 20 nt, Streptococcus pneumoniae R6
uuucuaaaacauugugagaa

SEQ ID NO: 2184725 - RNA, 13 nt, Streptococcus pneumoniae R6
uuucuaauuguaa

SEQ ID NO: 2184726 - RNA, 19 nt, Streptococcus pneumoniae R6
uuucccaccuuuucucaau

SEQ ID NO: 2184727 - RNA, 13 nt, Streptococcus pneumoniae R6
uuucccuucgucu

SEQ ID NO: 2184728 - RNA, 14 nt, Streptococcus pneumoniae R6
uuuccgauuucaga

SEQ ID NO: 2184729 - RNA, 16 nt, Streptococcus pneumoniae R6
uuuccauaccaaagua

SEQ ID NO: 2184730 - RNA, 19 nt, Streptococcus pneumoniae R6
uuuccaguaauuucccauu

SEQ ID NO: 2184731 - RNA, 20 nt, Streptococcus pneumoniae R6
uuuccauuguuguuucuugg

SEQ ID NO: 2184732 - RNA, 17 nt, Streptococcus pneumoniae R6
uuuccauuucuuuucug

SEQ ID NO: 2184733 - RNA, 17 nt, Streptococcus pneumoniae R6
uuuccagcguugcgauu

SEQ ID NO: 2184734 - RNA, 22 nt, Streptococcus pneumoniae R6
uuuccagcguugcgauuuuugu

SEQ ID NO: 2184735 - RNA, 13 nt, Streptococcus pneumoniae R6
uuuccagcuuuuu

SEQ ID NO: 2184736 - RNA, 16 nt, Streptococcus pneumoniae R6
uuuccagcuuuuucuu

SEQ ID NO: 2184737 - RNA, 22 nt, Streptococcus pneumoniae R6
uuuccagcuuuuucuuguugau

SEQ ID NO: 2184738 - RNA, 14 nt, Streptococcus pneumoniae R6
uuuccagaacuuca

SEQ ID NO: 2184739 - RNA, 15 nt, Streptococcus pneumoniae R6
uuucgaguaacauca

SEQ ID NO: 2184740 - RNA, 19 nt, Streptococcus pneumoniae R6
uuucgauugaaauucgcuu

SEQ ID NO: 2184741 - RNA, 21 nt, Streptococcus pneumoniae R6
uuucgaaaagaauuaggaaaa

SEQ ID NO: 2184742 - RNA, 15 nt, Streptococcus pneumoniae R6
uuuccuuuuugacac

SEQ ID NO: 2184743 - RNA, 21 nt, Streptococcus pneumoniae R6
uuuccuuguguguauccuuau

SEQ ID NO: 2184744 - RNA, 12 nt, Streptococcus pneumoniae R6
uuuccuuucaaa

SEQ ID NO: 2184745 - RNA, 12 nt, Streptococcus pneumoniae R6
uuuccuucauca

SEQ ID NO: 2184746 - RNA, 14 nt, Streptococcus pneumoniae R6
uuuccuucaucaaa

SEQ ID NO: 2184747 - RNA, 22 nt, Streptococcus pneumoniae R6
uuuccuugaccaaguccucaau

SEQ ID NO: 2184748 - RNA, 21 nt, Streptococcus pneumoniae R6
uuuccuugagcgaauccuuga

SEQ ID NO: 2184749 - RNA, 13 nt, Streptococcus pneumoniae R6
uuuccuaauucuu

SEQ ID NO: 2184750 - RNA, 14 nt, Streptococcus pneumoniae R6
uuuccuacaaugau

SEQ ID NO: 2184751 - RNA, 16 nt, Streptococcus pneumoniae R6
uuuccguucucaaagc

SEQ ID NO: 2184752 - RNA, 16 nt, Streptococcus pneumoniae R6
uuuccggcucuuuguc

SEQ ID NO: 2184753 - RNA, 17 nt, Streptococcus pneumoniae R6
uuuccuguuguauuuau

SEQ ID NO: 2184754 - RNA, 19 nt, Streptococcus pneumoniae R6
uuuccuguuguauuuauau

SEQ ID NO: 2184755 - RNA, 18 nt, Streptococcus pneumoniae R6
uuuccugauuaccaacua

SEQ ID NO: 2184756 - RNA, 20 nt, Streptococcus pneumoniae R6
uuuccugcaugaaggucuuu

SEQ ID NO: 2184757 - RNA, 21 nt, Streptococcus pneumoniae R6
uuuccucgaagcaagaacgau

SEQ ID NO: 2184758 - RNA, 17 nt, Streptococcus pneumoniae R6
uuuccuagauuacaaaa

SEQ ID NO: 2184759 - RNA, 21 nt, Streptococcus pneumoniae R6
uuuccugaagucgaguuuuuu

SEQ ID NO: 2184760 - RNA, 18 nt, Streptococcus pneumoniae R6
uuuccucgauuuguuuuu

SEQ ID NO: 2184761 - RNA, 16 nt, Streptococcus pneumoniae R6
uuugcaucaaucucuu

SEQ ID NO: 2184762 - RNA, 13 nt, Streptococcus pneumoniae R6
uuugcagcaccag

SEQ ID NO: 2184763 - RNA, 10 nt, Streptococcus pneumoniae R6
uuugcagcac

SEQ ID NO: 2184764 - RNA, 14 nt, Streptococcus pneumoniae R6
uuugcaggcuguuu

SEQ ID NO: 2184765 - RNA, 19 nt, Streptococcus pneumoniae R6
uuugcaacuggagacuuuc

SEQ ID NO: 2184766 - RNA, 18 nt, Streptococcus pneumoniae R6
uuugccgugcucuaaaau

SEQ ID NO: 2184767 - RNA, 13 nt, Streptococcus pneumoniae R6
uuugauguacgac

SEQ ID NO: 2184768 - RNA, 20 nt, Streptococcus pneumoniae R6
uuugauguuuccugcaaaga

SEQ ID NO: 2184769 - RNA, 22 nt, Streptococcus pneumoniae R6
uuugaugagaaaauaaaguaaa

SEQ ID NO: 2184770 - RNA, 19 nt, Streptococcus pneumoniae R6
uuugauucaucuccaaccu

SEQ ID NO: 2184771 - RNA, 19 nt, Streptococcus pneumoniae R6
uuugauucagauucaucau

SEQ ID NO: 2184772 - RNA, 12 nt, Streptococcus pneumoniae R6
uuugauuuuaau

SEQ ID NO: 2184773 - RNA, 11 nt, Streptococcus pneumoniae R6
uuugauuuuca

SEQ ID NO: 2184774 - RNA, 19 nt, Streptococcus pneumoniae R6
uuugauuuucauugaguau

SEQ ID NO: 2184775 - RNA, 12 nt, Streptococcus pneumoniae R6
uuugauuucuaa

SEQ ID NO: 2184776 - RNA, 13 nt, Streptococcus pneumoniae R6
uuugauuucuugg

SEQ ID NO: 2184777 - RNA, 21 nt, Streptococcus pneumoniae R6
uuugauuucuugguauuguuu

SEQ ID NO: 2184778 - RNA, 18 nt, Streptococcus pneumoniae R6
uuugauuucuugugcuga

SEQ ID NO: 2184779 - RNA, 15 nt, Streptococcus pneumoniae R6
uuugauuuuaaagac

SEQ ID NO: 2184780 - RNA, 21 nt, Streptococcus pneumoniae R6
uuugauuuuguaaaaauagaa

SEQ ID NO: 2184781 - RNA, 19 nt, Streptococcus pneumoniae R6
uuugcaaaguuuucuuugu

SEQ ID NO: 2184782 - RNA, 19 nt, Streptococcus pneumoniae R6
uuugagguuguagaugaaa

SEQ ID NO: 2184783 - RNA, 22 nt, Streptococcus pneumoniae R6
uuugagacuggcgauuuuagga

SEQ ID NO: 2184784 - RNA, 20 nt, Streptococcus pneumoniae R6
uuugagaaauuucaacaaaa

SEQ ID NO: 2184785 - RNA, 20 nt, Streptococcus pneumoniae R6
uuugagcuaauuuugccagu

SEQ ID NO: 2184786 - RNA, 14 nt, Streptococcus pneumoniae R6
uuugagcugacuuc

SEQ ID NO: 2184787 - RNA, 22 nt, Streptococcus pneumoniae R6
uuugagcugacuucgucaguuu

SEQ ID NO: 2184788 - RNA, 23 nt, Streptococcus pneumoniae R6
uuugagggcugcaaaauuuugag

SEQ ID NO: 2184789 - RNA, 23 nt, Streptococcus pneumoniae R6
uuugaggaagguuuuaaagacag

SEQ ID NO: 2184790 - RNA, 14 nt, Streptococcus pneumoniae R6
uuugagcagaacaa

SEQ ID NO: 2184791 - RNA, 19 nt, Streptococcus pneumoniae R6
uuugacguucuucugcagu

SEQ ID NO: 2184792 - RNA, 13 nt, Streptococcus pneumoniae R6
uuugacuuccaaa

SEQ ID NO: 2184793 - RNA, 23 nt, Streptococcus pneumoniae R6
uuugacuugcaaaaagacuuagc

SEQ ID NO: 2184794 - RNA, 12 nt, Streptococcus pneumoniae R6
uuugaauuucau

SEQ ID NO: 2184795 - RNA, 18 nt, Streptococcus pneumoniae R6
uuugacaaguaaguagca

SEQ ID NO: 2184796 - RNA, 21 nt, Streptococcus pneumoniae R6
uuugacaaguaaguagcaucu

SEQ ID NO: 2184797 - RNA, 20 nt, Streptococcus pneumoniae R6
uuugaaugccaaaauuccau

SEQ ID NO: 2184798 - RNA, 21 nt, Streptococcus pneumoniae R6
uuugaaugcucccuucuuuag

SEQ ID NO: 2184799 - RNA, 23 nt, Streptococcus pneumoniae R6
uuugaauagaaaguauagucaau

SEQ ID NO: 2184800 - RNA, 19 nt, Streptococcus pneumoniae R6
uuugaauaggguaguugaa

SEQ ID NO: 2184801 - RNA, 20 nt, Streptococcus pneumoniae R6
uuucuuuuuugaaguuuuca

SEQ ID NO: 2184802 - RNA, 13 nt, Streptococcus pneumoniae R6
uuucuuuuuccua

SEQ ID NO: 2184803 - RNA, 13 nt, Streptococcus pneumoniae R6
uuugaaacuagaa

SEQ ID NO: 2184804 - RNA, 14 nt, Streptococcus pneumoniae R6
uuugaaacuagaau

SEQ ID NO: 2184805 - RNA, 12 nt, Streptococcus pneumoniae R6
uuugaaaacuga

SEQ ID NO: 2184806 - RNA, 15 nt, Streptococcus pneumoniae R6
uuugaaaacugaaca

SEQ ID NO: 2184807 - RNA, 20 nt, Streptococcus pneumoniae R6
uuugaaaaauauacaaaaaa

SEQ ID NO: 2184808 - RNA, 21 nt, Streptococcus pneumoniae R6
uuucuuucucacuuaauucuu

SEQ ID NO: 2184809 - RNA, 12 nt, Streptococcus pneumoniae R6
uuucuuuuauuu

SEQ ID NO: 2184810 - RNA, 16 nt, Streptococcus pneumoniae R6
uuugaagaguauuauu

SEQ ID NO: 2184811 - RNA, 17 nt, Streptococcus pneumoniae R6
uuugaacaccugauuuu

SEQ ID NO: 2184812 - RNA, 19 nt, Streptococcus pneumoniae R6
uuugaacaccugauuuuau

SEQ ID NO: 2184813 - RNA, 12 nt, Streptococcus pneumoniae R6
uuugaacuugaa

SEQ ID NO: 2184814 - RNA, 13 nt, Streptococcus pneumoniae R6
uuugaacuugaau

SEQ ID NO: 2184815 - RNA, 19 nt, Streptococcus pneumoniae R6
uuugaacuugugcaacuuc

SEQ ID NO: 2184816 - RNA, 15 nt, Streptococcus pneumoniae R6
uuugaacauguccau

SEQ ID NO: 2184817 - RNA, 13 nt, Streptococcus pneumoniae R6
uuugaacauuacu

SEQ ID NO: 2184818 - RNA, 21 nt, Streptococcus pneumoniae R6
uuugaacaaauguugaaucau

SEQ ID NO: 2184819 - RNA, 15 nt, Streptococcus pneumoniae R6
uuugaacaaauuaau

SEQ ID NO: 2184820 - RNA, 22 nt, Streptococcus pneumoniae R6
uuugaaaggguagugaaaguua

SEQ ID NO: 2184821 - RNA, 17 nt, Streptococcus pneumoniae R6
uuugaaaggaaagcaua

SEQ ID NO: 2184822 - RNA, 16 nt, Streptococcus pneumoniae R6
uuugaaaucagaaaaa

SEQ ID NO: 2184823 - RNA, 19 nt, Streptococcus pneumoniae R6
uuugaaaucagaaaaaacg

SEQ ID NO: 2184824 - RNA, 16 nt, Streptococcus pneumoniae R6
uuucuucgaaauucca

SEQ ID NO: 2184825 - RNA, 14 nt, Streptococcus pneumoniae R6
uuucuucuucguca

SEQ ID NO: 2184826 - RNA, 14 nt, Streptococcus pneumoniae R6
uuucuuuaucuuug

SEQ ID NO: 2184827 - RNA, 21 nt, Streptococcus pneumoniae R6
uuucuugucguugaaaaagug

SEQ ID NO: 2184828 - RNA, 21 nt, Streptococcus pneumoniae R6
uuucuuaaguaaguacaugca

SEQ ID NO: 2184829 - RNA, 13 nt, Streptococcus pneumoniae R6
uuucuguuuucuu

SEQ ID NO: 2184830 - RNA, 16 nt, Streptococcus pneumoniae R6
uuucuuauuuuccuaa

SEQ ID NO: 2184831 - RNA, 18 nt, Streptococcus pneumoniae R6
uuucuguugauauuucca

SEQ ID NO: 2184832 - RNA, 17 nt, Streptococcus pneumoniae R6
uuucuggcagauuuuga

SEQ ID NO: 2184833 - RNA, 13 nt, Streptococcus pneumoniae R6
uuucuggcucuuu

SEQ ID NO: 2184834 - RNA, 20 nt, Streptococcus pneumoniae R6
uuucuggucuagcuauuucu

SEQ ID NO: 2184835 - RNA, 21 nt, Streptococcus pneumoniae R6
uuucuggucuagcuauuucuu

SEQ ID NO: 2184836 - RNA, 20 nt, Streptococcus pneumoniae R6
uuucuggucuuuuugcucau

SEQ ID NO: 2184837 - RNA, 14 nt, Streptococcus pneumoniae R6
uuucuguaaaauca

SEQ ID NO: 2184838 - RNA, 20 nt, Streptococcus pneumoniae R6
uuucuguaauuucuacugua

SEQ ID NO: 2184839 - RNA, 21 nt, Streptococcus pneumoniae R6
uuucaaagacuucuugagcua

SEQ ID NO: 2184840 - RNA, 17 nt, Streptococcus pneumoniae R6
uuucaaagaguauuaaa

SEQ ID NO: 2184841 - RNA, 12 nt, Streptococcus pneumoniae R6
uuucaaagaaga

SEQ ID NO: 2184842 - RNA, 13 nt, Streptococcus pneumoniae R6
uuucaaagaagag

SEQ ID NO: 2184843 - RNA, 16 nt, Streptococcus pneumoniae R6
uuucaaaaucagaaaa

SEQ ID NO: 2184844 - RNA, 22 nt, Streptococcus pneumoniae R6
uuucaaaagcuaauagagcuga

SEQ ID NO: 2184845 - RNA, 21 nt, Streptococcus pneumoniae R6
uuucaaaaugacaauuuuucc

SEQ ID NO: 2184846 - RNA, 18 nt, Streptococcus pneumoniae R6
uuucaaaguuaacuuuuc

SEQ ID NO: 2184847 - RNA, 16 nt, Streptococcus pneumoniae R6
uuucaaaguuccgaaa

SEQ ID NO: 2184848 - RNA, 21 nt, Streptococcus pneumoniae R6
uuucaaagccuguccuguuag

SEQ ID NO: 2184849 - RNA, 22 nt, Streptococcus pneumoniae R6
uuucaaagcgggauuuaaaaua

SEQ ID NO: 2184850 - RNA, 12 nt, Streptococcus pneumoniae R6
uuucaaaugaaa

SEQ ID NO: 2184851 - RNA, 16 nt, Streptococcus pneumoniae R6
uuucaaaugaaauauu

SEQ ID NO: 2184852 - RNA, 22 nt, Streptococcus pneumoniae R6
uuucaaaaauucugccaacuua

SEQ ID NO: 2184853 - RNA, 20 nt, Streptococcus pneumoniae R6
uuucaaaaacgacagauucu

SEQ ID NO: 2184854 - RNA, 13 nt, Streptococcus pneumoniae R6
uuucaaaaaauau

SEQ ID NO: 2184855 - RNA, 19 nt, Streptococcus pneumoniae R6
uuuauuuucucaucaaaug

SEQ ID NO: 2184856 - RNA, 12 nt, Streptococcus pneumoniae R6
uuuauuucuuga

SEQ ID NO: 2184857 - RNA, 20 nt, Streptococcus pneumoniae R6
uuuauucagccaaggcuccc

SEQ ID NO: 2184858 - RNA, 21 nt, Streptococcus pneumoniae R6
uuuauucagccaaggcuccca

SEQ ID NO: 2184859 - RNA, 14 nt, Streptococcus pneumoniae R6
uuuauuccauggua

SEQ ID NO: 2184860 - RNA, 12 nt, Streptococcus pneumoniae R6
uuuauucuaagc

SEQ ID NO: 2184861 - RNA, 18 nt, Streptococcus pneumoniae R6
uuuauucuaagcgaccau

SEQ ID NO: 2184862 - RNA, 18 nt, Streptococcus pneumoniae R6
uuuauucgauuacaauca

SEQ ID NO: 2184863 - RNA, 17 nt, Streptococcus pneumoniae R6
uuuauucuuaaauccac

SEQ ID NO: 2184864 - RNA, 14 nt, Streptococcus pneumoniae R6
uuuauugaguuuuu

SEQ ID NO: 2184865 - RNA, 22 nt, Streptococcus pneumoniae R6
uuuauuguagcauauuuuguuu

SEQ ID NO: 2184866 - RNA, 17 nt, Streptococcus pneumoniae R6
uuuauugucucuaaaaa

SEQ ID NO: 2184867 - RNA, 19 nt, Streptococcus pneumoniae R6
uuuauugucucuaaaaaua

SEQ ID NO: 2184868 - RNA, 18 nt, Streptococcus pneumoniae R6
uuuauugucuucaucucu

SEQ ID NO: 2184869 - RNA, 20 nt, Streptococcus pneumoniae R6
uuuauuuaccgaaaaauuaa

SEQ ID NO: 2184870 - RNA, 15 nt, Streptococcus pneumoniae R6
uuuauuuaagcaaaa

SEQ ID NO: 2184871 - RNA, 17 nt, Streptococcus pneumoniae R6
uuuauuuaagcaaaaaa

SEQ ID NO: 2184872 - RNA, 22 nt, Streptococcus pneumoniae R6
uuuauugugggaauguuugcuu

SEQ ID NO: 2184873 - RNA, 21 nt, Streptococcus pneumoniae R6
uuucaauuguuuauaaaauaa

SEQ ID NO: 2184874 - RNA, 21 nt, Streptococcus pneumoniae R6
uuucacaacucuuauacuuuu

SEQ ID NO: 2184875 - RNA, 23 nt, Streptococcus pneumoniae R6
uuucacgguaaacggcauuguug

SEQ ID NO: 2184876 - RNA, 16 nt, Streptococcus pneumoniae R6
uuucaccgccugcuca

SEQ ID NO: 2184877 - RNA, 18 nt, Streptococcus pneumoniae R6
uuucaagaccauuuccau

SEQ ID NO: 2184878 - RNA, 16 nt, Streptococcus pneumoniae R6
uuucaaggucgauauc

SEQ ID NO: 2184879 - RNA, 18 nt, Streptococcus pneumoniae R6
uuucaaggugaaguucac

SEQ ID NO: 2184880 - RNA, 13 nt, Streptococcus pneumoniae R6
uuucaacccacua

SEQ ID NO: 2184881 - RNA, 17 nt, Streptococcus pneumoniae R6
uuucaacccacuacagu

SEQ ID NO: 2184882 - RNA, 22 nt, Streptococcus pneumoniae R6
uuucaacccacuacaguugaca

SEQ ID NO: 2184883 - RNA, 18 nt, Streptococcus pneumoniae R6
uuucaacaugucagcuga

SEQ ID NO: 2184884 - RNA, 16 nt, Streptococcus pneumoniae R6
uuucaagucuucugaa

SEQ ID NO: 2184885 - RNA, 16 nt, Streptococcus pneumoniae R6
uuucaagucuugugaa

SEQ ID NO: 2184886 - RNA, 21 nt, Streptococcus pneumoniae R6
uuucaaugcccuugauaauaa

SEQ ID NO: 2184887 - RNA, 14 nt, Streptococcus pneumoniae R6
uuucauaauuucuu

SEQ ID NO: 2184888 - RNA, 16 nt, Streptococcus pneumoniae R6
uuucauacgauaaaaa

SEQ ID NO: 2184889 - RNA, 19 nt, Streptococcus pneumoniae R6
uuucauaagccguaaucau

SEQ ID NO: 2184890 - RNA, 15 nt, Streptococcus pneumoniae R6
uuucauaacuacagu

SEQ ID NO: 2184891 - RNA, 13 nt, Streptococcus pneumoniae R6
uuucauaaauaga

SEQ ID NO: 2184892 - RNA, 12 nt, Streptococcus pneumoniae R6
uuucauaaacaa

SEQ ID NO: 2184893 - RNA, 18 nt, Streptococcus pneumoniae R6
uuucauaaacaagagcaa

SEQ ID NO: 2184894 - RNA, 19 nt, Streptococcus pneumoniae R6
uuucauauguaaacaguaa

SEQ ID NO: 2184895 - RNA, 21 nt, Streptococcus pneumoniae R6
uuucagguguuucuaucacgg

SEQ ID NO: 2184896 - RNA, 17 nt, Streptococcus pneumoniae R6
uuucaggagaaaaugga

SEQ ID NO: 2184897 - RNA, 18 nt, Streptococcus pneumoniae R6
uuucacuuguauccuccu

SEQ ID NO: 2184898 - RNA, 15 nt, Streptococcus pneumoniae R6
uuucagaaucccaaa

SEQ ID NO: 2184899 - RNA, 22 nt, Streptococcus pneumoniae R6
uuucagagggcuuuuucauuga

SEQ ID NO: 2184900 - RNA, 15 nt, Streptococcus pneumoniae R6
uuucagauuuuaaag

SEQ ID NO: 2184901 - RNA, 14 nt, Streptococcus pneumoniae R6
uuucagauaaccau

SEQ ID NO: 2184902 - RNA, 16 nt, Streptococcus pneumoniae R6
uuucagcauauuuccc

SEQ ID NO: 2184903 - RNA, 17 nt, Streptococcus pneumoniae R6
uuucagcauauuuccca

SEQ ID NO: 2184904 - RNA, 19 nt, Streptococcus pneumoniae R6
uuucagcgaccaucauuuu

SEQ ID NO: 2184905 - RNA, 17 nt, Streptococcus pneumoniae R6
uuucagcgauuuccuug

SEQ ID NO: 2184906 - RNA, 18 nt, Streptococcus pneumoniae R6
uuucauccccauuuguau

SEQ ID NO: 2184907 - RNA, 17 nt, Streptococcus pneumoniae R6
uuucauccacaaccuca

SEQ ID NO: 2184908 - RNA, 14 nt, Streptococcus pneumoniae R6
uuucauauuuucag

SEQ ID NO: 2184909 - RNA, 16 nt, Streptococcus pneumoniae R6
uuucauguuccagacu

SEQ ID NO: 2184910 - RNA, 15 nt, Streptococcus pneumoniae R6
uuucauuacagaaca

SEQ ID NO: 2184911 - RNA, 20 nt, Streptococcus pneumoniae R6
uuucauuacuaaguuccugu

SEQ ID NO: 2184912 - RNA, 21 nt, Streptococcus pneumoniae R6
uuucauggcaaauucaccaau

SEQ ID NO: 2184913 - RNA, 14 nt, Streptococcus pneumoniae R6
uuucauguauucca

SEQ ID NO: 2184914 - RNA, 20 nt, Streptococcus pneumoniae R6
uuucauguauuccaagagua

SEQ ID NO: 2184915 - RNA, 23 nt, Streptococcus pneumoniae R6
uuucauguaagaguucuucccac

SEQ ID NO: 2184916 - RNA, 14 nt, Streptococcus pneumoniae R6
uuuccaaacauaca

SEQ ID NO: 2184917 - RNA, 18 nt, Streptococcus pneumoniae R6
uuucauuuuaauauauaa

SEQ ID NO: 2184918 - RNA, 21 nt, Streptococcus pneumoniae R6
uuucauuuuacuauauaucau

SEQ ID NO: 2184919 - RNA, 23 nt, Streptococcus pneumoniae R6
uuuccaaucagacuguuuuucuu

SEQ ID NO: 2184920 - RNA, 18 nt, Streptococcus pneumoniae R6
uuuccaaucuucuccagu

SEQ ID NO: 2184921 - RNA, 13 nt, Streptococcus pneumoniae R6
uuuccaagaucuu

SEQ ID NO: 2184922 - RNA, 17 nt, Streptococcus pneumoniae R6
uuuccaacucagccaua

SEQ ID NO: 2184923 - RNA, 15 nt, Streptococcus pneumoniae R6
uuuccacaauuuuca

SEQ ID NO: 2184924 - RNA, 16 nt, Streptococcus pneumoniae R6
uuucauuccaugaaaa

SEQ ID NO: 2184925 - RNA, 20 nt, Streptococcus pneumoniae R6
uuucauuuaauauauuuauu

SEQ ID NO: 2184926 - RNA, 21 nt, Streptococcus pneumoniae R6
uuucauuucgacugaaaauau

SEQ ID NO: 2184927 - RNA, 21 nt, Streptococcus pneumoniae R6
uuucauugaguauaagauaca

SEQ ID NO: 2184928 - RNA, 22 nt, Streptococcus pneumoniae R6
uuucauugaguauuacuucauu

SEQ ID NO: 2184929 - RNA, 13 nt, Streptococcus pneumoniae R6
uuucauugaguuu

SEQ ID NO: 2184930 - RNA, 23 nt, Streptococcus pneumoniae R6
uuuaugcuuggugagaaaguuuu

SEQ ID NO: 2184931 - RNA, 18 nt, Streptococcus pneumoniae R6
uuuaugcguuuuaucaua

SEQ ID NO: 2184932 - RNA, 14 nt, Streptococcus pneumoniae R6
uuuaugcuauauau

SEQ ID NO: 2184933 - RNA, 18 nt, Streptococcus pneumoniae R6
uuuaugccuugcaggauu

SEQ ID NO: 2184934 - RNA, 20 nt, Streptococcus pneumoniae R6
uuuaugccguuucaacaauc

SEQ ID NO: 2184935 - RNA, 12 nt, Streptococcus pneumoniae R6
uuuaucuuugaa

SEQ ID NO: 2184936 - RNA, 13 nt, Streptococcus pneumoniae R6
uuuaucuuugaaa

SEQ ID NO: 2184937 - RNA, 20 nt, Streptococcus pneumoniae R6
uuuauuacuucaauuucuaa

SEQ ID NO: 2184938 - RNA, 22 nt, Streptococcus pneumoniae R6
uuuauuacuucaauuucuaaug

SEQ ID NO: 2184939 - RNA, 13 nt, Streptococcus pneumoniae R6
uuuauguccuaaa

SEQ ID NO: 2184940 - RNA, 19 nt, Streptococcus pneumoniae R6
uuuaugguguuuuaaggag

SEQ ID NO: 2184941 - RNA, 17 nt, Streptococcus pneumoniae R6
uuuaucauuuugaaauc

SEQ ID NO: 2184942 - RNA, 16 nt, Streptococcus pneumoniae R6
uuuauccaaucuauuu

SEQ ID NO: 2184943 - RNA, 19 nt, Streptococcus pneumoniae R6
uuuauccaucugcucucca

SEQ ID NO: 2184944 - RNA, 19 nt, Streptococcus pneumoniae R6
uuuaucuaaacuauuucuu

SEQ ID NO: 2184945 - RNA, 20 nt, Streptococcus pneumoniae R6
uuuaucuaaacuauuucuua

SEQ ID NO: 2184946 - RNA, 15 nt, Streptococcus pneumoniae R6
uuuaucucccauacc

SEQ ID NO: 2184947 - RNA, 14 nt, Streptococcus pneumoniae R6
uuuaucugcaaccu

SEQ ID NO: 2184948 - RNA, 20 nt, Streptococcus pneumoniae R6
uuuaucugcaaccucaaagc

SEQ ID NO: 2184949 - RNA, 19 nt, Streptococcus pneumoniae R6
uuuaucugcccaaagacag

SEQ ID NO: 2184950 - RNA, 16 nt, Streptococcus pneumoniae R6
uuuaucuuaauucucu

SEQ ID NO: 2184951 - RNA, 17 nt, Streptococcus pneumoniae R6
uuuaucuucuauugcau

SEQ ID NO: 2184952 - RNA, 21 nt, Streptococcus pneumoniae R6
uuuauauuauaaauuucgaaa

SEQ ID NO: 2184953 - RNA, 16 nt, Streptococcus pneumoniae R6
uuuauauccuaaaaaa

SEQ ID NO: 2184954 - RNA, 14 nt, Streptococcus pneumoniae R6
uuuauaugauuuca

SEQ ID NO: 2184955 - RNA, 23 nt, Streptococcus pneumoniae R6
uuuauaugauuucaauuuuaaau

SEQ ID NO: 2184956 - RNA, 22 nt, Streptococcus pneumoniae R6
uuuauaguaaaaugaaauaaga

SEQ ID NO: 2184957 - RNA, 21 nt, Streptococcus pneumoniae R6
uuuauauaaaaagaaauguca

SEQ ID NO: 2184958 - RNA, 13 nt, Streptococcus pneumoniae R6
uuuaucaauaaua

SEQ ID NO: 2184959 - RNA, 19 nt, Streptococcus pneumoniae R6
uuuaucaagcaaaucaaag

SEQ ID NO: 2184960 - RNA, 13 nt, Streptococcus pneumoniae R6
uuuaucauagaaa

SEQ ID NO: 2184961 - RNA, 21 nt, Streptococcus pneumoniae R6
uuuaucauagaaauauuuacu

SEQ ID NO: 2184962 - RNA, 19 nt, Streptococcus pneumoniae R6
uuuaucaccuccuucucca

SEQ ID NO: 2184963 - RNA, 19 nt, Streptococcus pneumoniae R6
uuuauaauauaaacuuuuu

SEQ ID NO: 2184964 - RNA, 17 nt, Streptococcus pneumoniae R6
uuuauaaaucuucuaaa

SEQ ID NO: 2184965 - RNA, 18 nt, Streptococcus pneumoniae R6
uuuauaaaucuucuaaau

SEQ ID NO: 2184966 - RNA, 12 nt, Streptococcus pneumoniae R6
uuuauaaacuuu

SEQ ID NO: 2184967 - RNA, 23 nt, Streptococcus pneumoniae R6
uuuauaaacuuugguuauaaaaa

SEQ ID NO: 2184968 - RNA, 21 nt, Streptococcus pneumoniae R6
uuuauagaauauauuucucaa

SEQ ID NO: 2184969 - RNA, 14 nt, Streptococcus pneumoniae R6
uuuauagaaaauua

SEQ ID NO: 2184970 - RNA, 15 nt, Streptococcus pneumoniae R6
uuuauagaaaauuaa

SEQ ID NO: 2184971 - RNA, 22 nt, Streptococcus pneumoniae R6
uuuauagaaauuaauuuuacuu

SEQ ID NO: 2184972 - RNA, 14 nt, Streptococcus pneumoniae R6
uuuauacucaauga

SEQ ID NO: 2184973 - RNA, 15 nt, Streptococcus pneumoniae R6
uuuauaauuuuaaag

SEQ ID NO: 2184974 - RNA, 16 nt, Streptococcus pneumoniae R6
uuuauaaucauuaaaa

SEQ ID NO: 2184975 - RNA, 13 nt, Streptococcus pneumoniae R6
uuuagauuaaaaa

SEQ ID NO: 2184976 - RNA, 15 nt, Streptococcus pneumoniae R6
uuuagauuaaaaaau

SEQ ID NO: 2184977 - RNA, 15 nt, Streptococcus pneumoniae R6
uuuagcagagaagag

SEQ ID NO: 2184978 - RNA, 21 nt, Streptococcus pneumoniae R6
uuuagaagcagagguguacua

SEQ ID NO: 2184979 - RNA, 23 nt, Streptococcus pneumoniae R6
uuuagaaguagagguguacuauu

SEQ ID NO: 2184980 - RNA, 21 nt, Streptococcus pneumoniae R6
uuuagaaguagauguguacua

SEQ ID NO: 2184981 - RNA, 21 nt, Streptococcus pneumoniae R6
uuuagaagugccaguguacua

SEQ ID NO: 2184982 - RNA, 18 nt, Streptococcus pneumoniae R6
uuuagaaacuaugaugug

SEQ ID NO: 2184983 - RNA, 21 nt, Streptococcus pneumoniae R6
uuuagaaauagagguguacua

SEQ ID NO: 2184984 - RNA, 14 nt, Streptococcus pneumoniae R6
uuuaggaauauuau

SEQ ID NO: 2184985 - RNA, 19 nt, Streptococcus pneumoniae R6
uuuaggaauauuauauaaa

SEQ ID NO: 2184986 - RNA, 19 nt, Streptococcus pneumoniae R6
uuuaggaucaugagccaca

SEQ ID NO: 2184987 - RNA, 15 nt, Streptococcus pneumoniae R6
uuuaguaaaaauugc

SEQ ID NO: 2184988 - RNA, 13 nt, Streptococcus pneumoniae R6
uuuaguagaaaau

SEQ ID NO: 2184989 - RNA, 19 nt, Streptococcus pneumoniae R6
uuuaguagaaaaugaaaua

SEQ ID NO: 2184990 - RNA, 17 nt, Streptococcus pneumoniae R6
uuuaggugaaaugucua

SEQ ID NO: 2184991 - RNA, 14 nt, Streptococcus pneumoniae R6
uuuaguaaacaaag

SEQ ID NO: 2184992 - RNA, 16 nt, Streptococcus pneumoniae R6
uuuaguuccaauaacu

SEQ ID NO: 2184993 - RNA, 16 nt, Streptococcus pneumoniae R6
uuuaguguauaugaag

SEQ ID NO: 2184994 - RNA, 12 nt, Streptococcus pneumoniae R6
uuuagugaugua

SEQ ID NO: 2184995 - RNA, 19 nt, Streptococcus pneumoniae R6
uuuagucuauucuuuccuu

SEQ ID NO: 2184996 - RNA, 13 nt, Streptococcus pneumoniae R6
uuuacuguugcug

SEQ ID NO: 2184997 - RNA, 13 nt, Streptococcus pneumoniae R6
uuuacuuaaaauu

SEQ ID NO: 2184998 - RNA, 20 nt, Streptococcus pneumoniae R6
uuuacuucauguuuuccuaa

SEQ ID NO: 2184999 - RNA, 14 nt, Streptococcus pneumoniae R6
uuuacuucauuaug

SEQ ID NO: 2185000 - RNA, 18 nt, Streptococcus pneumoniae R6
uuuacuucauuuuugccu

SEQ ID NO: 2185001 - RNA, 13 nt, Streptococcus pneumoniae R6
uuuacuucuuugg

SEQ ID NO: 2185002 - RNA, 19 nt, Streptococcus pneumoniae R6
uuuacuuuccugauagagu

SEQ ID NO: 2185003 - RNA, 19 nt, Streptococcus pneumoniae R6
uuuacuuuauuuucucauc

SEQ ID NO: 2185004 - RNA, 20 nt, Streptococcus pneumoniae R6
uuuacucuccuccauaaaaa

SEQ ID NO: 2185005 - RNA, 16 nt, Streptococcus pneumoniae R6
uuuacuauauaucaug

SEQ ID NO: 2185006 - RNA, 17 nt, Streptococcus pneumoniae R6
uuuacuauacuuacuua

SEQ ID NO: 2185007 - RNA, 21 nt, Streptococcus pneumoniae R6
uuuacaguauuuauaaacuuu

SEQ ID NO: 2185008 - RNA, 15 nt, Streptococcus pneumoniae R6
uuuacaucaagcuca

SEQ ID NO: 2185009 - RNA, 19 nt, Streptococcus pneumoniae R6
uuuacaucaagcucaucua

SEQ ID NO: 2185010 - RNA, 16 nt, Streptococcus pneumoniae R6
uuuacguuuucguguu

SEQ ID NO: 2185011 - RNA, 14 nt, Streptococcus pneumoniae R6
uuuacuacaaagag

SEQ ID NO: 2185012 - RNA, 19 nt, Streptococcus pneumoniae R6
uuuacuaaggcccaauuaa

SEQ ID NO: 2185013 - RNA, 20 nt, Streptococcus pneumoniae R6
uuuacuaaaauaacuguaau

SEQ ID NO: 2185014 - RNA, 15 nt, Streptococcus pneumoniae R6
uuuacuaaacaaggg

SEQ ID NO: 2185015 - RNA, 15 nt, Streptococcus pneumoniae R6
uuuacguccaccaca

SEQ ID NO: 2185016 - RNA, 18 nt, Streptococcus pneumoniae R6
uuuacguccaccacaaaa

SEQ ID NO: 2185017 - RNA, 18 nt, Streptococcus pneumoniae R6
uuuacggacauguauauu

SEQ ID NO: 2185018 - RNA, 14 nt, Streptococcus pneumoniae R6
ucagggaaaaaacu

SEQ ID NO: 2185019 - RNA, 23 nt, Streptococcus pneumoniae R6
ucaggcuuuuucuguacuauaaa

SEQ ID NO: 2185020 - RNA, 15 nt, Streptococcus pneumoniae R6
ucagguguuucuggu

SEQ ID NO: 2185021 - RNA, 14 nt, Streptococcus pneumoniae R6
ucagguauugaaaa

SEQ ID NO: 2185022 - RNA, 16 nt, Streptococcus pneumoniae R6
ucagguauugaaaaaa

SEQ ID NO: 2185023 - RNA, 14 nt, Streptococcus pneumoniae R6
ucagggucaaagua

SEQ ID NO: 2185024 - RNA, 17 nt, Streptococcus pneumoniae R6
ucaggauaguugacaag

SEQ ID NO: 2185025 - RNA, 16 nt, Streptococcus pneumoniae R6
ucaggauuuuuaacuu

SEQ ID NO: 2185026 - RNA, 15 nt, Streptococcus pneumoniae R6
ucaggauuuuuucau

SEQ ID NO: 2185027 - RNA, 21 nt, Streptococcus pneumoniae R6
ucaggauugauaaaauuuaaa

SEQ ID NO: 2185028 - RNA, 19 nt, Streptococcus pneumoniae R6
ucaggauaaaaccaaaaag

SEQ ID NO: 2185029 - RNA, 15 nt, Streptococcus pneumoniae R6
ucaggccagaugacu

SEQ ID NO: 2185030 - RNA, 20 nt, Streptococcus pneumoniae R6
uaucuuccaguuuauaacuu

SEQ ID NO: 2185031 - RNA, 17 nt, Streptococcus pneumoniae R6
uaucuucgcaacugucu

SEQ ID NO: 2185032 - RNA, 22 nt, Streptococcus pneumoniae R6
ucaggagcacuugaugaaaaaa

SEQ ID NO: 2185033 - RNA, 16 nt, Streptococcus pneumoniae R6
ucagcuucuauuucuu

SEQ ID NO: 2185034 - RNA, 21 nt, Streptococcus pneumoniae R6
ucagcucaaaacacuguuuua

SEQ ID NO: 2185035 - RNA, 21 nt, Streptococcus pneumoniae R6
ucagcucaaaacaugguuuug

SEQ ID NO: 2185036 - RNA, 14 nt, Streptococcus pneumoniae R6
ucagcucaacugcg

SEQ ID NO: 2185037 - RNA, 23 nt, Streptococcus pneumoniae R6
ucagcuaggcucgagaaaggaca

SEQ ID NO: 2185038 - RNA, 21 nt, Streptococcus pneumoniae R6
ucagcuccgauguauuugagg

SEQ ID NO: 2185039 - RNA, 12 nt, Streptococcus pneumoniae R6
ucagcugucuga

SEQ ID NO: 2185040 - RNA, 13 nt, Streptococcus pneumoniae R6
ucagcucuuuuuu

SEQ ID NO: 2185041 - RNA, 18 nt, Streptococcus pneumoniae R6
ucaguagucuagcuagug

SEQ ID NO: 2185042 - RNA, 19 nt, Streptococcus pneumoniae R6
ucaguauauugaaaugaaa

SEQ ID NO: 2185043 - RNA, 21 nt, Streptococcus pneumoniae R6
ucaguauauugaaaugaaaua

SEQ ID NO: 2185044 - RNA, 19 nt, Streptococcus pneumoniae R6
ucaguaacguuagcaaaga

SEQ ID NO: 2185045 - RNA, 15 nt, Streptococcus pneumoniae R6
ucagguuucucuaca

SEQ ID NO: 2185046 - RNA, 21 nt, Streptococcus pneumoniae R6
ucaguaaaaaaaacauauauu

SEQ ID NO: 2185047 - RNA, 23 nt, Streptococcus pneumoniae R6
ucagguuuuucgucuuuuuuccg

SEQ ID NO: 2185048 - RNA, 18 nt, Streptococcus pneumoniae R6
ucaguauuuggauuauga

SEQ ID NO: 2185049 - RNA, 21 nt, Streptococcus pneumoniae R6
ucaguauuuggauuaugaaaa

SEQ ID NO: 2185050 - RNA, 15 nt, Streptococcus pneumoniae R6
ucaguauuacaucca

SEQ ID NO: 2185051 - RNA, 13 nt, Streptococcus pneumoniae R6
ucagucacauaua

SEQ ID NO: 2185052 - RNA, 19 nt, Streptococcus pneumoniae R6
ucagucaaacguuuaacug

SEQ ID NO: 2185053 - RNA, 13 nt, Streptococcus pneumoniae R6
ucagucaagaguu

SEQ ID NO: 2185054 - RNA, 17 nt, Streptococcus pneumoniae R6
ucagucugaccaccauu

SEQ ID NO: 2185055 - RNA, 15 nt, Streptococcus pneumoniae R6
ucagucugguuccca

SEQ ID NO: 2185056 - RNA, 15 nt, Streptococcus pneumoniae R6
ucagugaacuauuuu

SEQ ID NO: 2185057 - RNA, 19 nt, Streptococcus pneumoniae R6
ucagugguucacuggcauu

SEQ ID NO: 2185058 - RNA, 20 nt, Streptococcus pneumoniae R6
ucaguuauauugacagaaga

SEQ ID NO: 2185059 - RNA, 22 nt, Streptococcus pneumoniae R6
ucaguucccugcauuucuuuua

SEQ ID NO: 2185060 - RNA, 17 nt, Streptococcus pneumoniae R6
ucaguucauuuuuccuu

SEQ ID NO: 2185061 - RNA, 22 nt, Streptococcus pneumoniae R6
ucaguuccauccacaaccuuaa

SEQ ID NO: 2185062 - RNA, 22 nt, Streptococcus pneumoniae R6
ucaguuccaucuacaaccuuaa

SEQ ID NO: 2185063 - RNA, 23 nt, Streptococcus pneumoniae R6
ucaguuucgccuggagcuucauc

SEQ ID NO: 2185064 - RNA, 13 nt, Streptococcus pneumoniae R6
ucaguuucaucca

SEQ ID NO: 2185065 - RNA, 20 nt, Streptococcus pneumoniae R6
ucaguuucauccacaaccuc

SEQ ID NO: 2185066 - RNA, 15 nt, Streptococcus pneumoniae R6
ucaguuucaucuaca

SEQ ID NO: 2185067 - RNA, 19 nt, Streptococcus pneumoniae R6
ucaguuucaucuacaaccu

SEQ ID NO: 2185068 - RNA, 15 nt, Streptococcus pneumoniae R6
ucaguugcgccacuu

SEQ ID NO: 2185069 - RNA, 13 nt, Streptococcus pneumoniae R6
ucaguugcauaaa

SEQ ID NO: 2185070 - RNA, 16 nt, Streptococcus pneumoniae R6
ucaguugcauaaaucg

SEQ ID NO: 2185071 - RNA, 16 nt, Streptococcus pneumoniae R6
ucaguucuaucuacaa

SEQ ID NO: 2185072 - RNA, 19 nt, Streptococcus pneumoniae R6
ucaguucuaucugcaaccu

SEQ ID NO: 2185073 - RNA, 15 nt, Streptococcus pneumoniae R6
ucauaaaaauaaaga

SEQ ID NO: 2185074 - RNA, 16 nt, Streptococcus pneumoniae R6
ucauaaacaagagcaa

SEQ ID NO: 2185075 - RNA, 19 nt, Streptococcus pneumoniae R6
ucauaaacaagagcaagga

SEQ ID NO: 2185076 - RNA, 18 nt, Streptococcus pneumoniae R6
ucaguuucuauuucauuu

SEQ ID NO: 2185077 - RNA, 17 nt, Streptococcus pneumoniae R6
ucaguuuuaucaguaau

SEQ ID NO: 2185078 - RNA, 16 nt, Streptococcus pneumoniae R6
ucaguuuuuucacaaa

SEQ ID NO: 2185079 - RNA, 19 nt, Streptococcus pneumoniae R6
ucaguuuuuucacaaauuc

SEQ ID NO: 2185080 - RNA, 18 nt, Streptococcus pneumoniae R6
ucauaaauauccugcccc

SEQ ID NO: 2185081 - RNA, 14 nt, Streptococcus pneumoniae R6
ucauaaagccaguc

SEQ ID NO: 2185082 - RNA, 19 nt, Streptococcus pneumoniae R6
ucauaaaccucgauaccug

SEQ ID NO: 2185083 - RNA, 20 nt, Streptococcus pneumoniae R6
ucauaaacuauccagagcau

SEQ ID NO: 2185084 - RNA, 16 nt, Streptococcus pneumoniae R6
ucauaaagagaaggag

SEQ ID NO: 2185085 - RNA, 16 nt, Streptococcus pneumoniae R6
ucauaaaucaauuuuu

SEQ ID NO: 2185086 - RNA, 15 nt, Streptococcus pneumoniae R6
ucauaacacuauuaa

SEQ ID NO: 2185087 - RNA, 20 nt, Streptococcus pneumoniae R6
ucaucaaaggucucuucuuc

SEQ ID NO: 2185088 - RNA, 23 nt, Streptococcus pneumoniae R6
ucaucaaaugacuaaccuugucc

SEQ ID NO: 2185089 - RNA, 18 nt, Streptococcus pneumoniae R6
ucaucaaaugucuuggca

SEQ ID NO: 2185090 - RNA, 16 nt, Streptococcus pneumoniae R6
ucaucaagcuuucacu

SEQ ID NO: 2185091 - RNA, 17 nt, Streptococcus pneumoniae R6
ucaucaagcuuucacua

SEQ ID NO: 2185092 - RNA, 13 nt, Streptococcus pneumoniae R6
ucaucaaaaauag

SEQ ID NO: 2185093 - RNA, 18 nt, Streptococcus pneumoniae R6
ucauauuuucagauaacc

SEQ ID NO: 2185094 - RNA, 14 nt, Streptococcus pneumoniae R6
ucauauuuucuggg

SEQ ID NO: 2185095 - RNA, 12 nt, Streptococcus pneumoniae R6
ucauauuuuuug

SEQ ID NO: 2185096 - RNA, 15 nt, Streptococcus pneumoniae R6
ucauauuuauuaauu

SEQ ID NO: 2185097 - RNA, 16 nt, Streptococcus pneumoniae R6
ucauauuuauuaauuu

SEQ ID NO: 2185098 - RNA, 20 nt, Streptococcus pneumoniae R6
ucauauagaccaacuauuuu

SEQ ID NO: 2185099 - RNA, 18 nt, Streptococcus pneumoniae R6
ucauauaaauauagaaac

SEQ ID NO: 2185100 - RNA, 13 nt, Streptococcus pneumoniae R6
ucauauaaauaau

SEQ ID NO: 2185101 - RNA, 20 nt, Streptococcus pneumoniae R6
ucauaucauaacacuauuaa

SEQ ID NO: 2185102 - RNA, 17 nt, Streptococcus pneumoniae R6
ucauaucaucaaucaag

SEQ ID NO: 2185103 - RNA, 22 nt, Streptococcus pneumoniae R6
ucauaucaugggguguuuuucu

SEQ ID NO: 2185104 - RNA, 19 nt, Streptococcus pneumoniae R6
ucauaucaagguuuuucaa

SEQ ID NO: 2185105 - RNA, 14 nt, Streptococcus pneumoniae R6
ucauaucaaucucu

SEQ ID NO: 2185106 - RNA, 20 nt, Streptococcus pneumoniae R6
ucauaugggacuuuuuuucu

SEQ ID NO: 2185107 - RNA, 18 nt, Streptococcus pneumoniae R6
ucauauucuuuuacacuc

SEQ ID NO: 2185108 - RNA, 17 nt, Streptococcus pneumoniae R6
ucauaucuuauuucaau

SEQ ID NO: 2185109 - RNA, 19 nt, Streptococcus pneumoniae R6
ucauaucuuauuucaauuu

SEQ ID NO: 2185110 - RNA, 20 nt, Streptococcus pneumoniae R6
ucauaucuggcauuccugcu

SEQ ID NO: 2185111 - RNA, 19 nt, Streptococcus pneumoniae R6
ucauaagauuaauuucaga

SEQ ID NO: 2185112 - RNA, 16 nt, Streptococcus pneumoniae R6
ucauacgauaaaaauc

SEQ ID NO: 2185113 - RNA, 17 nt, Streptococcus pneumoniae R6
ucauagacuuaauuguc

SEQ ID NO: 2185114 - RNA, 18 nt, Streptococcus pneumoniae R6
ucauagaaauuuuuacuu

SEQ ID NO: 2185115 - RNA, 17 nt, Streptococcus pneumoniae R6
ucauagaaauauuuacu

SEQ ID NO: 2185116 - RNA, 23 nt, Streptococcus pneumoniae R6
ucauacuuagcuaauuuucuacc

SEQ ID NO: 2185117 - RNA, 15 nt, Streptococcus pneumoniae R6
ucauacucauuuaaa

SEQ ID NO: 2185118 - RNA, 19 nt, Streptococcus pneumoniae R6
ucauacugccaagauagag

SEQ ID NO: 2185119 - RNA, 21 nt, Streptococcus pneumoniae R6
ucauagagccuaguugcuagu

SEQ ID NO: 2185120 - RNA, 12 nt, Streptococcus pneumoniae R6
ucauagcagcaa

SEQ ID NO: 2185121 - RNA, 15 nt, Streptococcus pneumoniae R6
ucauagccauaaaac

SEQ ID NO: 2185122 - RNA, 18 nt, Streptococcus pneumoniae R6
ucauaguacaauaccuuu

SEQ ID NO: 2185123 - RNA, 15 nt, Streptococcus pneumoniae R6
ucauaggcuuuagua

SEQ ID NO: 2185124 - RNA, 16 nt, Streptococcus pneumoniae R6
ucauaggcauaguacc

SEQ ID NO: 2185125 - RNA, 14 nt, Streptococcus pneumoniae R6
ucauccacaaccuc

SEQ ID NO: 2185126 - RNA, 18 nt, Streptococcus pneumoniae R6
ucauccacaaccucaaaa

SEQ ID NO: 2185127 - RNA, 19 nt, Streptococcus pneumoniae R6
ucauccaccuugcaaaaaa

SEQ ID NO: 2185128 - RNA, 13 nt, Streptococcus pneumoniae R6
ucauccacuggau

SEQ ID NO: 2185129 - RNA, 20 nt, Streptococcus pneumoniae R6
ucaucagucaaucuacuugu

SEQ ID NO: 2185130 - RNA, 15 nt, Streptococcus pneumoniae R6
ucaucagcagagaaa

SEQ ID NO: 2185131 - RNA, 17 nt, Streptococcus pneumoniae R6
ucaucagguuaaaggaa

SEQ ID NO: 2185132 - RNA, 13 nt, Streptococcus pneumoniae R6
ucauccuugaguu

SEQ ID NO: 2185133 - RNA, 13 nt, Streptococcus pneumoniae R6
ucauccuuugcau

SEQ ID NO: 2185134 - RNA, 17 nt, Streptococcus pneumoniae R6
ucaucgauuucuucuug

SEQ ID NO: 2185135 - RNA, 23 nt, Streptococcus pneumoniae R6
ucaucgcccaauuuauguaauca

SEQ ID NO: 2185136 - RNA, 15 nt, Streptococcus pneumoniae R6
ucaucgccaaaucau

SEQ ID NO: 2185137 - RNA, 14 nt, Streptococcus pneumoniae R6
ucaucgcuaucaau

SEQ ID NO: 2185138 - RNA, 19 nt, Streptococcus pneumoniae R6
ucaucccgcccaucaugcu

SEQ ID NO: 2185139 - RNA, 22 nt, Streptococcus pneumoniae R6
ucauccauauaaaucuccagac

SEQ ID NO: 2185140 - RNA, 23 nt, Streptococcus pneumoniae R6
ucauccauucuuuuuuaauucuu

SEQ ID NO: 2185141 - RNA, 17 nt, Streptococcus pneumoniae R6
ucauccagauuuuucug

SEQ ID NO: 2185142 - RNA, 22 nt, Streptococcus pneumoniae R6
ucauccagcaggagaaaguuug

SEQ ID NO: 2185143 - RNA, 15 nt, Streptococcus pneumoniae R6
ucaucggaaugguaa

SEQ ID NO: 2185144 - RNA, 14 nt, Streptococcus pneumoniae R6
ucaucuaaggucaa

SEQ ID NO: 2185145 - RNA, 23 nt, Streptococcus pneumoniae R6
ucaucuaucuauuuuuaauagac

SEQ ID NO: 2185146 - RNA, 13 nt, Streptococcus pneumoniae R6
ucaucuauaauca

SEQ ID NO: 2185147 - RNA, 14 nt, Streptococcus pneumoniae R6
ucaucuacaaccuc

SEQ ID NO: 2185148 - RNA, 15 nt, Streptococcus pneumoniae R6
ucaucuacaaccuca

SEQ ID NO: 2185149 - RNA, 22 nt, Streptococcus pneumoniae R6
ucaucugcuuuagcagcgucac

SEQ ID NO: 2185150 - RNA, 14 nt, Streptococcus pneumoniae R6
ucaucugcuuucaa

SEQ ID NO: 2185151 - RNA, 18 nt, Streptococcus pneumoniae R6
ucaucugcuuucaaaaag

SEQ ID NO: 2185152 - RNA, 22 nt, Streptococcus pneumoniae R6
ucaucuggaguagcauccccag

SEQ ID NO: 2185153 - RNA, 14 nt, Streptococcus pneumoniae R6
ucaucuggauuuuc

SEQ ID NO: 2185154 - RNA, 16 nt, Streptococcus pneumoniae R6
ucaucuggauuuucag

SEQ ID NO: 2185155 - RNA, 22 nt, Streptococcus pneumoniae R6
ucaucuggauuuucagccucua

SEQ ID NO: 2185156 - RNA, 15 nt, Streptococcus pneumoniae R6
ucaucugcaucaaga

SEQ ID NO: 2185157 - RNA, 17 nt, Streptococcus pneumoniae R6
ucaucugaaugacaaau

SEQ ID NO: 2185158 - RNA, 13 nt, Streptococcus pneumoniae R6
ucaucuugauaga

SEQ ID NO: 2185159 - RNA, 20 nt, Streptococcus pneumoniae R6
ucaucuugcuaaaaaaaggg

SEQ ID NO: 2185160 - RNA, 18 nt, Streptococcus pneumoniae R6
ucaucuuauuucaaucug

SEQ ID NO: 2185161 - RNA, 18 nt, Streptococcus pneumoniae R6
ucaucuguuuucaaaaag

SEQ ID NO: 2185162 - RNA, 23 nt, Streptococcus pneumoniae R6
ucaugcaggaaguucaguagauu

SEQ ID NO: 2185163 - RNA, 19 nt, Streptococcus pneumoniae R6
ucaugcuggcagaaacugu

SEQ ID NO: 2185164 - RNA, 21 nt, Streptococcus pneumoniae R6
ucaugcgaaacagugaugaga

SEQ ID NO: 2185165 - RNA, 12 nt, Streptococcus pneumoniae R6
ucaucuuucaug

SEQ ID NO: 2185166 - RNA, 17 nt, Streptococcus pneumoniae R6
ucaucuuugauuucuug

SEQ ID NO: 2185167 - RNA, 18 nt, Streptococcus pneumoniae R6
ucaugaaauuauuucaca

SEQ ID NO: 2185168 - RNA, 13 nt, Streptococcus pneumoniae R6
ucaugaauacgua

SEQ ID NO: 2185169 - RNA, 19 nt, Streptococcus pneumoniae R6
ucaugacaaucaagaccca

SEQ ID NO: 2185170 - RNA, 15 nt, Streptococcus pneumoniae R6
ucaugacaucuucca

SEQ ID NO: 2185171 - RNA, 14 nt, Streptococcus pneumoniae R6
ucaugaccccuaaa

SEQ ID NO: 2185172 - RNA, 19 nt, Streptococcus pneumoniae R6
ucaugaccccuaaauauaa

SEQ ID NO: 2185173 - RNA, 13 nt, Streptococcus pneumoniae R6
ucaugagccacaa

SEQ ID NO: 2185174 - RNA, 16 nt, Streptococcus pneumoniae R6
ucaugauuagaaauag

SEQ ID NO: 2185175 - RNA, 14 nt, Streptococcus pneumoniae R6
ucaugaugauagac

SEQ ID NO: 2185176 - RNA, 15 nt, Streptococcus pneumoniae R6
ucauuauuuaacuaa

SEQ ID NO: 2185177 - RNA, 20 nt, Streptococcus pneumoniae R6
ucauuauuuaacuaaaucuu

SEQ ID NO: 2185178 - RNA, 19 nt, Streptococcus pneumoniae R6
ucauucaauccaucuccaa

SEQ ID NO: 2185179 - RNA, 18 nt, Streptococcus pneumoniae R6
ucauuagauauagaauuu

SEQ ID NO: 2185180 - RNA, 21 nt, Streptococcus pneumoniae R6
ucauuauagaaggcaauuaaa

SEQ ID NO: 2185181 - RNA, 22 nt, Streptococcus pneumoniae R6
ucauuauagaaggcaauuaaaa

SEQ ID NO: 2185182 - RNA, 14 nt, Streptococcus pneumoniae R6
ucauuauauuucuc

SEQ ID NO: 2185183 - RNA, 21 nt, Streptococcus pneumoniae R6
ucauucgcaaaggcgcgaucu

SEQ ID NO: 2185184 - RNA, 13 nt, Streptococcus pneumoniae R6
ucauucaucacca

SEQ ID NO: 2185185 - RNA, 23 nt, Streptococcus pneumoniae R6
ucauuccuucaagggcagacaua

SEQ ID NO: 2185186 - RNA, 15 nt, Streptococcus pneumoniae R6
ucauucgaaugauuu

SEQ ID NO: 2185187 - RNA, 16 nt, Streptococcus pneumoniae R6
ucauucgaaugauuuc

SEQ ID NO: 2185188 - RNA, 20 nt, Streptococcus pneumoniae R6
ucauucgaaugauuucucuu

SEQ ID NO: 2185189 - RNA, 16 nt, Streptococcus pneumoniae R6
ucauucuuauuuggca

SEQ ID NO: 2185190 - RNA, 12 nt, Streptococcus pneumoniae R6
ucauucuucaca

SEQ ID NO: 2185191 - RNA, 18 nt, Streptococcus pneumoniae R6
ucauugaaaaaauaucuu

SEQ ID NO: 2185192 - RNA, 23 nt, Streptococcus pneumoniae R6
ucauugaaaaaauaucuuuuauu

SEQ ID NO: 2185193 - RNA, 18 nt, Streptococcus pneumoniae R6
ucauugcaaaggagagga

SEQ ID NO: 2185194 - RNA, 18 nt, Streptococcus pneumoniae R6
ucauugaguuuuaaucuc

SEQ ID NO: 2185195 - RNA, 15 nt, Streptococcus pneumoniae R6
ucauugauauaaaga

SEQ ID NO: 2185196 - RNA, 21 nt, Streptococcus pneumoniae R6
ucauugaguaugaaauaagau

SEQ ID NO: 2185197 - RNA, 13 nt, Streptococcus pneumoniae R6
ucauguucauuug

SEQ ID NO: 2185198 - RNA, 16 nt, Streptococcus pneumoniae R6
ucauguggugcuucug

SEQ ID NO: 2185199 - RNA, 21 nt, Streptococcus pneumoniae R6
ucauguaguuggaacaaguca

SEQ ID NO: 2185200 - RNA, 20 nt, Streptococcus pneumoniae R6
ucauguaagaguucuuccca

SEQ ID NO: 2185201 - RNA, 14 nt, Streptococcus pneumoniae R6
ucauguaaaucauu

SEQ ID NO: 2185202 - RNA, 17 nt, Streptococcus pneumoniae R6
ucaugggcuucuguaau

SEQ ID NO: 2185203 - RNA, 23 nt, Streptococcus pneumoniae R6
ucaugggguguuuuucuauuuaa

SEQ ID NO: 2185204 - RNA, 13 nt, Streptococcus pneumoniae R6
ucauggcauggaa

SEQ ID NO: 2185205 - RNA, 20 nt, Streptococcus pneumoniae R6
ucauggccacgguuagaagc

SEQ ID NO: 2185206 - RNA, 15 nt, Streptococcus pneumoniae R6
ucauggcaaauucac

SEQ ID NO: 2185207 - RNA, 16 nt, Streptococcus pneumoniae R6
ucauggcaaauucacc

SEQ ID NO: 2185208 - RNA, 19 nt, Streptococcus pneumoniae R6
ucauggcaaauucaccaau

SEQ ID NO: 2185209 - RNA, 19 nt, Streptococcus pneumoniae R6
ucauuacacaaauuuucuu

SEQ ID NO: 2185210 - RNA, 17 nt, Streptococcus pneumoniae R6
ucauuacagaacauuuu

SEQ ID NO: 2185211 - RNA, 20 nt, Streptococcus pneumoniae R6
ucauuacagaacauuuuaau

SEQ ID NO: 2185212 - RNA, 17 nt, Streptococcus pneumoniae R6
ucauuacucaaguccuu

SEQ ID NO: 2185213 - RNA, 22 nt, Streptococcus pneumoniae R6
ucauguuuuccuaauucuuuuc

SEQ ID NO: 2185214 - RNA, 18 nt, Streptococcus pneumoniae R6
ucauguuucggaucauau

SEQ ID NO: 2185215 - RNA, 18 nt, Streptococcus pneumoniae R6
ucauuaaagaccaaagaa

SEQ ID NO: 2185216 - RNA, 14 nt, Streptococcus pneumoniae R6
ucauuaauaaaguu

SEQ ID NO: 2185217 - RNA, 16 nt, Streptococcus pneumoniae R6
uccaacgacuuccagc

SEQ ID NO: 2185218 - RNA, 17 nt, Streptococcus pneumoniae R6
uccaaagguccagaagc

SEQ ID NO: 2185219 - RNA, 16 nt, Streptococcus pneumoniae R6
uccaaagguucaauca

SEQ ID NO: 2185220 - RNA, 21 nt, Streptococcus pneumoniae R6
uccaaaguaaaauacaaacca

SEQ ID NO: 2185221 - RNA, 19 nt, Streptococcus pneumoniae R6
uccaaaguagcuugcucca

SEQ ID NO: 2185222 - RNA, 13 nt, Streptococcus pneumoniae R6
uccaaaugguugg

SEQ ID NO: 2185223 - RNA, 22 nt, Streptococcus pneumoniae R6
uccaacaccaauuuuacaaaua

SEQ ID NO: 2185224 - RNA, 20 nt, Streptococcus pneumoniae R6
uccaaaaggcaucuugucaa

SEQ ID NO: 2185225 - RNA, 17 nt, Streptococcus pneumoniae R6
uccaaacaacaauacuu

SEQ ID NO: 2185226 - RNA, 23 nt, Streptococcus pneumoniae R6
uccaaaccaacauagauaaagac

SEQ ID NO: 2185227 - RNA, 15 nt, Streptococcus pneumoniae R6
uccaaaccaaccuuc

SEQ ID NO: 2185228 - RNA, 12 nt, Streptococcus pneumoniae R6
uccaaagaagua

SEQ ID NO: 2185229 - RNA, 13 nt, Streptococcus pneumoniae R6
uccaaagaaguag

SEQ ID NO: 2185230 - RNA, 19 nt, Streptococcus pneumoniae R6
uccaaagaccaugaggaaa

SEQ ID NO: 2185231 - RNA, 12 nt, Streptococcus pneumoniae R6
uccaaacgucca

SEQ ID NO: 2185232 - RNA, 16 nt, Streptococcus pneumoniae R6
uccaaagauagaaucc

SEQ ID NO: 2185233 - RNA, 21 nt, Streptococcus pneumoniae R6
ucauuuuugagugguuucugg

SEQ ID NO: 2185234 - RNA, 12 nt, Streptococcus pneumoniae R6
ucauuuuuccuu

SEQ ID NO: 2185235 - RNA, 17 nt, Streptococcus pneumoniae R6
uccaaaaaguaggcaua

SEQ ID NO: 2185236 - RNA, 16 nt, Streptococcus pneumoniae R6
ucauuuaaaaucaaaa

SEQ ID NO: 2185237 - RNA, 17 nt, Streptococcus pneumoniae R6
ucauuucaauagaaauc

SEQ ID NO: 2185238 - RNA, 15 nt, Streptococcus pneumoniae R6
ucauuuaucuucuua

SEQ ID NO: 2185239 - RNA, 17 nt, Streptococcus pneumoniae R6
ucauuggauacaaggag

SEQ ID NO: 2185240 - RNA, 17 nt, Streptococcus pneumoniae R6
ucauuggaguuguaauc

SEQ ID NO: 2185241 - RNA, 15 nt, Streptococcus pneumoniae R6
ucauuuuacuauaaa

SEQ ID NO: 2185242 - RNA, 17 nt, Streptococcus pneumoniae R6
ucauuuuacuauaaaau

SEQ ID NO: 2185243 - RNA, 14 nt, Streptococcus pneumoniae R6
ucauuuuacuauau

SEQ ID NO: 2185244 - RNA, 17 nt, Streptococcus pneumoniae R6
ucauuuuccacaagaac

SEQ ID NO: 2185245 - RNA, 17 nt, Streptococcus pneumoniae R6
ucauuuuguaaccuuuu

SEQ ID NO: 2185246 - RNA, 12 nt, Streptococcus pneumoniae R6
ucauuucuucaa

SEQ ID NO: 2185247 - RNA, 19 nt, Streptococcus pneumoniae R6
ucauuucacuauguuuuag

SEQ ID NO: 2185248 - RNA, 12 nt, Streptococcus pneumoniae R6
ucauuuggaaaa

SEQ ID NO: 2185249 - RNA, 20 nt, Streptococcus pneumoniae R6
ucauuugauuuuccuaauca

SEQ ID NO: 2185250 - RNA, 15 nt, Streptococcus pneumoniae R6
uccagcuuuuucuug

SEQ ID NO: 2185251 - RNA, 15 nt, Streptococcus pneumoniae R6
uccaggacugguuuu

SEQ ID NO: 2185252 - RNA, 17 nt, Streptococcus pneumoniae R6
uccagcgguaucaauca

SEQ ID NO: 2185253 - RNA, 20 nt, Streptococcus pneumoniae R6
uccagcgguaucaaucauau

SEQ ID NO: 2185254 - RNA, 21 nt, Streptococcus pneumoniae R6
uccagcauaacgacagaagaa

SEQ ID NO: 2185255 - RNA, 22 nt, Streptococcus pneumoniae R6
uccagcauaacgacagaagaag

SEQ ID NO: 2185256 - RNA, 14 nt, Streptococcus pneumoniae R6
uccagccuugucuu

SEQ ID NO: 2185257 - RNA, 21 nt, Streptococcus pneumoniae R6
uccagccugccugaucuugga

SEQ ID NO: 2185258 - RNA, 22 nt, Streptococcus pneumoniae R6
uccauaccuaaacuuugagccu

SEQ ID NO: 2185259 - RNA, 23 nt, Streptococcus pneumoniae R6
uccauaccugcucgccccauuuc

SEQ ID NO: 2185260 - RNA, 12 nt, Streptococcus pneumoniae R6
uccauaccaaag

SEQ ID NO: 2185261 - RNA, 17 nt, Streptococcus pneumoniae R6
uccauaccaucaaagac

SEQ ID NO: 2185262 - RNA, 19 nt, Streptococcus pneumoniae R6
uccauaggcagcuuguucu

SEQ ID NO: 2185263 - RNA, 16 nt, Streptococcus pneumoniae R6
uccauaguaaacuucu

SEQ ID NO: 2185264 - RNA, 18 nt, Streptococcus pneumoniae R6
uccauagcgucaaagaag

SEQ ID NO: 2185265 - RNA, 21 nt, Streptococcus pneumoniae R6
uccauaaacgcaagcaacaaa

SEQ ID NO: 2185266 - RNA, 22 nt, Streptococcus pneumoniae R6
uccauaaacgcaagcaacaaaa

SEQ ID NO: 2185267 - RNA, 15 nt, Streptococcus pneumoniae R6
uccauccacaaccuu

SEQ ID NO: 2185268 - RNA, 23 nt, Streptococcus pneumoniae R6
uccauauaaaaaagcaagaccac

SEQ ID NO: 2185269 - RNA, 18 nt, Streptococcus pneumoniae R6
uccauauaaaucuccaga

SEQ ID NO: 2185270 - RNA, 19 nt, Streptococcus pneumoniae R6
uccauaucugcuuccagau

SEQ ID NO: 2185271 - RNA, 21 nt, Streptococcus pneumoniae R6
uccauaucuuuagggaaauua

SEQ ID NO: 2185272 - RNA, 18 nt, Streptococcus pneumoniae R6
uccagugaaaacaggagu

SEQ ID NO: 2185273 - RNA, 15 nt, Streptococcus pneumoniae R6
uccaguuuauaacuu

SEQ ID NO: 2185274 - RNA, 16 nt, Streptococcus pneumoniae R6
uccaguuuuaaucuua

SEQ ID NO: 2185275 - RNA, 19 nt, Streptococcus pneumoniae R6
uccaguuaucugcaaaagu

SEQ ID NO: 2185276 - RNA, 16 nt, Streptococcus pneumoniae R6
uccaguagaucacuga

SEQ ID NO: 2185277 - RNA, 16 nt, Streptococcus pneumoniae R6
uccagucccaaguucc

SEQ ID NO: 2185278 - RNA, 16 nt, Streptococcus pneumoniae R6
uccaguaauuucccau

SEQ ID NO: 2185279 - RNA, 15 nt, Streptococcus pneumoniae R6
uccaguaaaaacugu

SEQ ID NO: 2185280 - RNA, 16 nt, Streptococcus pneumoniae R6
uccaguaaaaacuguu

SEQ ID NO: 2185281 - RNA, 14 nt, Streptococcus pneumoniae R6
uccacggcucauga

SEQ ID NO: 2185282 - RNA, 19 nt, Streptococcus pneumoniae R6
uccacggagauagugagga

SEQ ID NO: 2185283 - RNA, 22 nt, Streptococcus pneumoniae R6
uccacuugguguugagaaagca

SEQ ID NO: 2185284 - RNA, 19 nt, Streptococcus pneumoniae R6
uccacuuguggcaaggagu

SEQ ID NO: 2185285 - RNA, 18 nt, Streptococcus pneumoniae R6
uccacuugggaaaccaaa

SEQ ID NO: 2185286 - RNA, 19 nt, Streptococcus pneumoniae R6
uccacuggauaauuucuuu

SEQ ID NO: 2185287 - RNA, 22 nt, Streptococcus pneumoniae R6
uccacugcaauuucuaaaaaau

SEQ ID NO: 2185288 - RNA, 13 nt, Streptococcus pneumoniae R6
uccacugaaucgu

SEQ ID NO: 2185289 - RNA, 20 nt, Streptococcus pneumoniae R6
uccacucaaaucauuucuuu

SEQ ID NO: 2185290 - RNA, 14 nt, Streptococcus pneumoniae R6
uccacucaacauua

SEQ ID NO: 2185291 - RNA, 20 nt, Streptococcus pneumoniae R6
uccacuauaauaaaaugaaa

SEQ ID NO: 2185292 - RNA, 22 nt, Streptococcus pneumoniae R6
uccacuauaauaaaaugaaaua

SEQ ID NO: 2185293 - RNA, 15 nt, Streptococcus pneumoniae R6
uccagagcauucuuu

SEQ ID NO: 2185294 - RNA, 16 nt, Streptococcus pneumoniae R6
uccagaauacuugauc

SEQ ID NO: 2185295 - RNA, 20 nt, Streptococcus pneumoniae R6
uccagaccaccuuccuuggu

SEQ ID NO: 2185296 - RNA, 19 nt, Streptococcus pneumoniae R6
uccagacccugcacaaaga

SEQ ID NO: 2185297 - RNA, 18 nt, Streptococcus pneumoniae R6
uccagaaccguucaaggu

SEQ ID NO: 2185298 - RNA, 19 nt, Streptococcus pneumoniae R6
uccagaacuucaauaauuu

SEQ ID NO: 2185299 - RNA, 16 nt, Streptococcus pneumoniae R6
uccagauuaggaacua

SEQ ID NO: 2185300 - RNA, 17 nt, Streptococcus pneumoniae R6
uccagauuaucuuccuu

SEQ ID NO: 2185301 - RNA, 18 nt, Streptococcus pneumoniae R6
uccagauuaucuuccuua

SEQ ID NO: 2185302 - RNA, 22 nt, Streptococcus pneumoniae R6
uccaagacuuucaauucuucac

SEQ ID NO: 2185303 - RNA, 21 nt, Streptococcus pneumoniae R6
uccaagcaaggcuagugggag

SEQ ID NO: 2185304 - RNA, 14 nt, Streptococcus pneumoniae R6
uccaacucaggaaa

SEQ ID NO: 2185305 - RNA, 21 nt, Streptococcus pneumoniae R6
uccaacucaggaaagaugaua

SEQ ID NO: 2185306 - RNA, 17 nt, Streptococcus pneumoniae R6
uccaacugcaaguccag

SEQ ID NO: 2185307 - RNA, 17 nt, Streptococcus pneumoniae R6
uccaagaaagagaauaa

SEQ ID NO: 2185308 - RNA, 16 nt, Streptococcus pneumoniae R6
uccaauaauucaccua

SEQ ID NO: 2185309 - RNA, 17 nt, Streptococcus pneumoniae R6
uccaaguggaagucugu

SEQ ID NO: 2185310 - RNA, 22 nt, Streptococcus pneumoniae R6
uccaaguggaauucauuuucuu

SEQ ID NO: 2185311 - RNA, 22 nt, Streptococcus pneumoniae R6
uccaaguuugcaaaguuuucuu

SEQ ID NO: 2185312 - RNA, 14 nt, Streptococcus pneumoniae R6
uccaaguuuuguug

SEQ ID NO: 2185313 - RNA, 16 nt, Streptococcus pneumoniae R6
uccaagccuuacucuu

SEQ ID NO: 2185314 - RNA, 20 nt, Streptococcus pneumoniae R6
uccaagccuuacucuuucga

SEQ ID NO: 2185315 - RNA, 21 nt, Streptococcus pneumoniae R6
uccaauucugcuuuuaaauag

SEQ ID NO: 2185316 - RNA, 13 nt, Streptococcus pneumoniae R6
uccaauucuucag

SEQ ID NO: 2185317 - RNA, 21 nt, Streptococcus pneumoniae R6
uccaauccuuguaugacaucu

SEQ ID NO: 2185318 - RNA, 14 nt, Streptococcus pneumoniae R6
uccaaucagaugac

SEQ ID NO: 2185319 - RNA, 15 nt, Streptococcus pneumoniae R6
uccaauuucuuuuca

SEQ ID NO: 2185320 - RNA, 16 nt, Streptococcus pneumoniae R6
uccaauuuguuuucaa

SEQ ID NO: 2185321 - RNA, 21 nt, Streptococcus pneumoniae R6
uccaauuuguuuucaagugac

SEQ ID NO: 2185322 - RNA, 14 nt, Streptococcus pneumoniae R6
uccaauugaggaag

SEQ ID NO: 2185323 - RNA, 13 nt, Streptococcus pneumoniae R6
uccaauugauuaa

SEQ ID NO: 2185324 - RNA, 14 nt, Streptococcus pneumoniae R6
uccaauugauuaag

SEQ ID NO: 2185325 - RNA, 19 nt, Streptococcus pneumoniae R6
uccacaaccucaaaacaau

SEQ ID NO: 2185326 - RNA, 19 nt, Streptococcus pneumoniae R6
uccacaaccucaaaacagu

SEQ ID NO: 2185327 - RNA, 16 nt, Streptococcus pneumoniae R6
uccacaaccuuaaaac

SEQ ID NO: 2185328 - RNA, 19 nt, Streptococcus pneumoniae R6
uccacaaccuuaaaacagu

SEQ ID NO: 2185329 - RNA, 22 nt, Streptococcus pneumoniae R6
uccacaaccuuaaaacaguguu

SEQ ID NO: 2185330 - RNA, 17 nt, Streptococcus pneumoniae R6
uccaccauaguguuucu

SEQ ID NO: 2185331 - RNA, 19 nt, Streptococcus pneumoniae R6
uccaccagcuauuaagaaa

SEQ ID NO: 2185332 - RNA, 19 nt, Streptococcus pneumoniae R6
uccacauccaaaugguugg

SEQ ID NO: 2185333 - RNA, 20 nt, Streptococcus pneumoniae R6
uccacagccuugacucccca

SEQ ID NO: 2185334 - RNA, 15 nt, Streptococcus pneumoniae R6
uccacagaccugucc

SEQ ID NO: 2185335 - RNA, 13 nt, Streptococcus pneumoniae R6
uccccaucuucaa

SEQ ID NO: 2185336 - RNA, 15 nt, Streptococcus pneumoniae R6
uccccaucuucaacu

SEQ ID NO: 2185337 - RNA, 22 nt, Streptococcus pneumoniae R6
uccccaguuacuuucuagggca

SEQ ID NO: 2185338 - RNA, 19 nt, Streptococcus pneumoniae R6
ucccccugauaauacuuga

SEQ ID NO: 2185339 - RNA, 14 nt, Streptococcus pneumoniae R6
ucccaucauuccuu

SEQ ID NO: 2185340 - RNA, 17 nt, Streptococcus pneumoniae R6
ucccaucauuccuucaa

SEQ ID NO: 2185341 - RNA, 22 nt, Streptococcus pneumoniae R6
ucccaucgcgaccaagagcaaa

SEQ ID NO: 2185342 - RNA, 12 nt, Streptococcus pneumoniae R6
ucccaugcuucc

SEQ ID NO: 2185343 - RNA, 13 nt, Streptococcus pneumoniae R6
ucccaugcuucca

SEQ ID NO: 2185344 - RNA, 17 nt, Streptococcus pneumoniae R6
ucccaugacaaucauuu

SEQ ID NO: 2185345 - RNA, 16 nt, Streptococcus pneumoniae R6
ucccauugcaauccca

SEQ ID NO: 2185346 - RNA, 13 nt, Streptococcus pneumoniae R6
ucccauucuucag

SEQ ID NO: 2185347 - RNA, 15 nt, Streptococcus pneumoniae R6
ucccauuuucagaaa

SEQ ID NO: 2185348 - RNA, 16 nt, Streptococcus pneumoniae R6
uccccaaucgguuaca

SEQ ID NO: 2185349 - RNA, 23 nt, Streptococcus pneumoniae R6
ucccauuuuuggaucauaaccua

SEQ ID NO: 2185350 - RNA, 16 nt, Streptococcus pneumoniae R6
uccccaagggaccaaa

SEQ ID NO: 2185351 - RNA, 19 nt, Streptococcus pneumoniae R6
ucccagagcuauaagccca

SEQ ID NO: 2185352 - RNA, 16 nt, Streptococcus pneumoniae R6
ucccauaaaaauaaua

SEQ ID NO: 2185353 - RNA, 13 nt, Streptococcus pneumoniae R6
ucccaguuuucuu

SEQ ID NO: 2185354 - RNA, 16 nt, Streptococcus pneumoniae R6
ucccaguuuucuucgg

SEQ ID NO: 2185355 - RNA, 21 nt, Streptococcus pneumoniae R6
uccaucguuccugucuuauuu

SEQ ID NO: 2185356 - RNA, 12 nt, Streptococcus pneumoniae R6
uccaucuccaac

SEQ ID NO: 2185357 - RNA, 15 nt, Streptococcus pneumoniae R6
uccaucuacaaccuu

SEQ ID NO: 2185358 - RNA, 18 nt, Streptococcus pneumoniae R6
uccaucuucucacguccu

SEQ ID NO: 2185359 - RNA, 17 nt, Streptococcus pneumoniae R6
uccauggaauaccaaua

SEQ ID NO: 2185360 - RNA, 15 nt, Streptococcus pneumoniae R6
uccaugcucuuucau

SEQ ID NO: 2185361 - RNA, 22 nt, Streptococcus pneumoniae R6
uccaugauaaugguaucacauu

SEQ ID NO: 2185362 - RNA, 18 nt, Streptococcus pneumoniae R6
uccaugaugcugguuguc

SEQ ID NO: 2185363 - RNA, 15 nt, Streptococcus pneumoniae R6
uccauucacaacauc

SEQ ID NO: 2185364 - RNA, 20 nt, Streptococcus pneumoniae R6
uccauuaugaagaacaccua

SEQ ID NO: 2185365 - RNA, 20 nt, Streptococcus pneumoniae R6
uccauucuuuuuuaauucuu

SEQ ID NO: 2185366 - RNA, 23 nt, Streptococcus pneumoniae R6
uccauucuuuuuuaauucuuuuu

SEQ ID NO: 2185367 - RNA, 20 nt, Streptococcus pneumoniae R6
uccauguuaugauucuccuu

SEQ ID NO: 2185368 - RNA, 18 nt, Streptococcus pneumoniae R6
uccaugguaucaaaggca

SEQ ID NO: 2185369 - RNA, 23 nt, Streptococcus pneumoniae R6
uccauuuggcaccgaauuuuuca

SEQ ID NO: 2185370 - RNA, 16 nt, Streptococcus pneumoniae R6
uccauuucuuugucuc

SEQ ID NO: 2185371 - RNA, 20 nt, Streptococcus pneumoniae R6
uccauuucuuugucuccaac

SEQ ID NO: 2185372 - RNA, 20 nt, Streptococcus pneumoniae R6
ucccaaucgauuuguucuca

SEQ ID NO: 2185373 - RNA, 14 nt, Streptococcus pneumoniae R6
ucccaaguaaauua

SEQ ID NO: 2185374 - RNA, 19 nt, Streptococcus pneumoniae R6
ucccaaguaguaguuucag

SEQ ID NO: 2185375 - RNA, 14 nt, Streptococcus pneumoniae R6
ucccacaauaaaac

SEQ ID NO: 2185376 - RNA, 17 nt, Streptococcus pneumoniae R6
ucccacccauauuuuuc

SEQ ID NO: 2185377 - RNA, 18 nt, Streptococcus pneumoniae R6
ucccacccauauuuuucc

SEQ ID NO: 2185378 - RNA, 22 nt, Streptococcus pneumoniae R6
ucccaccaaacuuucccuucgu

SEQ ID NO: 2185379 - RNA, 19 nt, Streptococcus pneumoniae R6
ucccacuaucuaaaaaaau

SEQ ID NO: 2185380 - RNA, 21 nt, Streptococcus pneumoniae R6
ucccgaaccguguuguaugaa

SEQ ID NO: 2185381 - RNA, 17 nt, Streptococcus pneumoniae R6
uccccuaggagaugagc

SEQ ID NO: 2185382 - RNA, 17 nt, Streptococcus pneumoniae R6
ucccuacaaggaagccu

SEQ ID NO: 2185383 - RNA, 19 nt, Streptococcus pneumoniae R6
ucccuaaagggauccucau

SEQ ID NO: 2185384 - RNA, 23 nt, Streptococcus pneumoniae R6
ucccuaauaauacaaaaaauagu

SEQ ID NO: 2185385 - RNA, 18 nt, Streptococcus pneumoniae R6
ucccgucucaugaaagga

SEQ ID NO: 2185386 - RNA, 13 nt, Streptococcus pneumoniae R6
ucccguaucuuug

SEQ ID NO: 2185387 - RNA, 19 nt, Streptococcus pneumoniae R6
ucccucuuuuuacaauugu

SEQ ID NO: 2185388 - RNA, 18 nt, Streptococcus pneumoniae R6
ucccugguaaaagagcaa

SEQ ID NO: 2185389 - RNA, 19 nt, Streptococcus pneumoniae R6
ucccugguaaaagagcaag

SEQ ID NO: 2185390 - RNA, 19 nt, Streptococcus pneumoniae R6
ucccugcauuucuuuuauc

SEQ ID NO: 2185391 - RNA, 20 nt, Streptococcus pneumoniae R6
ucccugccucauaucugucu

SEQ ID NO: 2185392 - RNA, 13 nt, Streptococcus pneumoniae R6
ucccuuaucauua

SEQ ID NO: 2185393 - RNA, 15 nt, Streptococcus pneumoniae R6
ucccuucaauggagu

SEQ ID NO: 2185394 - RNA, 22 nt, Streptococcus pneumoniae R6
ucccuucaauggaguaaaaaaa

SEQ ID NO: 2185395 - RNA, 20 nt, Streptococcus pneumoniae R6
ucccuuuuuaagauuuuacc

SEQ ID NO: 2185396 - RNA, 18 nt, Streptococcus pneumoniae R6
ucccuuuuugauuuuaaa

SEQ ID NO: 2185397 - RNA, 22 nt, Streptococcus pneumoniae R6
ucccuuuugcucggcauuguga

SEQ ID NO: 2185398 - RNA, 15 nt, Streptococcus pneumoniae R6
ucccuuuccaagaau

SEQ ID NO: 2185399 - RNA, 10 nt, Streptococcus pneumoniae R6
ucccuuguuu

SEQ ID NO: 2185400 - RNA, 20 nt, Streptococcus pneumoniae R6
ucccuuguuuaguaaacaaa

SEQ ID NO: 2185401 - RNA, 17 nt, Streptococcus pneumoniae R6
uccgaagacuuuaaaaa

SEQ ID NO: 2185402 - RNA, 19 nt, Streptococcus pneumoniae R6
uccgaaccacaacaaaaaa

SEQ ID NO: 2185403 - RNA, 16 nt, Streptococcus pneumoniae R6
uccgaacccuguuuua

SEQ ID NO: 2185404 - RNA, 16 nt, Streptococcus pneumoniae R6
uccgaauagcucaaaa

SEQ ID NO: 2185405 - RNA, 18 nt, Streptococcus pneumoniae R6
uccgaauagcucaaaagc

SEQ ID NO: 2185406 - RNA, 14 nt, Streptococcus pneumoniae R6
uccgaauaaauaga

SEQ ID NO: 2185407 - RNA, 16 nt, Streptococcus pneumoniae R6
uccgaagggcuauuuu

SEQ ID NO: 2185408 - RNA, 21 nt, Streptococcus pneumoniae R6
uccgaagauuuaguucuguau

SEQ ID NO: 2185409 - RNA, 13 nt, Streptococcus pneumoniae R6
uccgaacuugugg

SEQ ID NO: 2185410 - RNA, 18 nt, Streptococcus pneumoniae R6
uccgacuucaauaaaaua

SEQ ID NO: 2185411 - RNA, 23 nt, Streptococcus pneumoniae R6
uccgagauaaaagauagcuauga

SEQ ID NO: 2185412 - RNA, 12 nt, Streptococcus pneumoniae R6
uccgauaugugu

SEQ ID NO: 2185413 - RNA, 16 nt, Streptococcus pneumoniae R6
uccgaguuuuucagcc

SEQ ID NO: 2185414 - RNA, 14 nt, Streptococcus pneumoniae R6
uccgauagcaucau

SEQ ID NO: 2185415 - RNA, 14 nt, Streptococcus pneumoniae R6
uccgauuucagaau

SEQ ID NO: 2185416 - RNA, 15 nt, Streptococcus pneumoniae R6
uccgauuucagaauc

SEQ ID NO: 2185417 - RNA, 19 nt, Streptococcus pneumoniae R6
uccgauguguuggguagca

SEQ ID NO: 2185418 - RNA, 18 nt, Streptococcus pneumoniae R6
ucgcucaguguaguuuua

SEQ ID NO: 2185419 - RNA, 22 nt, Streptococcus pneumoniae R6
ucgcuauuuuuugaaucaauuu

SEQ ID NO: 2185420 - RNA, 16 nt, Streptococcus pneumoniae R6
ucgcugaguaaagacu

SEQ ID NO: 2185421 - RNA, 12 nt, Streptococcus pneumoniae R6
ucgcuugcuaga

SEQ ID NO: 2185422 - RNA, 21 nt, Streptococcus pneumoniae R6
ucggaauagcucaaaaguuua

SEQ ID NO: 2185423 - RNA, 14 nt, Streptococcus pneumoniae R6
ucggaaagccaaau

SEQ ID NO: 2185424 - RNA, 18 nt, Streptococcus pneumoniae R6
ucggaaagccaaaucaau

SEQ ID NO: 2185425 - RNA, 17 nt, Streptococcus pneumoniae R6
ucggaacaucuuuucca

SEQ ID NO: 2185426 - RNA, 14 nt, Streptococcus pneumoniae R6
ucggacuuuuucca

SEQ ID NO: 2185427 - RNA, 20 nt, Streptococcus pneumoniae R6
ucgccucacuaucgaaaaau

SEQ ID NO: 2185428 - RNA, 18 nt, Streptococcus pneumoniae R6
ucgagaaaggggcucuuu

SEQ ID NO: 2185429 - RNA, 20 nt, Streptococcus pneumoniae R6
ucgagaaaggggcucuuugu

SEQ ID NO: 2185430 - RNA, 22 nt, Streptococcus pneumoniae R6
ucgagaaaggggcucuuuguca

SEQ ID NO: 2185431 - RNA, 21 nt, Streptococcus pneumoniae R6
ucgagacauaccauuuuccaa

SEQ ID NO: 2185432 - RNA, 20 nt, Streptococcus pneumoniae R6
ucgagacaacgcacaccaga

SEQ ID NO: 2185433 - RNA, 16 nt, Streptococcus pneumoniae R6
ucgagcaguuccauca

SEQ ID NO: 2185434 - RNA, 17 nt, Streptococcus pneumoniae R6
ucgagcaguuccaucaa

SEQ ID NO: 2185435 - RNA, 20 nt, Streptococcus pneumoniae R6
ucgagcaguuccaucaaucu

SEQ ID NO: 2185436 - RNA, 22 nt, Streptococcus pneumoniae R6
ucgacuggcaaaggcaugggcc

SEQ ID NO: 2185437 - RNA, 18 nt, Streptococcus pneumoniae R6
ucgacuucaggaaaaaau

SEQ ID NO: 2185438 - RNA, 14 nt, Streptococcus pneumoniae R6
ucgaaugauauuuu

SEQ ID NO: 2185439 - RNA, 18 nt, Streptococcus pneumoniae R6
ucgaaugacuacauuuuu

SEQ ID NO: 2185440 - RNA, 14 nt, Streptococcus pneumoniae R6
ucgaagcuugcuuc

SEQ ID NO: 2185441 - RNA, 13 nt, Streptococcus pneumoniae R6
ucgaagcuuccaa

SEQ ID NO: 2185442 - RNA, 18 nt, Streptococcus pneumoniae R6
ucgaagcuuccaauaaua

SEQ ID NO: 2185443 - RNA, 13 nt, Streptococcus pneumoniae R6
uccuuaaacucuu

SEQ ID NO: 2185444 - RNA, 13 nt, Streptococcus pneumoniae R6
uccuguuucagga

SEQ ID NO: 2185445 - RNA, 17 nt, Streptococcus pneumoniae R6
uccuguucuuguuucaa

SEQ ID NO: 2185446 - RNA, 15 nt, Streptococcus pneumoniae R6
uccuguugcuucauc

SEQ ID NO: 2185447 - RNA, 15 nt, Streptococcus pneumoniae R6
uccuguuguaauuuu

SEQ ID NO: 2185448 - RNA, 22 nt, Streptococcus pneumoniae R6
ucgaagaguauaaaauuuugac

SEQ ID NO: 2185449 - RNA, 23 nt, Streptococcus pneumoniae R6
ucgaagaguauuagccuuccaua

SEQ ID NO: 2185450 - RNA, 17 nt, Streptococcus pneumoniae R6
ucgacaggaguguagag

SEQ ID NO: 2185451 - RNA, 18 nt, Streptococcus pneumoniae R6
ucgaccucuaccaagccc

SEQ ID NO: 2185452 - RNA, 16 nt, Streptococcus pneumoniae R6
ucgcauuugagcgaaa

SEQ ID NO: 2185453 - RNA, 22 nt, Streptococcus pneumoniae R6
ucgcagcaucgagaauuucugg

SEQ ID NO: 2185454 - RNA, 21 nt, Streptococcus pneumoniae R6
ucgcaaaggcgcgaucuugua

SEQ ID NO: 2185455 - RNA, 16 nt, Streptococcus pneumoniae R6
ucgauuauuuuuucuc

SEQ ID NO: 2185456 - RNA, 13 nt, Streptococcus pneumoniae R6
ucgauuuuuucac

SEQ ID NO: 2185457 - RNA, 19 nt, Streptococcus pneumoniae R6
ucgaugguugucccuggga

SEQ ID NO: 2185458 - RNA, 18 nt, Streptococcus pneumoniae R6
ucgauaauaccuaccaga

SEQ ID NO: 2185459 - RNA, 19 nt, Streptococcus pneumoniae R6
ucgaucaguccuauuccuu

SEQ ID NO: 2185460 - RNA, 16 nt, Streptococcus pneumoniae R6
uccugauaccaaccag

SEQ ID NO: 2185461 - RNA, 19 nt, Streptococcus pneumoniae R6
uccugauagaguuguucac

SEQ ID NO: 2185462 - RNA, 18 nt, Streptococcus pneumoniae R6
uccugaucgauuuguucu

SEQ ID NO: 2185463 - RNA, 15 nt, Streptococcus pneumoniae R6
uccugauuaccaacu

SEQ ID NO: 2185464 - RNA, 22 nt, Streptococcus pneumoniae R6
uccugauuaccaacuacuccuc

SEQ ID NO: 2185465 - RNA, 19 nt, Streptococcus pneumoniae R6
uccugagaacuaaauuacu

SEQ ID NO: 2185466 - RNA, 18 nt, Streptococcus pneumoniae R6
uccugagaugacaacaug

SEQ ID NO: 2185467 - RNA, 21 nt, Streptococcus pneumoniae R6
uccugcaaaacuagaauccua

SEQ ID NO: 2185468 - RNA, 19 nt, Streptococcus pneumoniae R6
uccugcaaaucuacuggca

SEQ ID NO: 2185469 - RNA, 17 nt, Streptococcus pneumoniae R6
uccugcaaggcauaaac

SEQ ID NO: 2185470 - RNA, 17 nt, Streptococcus pneumoniae R6
uccugcccacuaaaaau

SEQ ID NO: 2185471 - RNA, 18 nt, Streptococcus pneumoniae R6
uccugcccacuaaaaaua

SEQ ID NO: 2185472 - RNA, 19 nt, Streptococcus pneumoniae R6
uccuguguacuguucuaaa

SEQ ID NO: 2185473 - RNA, 13 nt, Streptococcus pneumoniae R6
uccugcgacuacu

SEQ ID NO: 2185474 - RNA, 15 nt, Streptococcus pneumoniae R6
uccuggcguaguaaa

SEQ ID NO: 2185475 - RNA, 14 nt, Streptococcus pneumoniae R6
uccugaaaaucauc

SEQ ID NO: 2185476 - RNA, 20 nt, Streptococcus pneumoniae R6
uccugaaauaagggcaaaga

SEQ ID NO: 2185477 - RNA, 20 nt, Streptococcus pneumoniae R6
uccugaaugauuucuucuug

SEQ ID NO: 2185478 - RNA, 13 nt, Streptococcus pneumoniae R6
uccucuuuuuccc

SEQ ID NO: 2185479 - RNA, 18 nt, Streptococcus pneumoniae R6
uccucguagcggauuuuc

SEQ ID NO: 2185480 - RNA, 23 nt, Streptococcus pneumoniae R6
uccucuaucaugcgaaucaauuu

SEQ ID NO: 2185481 - RNA, 20 nt, Streptococcus pneumoniae R6
uccucuaacuggaaagauaa

SEQ ID NO: 2185482 - RNA, 14 nt, Streptococcus pneumoniae R6
uccucgcaagagac

SEQ ID NO: 2185483 - RNA, 21 nt, Streptococcus pneumoniae R6
uccuauuuucuucuuuauaau

SEQ ID NO: 2185484 - RNA, 15 nt, Streptococcus pneumoniae R6
uccucaaaauucugu

SEQ ID NO: 2185485 - RNA, 17 nt, Streptococcus pneumoniae R6
uccucaaaauucugucu

SEQ ID NO: 2185486 - RNA, 23 nt, Streptococcus pneumoniae R6
uccucagcacggagaaucuuccc

SEQ ID NO: 2185487 - RNA, 21 nt, Streptococcus pneumoniae R6
uccucaaugaguccgaaaaau

SEQ ID NO: 2185488 - RNA, 22 nt, Streptococcus pneumoniae R6
uccucaaugaguccgaaaaauu

SEQ ID NO: 2185489 - RNA, 12 nt, Streptococcus pneumoniae R6
uccucaauuuga

SEQ ID NO: 2185490 - RNA, 21 nt, Streptococcus pneumoniae R6
uccucaauaaguccgaaaaau

SEQ ID NO: 2185491 - RNA, 22 nt, Streptococcus pneumoniae R6
uccucaauaaguccgaaaaauu

SEQ ID NO: 2185492 - RNA, 16 nt, Streptococcus pneumoniae R6
uccuauggguucguga

SEQ ID NO: 2185493 - RNA, 14 nt, Streptococcus pneumoniae R6
uccuaucaaguuca

SEQ ID NO: 2185494 - RNA, 19 nt, Streptococcus pneumoniae R6
uccuauucuuauuucauuu

SEQ ID NO: 2185495 - RNA, 14 nt, Streptococcus pneumoniae R6
uccuauucuuguuu

SEQ ID NO: 2185496 - RNA, 15 nt, Streptococcus pneumoniae R6
uccuauucuuguuuc

SEQ ID NO: 2185497 - RNA, 16 nt, Streptococcus pneumoniae R6
uccuauucuuguuuca

SEQ ID NO: 2185498 - RNA, 14 nt, Streptococcus pneumoniae R6
uccuaguuugcucu

SEQ ID NO: 2185499 - RNA, 18 nt, Streptococcus pneumoniae R6
uccuagucuacaaauuca

SEQ ID NO: 2185500 - RNA, 20 nt, Streptococcus pneumoniae R6
uccuagucuacaaauucaaa

SEQ ID NO: 2185501 - RNA, 15 nt, Streptococcus pneumoniae R6
uccuagauacaguga

SEQ ID NO: 2185502 - RNA, 18 nt, Streptococcus pneumoniae R6
uccuagccuauuuuuuau

SEQ ID NO: 2185503 - RNA, 15 nt, Streptococcus pneumoniae R6
uccuauagaaaaauc

SEQ ID NO: 2185504 - RNA, 22 nt, Streptococcus pneumoniae R6
uccuauagaaaaggaguagaaa

SEQ ID NO: 2185505 - RNA, 16 nt, Streptococcus pneumoniae R6
uccucauuucaauaga

SEQ ID NO: 2185506 - RNA, 15 nt, Streptococcus pneumoniae R6
uccucauuuucuagu

SEQ ID NO: 2185507 - RNA, 18 nt, Streptococcus pneumoniae R6
uccuccauaaaaagaccg

SEQ ID NO: 2185508 - RNA, 17 nt, Streptococcus pneumoniae R6
uccucauauuuauuaau

SEQ ID NO: 2185509 - RNA, 13 nt, Streptococcus pneumoniae R6
uccucccuucuuu

SEQ ID NO: 2185510 - RNA, 18 nt, Streptococcus pneumoniae R6
uccucccuucuuucucaa

SEQ ID NO: 2185511 - RNA, 13 nt, Streptococcus pneumoniae R6
uccucccauauuu

SEQ ID NO: 2185512 - RNA, 16 nt, Streptococcus pneumoniae R6
uccuccccuuuagaac

SEQ ID NO: 2185513 - RNA, 15 nt, Streptococcus pneumoniae R6
uccuaagcuuucagc

SEQ ID NO: 2185514 - RNA, 19 nt, Streptococcus pneumoniae R6
uccuaagcuuucagcagcu

SEQ ID NO: 2185515 - RNA, 11 nt, Streptococcus pneumoniae R6
uccuaaggagu

SEQ ID NO: 2185516 - RNA, 21 nt, Streptococcus pneumoniae R6
uccuaaauagaagauaaagag

SEQ ID NO: 2185517 - RNA, 19 nt, Streptococcus pneumoniae R6
uccuaaacagaauuggcua

SEQ ID NO: 2185518 - RNA, 19 nt, Streptococcus pneumoniae R6
uccguuuuuugaaguuuuc

SEQ ID NO: 2185519 - RNA, 20 nt, Streptococcus pneumoniae R6
uccuacaaugaucaagauga

SEQ ID NO: 2185520 - RNA, 22 nt, Streptococcus pneumoniae R6
uccuacaaugaucaagaugaga

SEQ ID NO: 2185521 - RNA, 19 nt, Streptococcus pneumoniae R6
uccuacauauguaagaaga

SEQ ID NO: 2185522 - RNA, 18 nt, Streptococcus pneumoniae R6
uccuacuugcuucccauu

SEQ ID NO: 2185523 - RNA, 19 nt, Streptococcus pneumoniae R6
uccuacuugcuucccauuu

SEQ ID NO: 2185524 - RNA, 16 nt, Streptococcus pneumoniae R6
uccguguaaaaccuuu

SEQ ID NO: 2185525 - RNA, 14 nt, Streptococcus pneumoniae R6
uccguuuuucuccu

SEQ ID NO: 2185526 - RNA, 14 nt, Streptococcus pneumoniae R6
uccgucgcauauuu

SEQ ID NO: 2185527 - RNA, 19 nt, Streptococcus pneumoniae R6
uccguauucuuauuucaaa

SEQ ID NO: 2185528 - RNA, 21 nt, Streptococcus pneumoniae R6
uccguaaaacgauaaauuccc

SEQ ID NO: 2185529 - RNA, 20 nt, Streptococcus pneumoniae R6
uccgcacugucguuccuuuu

SEQ ID NO: 2185530 - RNA, 17 nt, Streptococcus pneumoniae R6
uccgcaaggaugguaua

SEQ ID NO: 2185531 - RNA, 18 nt, Streptococcus pneumoniae R6
uccgcuuuuaucaaagac

SEQ ID NO: 2185532 - RNA, 13 nt, Streptococcus pneumoniae R6
uccggaaaccaaa

SEQ ID NO: 2185533 - RNA, 15 nt, Streptococcus pneumoniae R6
uccggaaaccaaagg

SEQ ID NO: 2185534 - RNA, 15 nt, Streptococcus pneumoniae R6
uccgccuccagagaa

SEQ ID NO: 2185535 - RNA, 17 nt, Streptococcus pneumoniae R6
ucucauuugaugagaaa

SEQ ID NO: 2185536 - RNA, 13 nt, Streptococcus pneumoniae R6
ucuccacagaccu

SEQ ID NO: 2185537 - RNA, 14 nt, Streptococcus pneumoniae R6
ucuccacagaccug

SEQ ID NO: 2185538 - RNA, 14 nt, Streptococcus pneumoniae R6
ucuccaauccuugu

SEQ ID NO: 2185539 - RNA, 18 nt, Streptococcus pneumoniae R6
ucuccaaccaucaaaaua

SEQ ID NO: 2185540 - RNA, 20 nt, Streptococcus pneumoniae R6
ucuccaaagauagaauccau

SEQ ID NO: 2185541 - RNA, 12 nt, Streptococcus pneumoniae R6
ucucauagccau

SEQ ID NO: 2185542 - RNA, 19 nt, Streptococcus pneumoniae R6
ucucauagccauaaaacau

SEQ ID NO: 2185543 - RNA, 20 nt, Streptococcus pneumoniae R6
ucucauagccauaaaacauu

SEQ ID NO: 2185544 - RNA, 15 nt, Streptococcus pneumoniae R6
ucucaguucugagga

SEQ ID NO: 2185545 - RNA, 16 nt, Streptococcus pneumoniae R6
ucucaggcuuuuucug

SEQ ID NO: 2185546 - RNA, 21 nt, Streptococcus pneumoniae R6
ucuccguaaaagacacaugga

SEQ ID NO: 2185547 - RNA, 12 nt, Streptococcus pneumoniae R6
ucuccuaaaauu

SEQ ID NO: 2185548 - RNA, 23 nt, Streptococcus pneumoniae R6
ucuccuaaaauugacuuucuugu

SEQ ID NO: 2185549 - RNA, 16 nt, Streptococcus pneumoniae R6
ucuccuaaaauugugu

SEQ ID NO: 2185550 - RNA, 14 nt, Streptococcus pneumoniae R6
ucuccguuuuuaau

SEQ ID NO: 2185551 - RNA, 16 nt, Streptococcus pneumoniae R6
ucuccuagucuacaaa

SEQ ID NO: 2185552 - RNA, 22 nt, Streptococcus pneumoniae R6
ucuccugugcuccauuuuuuaa

SEQ ID NO: 2185553 - RNA, 13 nt, Streptococcus pneumoniae R6
ucuccuguuucaa

SEQ ID NO: 2185554 - RNA, 18 nt, Streptococcus pneumoniae R6
ucuccuacuugcuuccca

SEQ ID NO: 2185555 - RNA, 16 nt, Streptococcus pneumoniae R6
ucuccuuagucucaaa

SEQ ID NO: 2185556 - RNA, 17 nt, Streptococcus pneumoniae R6
ucuccauuacuugcauu

SEQ ID NO: 2185557 - RNA, 12 nt, Streptococcus pneumoniae R6
ucuccauccuca

SEQ ID NO: 2185558 - RNA, 16 nt, Streptococcus pneumoniae R6
ucucacacggaaacag

SEQ ID NO: 2185559 - RNA, 23 nt, Streptococcus pneumoniae R6
ucucaauuucuauuuuaaaaaua

SEQ ID NO: 2185560 - RNA, 19 nt, Streptococcus pneumoniae R6
ucucaaucaguuuuuucac

SEQ ID NO: 2185561 - RNA, 14 nt, Streptococcus pneumoniae R6
ucucacuuaauucu

SEQ ID NO: 2185562 - RNA, 17 nt, Streptococcus pneumoniae R6
ucucacuuaauucuuca

SEQ ID NO: 2185563 - RNA, 19 nt, Streptococcus pneumoniae R6
ucucacuuaauucuucaua

SEQ ID NO: 2185564 - RNA, 13 nt, Streptococcus pneumoniae R6
ucucagauaauaa

SEQ ID NO: 2185565 - RNA, 18 nt, Streptococcus pneumoniae R6
ucucacuaugauuagguu

SEQ ID NO: 2185566 - RNA, 14 nt, Streptococcus pneumoniae R6
ucucacuauucauc

SEQ ID NO: 2185567 - RNA, 17 nt, Streptococcus pneumoniae R6
ucucacgguaaauguag

SEQ ID NO: 2185568 - RNA, 22 nt, Streptococcus pneumoniae R6
ucucacguaacauauuuucaaa

SEQ ID NO: 2185569 - RNA, 15 nt, Streptococcus pneumoniae R6
ucuauuucuuuaaaa

SEQ ID NO: 2185570 - RNA, 15 nt, Streptococcus pneumoniae R6
ucuauuuuaaaaaua

SEQ ID NO: 2185571 - RNA, 13 nt, Streptococcus pneumoniae R6
ucuauuuuaaaaa

SEQ ID NO: 2185572 - RNA, 17 nt, Streptococcus pneumoniae R6
ucuauuuaccccaccuc

SEQ ID NO: 2185573 - RNA, 22 nt, Streptococcus pneumoniae R6
ucuauuuaagucaaagccaauc

SEQ ID NO: 2185574 - RNA, 21 nt, Streptococcus pneumoniae R6
ucuauuguugcauuaaaaagu

SEQ ID NO: 2185575 - RNA, 15 nt, Streptococcus pneumoniae R6
ucuauugauuagucc

SEQ ID NO: 2185576 - RNA, 18 nt, Streptococcus pneumoniae R6
ucuauuguagaguggcuu

SEQ ID NO: 2185577 - RNA, 21 nt, Streptococcus pneumoniae R6
ucucaaacagugcuagaaauu

SEQ ID NO: 2185578 - RNA, 17 nt, Streptococcus pneumoniae R6
ucuauuuuuaaauuuua

SEQ ID NO: 2185579 - RNA, 21 nt, Streptococcus pneumoniae R6
ucuauuuuuacucaaggacua

SEQ ID NO: 2185580 - RNA, 21 nt, Streptococcus pneumoniae R6
ucuauuuuugagcagaacaau

SEQ ID NO: 2185581 - RNA, 16 nt, Streptococcus pneumoniae R6
ucuauuuucuuugauu

SEQ ID NO: 2185582 - RNA, 23 nt, Streptococcus pneumoniae R6
ucucaaaaguuagaaauaaaacu

SEQ ID NO: 2185583 - RNA, 20 nt, Streptococcus pneumoniae R6
ucucaacgcgugauuuguug

SEQ ID NO: 2185584 - RNA, 21 nt, Streptococcus pneumoniae R6
ucuaugcuuuuauucagccaa

SEQ ID NO: 2185585 - RNA, 14 nt, Streptococcus pneumoniae R6
ucuauuauauauau

SEQ ID NO: 2185586 - RNA, 14 nt, Streptococcus pneumoniae R6
ucuauuauuugguu

SEQ ID NO: 2185587 - RNA, 20 nt, Streptococcus pneumoniae R6
ucuauuauuugguuagguga

SEQ ID NO: 2185588 - RNA, 14 nt, Streptococcus pneumoniae R6
ucuauuccaucucc

SEQ ID NO: 2185589 - RNA, 13 nt, Streptococcus pneumoniae R6
ucuaugauuuuca

SEQ ID NO: 2185590 - RNA, 19 nt, Streptococcus pneumoniae R6
ucuaugauaggagcuaugu

SEQ ID NO: 2185591 - RNA, 15 nt, Streptococcus pneumoniae R6
ucuaucuacaaccuc

SEQ ID NO: 2185592 - RNA, 20 nt, Streptococcus pneumoniae R6
ucuaucucaccaggcauuau

SEQ ID NO: 2185593 - RNA, 23 nt, Streptococcus pneumoniae R6
ucuaucugcaaccucaaaacagu

SEQ ID NO: 2185594 - RNA, 20 nt, Streptococcus pneumoniae R6
ucuaucugcaaccuuaaaac

SEQ ID NO: 2185595 - RNA, 23 nt, Streptococcus pneumoniae R6
ucuaucugcaaccuuaaaacagu

SEQ ID NO: 2185596 - RNA, 23 nt, Streptococcus pneumoniae R6
ucuaucuuaguaguuuguauaau

SEQ ID NO: 2185597 - RNA, 18 nt, Streptococcus pneumoniae R6
ucuaucuucauuuugcac

SEQ ID NO: 2185598 - RNA, 20 nt, Streptococcus pneumoniae R6
ucuauccagccuucauaaaa

SEQ ID NO: 2185599 - RNA, 14 nt, Streptococcus pneumoniae R6
ucuauccacaaccu

SEQ ID NO: 2185600 - RNA, 15 nt, Streptococcus pneumoniae R6
ucuauccacaaccuc

SEQ ID NO: 2185601 - RNA, 16 nt, Streptococcus pneumoniae R6
ucuauccacaaccuca

SEQ ID NO: 2185602 - RNA, 21 nt, Streptococcus pneumoniae R6
ucuauccacaaccucaaaaca

SEQ ID NO: 2185603 - RNA, 23 nt, Streptococcus pneumoniae R6
ucuauccacaaccucaaaacagu

SEQ ID NO: 2185604 - RNA, 20 nt, Streptococcus pneumoniae R6
ucuaucaggaaagucaaauu

SEQ ID NO: 2185605 - RNA, 22 nt, Streptococcus pneumoniae R6
ucuaucaugcgaaucaauuuuu

SEQ ID NO: 2185606 - RNA, 15 nt, Streptococcus pneumoniae R6
ucuaucacuccaaaa

SEQ ID NO: 2185607 - RNA, 22 nt, Streptococcus pneumoniae R6
ucuaucagaaagucgugauuuc

SEQ ID NO: 2185608 - RNA, 24 nt, Streptococcus pneumoniae R6
ucuaucagaaagucgugauuucua

SEQ ID NO: 2185609 - RNA, 21 nt, Streptococcus pneumoniae R6
ucuauaggauuuauuuuucuu

SEQ ID NO: 2185610 - RNA, 19 nt, Streptococcus pneumoniae R6
ucuauaggucguguauaga

SEQ ID NO: 2185611 - RNA, 15 nt, Streptococcus pneumoniae R6
ucuauaguuaaauua

SEQ ID NO: 2185612 - RNA, 22 nt, Streptococcus pneumoniae R6
ucuauagaacuaguaaauuguc

SEQ ID NO: 2185613 - RNA, 13 nt, Streptococcus pneumoniae R6
ucuagacuauaac

SEQ ID NO: 2185614 - RNA, 13 nt, Streptococcus pneumoniae R6
ucuagaguccaag

SEQ ID NO: 2185615 - RNA, 23 nt, Streptococcus pneumoniae R6
ucuagaccaugcggaugcaugcc

SEQ ID NO: 2185616 - RNA, 22 nt, Streptococcus pneumoniae R6
ucuagaugaauuacaugaaacu

SEQ ID NO: 2185617 - RNA, 18 nt, Streptococcus pneumoniae R6
ucuagcauaaaagccucc

SEQ ID NO: 2185618 - RNA, 14 nt, Streptococcus pneumoniae R6
ucuagcaagaguuu

SEQ ID NO: 2185619 - RNA, 15 nt, Streptococcus pneumoniae R6
ucuacuucuaaaaca

SEQ ID NO: 2185620 - RNA, 13 nt, Streptococcus pneumoniae R6
ucuacuuuuucaa

SEQ ID NO: 2185621 - RNA, 16 nt, Streptococcus pneumoniae R6
ucuacuuuuuucuaaa

SEQ ID NO: 2185622 - RNA, 22 nt, Streptococcus pneumoniae R6
ucuacuuuuuucuaaagcaauu

SEQ ID NO: 2185623 - RNA, 23 nt, Streptococcus pneumoniae R6
ucuagaaugucuuccaaacgugg

SEQ ID NO: 2185624 - RNA, 14 nt, Streptococcus pneumoniae R6
ucuagaaauuaauu

SEQ ID NO: 2185625 - RNA, 20 nt, Streptococcus pneumoniae R6
ucuagaaaucucuuuuuucu

SEQ ID NO: 2185626 - RNA, 19 nt, Streptococcus pneumoniae R6
ucuaguugguuuccuuggu

SEQ ID NO: 2185627 - RNA, 11 nt, Streptococcus pneumoniae R6
ucuaguuucaa

SEQ ID NO: 2185628 - RNA, 19 nt, Streptococcus pneumoniae R6
ucuaguuuugguuuuucuu

SEQ ID NO: 2185629 - RNA, 21 nt, Streptococcus pneumoniae R6
ucuagucuggagauuuuucaa

SEQ ID NO: 2185630 - RNA, 22 nt, Streptococcus pneumoniae R6
ucuagcuuccccauucuaugga

SEQ ID NO: 2185631 - RNA, 14 nt, Streptococcus pneumoniae R6
ucuaggaauaucaa

SEQ ID NO: 2185632 - RNA, 14 nt, Streptococcus pneumoniae R6
ucuauaaaauauag

SEQ ID NO: 2185633 - RNA, 16 nt, Streptococcus pneumoniae R6
ucuauaaaucaauuuu

SEQ ID NO: 2185634 - RNA, 20 nt, Streptococcus pneumoniae R6
ucuauacacgaccuauagaa

SEQ ID NO: 2185635 - RNA, 13 nt, Streptococcus pneumoniae R6
ucuacuccuuuuc

SEQ ID NO: 2185636 - RNA, 21 nt, Streptococcus pneumoniae R6
ucuacuauacgacaugccugu

SEQ ID NO: 2185637 - RNA, 21 nt, Streptococcus pneumoniae R6
ucuacuauagaaaaaagucuu

SEQ ID NO: 2185638 - RNA, 12 nt, Streptococcus pneumoniae R6
ucuacugaaauu

SEQ ID NO: 2185639 - RNA, 12 nt, Streptococcus pneumoniae R6
ucuacuaaaauu

SEQ ID NO: 2185640 - RNA, 17 nt, Streptococcus pneumoniae R6
ucuacuaaaauuauguu

SEQ ID NO: 2185641 - RNA, 17 nt, Streptococcus pneumoniae R6
ucuacgcuuuaaaaauc

SEQ ID NO: 2185642 - RNA, 16 nt, Streptococcus pneumoniae R6
ucuaccuauucauaua

SEQ ID NO: 2185643 - RNA, 19 nt, Streptococcus pneumoniae R6
ucuaauagacuaucuaaaa

SEQ ID NO: 2185644 - RNA, 21 nt, Streptococcus pneumoniae R6
ucuaauucggugguauuuaga

SEQ ID NO: 2185645 - RNA, 21 nt, Streptococcus pneumoniae R6
ucuaauuauuucaauuaguuu

SEQ ID NO: 2185646 - RNA, 20 nt, Streptococcus pneumoniae R6
ucuaauguacgaauuagguu

SEQ ID NO: 2185647 - RNA, 16 nt, Streptococcus pneumoniae R6
ucuaauguaauucuca

SEQ ID NO: 2185648 - RNA, 12 nt, Streptococcus pneumoniae R6
ucuacaauaaca

SEQ ID NO: 2185649 - RNA, 22 nt, Streptococcus pneumoniae R6
ucuacaaccuuaaaacaguguu

SEQ ID NO: 2185650 - RNA, 15 nt, Streptococcus pneumoniae R6
ucuacaacgucuuuu

SEQ ID NO: 2185651 - RNA, 20 nt, Streptococcus pneumoniae R6
ucuacaacgucuuuugccuu

SEQ ID NO: 2185652 - RNA, 13 nt, Streptococcus pneumoniae R6
ucuaaaauaaguu

SEQ ID NO: 2185653 - RNA, 17 nt, Streptococcus pneumoniae R6
ucuaaaauaaguucugu

SEQ ID NO: 2185654 - RNA, 17 nt, Streptococcus pneumoniae R6
ucuaaaacauugugaga

SEQ ID NO: 2185655 - RNA, 16 nt, Streptococcus pneumoniae R6
ucuaaaauagaaggag

SEQ ID NO: 2185656 - RNA, 16 nt, Streptococcus pneumoniae R6
ucguuuuuacuacaaa

SEQ ID NO: 2185657 - RNA, 18 nt, Streptococcus pneumoniae R6
ucuaaacuguacaagaac

SEQ ID NO: 2185658 - RNA, 19 nt, Streptococcus pneumoniae R6
ucuaaacaaacuccucucc

SEQ ID NO: 2185659 - RNA, 18 nt, Streptococcus pneumoniae R6
ucuaaacaauguucucau

SEQ ID NO: 2185660 - RNA, 18 nt, Streptococcus pneumoniae R6
ucuaaaaucugauuccuu

SEQ ID NO: 2185661 - RNA, 21 nt, Streptococcus pneumoniae R6
ucuaaagaauuugaaaaaaau

SEQ ID NO: 2185662 - RNA, 20 nt, Streptococcus pneumoniae R6
ucuaacauuauugauuccgu

SEQ ID NO: 2185663 - RNA, 19 nt, Streptococcus pneumoniae R6
ucguuugguguaauaaacu

SEQ ID NO: 2185664 - RNA, 22 nt, Streptococcus pneumoniae R6
ucguuugauaaguuugaugaga

SEQ ID NO: 2185665 - RNA, 17 nt, Streptococcus pneumoniae R6
ucguuucugacagagcu

SEQ ID NO: 2185666 - RNA, 15 nt, Streptococcus pneumoniae R6
ucguuucuaauaauu

SEQ ID NO: 2185667 - RNA, 16 nt, Streptococcus pneumoniae R6
ucguuucuaauaauuu

SEQ ID NO: 2185668 - RNA, 16 nt, Streptococcus pneumoniae R6
ucguguugacuugggu

SEQ ID NO: 2185669 - RNA, 22 nt, Streptococcus pneumoniae R6
ucguugaaugaaaugaggcuga

SEQ ID NO: 2185670 - RNA, 20 nt, Streptococcus pneumoniae R6
ucgucacauucccauucccu

SEQ ID NO: 2185671 - RNA, 16 nt, Streptococcus pneumoniae R6
ucgucaguuucaucua

SEQ ID NO: 2185672 - RNA, 18 nt, Streptococcus pneumoniae R6
ucgucaucacgacuaauu

SEQ ID NO: 2185673 - RNA, 12 nt, Streptococcus pneumoniae R6
ucgucaguucca

SEQ ID NO: 2185674 - RNA, 16 nt, Streptococcus pneumoniae R6
ucgucaguucuaucca

SEQ ID NO: 2185675 - RNA, 18 nt, Streptococcus pneumoniae R6
ucgucaguucuaucuaca

SEQ ID NO: 2185676 - RNA, 19 nt, Streptococcus pneumoniae R6
ucguacucucuuuuuugau

SEQ ID NO: 2185677 - RNA, 13 nt, Streptococcus pneumoniae R6
ucguagagaagga

SEQ ID NO: 2185678 - RNA, 19 nt, Streptococcus pneumoniae R6
ucgguuagaccaucuagaa

SEQ ID NO: 2185679 - RNA, 16 nt, Streptococcus pneumoniae R6
ucggcaguuuuuucuu

SEQ ID NO: 2185680 - RNA, 20 nt, Streptococcus pneumoniae R6
ucggcauucuucucuugaaa

SEQ ID NO: 2185681 - RNA, 17 nt, Streptococcus pneumoniae R6
ucgucauuuguuuuagu

SEQ ID NO: 2185682 - RNA, 13 nt, Streptococcus pneumoniae R6
ucguccuuucuuu

SEQ ID NO: 2185683 - RNA, 21 nt, Streptococcus pneumoniae R6
ucgugcaaucucacguaacau

SEQ ID NO: 2185684 - RNA, 17 nt, Streptococcus pneumoniae R6
ucgucuggauugaccaa

SEQ ID NO: 2185685 - RNA, 21 nt, Streptococcus pneumoniae R6
ucguguaggggauaaugagga

SEQ ID NO: 2185686 - RNA, 22 nt, Streptococcus pneumoniae R6
ucguggcgagggagaccggaga

SEQ ID NO: 2185687 - RNA, 16 nt, Streptococcus pneumoniae R6
ucuuccuacugauauc

SEQ ID NO: 2185688 - RNA, 23 nt, Streptococcus pneumoniae R6
ucuucauuggacaaguuagccac

SEQ ID NO: 2185689 - RNA, 20 nt, Streptococcus pneumoniae R6
ucuucauucaaagaaccugc

SEQ ID NO: 2185690 - RNA, 21 nt, Streptococcus pneumoniae R6
ucuucauguggcuaucuguca

SEQ ID NO: 2185691 - RNA, 21 nt, Streptococcus pneumoniae R6
ucuucauggaucauuucuucu

SEQ ID NO: 2185692 - RNA, 23 nt, Streptococcus pneumoniae R6
ucuuccgaauagcucaaaagcuu

SEQ ID NO: 2185693 - RNA, 13 nt, Streptococcus pneumoniae R6
ucuuccaauuucu

SEQ ID NO: 2185694 - RNA, 16 nt, Streptococcus pneumoniae R6
ucuucccguagguuuu

SEQ ID NO: 2185695 - RNA, 21 nt, Streptococcus pneumoniae R6
ucuucccguagguuuucuccu

SEQ ID NO: 2185696 - RNA, 22 nt, Streptococcus pneumoniae R6
ucuucccguagguuuucuccuu

SEQ ID NO: 2185697 - RNA, 19 nt, Streptococcus pneumoniae R6
ucuuccaaagguugcuuga

SEQ ID NO: 2185698 - RNA, 18 nt, Streptococcus pneumoniae R6
ucuuccaaaguucgaaag

SEQ ID NO: 2185699 - RNA, 21 nt, Streptococcus pneumoniae R6
ucuuccaaaguucgaaaggcu

SEQ ID NO: 2185700 - RNA, 20 nt, Streptococcus pneumoniae R6
ucuuaaaugacauuccuguc

SEQ ID NO: 2185701 - RNA, 24 nt, Streptococcus pneumoniae R6
ucuuaagacaccuguuacaguugc

SEQ ID NO: 2185702 - RNA, 13 nt, Streptococcus pneumoniae R6
ucuuaauucucuu

SEQ ID NO: 2185703 - RNA, 23 nt, Streptococcus pneumoniae R6
ucuuacaaaaaaucaaaaaaauu

SEQ ID NO: 2185704 - RNA, 14 nt, Streptococcus pneumoniae R6
ucuuacaaauugau

SEQ ID NO: 2185705 - RNA, 12 nt, Streptococcus pneumoniae R6
ucuucaguuccc

SEQ ID NO: 2185706 - RNA, 23 nt, Streptococcus pneumoniae R6
ucuucaggauugauaaaauuuaa

SEQ ID NO: 2185707 - RNA, 15 nt, Streptococcus pneumoniae R6
ucuucguuuuuacua

SEQ ID NO: 2185708 - RNA, 14 nt, Streptococcus pneumoniae R6
ucuucguccagacg

SEQ ID NO: 2185709 - RNA, 13 nt, Streptococcus pneumoniae R6
ucuucgugaaaga

SEQ ID NO: 2185710 - RNA, 21 nt, Streptococcus pneumoniae R6
ucuucuccaaaccauuuuugg

SEQ ID NO: 2185711 - RNA, 23 nt, Streptococcus pneumoniae R6
ucuucuccaaaccauuuuuggcu

SEQ ID NO: 2185712 - RNA, 18 nt, Streptococcus pneumoniae R6
ucuucuccaguuuuaauc

SEQ ID NO: 2185713 - RNA, 24 nt, Streptococcus pneumoniae R6
ucuucuccgugaacaaguguaaca

SEQ ID NO: 2185714 - RNA, 17 nt, Streptococcus pneumoniae R6
ucuucucgauucccuga

SEQ ID NO: 2185715 - RNA, 19 nt, Streptococcus pneumoniae R6
ucuucucaggcuuuuucug

SEQ ID NO: 2185716 - RNA, 20 nt, Streptococcus pneumoniae R6
ucuucucaggcuuuuucugu

SEQ ID NO: 2185717 - RNA, 20 nt, Streptococcus pneumoniae R6
ucuucucacguccuagcucu

SEQ ID NO: 2185718 - RNA, 14 nt, Streptococcus pneumoniae R6
ucuucucagcuagu

SEQ ID NO: 2185719 - RNA, 16 nt, Streptococcus pneumoniae R6
ucuucuaauaccaaua

SEQ ID NO: 2185720 - RNA, 17 nt, Streptococcus pneumoniae R6
ucuucuaguugguuucc

SEQ ID NO: 2185721 - RNA, 18 nt, Streptococcus pneumoniae R6
ucuucuaguugguuuccu

SEQ ID NO: 2185722 - RNA, 15 nt, Streptococcus pneumoniae R6
ucuucuaucuucuug

SEQ ID NO: 2185723 - RNA, 17 nt, Streptococcus pneumoniae R6
ucuucgcuuucuucauu

SEQ ID NO: 2185724 - RNA, 23 nt, Streptococcus pneumoniae R6
ucuucggaauagcucaaaaguuu

SEQ ID NO: 2185725 - RNA, 19 nt, Streptococcus pneumoniae R6
ucuucggagaagaaaacag

SEQ ID NO: 2185726 - RNA, 15 nt, Streptococcus pneumoniae R6
ucuuccuuucucugu

SEQ ID NO: 2185727 - RNA, 15 nt, Streptococcus pneumoniae R6
ucuucgaaaaucucu

SEQ ID NO: 2185728 - RNA, 18 nt, Streptococcus pneumoniae R6
ucuucgaaauuccauacc

SEQ ID NO: 2185729 - RNA, 16 nt, Streptococcus pneumoniae R6
ucuucgaccuacauug

SEQ ID NO: 2185730 - RNA, 21 nt, Streptococcus pneumoniae R6
ucuugauuuaggguacuuucu

SEQ ID NO: 2185731 - RNA, 16 nt, Streptococcus pneumoniae R6
ucuugauuuucuuuaa

SEQ ID NO: 2185732 - RNA, 23 nt, Streptococcus pneumoniae R6
ucuugcaaacuuuccaauauguu

SEQ ID NO: 2185733 - RNA, 14 nt, Streptococcus pneumoniae R6
ucuugcauuuuaau

SEQ ID NO: 2185734 - RNA, 23 nt, Streptococcus pneumoniae R6
ucuugcauuuuaauuucaaugua

SEQ ID NO: 2185735 - RNA, 14 nt, Streptococcus pneumoniae R6
ucuugcgaagugau

SEQ ID NO: 2185736 - RNA, 19 nt, Streptococcus pneumoniae R6
ucuugcgaagugauaauga

SEQ ID NO: 2185737 - RNA, 21 nt, Streptococcus pneumoniae R6
ucuugcgaagugauaaugauu

SEQ ID NO: 2185738 - RNA, 17 nt, Streptococcus pneumoniae R6
ucuugcccuucuagagu

SEQ ID NO: 2185739 - RNA, 14 nt, Streptococcus pneumoniae R6
ucuuguccuaaaua

SEQ ID NO: 2185740 - RNA, 14 nt, Streptococcus pneumoniae R6
ucuuguauucgcuu

SEQ ID NO: 2185741 - RNA, 16 nt, Streptococcus pneumoniae R6
ucuugugagaauauuu

SEQ ID NO: 2185742 - RNA, 17 nt, Streptococcus pneumoniae R6
ucuugucguugaaaaag

SEQ ID NO: 2185743 - RNA, 23 nt, Streptococcus pneumoniae R6
ucuugucuucaaaggucaaauca

SEQ ID NO: 2185744 - RNA, 16 nt, Streptococcus pneumoniae R6
ucuuguaaaaccuuuu

SEQ ID NO: 2185745 - RNA, 19 nt, Streptococcus pneumoniae R6
ucuugcgcagucagugguu

SEQ ID NO: 2185746 - RNA, 13 nt, Streptococcus pneumoniae R6
ucuuuaaacuuuu

SEQ ID NO: 2185747 - RNA, 12 nt, Streptococcus pneumoniae R6
ucuuuacuucug

SEQ ID NO: 2185748 - RNA, 16 nt, Streptococcus pneumoniae R6
ucuuuagagagaugaa

SEQ ID NO: 2185749 - RNA, 23 nt, Streptococcus pneumoniae R6
ucuuuacugagauggauuuuccu

SEQ ID NO: 2185750 - RNA, 17 nt, Streptococcus pneumoniae R6
ucuuuacguccaccaca

SEQ ID NO: 2185751 - RNA, 14 nt, Streptococcus pneumoniae R6
ucuuuagcagagaa

SEQ ID NO: 2185752 - RNA, 16 nt, Streptococcus pneumoniae R6
ucuuuagcauaauagc

SEQ ID NO: 2185753 - RNA, 21 nt, Streptococcus pneumoniae R6
ucuuuagggaaauuauuuauu

SEQ ID NO: 2185754 - RNA, 16 nt, Streptococcus pneumoniae R6
ucuuuaguagucuaaa

SEQ ID NO: 2185755 - RNA, 19 nt, Streptococcus pneumoniae R6
ucuuuagucccauuuucag

SEQ ID NO: 2185756 - RNA, 20 nt, Streptococcus pneumoniae R6
ucuuuagucccauuuucaga

SEQ ID NO: 2185757 - RNA, 15 nt, Streptococcus pneumoniae R6
ucuugaugucuugga

SEQ ID NO: 2185758 - RNA, 18 nt, Streptococcus pneumoniae R6
ucuugagcgauuuuaaug

SEQ ID NO: 2185759 - RNA, 23 nt, Streptococcus pneumoniae R6
ucuugagcuaggguguuuucaau

SEQ ID NO: 2185760 - RNA, 21 nt, Streptococcus pneumoniae R6
ucuugagggcacggucacgaa

SEQ ID NO: 2185761 - RNA, 20 nt, Streptococcus pneumoniae R6
ucuugaguaaguuuaauguc

SEQ ID NO: 2185762 - RNA, 22 nt, Streptococcus pneumoniae R6
ucuugaguaaguuuaaugucca

SEQ ID NO: 2185763 - RNA, 16 nt, Streptococcus pneumoniae R6
ucuugaggaagagcuu

SEQ ID NO: 2185764 - RNA, 20 nt, Streptococcus pneumoniae R6
ucuugaggaagagcuuugcu

SEQ ID NO: 2185765 - RNA, 18 nt, Streptococcus pneumoniae R6
ucuucuuuuuguccuucu

SEQ ID NO: 2185766 - RNA, 22 nt, Streptococcus pneumoniae R6
ucuugaaaaugaaagagcagga

SEQ ID NO: 2185767 - RNA, 11 nt, Streptococcus pneumoniae R6
ucuucuuuucu

SEQ ID NO: 2185768 - RNA, 12 nt, Streptococcus pneumoniae R6
ucuucuuuucuu

SEQ ID NO: 2185769 - RNA, 12 nt, Streptococcus pneumoniae R6
ucuugaaaugaa

SEQ ID NO: 2185770 - RNA, 16 nt, Streptococcus pneumoniae R6
ucuugaaaugaaguua

SEQ ID NO: 2185771 - RNA, 22 nt, Streptococcus pneumoniae R6
ucuugaaaugaaguuagguuuu

SEQ ID NO: 2185772 - RNA, 22 nt, Streptococcus pneumoniae R6
ucuugaccaacuuuaagagcuu

SEQ ID NO: 2185773 - RNA, 18 nt, Streptococcus pneumoniae R6
ucuugaccagcgauagcu

SEQ ID NO: 2185774 - RNA, 19 nt, Streptococcus pneumoniae R6
ucuugacaaagaaaaaaca

SEQ ID NO: 2185775 - RNA, 23 nt, Streptococcus pneumoniae R6
ucuugacaaagaaaaaacaaagu

SEQ ID NO: 2185776 - RNA, 22 nt, Streptococcus pneumoniae R6
ucuucuuugauggaguuuucaa

SEQ ID NO: 2185777 - RNA, 15 nt, Streptococcus pneumoniae R6
ucuucuuuauaauau

SEQ ID NO: 2185778 - RNA, 16 nt, Streptococcus pneumoniae R6
ucuucuuuauaauauu

SEQ ID NO: 2185779 - RNA, 17 nt, Streptococcus pneumoniae R6
ucuucuugguauuccuu

SEQ ID NO: 2185780 - RNA, 14 nt, Streptococcus pneumoniae R6
ucuucuucgucaaa

SEQ ID NO: 2185781 - RNA, 14 nt, Streptococcus pneumoniae R6
ucuucucuuuucuu

SEQ ID NO: 2185782 - RNA, 19 nt, Streptococcus pneumoniae R6
ucuucugggagaaauuccu

SEQ ID NO: 2185783 - RNA, 20 nt, Streptococcus pneumoniae R6
ucuucugggagaaauuccuu

SEQ ID NO: 2185784 - RNA, 23 nt, Streptococcus pneumoniae R6
ucuucuguacauuagaauucagc

SEQ ID NO: 2185785 - RNA, 13 nt, Streptococcus pneumoniae R6
ucuucuguuucug

SEQ ID NO: 2185786 - RNA, 22 nt, Streptococcus pneumoniae R6
ucugacaggcuauugaagaaga

SEQ ID NO: 2185787 - RNA, 20 nt, Streptococcus pneumoniae R6
ucugaccaugcguuggaacg

SEQ ID NO: 2185788 - RNA, 15 nt, Streptococcus pneumoniae R6
ucugaacuaaaaaau

SEQ ID NO: 2185789 - RNA, 16 nt, Streptococcus pneumoniae R6
ucugaaugcuuuccaa

SEQ ID NO: 2185790 - RNA, 20 nt, Streptococcus pneumoniae R6
ucugaacugccccccaaaag

SEQ ID NO: 2185791 - RNA, 19 nt, Streptococcus pneumoniae R6
ucugaaugacaaauccauu

SEQ ID NO: 2185792 - RNA, 23 nt, Streptococcus pneumoniae R6
ucugagguuaaaaucuuuuacuu

SEQ ID NO: 2185793 - RNA, 15 nt, Streptococcus pneumoniae R6
ucugagcuacuauag

SEQ ID NO: 2185794 - RNA, 20 nt, Streptococcus pneumoniae R6
ucugauagaagagucagcuc

SEQ ID NO: 2185795 - RNA, 17 nt, Streptococcus pneumoniae R6
ucugauggauuuauagu

SEQ ID NO: 2185796 - RNA, 14 nt, Streptococcus pneumoniae R6
ucugaaacuaagcu

SEQ ID NO: 2185797 - RNA, 19 nt, Streptococcus pneumoniae R6
ucugaaacacugauuucaa

SEQ ID NO: 2185798 - RNA, 16 nt, Streptococcus pneumoniae R6
ucugaaagugaaaaag

SEQ ID NO: 2185799 - RNA, 20 nt, Streptococcus pneumoniae R6
ucugaaauaguacgaaacaa

SEQ ID NO: 2185800 - RNA, 21 nt, Streptococcus pneumoniae R6
ucugcccaaagacagguuuca

SEQ ID NO: 2185801 - RNA, 21 nt, Streptococcus pneumoniae R6
ucugauuugggguugagaagu

SEQ ID NO: 2185802 - RNA, 18 nt, Streptococcus pneumoniae R6
ucugauuccuuuuuucua

SEQ ID NO: 2185803 - RNA, 19 nt, Streptococcus pneumoniae R6
ucugcagguuuugugacca

SEQ ID NO: 2185804 - RNA, 20 nt, Streptococcus pneumoniae R6
ucugccagauuccugaaaua

SEQ ID NO: 2185805 - RNA, 20 nt, Streptococcus pneumoniae R6
ucuguuuggcaagugccuuc

SEQ ID NO: 2185806 - RNA, 23 nt, Streptococcus pneumoniae R6
ucuguuugaauacgauuggcgac

SEQ ID NO: 2185807 - RNA, 16 nt, Streptococcus pneumoniae R6
ucuguuuucaaaaagc

SEQ ID NO: 2185808 - RNA, 15 nt, Streptococcus pneumoniae R6
ucuuaaaagcaaaag

SEQ ID NO: 2185809 - RNA, 19 nt, Streptococcus pneumoniae R6
ucuuaaaaaaguccaaaag

SEQ ID NO: 2185810 - RNA, 14 nt, Streptococcus pneumoniae R6
ucuguuuuuggauu

SEQ ID NO: 2185811 - RNA, 14 nt, Streptococcus pneumoniae R6
ucuuaaauccacgu

SEQ ID NO: 2185812 - RNA, 21 nt, Streptococcus pneumoniae R6
ucuuaaaguuauuggaacuaa

SEQ ID NO: 2185813 - RNA, 18 nt, Streptococcus pneumoniae R6
ucuuaaaaucacaaaaac

SEQ ID NO: 2185814 - RNA, 16 nt, Streptococcus pneumoniae R6
ucuguauuuggcauug

SEQ ID NO: 2185815 - RNA, 17 nt, Streptococcus pneumoniae R6
ucuguaugguauucguu

SEQ ID NO: 2185816 - RNA, 15 nt, Streptococcus pneumoniae R6
ucugucuguucucug

SEQ ID NO: 2185817 - RNA, 15 nt, Streptococcus pneumoniae R6
ucugugcuuuuucaa

SEQ ID NO: 2185818 - RNA, 19 nt, Streptococcus pneumoniae R6
ucugugauugacaccacuu

SEQ ID NO: 2185819 - RNA, 14 nt, Streptococcus pneumoniae R6
ucugugauuucagu

SEQ ID NO: 2185820 - RNA, 20 nt, Streptococcus pneumoniae R6
ucugucuugacugcaucaga

SEQ ID NO: 2185821 - RNA, 14 nt, Streptococcus pneumoniae R6
ucugucuuguaaaa

SEQ ID NO: 2185822 - RNA, 19 nt, Streptococcus pneumoniae R6
ucugugaaugccuguucca

SEQ ID NO: 2185823 - RNA, 15 nt, Streptococcus pneumoniae R6
ucuggucugauuuuc

SEQ ID NO: 2185824 - RNA, 18 nt, Streptococcus pneumoniae R6
ucuggucuuaagacaccu

SEQ ID NO: 2185825 - RNA, 20 nt, Streptococcus pneumoniae R6
ucugguauauuuuguuuucu

SEQ ID NO: 2185826 - RNA, 16 nt, Streptococcus pneumoniae R6
ucuggucuuuuugcuc

SEQ ID NO: 2185827 - RNA, 18 nt, Streptococcus pneumoniae R6
ucuggucuuuuugcucau

SEQ ID NO: 2185828 - RNA, 20 nt, Streptococcus pneumoniae R6
ucuguacugccccccaaaag

SEQ ID NO: 2185829 - RNA, 20 nt, Streptococcus pneumoniae R6
ucuguagaauugcugucaaa

SEQ ID NO: 2185830 - RNA, 17 nt, Streptococcus pneumoniae R6
ucuguagagaguuaaaa

SEQ ID NO: 2185831 - RNA, 19 nt, Streptococcus pneumoniae R6
ucugcuucuuuuuuuacua

SEQ ID NO: 2185832 - RNA, 21 nt, Streptococcus pneumoniae R6
ucugcuuuuuauacaguccuc

SEQ ID NO: 2185833 - RNA, 12 nt, Streptococcus pneumoniae R6
ucuggauuuuca

SEQ ID NO: 2185834 - RNA, 22 nt, Streptococcus pneumoniae R6
ucuggauuuucagccucuauac

SEQ ID NO: 2185835 - RNA, 22 nt, Streptococcus pneumoniae R6
ucuggaucuuccgucccuugga

SEQ ID NO: 2185836 - RNA, 20 nt, Streptococcus pneumoniae R6
ucuggaugauucuuuucaaa

SEQ ID NO: 2185837 - RNA, 23 nt, Streptococcus pneumoniae R6
ucuggaugauucuuuucaaaaua

SEQ ID NO: 2185838 - RNA, 14 nt, Streptococcus pneumoniae R6
ucugcuucuaaaac

SEQ ID NO: 2185839 - RNA, 17 nt, Streptococcus pneumoniae R6
ucugcuucuaaaacauu

SEQ ID NO: 2185840 - RNA, 20 nt, Streptococcus pneumoniae R6
ucuggcagaaggauuuccua

SEQ ID NO: 2185841 - RNA, 17 nt, Streptococcus pneumoniae R6
ucuggcaauuuauccca

SEQ ID NO: 2185842 - RNA, 18 nt, Streptococcus pneumoniae R6
ucuggcaauuuaucuccu

SEQ ID NO: 2185843 - RNA, 13 nt, Streptococcus pneumoniae R6
ucuggcaggcuga

SEQ ID NO: 2185844 - RNA, 18 nt, Streptococcus pneumoniae R6
ucuggguacucuuuuuuc

SEQ ID NO: 2185845 - RNA, 18 nt, Streptococcus pneumoniae R6
ucugggauuacaagaccg

SEQ ID NO: 2185846 - RNA, 21 nt, Streptococcus pneumoniae R6
uggcuuugagauauuucuucu

SEQ ID NO: 2185847 - RNA, 12 nt, Streptococcus pneumoniae R6
ugggaaaccaaa

SEQ ID NO: 2185848 - RNA, 12 nt, Streptococcus pneumoniae R6
uggcuuucuuuc

SEQ ID NO: 2185849 - RNA, 22 nt, Streptococcus pneumoniae R6
ugggcacgacgggcuuggaaau

SEQ ID NO: 2185850 - RNA, 23 nt, Streptococcus pneumoniae R6
ugggauuauuugccuaugaaaug

SEQ ID NO: 2185851 - RNA, 22 nt, Streptococcus pneumoniae R6
uggggcaccauuuucagcccag

SEQ ID NO: 2185852 - RNA, 22 nt, Streptococcus pneumoniae R6
ugggcuuacaucaaaaacaucu

SEQ ID NO: 2185853 - RNA, 15 nt, Streptococcus pneumoniae R6
ugggcugauuuugaa

SEQ ID NO: 2185854 - RNA, 19 nt, Streptococcus pneumoniae R6
ugggcuggacguucuucaa

SEQ ID NO: 2185855 - RNA, 20 nt, Streptococcus pneumoniae R6
ugggcucccacuuucaaguc

SEQ ID NO: 2185856 - RNA, 14 nt, Streptococcus pneumoniae R6
ugggcuaauucucu

SEQ ID NO: 2185857 - RNA, 21 nt, Streptococcus pneumoniae R6
ugggcuauuccauauucaauu

SEQ ID NO: 2185858 - RNA, 22 nt, Streptococcus pneumoniae R6
uggguaggcgaaaagcuacaau

SEQ ID NO: 2185859 - RNA, 15 nt, Streptococcus pneumoniae R6
uggguauauaagcuu

SEQ ID NO: 2185860 - RNA, 21 nt, Streptococcus pneumoniae R6
ugggucuguuuuugaagaaaa

SEQ ID NO: 2185861 - RNA, 22 nt, Streptococcus pneumoniae R6
ugggucaaucuugucuaaaaau

SEQ ID NO: 2185862 - RNA, 16 nt, Streptococcus pneumoniae R6
uggucuagcaagaguu

SEQ ID NO: 2185863 - RNA, 15 nt, Streptococcus pneumoniae R6
uggucuauccagccu

SEQ ID NO: 2185864 - RNA, 14 nt, Streptococcus pneumoniae R6
ugguguuucaaguc

SEQ ID NO: 2185865 - RNA, 17 nt, Streptococcus pneumoniae R6
ugguggcuaccaaguaa

SEQ ID NO: 2185866 - RNA, 21 nt, Streptococcus pneumoniae R6
ugguagaaagucuuuaacauc

SEQ ID NO: 2185867 - RNA, 23 nt, Streptococcus pneumoniae R6
ugguaucaaaggcaagacuuggu

SEQ ID NO: 2185868 - RNA, 19 nt, Streptococcus pneumoniae R6
ugguauacgaaaaauccac

SEQ ID NO: 2185869 - RNA, 12 nt, Streptococcus pneumoniae R6
ugguaguugagc

SEQ ID NO: 2185870 - RNA, 20 nt, Streptococcus pneumoniae R6
ugguaguuuaccccaaauuc

SEQ ID NO: 2185871 - RNA, 22 nt, Streptococcus pneumoniae R6
ugguauucauuaagucaacauc

SEQ ID NO: 2185872 - RNA, 13 nt, Streptococcus pneumoniae R6
uggucagauugua

SEQ ID NO: 2185873 - RNA, 21 nt, Streptococcus pneumoniae R6
uggucagauuguaaaggauga

SEQ ID NO: 2185874 - RNA, 14 nt, Streptococcus pneumoniae R6
ugguaaagacucuu

SEQ ID NO: 2185875 - RNA, 20 nt, Streptococcus pneumoniae R6
ugguaaaagagcaagaacuu

SEQ ID NO: 2185876 - RNA, 22 nt, Streptococcus pneumoniae R6
uggguuuuaaagccgacccagg

SEQ ID NO: 2185877 - RNA, 19 nt, Streptococcus pneumoniae R6
uggguuaaaauuuuaucuu

SEQ ID NO: 2185878 - RNA, 14 nt, Streptococcus pneumoniae R6
uggguuaagugcau

SEQ ID NO: 2185879 - RNA, 14 nt, Streptococcus pneumoniae R6
uggguugaggccga

SEQ ID NO: 2185880 - RNA, 12 nt, Streptococcus pneumoniae R6
uggguugaaaaa

SEQ ID NO: 2185881 - RNA, 19 nt, Streptococcus pneumoniae R6
uguauuuugaauauaccuu

SEQ ID NO: 2185882 - RNA, 18 nt, Streptococcus pneumoniae R6
uguauuuggcgauuuuuu

SEQ ID NO: 2185883 - RNA, 21 nt, Streptococcus pneumoniae R6
ugucaaaccaugagguaagag

SEQ ID NO: 2185884 - RNA, 22 nt, Streptococcus pneumoniae R6
ugucacaauuacguuuaaagac

SEQ ID NO: 2185885 - RNA, 23 nt, Streptococcus pneumoniae R6
ugucaaaaaggaaaacuuccaag

SEQ ID NO: 2185886 - RNA, 23 nt, Streptococcus pneumoniae R6
uguaucugaaccugauuggccgc

SEQ ID NO: 2185887 - RNA, 20 nt, Streptococcus pneumoniae R6
uguauggacgaagugcuucu

SEQ ID NO: 2185888 - RNA, 18 nt, Streptococcus pneumoniae R6
uguaugugcauaguauuu

SEQ ID NO: 2185889 - RNA, 22 nt, Streptococcus pneumoniae R6
uguaugugcauaguauuuguua

SEQ ID NO: 2185890 - RNA, 21 nt, Streptococcus pneumoniae R6
uguauucauugaaaaaauauc

SEQ ID NO: 2185891 - RNA, 21 nt, Streptococcus pneumoniae R6
uguaucaccaagcauuuucau

SEQ ID NO: 2185892 - RNA, 18 nt, Streptococcus pneumoniae R6
uguauaugaagauucugu

SEQ ID NO: 2185893 - RNA, 16 nt, Streptococcus pneumoniae R6
uguauccaaucucuug

SEQ ID NO: 2185894 - RNA, 16 nt, Streptococcus pneumoniae R6
uguaucgccucuucaa

SEQ ID NO: 2185895 - RNA, 23 nt, Streptococcus pneumoniae R6
uguaucgccucuucaauuuguuu

SEQ ID NO: 2185896 - RNA, 18 nt, Streptococcus pneumoniae R6
uguauccugaaaagccac

SEQ ID NO: 2185897 - RNA, 22 nt, Streptococcus pneumoniae R6
uguauccuaaaucauuauagaa

SEQ ID NO: 2185898 - RNA, 20 nt, Streptococcus pneumoniae R6
uguauaauggauugaaauaa

SEQ ID NO: 2185899 - RNA, 23 nt, Streptococcus pneumoniae R6
uguauaauagguggauaaaaguc

SEQ ID NO: 2185900 - RNA, 14 nt, Streptococcus pneumoniae R6
uguauacguuuuua

SEQ ID NO: 2185901 - RNA, 17 nt, Streptococcus pneumoniae R6
uguauacguuuuuacua

SEQ ID NO: 2185902 - RNA, 12 nt, Streptococcus pneumoniae R6
uguauacuuuuu

SEQ ID NO: 2185903 - RNA, 19 nt, Streptococcus pneumoniae R6
uguauagugaacugaaucu

SEQ ID NO: 2185904 - RNA, 15 nt, Streptococcus pneumoniae R6
uguauagugaauuga

SEQ ID NO: 2185905 - RNA, 20 nt, Streptococcus pneumoniae R6
uguauagugaauugaaauaa

SEQ ID NO: 2185906 - RNA, 14 nt, Streptococcus pneumoniae R6
uguagaugaaacug

SEQ ID NO: 2185907 - RNA, 16 nt, Streptococcus pneumoniae R6
uguagaugaaacugac

SEQ ID NO: 2185908 - RNA, 17 nt, Streptococcus pneumoniae R6
uguagaggcguuauuug

SEQ ID NO: 2185909 - RNA, 12 nt, Streptococcus pneumoniae R6
uguaggaaguuu

SEQ ID NO: 2185910 - RNA, 23 nt, Streptococcus pneumoniae R6
uguaggaaaccaaucucaaaucc

SEQ ID NO: 2185911 - RNA, 16 nt, Streptococcus pneumoniae R6
uguaggggauaaugag

SEQ ID NO: 2185912 - RNA, 15 nt, Streptococcus pneumoniae R6
uguaggcuucuucuc

SEQ ID NO: 2185913 - RNA, 21 nt, Streptococcus pneumoniae R6
uguagggggcauauaaauaca

SEQ ID NO: 2185914 - RNA, 21 nt, Streptococcus pneumoniae R6
uguagucagcugucuuuucaa

SEQ ID NO: 2185915 - RNA, 16 nt, Streptococcus pneumoniae R6
uguagucaucaauauu

SEQ ID NO: 2185916 - RNA, 16 nt, Streptococcus pneumoniae R6
uguaguacugaacaau

SEQ ID NO: 2185917 - RNA, 23 nt, Streptococcus pneumoniae R6
uguaguagguuccgagauaaaag

SEQ ID NO: 2185918 - RNA, 18 nt, Streptococcus pneumoniae R6
uguagguucgguuuccau

SEQ ID NO: 2185919 - RNA, 20 nt, Streptococcus pneumoniae R6
uguauaaauagcuacaguca

SEQ ID NO: 2185920 - RNA, 16 nt, Streptococcus pneumoniae R6
uguaguuuuaccacua

SEQ ID NO: 2185921 - RNA, 13 nt, Streptococcus pneumoniae R6
uguaguuaauuga

SEQ ID NO: 2185922 - RNA, 17 nt, Streptococcus pneumoniae R6
uguaguggguugaagaa

SEQ ID NO: 2185923 - RNA, 18 nt, Streptococcus pneumoniae R6
uguaguggguugaagaaa

SEQ ID NO: 2185924 - RNA, 18 nt, Streptococcus pneumoniae R6
uguaaacgaauacuuugu

SEQ ID NO: 2185925 - RNA, 15 nt, Streptococcus pneumoniae R6
uguaaaguagcaaaa

SEQ ID NO: 2185926 - RNA, 18 nt, Streptococcus pneumoniae R6
uguaaaguagcaaaacac

SEQ ID NO: 2185927 - RNA, 21 nt, Streptococcus pneumoniae R6
uguaaaguuaauugaauuuca

SEQ ID NO: 2185928 - RNA, 22 nt, Streptococcus pneumoniae R6
uguaaaguuaauugaauuucaa

SEQ ID NO: 2185929 - RNA, 16 nt, Streptococcus pneumoniae R6
uguaaacugugaugga

SEQ ID NO: 2185930 - RNA, 16 nt, Streptococcus pneumoniae R6
uguaaagaguacaguc

SEQ ID NO: 2185931 - RNA, 20 nt, Streptococcus pneumoniae R6
uguaaagcgaaaggagaaaa

SEQ ID NO: 2185932 - RNA, 22 nt, Streptococcus pneumoniae R6
uguaaagcgaaaggagaaaaaa

SEQ ID NO: 2185933 - RNA, 12 nt, Streptococcus pneumoniae R6
uguaaauagaaa

SEQ ID NO: 2185934 - RNA, 18 nt, Streptococcus pneumoniae R6
uguaaauagaaaccagcu

SEQ ID NO: 2185935 - RNA, 20 nt, Streptococcus pneumoniae R6
uguaacguucuucaacaucg

SEQ ID NO: 2185936 - RNA, 15 nt, Streptococcus pneumoniae R6
uguaagaacuuuuua

SEQ ID NO: 2185937 - RNA, 22 nt, Streptococcus pneumoniae R6
uguaagaacuuuuuaaaguauu

SEQ ID NO: 2185938 - RNA, 22 nt, Streptococcus pneumoniae R6
uguaacgaugaccguugacuuc

SEQ ID NO: 2185939 - RNA, 18 nt, Streptococcus pneumoniae R6
uguaaaucauuuucuuga

SEQ ID NO: 2185940 - RNA, 19 nt, Streptococcus pneumoniae R6
uguaauuguuccauaugau

SEQ ID NO: 2185941 - RNA, 16 nt, Streptococcus pneumoniae R6
uguaauaugaacaaaa

SEQ ID NO: 2185942 - RNA, 21 nt, Streptococcus pneumoniae R6
uguacauuagaauucagcuuu

SEQ ID NO: 2185943 - RNA, 15 nt, Streptococcus pneumoniae R6
uguacuguuauagau

SEQ ID NO: 2185944 - RNA, 16 nt, Streptococcus pneumoniae R6
uguacuguucuaaauu

SEQ ID NO: 2185945 - RNA, 18 nt, Streptococcus pneumoniae R6
uguacuguauacuuugca

SEQ ID NO: 2185946 - RNA, 12 nt, Streptococcus pneumoniae R6
uguacuuuccaa

SEQ ID NO: 2185947 - RNA, 18 nt, Streptococcus pneumoniae R6
uguacuagggcauuuuga

SEQ ID NO: 2185948 - RNA, 18 nt, Streptococcus pneumoniae R6
uguacuagucuaacuucu

SEQ ID NO: 2185949 - RNA, 23 nt, Streptococcus pneumoniae R6
uguacugccccccaaaaguuaga

SEQ ID NO: 2185950 - RNA, 23 nt, Streptococcus pneumoniae R6
uguaccuaauuuuuuggcaaccu

SEQ ID NO: 2185951 - RNA, 21 nt, Streptococcus pneumoniae R6
uguaccguccccuuuuggauc

SEQ ID NO: 2185952 - RNA, 17 nt, Streptococcus pneumoniae R6
uggccaagguucauuuc

SEQ ID NO: 2185953 - RNA, 21 nt, Streptococcus pneumoniae R6
uggccaagguucauuucuucu

SEQ ID NO: 2185954 - RNA, 14 nt, Streptococcus pneumoniae R6
uggcauucaaaacg

SEQ ID NO: 2185955 - RNA, 20 nt, Streptococcus pneumoniae R6
uggcauuccugcuccuccga

SEQ ID NO: 2185956 - RNA, 19 nt, Streptococcus pneumoniae R6
uggcauugaugaauugauu

SEQ ID NO: 2185957 - RNA, 12 nt, Streptococcus pneumoniae R6
uggcauccccag

SEQ ID NO: 2185958 - RNA, 13 nt, Streptococcus pneumoniae R6
uggcauccccagc

SEQ ID NO: 2185959 - RNA, 23 nt, Streptococcus pneumoniae R6
uggcauggaaagcaucuccaucc

SEQ ID NO: 2185960 - RNA, 14 nt, Streptococcus pneumoniae R6
uggcauguccuagu

SEQ ID NO: 2185961 - RNA, 15 nt, Streptococcus pneumoniae R6
uggcccuaccugcuc

SEQ ID NO: 2185962 - RNA, 17 nt, Streptococcus pneumoniae R6
uggcccuaccugcucca

SEQ ID NO: 2185963 - RNA, 22 nt, Streptococcus pneumoniae R6
uggcccuaccugcuccaaauau

SEQ ID NO: 2185964 - RNA, 22 nt, Streptococcus pneumoniae R6
uggcccgcuucgcuuccaaucu

SEQ ID NO: 2185965 - RNA, 22 nt, Streptococcus pneumoniae R6
uggcgauuuuuuugauuucugg

SEQ ID NO: 2185966 - RNA, 17 nt, Streptococcus pneumoniae R6
uggcgaguccuacgaac

SEQ ID NO: 2185967 - RNA, 16 nt, Streptococcus pneumoniae R6
uggccuguaguuucau

SEQ ID NO: 2185968 - RNA, 22 nt, Streptococcus pneumoniae R6
uggagcuucaucaguuccagca

SEQ ID NO: 2185969 - RNA, 15 nt, Streptococcus pneumoniae R6
uggaguagcaucccc

SEQ ID NO: 2185970 - RNA, 17 nt, Streptococcus pneumoniae R6
uggagucugaccaugcg

SEQ ID NO: 2185971 - RNA, 21 nt, Streptococcus pneumoniae R6
uggacguuuucgagccaauac

SEQ ID NO: 2185972 - RNA, 15 nt, Streptococcus pneumoniae R6
uggacuguuauagau

SEQ ID NO: 2185973 - RNA, 14 nt, Streptococcus pneumoniae R6
uggagacagcacca

SEQ ID NO: 2185974 - RNA, 16 nt, Streptococcus pneumoniae R6
uggagacagcaccaac

SEQ ID NO: 2185975 - RNA, 15 nt, Streptococcus pneumoniae R6
uggacguucuucaag

SEQ ID NO: 2185976 - RNA, 16 nt, Streptococcus pneumoniae R6
uggacguucuucaaga

SEQ ID NO: 2185977 - RNA, 13 nt, Streptococcus pneumoniae R6
uggauagguugca

SEQ ID NO: 2185978 - RNA, 16 nt, Streptococcus pneumoniae R6
uggauacgacgauucc

SEQ ID NO: 2185979 - RNA, 23 nt, Streptococcus pneumoniae R6
uggauacuguauuuuuuuugguu

SEQ ID NO: 2185980 - RNA, 21 nt, Streptococcus pneumoniae R6
uggauacuuaacuuuguauaa

SEQ ID NO: 2185981 - RNA, 15 nt, Streptococcus pneumoniae R6
uggauagaacugacg

SEQ ID NO: 2185982 - RNA, 16 nt, Streptococcus pneumoniae R6
uggauauccuuuucca

SEQ ID NO: 2185983 - RNA, 20 nt, Streptococcus pneumoniae R6
uggauauaacaacucccucc

SEQ ID NO: 2185984 - RNA, 21 nt, Streptococcus pneumoniae R6
uggauauagucuacaauuucu

SEQ ID NO: 2185985 - RNA, 18 nt, Streptococcus pneumoniae R6
uggauauugaguaauucc

SEQ ID NO: 2185986 - RNA, 11 nt, Streptococcus pneumoniae R6
uggauaaaauc

SEQ ID NO: 2185987 - RNA, 14 nt, Streptococcus pneumoniae R6
uggauaaaaucuuu

SEQ ID NO: 2185988 - RNA, 15 nt, Streptococcus pneumoniae R6
uggaguucaccagua

SEQ ID NO: 2185989 - RNA, 14 nt, Streptococcus pneumoniae R6
uggaguucuuuuca

SEQ ID NO: 2185990 - RNA, 19 nt, Streptococcus pneumoniae R6
uggaguguucuaaaauaag

SEQ ID NO: 2185991 - RNA, 20 nt, Streptococcus pneumoniae R6
uggaguguucuaaaauaagu

SEQ ID NO: 2185992 - RNA, 20 nt, Streptococcus pneumoniae R6
uggauaagcuugugaaagcu

SEQ ID NO: 2185993 - RNA, 15 nt, Streptococcus pneumoniae R6
uggaugucauuccaa

SEQ ID NO: 2185994 - RNA, 16 nt, Streptococcus pneumoniae R6
uggauguuucuuuaaa

SEQ ID NO: 2185995 - RNA, 15 nt, Streptococcus pneumoniae R6
uggaugaaacugacg

SEQ ID NO: 2185996 - RNA, 16 nt, Streptococcus pneumoniae R6
uggaugaguuuacuau

SEQ ID NO: 2185997 - RNA, 14 nt, Streptococcus pneumoniae R6
uggaugccauugga

SEQ ID NO: 2185998 - RNA, 15 nt, Streptococcus pneumoniae R6
uggaugauuuaauua

SEQ ID NO: 2185999 - RNA, 21 nt, Streptococcus pneumoniae R6
uggaugauuuaauuagaaaaa

SEQ ID NO: 2186000 - RNA, 16 nt, Streptococcus pneumoniae R6
uggaucauuucuucug

SEQ ID NO: 2186001 - RNA, 18 nt, Streptococcus pneumoniae R6
uggaucaugguugcuccg

SEQ ID NO: 2186002 - RNA, 23 nt, Streptococcus pneumoniae R6
uggaucuuagguugguugcuucc

SEQ ID NO: 2186003 - RNA, 14 nt, Streptococcus pneumoniae R6
uggaucuagauagu

SEQ ID NO: 2186004 - RNA, 17 nt, Streptococcus pneumoniae R6
uggaucuagauaguacc

SEQ ID NO: 2186005 - RNA, 16 nt, Streptococcus pneumoniae R6
uggcauaagcaaucau

SEQ ID NO: 2186006 - RNA, 13 nt, Streptococcus pneumoniae R6
uggcauaagucau

SEQ ID NO: 2186007 - RNA, 18 nt, Streptococcus pneumoniae R6
uggcaguucuugcucaau

SEQ ID NO: 2186008 - RNA, 16 nt, Streptococcus pneumoniae R6
uggcaggucgguuuua

SEQ ID NO: 2186009 - RNA, 19 nt, Streptococcus pneumoniae R6
uggcaggucgguuuuauua

SEQ ID NO: 2186010 - RNA, 20 nt, Streptococcus pneumoniae R6
uggcaauuuuacuucuuccc

SEQ ID NO: 2186011 - RNA, 22 nt, Streptococcus pneumoniae R6
uggcaauuuuacuucuucccca

SEQ ID NO: 2186012 - RNA, 18 nt, Streptococcus pneumoniae R6
uggcacguguaauggcug

SEQ ID NO: 2186013 - RNA, 20 nt, Streptococcus pneumoniae R6
uggcacgccagucauuacca

SEQ ID NO: 2186014 - RNA, 19 nt, Streptococcus pneumoniae R6
uggcagauagagacauaau

SEQ ID NO: 2186015 - RNA, 13 nt, Streptococcus pneumoniae R6
uggcaaucaaaau

SEQ ID NO: 2186016 - RNA, 14 nt, Streptococcus pneumoniae R6
uggcaauaaacauc

SEQ ID NO: 2186017 - RNA, 23 nt, Streptococcus pneumoniae R6
uggcaaauuccuugaugagcaaa

SEQ ID NO: 2186018 - RNA, 13 nt, Streptococcus pneumoniae R6
uggcaaauugaua

SEQ ID NO: 2186019 - RNA, 19 nt, Streptococcus pneumoniae R6
uggcaaccaagucugcaug

SEQ ID NO: 2186020 - RNA, 18 nt, Streptococcus pneumoniae R6
uggcaacguuaaagaguu

SEQ ID NO: 2186021 - RNA, 15 nt, Streptococcus pneumoniae R6
uggcaagaucaaguu

SEQ ID NO: 2186022 - RNA, 17 nt, Streptococcus pneumoniae R6
uggcaagaucaaguuca

SEQ ID NO: 2186023 - RNA, 21 nt, Streptococcus pneumoniae R6
uggauuuuaaaaguuuuauua

SEQ ID NO: 2186024 - RNA, 18 nt, Streptococcus pneumoniae R6
uggauuugucauucagau

SEQ ID NO: 2186025 - RNA, 15 nt, Streptococcus pneumoniae R6
uggauuuuucuucuu

SEQ ID NO: 2186026 - RNA, 18 nt, Streptococcus pneumoniae R6
uggauuuuucuucuuuuc

SEQ ID NO: 2186027 - RNA, 17 nt, Streptococcus pneumoniae R6
uggauuuucacgaguca

SEQ ID NO: 2186028 - RNA, 22 nt, Streptococcus pneumoniae R6
uggauuuucugaaguuccucuu

SEQ ID NO: 2186029 - RNA, 20 nt, Streptococcus pneumoniae R6
uggauuaauccccauuugcu

SEQ ID NO: 2186030 - RNA, 15 nt, Streptococcus pneumoniae R6
uggauuauuaccuug

SEQ ID NO: 2186031 - RNA, 21 nt, Streptococcus pneumoniae R6
uggauuauuaccuugaacgac

SEQ ID NO: 2186032 - RNA, 18 nt, Streptococcus pneumoniae R6
uggauugauacucuucga

SEQ ID NO: 2186033 - RNA, 16 nt, Streptococcus pneumoniae R6
uggauugauugagaaa

SEQ ID NO: 2186034 - RNA, 13 nt, Streptococcus pneumoniae R6
uggauuuaaaaac

SEQ ID NO: 2186035 - RNA, 21 nt, Streptococcus pneumoniae R6
uggauuguauagugaauugaa

SEQ ID NO: 2186036 - RNA, 20 nt, Streptococcus pneumoniae R6
uguuugagaugauuugcuca

SEQ ID NO: 2186037 - RNA, 19 nt, Streptococcus pneumoniae R6
uguuugaaucaauucuuca

SEQ ID NO: 2186038 - RNA, 13 nt, Streptococcus pneumoniae R6
uguuucuuuuugg

SEQ ID NO: 2186039 - RNA, 18 nt, Streptococcus pneumoniae R6
uguuugccaucuagacua

SEQ ID NO: 2186040 - RNA, 13 nt, Streptococcus pneumoniae R6
uguuucuuuaaau

SEQ ID NO: 2186041 - RNA, 12 nt, Streptococcus pneumoniae R6
uguuucuuuuug

SEQ ID NO: 2186042 - RNA, 15 nt, Streptococcus pneumoniae R6
uguuucuugagaaga

SEQ ID NO: 2186043 - RNA, 20 nt, Streptococcus pneumoniae R6
uguuucuugggguuucaucc

SEQ ID NO: 2186044 - RNA, 14 nt, Streptococcus pneumoniae R6
uguuucuaaaacau

SEQ ID NO: 2186045 - RNA, 20 nt, Streptococcus pneumoniae R6
uguuucuaaaacauugugag

SEQ ID NO: 2186046 - RNA, 18 nt, Streptococcus pneumoniae R6
uguuucguacuauuucag

SEQ ID NO: 2186047 - RNA, 19 nt, Streptococcus pneumoniae R6
uguuucguacuauuucaga

SEQ ID NO: 2186048 - RNA, 20 nt, Streptococcus pneumoniae R6
uguuugggggcaguacagaa

SEQ ID NO: 2186049 - RNA, 20 nt, Streptococcus pneumoniae R6
uguuugguugucaaaccaca

SEQ ID NO: 2186050 - RNA, 18 nt, Streptococcus pneumoniae R6
uguuuuaggaacaauaaa

SEQ ID NO: 2186051 - RNA, 15 nt, Streptococcus pneumoniae R6
uguuuuaaggagcaa

SEQ ID NO: 2186052 - RNA, 23 nt, Streptococcus pneumoniae R6
uguuuuagaugauuggaaauuca

SEQ ID NO: 2186053 - RNA, 17 nt, Streptococcus pneumoniae R6
uguuuucacauuuucaa

SEQ ID NO: 2186054 - RNA, 13 nt, Streptococcus pneumoniae R6
uguuuuccuuuca

SEQ ID NO: 2186055 - RNA, 15 nt, Streptococcus pneumoniae R6
uguuuuccuuucaau

SEQ ID NO: 2186056 - RNA, 16 nt, Streptococcus pneumoniae R6
uguuuuccuuucaaug

SEQ ID NO: 2186057 - RNA, 11 nt, Streptococcus pneumoniae R6
uguuuuauuac

SEQ ID NO: 2186058 - RNA, 18 nt, Streptococcus pneumoniae R6
uguuuucaaaaagcauuc

SEQ ID NO: 2186059 - RNA, 19 nt, Streptococcus pneumoniae R6
uguuuucaaaaagcauucu

SEQ ID NO: 2186060 - RNA, 19 nt, Streptococcus pneumoniae R6
uguuuucuuggucauuuga

SEQ ID NO: 2186061 - RNA, 12 nt, Streptococcus pneumoniae R6
uguuuucucaau

SEQ ID NO: 2186062 - RNA, 16 nt, Streptococcus pneumoniae R6
uguuuauagauaaaug

SEQ ID NO: 2186063 - RNA, 18 nt, Streptococcus pneumoniae R6
uguuuauagauaaauguu

SEQ ID NO: 2186064 - RNA, 14 nt, Streptococcus pneumoniae R6
uguuuauaaucauu

SEQ ID NO: 2186065 - RNA, 18 nt, Streptococcus pneumoniae R6
uguuuauaaucauuaaaa

SEQ ID NO: 2186066 - RNA, 16 nt, Streptococcus pneumoniae R6
uguuuacguuuuaaaa

SEQ ID NO: 2186067 - RNA, 16 nt, Streptococcus pneumoniae R6
uguuuagcaucuaaau

SEQ ID NO: 2186068 - RNA, 18 nt, Streptococcus pneumoniae R6
uguuuagcaucuaaauga

SEQ ID NO: 2186069 - RNA, 12 nt, Streptococcus pneumoniae R6
uguuuaauacuc

SEQ ID NO: 2186070 - RNA, 17 nt, Streptococcus pneumoniae R6
uguuuaauucuugaaaa

SEQ ID NO: 2186071 - RNA, 14 nt, Streptococcus pneumoniae R6
uguuuaaauacuuu

SEQ ID NO: 2186072 - RNA, 17 nt, Streptococcus pneumoniae R6
uguuuaaauacuuuuuc

SEQ ID NO: 2186073 - RNA, 19 nt, Streptococcus pneumoniae R6
uguuuaaagacgauguuga

SEQ ID NO: 2186074 - RNA, 13 nt, Streptococcus pneumoniae R6
uguuuaaaaucug

SEQ ID NO: 2186075 - RNA, 15 nt, Streptococcus pneumoniae R6
uguuucccuaauaau

SEQ ID NO: 2186076 - RNA, 23 nt, Streptococcus pneumoniae R6
uguuuccaaggaaaguucuuccc

SEQ ID NO: 2186077 - RNA, 17 nt, Streptococcus pneumoniae R6
uguuucauguaagaguu

SEQ ID NO: 2186078 - RNA, 18 nt, Streptococcus pneumoniae R6
uguuucaaaugaaauauu

SEQ ID NO: 2186079 - RNA, 19 nt, Streptococcus pneumoniae R6
uguuucaaaugaaauauuu

SEQ ID NO: 2186080 - RNA, 23 nt, Streptococcus pneumoniae R6
uguuucaaaugaaauauuuuuua

SEQ ID NO: 2186081 - RNA, 17 nt, Streptococcus pneumoniae R6
uguuucacuaggauuuu

SEQ ID NO: 2186082 - RNA, 17 nt, Streptococcus pneumoniae R6
uuaaaaguaagagaaac

SEQ ID NO: 2186083 - RNA, 22 nt, Streptococcus pneumoniae R6
uuaaaaguagcgcccuuguucu

SEQ ID NO: 2186084 - RNA, 13 nt, Streptococcus pneumoniae R6
uuaaaauaaguua

SEQ ID NO: 2186085 - RNA, 14 nt, Streptococcus pneumoniae R6
uuaaaaucaaaaaa

SEQ ID NO: 2186086 - RNA, 15 nt, Streptococcus pneumoniae R6
uuaaaauccauaauu

SEQ ID NO: 2186087 - RNA, 17 nt, Streptococcus pneumoniae R6
uuaaaaugaauucuaug

SEQ ID NO: 2186088 - RNA, 21 nt, Streptococcus pneumoniae R6
uuaaaaugagucuaucaaaca

SEQ ID NO: 2186089 - RNA, 21 nt, Streptococcus pneumoniae R6
uuaaaauuacucccauucuuc

SEQ ID NO: 2186090 - RNA, 12 nt, Streptococcus pneumoniae R6
uuaaaauuaaaa

SEQ ID NO: 2186091 - RNA, 19 nt, Streptococcus pneumoniae R6
uuaaacuaguuuucuaaag

SEQ ID NO: 2186092 - RNA, 17 nt, Streptococcus pneumoniae R6
uuaaacuaauguaaaaa

SEQ ID NO: 2186093 - RNA, 22 nt, Streptococcus pneumoniae R6
uuaaacuaauguaaaaaaguug

SEQ ID NO: 2186094 - RNA, 21 nt, Streptococcus pneumoniae R6
uuaaacgugcuauaucaaaac

SEQ ID NO: 2186095 - RNA, 21 nt, Streptococcus pneumoniae R6
uuaaacucugcacguguaaug

SEQ ID NO: 2186096 - RNA, 19 nt, Streptococcus pneumoniae R6
uuaaaguuaauagaagaac

SEQ ID NO: 2186097 - RNA, 16 nt, Streptococcus pneumoniae R6
uuaaaguuuaacccac

SEQ ID NO: 2186098 - RNA, 20 nt, Streptococcus pneumoniae R6
uuaaaguuauuggaacuaaa

SEQ ID NO: 2186099 - RNA, 19 nt, Streptococcus pneumoniae R6
uuaaaguuccggaaaccaa

SEQ ID NO: 2186100 - RNA, 13 nt, Streptococcus pneumoniae R6
uuaaagcaaauua

SEQ ID NO: 2186101 - RNA, 17 nt, Streptococcus pneumoniae R6
uuaaagccaucuaaaac

SEQ ID NO: 2186102 - RNA, 20 nt, Streptococcus pneumoniae R6
uuaaaaauguugcauuuuuu

SEQ ID NO: 2186103 - RNA, 12 nt, Streptococcus pneumoniae R6
uuaaaacaaaga

SEQ ID NO: 2186104 - RNA, 13 nt, Streptococcus pneumoniae R6
uuaaaacaaagaa

SEQ ID NO: 2186105 - RNA, 12 nt, Streptococcus pneumoniae R6
uuaaaacagugu

SEQ ID NO: 2186106 - RNA, 13 nt, Streptococcus pneumoniae R6
uuaaaacaguguu

SEQ ID NO: 2186107 - RNA, 22 nt, Streptococcus pneumoniae R6
uuaaaacaguguuuugagcuga

SEQ ID NO: 2186108 - RNA, 17 nt, Streptococcus pneumoniae R6
uuaaaaaauaacucugu

SEQ ID NO: 2186109 - RNA, 17 nt, Streptococcus pneumoniae R6
uuaaaaaauaaucaaaa

SEQ ID NO: 2186110 - RNA, 12 nt, Streptococcus pneumoniae R6
uuaaaaacucag

SEQ ID NO: 2186111 - RNA, 21 nt, Streptococcus pneumoniae R6
uguuuuuucaaguaaagagcu

SEQ ID NO: 2186112 - RNA, 11 nt, Streptococcus pneumoniae R6
uguuuuuucau

SEQ ID NO: 2186113 - RNA, 17 nt, Streptococcus pneumoniae R6
uguuuuuucuugcuugu

SEQ ID NO: 2186114 - RNA, 18 nt, Streptococcus pneumoniae R6
uguuuuuuccguuuuaua

SEQ ID NO: 2186115 - RNA, 11 nt, Streptococcus pneumoniae R6
uuaaaaaacca

SEQ ID NO: 2186116 - RNA, 23 nt, Streptococcus pneumoniae R6
uuaaaaaaccaauucccaaacau

SEQ ID NO: 2186117 - RNA, 13 nt, Streptococcus pneumoniae R6
uguuuuucgucac

SEQ ID NO: 2186118 - RNA, 14 nt, Streptococcus pneumoniae R6
uguuuugucgcuuu

SEQ ID NO: 2186119 - RNA, 19 nt, Streptococcus pneumoniae R6
uguuuuuauaugauuucaa

SEQ ID NO: 2186120 - RNA, 17 nt, Streptococcus pneumoniae R6
uguuaagaaauaaaaua

SEQ ID NO: 2186121 - RNA, 17 nt, Streptococcus pneumoniae R6
uguuaagccuauucccu

SEQ ID NO: 2186122 - RNA, 17 nt, Streptococcus pneumoniae R6
uguuaagugcuucuuug

SEQ ID NO: 2186123 - RNA, 21 nt, Streptococcus pneumoniae R6
uguuauuaagauuacagauca

SEQ ID NO: 2186124 - RNA, 17 nt, Streptococcus pneumoniae R6
uguuaucuucgcaacug

SEQ ID NO: 2186125 - RNA, 18 nt, Streptococcus pneumoniae R6
uguuaucguuuuaucugc

SEQ ID NO: 2186126 - RNA, 19 nt, Streptococcus pneumoniae R6
uguuaucguuuuaucugca

SEQ ID NO: 2186127 - RNA, 23 nt, Streptococcus pneumoniae R6
uguucacgauuggggucagaaag

SEQ ID NO: 2186128 - RNA, 19 nt, Streptococcus pneumoniae R6
uguuauuuaggacaucaua

SEQ ID NO: 2186129 - RNA, 15 nt, Streptococcus pneumoniae R6
uguuccucuuuuugu

SEQ ID NO: 2186130 - RNA, 14 nt, Streptococcus pneumoniae R6
uguuccuaaaacag

SEQ ID NO: 2186131 - RNA, 18 nt, Streptococcus pneumoniae R6
uguucuaagguuucaaaa

SEQ ID NO: 2186132 - RNA, 19 nt, Streptococcus pneumoniae R6
uguucuaagguuucaaaac

SEQ ID NO: 2186133 - RNA, 14 nt, Streptococcus pneumoniae R6
uguucuaaguuggg

SEQ ID NO: 2186134 - RNA, 13 nt, Streptococcus pneumoniae R6
uguucuaagaacu

SEQ ID NO: 2186135 - RNA, 12 nt, Streptococcus pneumoniae R6
uguuccagacuc

SEQ ID NO: 2186136 - RNA, 17 nt, Streptococcus pneumoniae R6
uguuccagacucaucug

SEQ ID NO: 2186137 - RNA, 20 nt, Streptococcus pneumoniae R6
uguucaggugcgagagcuuu

SEQ ID NO: 2186138 - RNA, 14 nt, Streptococcus pneumoniae R6
uguugcauuaaaaa

SEQ ID NO: 2186139 - RNA, 11 nt, Streptococcus pneumoniae R6
uguucuaucac

SEQ ID NO: 2186140 - RNA, 16 nt, Streptococcus pneumoniae R6
uguucuaucacauugu

SEQ ID NO: 2186141 - RNA, 21 nt, Streptococcus pneumoniae R6
uguucuacucuaaccauuaua

SEQ ID NO: 2186142 - RNA, 14 nt, Streptococcus pneumoniae R6
uguugcaaauuuau

SEQ ID NO: 2186143 - RNA, 16 nt, Streptococcus pneumoniae R6
uguugucccuuuuuca

SEQ ID NO: 2186144 - RNA, 16 nt, Streptococcus pneumoniae R6
uguuguuuauuaccuu

SEQ ID NO: 2186145 - RNA, 16 nt, Streptococcus pneumoniae R6
uguuguaauuuuaaaa

SEQ ID NO: 2186146 - RNA, 20 nt, Streptococcus pneumoniae R6
ugugacuguuucagagacag

SEQ ID NO: 2186147 - RNA, 21 nt, Streptococcus pneumoniae R6
ugugaggaccagguuuuucac

SEQ ID NO: 2186148 - RNA, 20 nt, Streptococcus pneumoniae R6
ugucacucgggcaauuggaa

SEQ ID NO: 2186149 - RNA, 19 nt, Streptococcus pneumoniae R6
ugucagauaggauugcccu

SEQ ID NO: 2186150 - RNA, 23 nt, Streptococcus pneumoniae R6
ugugaccugcuuucugcaguuuc

SEQ ID NO: 2186151 - RNA, 19 nt, Streptococcus pneumoniae R6
ugugacguggguguagaug

SEQ ID NO: 2186152 - RNA, 19 nt, Streptococcus pneumoniae R6
uguuaaagccaucuaaaac

SEQ ID NO: 2186153 - RNA, 20 nt, Streptococcus pneumoniae R6
uguuaaaucauuauuuaacu

SEQ ID NO: 2186154 - RNA, 13 nt, Streptococcus pneumoniae R6
uguuaacccacuc

SEQ ID NO: 2186155 - RNA, 21 nt, Streptococcus pneumoniae R6
uguuaaaaugagucuaucaaa

SEQ ID NO: 2186156 - RNA, 16 nt, Streptococcus pneumoniae R6
uguuaaacaaggcaga

SEQ ID NO: 2186157 - RNA, 18 nt, Streptococcus pneumoniae R6
uguguuuuuucuugcuug

SEQ ID NO: 2186158 - RNA, 20 nt, Streptococcus pneumoniae R6
ugugugccaguugcuguaau

SEQ ID NO: 2186159 - RNA, 18 nt, Streptococcus pneumoniae R6
ugugucuugcauuuuaau

SEQ ID NO: 2186160 - RNA, 20 nt, Streptococcus pneumoniae R6
ugugugacaaaauaaaaaca

SEQ ID NO: 2186161 - RNA, 22 nt, Streptococcus pneumoniae R6
ugugugacaaaauaaaaacauc

SEQ ID NO: 2186162 - RNA, 13 nt, Streptococcus pneumoniae R6
uguguauggagga

SEQ ID NO: 2186163 - RNA, 20 nt, Streptococcus pneumoniae R6
ugugggaauguuugcuucau

SEQ ID NO: 2186164 - RNA, 15 nt, Streptococcus pneumoniae R6
ugugcuauucuaaau

SEQ ID NO: 2186165 - RNA, 17 nt, Streptococcus pneumoniae R6
uguggcgacuuccuugc

SEQ ID NO: 2186166 - RNA, 12 nt, Streptococcus pneumoniae R6
uuaccuguuuuc

SEQ ID NO: 2186167 - RNA, 18 nt, Streptococcus pneumoniae R6
uuaccugaaauauacuca

SEQ ID NO: 2186168 - RNA, 17 nt, Streptococcus pneumoniae R6
uuacaauccugcgaaau

SEQ ID NO: 2186169 - RNA, 19 nt, Streptococcus pneumoniae R6
uuacaauccugcgaaaucu

SEQ ID NO: 2186170 - RNA, 13 nt, Streptococcus pneumoniae R6
uuacaauguaaua

SEQ ID NO: 2186171 - RNA, 15 nt, Streptococcus pneumoniae R6
uuacaauuguaaaaa

SEQ ID NO: 2186172 - RNA, 17 nt, Streptococcus pneumoniae R6
uuacaauuuaccugcua

SEQ ID NO: 2186173 - RNA, 21 nt, Streptococcus pneumoniae R6
uuacaggcaggacaaaagaua

SEQ ID NO: 2186174 - RNA, 14 nt, Streptococcus pneumoniae R6
uuacaguauuuaua

SEQ ID NO: 2186175 - RNA, 20 nt, Streptococcus pneumoniae R6
uuaccaaguuaaacaaccuu

SEQ ID NO: 2186176 - RNA, 22 nt, Streptococcus pneumoniae R6
uuaccaauacaggaaaaccagu

SEQ ID NO: 2186177 - RNA, 20 nt, Streptococcus pneumoniae R6
uuacaguuauuuuaguaaaa

SEQ ID NO: 2186178 - RNA, 14 nt, Streptococcus pneumoniae R6
uuaccaauuuuucc

SEQ ID NO: 2186179 - RNA, 17 nt, Streptococcus pneumoniae R6
uuaccacuuccuaccua

SEQ ID NO: 2186180 - RNA, 16 nt, Streptococcus pneumoniae R6
uuaccacuaaacuaca

SEQ ID NO: 2186181 - RNA, 18 nt, Streptococcus pneumoniae R6
uuaauguugguaagagaa

SEQ ID NO: 2186182 - RNA, 18 nt, Streptococcus pneumoniae R6
uuaauuuuacuuucccaa

SEQ ID NO: 2186183 - RNA, 15 nt, Streptococcus pneumoniae R6
uuaauugaauuucaa

SEQ ID NO: 2186184 - RNA, 21 nt, Streptococcus pneumoniae R6
uuaauugaauuucaagaauga

SEQ ID NO: 2186185 - RNA, 15 nt, Streptococcus pneumoniae R6
uuaauauauuuauua

SEQ ID NO: 2186186 - RNA, 17 nt, Streptococcus pneumoniae R6
uuaaucaaaauaaagca

SEQ ID NO: 2186187 - RNA, 22 nt, Streptococcus pneumoniae R6
uuaaucagaauggguuaaaauu

SEQ ID NO: 2186188 - RNA, 19 nt, Streptococcus pneumoniae R6
uuaaucauacacauguuaa

SEQ ID NO: 2186189 - RNA, 14 nt, Streptococcus pneumoniae R6
uuaauauauaaaaa

SEQ ID NO: 2186190 - RNA, 17 nt, Streptococcus pneumoniae R6
uuaauauauaaaaaaua

SEQ ID NO: 2186191 - RNA, 19 nt, Streptococcus pneumoniae R6
uuaauauauaaaaaauaua

SEQ ID NO: 2186192 - RNA, 15 nt, Streptococcus pneumoniae R6
uuaaaucuuauauuu

SEQ ID NO: 2186193 - RNA, 17 nt, Streptococcus pneumoniae R6
uuaaaucgcuauaaaua

SEQ ID NO: 2186194 - RNA, 13 nt, Streptococcus pneumoniae R6
uuaaaucauaauc

SEQ ID NO: 2186195 - RNA, 24 nt, Streptococcus pneumoniae R6
uuaaauccuauaccaagcucagca

SEQ ID NO: 2186196 - RNA, 18 nt, Streptococcus pneumoniae R6
uuaaauccugcaaagaua

SEQ ID NO: 2186197 - RNA, 19 nt, Streptococcus pneumoniae R6
uuaagaacucuuuccaacu

SEQ ID NO: 2186198 - RNA, 20 nt, Streptococcus pneumoniae R6
uuaacuccuuuguuuauaga

SEQ ID NO: 2186199 - RNA, 12 nt, Streptococcus pneumoniae R6
uuaagaaucuuu

SEQ ID NO: 2186200 - RNA, 18 nt, Streptococcus pneumoniae R6
uuaagaagucaucuauca

SEQ ID NO: 2186201 - RNA, 22 nt, Streptococcus pneumoniae R6
uuaagaagucaucuaucaaaag

SEQ ID NO: 2186202 - RNA, 18 nt, Streptococcus pneumoniae R6
uuaagagacuuugguauu

SEQ ID NO: 2186203 - RNA, 23 nt, Streptococcus pneumoniae R6
uuaagagaguuacggguuuuaaa

SEQ ID NO: 2186204 - RNA, 23 nt, Streptococcus pneumoniae R6
uuaagguuguagauggaacugac

SEQ ID NO: 2186205 - RNA, 23 nt, Streptococcus pneumoniae R6
uuaagguuguggauggaacugac

SEQ ID NO: 2186206 - RNA, 18 nt, Streptococcus pneumoniae R6
uuaaguauccaucacagu

SEQ ID NO: 2186207 - RNA, 19 nt, Streptococcus pneumoniae R6
uuaagguugcagauagaac

SEQ ID NO: 2186208 - RNA, 18 nt, Streptococcus pneumoniae R6
uuaagugacuauuaguuu

SEQ ID NO: 2186209 - RNA, 20 nt, Streptococcus pneumoniae R6
uuaggauagauaccuuguua

SEQ ID NO: 2186210 - RNA, 12 nt, Streptococcus pneumoniae R6
uuaggcaauaaa

SEQ ID NO: 2186211 - RNA, 22 nt, Streptococcus pneumoniae R6
uuaggccuaaggcuguuucaaa

SEQ ID NO: 2186212 - RNA, 16 nt, Streptococcus pneumoniae R6
uuaggacaauuucucg

SEQ ID NO: 2186213 - RNA, 20 nt, Streptococcus pneumoniae R6
uuaggacuaaauacaaaaac

SEQ ID NO: 2186214 - RNA, 22 nt, Streptococcus pneumoniae R6
uuagccuccauucaguuucuau

SEQ ID NO: 2186215 - RNA, 20 nt, Streptococcus pneumoniae R6
uuagcguuggaauaaggcag

SEQ ID NO: 2186216 - RNA, 16 nt, Streptococcus pneumoniae R6
uuagcuguuuggccaa

SEQ ID NO: 2186217 - RNA, 19 nt, Streptococcus pneumoniae R6
uuagcucugugcaauacag

SEQ ID NO: 2186218 - RNA, 18 nt, Streptococcus pneumoniae R6
uuagccacaacuaggaag

SEQ ID NO: 2186219 - RNA, 19 nt, Streptococcus pneumoniae R6
uuagcaucuucuucuggug

SEQ ID NO: 2186220 - RNA, 16 nt, Streptococcus pneumoniae R6
uuagccauacguuuca

SEQ ID NO: 2186221 - RNA, 21 nt, Streptococcus pneumoniae R6
uuagauuuuuucugucuaacu

SEQ ID NO: 2186222 - RNA, 12 nt, Streptococcus pneumoniae R6
uuagcaaucacu

SEQ ID NO: 2186223 - RNA, 19 nt, Streptococcus pneumoniae R6
uuagcaaucacucuaacuu

SEQ ID NO: 2186224 - RNA, 13 nt, Streptococcus pneumoniae R6
uuagcagacuucu

SEQ ID NO: 2186225 - RNA, 17 nt, Streptococcus pneumoniae R6
uuagaagagguaucugu

SEQ ID NO: 2186226 - RNA, 15 nt, Streptococcus pneumoniae R6
uuagacagaaaaaau

SEQ ID NO: 2186227 - RNA, 13 nt, Streptococcus pneumoniae R6
uuagacaaauaau

SEQ ID NO: 2186228 - RNA, 22 nt, Streptococcus pneumoniae R6
uuagacaaauaauuuauccaaa

SEQ ID NO: 2186229 - RNA, 16 nt, Streptococcus pneumoniae R6
uuagauuuucuggcag

SEQ ID NO: 2186230 - RNA, 20 nt, Streptococcus pneumoniae R6
uuagaugauuuuucuguuuu

SEQ ID NO: 2186231 - RNA, 23 nt, Streptococcus pneumoniae R6
uuagauagaugcuacuauauucu

SEQ ID NO: 2186232 - RNA, 14 nt, Streptococcus pneumoniae R6
uuacuucaauuucu

SEQ ID NO: 2186233 - RNA, 14 nt, Streptococcus pneumoniae R6
uuacgacauccuau

SEQ ID NO: 2186234 - RNA, 20 nt, Streptococcus pneumoniae R6
uuacuuaccauaauuaaaga

SEQ ID NO: 2186235 - RNA, 19 nt, Streptococcus pneumoniae R6
uuacgaauuauuuccuuga

SEQ ID NO: 2186236 - RNA, 18 nt, Streptococcus pneumoniae R6
uuacgacaacgguaucuu

SEQ ID NO: 2186237 - RNA, 14 nt, Streptococcus pneumoniae R6
uuaccuuugaaaaa

SEQ ID NO: 2186238 - RNA, 16 nt, Streptococcus pneumoniae R6
uuacgaaauuggauau

SEQ ID NO: 2186239 - RNA, 20 nt, Streptococcus pneumoniae R6
uuagaaccaagaucuugucu

SEQ ID NO: 2186240 - RNA, 15 nt, Streptococcus pneumoniae R6
uuagaaagguaaaau

SEQ ID NO: 2186241 - RNA, 17 nt, Streptococcus pneumoniae R6
uuagaaauagauucucu

SEQ ID NO: 2186242 - RNA, 18 nt, Streptococcus pneumoniae R6
uuagaaaucaaaaagcaa

SEQ ID NO: 2186243 - RNA, 17 nt, Streptococcus pneumoniae R6
uuacuugcguuucuucu

SEQ ID NO: 2186244 - RNA, 12 nt, Streptococcus pneumoniae R6
uuacuucuuccc

SEQ ID NO: 2186245 - RNA, 20 nt, Streptococcus pneumoniae R6
uuacuuccuuuucuacugaa

SEQ ID NO: 2186246 - RNA, 21 nt, Streptococcus pneumoniae R6
uuacuucguucacccuugcuu

SEQ ID NO: 2186247 - RNA, 14 nt, Streptococcus pneumoniae R6
uuacuucuaaaaca

SEQ ID NO: 2186248 - RNA, 17 nt, Streptococcus pneumoniae R6
uuauacuuuuaauauuu

SEQ ID NO: 2186249 - RNA, 17 nt, Streptococcus pneumoniae R6
uuauacucuuagaaaau

SEQ ID NO: 2186250 - RNA, 14 nt, Streptococcus pneumoniae R6
uuauacucuucaaa

SEQ ID NO: 2186251 - RNA, 20 nt, Streptococcus pneumoniae R6
uuauaguuuugauuauuuuu

SEQ ID NO: 2186252 - RNA, 22 nt, Streptococcus pneumoniae R6
uuauauaaaaagaaaugucauc

SEQ ID NO: 2186253 - RNA, 14 nt, Streptococcus pneumoniae R6
uuauauaaaaagac

SEQ ID NO: 2186254 - RNA, 15 nt, Streptococcus pneumoniae R6
uuauauaaaaagacc

SEQ ID NO: 2186255 - RNA, 12 nt, Streptococcus pneumoniae R6
uuauauaaaaag

SEQ ID NO: 2186256 - RNA, 20 nt, Streptococcus pneumoniae R6
uuauagucgcuauaagauga

SEQ ID NO: 2186257 - RNA, 15 nt, Streptococcus pneumoniae R6
uuauaccaaaaaaac

SEQ ID NO: 2186258 - RNA, 16 nt, Streptococcus pneumoniae R6
uuauaccaaaaaaacu

SEQ ID NO: 2186259 - RNA, 19 nt, Streptococcus pneumoniae R6
uuauaucuuauuucaguuu

SEQ ID NO: 2186260 - RNA, 14 nt, Streptococcus pneumoniae R6
uuauaugauuucaa

SEQ ID NO: 2186261 - RNA, 14 nt, Streptococcus pneumoniae R6
uuauaugcgaacua

SEQ ID NO: 2186262 - RNA, 21 nt, Streptococcus pneumoniae R6
uuauauaaaauaauuaaaaug

SEQ ID NO: 2186263 - RNA, 14 nt, Streptococcus pneumoniae R6
uuauauuaaaaaaa

SEQ ID NO: 2186264 - RNA, 20 nt, Streptococcus pneumoniae R6
uuaucaaaaucgauagccaa

SEQ ID NO: 2186265 - RNA, 21 nt, Streptococcus pneumoniae R6
uuauauuuaggggucaugacu

SEQ ID NO: 2186266 - RNA, 13 nt, Streptococcus pneumoniae R6
uuauaaaaaacaa

SEQ ID NO: 2186267 - RNA, 13 nt, Streptococcus pneumoniae R6
uuauaaaaaacac

SEQ ID NO: 2186268 - RNA, 12 nt, Streptococcus pneumoniae R6
uuaguucuacuu

SEQ ID NO: 2186269 - RNA, 23 nt, Streptococcus pneumoniae R6
uuaguucucaggaauuaauggca

SEQ ID NO: 2186270 - RNA, 16 nt, Streptococcus pneumoniae R6
uuaguuccaauaacuu

SEQ ID NO: 2186271 - RNA, 13 nt, Streptococcus pneumoniae R6
uuaguucuguauu

SEQ ID NO: 2186272 - RNA, 15 nt, Streptococcus pneumoniae R6
uuagucaaaaagaag

SEQ ID NO: 2186273 - RNA, 14 nt, Streptococcus pneumoniae R6
uuagucuuauccuu

SEQ ID NO: 2186274 - RNA, 15 nt, Streptococcus pneumoniae R6
uuagucggaaucuuu

SEQ ID NO: 2186275 - RNA, 19 nt, Streptococcus pneumoniae R6
uuagucuauucuuuccuuu

SEQ ID NO: 2186276 - RNA, 13 nt, Streptococcus pneumoniae R6
uuaguuaaaauaa

SEQ ID NO: 2186277 - RNA, 14 nt, Streptococcus pneumoniae R6
uuagggauacucca

SEQ ID NO: 2186278 - RNA, 13 nt, Streptococcus pneumoniae R6
uuagggaaacaaa

SEQ ID NO: 2186279 - RNA, 20 nt, Streptococcus pneumoniae R6
uuagggaaacaaaagucuuc

SEQ ID NO: 2186280 - RNA, 17 nt, Streptococcus pneumoniae R6
uuagggaaauuauuuau

SEQ ID NO: 2186281 - RNA, 17 nt, Streptococcus pneumoniae R6
uuaggugcgagacaaaa

SEQ ID NO: 2186282 - RNA, 13 nt, Streptococcus pneumoniae R6
uuaguaaacaaag

SEQ ID NO: 2186283 - RNA, 21 nt, Streptococcus pneumoniae R6
uuaguaaacagucccauaaaa

SEQ ID NO: 2186284 - RNA, 22 nt, Streptococcus pneumoniae R6
uuaggugaaaugucuauuuucu

SEQ ID NO: 2186285 - RNA, 17 nt, Streptococcus pneumoniae R6
uuagguaguuaaucuau

SEQ ID NO: 2186286 - RNA, 14 nt, Streptococcus pneumoniae R6
uuaguaaucugguc

SEQ ID NO: 2186287 - RNA, 21 nt, Streptococcus pneumoniae R6
uuaguaaugacuuguguuuuu

SEQ ID NO: 2186288 - RNA, 17 nt, Streptococcus pneumoniae R6
uuaguaauucaauuaag

SEQ ID NO: 2186289 - RNA, 13 nt, Streptococcus pneumoniae R6
uuaguauccuuga

SEQ ID NO: 2186290 - RNA, 17 nt, Streptococcus pneumoniae R6
uuaguauaguaaacuga

SEQ ID NO: 2186291 - RNA, 19 nt, Streptococcus pneumoniae R6
uuaguaugagcacuauugu

SEQ ID NO: 2186292 - RNA, 22 nt, Streptococcus pneumoniae R6
ugcugacacgcuugccaacccu

SEQ ID NO: 2186293 - RNA, 17 nt, Streptococcus pneumoniae R6
ugcugggucaaacggcc

SEQ ID NO: 2186294 - RNA, 18 nt, Streptococcus pneumoniae R6
ugcuguccucaaaaugaa

SEQ ID NO: 2186295 - RNA, 18 nt, Streptococcus pneumoniae R6
ugcuucgauaacaagguu

SEQ ID NO: 2186296 - RNA, 14 nt, Streptococcus pneumoniae R6
ugcuuccuccugcc

SEQ ID NO: 2186297 - RNA, 13 nt, Streptococcus pneumoniae R6
ugcuucuguuguc

SEQ ID NO: 2186298 - RNA, 21 nt, Streptococcus pneumoniae R6
ugcuucaucauuuuauucaua

SEQ ID NO: 2186299 - RNA, 21 nt, Streptococcus pneumoniae R6
ugcuuacaugcguuucagcau

SEQ ID NO: 2186300 - RNA, 12 nt, Streptococcus pneumoniae R6
ugcuguuuucau

SEQ ID NO: 2186301 - RNA, 20 nt, Streptococcus pneumoniae R6
ugcuuaaauaggccucuuca

SEQ ID NO: 2186302 - RNA, 17 nt, Streptococcus pneumoniae R6
ugcuugucaucuuccaa

SEQ ID NO: 2186303 - RNA, 18 nt, Streptococcus pneumoniae R6
ugcuugguauugguugug

SEQ ID NO: 2186304 - RNA, 17 nt, Streptococcus pneumoniae R6
ugcuuugcugacuugcc

SEQ ID NO: 2186305 - RNA, 11 nt, Streptococcus pneumoniae R6
ugcuuugaggu

SEQ ID NO: 2186306 - RNA, 12 nt, Streptococcus pneumoniae R6
ugcuuuucuuga

SEQ ID NO: 2186307 - RNA, 18 nt, Streptococcus pneumoniae R6
ugcuuuugugauuuuaaa

SEQ ID NO: 2186308 - RNA, 20 nt, Streptococcus pneumoniae R6
ugcuuucugcaguuucucua

SEQ ID NO: 2186309 - RNA, 13 nt, Streptococcus pneumoniae R6
ugcuuucuaucaa

SEQ ID NO: 2186310 - RNA, 20 nt, Streptococcus pneumoniae R6
ugcuuucuucagauuuuaua

SEQ ID NO: 2186311 - RNA, 23 nt, Streptococcus pneumoniae R6
ugcuuuccaacgauuuuauccaa

SEQ ID NO: 2186312 - RNA, 17 nt, Streptococcus pneumoniae R6
ugcuuuccaauaauuca

SEQ ID NO: 2186313 - RNA, 23 nt, Streptococcus pneumoniae R6
ugcuuuccaauaauucaccuauu

SEQ ID NO: 2186314 - RNA, 20 nt, Streptococcus pneumoniae R6
ugcuuuccucagcaggagca

SEQ ID NO: 2186315 - RNA, 15 nt, Streptococcus pneumoniae R6
ugcuuuccuucauac

SEQ ID NO: 2186316 - RNA, 17 nt, Streptococcus pneumoniae R6
ugcuuuccuuucaaaau

SEQ ID NO: 2186317 - RNA, 21 nt, Streptococcus pneumoniae R6
ugcuuuccauuaauucgauuu

SEQ ID NO: 2186318 - RNA, 20 nt, Streptococcus pneumoniae R6
uggaaagaggacuuuuugug

SEQ ID NO: 2186319 - RNA, 21 nt, Streptococcus pneumoniae R6
uggaaauaacaaaccaagaau

SEQ ID NO: 2186320 - RNA, 13 nt, Streptococcus pneumoniae R6
uggaaaugauaau

SEQ ID NO: 2186321 - RNA, 21 nt, Streptococcus pneumoniae R6
ugcuuuuuuauauggaaaaau

SEQ ID NO: 2186322 - RNA, 14 nt, Streptococcus pneumoniae R6
ugcuuuuucuuuuu

SEQ ID NO: 2186323 - RNA, 15 nt, Streptococcus pneumoniae R6
ugcuuuuucaagcau

SEQ ID NO: 2186324 - RNA, 13 nt, Streptococcus pneumoniae R6
uggaaaccaagaa

SEQ ID NO: 2186325 - RNA, 22 nt, Streptococcus pneumoniae R6
uggaaacucucguaaacaaaga

SEQ ID NO: 2186326 - RNA, 16 nt, Streptococcus pneumoniae R6
uggaaacucaggaugu

SEQ ID NO: 2186327 - RNA, 17 nt, Streptococcus pneumoniae R6
uggaacgcguugugcag

SEQ ID NO: 2186328 - RNA, 16 nt, Streptococcus pneumoniae R6
uggaagugaaaaagca

SEQ ID NO: 2186329 - RNA, 17 nt, Streptococcus pneumoniae R6
uggaaguacaugucagg

SEQ ID NO: 2186330 - RNA, 20 nt, Streptococcus pneumoniae R6
uggaaggcuugguccuuaac

SEQ ID NO: 2186331 - RNA, 18 nt, Streptococcus pneumoniae R6
uggaaggcuguaguuuua

SEQ ID NO: 2186332 - RNA, 21 nt, Streptococcus pneumoniae R6
uggaagaguauuacaaucaua

SEQ ID NO: 2186333 - RNA, 13 nt, Streptococcus pneumoniae R6
uggaaguuucaaa

SEQ ID NO: 2186334 - RNA, 15 nt, Streptococcus pneumoniae R6
uggaaguuuuccuuu

SEQ ID NO: 2186335 - RNA, 23 nt, Streptococcus pneumoniae R6
uggaaucacauuggcaagagcug

SEQ ID NO: 2186336 - RNA, 17 nt, Streptococcus pneumoniae R6
uggaauaguccucccuu

SEQ ID NO: 2186337 - RNA, 21 nt, Streptococcus pneumoniae R6
uggaauaguccucccuucuuu

SEQ ID NO: 2186338 - RNA, 13 nt, Streptococcus pneumoniae R6
uggaauucuggau

SEQ ID NO: 2186339 - RNA, 15 nt, Streptococcus pneumoniae R6
uggacaacaaugaga

SEQ ID NO: 2186340 - RNA, 20 nt, Streptococcus pneumoniae R6
ugcucggcuuuuuguuuucu

SEQ ID NO: 2186341 - RNA, 13 nt, Streptococcus pneumoniae R6
ugcucuaugauuu

SEQ ID NO: 2186342 - RNA, 15 nt, Streptococcus pneumoniae R6
ugcucuaugauuuuc

SEQ ID NO: 2186343 - RNA, 14 nt, Streptococcus pneumoniae R6
ugcucuucugaaau

SEQ ID NO: 2186344 - RNA, 16 nt, Streptococcus pneumoniae R6
ugcucuuaucuguccu

SEQ ID NO: 2186345 - RNA, 17 nt, Streptococcus pneumoniae R6
ugcucuuaucuguccuc

SEQ ID NO: 2186346 - RNA, 14 nt, Streptococcus pneumoniae R6
ugcucgcuggagag

SEQ ID NO: 2186347 - RNA, 14 nt, Streptococcus pneumoniae R6
ugcucccauuuuug

SEQ ID NO: 2186348 - RNA, 21 nt, Streptococcus pneumoniae R6
ugcuaaaacaaaauucuuccu

SEQ ID NO: 2186349 - RNA, 18 nt, Streptococcus pneumoniae R6
ugcguuuuuuugauuuua

SEQ ID NO: 2186350 - RNA, 13 nt, Streptococcus pneumoniae R6
ugcuaacugcugg

SEQ ID NO: 2186351 - RNA, 20 nt, Streptococcus pneumoniae R6
ugcuaaguccuugaugcucu

SEQ ID NO: 2186352 - RNA, 18 nt, Streptococcus pneumoniae R6
ugcuaaucaaaacgcagu

SEQ ID NO: 2186353 - RNA, 19 nt, Streptococcus pneumoniae R6
ugcuaccguugaaaucaau

SEQ ID NO: 2186354 - RNA, 22 nt, Streptococcus pneumoniae R6
ugcuacgacacuauuuacaagu

SEQ ID NO: 2186355 - RNA, 14 nt, Streptococcus pneumoniae R6
ugcuauaucuuauu

SEQ ID NO: 2186356 - RNA, 21 nt, Streptococcus pneumoniae R6
ugcuauagucaauugaaacaa

SEQ ID NO: 2186357 - RNA, 20 nt, Streptococcus pneumoniae R6
ugcuauacuguaguuaugaa

SEQ ID NO: 2186358 - RNA, 19 nt, Streptococcus pneumoniae R6
ugcuaguguggacaugagu

SEQ ID NO: 2186359 - RNA, 19 nt, Streptococcus pneumoniae R6
ugcuaggaagagggcugug

SEQ ID NO: 2186360 - RNA, 18 nt, Streptococcus pneumoniae R6
ugcuaggcugauuccugg

SEQ ID NO: 2186361 - RNA, 17 nt, Streptococcus pneumoniae R6
ugcuacugcauccaaca

SEQ ID NO: 2186362 - RNA, 14 nt, Streptococcus pneumoniae R6
ugcuagacuaacuu

SEQ ID NO: 2186363 - RNA, 16 nt, Streptococcus pneumoniae R6
ugcuauugcuuuuaga

SEQ ID NO: 2186364 - RNA, 12 nt, Streptococcus pneumoniae R6
ugcuauucuaaa

SEQ ID NO: 2186365 - RNA, 19 nt, Streptococcus pneumoniae R6
ugcuauugaaaggaaaaug

SEQ ID NO: 2186366 - RNA, 19 nt, Streptococcus pneumoniae R6
ugcucaaaacacuguuuua

SEQ ID NO: 2186367 - RNA, 19 nt, Streptococcus pneumoniae R6
ugcucaaagcacugauuug

SEQ ID NO: 2186368 - RNA, 23 nt, Streptococcus pneumoniae R6
ugcucaaaguacagauuugaaaa

SEQ ID NO: 2186369 - RNA, 17 nt, Streptococcus pneumoniae R6
ugcucaaaguacugcuu

SEQ ID NO: 2186370 - RNA, 14 nt, Streptococcus pneumoniae R6
ugcguuaaaaguua

SEQ ID NO: 2186371 - RNA, 21 nt, Streptococcus pneumoniae R6
ugccagaaaaagucaauaaua

SEQ ID NO: 2186372 - RNA, 15 nt, Streptococcus pneumoniae R6
ugccagaaauucccu

SEQ ID NO: 2186373 - RNA, 18 nt, Streptococcus pneumoniae R6
ugccagaaauucccucug

SEQ ID NO: 2186374 - RNA, 18 nt, Streptococcus pneumoniae R6
ugccaacccucucuucaa

SEQ ID NO: 2186375 - RNA, 13 nt, Streptococcus pneumoniae R6
ugcaguauaucug

SEQ ID NO: 2186376 - RNA, 12 nt, Streptococcus pneumoniae R6
ugcccaagagac

SEQ ID NO: 2186377 - RNA, 23 nt, Streptococcus pneumoniae R6
ugccauauguccuucaugaaauu

SEQ ID NO: 2186378 - RNA, 13 nt, Streptococcus pneumoniae R6
ugccauagcuccu

SEQ ID NO: 2186379 - RNA, 15 nt, Streptococcus pneumoniae R6
ugccaguucuucaug

SEQ ID NO: 2186380 - RNA, 13 nt, Streptococcus pneumoniae R6
ugcccuucuagag

SEQ ID NO: 2186381 - RNA, 13 nt, Streptococcus pneumoniae R6
ugcccuuuuuugu

SEQ ID NO: 2186382 - RNA, 13 nt, Streptococcus pneumoniae R6
ugccccugaugag

SEQ ID NO: 2186383 - RNA, 23 nt, Streptococcus pneumoniae R6
ugcccauucuuuagcagagaaga

SEQ ID NO: 2186384 - RNA, 16 nt, Streptococcus pneumoniae R6
ugcccacuaaaaauau

SEQ ID NO: 2186385 - RNA, 17 nt, Streptococcus pneumoniae R6
ugcccaucauuccugau

SEQ ID NO: 2186386 - RNA, 18 nt, Streptococcus pneumoniae R6
ugcgcaacacacuguuuu

SEQ ID NO: 2186387 - RNA, 22 nt, Streptococcus pneumoniae R6
ugcgauuuuuguguuuuuucuu

SEQ ID NO: 2186388 - RNA, 20 nt, Streptococcus pneumoniae R6
ugcgauacgaucugaaauaa

SEQ ID NO: 2186389 - RNA, 22 nt, Streptococcus pneumoniae R6
ugcgauaaagcuaaagaugaug

SEQ ID NO: 2186390 - RNA, 21 nt, Streptococcus pneumoniae R6
ugcgaguugugaauuucauua

SEQ ID NO: 2186391 - RNA, 13 nt, Streptococcus pneumoniae R6
ugcgaugaugagg

SEQ ID NO: 2186392 - RNA, 13 nt, Streptococcus pneumoniae R6
ugcgcacuuguuc

SEQ ID NO: 2186393 - RNA, 15 nt, Streptococcus pneumoniae R6
ugcgaaucaauuuuu

SEQ ID NO: 2186394 - RNA, 16 nt, Streptococcus pneumoniae R6
ugcgaacuagcuaacu

SEQ ID NO: 2186395 - RNA, 17 nt, Streptococcus pneumoniae R6
ugcgacguuuucuccuu

SEQ ID NO: 2186396 - RNA, 21 nt, Streptococcus pneumoniae R6
ugcgagaaucaaagccaccau

SEQ ID NO: 2186397 - RNA, 15 nt, Streptococcus pneumoniae R6
ugcgagacaaaaaaa

SEQ ID NO: 2186398 - RNA, 12 nt, Streptococcus pneumoniae R6
ugcgagccucuu

SEQ ID NO: 2186399 - RNA, 17 nt, Streptococcus pneumoniae R6
ugccgccaccuccgccu

SEQ ID NO: 2186400 - RNA, 23 nt, Streptococcus pneumoniae R6
ugccgccaccuccgccuccagag

SEQ ID NO: 2186401 - RNA, 20 nt, Streptococcus pneumoniae R6
ugccgccauacuuucucuga

SEQ ID NO: 2186402 - RNA, 20 nt, Streptococcus pneumoniae R6
ugccuugcaggauuuuugcu

SEQ ID NO: 2186403 - RNA, 23 nt, Streptococcus pneumoniae R6
ugccuguuccaacauuguuugua

SEQ ID NO: 2186404 - RNA, 17 nt, Streptococcus pneumoniae R6
ugccuucaaucuuuugc

SEQ ID NO: 2186405 - RNA, 14 nt, Streptococcus pneumoniae R6
ugccuaugaaauga

SEQ ID NO: 2186406 - RNA, 19 nt, Streptococcus pneumoniae R6
ugccuagcgauuuccauug

SEQ ID NO: 2186407 - RNA, 12 nt, Streptococcus pneumoniae R6
ugccucaauauc

SEQ ID NO: 2186408 - RNA, 16 nt, Streptococcus pneumoniae R6
ugccucaauccuuuuc

SEQ ID NO: 2186409 - RNA, 18 nt, Streptococcus pneumoniae R6
ugccucaauccuuuucug

SEQ ID NO: 2186410 - RNA, 18 nt, Streptococcus pneumoniae R6
ugccucagauucugacaa

SEQ ID NO: 2186411 - RNA, 23 nt, Streptococcus pneumoniae R6
ugccucagauucugacaauccac

SEQ ID NO: 2186412 - RNA, 23 nt, Streptococcus pneumoniae R6
ugaaucuaaaauaguacgaaaca

SEQ ID NO: 2186413 - RNA, 17 nt, Streptococcus pneumoniae R6
ugaaucuaguaaagcua

SEQ ID NO: 2186414 - RNA, 14 nt, Streptococcus pneumoniae R6
ugaaucugaaauag

SEQ ID NO: 2186415 - RNA, 23 nt, Streptococcus pneumoniae R6
ugaaucugaaauaguacgaaaca

SEQ ID NO: 2186416 - RNA, 19 nt, Streptococcus pneumoniae R6
ugaauauuaguaaauagaa

SEQ ID NO: 2186417 - RNA, 17 nt, Streptococcus pneumoniae R6
ugaauauggauaauuga

SEQ ID NO: 2186418 - RNA, 22 nt, Streptococcus pneumoniae R6
ucuuucaagcgaacaucuccaa

SEQ ID NO: 2186419 - RNA, 14 nt, Streptococcus pneumoniae R6
ucuuuauaauauuu

SEQ ID NO: 2186420 - RNA, 17 nt, Streptococcus pneumoniae R6
ucuuuauaauauuuaau

SEQ ID NO: 2186421 - RNA, 20 nt, Streptococcus pneumoniae R6
ucuuuauuuucguauggcaa

SEQ ID NO: 2186422 - RNA, 21 nt, Streptococcus pneumoniae R6
ugaauucuccaaucaaauugu

SEQ ID NO: 2186423 - RNA, 22 nt, Streptococcus pneumoniae R6
ugaauucuccaaucaaauugug

SEQ ID NO: 2186424 - RNA, 20 nt, Streptococcus pneumoniae R6
ugaauucuccauuuuggaua

SEQ ID NO: 2186425 - RNA, 13 nt, Streptococcus pneumoniae R6
ugaaugauaaaac

SEQ ID NO: 2186426 - RNA, 15 nt, Streptococcus pneumoniae R6
ugaaugauaaaacau

SEQ ID NO: 2186427 - RNA, 23 nt, Streptococcus pneumoniae R6
ugaauuucaagaaugaaaguuua

SEQ ID NO: 2186428 - RNA, 16 nt, Streptococcus pneumoniae R6
ugaauuucaugguucg

SEQ ID NO: 2186429 - RNA, 16 nt, Streptococcus pneumoniae R6
ugaauuguguaucaau

SEQ ID NO: 2186430 - RNA, 22 nt, Streptococcus pneumoniae R6
ugaauuguaggacuuccuuuuc

SEQ ID NO: 2186431 - RNA, 20 nt, Streptococcus pneumoniae R6
ugaauuggauuguuaaacaa

SEQ ID NO: 2186432 - RNA, 19 nt, Streptococcus pneumoniae R6
ugaauugguggguuuucug

SEQ ID NO: 2186433 - RNA, 13 nt, Streptococcus pneumoniae R6
ugacaaauucucc

SEQ ID NO: 2186434 - RNA, 15 nt, Streptococcus pneumoniae R6
ugacaaauucuccac

SEQ ID NO: 2186435 - RNA, 16 nt, Streptococcus pneumoniae R6
ugacaaauccauucuu

SEQ ID NO: 2186436 - RNA, 17 nt, Streptococcus pneumoniae R6
ugacaaauccauucuuu

SEQ ID NO: 2186437 - RNA, 20 nt, Streptococcus pneumoniae R6
ugacaaaucuaagucaaaua

SEQ ID NO: 2186438 - RNA, 13 nt, Streptococcus pneumoniae R6
ugacaaagaaaaa

SEQ ID NO: 2186439 - RNA, 23 nt, Streptococcus pneumoniae R6
ugacaaagaaaaaacaaaguauu

SEQ ID NO: 2186440 - RNA, 21 nt, Streptococcus pneumoniae R6
ugacaaagaccuuugaaaacu

SEQ ID NO: 2186441 - RNA, 17 nt, Streptococcus pneumoniae R6
ugacaaagagccaaaaa

SEQ ID NO: 2186442 - RNA, 20 nt, Streptococcus pneumoniae R6
ugacaaagagccaaaaaaga

SEQ ID NO: 2186443 - RNA, 15 nt, Streptococcus pneumoniae R6
ugacaaagagccaga

SEQ ID NO: 2186444 - RNA, 21 nt, Streptococcus pneumoniae R6
ugacaaagagccauaaaaaua

SEQ ID NO: 2186445 - RNA, 21 nt, Streptococcus pneumoniae R6
ugacaaagagccgaaaaaaua

SEQ ID NO: 2186446 - RNA, 22 nt, Streptococcus pneumoniae R6
ugacaaagagccgaaaaaauag

SEQ ID NO: 2186447 - RNA, 14 nt, Streptococcus pneumoniae R6
ugacaagugaaagu

SEQ ID NO: 2186448 - RNA, 13 nt, Streptococcus pneumoniae R6
ugacagugauuaa

SEQ ID NO: 2186449 - RNA, 21 nt, Streptococcus pneumoniae R6
ugacagucgcaaagaggaaga

SEQ ID NO: 2186450 - RNA, 20 nt, Streptococcus pneumoniae R6
ugacauacaacuuaaaaaga

SEQ ID NO: 2186451 - RNA, 21 nt, Streptococcus pneumoniae R6
ugacauacaacuuaaaaagag

SEQ ID NO: 2186452 - RNA, 18 nt, Streptococcus pneumoniae R6
ugacauaccaccaaguac

SEQ ID NO: 2186453 - RNA, 15 nt, Streptococcus pneumoniae R6
ugacauaugauuguc

SEQ ID NO: 2186454 - RNA, 14 nt, Streptococcus pneumoniae R6
ugacagaaaugagu

SEQ ID NO: 2186455 - RNA, 19 nt, Streptococcus pneumoniae R6
ugacagaaaugaguaagaa

SEQ ID NO: 2186456 - RNA, 17 nt, Streptococcus pneumoniae R6
ugacagaaccuuggaaa

SEQ ID NO: 2186457 - RNA, 21 nt, Streptococcus pneumoniae R6
ugacagcaucgacaaaggauu

SEQ ID NO: 2186458 - RNA, 16 nt, Streptococcus pneumoniae R6
ugacagccucaaugau

SEQ ID NO: 2186459 - RNA, 19 nt, Streptococcus pneumoniae R6
ugacagagcuugaagcuau

SEQ ID NO: 2186460 - RNA, 16 nt, Streptococcus pneumoniae R6
ugacgcuggaaauaag

SEQ ID NO: 2186461 - RNA, 12 nt, Streptococcus pneumoniae R6
ugacgauaaaag

SEQ ID NO: 2186462 - RNA, 16 nt, Streptococcus pneumoniae R6
ugacgagugaagaauu

SEQ ID NO: 2186463 - RNA, 15 nt, Streptococcus pneumoniae R6
ugaccuaaaucacuu

SEQ ID NO: 2186464 - RNA, 20 nt, Streptococcus pneumoniae R6
ugacgagacagauucaucag

SEQ ID NO: 2186465 - RNA, 21 nt, Streptococcus pneumoniae R6
ugaccauuucaauagcuccuu

SEQ ID NO: 2186466 - RNA, 19 nt, Streptococcus pneumoniae R6
ugaccaugucguuuccuuc

SEQ ID NO: 2186467 - RNA, 12 nt, Streptococcus pneumoniae R6
ugaccaucccag

SEQ ID NO: 2186468 - RNA, 21 nt, Streptococcus pneumoniae R6
ugaccaucccaguaaaggacu

SEQ ID NO: 2186469 - RNA, 16 nt, Streptococcus pneumoniae R6
ugacucagcuucugcu

SEQ ID NO: 2186470 - RNA, 17 nt, Streptococcus pneumoniae R6
ugacucagcuucugcuu

SEQ ID NO: 2186471 - RNA, 18 nt, Streptococcus pneumoniae R6
ugacucagcuucugcuug

SEQ ID NO: 2186472 - RNA, 16 nt, Streptococcus pneumoniae R6
ugacucccauaaaaau

SEQ ID NO: 2186473 - RNA, 19 nt, Streptococcus pneumoniae R6
ugacucgucacuugccucu

SEQ ID NO: 2186474 - RNA, 18 nt, Streptococcus pneumoniae R6
ugacucguuacuauaaga

SEQ ID NO: 2186475 - RNA, 15 nt, Streptococcus pneumoniae R6
ugacuggccucugca

SEQ ID NO: 2186476 - RNA, 13 nt, Streptococcus pneumoniae R6
ugacuuuucuaau

SEQ ID NO: 2186477 - RNA, 18 nt, Streptococcus pneumoniae R6
ugagaacuaaauuacuga

SEQ ID NO: 2186478 - RNA, 21 nt, Streptococcus pneumoniae R6
ugagaaaauaaaguaaaaauu

SEQ ID NO: 2186479 - RNA, 20 nt, Streptococcus pneumoniae R6
ugagaaccucuguauaaaua

SEQ ID NO: 2186480 - RNA, 24 nt, Streptococcus pneumoniae R6
ugagaaccucuguauaaauagcua

SEQ ID NO: 2186481 - RNA, 16 nt, Streptococcus pneumoniae R6
ugacuuucuaauuauu

SEQ ID NO: 2186482 - RNA, 20 nt, Streptococcus pneumoniae R6
ugacuuucuaauuauuucaa

SEQ ID NO: 2186483 - RNA, 16 nt, Streptococcus pneumoniae R6
ugacuuguguuuuucc

SEQ ID NO: 2186484 - RNA, 18 nt, Streptococcus pneumoniae R6
ugacuuguguuuuuccuu

SEQ ID NO: 2186485 - RNA, 19 nt, Streptococcus pneumoniae R6
ugacuugccuucaacaccg

SEQ ID NO: 2186486 - RNA, 21 nt, Streptococcus pneumoniae R6
ugacugucaauauagagugac

SEQ ID NO: 2186487 - RNA, 18 nt, Streptococcus pneumoniae R6
ugagcagaacaaugacuc

SEQ ID NO: 2186488 - RNA, 18 nt, Streptococcus pneumoniae R6
ugagccguuucuuuggga

SEQ ID NO: 2186489 - RNA, 14 nt, Streptococcus pneumoniae R6
ugagcgaaaucaac

SEQ ID NO: 2186490 - RNA, 15 nt, Streptococcus pneumoniae R6
ugagauuggauuuuc

SEQ ID NO: 2186491 - RNA, 23 nt, Streptococcus pneumoniae R6
ugagauuauugguggcuuccagu

SEQ ID NO: 2186492 - RNA, 18 nt, Streptococcus pneumoniae R6
ugagauacuccaaaacau

SEQ ID NO: 2186493 - RNA, 13 nt, Streptococcus pneumoniae R6
ugagauauuucuu

SEQ ID NO: 2186494 - RNA, 20 nt, Streptococcus pneumoniae R6
ugagaaggagaacuccagau

SEQ ID NO: 2186495 - RNA, 13 nt, Streptococcus pneumoniae R6
ugagaaggcuggu

SEQ ID NO: 2186496 - RNA, 19 nt, Streptococcus pneumoniae R6
ugagaagagcuucuuucau

SEQ ID NO: 2186497 - RNA, 22 nt, Streptococcus pneumoniae R6
ugaggcugacgcgaucuggcag

SEQ ID NO: 2186498 - RNA, 19 nt, Streptococcus pneumoniae R6
ugaggcaacaaaguaacca

SEQ ID NO: 2186499 - RNA, 21 nt, Streptococcus pneumoniae R6
ugagguuuuagauaagacuga

SEQ ID NO: 2186500 - RNA, 16 nt, Streptococcus pneumoniae R6
ugagguuguagauaga

SEQ ID NO: 2186501 - RNA, 15 nt, Streptococcus pneumoniae R6
ugaguauuauuucau

SEQ ID NO: 2186502 - RNA, 17 nt, Streptococcus pneumoniae R6
ugaguauuuagcaacca

SEQ ID NO: 2186503 - RNA, 20 nt, Streptococcus pneumoniae R6
ugaguauuuagcaaccauuu

SEQ ID NO: 2186504 - RNA, 22 nt, Streptococcus pneumoniae R6
ugaguaugaguuaccuaaauua

SEQ ID NO: 2186505 - RNA, 22 nt, Streptococcus pneumoniae R6
ugaguauuaauuaggaaagaau

SEQ ID NO: 2186506 - RNA, 13 nt, Streptococcus pneumoniae R6
ugaguauaaaugg

SEQ ID NO: 2186507 - RNA, 14 nt, Streptococcus pneumoniae R6
ugaguauaaaugga

SEQ ID NO: 2186508 - RNA, 13 nt, Streptococcus pneumoniae R6
ugaguauaagguu

SEQ ID NO: 2186509 - RNA, 15 nt, Streptococcus pneumoniae R6
ugaguacuugcugga

SEQ ID NO: 2186510 - RNA, 18 nt, Streptococcus pneumoniae R6
ugaguaccagauauacca

SEQ ID NO: 2186511 - RNA, 18 nt, Streptococcus pneumoniae R6
ugaguacggcaaggcaaa

SEQ ID NO: 2186512 - RNA, 17 nt, Streptococcus pneumoniae R6
ugagcgucuuucuuauc

SEQ ID NO: 2186513 - RNA, 23 nt, Streptococcus pneumoniae R6
ugagcuagggauuugauaagaau

SEQ ID NO: 2186514 - RNA, 21 nt, Streptococcus pneumoniae R6
ugagcuccguacgcuccugaa

SEQ ID NO: 2186515 - RNA, 15 nt, Streptococcus pneumoniae R6
ugagcuaauuuugcc

SEQ ID NO: 2186516 - RNA, 22 nt, Streptococcus pneumoniae R6
ugagcuaauuuugccaguuuug

SEQ ID NO: 2186517 - RNA, 13 nt, Streptococcus pneumoniae R6
ugaggaguuucaa

SEQ ID NO: 2186518 - RNA, 17 nt, Streptococcus pneumoniae R6
ugaggauggcuuucuuu

SEQ ID NO: 2186519 - RNA, 20 nt, Streptococcus pneumoniae R6
ugaggauggcuuucuuucaa

SEQ ID NO: 2186520 - RNA, 13 nt, Streptococcus pneumoniae R6
ugaggaaaucccu

SEQ ID NO: 2186521 - RNA, 17 nt, Streptococcus pneumoniae R6
ugaggaaguaccaagga

SEQ ID NO: 2186522 - RNA, 15 nt, Streptococcus pneumoniae R6
ugaggagaaagaaga

SEQ ID NO: 2186523 - RNA, 22 nt, Streptococcus pneumoniae R6
ugaggaccagguuuuucaccag

SEQ ID NO: 2186524 - RNA, 13 nt, Streptococcus pneumoniae R6
ugagcuuuaaaau

SEQ ID NO: 2186525 - RNA, 22 nt, Streptococcus pneumoniae R6
ugagcuggcucaucuggcuuuc

SEQ ID NO: 2186526 - RNA, 13 nt, Streptococcus pneumoniae R6
ugagcuggaagaa

SEQ ID NO: 2186527 - RNA, 19 nt, Streptococcus pneumoniae R6
ugcaggauuuuugcuucug

SEQ ID NO: 2186528 - RNA, 19 nt, Streptococcus pneumoniae R6
ugcaggcugcucaaaacac

SEQ ID NO: 2186529 - RNA, 15 nt, Streptococcus pneumoniae R6
ugcagcuaguuuccu

SEQ ID NO: 2186530 - RNA, 15 nt, Streptococcus pneumoniae R6
ugcagcugcggcuuu

SEQ ID NO: 2186531 - RNA, 20 nt, Streptococcus pneumoniae R6
ugcagcugcggcuuuuucuu

SEQ ID NO: 2186532 - RNA, 16 nt, Streptococcus pneumoniae R6
ugcagcugaggaaauc

SEQ ID NO: 2186533 - RNA, 16 nt, Streptococcus pneumoniae R6
ugcagaaucgugaguu

SEQ ID NO: 2186534 - RNA, 21 nt, Streptococcus pneumoniae R6
ugcagaaucgugaguuccugu

SEQ ID NO: 2186535 - RNA, 17 nt, Streptococcus pneumoniae R6
ugcagaaggcuuucuaa

SEQ ID NO: 2186536 - RNA, 18 nt, Streptococcus pneumoniae R6
ugcagaauacucuuucag

SEQ ID NO: 2186537 - RNA, 15 nt, Streptococcus pneumoniae R6
ugcagauaagacuga

SEQ ID NO: 2186538 - RNA, 14 nt, Streptococcus pneumoniae R6
ugcagagagauaaa

SEQ ID NO: 2186539 - RNA, 14 nt, Streptococcus pneumoniae R6
ugcagaugaaagcu

SEQ ID NO: 2186540 - RNA, 20 nt, Streptococcus pneumoniae R6
ugcagcaacgucuucaauac

SEQ ID NO: 2186541 - RNA, 22 nt, Streptococcus pneumoniae R6
ugcagccucaaaacacuguuuu

SEQ ID NO: 2186542 - RNA, 22 nt, Streptococcus pneumoniae R6
ugcaaguuuaugccuugcagga

SEQ ID NO: 2186543 - RNA, 14 nt, Streptococcus pneumoniae R6
ugcaaguccagaac

SEQ ID NO: 2186544 - RNA, 15 nt, Streptococcus pneumoniae R6
ugcaaguagaacgcu

SEQ ID NO: 2186545 - RNA, 12 nt, Streptococcus pneumoniae R6
ugcaaggcaaug

SEQ ID NO: 2186546 - RNA, 19 nt, Streptococcus pneumoniae R6
ugcaaggcauaaacuugca

SEQ ID NO: 2186547 - RNA, 14 nt, Streptococcus pneumoniae R6
ugcaaagaugauga

SEQ ID NO: 2186548 - RNA, 12 nt, Streptococcus pneumoniae R6
ugcaaacuuuuu

SEQ ID NO: 2186549 - RNA, 19 nt, Streptococcus pneumoniae R6
ugcaaugagccaaggaagu

SEQ ID NO: 2186550 - RNA, 20 nt, Streptococcus pneumoniae R6
ugcaauacagaacuaaaucu

SEQ ID NO: 2186551 - RNA, 21 nt, Streptococcus pneumoniae R6
ugcaauacagaacuaaaucuu

SEQ ID NO: 2186552 - RNA, 19 nt, Streptococcus pneumoniae R6
ugcacaaagaaccaguacu

SEQ ID NO: 2186553 - RNA, 23 nt, Streptococcus pneumoniae R6
ugcacaauauagccuaagacaac

SEQ ID NO: 2186554 - RNA, 16 nt, Streptococcus pneumoniae R6
ugcacuuuccucuuga

SEQ ID NO: 2186555 - RNA, 16 nt, Streptococcus pneumoniae R6
ugcacuuugauuuuua

SEQ ID NO: 2186556 - RNA, 18 nt, Streptococcus pneumoniae R6
ugcacggguuuaacuaaa

SEQ ID NO: 2186557 - RNA, 18 nt, Streptococcus pneumoniae R6
ugcacauugguucuuuuu

SEQ ID NO: 2186558 - RNA, 15 nt, Streptococcus pneumoniae R6
ugcacacucagaacc

SEQ ID NO: 2186559 - RNA, 14 nt, Streptococcus pneumoniae R6
ugaguguaaaaaga

SEQ ID NO: 2186560 - RNA, 21 nt, Streptococcus pneumoniae R6
ugaguguaaaaagaaaguccu

SEQ ID NO: 2186561 - RNA, 22 nt, Streptococcus pneumoniae R6
ugaguggauuagguguauuuag

SEQ ID NO: 2186562 - RNA, 15 nt, Streptococcus pneumoniae R6
ugaguggauuuuucg

SEQ ID NO: 2186563 - RNA, 19 nt, Streptococcus pneumoniae R6
ugaguggaaaaaccuucaa

SEQ ID NO: 2186564 - RNA, 17 nt, Streptococcus pneumoniae R6
ugauauagucuauugaa

SEQ ID NO: 2186565 - RNA, 21 nt, Streptococcus pneumoniae R6
ugauauuggcugcuugcaauu

SEQ ID NO: 2186566 - RNA, 18 nt, Streptococcus pneumoniae R6
ugauauugucuacauuga

SEQ ID NO: 2186567 - RNA, 19 nt, Streptococcus pneumoniae R6
ugauauugucuacauugau

SEQ ID NO: 2186568 - RNA, 14 nt, Streptococcus pneumoniae R6
ugauauuuauagaa

SEQ ID NO: 2186569 - RNA, 21 nt, Streptococcus pneumoniae R6
ugauauuuauuuacauaauuu

SEQ ID NO: 2186570 - RNA, 23 nt, Streptococcus pneumoniae R6
ugauauuuauuuacauaauuuaa

SEQ ID NO: 2186571 - RNA, 23 nt, Streptococcus pneumoniae R6
ugauauauaguagacugaaucug

SEQ ID NO: 2186572 - RNA, 20 nt, Streptococcus pneumoniae R6
ugauauccugucuauacacg

SEQ ID NO: 2186573 - RNA, 15 nt, Streptococcus pneumoniae R6
ugauauuaugcguuu

SEQ ID NO: 2186574 - RNA, 14 nt, Streptococcus pneumoniae R6
ugaucagaccaguu

SEQ ID NO: 2186575 - RNA, 21 nt, Streptococcus pneumoniae R6
ugaucagaguuuugaaaacuu

SEQ ID NO: 2186576 - RNA, 17 nt, Streptococcus pneumoniae R6
ugaucccuccauuucau

SEQ ID NO: 2186577 - RNA, 14 nt, Streptococcus pneumoniae R6
ugaugauucaagga

SEQ ID NO: 2186578 - RNA, 22 nt, Streptococcus pneumoniae R6
ugaugcaaaucucauuugauga

SEQ ID NO: 2186579 - RNA, 17 nt, Streptococcus pneumoniae R6
ugaugauuuggcgauga

SEQ ID NO: 2186580 - RNA, 15 nt, Streptococcus pneumoniae R6
ugauggaagacugag

SEQ ID NO: 2186581 - RNA, 21 nt, Streptococcus pneumoniae R6
ugaucgaguuauuaacaaaag

SEQ ID NO: 2186582 - RNA, 13 nt, Streptococcus pneumoniae R6
ugaucgagcagau

SEQ ID NO: 2186583 - RNA, 15 nt, Streptococcus pneumoniae R6
ugauuuuauauaaaa

SEQ ID NO: 2186584 - RNA, 17 nt, Streptococcus pneumoniae R6
ugauuuuauauaaaaua

SEQ ID NO: 2186585 - RNA, 16 nt, Streptococcus pneumoniae R6
ugauuuuaaagaaaua

SEQ ID NO: 2186586 - RNA, 24 nt, Streptococcus pneumoniae R6
ugauuuguccaucuguaauaugaa

SEQ ID NO: 2186587 - RNA, 19 nt, Streptococcus pneumoniae R6
ugauuuggcgaugauuuua

SEQ ID NO: 2186588 - RNA, 19 nt, Streptococcus pneumoniae R6
ugauuuuuuuuaaaaaagu

SEQ ID NO: 2186589 - RNA, 21 nt, Streptococcus pneumoniae R6
ugcaaaaaaaaugaaaaaaau

SEQ ID NO: 2186590 - RNA, 11 nt, Streptococcus pneumoniae R6
ugcaaaaaaac

SEQ ID NO: 2186591 - RNA, 22 nt, Streptococcus pneumoniae R6
ugauuuuuauugaguauuagag

SEQ ID NO: 2186592 - RNA, 14 nt, Streptococcus pneumoniae R6
ugauuuuucuaaau

SEQ ID NO: 2186593 - RNA, 19 nt, Streptococcus pneumoniae R6
ugauuuuuucauucgcaaa

SEQ ID NO: 2186594 - RNA, 15 nt, Streptococcus pneumoniae R6
ugauuguuuuuaaag

SEQ ID NO: 2186595 - RNA, 16 nt, Streptococcus pneumoniae R6
ugauucuacuuuuuca

SEQ ID NO: 2186596 - RNA, 20 nt, Streptococcus pneumoniae R6
ugauuuaaauguuuucucau

SEQ ID NO: 2186597 - RNA, 18 nt, Streptococcus pneumoniae R6
ugauuuccaaucuucucc

SEQ ID NO: 2186598 - RNA, 19 nt, Streptococcus pneumoniae R6
ugauuuaacaaucuaucuu

SEQ ID NO: 2186599 - RNA, 17 nt, Streptococcus pneumoniae R6
ugauuucuguaaaaaua

SEQ ID NO: 2186600 - RNA, 18 nt, Streptococcus pneumoniae R6
ugauuucuguaaaaauac

SEQ ID NO: 2186601 - RNA, 18 nt, Streptococcus pneumoniae R6
ugauuugagguuguagau

SEQ ID NO: 2186602 - RNA, 20 nt, Streptococcus pneumoniae R6
ugauuucuaaagaguauaau

SEQ ID NO: 2186603 - RNA, 22 nt, Streptococcus pneumoniae R6
ugauuucuccgaggauuuccca

SEQ ID NO: 2186604 - RNA, 17 nt, Streptococcus pneumoniae R6
ugauuucuccgcuucca

SEQ ID NO: 2186605 - RNA, 21 nt, Streptococcus pneumoniae R6
ugaugugcuauucuaaauuca

SEQ ID NO: 2186606 - RNA, 22 nt, Streptococcus pneumoniae R6
ugauguaacuguuuuaggaaca

SEQ ID NO: 2186607 - RNA, 23 nt, Streptococcus pneumoniae R6
ugauguaacuguuuuaggaacaa

SEQ ID NO: 2186608 - RNA, 13 nt, Streptococcus pneumoniae R6
ugauggcuugugu

SEQ ID NO: 2186609 - RNA, 19 nt, Streptococcus pneumoniae R6
gaccuguuuggucagacug

SEQ ID NO: 2186610 - RNA, 13 nt, Streptococcus pneumoniae R6
gaccuguuuucac

SEQ ID NO: 2186611 - RNA, 20 nt, Streptococcus pneumoniae R6
gaccuguauucauugaaaaa

SEQ ID NO: 2186612 - RNA, 21 nt, Streptococcus pneumoniae R6
gaccuguauucauugaaaaaa

SEQ ID NO: 2186613 - RNA, 19 nt, Streptococcus pneumoniae R6
gaccugcauacguucaaau

SEQ ID NO: 2186614 - RNA, 15 nt, Streptococcus pneumoniae R6
gaccugccaugcuga

SEQ ID NO: 2186615 - RNA, 13 nt, Streptococcus pneumoniae R6
gaccuaaaucacu

SEQ ID NO: 2186616 - RNA, 14 nt, Streptococcus pneumoniae R6
gaccuaaaucacuu

SEQ ID NO: 2186617 - RNA, 18 nt, Streptococcus pneumoniae R6
gaccguggaguacuucuu

SEQ ID NO: 2186618 - RNA, 22 nt, Streptococcus pneumoniae R6
gaccucuaccaagcccucagcc

SEQ ID NO: 2186619 - RNA, 13 nt, Streptococcus pneumoniae R6
gaccguauuuuug

SEQ ID NO: 2186620 - RNA, 13 nt, Streptococcus pneumoniae R6
gaccggagaaaga

SEQ ID NO: 2186621 - RNA, 17 nt, Streptococcus pneumoniae R6
gaccggcuuccuaauuu

SEQ ID NO: 2186622 - RNA, 22 nt, Streptococcus pneumoniae R6
gacccaagucggcaggcugguu

SEQ ID NO: 2186623 - RNA, 14 nt, Streptococcus pneumoniae R6
gaccauacauugau

SEQ ID NO: 2186624 - RNA, 18 nt, Streptococcus pneumoniae R6
gaccauacauugauugca

SEQ ID NO: 2186625 - RNA, 20 nt, Streptococcus pneumoniae R6
gaccaguucaucaugauaga

SEQ ID NO: 2186626 - RNA, 20 nt, Streptococcus pneumoniae R6
gaccaguuucuucuuucacu

SEQ ID NO: 2186627 - RNA, 19 nt, Streptococcus pneumoniae R6
gacccaggcaaagaguccc

SEQ ID NO: 2186628 - RNA, 22 nt, Streptococcus pneumoniae R6
gacccuauauuucaagaauuaa

SEQ ID NO: 2186629 - RNA, 17 nt, Streptococcus pneumoniae R6
gaccgauucgucugagu

SEQ ID NO: 2186630 - RNA, 18 nt, Streptococcus pneumoniae R6
gaccgauagcuuuugcag

SEQ ID NO: 2186631 - RNA, 23 nt, Streptococcus pneumoniae R6
gaccgauagcuuuugcagcacca

SEQ ID NO: 2186632 - RNA, 21 nt, Streptococcus pneumoniae R6
gaccgagaguucuuguuucuc

SEQ ID NO: 2186633 - RNA, 22 nt, Streptococcus pneumoniae R6
gaccuugaccagccaagacacu

SEQ ID NO: 2186634 - RNA, 16 nt, Streptococcus pneumoniae R6
gaccuuucagaacuaa

SEQ ID NO: 2186635 - RNA, 20 nt, Streptococcus pneumoniae R6
gaccuuucauaaaguuuucu

SEQ ID NO: 2186636 - RNA, 15 nt, Streptococcus pneumoniae R6
gacgaaacgaagaag

SEQ ID NO: 2186637 - RNA, 17 nt, Streptococcus pneumoniae R6
gacgaacccccaugacu

SEQ ID NO: 2186638 - RNA, 14 nt, Streptococcus pneumoniae R6
gacgaagaaaccaa

SEQ ID NO: 2186639 - RNA, 19 nt, Streptococcus pneumoniae R6
gacgaaucggucugaguuu

SEQ ID NO: 2186640 - RNA, 15 nt, Streptococcus pneumoniae R6
gacgaauaaagaaac

SEQ ID NO: 2186641 - RNA, 14 nt, Streptococcus pneumoniae R6
gacgaagugcuucu

SEQ ID NO: 2186642 - RNA, 18 nt, Streptococcus pneumoniae R6
gacgaagugcuucuggga

SEQ ID NO: 2186643 - RNA, 22 nt, Streptococcus pneumoniae R6
gacgaagucagcucaaaacacu

SEQ ID NO: 2186644 - RNA, 18 nt, Streptococcus pneumoniae R6
gacgaccauugucacaau

SEQ ID NO: 2186645 - RNA, 21 nt, Streptococcus pneumoniae R6
gacgauuaaaaguaagagaaa

SEQ ID NO: 2186646 - RNA, 13 nt, Streptococcus pneumoniae R6
gacgauuccaaac

SEQ ID NO: 2186647 - RNA, 18 nt, Streptococcus pneumoniae R6
gacgauguugaugauaug

SEQ ID NO: 2186648 - RNA, 21 nt, Streptococcus pneumoniae R6
gacgauuuucucuuuguccuu

SEQ ID NO: 2186649 - RNA, 14 nt, Streptococcus pneumoniae R6
gacgauuuuuucuu

SEQ ID NO: 2186650 - RNA, 21 nt, Streptococcus pneumoniae R6
gacgauuuuuucuuuguucuu

SEQ ID NO: 2186651 - RNA, 22 nt, Streptococcus pneumoniae R6
gacgcacaaacuucaucccagu

SEQ ID NO: 2186652 - RNA, 23 nt, Streptococcus pneumoniae R6
gacgaguuaaaacaaagaaaaag

SEQ ID NO: 2186653 - RNA, 21 nt, Streptococcus pneumoniae R6
gacgaggccagaacucccugu

SEQ ID NO: 2186654 - RNA, 14 nt, Streptococcus pneumoniae R6
gacgacuacuuccu

SEQ ID NO: 2186655 - RNA, 19 nt, Streptococcus pneumoniae R6
gacgacuacuuccuaagcu

SEQ ID NO: 2186656 - RNA, 15 nt, Streptococcus pneumoniae R6
gacgagaaucgaacu

SEQ ID NO: 2186657 - RNA, 22 nt, Streptococcus pneumoniae R6
gacgcuuucuaaggagaauucu

SEQ ID NO: 2186658 - RNA, 17 nt, Streptococcus pneumoniae R6
gacaccaccgaaggcuu

SEQ ID NO: 2186659 - RNA, 14 nt, Streptococcus pneumoniae R6
gacaccaaaaagug

SEQ ID NO: 2186660 - RNA, 21 nt, Streptococcus pneumoniae R6
gacacauucguuccuuuaaaa

SEQ ID NO: 2186661 - RNA, 12 nt, Streptococcus pneumoniae R6
gacacauaguag

SEQ ID NO: 2186662 - RNA, 20 nt, Streptococcus pneumoniae R6
gacacauaguaguaaacaca

SEQ ID NO: 2186663 - RNA, 23 nt, Streptococcus pneumoniae R6
gacaauuuuuccagcuuuuucuu

SEQ ID NO: 2186664 - RNA, 14 nt, Streptococcus pneumoniae R6
gacacuauuuacaa

SEQ ID NO: 2186665 - RNA, 13 nt, Streptococcus pneumoniae R6
gacacuagacagu

SEQ ID NO: 2186666 - RNA, 18 nt, Streptococcus pneumoniae R6
gacagcaguuaugauaua

SEQ ID NO: 2186667 - RNA, 17 nt, Streptococcus pneumoniae R6
gacagaaaugaguaaga

SEQ ID NO: 2186668 - RNA, 23 nt, Streptococcus pneumoniae R6
gacagagacuuuaaacauacuga

SEQ ID NO: 2186669 - RNA, 14 nt, Streptococcus pneumoniae R6
gacagaagaaguga

SEQ ID NO: 2186670 - RNA, 14 nt, Streptococcus pneumoniae R6
gacagauaagagca

SEQ ID NO: 2186671 - RNA, 19 nt, Streptococcus pneumoniae R6
gacagauucaucagggcaa

SEQ ID NO: 2186672 - RNA, 12 nt, Streptococcus pneumoniae R6
gacaaucuuuuc

SEQ ID NO: 2186673 - RNA, 14 nt, Streptococcus pneumoniae R6
gacaauuauauaaa

SEQ ID NO: 2186674 - RNA, 17 nt, Streptococcus pneumoniae R6
gacaauuauauaaacca

SEQ ID NO: 2186675 - RNA, 16 nt, Streptococcus pneumoniae R6
gacaauuuaaccaaac

SEQ ID NO: 2186676 - RNA, 21 nt, Streptococcus pneumoniae R6
gacaauguaccugcaaauuua

SEQ ID NO: 2186677 - RNA, 22 nt, Streptococcus pneumoniae R6
gacaaugcgcaagguuguuaga

SEQ ID NO: 2186678 - RNA, 16 nt, Streptococcus pneumoniae R6
gacaaguaaguagcau

SEQ ID NO: 2186679 - RNA, 18 nt, Streptococcus pneumoniae R6
gacaaggcugcggcuaca

SEQ ID NO: 2186680 - RNA, 21 nt, Streptococcus pneumoniae R6
gacaagggaugaaaccccaag

SEQ ID NO: 2186681 - RNA, 21 nt, Streptococcus pneumoniae R6
gacaaguuagccacaacuagg

SEQ ID NO: 2186682 - RNA, 23 nt, Streptococcus pneumoniae R6
gacaacuucaacccuaaacugac

SEQ ID NO: 2186683 - RNA, 14 nt, Streptococcus pneumoniae R6
gacaagauacccac

SEQ ID NO: 2186684 - RNA, 14 nt, Streptococcus pneumoniae R6
gacaacccaguaaa

SEQ ID NO: 2186685 - RNA, 23 nt, Streptococcus pneumoniae R6
gacaaaucgaucaggacagucaa

SEQ ID NO: 2186686 - RNA, 23 nt, Streptococcus pneumoniae R6
gacaaaucguucaggacagucaa

SEQ ID NO: 2186687 - RNA, 23 nt, Streptococcus pneumoniae R6
gacaaauaauuuauccaaaggau

SEQ ID NO: 2186688 - RNA, 19 nt, Streptococcus pneumoniae R6
gacaaauucuccacagacc

SEQ ID NO: 2186689 - RNA, 18 nt, Streptococcus pneumoniae R6
gacaaauuucguccuuuc

SEQ ID NO: 2186690 - RNA, 18 nt, Streptococcus pneumoniae R6
gacaaauuuuguccuuuc

SEQ ID NO: 2186691 - RNA, 21 nt, Streptococcus pneumoniae R6
gacaaagagccgaaaaaauag

SEQ ID NO: 2186692 - RNA, 12 nt, Streptococcus pneumoniae R6
gacaaagagccc

SEQ ID NO: 2186693 - RNA, 13 nt, Streptococcus pneumoniae R6
gacaaagaaaaaa

SEQ ID NO: 2186694 - RNA, 17 nt, Streptococcus pneumoniae R6
gacaaagaaaaaacaaa

SEQ ID NO: 2186695 - RNA, 21 nt, Streptococcus pneumoniae R6
gacaaagaaaaaacaaaguau

SEQ ID NO: 2186696 - RNA, 15 nt, Streptococcus pneumoniae R6
gacaaacauugacuu

SEQ ID NO: 2186697 - RNA, 13 nt, Streptococcus pneumoniae R6
gacaaaacuuuuu

SEQ ID NO: 2186698 - RNA, 20 nt, Streptococcus pneumoniae R6
gacaaaagagccucauaaaa

SEQ ID NO: 2186699 - RNA, 12 nt, Streptococcus pneumoniae R6
gacaaaaacuca

SEQ ID NO: 2186700 - RNA, 20 nt, Streptococcus pneumoniae R6
gaauuuuucgacugugauuu

SEQ ID NO: 2186701 - RNA, 14 nt, Streptococcus pneumoniae R6
cuuugguuauaaaa

SEQ ID NO: 2186702 - RNA, 16 nt, Streptococcus pneumoniae R6
cuuuguaaguuucuuc

SEQ ID NO: 2186703 - RNA, 19 nt, Streptococcus pneumoniae R6
cuuuguaaguuucuucuuu

SEQ ID NO: 2186704 - RNA, 20 nt, Streptococcus pneumoniae R6
cuuuguaaguuucuucuuua

SEQ ID NO: 2186705 - RNA, 19 nt, Streptococcus pneumoniae R6
gaccagaaaaucauugcua

SEQ ID NO: 2186706 - RNA, 22 nt, Streptococcus pneumoniae R6
gaccacguucugcaacaacagc

SEQ ID NO: 2186707 - RNA, 21 nt, Streptococcus pneumoniae R6
gaccaagccugagaugauucu

SEQ ID NO: 2186708 - RNA, 16 nt, Streptococcus pneumoniae R6
gaccaagagcaaaaac

SEQ ID NO: 2186709 - RNA, 17 nt, Streptococcus pneumoniae R6
gaccaagagcaaaaaca

SEQ ID NO: 2186710 - RNA, 15 nt, Streptococcus pneumoniae R6
gaccaaguccucaau

SEQ ID NO: 2186711 - RNA, 22 nt, Streptococcus pneumoniae R6
gaccaaguucuuuucauaaaga

SEQ ID NO: 2186712 - RNA, 16 nt, Streptococcus pneumoniae R6
gaccaauccuaugaua

SEQ ID NO: 2186713 - RNA, 21 nt, Streptococcus pneumoniae R6
gaccaauccuaugauacccaa

SEQ ID NO: 2186714 - RNA, 16 nt, Streptococcus pneumoniae R6
gaccaaucuuuuccaa

SEQ ID NO: 2186715 - RNA, 16 nt, Streptococcus pneumoniae R6
gaccaauucuucucuu

SEQ ID NO: 2186716 - RNA, 19 nt, Streptococcus pneumoniae R6
gaccagcuacaaaggcuau

SEQ ID NO: 2186717 - RNA, 14 nt, Streptococcus pneumoniae R6
gacauuaccucuuu

SEQ ID NO: 2186718 - RNA, 13 nt, Streptococcus pneumoniae R6
gacauguauauua

SEQ ID NO: 2186719 - RNA, 15 nt, Streptococcus pneumoniae R6
gacaugcguuaaaag

SEQ ID NO: 2186720 - RNA, 18 nt, Streptococcus pneumoniae R6
gacauggaaauuauaaaa

SEQ ID NO: 2186721 - RNA, 17 nt, Streptococcus pneumoniae R6
gacaucuucucaggcuu

SEQ ID NO: 2186722 - RNA, 13 nt, Streptococcus pneumoniae R6
gacaucugugauu

SEQ ID NO: 2186723 - RNA, 14 nt, Streptococcus pneumoniae R6
gacaucgucaccau

SEQ ID NO: 2186724 - RNA, 23 nt, Streptococcus pneumoniae R6
gacaucgguaucaaagacgccaa

SEQ ID NO: 2186725 - RNA, 21 nt, Streptococcus pneumoniae R6
gacauccuauuuauuacuuca

SEQ ID NO: 2186726 - RNA, 16 nt, Streptococcus pneumoniae R6
gacauccuuuucugua

SEQ ID NO: 2186727 - RNA, 15 nt, Streptococcus pneumoniae R6
gacauagucaagcuc

SEQ ID NO: 2186728 - RNA, 18 nt, Streptococcus pneumoniae R6
gacauagucaagcucuug

SEQ ID NO: 2186729 - RNA, 21 nt, Streptococcus pneumoniae R6
gacauaggucacgaggaggag

SEQ ID NO: 2186730 - RNA, 18 nt, Streptococcus pneumoniae R6
gacauaaucgcuggcauu

SEQ ID NO: 2186731 - RNA, 15 nt, Streptococcus pneumoniae R6
gacauaccaccaagu

SEQ ID NO: 2186732 - RNA, 15 nt, Streptococcus pneumoniae R6
gacagucgcaaagag

SEQ ID NO: 2186733 - RNA, 20 nt, Streptococcus pneumoniae R6
gacagucgcaaagaggaaga

SEQ ID NO: 2186734 - RNA, 14 nt, Streptococcus pneumoniae R6
gacagucugaaaaa

SEQ ID NO: 2186735 - RNA, 20 nt, Streptococcus pneumoniae R6
gacagucugaaaaagaggau

SEQ ID NO: 2186736 - RNA, 16 nt, Streptococcus pneumoniae R6
gacagucugaaaaaua

SEQ ID NO: 2186737 - RNA, 18 nt, Streptococcus pneumoniae R6
gacaggugcuuaaauagg

SEQ ID NO: 2186738 - RNA, 21 nt, Streptococcus pneumoniae R6
gacaggucaauggcaaaaaau

SEQ ID NO: 2186739 - RNA, 15 nt, Streptococcus pneumoniae R6
gacaggcuuucuccc

SEQ ID NO: 2186740 - RNA, 22 nt, Streptococcus pneumoniae R6
gacagggccuuagcagacuucu

SEQ ID NO: 2186741 - RNA, 18 nt, Streptococcus pneumoniae R6
gacuugaccgcagauuua

SEQ ID NO: 2186742 - RNA, 20 nt, Streptococcus pneumoniae R6
gacuugaaauacuaaaaaaa

SEQ ID NO: 2186743 - RNA, 16 nt, Streptococcus pneumoniae R6
gacuucuugagcuagg

SEQ ID NO: 2186744 - RNA, 16 nt, Streptococcus pneumoniae R6
gacuuggaaccagccu

SEQ ID NO: 2186745 - RNA, 14 nt, Streptococcus pneumoniae R6
gacuuggccaauuc

SEQ ID NO: 2186746 - RNA, 15 nt, Streptococcus pneumoniae R6
gacuugccuucaaca

SEQ ID NO: 2186747 - RNA, 21 nt, Streptococcus pneumoniae R6
gacuucgucguaaccuucuuc

SEQ ID NO: 2186748 - RNA, 13 nt, Streptococcus pneumoniae R6
gacuucgucaguu

SEQ ID NO: 2186749 - RNA, 21 nt, Streptococcus pneumoniae R6
gacuucgucaguucuauccac

SEQ ID NO: 2186750 - RNA, 17 nt, Streptococcus pneumoniae R6
gacuucgucaguuucau

SEQ ID NO: 2186751 - RNA, 20 nt, Streptococcus pneumoniae R6
gacuucgucaguuucaucca

SEQ ID NO: 2186752 - RNA, 14 nt, Streptococcus pneumoniae R6
gacuucuuaaucaa

SEQ ID NO: 2186753 - RNA, 22 nt, Streptococcus pneumoniae R6
gacuucaauaaaauauaacuau

SEQ ID NO: 2186754 - RNA, 15 nt, Streptococcus pneumoniae R6
gacuuccuuuucuua

SEQ ID NO: 2186755 - RNA, 19 nt, Streptococcus pneumoniae R6
gacuucccagccuaccugc

SEQ ID NO: 2186756 - RNA, 24 nt, Streptococcus pneumoniae R6
gacuuagcucugugcaauacagaa

SEQ ID NO: 2186757 - RNA, 16 nt, Streptococcus pneumoniae R6
gacuuagcaaaucagc

SEQ ID NO: 2186758 - RNA, 17 nt, Streptococcus pneumoniae R6
gacugguaaagaaugga

SEQ ID NO: 2186759 - RNA, 16 nt, Streptococcus pneumoniae R6
gacuggcuaggugaga

SEQ ID NO: 2186760 - RNA, 13 nt, Streptococcus pneumoniae R6
gacugucaaguuc

SEQ ID NO: 2186761 - RNA, 14 nt, Streptococcus pneumoniae R6
gacugguuuccuag

SEQ ID NO: 2186762 - RNA, 24 nt, Streptococcus pneumoniae R6
gacuggugucguugaaugaaauga

SEQ ID NO: 2186763 - RNA, 15 nt, Streptococcus pneumoniae R6
gacuggugugauuuu

SEQ ID NO: 2186764 - RNA, 19 nt, Streptococcus pneumoniae R6
gacuggugugauuuuccug

SEQ ID NO: 2186765 - RNA, 23 nt, Streptococcus pneumoniae R6
gacuggugugauuuuccugaaua

SEQ ID NO: 2186766 - RNA, 14 nt, Streptococcus pneumoniae R6
gacugguucucucu

SEQ ID NO: 2186767 - RNA, 22 nt, Streptococcus pneumoniae R6
gacugguucucucuuuuugauu

SEQ ID NO: 2186768 - RNA, 14 nt, Streptococcus pneumoniae R6
gacuugguaaaaug

SEQ ID NO: 2186769 - RNA, 12 nt, Streptococcus pneumoniae R6
gacuuguguuuu

SEQ ID NO: 2186770 - RNA, 19 nt, Streptococcus pneumoniae R6
gacuuguguuuuuccuuug

SEQ ID NO: 2186771 - RNA, 17 nt, Streptococcus pneumoniae R6
gacuuuaaacauacuga

SEQ ID NO: 2186772 - RNA, 15 nt, Streptococcus pneumoniae R6
gacuuuaucaccucc

SEQ ID NO: 2186773 - RNA, 23 nt, Streptococcus pneumoniae R6
gacuuuaucaccuccuucuccaa

SEQ ID NO: 2186774 - RNA, 12 nt, Streptococcus pneumoniae R6
gacuuucaauuc

SEQ ID NO: 2186775 - RNA, 17 nt, Streptococcus pneumoniae R6
gacuuucaauucuucac

SEQ ID NO: 2186776 - RNA, 14 nt, Streptococcus pneumoniae R6
gacuuucuuguuuu

SEQ ID NO: 2186777 - RNA, 17 nt, Streptococcus pneumoniae R6
gacuuucuuguuuucuu

SEQ ID NO: 2186778 - RNA, 22 nt, Streptococcus pneumoniae R6
gacuuucuuuuuauacucaucu

SEQ ID NO: 2186779 - RNA, 21 nt, Streptococcus pneumoniae R6
gacuuucucacgaauaaccaa

SEQ ID NO: 2186780 - RNA, 12 nt, Streptococcus pneumoniae R6
gacuuuuuucua

SEQ ID NO: 2186781 - RNA, 20 nt, Streptococcus pneumoniae R6
gacuuuuuucuauaguagau

SEQ ID NO: 2186782 - RNA, 14 nt, Streptococcus pneumoniae R6
gagaaaaaauaugg

SEQ ID NO: 2186783 - RNA, 17 nt, Streptococcus pneumoniae R6
gagaaaaagccuccaga

SEQ ID NO: 2186784 - RNA, 11 nt, Streptococcus pneumoniae R6
gagaaaggaca

SEQ ID NO: 2186785 - RNA, 22 nt, Streptococcus pneumoniae R6
gagaacaguuucggcuguucuu

SEQ ID NO: 2186786 - RNA, 21 nt, Streptococcus pneumoniae R6
gagaaaauaugggcuuacauc

SEQ ID NO: 2186787 - RNA, 16 nt, Streptococcus pneumoniae R6
gagaaacaagaacucu

SEQ ID NO: 2186788 - RNA, 18 nt, Streptococcus pneumoniae R6
gagaaacaauaaaaucaa

SEQ ID NO: 2186789 - RNA, 13 nt, Streptococcus pneumoniae R6
gagaaagacuuga

SEQ ID NO: 2186790 - RNA, 13 nt, Streptococcus pneumoniae R6
gagaaagaaaaac

SEQ ID NO: 2186791 - RNA, 12 nt, Streptococcus pneumoniae R6
gagaaagaaaac

SEQ ID NO: 2186792 - RNA, 13 nt, Streptococcus pneumoniae R6
gagacuaaggaga

SEQ ID NO: 2186793 - RNA, 14 nt, Streptococcus pneumoniae R6
gagacuaaggagag

SEQ ID NO: 2186794 - RNA, 14 nt, Streptococcus pneumoniae R6
gagacuuuaaacau

SEQ ID NO: 2186795 - RNA, 19 nt, Streptococcus pneumoniae R6
gagacuuugguauuacuua

SEQ ID NO: 2186796 - RNA, 20 nt, Streptococcus pneumoniae R6
gagacuggcuaggugagauu

SEQ ID NO: 2186797 - RNA, 14 nt, Streptococcus pneumoniae R6
gagacuugcaagaa

SEQ ID NO: 2186798 - RNA, 15 nt, Streptococcus pneumoniae R6
gagaccgacaccugc

SEQ ID NO: 2186799 - RNA, 15 nt, Streptococcus pneumoniae R6
gagagggucucccag

SEQ ID NO: 2186800 - RNA, 14 nt, Streptococcus pneumoniae R6
gagaauucuaguag

SEQ ID NO: 2186801 - RNA, 23 nt, Streptococcus pneumoniae R6
gagaaucaacaugagaauacaaa

SEQ ID NO: 2186802 - RNA, 13 nt, Streptococcus pneumoniae R6
gagaaucaucaug

SEQ ID NO: 2186803 - RNA, 20 nt, Streptococcus pneumoniae R6
gagaaucaucaugaaaccac

SEQ ID NO: 2186804 - RNA, 16 nt, Streptococcus pneumoniae R6
gagaaugaaauauaga

SEQ ID NO: 2186805 - RNA, 15 nt, Streptococcus pneumoniae R6
gagacagcaccaacu

SEQ ID NO: 2186806 - RNA, 13 nt, Streptococcus pneumoniae R6
gagacaaaaaaaa

SEQ ID NO: 2186807 - RNA, 14 nt, Streptococcus pneumoniae R6
gagacaaaaaaaac

SEQ ID NO: 2186808 - RNA, 14 nt, Streptococcus pneumoniae R6
gagacaaaggagcu

SEQ ID NO: 2186809 - RNA, 20 nt, Streptococcus pneumoniae R6
gagacaacgcacaccagaga

SEQ ID NO: 2186810 - RNA, 18 nt, Streptococcus pneumoniae R6
gagaaggcugguugaaaa

SEQ ID NO: 2186811 - RNA, 17 nt, Streptococcus pneumoniae R6
gagaagccaagaguaga

SEQ ID NO: 2186812 - RNA, 22 nt, Streptococcus pneumoniae R6
gagaagccaagaguagagagaa

SEQ ID NO: 2186813 - RNA, 11 nt, Streptococcus pneumoniae R6
gagaagaaauu

SEQ ID NO: 2186814 - RNA, 18 nt, Streptococcus pneumoniae R6
gagaacccuuuuuggaua

SEQ ID NO: 2186815 - RNA, 19 nt, Streptococcus pneumoniae R6
gacugaaucugaaauagua

SEQ ID NO: 2186816 - RNA, 20 nt, Streptococcus pneumoniae R6
gacugaaauacggauaacgu

SEQ ID NO: 2186817 - RNA, 18 nt, Streptococcus pneumoniae R6
gacugauggaaguaauuu

SEQ ID NO: 2186818 - RNA, 23 nt, Streptococcus pneumoniae R6
gacugacgaagucagcucaaaac

SEQ ID NO: 2186819 - RNA, 15 nt, Streptococcus pneumoniae R6
gacugacuaccaagu

SEQ ID NO: 2186820 - RNA, 16 nt, Streptococcus pneumoniae R6
gacucuuauuucucaa

SEQ ID NO: 2186821 - RNA, 20 nt, Streptococcus pneumoniae R6
gacucuugcccuuggcuagu

SEQ ID NO: 2186822 - RNA, 12 nt, Streptococcus pneumoniae R6
gacucuuguucu

SEQ ID NO: 2186823 - RNA, 17 nt, Streptococcus pneumoniae R6
gacugccuuuauuuuuu

SEQ ID NO: 2186824 - RNA, 22 nt, Streptococcus pneumoniae R6
gacugauuaaauagagccuucu

SEQ ID NO: 2186825 - RNA, 14 nt, Streptococcus pneumoniae R6
gacugauuuacaaa

SEQ ID NO: 2186826 - RNA, 15 nt, Streptococcus pneumoniae R6
gacugauuucaauuu

SEQ ID NO: 2186827 - RNA, 17 nt, Streptococcus pneumoniae R6
gacuauaucauauagau

SEQ ID NO: 2186828 - RNA, 20 nt, Streptococcus pneumoniae R6
gacuaggugagcaucaggaa

SEQ ID NO: 2186829 - RNA, 15 nt, Streptococcus pneumoniae R6
gacuagauaaaagaa

SEQ ID NO: 2186830 - RNA, 19 nt, Streptococcus pneumoniae R6
gacuagauaaaagaaugcu

SEQ ID NO: 2186831 - RNA, 12 nt, Streptococcus pneumoniae R6
gacuagcaauca

SEQ ID NO: 2186832 - RNA, 14 nt, Streptococcus pneumoniae R6
gacuaggcggcugg

SEQ ID NO: 2186833 - RNA, 14 nt, Streptococcus pneumoniae R6
gacuacauuuuuug

SEQ ID NO: 2186834 - RNA, 14 nt, Streptococcus pneumoniae R6
gacuacuaaaacau

SEQ ID NO: 2186835 - RNA, 23 nt, Streptococcus pneumoniae R6
gacuaucuuguugaaugagcuuc

SEQ ID NO: 2186836 - RNA, 20 nt, Streptococcus pneumoniae R6
gacuauuaaccuugucuucu

SEQ ID NO: 2186837 - RNA, 21 nt, Streptococcus pneumoniae R6
gacuauuaaccuugucuucuc

SEQ ID NO: 2186838 - RNA, 20 nt, Streptococcus pneumoniae R6
gacuccaccauaguguuucu

SEQ ID NO: 2186839 - RNA, 24 nt, Streptococcus pneumoniae R6
gacuccaccauaguguuucucugu

SEQ ID NO: 2186840 - RNA, 19 nt, Streptococcus pneumoniae R6
gacguuuucuccuuugagg

SEQ ID NO: 2186841 - RNA, 20 nt, Streptococcus pneumoniae R6
gacuaacuucuuauuagcaa

SEQ ID NO: 2186842 - RNA, 21 nt, Streptococcus pneumoniae R6
gacuaaauccaaaagcaggag

SEQ ID NO: 2186843 - RNA, 16 nt, Streptococcus pneumoniae R6
gacuaaauacaaaaac

SEQ ID NO: 2186844 - RNA, 22 nt, Streptococcus pneumoniae R6
gacuaaaguuguacaagaaaag

SEQ ID NO: 2186845 - RNA, 14 nt, Streptococcus pneumoniae R6
gacguuuaucaaua

SEQ ID NO: 2186846 - RNA, 18 nt, Streptococcus pneumoniae R6
gacguucaaagauaucau

SEQ ID NO: 2186847 - RNA, 15 nt, Streptococcus pneumoniae R6
gacguucuucugcag

SEQ ID NO: 2186848 - RNA, 16 nt, Streptococcus pneumoniae R6
gacgugguuugaagag

SEQ ID NO: 2186849 - RNA, 15 nt, Streptococcus pneumoniae R6
gacgucguaaccaga

SEQ ID NO: 2186850 - RNA, 12 nt, Streptococcus pneumoniae R6
gacggucaugcg

SEQ ID NO: 2186851 - RNA, 13 nt, Streptococcus pneumoniae R6
gagcgaaaucaac

SEQ ID NO: 2186852 - RNA, 17 nt, Streptococcus pneumoniae R6
gagcgauaaaaauccuu

SEQ ID NO: 2186853 - RNA, 23 nt, Streptococcus pneumoniae R6
gagcgaggucgcugugauaaugg

SEQ ID NO: 2186854 - RNA, 15 nt, Streptococcus pneumoniae R6
gagcgacuuuuucug

SEQ ID NO: 2186855 - RNA, 19 nt, Streptococcus pneumoniae R6
gagcgacguuuucauaagc

SEQ ID NO: 2186856 - RNA, 23 nt, Streptococcus pneumoniae R6
gagcuauuagaugguauugacug

SEQ ID NO: 2186857 - RNA, 17 nt, Streptococcus pneumoniae R6
gagcuacguucugucaa

SEQ ID NO: 2186858 - RNA, 21 nt, Streptococcus pneumoniae R6
gagcuacguucugucaaacca

SEQ ID NO: 2186859 - RNA, 16 nt, Streptococcus pneumoniae R6
gagcugcugcuuccau

SEQ ID NO: 2186860 - RNA, 21 nt, Streptococcus pneumoniae R6
gagcugacuucgucaguucua

SEQ ID NO: 2186861 - RNA, 15 nt, Streptococcus pneumoniae R6
gagcugauagugaug

SEQ ID NO: 2186862 - RNA, 22 nt, Streptococcus pneumoniae R6
gaggcaaugacaacaccgacag

SEQ ID NO: 2186863 - RNA, 22 nt, Streptococcus pneumoniae R6
gaggcacuuuuguccuauucuu

SEQ ID NO: 2186864 - RNA, 18 nt, Streptococcus pneumoniae R6
gaggauaaaaaagaagga

SEQ ID NO: 2186865 - RNA, 14 nt, Streptococcus pneumoniae R6
gaggagugauaaug

SEQ ID NO: 2186866 - RNA, 15 nt, Streptococcus pneumoniae R6
gaggagguaaauccc

SEQ ID NO: 2186867 - RNA, 21 nt, Streptococcus pneumoniae R6
gaggaguaggaguaguaaaac

SEQ ID NO: 2186868 - RNA, 18 nt, Streptococcus pneumoniae R6
gaggaucagacugguucu

SEQ ID NO: 2186869 - RNA, 20 nt, Streptococcus pneumoniae R6
gagcuucuuucaugagugga

SEQ ID NO: 2186870 - RNA, 12 nt, Streptococcus pneumoniae R6
gagcuucuuuug

SEQ ID NO: 2186871 - RNA, 16 nt, Streptococcus pneumoniae R6
gagcuucuuuuggauu

SEQ ID NO: 2186872 - RNA, 18 nt, Streptococcus pneumoniae R6
gagcuuuuauuucuugaa

SEQ ID NO: 2186873 - RNA, 16 nt, Streptococcus pneumoniae R6
gagcuggggcuacugg

SEQ ID NO: 2186874 - RNA, 17 nt, Streptococcus pneumoniae R6
gagcugcugugaugagg

SEQ ID NO: 2186875 - RNA, 13 nt, Streptococcus pneumoniae R6
gagcuuauuuuug

SEQ ID NO: 2186876 - RNA, 16 nt, Streptococcus pneumoniae R6
gagcuuauuuuugcaa

SEQ ID NO: 2186877 - RNA, 20 nt, Streptococcus pneumoniae R6
gagcuuccaguagcgcuuga

SEQ ID NO: 2186878 - RNA, 18 nt, Streptococcus pneumoniae R6
gagcuuagcuuuucuuca

SEQ ID NO: 2186879 - RNA, 19 nt, Streptococcus pneumoniae R6
gagcuuagcuuuucuucaa

SEQ ID NO: 2186880 - RNA, 12 nt, Streptococcus pneumoniae R6
gaggaaggggcg

SEQ ID NO: 2186881 - RNA, 19 nt, Streptococcus pneumoniae R6
gaggaauaaaugcaaagcc

SEQ ID NO: 2186882 - RNA, 19 nt, Streptococcus pneumoniae R6
gaggacaguuauagggauu

SEQ ID NO: 2186883 - RNA, 18 nt, Streptococcus pneumoniae R6
gaggagaauuuuugagau

SEQ ID NO: 2186884 - RNA, 15 nt, Streptococcus pneumoniae R6
gaggaggagaaaaag

SEQ ID NO: 2186885 - RNA, 14 nt, Streptococcus pneumoniae R6
gagcaauacuuuuu

SEQ ID NO: 2186886 - RNA, 13 nt, Streptococcus pneumoniae R6
gagcaaugauaga

SEQ ID NO: 2186887 - RNA, 17 nt, Streptococcus pneumoniae R6
gagauuuucauaaacaa

SEQ ID NO: 2186888 - RNA, 20 nt, Streptococcus pneumoniae R6
gagauuucuccauagauuuc

SEQ ID NO: 2186889 - RNA, 18 nt, Streptococcus pneumoniae R6
gagcaaacugaauccgca

SEQ ID NO: 2186890 - RNA, 21 nt, Streptococcus pneumoniae R6
gagcaaccuacggcuagcuuc

SEQ ID NO: 2186891 - RNA, 20 nt, Streptococcus pneumoniae R6
gagcacugcuagcaucaucg

SEQ ID NO: 2186892 - RNA, 21 nt, Streptococcus pneumoniae R6
gagcagauuucuuuuaagaaa

SEQ ID NO: 2186893 - RNA, 22 nt, Streptococcus pneumoniae R6
gagcacccucguuaucauucca

SEQ ID NO: 2186894 - RNA, 14 nt, Streptococcus pneumoniae R6
gagaugaggcgcuc

SEQ ID NO: 2186895 - RNA, 15 nt, Streptococcus pneumoniae R6
gagauuggaaaccaa

SEQ ID NO: 2186896 - RNA, 20 nt, Streptococcus pneumoniae R6
gagauuauugguggcuucca

SEQ ID NO: 2186897 - RNA, 20 nt, Streptococcus pneumoniae R6
gagauuacugauaaaacuga

SEQ ID NO: 2186898 - RNA, 15 nt, Streptococcus pneumoniae R6
gagauaguaucaaau

SEQ ID NO: 2186899 - RNA, 22 nt, Streptococcus pneumoniae R6
gagauaguaucccauucuucag

SEQ ID NO: 2186900 - RNA, 19 nt, Streptococcus pneumoniae R6
gagauagcgcugggcuguc

SEQ ID NO: 2186901 - RNA, 21 nt, Streptococcus pneumoniae R6
gagaguuacggguuuuaaacu

SEQ ID NO: 2186902 - RNA, 22 nt, Streptococcus pneumoniae R6
gagccaauacugcucgguaaaa

SEQ ID NO: 2186903 - RNA, 13 nt, Streptococcus pneumoniae R6
gagcauucuuuug

SEQ ID NO: 2186904 - RNA, 14 nt, Streptococcus pneumoniae R6
gagcauacugcccu

SEQ ID NO: 2186905 - RNA, 15 nt, Streptococcus pneumoniae R6
gagcaguugauggag

SEQ ID NO: 2186906 - RNA, 22 nt, Streptococcus pneumoniae R6
gagcaguuccacgauauuguug

SEQ ID NO: 2186907 - RNA, 20 nt, Streptococcus pneumoniae R6
gagccagcugaaaaaaacug

SEQ ID NO: 2186908 - RNA, 17 nt, Streptococcus pneumoniae R6
gagccacucuuuauucc

SEQ ID NO: 2186909 - RNA, 14 nt, Streptococcus pneumoniae R6
gagccgcaagguga

SEQ ID NO: 2186910 - RNA, 14 nt, Streptococcus pneumoniae R6
gagccgcugaguca

SEQ ID NO: 2186911 - RNA, 16 nt, Streptococcus pneumoniae R6
gagccggaaauugucu

SEQ ID NO: 2186912 - RNA, 20 nt, Streptococcus pneumoniae R6
gagccggggggcucuuuuua

SEQ ID NO: 2186913 - RNA, 13 nt, Streptococcus pneumoniae R6
gauguuacagaca

SEQ ID NO: 2186914 - RNA, 20 nt, Streptococcus pneumoniae R6
gauguuacagacaaaacugg

SEQ ID NO: 2186915 - RNA, 12 nt, Streptococcus pneumoniae R6
gauguucagagc

SEQ ID NO: 2186916 - RNA, 12 nt, Streptococcus pneumoniae R6
gauguucaaagc

SEQ ID NO: 2186917 - RNA, 12 nt, Streptococcus pneumoniae R6
gauguucaaagu

SEQ ID NO: 2186918 - RNA, 21 nt, Streptococcus pneumoniae R6
gauguuauuuacuguuuuagc

SEQ ID NO: 2186919 - RNA, 22 nt, Streptococcus pneumoniae R6
gauguuauacaaauaaggagua

SEQ ID NO: 2186920 - RNA, 16 nt, Streptococcus pneumoniae R6
gauguucuuugaaaua

SEQ ID NO: 2186921 - RNA, 22 nt, Streptococcus pneumoniae R6
gauuacacaaucguuucaaaaa

SEQ ID NO: 2186922 - RNA, 17 nt, Streptococcus pneumoniae R6
gauuacaucucuuguaa

SEQ ID NO: 2186923 - RNA, 15 nt, Streptococcus pneumoniae R6
gauuacauagacuuc

SEQ ID NO: 2186924 - RNA, 13 nt, Streptococcus pneumoniae R6
gauuaauccccau

SEQ ID NO: 2186925 - RNA, 22 nt, Streptococcus pneumoniae R6
gauucacauggagggucaaaac

SEQ ID NO: 2186926 - RNA, 17 nt, Streptococcus pneumoniae R6
gauucauaguuacuccu

SEQ ID NO: 2186927 - RNA, 19 nt, Streptococcus pneumoniae R6
gauucacuagccccagcua

SEQ ID NO: 2186928 - RNA, 15 nt, Streptococcus pneumoniae R6
gauucagauucauca

SEQ ID NO: 2186929 - RNA, 11 nt, Streptococcus pneumoniae R6
gauuauaaaag

SEQ ID NO: 2186930 - RNA, 18 nt, Streptococcus pneumoniae R6
gauuauagguuccuucug

SEQ ID NO: 2186931 - RNA, 18 nt, Streptococcus pneumoniae R6
gauuaggagaaucaacau

SEQ ID NO: 2186932 - RNA, 16 nt, Streptococcus pneumoniae R6
gauuagguuuccuuua

SEQ ID NO: 2186933 - RNA, 19 nt, Streptococcus pneumoniae R6
gauuauuuuuuaacagauu

SEQ ID NO: 2186934 - RNA, 16 nt, Streptococcus pneumoniae R6
gauucaugacaucuuc

SEQ ID NO: 2186935 - RNA, 16 nt, Streptococcus pneumoniae R6
gauuccaaacaacaau

SEQ ID NO: 2186936 - RNA, 12 nt, Streptococcus pneumoniae R6
gauuccuccgag

SEQ ID NO: 2186937 - RNA, 15 nt, Streptococcus pneumoniae R6
gauuccuuuuugcag

SEQ ID NO: 2186938 - RNA, 15 nt, Streptococcus pneumoniae R6
gauuuucucuuuguu

SEQ ID NO: 2186939 - RNA, 20 nt, Streptococcus pneumoniae R6
gauuuucgaaaauucuuugg

SEQ ID NO: 2186940 - RNA, 19 nt, Streptococcus pneumoniae R6
gauuuucgaagaguauaaa

SEQ ID NO: 2186941 - RNA, 22 nt, Streptococcus pneumoniae R6
gauuuucauauaauaaauugua

SEQ ID NO: 2186942 - RNA, 14 nt, Streptococcus pneumoniae R6
gauuuucaucauca

SEQ ID NO: 2186943 - RNA, 22 nt, Streptococcus pneumoniae R6
gauuuucauugacucuaacugu

SEQ ID NO: 2186944 - RNA, 20 nt, Streptococcus pneumoniae R6
gauuuucauugaguauaagc

SEQ ID NO: 2186945 - RNA, 22 nt, Streptococcus pneumoniae R6
gauuuugccaaguuucuuuauu

SEQ ID NO: 2186946 - RNA, 22 nt, Streptococcus pneumoniae R6
gauuuugagacuaaggagaguc

SEQ ID NO: 2186947 - RNA, 21 nt, Streptococcus pneumoniae R6
gauuuucuggcagauuuugaa

SEQ ID NO: 2186948 - RNA, 10 nt, Streptococcus pneumoniae R6
gcaaaaaaag

SEQ ID NO: 2186949 - RNA, 16 nt, Streptococcus pneumoniae R6
gcaaaaaaaaugaaaa

SEQ ID NO: 2186950 - RNA, 20 nt, Streptococcus pneumoniae R6
gcaaaaaaaaugaaaaaaau

SEQ ID NO: 2186951 - RNA, 13 nt, Streptococcus pneumoniae R6
gauuuuuuccuug

SEQ ID NO: 2186952 - RNA, 19 nt, Streptococcus pneumoniae R6
gauuuuuucugucuaacuu

SEQ ID NO: 2186953 - RNA, 20 nt, Streptococcus pneumoniae R6
gauuuuuucugucuaacuuu

SEQ ID NO: 2186954 - RNA, 17 nt, Streptococcus pneumoniae R6
gauuuuuucuuuguucu

SEQ ID NO: 2186955 - RNA, 17 nt, Streptococcus pneumoniae R6
gauuuuuuucaaacaau

SEQ ID NO: 2186956 - RNA, 20 nt, Streptococcus pneumoniae R6
gauuuuuuucaaacaauuga

SEQ ID NO: 2186957 - RNA, 19 nt, Streptococcus pneumoniae R6
gauuuuuuuuaaaaaagug

SEQ ID NO: 2186958 - RNA, 20 nt, Streptococcus pneumoniae R6
gauuuuuuuuaaaaaagugg

SEQ ID NO: 2186959 - RNA, 22 nt, Streptococcus pneumoniae R6
gauuuuuuuuaaaaaaguggua

SEQ ID NO: 2186960 - RNA, 16 nt, Streptococcus pneumoniae R6
gauuuuuuagcuucuu

SEQ ID NO: 2186961 - RNA, 13 nt, Streptococcus pneumoniae R6
gauuuuuucauuc

SEQ ID NO: 2186962 - RNA, 19 nt, Streptococcus pneumoniae R6
gauuuuuggaaaaaauaaa

SEQ ID NO: 2186963 - RNA, 22 nt, Streptococcus pneumoniae R6
gauuuuuggaaaaaauaaaaaa

SEQ ID NO: 2186964 - RNA, 16 nt, Streptococcus pneumoniae R6
gauuuccacuaaaggu

SEQ ID NO: 2186965 - RNA, 17 nt, Streptococcus pneumoniae R6
gauuuccacuaaagguu

SEQ ID NO: 2186966 - RNA, 19 nt, Streptococcus pneumoniae R6
gauuuccaaucuucuccag

SEQ ID NO: 2186967 - RNA, 17 nt, Streptococcus pneumoniae R6
gauuuccauuuuccaug

SEQ ID NO: 2186968 - RNA, 15 nt, Streptococcus pneumoniae R6
gauuucuaaagagua

SEQ ID NO: 2186969 - RNA, 22 nt, Streptococcus pneumoniae R6
gauuucuccgaggauuucccaa

SEQ ID NO: 2186970 - RNA, 19 nt, Streptococcus pneumoniae R6
gauuucuggauuuccauuu

SEQ ID NO: 2186971 - RNA, 12 nt, Streptococcus pneumoniae R6
gauuucuccugu

SEQ ID NO: 2186972 - RNA, 20 nt, Streptococcus pneumoniae R6
gauuucuccuguuucaaagu

SEQ ID NO: 2186973 - RNA, 21 nt, Streptococcus pneumoniae R6
gauuucucuauucuuuuuugg

SEQ ID NO: 2186974 - RNA, 16 nt, Streptococcus pneumoniae R6
gauuuguccuggucuu

SEQ ID NO: 2186975 - RNA, 15 nt, Streptococcus pneumoniae R6
gauuuguucucuuug

SEQ ID NO: 2186976 - RNA, 18 nt, Streptococcus pneumoniae R6
gauuugguugaagaggua

SEQ ID NO: 2186977 - RNA, 19 nt, Streptococcus pneumoniae R6
gauuuggacuauucguuug

SEQ ID NO: 2186978 - RNA, 23 nt, Streptococcus pneumoniae R6
gauuguagguguaaacuuuauau

SEQ ID NO: 2186979 - RNA, 19 nt, Streptococcus pneumoniae R6
gauugugaauuauaguaga

SEQ ID NO: 2186980 - RNA, 13 nt, Streptococcus pneumoniae R6
gauugguucugcu

SEQ ID NO: 2186981 - RNA, 19 nt, Streptococcus pneumoniae R6
gauuggcuuugacuuaaau

SEQ ID NO: 2186982 - RNA, 21 nt, Streptococcus pneumoniae R6
gauugggaaaguaaaauuaau

SEQ ID NO: 2186983 - RNA, 16 nt, Streptococcus pneumoniae R6
gauugcccaaaaugag

SEQ ID NO: 2186984 - RNA, 21 nt, Streptococcus pneumoniae R6
gauuuaccuuccucaacaaaa

SEQ ID NO: 2186985 - RNA, 19 nt, Streptococcus pneumoniae R6
gauuuaauuagaaaaaaau

SEQ ID NO: 2186986 - RNA, 19 nt, Streptococcus pneumoniae R6
gauuuagcuuugcgcuaga

SEQ ID NO: 2186987 - RNA, 21 nt, Streptococcus pneumoniae R6
gauuuaggacuaaauacaaaa

SEQ ID NO: 2186988 - RNA, 19 nt, Streptococcus pneumoniae R6
gauuuaguagcaucauaga

SEQ ID NO: 2186989 - RNA, 17 nt, Streptococcus pneumoniae R6
gauuuaguucuguacug

SEQ ID NO: 2186990 - RNA, 15 nt, Streptococcus pneumoniae R6
gauuuauaauuucaa

SEQ ID NO: 2186991 - RNA, 21 nt, Streptococcus pneumoniae R6
gauuuauagcgcuagagacua

SEQ ID NO: 2186992 - RNA, 19 nt, Streptococcus pneumoniae R6
gauucgucauuuguuuuag

SEQ ID NO: 2186993 - RNA, 19 nt, Streptococcus pneumoniae R6
gauucggacgauuaaaagu

SEQ ID NO: 2186994 - RNA, 22 nt, Streptococcus pneumoniae R6
gauucggauaaguuuuguuugu

SEQ ID NO: 2186995 - RNA, 14 nt, Streptococcus pneumoniae R6
gauugauuauccuu

SEQ ID NO: 2186996 - RNA, 19 nt, Streptococcus pneumoniae R6
gauucuacucuguuuucac

SEQ ID NO: 2186997 - RNA, 12 nt, Streptococcus pneumoniae R6
gauucuacuuuu

SEQ ID NO: 2186998 - RNA, 18 nt, Streptococcus pneumoniae R6
gauugauuuucagcaccu

SEQ ID NO: 2186999 - RNA, 18 nt, Streptococcus pneumoniae R6
gauugcaagcccuuauuu

SEQ ID NO: 2187000 - RNA, 22 nt, Streptococcus pneumoniae R6
gauugcaagcccuuauuuccau

SEQ ID NO: 2187001 - RNA, 16 nt, Streptococcus pneumoniae R6
gaugcuacuauauucu

SEQ ID NO: 2187002 - RNA, 21 nt, Streptococcus pneumoniae R6
gaugcugacaagucauccaug

SEQ ID NO: 2187003 - RNA, 14 nt, Streptococcus pneumoniae R6
gaugauguuuaaaa

SEQ ID NO: 2187004 - RNA, 20 nt, Streptococcus pneumoniae R6
gaugauguuuaaaaucugga

SEQ ID NO: 2187005 - RNA, 22 nt, Streptococcus pneumoniae R6
gaugauuggaaauucaagaaug

SEQ ID NO: 2187006 - RNA, 20 nt, Streptococcus pneumoniae R6
gaugauuuaauuagaaaaaa

SEQ ID NO: 2187007 - RNA, 19 nt, Streptococcus pneumoniae R6
gaugauucucagguuuuuc

SEQ ID NO: 2187008 - RNA, 15 nt, Streptococcus pneumoniae R6
gaugcaauuuuuuug

SEQ ID NO: 2187009 - RNA, 19 nt, Streptococcus pneumoniae R6
gaugaagggcuuuucuauc

SEQ ID NO: 2187010 - RNA, 21 nt, Streptococcus pneumoniae R6
gaugaaguaaaugugagcuuu

SEQ ID NO: 2187011 - RNA, 16 nt, Streptococcus pneumoniae R6
gaugauaacgaaucca

SEQ ID NO: 2187012 - RNA, 19 nt, Streptococcus pneumoniae R6
gaugauaacgaauccaacu

SEQ ID NO: 2187013 - RNA, 15 nt, Streptococcus pneumoniae R6
gaugaaacuaauagg

SEQ ID NO: 2187014 - RNA, 13 nt, Streptococcus pneumoniae R6
gaugaaacugacg

SEQ ID NO: 2187015 - RNA, 11 nt, Streptococcus pneumoniae R6
gaugaaacccc

SEQ ID NO: 2187016 - RNA, 13 nt, Streptococcus pneumoniae R6
gaugaaaccccaa

SEQ ID NO: 2187017 - RNA, 20 nt, Streptococcus pneumoniae R6
gaugaaaccccaagaaacaa

SEQ ID NO: 2187018 - RNA, 12 nt, Streptococcus pneumoniae R6
gaugaaaaaaag

SEQ ID NO: 2187019 - RNA, 14 nt, Streptococcus pneumoniae R6
gaugaaaaaaaguu

SEQ ID NO: 2187020 - RNA, 19 nt, Streptococcus pneumoniae R6
gaucuuggauauucaauuc

SEQ ID NO: 2187021 - RNA, 15 nt, Streptococcus pneumoniae R6
gaucuugucugcaug

SEQ ID NO: 2187022 - RNA, 16 nt, Streptococcus pneumoniae R6
gaucuugucugcaugg

SEQ ID NO: 2187023 - RNA, 14 nt, Streptococcus pneumoniae R6
gaucuuaaauuuuc

SEQ ID NO: 2187024 - RNA, 17 nt, Streptococcus pneumoniae R6
gaucuacuucuuuaacu

SEQ ID NO: 2187025 - RNA, 15 nt, Streptococcus pneumoniae R6
gaucuacuuuuuucu

SEQ ID NO: 2187026 - RNA, 22 nt, Streptococcus pneumoniae R6
gaucuauuguugcauuaaaaag

SEQ ID NO: 2187027 - RNA, 19 nt, Streptococcus pneumoniae R6
gaucugacuucgucaguuc

SEQ ID NO: 2187028 - RNA, 22 nt, Streptococcus pneumoniae R6
gaucugacuucgucaguucuau

SEQ ID NO: 2187029 - RNA, 23 nt, Streptococcus pneumoniae R6
gaucugacuucgucaguucuauc

SEQ ID NO: 2187030 - RNA, 20 nt, Streptococcus pneumoniae R6
gaucugauauauuuucgauu

SEQ ID NO: 2187031 - RNA, 14 nt, Streptococcus pneumoniae R6
gaucaauucaacag

SEQ ID NO: 2187032 - RNA, 17 nt, Streptococcus pneumoniae R6
gauauuaugcguuuuuc

SEQ ID NO: 2187033 - RNA, 23 nt, Streptococcus pneumoniae R6
gauaucaaacuuuuuaguuuuug

SEQ ID NO: 2187034 - RNA, 23 nt, Streptococcus pneumoniae R6
gauauucaauucuuuaacaaaau

SEQ ID NO: 2187035 - RNA, 12 nt, Streptococcus pneumoniae R6
gauauucagagc

SEQ ID NO: 2187036 - RNA, 18 nt, Streptococcus pneumoniae R6
gauauaguuaaaaaagau

SEQ ID NO: 2187037 - RNA, 12 nt, Streptococcus pneumoniae R6
gauauaggaggg

SEQ ID NO: 2187038 - RNA, 15 nt, Streptococcus pneumoniae R6
gauauauaaaugaaa

SEQ ID NO: 2187039 - RNA, 22 nt, Streptococcus pneumoniae R6
gauauauugacuuuugaaaaaa

SEQ ID NO: 2187040 - RNA, 14 nt, Streptococcus pneumoniae R6
gauauucuuaucaa

SEQ ID NO: 2187041 - RNA, 21 nt, Streptococcus pneumoniae R6
gaucauggauuuuucuuauuu

SEQ ID NO: 2187042 - RNA, 14 nt, Streptococcus pneumoniae R6
gaucaucaaccuca

SEQ ID NO: 2187043 - RNA, 22 nt, Streptococcus pneumoniae R6
gaucagaguuuugaaaacuuac

SEQ ID NO: 2187044 - RNA, 19 nt, Streptococcus pneumoniae R6
gaucagaccaguuucuucu

SEQ ID NO: 2187045 - RNA, 16 nt, Streptococcus pneumoniae R6
gauagcugcagcugag

SEQ ID NO: 2187046 - RNA, 17 nt, Streptococcus pneumoniae R6
gauagcugcagcugagg

SEQ ID NO: 2187047 - RNA, 21 nt, Streptococcus pneumoniae R6
gauagcugcagcugaggaaau

SEQ ID NO: 2187048 - RNA, 13 nt, Streptococcus pneumoniae R6
gauagcggcaacu

SEQ ID NO: 2187049 - RNA, 13 nt, Streptococcus pneumoniae R6
gauagcuugaauu

SEQ ID NO: 2187050 - RNA, 14 nt, Streptococcus pneumoniae R6
gauaggugcugguu

SEQ ID NO: 2187051 - RNA, 17 nt, Streptococcus pneumoniae R6
gauaguaucaaaugacu

SEQ ID NO: 2187052 - RNA, 18 nt, Streptococcus pneumoniae R6
gauauaaugguuauaucu

SEQ ID NO: 2187053 - RNA, 18 nt, Streptococcus pneumoniae R6
gauauagauaccugguuc

SEQ ID NO: 2187054 - RNA, 19 nt, Streptococcus pneumoniae R6
gauauaauaaaaagagaag

SEQ ID NO: 2187055 - RNA, 20 nt, Streptococcus pneumoniae R6
gauauaagguaggagugaaa

SEQ ID NO: 2187056 - RNA, 14 nt, Streptococcus pneumoniae R6
gauauaagaagcau

SEQ ID NO: 2187057 - RNA, 19 nt, Streptococcus pneumoniae R6
gauagugauguuucaaguc

SEQ ID NO: 2187058 - RNA, 18 nt, Streptococcus pneumoniae R6
gauagugguguuucaagu

SEQ ID NO: 2187059 - RNA, 21 nt, Streptococcus pneumoniae R6
gauaguuuugcaagagcgguu

SEQ ID NO: 2187060 - RNA, 13 nt, Streptococcus pneumoniae R6
gauaguuuuuccc

SEQ ID NO: 2187061 - RNA, 19 nt, Streptococcus pneumoniae R6
gauaccuauccuacccacu

SEQ ID NO: 2187062 - RNA, 23 nt, Streptococcus pneumoniae R6
gauaaguuccaucugggucggcu

SEQ ID NO: 2187063 - RNA, 18 nt, Streptococcus pneumoniae R6
gauaaguggcaaaaauau

SEQ ID NO: 2187064 - RNA, 18 nt, Streptococcus pneumoniae R6
gauaaguuugguuuuuug

SEQ ID NO: 2187065 - RNA, 18 nt, Streptococcus pneumoniae R6
gauaaggagcgaauuuga

SEQ ID NO: 2187066 - RNA, 18 nt, Streptococcus pneumoniae R6
gauaaggaauuuuagaag

SEQ ID NO: 2187067 - RNA, 22 nt, Streptococcus pneumoniae R6
gauaaggccugauaagaugaca

SEQ ID NO: 2187068 - RNA, 21 nt, Streptococcus pneumoniae R6
gauaaggcaucuuaacauucu

SEQ ID NO: 2187069 - RNA, 13 nt, Streptococcus pneumoniae R6
gauacuaacacau

SEQ ID NO: 2187070 - RNA, 17 nt, Streptococcus pneumoniae R6
gauacuaugcguuuuaa

SEQ ID NO: 2187071 - RNA, 20 nt, Streptococcus pneumoniae R6
gauacguguaugugcauagu

SEQ ID NO: 2187072 - RNA, 17 nt, Streptococcus pneumoniae R6
gauaccucgacuucaaa

SEQ ID NO: 2187073 - RNA, 20 nt, Streptococcus pneumoniae R6
gauaccugggaagaugaaga

SEQ ID NO: 2187074 - RNA, 16 nt, Streptococcus pneumoniae R6
gauaccuuuuccuuca

SEQ ID NO: 2187075 - RNA, 23 nt, Streptococcus pneumoniae R6
gauaccuuuuccuucauuuccaa

SEQ ID NO: 2187076 - RNA, 20 nt, Streptococcus pneumoniae R6
gauagaaagcaaggcuuugu

SEQ ID NO: 2187077 - RNA, 13 nt, Streptococcus pneumoniae R6
gauagaacugacg

SEQ ID NO: 2187078 - RNA, 15 nt, Streptococcus pneumoniae R6
gauagaacugacgaa

SEQ ID NO: 2187079 - RNA, 22 nt, Streptococcus pneumoniae R6
gauagaagagucagcucuuuuu

SEQ ID NO: 2187080 - RNA, 16 nt, Streptococcus pneumoniae R6
gauagaaggucaagag

SEQ ID NO: 2187081 - RNA, 19 nt, Streptococcus pneumoniae R6
gauagaaggucaagagaaa

SEQ ID NO: 2187082 - RNA, 21 nt, Streptococcus pneumoniae R6
gauagaaggucaagagaaaac

SEQ ID NO: 2187083 - RNA, 21 nt, Streptococcus pneumoniae R6
gauagaagguccguuggucaa

SEQ ID NO: 2187084 - RNA, 15 nt, Streptococcus pneumoniae R6
gauagaaguagagag

SEQ ID NO: 2187085 - RNA, 11 nt, Streptococcus pneumoniae R6
gauagccaacu

SEQ ID NO: 2187086 - RNA, 22 nt, Streptococcus pneumoniae R6
gauagccaacucauacuuucua

SEQ ID NO: 2187087 - RNA, 19 nt, Streptococcus pneumoniae R6
gaguaaugggcgcauuuuc

SEQ ID NO: 2187088 - RNA, 14 nt, Streptococcus pneumoniae R6
gaguaacggcuucc

SEQ ID NO: 2187089 - RNA, 14 nt, Streptococcus pneumoniae R6
gaguaacuaugaau

SEQ ID NO: 2187090 - RNA, 23 nt, Streptococcus pneumoniae R6
gagguuguugauucgcucuucaa

SEQ ID NO: 2187091 - RNA, 18 nt, Streptococcus pneumoniae R6
gagguuguagauagaacu

SEQ ID NO: 2187092 - RNA, 23 nt, Streptococcus pneumoniae R6
gagguuguggaugaaacugacga

SEQ ID NO: 2187093 - RNA, 18 nt, Streptococcus pneumoniae R6
gaguaaaagaaauacagu

SEQ ID NO: 2187094 - RNA, 16 nt, Streptococcus pneumoniae R6
gaguaaaagacaucag

SEQ ID NO: 2187095 - RNA, 16 nt, Streptococcus pneumoniae R6
gaguaaauaaaacaaa

SEQ ID NO: 2187096 - RNA, 14 nt, Streptococcus pneumoniae R6
gaggucugaaacua

SEQ ID NO: 2187097 - RNA, 18 nt, Streptococcus pneumoniae R6
gaggucgcugugauaaug

SEQ ID NO: 2187098 - RNA, 17 nt, Streptococcus pneumoniae R6
gaggucccaugcuucca

SEQ ID NO: 2187099 - RNA, 15 nt, Streptococcus pneumoniae R6
gagguguaaguccuc

SEQ ID NO: 2187100 - RNA, 16 nt, Streptococcus pneumoniae R6
gagguuaacuccuuug

SEQ ID NO: 2187101 - RNA, 16 nt, Streptococcus pneumoniae R6
gaggugauaaagucca

SEQ ID NO: 2187102 - RNA, 18 nt, Streptococcus pneumoniae R6
gagggaaagauccaguac

SEQ ID NO: 2187103 - RNA, 20 nt, Streptococcus pneumoniae R6
gagggcacggagggcaccga

SEQ ID NO: 2187104 - RNA, 14 nt, Streptococcus pneumoniae R6
gagggauuuuguau

SEQ ID NO: 2187105 - RNA, 22 nt, Streptococcus pneumoniae R6
gagguagaggcgccugcugcua

SEQ ID NO: 2187106 - RNA, 17 nt, Streptococcus pneumoniae R6
gagguaaaucccaagua

SEQ ID NO: 2187107 - RNA, 23 nt, Streptococcus pneumoniae R6
gaggguccgaaccacaacaaaaa

SEQ ID NO: 2187108 - RNA, 21 nt, Streptococcus pneumoniae R6
gagggcugcguugaggacagg

SEQ ID NO: 2187109 - RNA, 20 nt, Streptococcus pneumoniae R6
gagggcugagaaggcugguu

SEQ ID NO: 2187110 - RNA, 18 nt, Streptococcus pneumoniae R6
gauaacauugacaucugu

SEQ ID NO: 2187111 - RNA, 13 nt, Streptococcus pneumoniae R6
gauaagacugacg

SEQ ID NO: 2187112 - RNA, 22 nt, Streptococcus pneumoniae R6
gauaagacugacgaagucagcu

SEQ ID NO: 2187113 - RNA, 16 nt, Streptococcus pneumoniae R6
gauaagaguuuuacag

SEQ ID NO: 2187114 - RNA, 12 nt, Streptococcus pneumoniae R6
gauaagauaaag

SEQ ID NO: 2187115 - RNA, 13 nt, Streptococcus pneumoniae R6
gauaagauuuuug

SEQ ID NO: 2187116 - RNA, 18 nt, Streptococcus pneumoniae R6
gauaagauuuuuggaaaa

SEQ ID NO: 2187117 - RNA, 23 nt, Streptococcus pneumoniae R6
gauaagauuuuuggaaaaaauaa

SEQ ID NO: 2187118 - RNA, 22 nt, Streptococcus pneumoniae R6
gauaagauaaaguggucuuuuu

SEQ ID NO: 2187119 - RNA, 13 nt, Streptococcus pneumoniae R6
gauaacagucagu

SEQ ID NO: 2187120 - RNA, 23 nt, Streptococcus pneumoniae R6
gauaacaguuuuuaauuuuucuu

SEQ ID NO: 2187121 - RNA, 21 nt, Streptococcus pneumoniae R6
gauaaauuuuauugucuucau

SEQ ID NO: 2187122 - RNA, 18 nt, Streptococcus pneumoniae R6
gauaaccacagacugagg

SEQ ID NO: 2187123 - RNA, 19 nt, Streptococcus pneumoniae R6
gauaaccaucucacacaau

SEQ ID NO: 2187124 - RNA, 23 nt, Streptococcus pneumoniae R6
gauaaauguugaauaguuuagua

SEQ ID NO: 2187125 - RNA, 15 nt, Streptococcus pneumoniae R6
gaguuuuaaucucaa

SEQ ID NO: 2187126 - RNA, 13 nt, Streptococcus pneumoniae R6
gaguuuugaaaac

SEQ ID NO: 2187127 - RNA, 15 nt, Streptococcus pneumoniae R6
gaguuuuuaucuagc

SEQ ID NO: 2187128 - RNA, 13 nt, Streptococcus pneumoniae R6
gaguuuucaaccu

SEQ ID NO: 2187129 - RNA, 15 nt, Streptococcus pneumoniae R6
gauaaacguaaaagu

SEQ ID NO: 2187130 - RNA, 19 nt, Streptococcus pneumoniae R6
gauaaacguaaaagucaua

SEQ ID NO: 2187131 - RNA, 12 nt, Streptococcus pneumoniae R6
gaguguuugcaa

SEQ ID NO: 2187132 - RNA, 20 nt, Streptococcus pneumoniae R6
gaguguuugcaaagaugaug

SEQ ID NO: 2187133 - RNA, 13 nt, Streptococcus pneumoniae R6
gaguggauguuuc

SEQ ID NO: 2187134 - RNA, 13 nt, Streptococcus pneumoniae R6
gaguggucaaaca

SEQ ID NO: 2187135 - RNA, 16 nt, Streptococcus pneumoniae R6
gaguugcuugucaucu

SEQ ID NO: 2187136 - RNA, 16 nt, Streptococcus pneumoniae R6
gaguugggugaugagu

SEQ ID NO: 2187137 - RNA, 15 nt, Streptococcus pneumoniae R6
gaguugcauagcgaa

SEQ ID NO: 2187138 - RNA, 11 nt, Streptococcus pneumoniae R6
gaguuucucuu

SEQ ID NO: 2187139 - RNA, 16 nt, Streptococcus pneumoniae R6
gaguagucauaccaag

SEQ ID NO: 2187140 - RNA, 21 nt, Streptococcus pneumoniae R6
gaguagguacuugcuguauuu

SEQ ID NO: 2187141 - RNA, 15 nt, Streptococcus pneumoniae R6
gcagauagggcuagg

SEQ ID NO: 2187142 - RNA, 22 nt, Streptococcus pneumoniae R6
gcagccuccguaccaacacauu

SEQ ID NO: 2187143 - RNA, 13 nt, Streptococcus pneumoniae R6
gcagaaccuuaaa

SEQ ID NO: 2187144 - RNA, 15 nt, Streptococcus pneumoniae R6
gcacuucuuuuuguu

SEQ ID NO: 2187145 - RNA, 15 nt, Streptococcus pneumoniae R6
gcacuugaugaaaaa

SEQ ID NO: 2187146 - RNA, 20 nt, Streptococcus pneumoniae R6
gcacuugaugaaaaaaaguu

SEQ ID NO: 2187147 - RNA, 17 nt, Streptococcus pneumoniae R6
gcagacgaaauacaaga

SEQ ID NO: 2187148 - RNA, 18 nt, Streptococcus pneumoniae R6
gcagacgaguuaaaacaa

SEQ ID NO: 2187149 - RNA, 19 nt, Streptococcus pneumoniae R6
gcagacgaguuaaaacaaa

SEQ ID NO: 2187150 - RNA, 15 nt, Streptococcus pneumoniae R6
gcagacagagaaaau

SEQ ID NO: 2187151 - RNA, 16 nt, Streptococcus pneumoniae R6
gcagagacauuagaaa

SEQ ID NO: 2187152 - RNA, 14 nt, Streptococcus pneumoniae R6
gcagagaaagaaaa

SEQ ID NO: 2187153 - RNA, 14 nt, Streptococcus pneumoniae R6
gcagagcuaaaaac

SEQ ID NO: 2187154 - RNA, 15 nt, Streptococcus pneumoniae R6
gcagaggcaaugaca

SEQ ID NO: 2187155 - RNA, 17 nt, Streptococcus pneumoniae R6
gcagauaagacugacga

SEQ ID NO: 2187156 - RNA, 23 nt, Streptococcus pneumoniae R6
gcagaguuuuuaucuagcucccu

SEQ ID NO: 2187157 - RNA, 15 nt, Streptococcus pneumoniae R6
gcagaguggucaaac

SEQ ID NO: 2187158 - RNA, 23 nt, Streptococcus pneumoniae R6
gcagggcuauuuggcuuaucuga

SEQ ID NO: 2187159 - RNA, 16 nt, Streptococcus pneumoniae R6
gcaguuccgauguguu

SEQ ID NO: 2187160 - RNA, 12 nt, Streptococcus pneumoniae R6
gcaguucuucau

SEQ ID NO: 2187161 - RNA, 19 nt, Streptococcus pneumoniae R6
gcaguucuugcucaaucaa

SEQ ID NO: 2187162 - RNA, 20 nt, Streptococcus pneumoniae R6
gcaguugugucuucgucugg

SEQ ID NO: 2187163 - RNA, 14 nt, Streptococcus pneumoniae R6
gcauaagaaacucu

SEQ ID NO: 2187164 - RNA, 22 nt, Streptococcus pneumoniae R6
gcauaaaucaaaucgauaaaga

SEQ ID NO: 2187165 - RNA, 12 nt, Streptococcus pneumoniae R6
gcagugacuacc

SEQ ID NO: 2187166 - RNA, 16 nt, Streptococcus pneumoniae R6
gcaguacauucaacac

SEQ ID NO: 2187167 - RNA, 12 nt, Streptococcus pneumoniae R6
gcaguacuuuga

SEQ ID NO: 2187168 - RNA, 15 nt, Streptococcus pneumoniae R6
gcagucguuccuuuu

SEQ ID NO: 2187169 - RNA, 15 nt, Streptococcus pneumoniae R6
gcagucuuuuugcug

SEQ ID NO: 2187170 - RNA, 15 nt, Streptococcus pneumoniae R6
gcagcuaguuuccua

SEQ ID NO: 2187171 - RNA, 23 nt, Streptococcus pneumoniae R6
gcagcuaguuuccuaguuugcuc

SEQ ID NO: 2187172 - RNA, 14 nt, Streptococcus pneumoniae R6
gcaggaagaaagag

SEQ ID NO: 2187173 - RNA, 17 nt, Streptococcus pneumoniae R6
gcaggaagaaagaggag

SEQ ID NO: 2187174 - RNA, 19 nt, Streptococcus pneumoniae R6
gcaggaagaaagaggagua

SEQ ID NO: 2187175 - RNA, 13 nt, Streptococcus pneumoniae R6
gcaggaaggaaau

SEQ ID NO: 2187176 - RNA, 15 nt, Streptococcus pneumoniae R6
gcaggacuaaaucca

SEQ ID NO: 2187177 - RNA, 17 nt, Streptococcus pneumoniae R6
gcaggcugguuccuccu

SEQ ID NO: 2187178 - RNA, 18 nt, Streptococcus pneumoniae R6
gcaccuaguacaaagaau

SEQ ID NO: 2187179 - RNA, 22 nt, Streptococcus pneumoniae R6
gcaccucacggagcgagacaaa

SEQ ID NO: 2187180 - RNA, 16 nt, Streptococcus pneumoniae R6
gcaccgaauuuuucaa

SEQ ID NO: 2187181 - RNA, 12 nt, Streptococcus pneumoniae R6
gcacaaacuuca

SEQ ID NO: 2187182 - RNA, 19 nt, Streptococcus pneumoniae R6
gcaccauuuucagcccaga

SEQ ID NO: 2187183 - RNA, 20 nt, Streptococcus pneumoniae R6
gcaagagcaucugccgcaug

SEQ ID NO: 2187184 - RNA, 21 nt, Streptococcus pneumoniae R6
gcaagagccuuuuuaaagaua

SEQ ID NO: 2187185 - RNA, 14 nt, Streptococcus pneumoniae R6
gcaagagggcuuca

SEQ ID NO: 2187186 - RNA, 17 nt, Streptococcus pneumoniae R6
gcaagacgaagcugaca

SEQ ID NO: 2187187 - RNA, 21 nt, Streptococcus pneumoniae R6
gcaagacgaagcugacaugau

SEQ ID NO: 2187188 - RNA, 15 nt, Streptococcus pneumoniae R6
gcaaggcaagacuga

SEQ ID NO: 2187189 - RNA, 17 nt, Streptococcus pneumoniae R6
gcaaggaugccagccuu

SEQ ID NO: 2187190 - RNA, 18 nt, Streptococcus pneumoniae R6
gcaaggaugccagccuua

SEQ ID NO: 2187191 - RNA, 18 nt, Streptococcus pneumoniae R6
gcaacuaggacaagaaga

SEQ ID NO: 2187192 - RNA, 13 nt, Streptococcus pneumoniae R6
gcaaguucuucuc

SEQ ID NO: 2187193 - RNA, 16 nt, Streptococcus pneumoniae R6
gcaauacagaacuaaa

SEQ ID NO: 2187194 - RNA, 15 nt, Streptococcus pneumoniae R6
gcaauaauaaugguu

SEQ ID NO: 2187195 - RNA, 13 nt, Streptococcus pneumoniae R6
gcaauacuucaac

SEQ ID NO: 2187196 - RNA, 18 nt, Streptococcus pneumoniae R6
gcaaucauuucaaagccu

SEQ ID NO: 2187197 - RNA, 17 nt, Streptococcus pneumoniae R6
gcaaucauugcaaagga

SEQ ID NO: 2187198 - RNA, 13 nt, Streptococcus pneumoniae R6
gcaaaagaacaag

SEQ ID NO: 2187199 - RNA, 14 nt, Streptococcus pneumoniae R6
gcaacaaccugcac

SEQ ID NO: 2187200 - RNA, 21 nt, Streptococcus pneumoniae R6
gcaacaaaguaaccaucugua

SEQ ID NO: 2187201 - RNA, 17 nt, Streptococcus pneumoniae R6
gcaaccaagucugcaug

SEQ ID NO: 2187202 - RNA, 14 nt, Streptococcus pneumoniae R6
gcaaccuuaaaaca

SEQ ID NO: 2187203 - RNA, 16 nt, Streptococcus pneumoniae R6
gcccaucccaaagaau

SEQ ID NO: 2187204 - RNA, 19 nt, Streptococcus pneumoniae R6
gcccauacgcccuccauua

SEQ ID NO: 2187205 - RNA, 14 nt, Streptococcus pneumoniae R6
gcccauguuuucuc

SEQ ID NO: 2187206 - RNA, 15 nt, Streptococcus pneumoniae R6
gccccauuucuucag

SEQ ID NO: 2187207 - RNA, 15 nt, Streptococcus pneumoniae R6
gcccccaucuccuug

SEQ ID NO: 2187208 - RNA, 15 nt, Streptococcus pneumoniae R6
gcccgcuucgcuucc

SEQ ID NO: 2187209 - RNA, 19 nt, Streptococcus pneumoniae R6
gccauauagcauuguccau

SEQ ID NO: 2187210 - RNA, 23 nt, Streptococcus pneumoniae R6
gccauauuagccaagcuaguaca

SEQ ID NO: 2187211 - RNA, 17 nt, Streptococcus pneumoniae R6
gccagugagaagaaggg

SEQ ID NO: 2187212 - RNA, 22 nt, Streptococcus pneumoniae R6
gccaguugcugcguuaaauccu

SEQ ID NO: 2187213 - RNA, 20 nt, Streptococcus pneumoniae R6
gccaguugcuguaaucacau

SEQ ID NO: 2187214 - RNA, 19 nt, Streptococcus pneumoniae R6
gccauaaaaauaacuucag

SEQ ID NO: 2187215 - RNA, 22 nt, Streptococcus pneumoniae R6
gccaguucagcauaagacaauu

SEQ ID NO: 2187216 - RNA, 17 nt, Streptococcus pneumoniae R6
gccagcucgucaaucuc

SEQ ID NO: 2187217 - RNA, 15 nt, Streptococcus pneumoniae R6
gccagccuaucguag

SEQ ID NO: 2187218 - RNA, 17 nt, Streptococcus pneumoniae R6
gccaccuccgccuccag

SEQ ID NO: 2187219 - RNA, 20 nt, Streptococcus pneumoniae R6
gccaccuuuucgaguaacau

SEQ ID NO: 2187220 - RNA, 14 nt, Streptococcus pneumoniae R6
gccagauacuggua

SEQ ID NO: 2187221 - RNA, 21 nt, Streptococcus pneumoniae R6
gccagauggacugaccaccug

SEQ ID NO: 2187222 - RNA, 20 nt, Streptococcus pneumoniae R6
gccagauuccugaaauaaaa

SEQ ID NO: 2187223 - RNA, 19 nt, Streptococcus pneumoniae R6
gccagaacuuccacuucca

SEQ ID NO: 2187224 - RNA, 15 nt, Streptococcus pneumoniae R6
gccagaaauucccuc

SEQ ID NO: 2187225 - RNA, 19 nt, Streptococcus pneumoniae R6
gccacuauuuuaucuuacu

SEQ ID NO: 2187226 - RNA, 14 nt, Streptococcus pneumoniae R6
gccucauaucuguc

SEQ ID NO: 2187227 - RNA, 19 nt, Streptococcus pneumoniae R6
gccucagauucugacaauc

SEQ ID NO: 2187228 - RNA, 20 nt, Streptococcus pneumoniae R6
gccuccagagaagccaccgc

SEQ ID NO: 2187229 - RNA, 15 nt, Streptococcus pneumoniae R6
gccuccaagaaagag

SEQ ID NO: 2187230 - RNA, 22 nt, Streptococcus pneumoniae R6
gccucccacuaucuaaaaaaau

SEQ ID NO: 2187231 - RNA, 16 nt, Streptococcus pneumoniae R6
gccuaucuuaagacua

SEQ ID NO: 2187232 - RNA, 19 nt, Streptococcus pneumoniae R6
gccuaucuuaagacuaagu

SEQ ID NO: 2187233 - RNA, 14 nt, Streptococcus pneumoniae R6
gccuaugaaaugag

SEQ ID NO: 2187234 - RNA, 12 nt, Streptococcus pneumoniae R6
gccuacaugugu

SEQ ID NO: 2187235 - RNA, 16 nt, Streptococcus pneumoniae R6
gccuacaauuggaaau

SEQ ID NO: 2187236 - RNA, 14 nt, Streptococcus pneumoniae R6
gccuaauuuuucaa

SEQ ID NO: 2187237 - RNA, 18 nt, Streptococcus pneumoniae R6
gccggguuuuccaccagu

SEQ ID NO: 2187238 - RNA, 20 nt, Streptococcus pneumoniae R6
gccugcagcuaguuuccuag

SEQ ID NO: 2187239 - RNA, 20 nt, Streptococcus pneumoniae R6
gccucucuucuguucauucu

SEQ ID NO: 2187240 - RNA, 16 nt, Streptococcus pneumoniae R6
gccucugcacuagcuu

SEQ ID NO: 2187241 - RNA, 16 nt, Streptococcus pneumoniae R6
gccucucuaaaguaag

SEQ ID NO: 2187242 - RNA, 23 nt, Streptococcus pneumoniae R6
gccucuuucuugucguugaaaaa

SEQ ID NO: 2187243 - RNA, 11 nt, Streptococcus pneumoniae R6
gccucuuucau

SEQ ID NO: 2187244 - RNA, 18 nt, Streptococcus pneumoniae R6
gccugauaacgaagagcu

SEQ ID NO: 2187245 - RNA, 22 nt, Streptococcus pneumoniae R6
gccugauaacgaagagcuggcu

SEQ ID NO: 2187246 - RNA, 21 nt, Streptococcus pneumoniae R6
gccugagaagacaucuucuca

SEQ ID NO: 2187247 - RNA, 23 nt, Streptococcus pneumoniae R6
gccuguaguuucauguggccuug

SEQ ID NO: 2187248 - RNA, 20 nt, Streptococcus pneumoniae R6
gccuguacuagggcauuuug

SEQ ID NO: 2187249 - RNA, 21 nt, Streptococcus pneumoniae R6
gccuggguaacaacucaauuu

SEQ ID NO: 2187250 - RNA, 18 nt, Streptococcus pneumoniae R6
gccugcuuuuucaagcau

SEQ ID NO: 2187251 - RNA, 14 nt, Streptococcus pneumoniae R6
gccugcuuuuugca

SEQ ID NO: 2187252 - RNA, 20 nt, Streptococcus pneumoniae R6
gccugcucaccaucuuccgc

SEQ ID NO: 2187253 - RNA, 21 nt, Streptococcus pneumoniae R6
gccugcucaccaucuuccgca

SEQ ID NO: 2187254 - RNA, 21 nt, Streptococcus pneumoniae R6
gccgcacgugcucaaaacacu

SEQ ID NO: 2187255 - RNA, 21 nt, Streptococcus pneumoniae R6
gccgcuggaaugguaucugcu

SEQ ID NO: 2187256 - RNA, 22 nt, Streptococcus pneumoniae R6
gccggauuuauagcgcuagaga

SEQ ID NO: 2187257 - RNA, 14 nt, Streptococcus pneumoniae R6
gcgguuugaagaga

SEQ ID NO: 2187258 - RNA, 15 nt, Streptococcus pneumoniae R6
gcggcauucaagaga

SEQ ID NO: 2187259 - RNA, 20 nt, Streptococcus pneumoniae R6
gcgcuggucacgaccagaaa

SEQ ID NO: 2187260 - RNA, 14 nt, Streptococcus pneumoniae R6
gcuaguacauucuu

SEQ ID NO: 2187261 - RNA, 16 nt, Streptococcus pneumoniae R6
gcuagucgugaaagag

SEQ ID NO: 2187262 - RNA, 19 nt, Streptococcus pneumoniae R6
gcucaaucaaguaagccau

SEQ ID NO: 2187263 - RNA, 14 nt, Streptococcus pneumoniae R6
gcucaaucuuauca

SEQ ID NO: 2187264 - RNA, 13 nt, Streptococcus pneumoniae R6
gcuaggagacucu

SEQ ID NO: 2187265 - RNA, 16 nt, Streptococcus pneumoniae R6
gcuaggcgcuucacua

SEQ ID NO: 2187266 - RNA, 16 nt, Streptococcus pneumoniae R6
gcucagaaacaagaaa

SEQ ID NO: 2187267 - RNA, 21 nt, Streptococcus pneumoniae R6
gcuccaaauggcaugaggaga

SEQ ID NO: 2187268 - RNA, 13 nt, Streptococcus pneumoniae R6
gcuccaaucccuu

SEQ ID NO: 2187269 - RNA, 15 nt, Streptococcus pneumoniae R6
gcucaucaucugaau

SEQ ID NO: 2187270 - RNA, 15 nt, Streptococcus pneumoniae R6
gcucauaguuuaucu

SEQ ID NO: 2187271 - RNA, 16 nt, Streptococcus pneumoniae R6
gcuccuccgagagcug

SEQ ID NO: 2187272 - RNA, 19 nt, Streptococcus pneumoniae R6
gcuccuccgagagcugaua

SEQ ID NO: 2187273 - RNA, 18 nt, Streptococcus pneumoniae R6
gcuccuauuacuaucaag

SEQ ID NO: 2187274 - RNA, 19 nt, Streptococcus pneumoniae R6
gcuccgauacugccgccac

SEQ ID NO: 2187275 - RNA, 13 nt, Streptococcus pneumoniae R6
gcuccaucuccaa

SEQ ID NO: 2187276 - RNA, 14 nt, Streptococcus pneumoniae R6
gcuccaucuccaac

SEQ ID NO: 2187277 - RNA, 18 nt, Streptococcus pneumoniae R6
gcucgcuguuuauuuuuu

SEQ ID NO: 2187278 - RNA, 15 nt, Streptococcus pneumoniae R6
gcuaaucaaaacgca

SEQ ID NO: 2187279 - RNA, 16 nt, Streptococcus pneumoniae R6
gcuaacugcuucacua

SEQ ID NO: 2187280 - RNA, 15 nt, Streptococcus pneumoniae R6
gcuaacuuuuccuua

SEQ ID NO: 2187281 - RNA, 15 nt, Streptococcus pneumoniae R6
gcuaagagagaagcc

SEQ ID NO: 2187282 - RNA, 22 nt, Streptococcus pneumoniae R6
gcuaagagagaagccuucuguu

SEQ ID NO: 2187283 - RNA, 22 nt, Streptococcus pneumoniae R6
gcuaagauaauagcgaugaaga

SEQ ID NO: 2187284 - RNA, 23 nt, Streptococcus pneumoniae R6
gcuaaguccuuuuaguuuuaucu

SEQ ID NO: 2187285 - RNA, 20 nt, Streptococcus pneumoniae R6
gcuaagcucgauaaaggaca

SEQ ID NO: 2187286 - RNA, 17 nt, Streptococcus pneumoniae R6
gcuaaagaugaugguua

SEQ ID NO: 2187287 - RNA, 20 nt, Streptococcus pneumoniae R6
gcuaaaacauuuauagaaau

SEQ ID NO: 2187288 - RNA, 19 nt, Streptococcus pneumoniae R6
gcuaaaauguuuuucgucu

SEQ ID NO: 2187289 - RNA, 12 nt, Streptococcus pneumoniae R6
gcuaaaaagcua

SEQ ID NO: 2187290 - RNA, 21 nt, Streptococcus pneumoniae R6
gcuaauuucaagaaguugucu

SEQ ID NO: 2187291 - RNA, 12 nt, Streptococcus pneumoniae R6
gcuaauucuuug

SEQ ID NO: 2187292 - RNA, 13 nt, Streptococcus pneumoniae R6
gcuaauuuugcca

SEQ ID NO: 2187293 - RNA, 14 nt, Streptococcus pneumoniae R6
gcuaauuuugccag

SEQ ID NO: 2187294 - RNA, 20 nt, Streptococcus pneumoniae R6
gcuaauuuuuugagcaauaa

SEQ ID NO: 2187295 - RNA, 23 nt, Streptococcus pneumoniae R6
gcuacaccagcuaugccagugcc

SEQ ID NO: 2187296 - RNA, 14 nt, Streptococcus pneumoniae R6
gcuacagaugcugc

SEQ ID NO: 2187297 - RNA, 18 nt, Streptococcus pneumoniae R6
gcuacaccguaauuuccu

SEQ ID NO: 2187298 - RNA, 19 nt, Streptococcus pneumoniae R6
gcuaccguugaaaucaaua

SEQ ID NO: 2187299 - RNA, 14 nt, Streptococcus pneumoniae R6
gcuacgacuuucaa

SEQ ID NO: 2187300 - RNA, 16 nt, Streptococcus pneumoniae R6
gcguuuugaguuaacu

SEQ ID NO: 2187301 - RNA, 22 nt, Streptococcus pneumoniae R6
gcguuuuaucauagaaauauuu

SEQ ID NO: 2187302 - RNA, 14 nt, Streptococcus pneumoniae R6
gcguuuugaaacua

SEQ ID NO: 2187303 - RNA, 16 nt, Streptococcus pneumoniae R6
gcguuuugaaacuaga

SEQ ID NO: 2187304 - RNA, 17 nt, Streptococcus pneumoniae R6
gcguuugacaaguaagu

SEQ ID NO: 2187305 - RNA, 19 nt, Streptococcus pneumoniae R6
gcguuauuugaaaaauaua

SEQ ID NO: 2187306 - RNA, 17 nt, Streptococcus pneumoniae R6
gcgauacgaucugaaau

SEQ ID NO: 2187307 - RNA, 23 nt, Streptococcus pneumoniae R6
gcgauagcuccaucuccaacugc

SEQ ID NO: 2187308 - RNA, 20 nt, Streptococcus pneumoniae R6
gcgagagcuuugacauccuu

SEQ ID NO: 2187309 - RNA, 20 nt, Streptococcus pneumoniae R6
gcgauuaggggggcuauucu

SEQ ID NO: 2187310 - RNA, 14 nt, Streptococcus pneumoniae R6
gcgauuuuaggaua

SEQ ID NO: 2187311 - RNA, 16 nt, Streptococcus pneumoniae R6
gcgauuuuaggauacu

SEQ ID NO: 2187312 - RNA, 13 nt, Streptococcus pneumoniae R6
gcgauuuugccaa

SEQ ID NO: 2187313 - RNA, 13 nt, Streptococcus pneumoniae R6
gcgauuucuucac

SEQ ID NO: 2187314 - RNA, 21 nt, Streptococcus pneumoniae R6
gcgauuuacaucuucucuggc

SEQ ID NO: 2187315 - RNA, 13 nt, Streptococcus pneumoniae R6
gccuuuuucuucu

SEQ ID NO: 2187316 - RNA, 17 nt, Streptococcus pneumoniae R6
gccuuuuucuucuuauc

SEQ ID NO: 2187317 - RNA, 16 nt, Streptococcus pneumoniae R6
gcgaaaggagaaaaaa

SEQ ID NO: 2187318 - RNA, 19 nt, Streptococcus pneumoniae R6
gcgaaaggagaaaaaauau

SEQ ID NO: 2187319 - RNA, 18 nt, Streptococcus pneumoniae R6
gcgaaaggagaaaaauau

SEQ ID NO: 2187320 - RNA, 20 nt, Streptococcus pneumoniae R6
gcgaaaucauuugaaucaaa

SEQ ID NO: 2187321 - RNA, 22 nt, Streptococcus pneumoniae R6
gcgaacaaaucaauuagaaaau

SEQ ID NO: 2187322 - RNA, 21 nt, Streptococcus pneumoniae R6
gccuucuacuuccugcucaaa

SEQ ID NO: 2187323 - RNA, 11 nt, Streptococcus pneumoniae R6
gccuucuucca

SEQ ID NO: 2187324 - RNA, 16 nt, Streptococcus pneumoniae R6
gccuucuguugguuga

SEQ ID NO: 2187325 - RNA, 22 nt, Streptococcus pneumoniae R6
gccuuguauccaaucucuugaa

SEQ ID NO: 2187326 - RNA, 23 nt, Streptococcus pneumoniae R6
gccuugucccaucauuccuucaa

SEQ ID NO: 2187327 - RNA, 17 nt, Streptococcus pneumoniae R6
gccuucauuuuacaucu

SEQ ID NO: 2187328 - RNA, 15 nt, Streptococcus pneumoniae R6
gccuucauccuugag

SEQ ID NO: 2187329 - RNA, 17 nt, Streptococcus pneumoniae R6
gccuucauccuugaguu

SEQ ID NO: 2187330 - RNA, 23 nt, Streptococcus pneumoniae R6
gccuuaaaaaaccaauucccaaa

SEQ ID NO: 2187331 - RNA, 19 nt, Streptococcus pneumoniae R6
gccuucagcccaaccagcu

SEQ ID NO: 2187332 - RNA, 15 nt, Streptococcus pneumoniae R6
gcgcucuaaccaccu

SEQ ID NO: 2187333 - RNA, 15 nt, Streptococcus pneumoniae R6
gcgcgugguccagau

SEQ ID NO: 2187334 - RNA, 15 nt, Streptococcus pneumoniae R6
gcgcgcuugaaugau

SEQ ID NO: 2187335 - RNA, 21 nt, Streptococcus pneumoniae R6
gugcgaaugcuucuuggauac

SEQ ID NO: 2187336 - RNA, 17 nt, Streptococcus pneumoniae R6
gugcgagacaaaaaaaa

SEQ ID NO: 2187337 - RNA, 16 nt, Streptococcus pneumoniae R6
gugcgagccucuuuuu

SEQ ID NO: 2187338 - RNA, 17 nt, Streptococcus pneumoniae R6
gugcgcgucgaagguua

SEQ ID NO: 2187339 - RNA, 15 nt, Streptococcus pneumoniae R6
gugcuccauuuuuua

SEQ ID NO: 2187340 - RNA, 13 nt, Streptococcus pneumoniae R6
gugcucacagagu

SEQ ID NO: 2187341 - RNA, 17 nt, Streptococcus pneumoniae R6
gucgcuugaaccuuucu

SEQ ID NO: 2187342 - RNA, 18 nt, Streptococcus pneumoniae R6
gugaugagggucaacuug

SEQ ID NO: 2187343 - RNA, 14 nt, Streptococcus pneumoniae R6
gugauuaaaacugc

SEQ ID NO: 2187344 - RNA, 16 nt, Streptococcus pneumoniae R6
gugauuuaccauaguu

SEQ ID NO: 2187345 - RNA, 18 nt, Streptococcus pneumoniae R6
guggauuggcucaaucaa

SEQ ID NO: 2187346 - RNA, 23 nt, Streptococcus pneumoniae R6
guggauuuucacgagucacugug

SEQ ID NO: 2187347 - RNA, 20 nt, Streptococcus pneumoniae R6
guggauuuuucuucuuuucu

SEQ ID NO: 2187348 - RNA, 12 nt, Streptococcus pneumoniae R6
gugcuucuggga

SEQ ID NO: 2187349 - RNA, 21 nt, Streptococcus pneumoniae R6
gugcuucuuuguaggcuucuu

SEQ ID NO: 2187350 - RNA, 12 nt, Streptococcus pneumoniae R6
guggaugaaacu

SEQ ID NO: 2187351 - RNA, 13 nt, Streptococcus pneumoniae R6
gugguugaugaga

SEQ ID NO: 2187352 - RNA, 16 nt, Streptococcus pneumoniae R6
guggugucauauaauc

SEQ ID NO: 2187353 - RNA, 15 nt, Streptococcus pneumoniae R6
gugguauacuauuuu

SEQ ID NO: 2187354 - RNA, 15 nt, Streptococcus pneumoniae R6
guguuucuugagaag

SEQ ID NO: 2187355 - RNA, 16 nt, Streptococcus pneumoniae R6
guuaaaaucuuuuacu

SEQ ID NO: 2187356 - RNA, 17 nt, Streptococcus pneumoniae R6
guguugaauguugaaac

SEQ ID NO: 2187357 - RNA, 11 nt, Streptococcus pneumoniae R6
guguugacaag

SEQ ID NO: 2187358 - RNA, 12 nt, Streptococcus pneumoniae R6
guguugacaagu

SEQ ID NO: 2187359 - RNA, 15 nt, Streptococcus pneumoniae R6
guguuaauuggaaaa

SEQ ID NO: 2187360 - RNA, 19 nt, Streptococcus pneumoniae R6
gugugggcuuuuuucuauc

SEQ ID NO: 2187361 - RNA, 14 nt, Streptococcus pneumoniae R6
guguguucugcagg

SEQ ID NO: 2187362 - RNA, 17 nt, Streptococcus pneumoniae R6
guguacuacucuaacuu

SEQ ID NO: 2187363 - RNA, 23 nt, Streptococcus pneumoniae R6
guguacuauucuaguuucaaucu

SEQ ID NO: 2187364 - RNA, 11 nt, Streptococcus pneumoniae R6
gugucucuggu

SEQ ID NO: 2187365 - RNA, 15 nt, Streptococcus pneumoniae R6
gugugaaaacuugau

SEQ ID NO: 2187366 - RNA, 20 nt, Streptococcus pneumoniae R6
gugugagaggggcuagagau

SEQ ID NO: 2187367 - RNA, 19 nt, Streptococcus pneumoniae R6
guuacugauuucgucaguu

SEQ ID NO: 2187368 - RNA, 19 nt, Streptococcus pneumoniae R6
guuacucaggauaaaacca

SEQ ID NO: 2187369 - RNA, 22 nt, Streptococcus pneumoniae R6
guuacagacaaaacuggcaaaa

SEQ ID NO: 2187370 - RNA, 19 nt, Streptococcus pneumoniae R6
guuaccucauaucucuugu

SEQ ID NO: 2187371 - RNA, 17 nt, Streptococcus pneumoniae R6
guuaauugaauuucaag

SEQ ID NO: 2187372 - RNA, 20 nt, Streptococcus pneumoniae R6
guuaaaggugugauuuucga

SEQ ID NO: 2187373 - RNA, 16 nt, Streptococcus pneumoniae R6
guuaauaacucucauc

SEQ ID NO: 2187374 - RNA, 21 nt, Streptococcus pneumoniae R6
guuaauaacucucaucuaucu

SEQ ID NO: 2187375 - RNA, 17 nt, Streptococcus pneumoniae R6
guuccaauagucauucc

SEQ ID NO: 2187376 - RNA, 21 nt, Streptococcus pneumoniae R6
guuccaauagucauuccaugg

SEQ ID NO: 2187377 - RNA, 13 nt, Streptococcus pneumoniae R6
guucgaguccuac

SEQ ID NO: 2187378 - RNA, 15 nt, Streptococcus pneumoniae R6
guuccucuuucaaaa

SEQ ID NO: 2187379 - RNA, 20 nt, Streptococcus pneumoniae R6
guucacuugagcaaacugaa

SEQ ID NO: 2187380 - RNA, 23 nt, Streptococcus pneumoniae R6
guuacuuggcgaaggucuuucaa

SEQ ID NO: 2187381 - RNA, 14 nt, Streptococcus pneumoniae R6
guuagacagaaaaa

SEQ ID NO: 2187382 - RNA, 17 nt, Streptococcus pneumoniae R6
guuagauuuuuucuguc

SEQ ID NO: 2187383 - RNA, 17 nt, Streptococcus pneumoniae R6
guuagauuauguaagau

SEQ ID NO: 2187384 - RNA, 20 nt, Streptococcus pneumoniae R6
guuagauuuauaauuucaac

SEQ ID NO: 2187385 - RNA, 22 nt, Streptococcus pneumoniae R6
guuagauuuauaauuucaacua

SEQ ID NO: 2187386 - RNA, 14 nt, Streptococcus pneumoniae R6
guucacucaaaccu

SEQ ID NO: 2187387 - RNA, 17 nt, Streptococcus pneumoniae R6
guucacucaaaccugau

SEQ ID NO: 2187388 - RNA, 21 nt, Streptococcus pneumoniae R6
guucacguucgguauuuucau

SEQ ID NO: 2187389 - RNA, 14 nt, Streptococcus pneumoniae R6
guucaguuucuauu

SEQ ID NO: 2187390 - RNA, 20 nt, Streptococcus pneumoniae R6
guucagugaacuauuuuauc

SEQ ID NO: 2187391 - RNA, 14 nt, Streptococcus pneumoniae R6
guucauuagaacac

SEQ ID NO: 2187392 - RNA, 22 nt, Streptococcus pneumoniae R6
guucauuaacgacauagucaaa

SEQ ID NO: 2187393 - RNA, 20 nt, Streptococcus pneumoniae R6
guucauaucuuauuucaauc

SEQ ID NO: 2187394 - RNA, 15 nt, Streptococcus pneumoniae R6
guucauguucgaucu

SEQ ID NO: 2187395 - RNA, 16 nt, Streptococcus pneumoniae R6
guucuugaaaugaagu

SEQ ID NO: 2187396 - RNA, 12 nt, Streptococcus pneumoniae R6
guucuuuagaaa

SEQ ID NO: 2187397 - RNA, 12 nt, Streptococcus pneumoniae R6
guucuuguuuca

SEQ ID NO: 2187398 - RNA, 13 nt, Streptococcus pneumoniae R6
guucuuguuucaa

SEQ ID NO: 2187399 - RNA, 16 nt, Streptococcus pneumoniae R6
guucuaaaacuccuau

SEQ ID NO: 2187400 - RNA, 20 nt, Streptococcus pneumoniae R6
guucuaaaauaaguucuguu

SEQ ID NO: 2187401 - RNA, 17 nt, Streptococcus pneumoniae R6
guucgugccaaucucaa

SEQ ID NO: 2187402 - RNA, 20 nt, Streptococcus pneumoniae R6
guucuuuucucuagcuuuua

SEQ ID NO: 2187403 - RNA, 23 nt, Streptococcus pneumoniae R6
guucuuuucuguugauauuucca

SEQ ID NO: 2187404 - RNA, 15 nt, Streptococcus pneumoniae R6
guucuuuuucaaaag

SEQ ID NO: 2187405 - RNA, 16 nt, Streptococcus pneumoniae R6
guucuuuuucaaaagc

SEQ ID NO: 2187406 - RNA, 16 nt, Streptococcus pneumoniae R6
guugaaaaaaagcuaa

SEQ ID NO: 2187407 - RNA, 15 nt, Streptococcus pneumoniae R6
guugaacuuuagaaa

SEQ ID NO: 2187408 - RNA, 19 nt, Streptococcus pneumoniae R6
guugaagaaaagcuaagcu

SEQ ID NO: 2187409 - RNA, 23 nt, Streptococcus pneumoniae R6
guugaccauuucaauagcuccuu

SEQ ID NO: 2187410 - RNA, 14 nt, Streptococcus pneumoniae R6
guugacaaagagcc

SEQ ID NO: 2187411 - RNA, 16 nt, Streptococcus pneumoniae R6
guugacaaagagccaa

SEQ ID NO: 2187412 - RNA, 22 nt, Streptococcus pneumoniae R6
guugacaaagagccaaaaaaga

SEQ ID NO: 2187413 - RNA, 21 nt, Streptococcus pneumoniae R6
guugacaaagagccagaaaaa

SEQ ID NO: 2187414 - RNA, 17 nt, Streptococcus pneumoniae R6
guugacaaucuuuucuu

SEQ ID NO: 2187415 - RNA, 15 nt, Streptococcus pneumoniae R6
guugaaugagcuucc

SEQ ID NO: 2187416 - RNA, 16 nt, Streptococcus pneumoniae R6
guugaaugccuccaag

SEQ ID NO: 2187417 - RNA, 18 nt, Streptococcus pneumoniae R6
guugaagucagcuaggcu

SEQ ID NO: 2187418 - RNA, 17 nt, Streptococcus pneumoniae R6
guugaaucauuuuguuu

SEQ ID NO: 2187419 - RNA, 21 nt, Streptococcus pneumoniae R6
guugauucaugacaucuucca

SEQ ID NO: 2187420 - RNA, 17 nt, Streptococcus pneumoniae R6
guugagaagugggagaa

SEQ ID NO: 2187421 - RNA, 20 nt, Streptococcus pneumoniae R6
guugagaagugggagaaaag

SEQ ID NO: 2187422 - RNA, 18 nt, Streptococcus pneumoniae R6
guugaccuuggcuuccga

SEQ ID NO: 2187423 - RNA, 22 nt, Streptococcus pneumoniae R6
guugagcauguagucaaucaaa

SEQ ID NO: 2187424 - RNA, 17 nt, Streptococcus pneumoniae R6
guugauaaucuuaucuc

SEQ ID NO: 2187425 - RNA, 19 nt, Streptococcus pneumoniae R6
guugaguuguguacucaac

SEQ ID NO: 2187426 - RNA, 18 nt, Streptococcus pneumoniae R6
guuggugaauuugcuaca

SEQ ID NO: 2187427 - RNA, 22 nt, Streptococcus pneumoniae R6
guugggcagacgaguuaaaaca

SEQ ID NO: 2187428 - RNA, 13 nt, Streptococcus pneumoniae R6
guuggauuuccac

SEQ ID NO: 2187429 - RNA, 20 nt, Streptococcus pneumoniae R6
guuggauuuccacuaaaggu

SEQ ID NO: 2187430 - RNA, 12 nt, Streptococcus pneumoniae R6
guugcucaaagu

SEQ ID NO: 2187431 - RNA, 14 nt, Streptococcus pneumoniae R6
guugccuuuuugaa

SEQ ID NO: 2187432 - RNA, 13 nt, Streptococcus pneumoniae R6
guuuccuucuacu

SEQ ID NO: 2187433 - RNA, 13 nt, Streptococcus pneumoniae R6
guuuaucucccau

SEQ ID NO: 2187434 - RNA, 14 nt, Streptococcus pneumoniae R6
guuuaucucccaua

SEQ ID NO: 2187435 - RNA, 23 nt, Streptococcus pneumoniae R6
guuugaacagcuugagauuucac

SEQ ID NO: 2187436 - RNA, 17 nt, Streptococcus pneumoniae R6
guuugaagaguauuauu

SEQ ID NO: 2187437 - RNA, 13 nt, Streptococcus pneumoniae R6
guuugaagcugcu

SEQ ID NO: 2187438 - RNA, 15 nt, Streptococcus pneumoniae R6
guuugagacaauccu

SEQ ID NO: 2187439 - RNA, 15 nt, Streptococcus pneumoniae R6
guuucuauauuuaua

SEQ ID NO: 2187440 - RNA, 22 nt, Streptococcus pneumoniae R6
guuucuagccccucggauuuua

SEQ ID NO: 2187441 - RNA, 20 nt, Streptococcus pneumoniae R6
guuuagcaucuaaaugaucc

SEQ ID NO: 2187442 - RNA, 17 nt, Streptococcus pneumoniae R6
guuuauauaguagccaa

SEQ ID NO: 2187443 - RNA, 17 nt, Streptococcus pneumoniae R6
guuuauaucuaauaauu

SEQ ID NO: 2187444 - RNA, 13 nt, Streptococcus pneumoniae R6
guuuauaaacuuu

SEQ ID NO: 2187445 - RNA, 16 nt, Streptococcus pneumoniae R6
guuuauagauaaaugu

SEQ ID NO: 2187446 - RNA, 19 nt, Streptococcus pneumoniae R6
guuuaucacucaguuucug

SEQ ID NO: 2187447 - RNA, 17 nt, Streptococcus pneumoniae R6
guuuaaauucauuaaac

SEQ ID NO: 2187448 - RNA, 18 nt, Streptococcus pneumoniae R6
guuuaccaauuuuuccuu

SEQ ID NO: 2187449 - RNA, 21 nt, Streptococcus pneumoniae R6
guuguacaagaaaagugcaaa

SEQ ID NO: 2187450 - RNA, 14 nt, Streptococcus pneumoniae R6
guuguaagcuagca

SEQ ID NO: 2187451 - RNA, 14 nt, Streptococcus pneumoniae R6
guuguagaugaaac

SEQ ID NO: 2187452 - RNA, 21 nt, Streptococcus pneumoniae R6
guuguaugguugacuggacca

SEQ ID NO: 2187453 - RNA, 14 nt, Streptococcus pneumoniae R6
guuuaaaucauaau

SEQ ID NO: 2187454 - RNA, 13 nt, Streptococcus pneumoniae R6
guuuaaaccuugc

SEQ ID NO: 2187455 - RNA, 18 nt, Streptococcus pneumoniae R6
guuuaaagacaguugcau

SEQ ID NO: 2187456 - RNA, 13 nt, Streptococcus pneumoniae R6
uaaaaacucagaa

SEQ ID NO: 2187457 - RNA, 16 nt, Streptococcus pneumoniae R6
uaaaaacguuuuucaa

SEQ ID NO: 2187458 - RNA, 15 nt, Streptococcus pneumoniae R6
uaaaaaccuaucaua

SEQ ID NO: 2187459 - RNA, 16 nt, Streptococcus pneumoniae R6
uaaaaaccuaucauau

SEQ ID NO: 2187460 - RNA, 21 nt, Streptococcus pneumoniae R6
uaaaaacugaacaaauuaauu

SEQ ID NO: 2187461 - RNA, 13 nt, Streptococcus pneumoniae R6
uaaaaagaaauau

SEQ ID NO: 2187462 - RNA, 15 nt, Streptococcus pneumoniae R6
uaaaaagaaauauau

SEQ ID NO: 2187463 - RNA, 14 nt, Streptococcus pneumoniae R6
uaaaaagaaauguc

SEQ ID NO: 2187464 - RNA, 15 nt, Streptococcus pneumoniae R6
guuugauuaguccau

SEQ ID NO: 2187465 - RNA, 15 nt, Streptococcus pneumoniae R6
guuugagcucuuuga

SEQ ID NO: 2187466 - RNA, 16 nt, Streptococcus pneumoniae R6
guuugaugacuucagc

SEQ ID NO: 2187467 - RNA, 20 nt, Streptococcus pneumoniae R6
guuugauacuguuaauaaaa

SEQ ID NO: 2187468 - RNA, 14 nt, Streptococcus pneumoniae R6
guuugaucuuugcu

SEQ ID NO: 2187469 - RNA, 16 nt, Streptococcus pneumoniae R6
uaaaaagugaaaggaa

SEQ ID NO: 2187470 - RNA, 19 nt, Streptococcus pneumoniae R6
uaaaaaucuucaaaaaagu

SEQ ID NO: 2187471 - RNA, 23 nt, Streptococcus pneumoniae R6
uaaaaagagguggaauauuuacu

SEQ ID NO: 2187472 - RNA, 21 nt, Streptococcus pneumoniae R6
uaaaaagauaagguucaaaaa

SEQ ID NO: 2187473 - RNA, 17 nt, Streptococcus pneumoniae R6
uaaaaagcauaguauca

SEQ ID NO: 2187474 - RNA, 18 nt, Streptococcus pneumoniae R6
uaaaaagggauaaguuga

SEQ ID NO: 2187475 - RNA, 21 nt, Streptococcus pneumoniae R6
uaaaaagcuacuauaaaagag

SEQ ID NO: 2187476 - RNA, 22 nt, Streptococcus pneumoniae R6
uaaaaagcuauagauaagguca

SEQ ID NO: 2187477 - RNA, 16 nt, Streptococcus pneumoniae R6
uaaaagaguuuuugga

SEQ ID NO: 2187478 - RNA, 18 nt, Streptococcus pneumoniae R6
uaaaagauagagaaagaa

SEQ ID NO: 2187479 - RNA, 14 nt, Streptococcus pneumoniae R6
uaaaagaauucacu

SEQ ID NO: 2187480 - RNA, 19 nt, Streptococcus pneumoniae R6
uaaaagaauucacugagau

SEQ ID NO: 2187481 - RNA, 19 nt, Streptococcus pneumoniae R6
uaaaagaauagagggauuc

SEQ ID NO: 2187482 - RNA, 16 nt, Streptococcus pneumoniae R6
uaaaacggagaauaag

SEQ ID NO: 2187483 - RNA, 18 nt, Streptococcus pneumoniae R6
uaaaacgcauaguaucag

SEQ ID NO: 2187484 - RNA, 17 nt, Streptococcus pneumoniae R6
uaaaacguacaguauca

SEQ ID NO: 2187485 - RNA, 15 nt, Streptococcus pneumoniae R6
uaaaacgucguaauc

SEQ ID NO: 2187486 - RNA, 17 nt, Streptococcus pneumoniae R6
uaaaacgcauaauauca

SEQ ID NO: 2187487 - RNA, 21 nt, Streptococcus pneumoniae R6
uaaaacugacgugguuuaaaa

SEQ ID NO: 2187488 - RNA, 17 nt, Streptococcus pneumoniae R6
uaaaacucauuaauaaa

SEQ ID NO: 2187489 - RNA, 15 nt, Streptococcus pneumoniae R6
uaaaacuagugaagc

SEQ ID NO: 2187490 - RNA, 17 nt, Streptococcus pneumoniae R6
uaaaacguugguaaaag

SEQ ID NO: 2187491 - RNA, 17 nt, Streptococcus pneumoniae R6
uaaaaauuauuuaaagc

SEQ ID NO: 2187492 - RNA, 15 nt, Streptococcus pneumoniae R6
uaaaaauuacaaaca

SEQ ID NO: 2187493 - RNA, 14 nt, Streptococcus pneumoniae R6
uaaaacaaaauucu

SEQ ID NO: 2187494 - RNA, 21 nt, Streptococcus pneumoniae R6
uaaaacaaagaaaaagaagga

SEQ ID NO: 2187495 - RNA, 18 nt, Streptococcus pneumoniae R6
uaaaaauuuuuuucuaau

SEQ ID NO: 2187496 - RNA, 10 nt, Streptococcus pneumoniae R6
uaaaacauug

SEQ ID NO: 2187497 - RNA, 12 nt, Streptococcus pneumoniae R6
uaaaacauuuau

SEQ ID NO: 2187498 - RNA, 16 nt, Streptococcus pneumoniae R6
uaaaacauuuauagaa

SEQ ID NO: 2187499 - RNA, 17 nt, Streptococcus pneumoniae R6
uaaaacauuuauagaaa

SEQ ID NO: 2187500 - RNA, 19 nt, Streptococcus pneumoniae R6
uaaaacauuuauagaaauu

SEQ ID NO: 2187501 - RNA, 22 nt, Streptococcus pneumoniae R6
uaaaacauuuauagaaauuaau

SEQ ID NO: 2187502 - RNA, 23 nt, Streptococcus pneumoniae R6
uaaaacauuuauagaaauuaauu

SEQ ID NO: 2187503 - RNA, 13 nt, Streptococcus pneumoniae R6
uaaaacauuguga

SEQ ID NO: 2187504 - RNA, 23 nt, Streptococcus pneumoniae R6
uaaaacauugugagaaauugguu

SEQ ID NO: 2187505 - RNA, 22 nt, Streptococcus pneumoniae R6
uaaaacauuguuaaaaaucgau

SEQ ID NO: 2187506 - RNA, 14 nt, Streptococcus pneumoniae R6
uaaaaccaaaggca

SEQ ID NO: 2187507 - RNA, 19 nt, Streptococcus pneumoniae R6
uaaaacauuuccgauuuca

SEQ ID NO: 2187508 - RNA, 20 nt, Streptococcus pneumoniae R6
uaaaacauuuccgauuucag

SEQ ID NO: 2187509 - RNA, 15 nt, Streptococcus pneumoniae R6
uaaacaagagauguu

SEQ ID NO: 2187510 - RNA, 22 nt, Streptococcus pneumoniae R6
uaaacaaguugcuugaaaacuc

SEQ ID NO: 2187511 - RNA, 21 nt, Streptococcus pneumoniae R6
uaaacaaggcagagauguaaa

SEQ ID NO: 2187512 - RNA, 16 nt, Streptococcus pneumoniae R6
uaaacaaaaagaaaaa

SEQ ID NO: 2187513 - RNA, 19 nt, Streptococcus pneumoniae R6
uaaacaaacuccucuccag

SEQ ID NO: 2187514 - RNA, 21 nt, Streptococcus pneumoniae R6
uaaacaaacuccucuccagca

SEQ ID NO: 2187515 - RNA, 14 nt, Streptococcus pneumoniae R6
uaaacacuucacua

SEQ ID NO: 2187516 - RNA, 20 nt, Streptococcus pneumoniae R6
uaaacacacuauguggcuug

SEQ ID NO: 2187517 - RNA, 15 nt, Streptococcus pneumoniae R6
uaaaauuuuaucuuu

SEQ ID NO: 2187518 - RNA, 12 nt, Streptococcus pneumoniae R6
uaaaauuuaaua

SEQ ID NO: 2187519 - RNA, 15 nt, Streptococcus pneumoniae R6
uaaaauuguuucaug

SEQ ID NO: 2187520 - RNA, 14 nt, Streptococcus pneumoniae R6
uaaaauuuaaaaau

SEQ ID NO: 2187521 - RNA, 18 nt, Streptococcus pneumoniae R6
uaaaauuuaaaaauagau

SEQ ID NO: 2187522 - RNA, 20 nt, Streptococcus pneumoniae R6
uaaaauuucuugacauacaa

SEQ ID NO: 2187523 - RNA, 16 nt, Streptococcus pneumoniae R6
uaaaauuauagucuuu

SEQ ID NO: 2187524 - RNA, 18 nt, Streptococcus pneumoniae R6
uaaaauuguguuuuugcc

SEQ ID NO: 2187525 - RNA, 20 nt, Streptococcus pneumoniae R6
uaaaauuccuuuaaaaacaa

SEQ ID NO: 2187526 - RNA, 21 nt, Streptococcus pneumoniae R6
uaaaauuccuuuaaaaacaau

SEQ ID NO: 2187527 - RNA, 16 nt, Streptococcus pneumoniae R6
uaaaauuaaaaagagu

SEQ ID NO: 2187528 - RNA, 17 nt, Streptococcus pneumoniae R6
uaaaaucccauauuugg

SEQ ID NO: 2187529 - RNA, 16 nt, Streptococcus pneumoniae R6
uaaaaucguagucuuu

SEQ ID NO: 2187530 - RNA, 16 nt, Streptococcus pneumoniae R6
uaaaaugccaaagaaa

SEQ ID NO: 2187531 - RNA, 15 nt, Streptococcus pneumoniae R6
uaaaauaacucaauu

SEQ ID NO: 2187532 - RNA, 19 nt, Streptococcus pneumoniae R6
uaaaauaacucaauuaaga

SEQ ID NO: 2187533 - RNA, 18 nt, Streptococcus pneumoniae R6
uaaaaggcucauaaaugg

SEQ ID NO: 2187534 - RNA, 20 nt, Streptococcus pneumoniae R6
uaaaaggcucauaaauggag

SEQ ID NO: 2187535 - RNA, 15 nt, Streptococcus pneumoniae R6
uaaaauaauuaaaau

SEQ ID NO: 2187536 - RNA, 21 nt, Streptococcus pneumoniae R6
uaaaauauaguagauugaaau

SEQ ID NO: 2187537 - RNA, 20 nt, Streptococcus pneumoniae R6
uaaauccuuuuuucuuuacu

SEQ ID NO: 2187538 - RNA, 18 nt, Streptococcus pneumoniae R6
uaaaucgcuuuuguaaau

SEQ ID NO: 2187539 - RNA, 16 nt, Streptococcus pneumoniae R6
uaaaucuacuaucucu

SEQ ID NO: 2187540 - RNA, 19 nt, Streptococcus pneumoniae R6
uaaaucuacuaucucuaca

SEQ ID NO: 2187541 - RNA, 16 nt, Streptococcus pneumoniae R6
uaaaucuaaucauucu

SEQ ID NO: 2187542 - RNA, 16 nt, Streptococcus pneumoniae R6
uaaaugaguaugaaaa

SEQ ID NO: 2187543 - RNA, 19 nt, Streptococcus pneumoniae R6
uaaauccgauaauauauag

SEQ ID NO: 2187544 - RNA, 18 nt, Streptococcus pneumoniae R6
uaaauccaccuaauuaua

SEQ ID NO: 2187545 - RNA, 22 nt, Streptococcus pneumoniae R6
uaaauccaagccugucuguaag

SEQ ID NO: 2187546 - RNA, 16 nt, Streptococcus pneumoniae R6
uaaaucgaucauauuu

SEQ ID NO: 2187547 - RNA, 16 nt, Streptococcus pneumoniae R6
uaaauccugcaaagau

SEQ ID NO: 2187548 - RNA, 15 nt, Streptococcus pneumoniae R6
uaaauauaaucgauu

SEQ ID NO: 2187549 - RNA, 21 nt, Streptococcus pneumoniae R6
uaaaucauaauccaacaccaa

SEQ ID NO: 2187550 - RNA, 19 nt, Streptococcus pneumoniae R6
uaaaucauugauaguaaca

SEQ ID NO: 2187551 - RNA, 18 nt, Streptococcus pneumoniae R6
uaaauccaaaagcaggag

SEQ ID NO: 2187552 - RNA, 24 nt, Streptococcus pneumoniae R6
uaaauccaaaagcaggaguuuucc

SEQ ID NO: 2187553 - RNA, 21 nt, Streptococcus pneumoniae R6
uaaaucauccauauaaggacc

SEQ ID NO: 2187554 - RNA, 20 nt, Streptococcus pneumoniae R6
uaaauaagguuuagcaaaag

SEQ ID NO: 2187555 - RNA, 20 nt, Streptococcus pneumoniae R6
uaaauaaggggauagagaua

SEQ ID NO: 2187556 - RNA, 13 nt, Streptococcus pneumoniae R6
uaaauaauauuau

SEQ ID NO: 2187557 - RNA, 14 nt, Streptococcus pneumoniae R6
uaaauaauagaaau

SEQ ID NO: 2187558 - RNA, 23 nt, Streptococcus pneumoniae R6
uaaauacaccuaauccacucaga

SEQ ID NO: 2187559 - RNA, 24 nt, Streptococcus pneumoniae R6
uaaauacaccuaauccacucagac

SEQ ID NO: 2187560 - RNA, 21 nt, Streptococcus pneumoniae R6
uaaauacucugccuuccuugu

SEQ ID NO: 2187561 - RNA, 18 nt, Streptococcus pneumoniae R6
uaaauacuaucaauaaaa

SEQ ID NO: 2187562 - RNA, 15 nt, Streptococcus pneumoniae R6
uaaaguguaaugcua

SEQ ID NO: 2187563 - RNA, 15 nt, Streptococcus pneumoniae R6
uaaagugucucccuu

SEQ ID NO: 2187564 - RNA, 22 nt, Streptococcus pneumoniae R6
uaaagugggaacuagagaguuu

SEQ ID NO: 2187565 - RNA, 22 nt, Streptococcus pneumoniae R6
uaaaguuacucuauuguagagu

SEQ ID NO: 2187566 - RNA, 22 nt, Streptococcus pneumoniae R6
uaaaguguucugucuuguaaaa

SEQ ID NO: 2187567 - RNA, 22 nt, Streptococcus pneumoniae R6
uaaaguauuauaauauaauugu

SEQ ID NO: 2187568 - RNA, 14 nt, Streptococcus pneumoniae R6
uaaagucaacagag

SEQ ID NO: 2187569 - RNA, 19 nt, Streptococcus pneumoniae R6
uaaagucuucggagaagaa

SEQ ID NO: 2187570 - RNA, 17 nt, Streptococcus pneumoniae R6
uaaaguagcaaaacacu

SEQ ID NO: 2187571 - RNA, 17 nt, Streptococcus pneumoniae R6
uaaacaugucuauagaa

SEQ ID NO: 2187572 - RNA, 12 nt, Streptococcus pneumoniae R6
uaaacaguaaua

SEQ ID NO: 2187573 - RNA, 18 nt, Streptococcus pneumoniae R6
uaaacaguaauaaagaca

SEQ ID NO: 2187574 - RNA, 22 nt, Streptococcus pneumoniae R6
uaaacagucccauaaaacuaua

SEQ ID NO: 2187575 - RNA, 12 nt, Streptococcus pneumoniae R6
uaaacaggcucg

SEQ ID NO: 2187576 - RNA, 21 nt, Streptococcus pneumoniae R6
uaaacuauccagagcauucuu

SEQ ID NO: 2187577 - RNA, 22 nt, Streptococcus pneumoniae R6
uaaacuauuaagccuucuccaa

SEQ ID NO: 2187578 - RNA, 16 nt, Streptococcus pneumoniae R6
uaaacuauuucuuauu

SEQ ID NO: 2187579 - RNA, 12 nt, Streptococcus pneumoniae R6
uaaacucuccaa

SEQ ID NO: 2187580 - RNA, 17 nt, Streptococcus pneumoniae R6
uaaacugaaucuagacu

SEQ ID NO: 2187581 - RNA, 19 nt, Streptococcus pneumoniae R6
uaaacugagcaaaaccauc

SEQ ID NO: 2187582 - RNA, 16 nt, Streptococcus pneumoniae R6
uaaagauuuuuuccuu

SEQ ID NO: 2187583 - RNA, 15 nt, Streptococcus pneumoniae R6
uaaagcuagauuuaa

SEQ ID NO: 2187584 - RNA, 11 nt, Streptococcus pneumoniae R6
uaaaggaaagu

SEQ ID NO: 2187585 - RNA, 22 nt, Streptococcus pneumoniae R6
uaaagcuuuuuguuagauuuau

SEQ ID NO: 2187586 - RNA, 17 nt, Streptococcus pneumoniae R6
uaaaggaugacaauagc

SEQ ID NO: 2187587 - RNA, 14 nt, Streptococcus pneumoniae R6
uaaaggccuuggcc

SEQ ID NO: 2187588 - RNA, 16 nt, Streptococcus pneumoniae R6
uaaaggccuuggccuu

SEQ ID NO: 2187589 - RNA, 21 nt, Streptococcus pneumoniae R6
uaaaggcagauuucaaaccug

SEQ ID NO: 2187590 - RNA, 14 nt, Streptococcus pneumoniae R6
uaaagauauuuugg

SEQ ID NO: 2187591 - RNA, 14 nt, Streptococcus pneumoniae R6
uaaagauagccaug

SEQ ID NO: 2187592 - RNA, 20 nt, Streptococcus pneumoniae R6
uaaagaucuauccauuuggg

SEQ ID NO: 2187593 - RNA, 16 nt, Streptococcus pneumoniae R6
uaaagagucaagacaa

SEQ ID NO: 2187594 - RNA, 22 nt, Streptococcus pneumoniae R6
uaaagagucaagacaaggauaa

SEQ ID NO: 2187595 - RNA, 16 nt, Streptococcus pneumoniae R6
uaaagaguacagucuu

SEQ ID NO: 2187596 - RNA, 15 nt, Streptococcus pneumoniae R6
uaaagaaauagaaaa

SEQ ID NO: 2187597 - RNA, 19 nt, Streptococcus pneumoniae R6
uaaagaaauagaaaacaaa

SEQ ID NO: 2187598 - RNA, 21 nt, Streptococcus pneumoniae R6
uaaacuuuuucauaaauagau

SEQ ID NO: 2187599 - RNA, 11 nt, Streptococcus pneumoniae R6
uaaagaaaaag

SEQ ID NO: 2187600 - RNA, 21 nt, Streptococcus pneumoniae R6
uaaagaaaaaguucucuuucu

SEQ ID NO: 2187601 - RNA, 17 nt, Streptococcus pneumoniae R6
uaaagaaaagagcauau

SEQ ID NO: 2187602 - RNA, 18 nt, Streptococcus pneumoniae R6
uaacaauauuuuagaagc

SEQ ID NO: 2187603 - RNA, 21 nt, Streptococcus pneumoniae R6
uaacaauauuuuagaagcaga

SEQ ID NO: 2187604 - RNA, 21 nt, Streptococcus pneumoniae R6
uaaauuuuucugcaaaaaaua

SEQ ID NO: 2187605 - RNA, 13 nt, Streptococcus pneumoniae R6
uaacauaaaugau

SEQ ID NO: 2187606 - RNA, 17 nt, Streptococcus pneumoniae R6
uaacauaaaugauguuc

SEQ ID NO: 2187607 - RNA, 17 nt, Streptococcus pneumoniae R6
uaacaucaauaaccauc

SEQ ID NO: 2187608 - RNA, 19 nt, Streptococcus pneumoniae R6
uaacauauuucuagaaauu

SEQ ID NO: 2187609 - RNA, 14 nt, Streptococcus pneumoniae R6
uaacauauuuucaa

SEQ ID NO: 2187610 - RNA, 20 nt, Streptococcus pneumoniae R6
uaacaguuuuuaauuuuucu

SEQ ID NO: 2187611 - RNA, 20 nt, Streptococcus pneumoniae R6
uaacauccugagucuaucua

SEQ ID NO: 2187612 - RNA, 13 nt, Streptococcus pneumoniae R6
uaaccaaaccaac

SEQ ID NO: 2187613 - RNA, 11 nt, Streptococcus pneumoniae R6
uaaccaaauaa

SEQ ID NO: 2187614 - RNA, 17 nt, Streptococcus pneumoniae R6
uaaccaaaucagauaag

SEQ ID NO: 2187615 - RNA, 15 nt, Streptococcus pneumoniae R6
uaaccagaucuuaga

SEQ ID NO: 2187616 - RNA, 17 nt, Streptococcus pneumoniae R6
uaaccagaucuuagaag

SEQ ID NO: 2187617 - RNA, 17 nt, Streptococcus pneumoniae R6
uaaccaaguucuaaaua

SEQ ID NO: 2187618 - RNA, 22 nt, Streptococcus pneumoniae R6
uaaccaaguucuaaauaaucuc

SEQ ID NO: 2187619 - RNA, 22 nt, Streptococcus pneumoniae R6
uaaccaaguuuguaucuuccuu

SEQ ID NO: 2187620 - RNA, 17 nt, Streptococcus pneumoniae R6
uaaccacagacugagga

SEQ ID NO: 2187621 - RNA, 16 nt, Streptococcus pneumoniae R6
uaaccaauuucucaaa

SEQ ID NO: 2187622 - RNA, 15 nt, Streptococcus pneumoniae R6
uaacugcuaaaagau

SEQ ID NO: 2187623 - RNA, 23 nt, Streptococcus pneumoniae R6
uaacugcgauacgaucugaaaua

SEQ ID NO: 2187624 - RNA, 22 nt, Streptococcus pneumoniae R6
uaacuggaaagauaacugcuag

SEQ ID NO: 2187625 - RNA, 22 nt, Streptococcus pneumoniae R6
uaacugcugcuuggaaggaagc

SEQ ID NO: 2187626 - RNA, 14 nt, Streptococcus pneumoniae R6
uaacucuuuuuugg

SEQ ID NO: 2187627 - RNA, 15 nt, Streptococcus pneumoniae R6
uaacucuguaaucuc

SEQ ID NO: 2187628 - RNA, 16 nt, Streptococcus pneumoniae R6
uaacuaguuaauacug

SEQ ID NO: 2187629 - RNA, 21 nt, Streptococcus pneumoniae R6
uaacucaaguuaugcauuuuc

SEQ ID NO: 2187630 - RNA, 16 nt, Streptococcus pneumoniae R6
uaacucauaauagucu

SEQ ID NO: 2187631 - RNA, 12 nt, Streptococcus pneumoniae R6
uaacucaucaaa

SEQ ID NO: 2187632 - RNA, 20 nt, Streptococcus pneumoniae R6
uaacucccauaguuaagaga

SEQ ID NO: 2187633 - RNA, 18 nt, Streptococcus pneumoniae R6
uaacuaacgccaaauccu

SEQ ID NO: 2187634 - RNA, 19 nt, Streptococcus pneumoniae R6
uaacggcauccgcaagaga

SEQ ID NO: 2187635 - RNA, 22 nt, Streptococcus pneumoniae R6
uaacgguauagagaccaacucc

SEQ ID NO: 2187636 - RNA, 15 nt, Streptococcus pneumoniae R6
uaaccuuaaucaaau

SEQ ID NO: 2187637 - RNA, 12 nt, Streptococcus pneumoniae R6
uaacgccaaauc

SEQ ID NO: 2187638 - RNA, 19 nt, Streptococcus pneumoniae R6
uaaccucuugaaguucauu

SEQ ID NO: 2187639 - RNA, 20 nt, Streptococcus pneumoniae R6
uaacccaaacaagccuuuau

SEQ ID NO: 2187640 - RNA, 20 nt, Streptococcus pneumoniae R6
uaacccacucgccaguugcu

SEQ ID NO: 2187641 - RNA, 23 nt, Streptococcus pneumoniae R6
uaagcuucuucguccucugucuc

SEQ ID NO: 2187642 - RNA, 13 nt, Streptococcus pneumoniae R6
uaaggaaaacauu

SEQ ID NO: 2187643 - RNA, 20 nt, Streptococcus pneumoniae R6
uaaggaaaacauuacaaugu

SEQ ID NO: 2187644 - RNA, 20 nt, Streptococcus pneumoniae R6
uaaggaagucuguuauuucu

SEQ ID NO: 2187645 - RNA, 18 nt, Streptococcus pneumoniae R6
uaagcucgagaaaggaca

SEQ ID NO: 2187646 - RNA, 21 nt, Streptococcus pneumoniae R6
uaagcucgagaaaggacaaau

SEQ ID NO: 2187647 - RNA, 18 nt, Streptococcus pneumoniae R6
uaagcucgauaaaggaca

SEQ ID NO: 2187648 - RNA, 15 nt, Streptococcus pneumoniae R6
uaagcugaucaauau

SEQ ID NO: 2187649 - RNA, 16 nt, Streptococcus pneumoniae R6
uaagcgauuuuauagu

SEQ ID NO: 2187650 - RNA, 14 nt, Streptococcus pneumoniae R6
uaagccuuuuucuu

SEQ ID NO: 2187651 - RNA, 15 nt, Streptococcus pneumoniae R6
uaagccucuuucaua

SEQ ID NO: 2187652 - RNA, 21 nt, Streptococcus pneumoniae R6
uaagccggcuugucuuugauu

SEQ ID NO: 2187653 - RNA, 17 nt, Streptococcus pneumoniae R6
uaagcaugauaugaagu

SEQ ID NO: 2187654 - RNA, 22 nt, Streptococcus pneumoniae R6
uaagcaugauaugaaguuuauu

SEQ ID NO: 2187655 - RNA, 22 nt, Streptococcus pneumoniae R6
uaagcccaugauaucuuugauu

SEQ ID NO: 2187656 - RNA, 20 nt, Streptococcus pneumoniae R6
uaagccgaagccaaucaaac

SEQ ID NO: 2187657 - RNA, 20 nt, Streptococcus pneumoniae R6
uaagcccgaaaaauuucucu

SEQ ID NO: 2187658 - RNA, 21 nt, Streptococcus pneumoniae R6
uaagcccgaaaaauuucucug

SEQ ID NO: 2187659 - RNA, 21 nt, Streptococcus pneumoniae R6
uaagcaccuacaacauagacu

SEQ ID NO: 2187660 - RNA, 20 nt, Streptococcus pneumoniae R6
uaagcaauuuuuuauagaca

SEQ ID NO: 2187661 - RNA, 20 nt, Streptococcus pneumoniae R6
uaagcaauucaauuuuauac

SEQ ID NO: 2187662 - RNA, 20 nt, Streptococcus pneumoniae R6
uaagcauaacuaaaaccuuc

SEQ ID NO: 2187663 - RNA, 15 nt, Streptococcus pneumoniae R6
uaagaugagaacaaa

SEQ ID NO: 2187664 - RNA, 17 nt, Streptococcus pneumoniae R6
uaagaugaccuuaucua

SEQ ID NO: 2187665 - RNA, 22 nt, Streptococcus pneumoniae R6
uaagaugcgaacaaaucaauua

SEQ ID NO: 2187666 - RNA, 15 nt, Streptococcus pneumoniae R6
uaagaugauuuuucu

SEQ ID NO: 2187667 - RNA, 15 nt, Streptococcus pneumoniae R6
uaagauuacagauca

SEQ ID NO: 2187668 - RNA, 19 nt, Streptococcus pneumoniae R6
uaagauuacugucauauca

SEQ ID NO: 2187669 - RNA, 20 nt, Streptococcus pneumoniae R6
uaagauuacugucauaucau

SEQ ID NO: 2187670 - RNA, 15 nt, Streptococcus pneumoniae R6
uaagauuuuuggaaa

SEQ ID NO: 2187671 - RNA, 17 nt, Streptococcus pneumoniae R6
uaagauuuuuggaaaaa

SEQ ID NO: 2187672 - RNA, 16 nt, Streptococcus pneumoniae R6
uaagauucuucugguu

SEQ ID NO: 2187673 - RNA, 14 nt, Streptococcus pneumoniae R6
uaagcaaaaaaagc

SEQ ID NO: 2187674 - RNA, 19 nt, Streptococcus pneumoniae R6
uaagcaaaguccuuacuca

SEQ ID NO: 2187675 - RNA, 22 nt, Streptococcus pneumoniae R6
uaacuuuuggggggcaguacag

SEQ ID NO: 2187676 - RNA, 15 nt, Streptococcus pneumoniae R6
uaacuuuuuugagaa

SEQ ID NO: 2187677 - RNA, 16 nt, Streptococcus pneumoniae R6
uaacuuuuuugagaaa

SEQ ID NO: 2187678 - RNA, 17 nt, Streptococcus pneumoniae R6
uaagaacuuuuuaaagu

SEQ ID NO: 2187679 - RNA, 15 nt, Streptococcus pneumoniae R6
uaagaacucuuucca

SEQ ID NO: 2187680 - RNA, 16 nt, Streptococcus pneumoniae R6
uaagaacucuuuccaa

SEQ ID NO: 2187681 - RNA, 13 nt, Streptococcus pneumoniae R6
uaagaaccaauau

SEQ ID NO: 2187682 - RNA, 18 nt, Streptococcus pneumoniae R6
uaagaaaccgucaucagc

SEQ ID NO: 2187683 - RNA, 21 nt, Streptococcus pneumoniae R6
uaagaaauaguuuagauaaaa

SEQ ID NO: 2187684 - RNA, 15 nt, Streptococcus pneumoniae R6
uaagaaaucauacac

SEQ ID NO: 2187685 - RNA, 21 nt, Streptococcus pneumoniae R6
uaagaaaguaagaaucugcau

SEQ ID NO: 2187686 - RNA, 14 nt, Streptococcus pneumoniae R6
uaagaaaucuccag

SEQ ID NO: 2187687 - RNA, 20 nt, Streptococcus pneumoniae R6
uaagaacaggacaaaucgau

SEQ ID NO: 2187688 - RNA, 20 nt, Streptococcus pneumoniae R6
uaagaaauuuucuuuuuccu

SEQ ID NO: 2187689 - RNA, 21 nt, Streptococcus pneumoniae R6
uaagaaauuuucuuuuuccua

SEQ ID NO: 2187690 - RNA, 14 nt, Streptococcus pneumoniae R6
uaagaaauuuugga

SEQ ID NO: 2187691 - RNA, 15 nt, Streptococcus pneumoniae R6
uaagaaauuuuggau

SEQ ID NO: 2187692 - RNA, 21 nt, Streptococcus pneumoniae R6
uaagaaauuuuggauuucuuu

SEQ ID NO: 2187693 - RNA, 13 nt, Streptococcus pneumoniae R6
uaacuucaauaga

SEQ ID NO: 2187694 - RNA, 13 nt, Streptococcus pneumoniae R6
uaacuucauuaua

SEQ ID NO: 2187695 - RNA, 14 nt, Streptococcus pneumoniae R6
uaacuuauuuuaac

SEQ ID NO: 2187696 - RNA, 20 nt, Streptococcus pneumoniae R6
uaacuuguuuacguuuuaaa

SEQ ID NO: 2187697 - RNA, 15 nt, Streptococcus pneumoniae R6
uaacuucuuauuagc

SEQ ID NO: 2187698 - RNA, 18 nt, Streptococcus pneumoniae R6
uaacuucugcuaauugag

SEQ ID NO: 2187699 - RNA, 15 nt, Streptococcus pneumoniae R6
uaagagaagagagca

SEQ ID NO: 2187700 - RNA, 14 nt, Streptococcus pneumoniae R6
uaagagaacuucac

SEQ ID NO: 2187701 - RNA, 13 nt, Streptococcus pneumoniae R6
uaagacuuuuccu

SEQ ID NO: 2187702 - RNA, 14 nt, Streptococcus pneumoniae R6
uaagagaaauuucu

SEQ ID NO: 2187703 - RNA, 19 nt, Streptococcus pneumoniae R6
uaagagaaauuucugaaac

SEQ ID NO: 2187704 - RNA, 13 nt, Streptococcus pneumoniae R6
uaagacuccucuu

SEQ ID NO: 2187705 - RNA, 22 nt, Streptococcus pneumoniae R6
uaagaaucuuuucuauuuuaua

SEQ ID NO: 2187706 - RNA, 14 nt, Streptococcus pneumoniae R6
uaagaaguagaggu

SEQ ID NO: 2187707 - RNA, 23 nt, Streptococcus pneumoniae R6
uaagaagucaucuaucaaaagau

SEQ ID NO: 2187708 - RNA, 15 nt, Streptococcus pneumoniae R6
uaagaauuugauuau

SEQ ID NO: 2187709 - RNA, 17 nt, Streptococcus pneumoniae R6
uaagauaauagcgauga

SEQ ID NO: 2187710 - RNA, 16 nt, Streptococcus pneumoniae R6
uaagauaaguuccauc

SEQ ID NO: 2187711 - RNA, 21 nt, Streptococcus pneumoniae R6
uaagauaaggcaucuuaacau

SEQ ID NO: 2187712 - RNA, 15 nt, Streptococcus pneumoniae R6
uaagaguucuuccca

SEQ ID NO: 2187713 - RNA, 23 nt, Streptococcus pneumoniae R6
uaagaguuaauggccaccuucaa

SEQ ID NO: 2187714 - RNA, 21 nt, Streptococcus pneumoniae R6
uaagauagagguuauucaaaa

SEQ ID NO: 2187715 - RNA, 18 nt, Streptococcus pneumoniae R6
uaagauaucacucaucug

SEQ ID NO: 2187716 - RNA, 20 nt, Streptococcus pneumoniae R6
uaagauaucacucaucugcu

SEQ ID NO: 2187717 - RNA, 23 nt, Streptococcus pneumoniae R6
uaagagaguuacggguuuuaaac

SEQ ID NO: 2187718 - RNA, 14 nt, Streptococcus pneumoniae R6
uaagagagaagccu

SEQ ID NO: 2187719 - RNA, 17 nt, Streptococcus pneumoniae R6
uaagagcuucuuuugga

SEQ ID NO: 2187720 - RNA, 17 nt, Streptococcus pneumoniae R6
uaagagcgaugccauga

SEQ ID NO: 2187721 - RNA, 13 nt, Streptococcus pneumoniae R6
uaagagcuagucg

SEQ ID NO: 2187722 - RNA, 11 nt, Streptococcus pneumoniae R6
uaagaguagua

SEQ ID NO: 2187723 - RNA, 19 nt, Streptococcus pneumoniae R6
uaagaguaguauuuacuaa

SEQ ID NO: 2187724 - RNA, 17 nt, Streptococcus pneumoniae R6
uaagaguauaaaaccuu

SEQ ID NO: 2187725 - RNA, 21 nt, Streptococcus pneumoniae R6
uauagaggagauuuaaaaaug

SEQ ID NO: 2187726 - RNA, 14 nt, Streptococcus pneumoniae R6
uauagauucaauau

SEQ ID NO: 2187727 - RNA, 22 nt, Streptococcus pneumoniae R6
uauagaguguuaucugaaaauu

SEQ ID NO: 2187728 - RNA, 17 nt, Streptococcus pneumoniae R6
uauagcauacugaauuu

SEQ ID NO: 2187729 - RNA, 16 nt, Streptococcus pneumoniae R6
uauagacuauauugau

SEQ ID NO: 2187730 - RNA, 19 nt, Streptococcus pneumoniae R6
uauagacuauauugauuau

SEQ ID NO: 2187731 - RNA, 23 nt, Streptococcus pneumoniae R6
uauagagcaauggggcuuuauuu

SEQ ID NO: 2187732 - RNA, 15 nt, Streptococcus pneumoniae R6
uauagaccugaucaa

SEQ ID NO: 2187733 - RNA, 21 nt, Streptococcus pneumoniae R6
uauagaccaagaacucuucug

SEQ ID NO: 2187734 - RNA, 21 nt, Streptococcus pneumoniae R6
uauagacaacuccuugaauca

SEQ ID NO: 2187735 - RNA, 22 nt, Streptococcus pneumoniae R6
uauagacaacuccuugaaucau

SEQ ID NO: 2187736 - RNA, 22 nt, Streptococcus pneumoniae R6
uauacuugauauaguuaaaaaa

SEQ ID NO: 2187737 - RNA, 13 nt, Streptococcus pneumoniae R6
uauacuuuucucu

SEQ ID NO: 2187738 - RNA, 17 nt, Streptococcus pneumoniae R6
uauacuuuuucaguuuu

SEQ ID NO: 2187739 - RNA, 16 nt, Streptococcus pneumoniae R6
uauacuuuuucuuccu

SEQ ID NO: 2187740 - RNA, 19 nt, Streptococcus pneumoniae R6
uauacuuuuuuaauuuaau

SEQ ID NO: 2187741 - RNA, 23 nt, Streptococcus pneumoniae R6
uauagaaaaaagucuuuaaaauu

SEQ ID NO: 2187742 - RNA, 15 nt, Streptococcus pneumoniae R6
uauagaaaauuaacu

SEQ ID NO: 2187743 - RNA, 21 nt, Streptococcus pneumoniae R6
uauagaacuaguaaauugucu

SEQ ID NO: 2187744 - RNA, 18 nt, Streptococcus pneumoniae R6
uauagaaggcaauuaaaa

SEQ ID NO: 2187745 - RNA, 19 nt, Streptococcus pneumoniae R6
uauagaaggcaauuaaaag

SEQ ID NO: 2187746 - RNA, 16 nt, Streptococcus pneumoniae R6
uauacuaaaagcgauu

SEQ ID NO: 2187747 - RNA, 16 nt, Streptococcus pneumoniae R6
uauacuaauacauuuu

SEQ ID NO: 2187748 - RNA, 18 nt, Streptococcus pneumoniae R6
uauacuaauauaguuguc

SEQ ID NO: 2187749 - RNA, 13 nt, Streptococcus pneumoniae R6
uauacuauaaaac

SEQ ID NO: 2187750 - RNA, 15 nt, Streptococcus pneumoniae R6
uauacuauaaaacaa

SEQ ID NO: 2187751 - RNA, 13 nt, Streptococcus pneumoniae R6
uauacucaaugaa

SEQ ID NO: 2187752 - RNA, 18 nt, Streptococcus pneumoniae R6
uauacuuuuaauauuucc

SEQ ID NO: 2187753 - RNA, 14 nt, Streptococcus pneumoniae R6
uauacucuuuagaa

SEQ ID NO: 2187754 - RNA, 14 nt, Streptococcus pneumoniae R6
uauacucaucuguu

SEQ ID NO: 2187755 - RNA, 19 nt, Streptococcus pneumoniae R6
uauacucaucuguuuucaa

SEQ ID NO: 2187756 - RNA, 20 nt, Streptococcus pneumoniae R6
uauacucaucuguuuucaaa

SEQ ID NO: 2187757 - RNA, 16 nt, Streptococcus pneumoniae R6
uauaccauaauaaaag

SEQ ID NO: 2187758 - RNA, 20 nt, Streptococcus pneumoniae R6
uauaccaaaaaaacuccaaa

SEQ ID NO: 2187759 - RNA, 19 nt, Streptococcus pneumoniae R6
uauacauuuagaaagguaa

SEQ ID NO: 2187760 - RNA, 21 nt, Streptococcus pneumoniae R6
uauacaucuucccacaauaaa

SEQ ID NO: 2187761 - RNA, 11 nt, Streptococcus pneumoniae R6
uauacaaaaaa

SEQ ID NO: 2187762 - RNA, 12 nt, Streptococcus pneumoniae R6
uauacaaaaaag

SEQ ID NO: 2187763 - RNA, 14 nt, Streptococcus pneumoniae R6
uauaauuucaacua

SEQ ID NO: 2187764 - RNA, 18 nt, Streptococcus pneumoniae R6
uauacacgaccuauagaa

SEQ ID NO: 2187765 - RNA, 13 nt, Streptococcus pneumoniae R6
uauacacuuaaau

SEQ ID NO: 2187766 - RNA, 21 nt, Streptococcus pneumoniae R6
uauacaggggauugauuaucc

SEQ ID NO: 2187767 - RNA, 15 nt, Streptococcus pneumoniae R6
uauacaguccucccu

SEQ ID NO: 2187768 - RNA, 21 nt, Streptococcus pneumoniae R6
uauacaguccucccuuguuuu

SEQ ID NO: 2187769 - RNA, 22 nt, Streptococcus pneumoniae R6
uauacauccguuuuucuccucu

SEQ ID NO: 2187770 - RNA, 23 nt, Streptococcus pneumoniae R6
uauacauccguuuuucuccucua

SEQ ID NO: 2187771 - RNA, 20 nt, Streptococcus pneumoniae R6
uauaauagguggauaaaagu

SEQ ID NO: 2187772 - RNA, 22 nt, Streptococcus pneumoniae R6
uauaauagguggauaaaagucu

SEQ ID NO: 2187773 - RNA, 17 nt, Streptococcus pneumoniae R6
uauaauuauauauaaaa

SEQ ID NO: 2187774 - RNA, 18 nt, Streptococcus pneumoniae R6
uauaauuauauauaaaaa

SEQ ID NO: 2187775 - RNA, 22 nt, Streptococcus pneumoniae R6
uauaauaaaaugaaauaagaau

SEQ ID NO: 2187776 - RNA, 20 nt, Streptococcus pneumoniae R6
uauaauaaaaugaaauaaua

SEQ ID NO: 2187777 - RNA, 15 nt, Streptococcus pneumoniae R6
uauaaauuauuucuu

SEQ ID NO: 2187778 - RNA, 16 nt, Streptococcus pneumoniae R6
uauaaauuauuucuuu

SEQ ID NO: 2187779 - RNA, 21 nt, Streptococcus pneumoniae R6
uauaaauucauuugauuuucc

SEQ ID NO: 2187780 - RNA, 22 nt, Streptococcus pneumoniae R6
uauaaauucauuugauuuuccu

SEQ ID NO: 2187781 - RNA, 15 nt, Streptococcus pneumoniae R6
uauaauauuuaauug

SEQ ID NO: 2187782 - RNA, 16 nt, Streptococcus pneumoniae R6
uagguacgacaggcau

SEQ ID NO: 2187783 - RNA, 13 nt, Streptococcus pneumoniae R6
uaggucaacagga

SEQ ID NO: 2187784 - RNA, 21 nt, Streptococcus pneumoniae R6
uaggucaaccaacuuuuccuu

SEQ ID NO: 2187785 - RNA, 18 nt, Streptococcus pneumoniae R6
uagucguaaauaauauua

SEQ ID NO: 2187786 - RNA, 14 nt, Streptococcus pneumoniae R6
uagucuagcuagug

SEQ ID NO: 2187787 - RNA, 20 nt, Streptococcus pneumoniae R6
uagucuacaauagcuuguuc

SEQ ID NO: 2187788 - RNA, 17 nt, Streptococcus pneumoniae R6
uagucuacaauuucucg

SEQ ID NO: 2187789 - RNA, 21 nt, Streptococcus pneumoniae R6
uagucuucuguacauuagaau

SEQ ID NO: 2187790 - RNA, 17 nt, Streptococcus pneumoniae R6
uagucuauucuuuccuu

SEQ ID NO: 2187791 - RNA, 19 nt, Streptococcus pneumoniae R6
uagucuggauauccuuuuc

SEQ ID NO: 2187792 - RNA, 18 nt, Streptococcus pneumoniae R6
uagucuucuuuucuuuua

SEQ ID NO: 2187793 - RNA, 17 nt, Streptococcus pneumoniae R6
uaguggguugaaaaaaa

SEQ ID NO: 2187794 - RNA, 19 nt, Streptococcus pneumoniae R6
uaguggguugaaaaaaagc

SEQ ID NO: 2187795 - RNA, 15 nt, Streptococcus pneumoniae R6
uaguggguugaagaa

SEQ ID NO: 2187796 - RNA, 18 nt, Streptococcus pneumoniae R6
uaguggguugaagucagc

SEQ ID NO: 2187797 - RNA, 13 nt, Streptococcus pneumoniae R6
uaguguauaaggu

SEQ ID NO: 2187798 - RNA, 23 nt, Streptococcus pneumoniae R6
uagugaaugauucugaaauaacu

SEQ ID NO: 2187799 - RNA, 14 nt, Streptococcus pneumoniae R6
uagugaauugaaau

SEQ ID NO: 2187800 - RNA, 17 nt, Streptococcus pneumoniae R6
uagugaauugaaauaag

SEQ ID NO: 2187801 - RNA, 12 nt, Streptococcus pneumoniae R6
uaguuaauacug

SEQ ID NO: 2187802 - RNA, 20 nt, Streptococcus pneumoniae R6
uaguuaaauguaguuggauu

SEQ ID NO: 2187803 - RNA, 20 nt, Streptococcus pneumoniae R6
uaguuaaucuauacauuuag

SEQ ID NO: 2187804 - RNA, 22 nt, Streptococcus pneumoniae R6
uaguuaaucuauacauuuagaa

SEQ ID NO: 2187805 - RNA, 15 nt, Streptococcus pneumoniae R6
uaguuauaaaggcuu

SEQ ID NO: 2187806 - RNA, 18 nt, Streptococcus pneumoniae R6
uauaaaccucauuggaaa

SEQ ID NO: 2187807 - RNA, 19 nt, Streptococcus pneumoniae R6
uauaaaccucauuggaaaa

SEQ ID NO: 2187808 - RNA, 16 nt, Streptococcus pneumoniae R6
uauaaacgaauagaaa

SEQ ID NO: 2187809 - RNA, 14 nt, Streptococcus pneumoniae R6
uauaaaauuuaaua

SEQ ID NO: 2187810 - RNA, 20 nt, Streptococcus pneumoniae R6
uauaaaauuucuugacauac

SEQ ID NO: 2187811 - RNA, 13 nt, Streptococcus pneumoniae R6
uauaaauauagaa

SEQ ID NO: 2187812 - RNA, 14 nt, Streptococcus pneumoniae R6
uauaaauauagaaa

SEQ ID NO: 2187813 - RNA, 17 nt, Streptococcus pneumoniae R6
uauaaauaauuauagaa

SEQ ID NO: 2187814 - RNA, 18 nt, Streptococcus pneumoniae R6
uauaaauaauuauagaaa

SEQ ID NO: 2187815 - RNA, 13 nt, Streptococcus pneumoniae R6
uauaaaugaugaa

SEQ ID NO: 2187816 - RNA, 20 nt, Streptococcus pneumoniae R6
uaguuuuuugcguuucugga

SEQ ID NO: 2187817 - RNA, 15 nt, Streptococcus pneumoniae R6
uaguuuuuagaagcu

SEQ ID NO: 2187818 - RNA, 12 nt, Streptococcus pneumoniae R6
uaguuuuucccg

SEQ ID NO: 2187819 - RNA, 17 nt, Streptococcus pneumoniae R6
uaguuuugguuuuucuu

SEQ ID NO: 2187820 - RNA, 19 nt, Streptococcus pneumoniae R6
uaguuuugguuuuucuuca

SEQ ID NO: 2187821 - RNA, 22 nt, Streptococcus pneumoniae R6
uaguuuucacuauugaugaacu

SEQ ID NO: 2187822 - RNA, 22 nt, Streptococcus pneumoniae R6
uaguuuucuaaagaauuugaaa

SEQ ID NO: 2187823 - RNA, 13 nt, Streptococcus pneumoniae R6
uaguuugcucuuu

SEQ ID NO: 2187824 - RNA, 22 nt, Streptococcus pneumoniae R6
uaguuugcucuuugauuuucau

SEQ ID NO: 2187825 - RNA, 16 nt, Streptococcus pneumoniae R6
uaguuugcuuuuugau

SEQ ID NO: 2187826 - RNA, 20 nt, Streptococcus pneumoniae R6
uaguuuccuaguuugcucuu

SEQ ID NO: 2187827 - RNA, 13 nt, Streptococcus pneumoniae R6
uaguuucauaacu

SEQ ID NO: 2187828 - RNA, 18 nt, Streptococcus pneumoniae R6
uaucauauagauaaaaaa

SEQ ID NO: 2187829 - RNA, 13 nt, Streptococcus pneumoniae R6
uaucauauaaaua

SEQ ID NO: 2187830 - RNA, 18 nt, Streptococcus pneumoniae R6
uaucauagaaauuuuuac

SEQ ID NO: 2187831 - RNA, 23 nt, Streptococcus pneumoniae R6
uaucacauuguguucaccccuaa

SEQ ID NO: 2187832 - RNA, 17 nt, Streptococcus pneumoniae R6
uaucaggaaagucaaau

SEQ ID NO: 2187833 - RNA, 21 nt, Streptococcus pneumoniae R6
uaucaggaaagucaaauuaau

SEQ ID NO: 2187834 - RNA, 18 nt, Streptococcus pneumoniae R6
uaucaggggauuaagaaa

SEQ ID NO: 2187835 - RNA, 15 nt, Streptococcus pneumoniae R6
uaucaagauaagaaa

SEQ ID NO: 2187836 - RNA, 16 nt, Streptococcus pneumoniae R6
uaucaagauaagaaaa

SEQ ID NO: 2187837 - RNA, 16 nt, Streptococcus pneumoniae R6
uaucaaggauuuuuug

SEQ ID NO: 2187838 - RNA, 17 nt, Streptococcus pneumoniae R6
uaucaaguucuuccacu

SEQ ID NO: 2187839 - RNA, 21 nt, Streptococcus pneumoniae R6
uaucaaguucuuccacucaaa

SEQ ID NO: 2187840 - RNA, 15 nt, Streptococcus pneumoniae R6
uaucaagguuuuuca

SEQ ID NO: 2187841 - RNA, 16 nt, Streptococcus pneumoniae R6
uaucaagguuuuucaa

SEQ ID NO: 2187842 - RNA, 18 nt, Streptococcus pneumoniae R6
uaucaagguuuuucaaaa

SEQ ID NO: 2187843 - RNA, 16 nt, Streptococcus pneumoniae R6
uaucaagguuuuucug

SEQ ID NO: 2187844 - RNA, 20 nt, Streptococcus pneumoniae R6
uaucaagguuuuucuguacu

SEQ ID NO: 2187845 - RNA, 22 nt, Streptococcus pneumoniae R6
uaucaagguuuuucuguacugc

SEQ ID NO: 2187846 - RNA, 19 nt, Streptococcus pneumoniae R6
uaucaagguuuuugaaaaa

SEQ ID NO: 2187847 - RNA, 21 nt, Streptococcus pneumoniae R6
uaucaagguuuuugaaaaacc

SEQ ID NO: 2187848 - RNA, 17 nt, Streptococcus pneumoniae R6
uaucaauugauuugaau

SEQ ID NO: 2187849 - RNA, 15 nt, Streptococcus pneumoniae R6
uaucaaucaaacgcu

SEQ ID NO: 2187850 - RNA, 16 nt, Streptococcus pneumoniae R6
uauauucaaaauacaa

SEQ ID NO: 2187851 - RNA, 18 nt, Streptococcus pneumoniae R6
uauauuccauuccucugg

SEQ ID NO: 2187852 - RNA, 21 nt, Streptococcus pneumoniae R6
uauauucugaaugcuuuccaa

SEQ ID NO: 2187853 - RNA, 24 nt, Streptococcus pneumoniae R6
uauauucuccagcuauuaaguccu

SEQ ID NO: 2187854 - RNA, 20 nt, Streptococcus pneumoniae R6
uauauucucucuuacuauac

SEQ ID NO: 2187855 - RNA, 18 nt, Streptococcus pneumoniae R6
uauauugaaaugaaauaa

SEQ ID NO: 2187856 - RNA, 17 nt, Streptococcus pneumoniae R6
uauaugaagauucugua

SEQ ID NO: 2187857 - RNA, 22 nt, Streptococcus pneumoniae R6
uauaugaagauucuguauggua

SEQ ID NO: 2187858 - RNA, 12 nt, Streptococcus pneumoniae R6
uauauuauaaau

SEQ ID NO: 2187859 - RNA, 13 nt, Streptococcus pneumoniae R6
uauauaguagacu

SEQ ID NO: 2187860 - RNA, 14 nt, Streptococcus pneumoniae R6
uauauaguuuaauc

SEQ ID NO: 2187861 - RNA, 19 nt, Streptococcus pneumoniae R6
uauauaguuuaaucaaaau

SEQ ID NO: 2187862 - RNA, 16 nt, Streptococcus pneumoniae R6
uauauaugcacagaca

SEQ ID NO: 2187863 - RNA, 18 nt, Streptococcus pneumoniae R6
uauauaugcacauauaca

SEQ ID NO: 2187864 - RNA, 14 nt, Streptococcus pneumoniae R6
uauauccuaaaaaa

SEQ ID NO: 2187865 - RNA, 14 nt, Streptococcus pneumoniae R6
uauaucuaauaauu

SEQ ID NO: 2187866 - RNA, 15 nt, Streptococcus pneumoniae R6
uauaucuaauaauuu

SEQ ID NO: 2187867 - RNA, 17 nt, Streptococcus pneumoniae R6
uauagcgcuagagacua

SEQ ID NO: 2187868 - RNA, 17 nt, Streptococcus pneumoniae R6
uauaggcucuuugucaa

SEQ ID NO: 2187869 - RNA, 15 nt, Streptococcus pneumoniae R6
uauccuuuuuuacuu

SEQ ID NO: 2187870 - RNA, 21 nt, Streptococcus pneumoniae R6
uauccgcaaccucaaaacagu

SEQ ID NO: 2187871 - RNA, 12 nt, Streptococcus pneumoniae R6
uaucccauucuu

SEQ ID NO: 2187872 - RNA, 13 nt, Streptococcus pneumoniae R6
uaucccauucuuc

SEQ ID NO: 2187873 - RNA, 16 nt, Streptococcus pneumoniae R6
uaucaucaaucaagau

SEQ ID NO: 2187874 - RNA, 20 nt, Streptococcus pneumoniae R6
uaucaucgauuuuuucacca

SEQ ID NO: 2187875 - RNA, 22 nt, Streptococcus pneumoniae R6
uaucaugggguguuuuucuauu

SEQ ID NO: 2187876 - RNA, 18 nt, Streptococcus pneumoniae R6
uaucauuaaguaaucucu

SEQ ID NO: 2187877 - RNA, 16 nt, Streptococcus pneumoniae R6
uaucauuaaagaccaa

SEQ ID NO: 2187878 - RNA, 20 nt, Streptococcus pneumoniae R6
uauccagccuucauaaaagu

SEQ ID NO: 2187879 - RNA, 18 nt, Streptococcus pneumoniae R6
uaucuaucucaacaaauc

SEQ ID NO: 2187880 - RNA, 13 nt, Streptococcus pneumoniae R6
uaucucuaucucu

SEQ ID NO: 2187881 - RNA, 19 nt, Streptococcus pneumoniae R6
uaucugaaaguuuaucucu

SEQ ID NO: 2187882 - RNA, 21 nt, Streptococcus pneumoniae R6
uaucugagguguaaguccucg

SEQ ID NO: 2187883 - RNA, 16 nt, Streptococcus pneumoniae R6
uaucugaugcugacaa

SEQ ID NO: 2187884 - RNA, 19 nt, Streptococcus pneumoniae R6
uaucugaugcugacaaguc

SEQ ID NO: 2187885 - RNA, 13 nt, Streptococcus pneumoniae R6
uaucugauagagu

SEQ ID NO: 2187886 - RNA, 15 nt, Streptococcus pneumoniae R6
uaucugaauaccuaa

SEQ ID NO: 2187887 - RNA, 19 nt, Streptococcus pneumoniae R6
uaucugaauaccuaaucuu

SEQ ID NO: 2187888 - RNA, 19 nt, Streptococcus pneumoniae R6
uaucugaaaauuaaucaga

SEQ ID NO: 2187889 - RNA, 21 nt, Streptococcus pneumoniae R6
uaucuuauuuuucuauuuaaa

SEQ ID NO: 2187890 - RNA, 18 nt, Streptococcus pneumoniae R6
uaucuuaauucucuuauu

SEQ ID NO: 2187891 - RNA, 18 nt, Streptococcus pneumoniae R6
uaucuguagaguuuuggu

SEQ ID NO: 2187892 - RNA, 20 nt, Streptococcus pneumoniae R6
uaucugucacaauccagccu

SEQ ID NO: 2187893 - RNA, 12 nt, Streptococcus pneumoniae R6
uaucugcaaccu

SEQ ID NO: 2187894 - RNA, 14 nt, Streptococcus pneumoniae R6
uaucugcaaccuca

SEQ ID NO: 2187895 - RNA, 23 nt, Streptococcus pneumoniae R6
uaucugcaaccucaaaacagugu

SEQ ID NO: 2187896 - RNA, 15 nt, Streptococcus pneumoniae R6
uaucugcaaccuuaa

SEQ ID NO: 2187897 - RNA, 17 nt, Streptococcus pneumoniae R6
uaucuagggcauuaauc

SEQ ID NO: 2187898 - RNA, 22 nt, Streptococcus pneumoniae R6
uaucuagggcauuaaucauucc

SEQ ID NO: 2187899 - RNA, 22 nt, Streptococcus pneumoniae R6
uaucuagucgaagcuuccaaua

SEQ ID NO: 2187900 - RNA, 16 nt, Streptococcus pneumoniae R6
uaucuagaauuucuuu

SEQ ID NO: 2187901 - RNA, 12 nt, Streptococcus pneumoniae R6
uaucuaagaugu

SEQ ID NO: 2187902 - RNA, 15 nt, Streptococcus pneumoniae R6
uaucuaauacccauu

SEQ ID NO: 2187903 - RNA, 23 nt, Streptococcus pneumoniae R6
uaucuaauacccauuuauggaaa

SEQ ID NO: 2187904 - RNA, 18 nt, Streptococcus pneumoniae R6
uaucuaaucacguugcuu

SEQ ID NO: 2187905 - RNA, 16 nt, Streptococcus pneumoniae R6
uaucgaccucuaccaa

SEQ ID NO: 2187906 - RNA, 15 nt, Streptococcus pneumoniae R6
uaucuaacaauaaga

SEQ ID NO: 2187907 - RNA, 21 nt, Streptococcus pneumoniae R6
uaucuaacaauaagauaucac

SEQ ID NO: 2187908 - RNA, 23 nt, Streptococcus pneumoniae R6
uagccuugaccagaaauaaaagu

SEQ ID NO: 2187909 - RNA, 16 nt, Streptococcus pneumoniae R6
uagccuucauuacuua

SEQ ID NO: 2187910 - RNA, 15 nt, Streptococcus pneumoniae R6
uagccuuguauucau

SEQ ID NO: 2187911 - RNA, 18 nt, Streptococcus pneumoniae R6
uagccuuuggauauuuug

SEQ ID NO: 2187912 - RNA, 23 nt, Streptococcus pneumoniae R6
uagcgaaaucguggcucuacgaa

SEQ ID NO: 2187913 - RNA, 23 nt, Streptococcus pneumoniae R6
uagccucuacaccauaaauauuu

SEQ ID NO: 2187914 - RNA, 22 nt, Streptococcus pneumoniae R6
uagccauaaaacauuuccgauu

SEQ ID NO: 2187915 - RNA, 21 nt, Streptococcus pneumoniae R6
uagccauaaaacauuucggau

SEQ ID NO: 2187916 - RNA, 24 nt, Streptococcus pneumoniae R6
uagccacucuggcaauuuaucucc

SEQ ID NO: 2187917 - RNA, 16 nt, Streptococcus pneumoniae R6
uagccauguuuuucuc

SEQ ID NO: 2187918 - RNA, 18 nt, Streptococcus pneumoniae R6
uagccauguuuuucuccu

SEQ ID NO: 2187919 - RNA, 20 nt, Streptococcus pneumoniae R6
uagccgcagguugcucaaaa

SEQ ID NO: 2187920 - RNA, 21 nt, Streptococcus pneumoniae R6
uagcaguaguuggcuugucuu

SEQ ID NO: 2187921 - RNA, 15 nt, Streptococcus pneumoniae R6
uagcacuuuuccauu

SEQ ID NO: 2187922 - RNA, 23 nt, Streptococcus pneumoniae R6
uagcaccauauuuguugcucuua

SEQ ID NO: 2187923 - RNA, 16 nt, Streptococcus pneumoniae R6
uagcauaaaagccucc

SEQ ID NO: 2187924 - RNA, 19 nt, Streptococcus pneumoniae R6
uagauauaauuguaaacaa

SEQ ID NO: 2187925 - RNA, 13 nt, Streptococcus pneumoniae R6
uagauauuuugaa

SEQ ID NO: 2187926 - RNA, 15 nt, Streptococcus pneumoniae R6
uagauaguuaaaugu

SEQ ID NO: 2187927 - RNA, 12 nt, Streptococcus pneumoniae R6
uagauccaagca

SEQ ID NO: 2187928 - RNA, 12 nt, Streptococcus pneumoniae R6
uagaucaucugc

SEQ ID NO: 2187929 - RNA, 15 nt, Streptococcus pneumoniae R6
uagaucaugacugag

SEQ ID NO: 2187930 - RNA, 20 nt, Streptococcus pneumoniae R6
uagcaauaaaccaucgugua

SEQ ID NO: 2187931 - RNA, 14 nt, Streptococcus pneumoniae R6
uagcaaucacucua

SEQ ID NO: 2187932 - RNA, 15 nt, Streptococcus pneumoniae R6
uagcaaucacucuaa

SEQ ID NO: 2187933 - RNA, 13 nt, Streptococcus pneumoniae R6
uagcaaggaugag

SEQ ID NO: 2187934 - RNA, 20 nt, Streptococcus pneumoniae R6
uagaucucucgaauaagguu

SEQ ID NO: 2187935 - RNA, 16 nt, Streptococcus pneumoniae R6
uagcaauuuguggaaa

SEQ ID NO: 2187936 - RNA, 14 nt, Streptococcus pneumoniae R6
uagcacaccaaaca

SEQ ID NO: 2187937 - RNA, 16 nt, Streptococcus pneumoniae R6
uagcaaugguuuagaa

SEQ ID NO: 2187938 - RNA, 13 nt, Streptococcus pneumoniae R6
uagcaauucuaaa

SEQ ID NO: 2187939 - RNA, 15 nt, Streptococcus pneumoniae R6
uagcgauugaauaug

SEQ ID NO: 2187940 - RNA, 17 nt, Streptococcus pneumoniae R6
uagcgacuuucuucgaa

SEQ ID NO: 2187941 - RNA, 17 nt, Streptococcus pneumoniae R6
uagcgauagauguuuuc

SEQ ID NO: 2187942 - RNA, 19 nt, Streptococcus pneumoniae R6
uagcgauagauguuuucaa

SEQ ID NO: 2187943 - RNA, 23 nt, Streptococcus pneumoniae R6
uagcgauagauguuuucaaaaau

SEQ ID NO: 2187944 - RNA, 17 nt, Streptococcus pneumoniae R6
uagcgugcccaaaaauu

SEQ ID NO: 2187945 - RNA, 18 nt, Streptococcus pneumoniae R6
uagcuaacugcuucacua

SEQ ID NO: 2187946 - RNA, 13 nt, Streptococcus pneumoniae R6
uagcuaauagaac

SEQ ID NO: 2187947 - RNA, 15 nt, Streptococcus pneumoniae R6
uagcuccaucuccaa

SEQ ID NO: 2187948 - RNA, 16 nt, Streptococcus pneumoniae R6
uagcuccaucuccaac

SEQ ID NO: 2187949 - RNA, 22 nt, Streptococcus pneumoniae R6
uagcugauuauguuuuaaauaa

SEQ ID NO: 2187950 - RNA, 13 nt, Streptococcus pneumoniae R6
uagcugauuuuug

SEQ ID NO: 2187951 - RNA, 18 nt, Streptococcus pneumoniae R6
uagcugauuuuuggauau

SEQ ID NO: 2187952 - RNA, 16 nt, Streptococcus pneumoniae R6
uagcugcagcugagga

SEQ ID NO: 2187953 - RNA, 14 nt, Streptococcus pneumoniae R6
uagcugagaagccc

SEQ ID NO: 2187954 - RNA, 20 nt, Streptococcus pneumoniae R6
uagcugagaagcccauaucu

SEQ ID NO: 2187955 - RNA, 23 nt, Streptococcus pneumoniae R6
uagcuuucuaguuugcucuuuga

SEQ ID NO: 2187956 - RNA, 18 nt, Streptococcus pneumoniae R6
uagcuuucaaguuuugau

SEQ ID NO: 2187957 - RNA, 13 nt, Streptococcus pneumoniae R6
uagcuugcaauuc

SEQ ID NO: 2187958 - RNA, 20 nt, Streptococcus pneumoniae R6
uagcuugcuccauucuuuua

SEQ ID NO: 2187959 - RNA, 17 nt, Streptococcus pneumoniae R6
uagcuuggucaguaaga

SEQ ID NO: 2187960 - RNA, 13 nt, Streptococcus pneumoniae R6
uagcuuuucuuca

SEQ ID NO: 2187961 - RNA, 16 nt, Streptococcus pneumoniae R6
uagcuuuugcagcacc

SEQ ID NO: 2187962 - RNA, 17 nt, Streptococcus pneumoniae R6
uaggaaaacaugaagua

SEQ ID NO: 2187963 - RNA, 18 nt, Streptococcus pneumoniae R6
uagggcuaggcuaacacu

SEQ ID NO: 2187964 - RNA, 19 nt, Streptococcus pneumoniae R6
uagggugacaguaaaaaau

SEQ ID NO: 2187965 - RNA, 21 nt, Streptococcus pneumoniae R6
uagggugacaguaaaaaauca

SEQ ID NO: 2187966 - RNA, 13 nt, Streptococcus pneumoniae R6
uagggaguuuaga

SEQ ID NO: 2187967 - RNA, 17 nt, Streptococcus pneumoniae R6
uagggcaugccaaucga

SEQ ID NO: 2187968 - RNA, 14 nt, Streptococcus pneumoniae R6
uaggcgcuucacua

SEQ ID NO: 2187969 - RNA, 18 nt, Streptococcus pneumoniae R6
uaggauauuuuuguaggc

SEQ ID NO: 2187970 - RNA, 18 nt, Streptococcus pneumoniae R6
uaggaucaugagccacaa

SEQ ID NO: 2187971 - RNA, 15 nt, Streptococcus pneumoniae R6
uaggauagauaccuu

SEQ ID NO: 2187972 - RNA, 18 nt, Streptococcus pneumoniae R6
uaggaaaggaaaauugau

SEQ ID NO: 2187973 - RNA, 17 nt, Streptococcus pneumoniae R6
uaggaauauuauauaaa

SEQ ID NO: 2187974 - RNA, 19 nt, Streptococcus pneumoniae R6
uaggaagguuauuuggauu

SEQ ID NO: 2187975 - RNA, 19 nt, Streptococcus pneumoniae R6
uaggaagauuuuuuggauu

SEQ ID NO: 2187976 - RNA, 14 nt, Streptococcus pneumoniae R6
uagacagaaaaaau

SEQ ID NO: 2187977 - RNA, 18 nt, Streptococcus pneumoniae R6
uagacagaaaaaaucuaa

SEQ ID NO: 2187978 - RNA, 14 nt, Streptococcus pneumoniae R6
uagacaauuuucau

SEQ ID NO: 2187979 - RNA, 13 nt, Streptococcus pneumoniae R6
uagacacaauggu

SEQ ID NO: 2187980 - RNA, 20 nt, Streptococcus pneumoniae R6
uagacacaaugguuagaaaa

SEQ ID NO: 2187981 - RNA, 12 nt, Streptococcus pneumoniae R6
uagacauuuucu

SEQ ID NO: 2187982 - RNA, 17 nt, Streptococcus pneumoniae R6
uagacauuuucugugua

SEQ ID NO: 2187983 - RNA, 13 nt, Streptococcus pneumoniae R6
uagaccaagagac

SEQ ID NO: 2187984 - RNA, 19 nt, Streptococcus pneumoniae R6
uagaccaaguucuuuucau

SEQ ID NO: 2187985 - RNA, 15 nt, Streptococcus pneumoniae R6
uagaccugaucaaag

SEQ ID NO: 2187986 - RNA, 13 nt, Streptococcus pneumoniae R6
uagaccugccaug

SEQ ID NO: 2187987 - RNA, 18 nt, Streptococcus pneumoniae R6
uagacccuuguuucuaaa

SEQ ID NO: 2187988 - RNA, 13 nt, Streptococcus pneumoniae R6
uagacuaacuucu

SEQ ID NO: 2187989 - RNA, 21 nt, Streptococcus pneumoniae R6
uagacuaacuucuuauuagca

SEQ ID NO: 2187990 - RNA, 15 nt, Streptococcus pneumoniae R6
uagacuauaacagag

SEQ ID NO: 2187991 - RNA, 22 nt, Streptococcus pneumoniae R6
uagacuauaacagagaagaaau

SEQ ID NO: 2187992 - RNA, 14 nt, Streptococcus pneumoniae R6
uagacuauauugau

SEQ ID NO: 2187993 - RNA, 22 nt, Streptococcus pneumoniae R6
uagacuauauugauuauuacaa

SEQ ID NO: 2187994 - RNA, 19 nt, Streptococcus pneumoniae R6
uagacucuuauuucucaac

SEQ ID NO: 2187995 - RNA, 17 nt, Streptococcus pneumoniae R6
uagacugaaucuaaaau

SEQ ID NO: 2187996 - RNA, 23 nt, Streptococcus pneumoniae R6
uagacugauuaaauagagccuuc

SEQ ID NO: 2187997 - RNA, 17 nt, Streptococcus pneumoniae R6
uagagaagccaagagua

SEQ ID NO: 2187998 - RNA, 21 nt, Streptococcus pneumoniae R6
uagagacauaaucaagaugaa

SEQ ID NO: 2187999 - RNA, 16 nt, Streptococcus pneumoniae R6
uagagaaagaaaaacu

SEQ ID NO: 2188000 - RNA, 16 nt, Streptococcus pneumoniae R6
uagacuugaccgcaga

SEQ ID NO: 2188001 - RNA, 22 nt, Streptococcus pneumoniae R6
uagacuugaccgcagauuuaac

SEQ ID NO: 2188002 - RNA, 19 nt, Streptococcus pneumoniae R6
uagagcuaacuuuuccuua

SEQ ID NO: 2188003 - RNA, 18 nt, Streptococcus pneumoniae R6
uagagcggacuaggcggc

SEQ ID NO: 2188004 - RNA, 23 nt, Streptococcus pneumoniae R6
uagagcugauagugauguuucaa

SEQ ID NO: 2188005 - RNA, 18 nt, Streptococcus pneumoniae R6
uagagauaccuuuuccuu

SEQ ID NO: 2188006 - RNA, 22 nt, Streptococcus pneumoniae R6
uagagauagaaggucaagagaa

SEQ ID NO: 2188007 - RNA, 15 nt, Streptococcus pneumoniae R6
uagagauaaguggca

SEQ ID NO: 2188008 - RNA, 16 nt, Streptococcus pneumoniae R6
uagagaguucugaaau

SEQ ID NO: 2188009 - RNA, 19 nt, Streptococcus pneumoniae R6
uagagagggucucccagga

SEQ ID NO: 2188010 - RNA, 20 nt, Streptococcus pneumoniae R6
uagauaaauguugaauaguu

SEQ ID NO: 2188011 - RNA, 20 nt, Streptococcus pneumoniae R6
uagauaacaccguucuaaau

SEQ ID NO: 2188012 - RNA, 21 nt, Streptococcus pneumoniae R6
uagauaacaccguucuaaauu

SEQ ID NO: 2188013 - RNA, 18 nt, Streptococcus pneumoniae R6
uagauaaaggccaagucc

SEQ ID NO: 2188014 - RNA, 13 nt, Streptococcus pneumoniae R6
uagauaauuuaaa

SEQ ID NO: 2188015 - RNA, 15 nt, Streptococcus pneumoniae R6
uagauagaacugacg

SEQ ID NO: 2188016 - RNA, 20 nt, Streptococcus pneumoniae R6
uagauagcaucgguaagaaa

SEQ ID NO: 2188017 - RNA, 16 nt, Streptococcus pneumoniae R6
uagauacaccaucccu

SEQ ID NO: 2188018 - RNA, 20 nt, Streptococcus pneumoniae R6
uagauaccugguucagcaga

SEQ ID NO: 2188019 - RNA, 23 nt, Streptococcus pneumoniae R6
uagaguccaagauucaacaucac

SEQ ID NO: 2188020 - RNA, 20 nt, Streptococcus pneumoniae R6
uagagguuauucaaaaacau

SEQ ID NO: 2188021 - RNA, 23 nt, Streptococcus pneumoniae R6
uagaguugcagggcuauuuggcu

SEQ ID NO: 2188022 - RNA, 13 nt, Streptococcus pneumoniae R6
uagauaaaaaaca

SEQ ID NO: 2188023 - RNA, 12 nt, Streptococcus pneumoniae R6
uagaguuagagc

SEQ ID NO: 2188024 - RNA, 16 nt, Streptococcus pneumoniae R6
uagaguucguaguaaa

SEQ ID NO: 2188025 - RNA, 21 nt, Streptococcus pneumoniae R6
uagaaagucauuuguuuagug

SEQ ID NO: 2188026 - RNA, 12 nt, Streptococcus pneumoniae R6
uagaaauaaaac

SEQ ID NO: 2188027 - RNA, 21 nt, Streptococcus pneumoniae R6
uagaaauaucugcacucucau

SEQ ID NO: 2188028 - RNA, 22 nt, Streptococcus pneumoniae R6
uagaaauauuuuagcagucaag

SEQ ID NO: 2188029 - RNA, 20 nt, Streptococcus pneumoniae R6
uagaaauagggauuaauaau

SEQ ID NO: 2188030 - RNA, 13 nt, Streptococcus pneumoniae R6
uagaaauuaauuu

SEQ ID NO: 2188031 - RNA, 18 nt, Streptococcus pneumoniae R6
uagaaauuaauuuuacuu

SEQ ID NO: 2188032 - RNA, 23 nt, Streptococcus pneumoniae R6
uagaaauuaauuuuacuuuccug

SEQ ID NO: 2188033 - RNA, 20 nt, Streptococcus pneumoniae R6
uagaaaucucuuuuuucucc

SEQ ID NO: 2188034 - RNA, 21 nt, Streptococcus pneumoniae R6
uagaaaugcgccaccaacugc

SEQ ID NO: 2188035 - RNA, 13 nt, Streptococcus pneumoniae R6
uagaaaucgauuu

SEQ ID NO: 2188036 - RNA, 21 nt, Streptococcus pneumoniae R6
uagaaccgaaaaucuccucua

SEQ ID NO: 2188037 - RNA, 17 nt, Streptococcus pneumoniae R6
uagaaauuuugaaauaa

SEQ ID NO: 2188038 - RNA, 16 nt, Streptococcus pneumoniae R6
uagaacaccaaagccc

SEQ ID NO: 2188039 - RNA, 22 nt, Streptococcus pneumoniae R6
uacuaguucucaaauuuucaua

SEQ ID NO: 2188040 - RNA, 19 nt, Streptococcus pneumoniae R6
uacuauaguuugcaaauua

SEQ ID NO: 2188041 - RNA, 22 nt, Streptococcus pneumoniae R6
uacuauacuuuuuuaauuuaau

SEQ ID NO: 2188042 - RNA, 12 nt, Streptococcus pneumoniae R6
uacuauaagacu

SEQ ID NO: 2188043 - RNA, 20 nt, Streptococcus pneumoniae R6
uacuauaagacuccucuuua

SEQ ID NO: 2188044 - RNA, 14 nt, Streptococcus pneumoniae R6
uacuagauucuauu

SEQ ID NO: 2188045 - RNA, 14 nt, Streptococcus pneumoniae R6
uacuacuuuuguca

SEQ ID NO: 2188046 - RNA, 14 nt, Streptococcus pneumoniae R6
uacuagucuuucuu

SEQ ID NO: 2188047 - RNA, 22 nt, Streptococcus pneumoniae R6
uagaaaaugguuccaaaaggca

SEQ ID NO: 2188048 - RNA, 18 nt, Streptococcus pneumoniae R6
uagaaaccagcuaccaga

SEQ ID NO: 2188049 - RNA, 20 nt, Streptococcus pneumoniae R6
uagaaacguuguuaaaucaa

SEQ ID NO: 2188050 - RNA, 21 nt, Streptococcus pneumoniae R6
uagaaacguuguuaaaucaac

SEQ ID NO: 2188051 - RNA, 16 nt, Streptococcus pneumoniae R6
uacuaugcguuuuaau

SEQ ID NO: 2188052 - RNA, 17 nt, Streptococcus pneumoniae R6
uacuaugcguuuuaaug

SEQ ID NO: 2188053 - RNA, 17 nt, Streptococcus pneumoniae R6
uacuaugcuuuuuucua

SEQ ID NO: 2188054 - RNA, 18 nt, Streptococcus pneumoniae R6
uagaagcuucuuggaauu

SEQ ID NO: 2188055 - RNA, 15 nt, Streptococcus pneumoniae R6
uagaaggcaauuaaa

SEQ ID NO: 2188056 - RNA, 17 nt, Streptococcus pneumoniae R6
uagaaggucaagagaaa

SEQ ID NO: 2188057 - RNA, 17 nt, Streptococcus pneumoniae R6
uagaagucucagugggc

SEQ ID NO: 2188058 - RNA, 17 nt, Streptococcus pneumoniae R6
uagaaguggauuuucuu

SEQ ID NO: 2188059 - RNA, 15 nt, Streptococcus pneumoniae R6
uagaaguugcuacga

SEQ ID NO: 2188060 - RNA, 18 nt, Streptococcus pneumoniae R6
uagaauagaaacaaaaua

SEQ ID NO: 2188061 - RNA, 21 nt, Streptococcus pneumoniae R6
uagaauagaaacaaaauauau

SEQ ID NO: 2188062 - RNA, 23 nt, Streptococcus pneumoniae R6
uagaagcaagacaaaaacucaau

SEQ ID NO: 2188063 - RNA, 18 nt, Streptococcus pneumoniae R6
uagaagaacaauccaaau

SEQ ID NO: 2188064 - RNA, 17 nt, Streptococcus pneumoniae R6
uagaagagguaucugua

SEQ ID NO: 2188065 - RNA, 14 nt, Streptococcus pneumoniae R6
uagaacuuccguau

SEQ ID NO: 2188066 - RNA, 19 nt, Streptococcus pneumoniae R6
uagaacugacgaaaucagu

SEQ ID NO: 2188067 - RNA, 19 nt, Streptococcus pneumoniae R6
uagaacugacgaagucagc

SEQ ID NO: 2188068 - RNA, 15 nt, Streptococcus pneumoniae R6
uagaacuaguaaauu

SEQ ID NO: 2188069 - RNA, 19 nt, Streptococcus pneumoniae R6
uagaaugcuuuuugaaagc

SEQ ID NO: 2188070 - RNA, 22 nt, Streptococcus pneumoniae R6
uagaaugcuuuuugaaagcaga

SEQ ID NO: 2188071 - RNA, 12 nt, Streptococcus pneumoniae R6
uagaauuucuuu

SEQ ID NO: 2188072 - RNA, 17 nt, Streptococcus pneumoniae R6
uagacaaaaucaucagu

SEQ ID NO: 2188073 - RNA, 12 nt, Streptococcus pneumoniae R6
uagaauauguaa

SEQ ID NO: 2188074 - RNA, 23 nt, Streptococcus pneumoniae R6
uagaauaguccacugcaauuucu

SEQ ID NO: 2188075 - RNA, 15 nt, Streptococcus pneumoniae R6
uagaauaguacacuu

SEQ ID NO: 2188076 - RNA, 18 nt, Streptococcus pneumoniae R6
uacagaagacuaggcuug

SEQ ID NO: 2188077 - RNA, 16 nt, Streptococcus pneumoniae R6
uacagaacuaaaucuu

SEQ ID NO: 2188078 - RNA, 15 nt, Streptococcus pneumoniae R6
uacagaaagaacaaa

SEQ ID NO: 2188079 - RNA, 23 nt, Streptococcus pneumoniae R6
uacacaaaauaggcuccauaaua

SEQ ID NO: 2188080 - RNA, 16 nt, Streptococcus pneumoniae R6
uacacuugauuuaucc

SEQ ID NO: 2188081 - RNA, 13 nt, Streptococcus pneumoniae R6
uacacacuuaaau

SEQ ID NO: 2188082 - RNA, 14 nt, Streptococcus pneumoniae R6
uacagauaaaaauc

SEQ ID NO: 2188083 - RNA, 13 nt, Streptococcus pneumoniae R6
uacagauaaaaau

SEQ ID NO: 2188084 - RNA, 14 nt, Streptococcus pneumoniae R6
uacagauuugaaaa

SEQ ID NO: 2188085 - RNA, 14 nt, Streptococcus pneumoniae R6
uacagcaaaaaauu

SEQ ID NO: 2188086 - RNA, 15 nt, Streptococcus pneumoniae R6
uaauugugacucuuu

SEQ ID NO: 2188087 - RNA, 20 nt, Streptococcus pneumoniae R6
uaauuguagcuuuauuaagc

SEQ ID NO: 2188088 - RNA, 13 nt, Streptococcus pneumoniae R6
uacaaauaagaaa

SEQ ID NO: 2188089 - RNA, 20 nt, Streptococcus pneumoniae R6
uacaaauaccauaaacuaag

SEQ ID NO: 2188090 - RNA, 17 nt, Streptococcus pneumoniae R6
uacaaaguauuuuuucu

SEQ ID NO: 2188091 - RNA, 22 nt, Streptococcus pneumoniae R6
uacaaaguauuuuuucuuccca

SEQ ID NO: 2188092 - RNA, 17 nt, Streptococcus pneumoniae R6
uacaacaauaagagaau

SEQ ID NO: 2188093 - RNA, 11 nt, Streptococcus pneumoniae R6
uacaaauuaau

SEQ ID NO: 2188094 - RNA, 17 nt, Streptococcus pneumoniae R6
uacaaaucccaugacaa

SEQ ID NO: 2188095 - RNA, 14 nt, Streptococcus pneumoniae R6
uacaauaacacccu

SEQ ID NO: 2188096 - RNA, 23 nt, Streptococcus pneumoniae R6
uacaauaacacccuuguaaauaa

SEQ ID NO: 2188097 - RNA, 16 nt, Streptococcus pneumoniae R6
uacaaccuuaaaacag

SEQ ID NO: 2188098 - RNA, 19 nt, Streptococcus pneumoniae R6
uacaaccuuaaaacagugu

SEQ ID NO: 2188099 - RNA, 14 nt, Streptococcus pneumoniae R6
uacaaccucaaagc

SEQ ID NO: 2188100 - RNA, 14 nt, Streptococcus pneumoniae R6
uacaauaucuccag

SEQ ID NO: 2188101 - RNA, 22 nt, Streptococcus pneumoniae R6
uacaauauuuguuguccuaaua

SEQ ID NO: 2188102 - RNA, 18 nt, Streptococcus pneumoniae R6
uacaauccugcgaaaucu

SEQ ID NO: 2188103 - RNA, 15 nt, Streptococcus pneumoniae R6
uaccaaaaccuucuu

SEQ ID NO: 2188104 - RNA, 18 nt, Streptococcus pneumoniae R6
uaccaacgcccucacacg

SEQ ID NO: 2188105 - RNA, 22 nt, Streptococcus pneumoniae R6
uaccaacuacuaaaccaauaau

SEQ ID NO: 2188106 - RNA, 23 nt, Streptococcus pneumoniae R6
uaccaacuacuaaaccaauaaua

SEQ ID NO: 2188107 - RNA, 24 nt, Streptococcus pneumoniae R6
uaccaaugcggaccaaauccccau

SEQ ID NO: 2188108 - RNA, 14 nt, Streptococcus pneumoniae R6
uaccaauuuuuccu

SEQ ID NO: 2188109 - RNA, 20 nt, Streptococcus pneumoniae R6
uaccaauuuuuccuuuuccg

SEQ ID NO: 2188110 - RNA, 23 nt, Streptococcus pneumoniae R6
uaccaaguucauuuuuuauggug

SEQ ID NO: 2188111 - RNA, 21 nt, Streptococcus pneumoniae R6
uaccaaggcaucacgaaaaua

SEQ ID NO: 2188112 - RNA, 16 nt, Streptococcus pneumoniae R6
uacauuuuuugaaaua

SEQ ID NO: 2188113 - RNA, 19 nt, Streptococcus pneumoniae R6
uacauuuugauuacacaau

SEQ ID NO: 2188114 - RNA, 21 nt, Streptococcus pneumoniae R6
uacauuuagaaagguaaaaua

SEQ ID NO: 2188115 - RNA, 14 nt, Streptococcus pneumoniae R6
uacauuugaguuuc

SEQ ID NO: 2188116 - RNA, 16 nt, Streptococcus pneumoniae R6
uacauugauugcuuca

SEQ ID NO: 2188117 - RNA, 17 nt, Streptococcus pneumoniae R6
uacauucccaaacaaaa

SEQ ID NO: 2188118 - RNA, 19 nt, Streptococcus pneumoniae R6
uacauucuuuuuaaggagu

SEQ ID NO: 2188119 - RNA, 17 nt, Streptococcus pneumoniae R6
uacauugaaauuaaaau

SEQ ID NO: 2188120 - RNA, 22 nt, Streptococcus pneumoniae R6
uacaugcaaaguaaaguaagga

SEQ ID NO: 2188121 - RNA, 15 nt, Streptococcus pneumoniae R6
uacaugcgcaaaaua

SEQ ID NO: 2188122 - RNA, 17 nt, Streptococcus pneumoniae R6
uacaugcgcaaaauaau

SEQ ID NO: 2188123 - RNA, 14 nt, Streptococcus pneumoniae R6
uacaugucaggguu

SEQ ID NO: 2188124 - RNA, 20 nt, Streptococcus pneumoniae R6
uacaucauugucaaacaaga

SEQ ID NO: 2188125 - RNA, 19 nt, Streptococcus pneumoniae R6
uacauccaccagcuauuaa

SEQ ID NO: 2188126 - RNA, 14 nt, Streptococcus pneumoniae R6
uacauaguuucaua

SEQ ID NO: 2188127 - RNA, 12 nt, Streptococcus pneumoniae R6
uacaucaagcuc

SEQ ID NO: 2188128 - RNA, 17 nt, Streptococcus pneumoniae R6
uacaucaagcucaucua

SEQ ID NO: 2188129 - RNA, 18 nt, Streptococcus pneumoniae R6
uacaucaaaaucacagac

SEQ ID NO: 2188130 - RNA, 20 nt, Streptococcus pneumoniae R6
uacaucaaaaucacagaccg

SEQ ID NO: 2188131 - RNA, 17 nt, Streptococcus pneumoniae R6
uacaggcaugggcaggg

SEQ ID NO: 2188132 - RNA, 17 nt, Streptococcus pneumoniae R6
uaccgucgacugcaguc

SEQ ID NO: 2188133 - RNA, 20 nt, Streptococcus pneumoniae R6
uaccguucauauccguucca

SEQ ID NO: 2188134 - RNA, 16 nt, Streptococcus pneumoniae R6
uaccggagaaauauug

SEQ ID NO: 2188135 - RNA, 19 nt, Streptococcus pneumoniae R6
uaccggagaaauauuguuu

SEQ ID NO: 2188136 - RNA, 16 nt, Streptococcus pneumoniae R6
uaccgaccuugucucc

SEQ ID NO: 2188137 - RNA, 15 nt, Streptococcus pneumoniae R6
uaccugauaagauuu

SEQ ID NO: 2188138 - RNA, 15 nt, Streptococcus pneumoniae R6
uaccugcuccaaaua

SEQ ID NO: 2188139 - RNA, 21 nt, Streptococcus pneumoniae R6
uaccugcucgccccauuucuu

SEQ ID NO: 2188140 - RNA, 19 nt, Streptococcus pneumoniae R6
uaccuaaaaaggaaccagu

SEQ ID NO: 2188141 - RNA, 15 nt, Streptococcus pneumoniae R6
uaccucauaucucuu

SEQ ID NO: 2188142 - RNA, 13 nt, Streptococcus pneumoniae R6
uaccacaggagcu

SEQ ID NO: 2188143 - RNA, 20 nt, Streptococcus pneumoniae R6
uaccaccaacaugucgcugc

SEQ ID NO: 2188144 - RNA, 15 nt, Streptococcus pneumoniae R6
uaccaccaaguacag

SEQ ID NO: 2188145 - RNA, 22 nt, Streptococcus pneumoniae R6
uaccauauccuuucaguagaua

SEQ ID NO: 2188146 - RNA, 17 nt, Streptococcus pneumoniae R6
uaccauaaacuaagcuu

SEQ ID NO: 2188147 - RNA, 21 nt, Streptococcus pneumoniae R6
uaccauaauaaaagugucuua

SEQ ID NO: 2188148 - RNA, 18 nt, Streptococcus pneumoniae R6
uaccaucuuuaggaucau

SEQ ID NO: 2188149 - RNA, 22 nt, Streptococcus pneumoniae R6
uaccauccugaauagugaagau

SEQ ID NO: 2188150 - RNA, 23 nt, Streptococcus pneumoniae R6
uaccauccugaauagugaagaua

SEQ ID NO: 2188151 - RNA, 16 nt, Streptococcus pneumoniae R6
uaccaucauaggcuuu

SEQ ID NO: 2188152 - RNA, 20 nt, Streptococcus pneumoniae R6
uaccauugacuuggaaccag

SEQ ID NO: 2188153 - RNA, 13 nt, Streptococcus pneumoniae R6
uaccauucuucau

SEQ ID NO: 2188154 - RNA, 18 nt, Streptococcus pneumoniae R6
uacccaugcuuuucuauu

SEQ ID NO: 2188155 - RNA, 14 nt, Streptococcus pneumoniae R6
uacgcccuccauua

SEQ ID NO: 2188156 - RNA, 16 nt, Streptococcus pneumoniae R6
uacgcccuccauuaug

SEQ ID NO: 2188157 - RNA, 22 nt, Streptococcus pneumoniae R6
uacgauucauaguuacuccuuu

SEQ ID NO: 2188158 - RNA, 23 nt, Streptococcus pneumoniae R6
uacgauucauaguuacuccuuuu

SEQ ID NO: 2188159 - RNA, 16 nt, Streptococcus pneumoniae R6
uacgauucccacaagg

SEQ ID NO: 2188160 - RNA, 19 nt, Streptococcus pneumoniae R6
uacgauucccacaagggau

SEQ ID NO: 2188161 - RNA, 14 nt, Streptococcus pneumoniae R6
uaccuguuaagccu

SEQ ID NO: 2188162 - RNA, 22 nt, Streptococcus pneumoniae R6
uaccuggcaauacuucaacaaa

SEQ ID NO: 2188163 - RNA, 16 nt, Streptococcus pneumoniae R6
uaccuuaagcauggca

SEQ ID NO: 2188164 - RNA, 13 nt, Streptococcus pneumoniae R6
uaccuuaauucuc

SEQ ID NO: 2188165 - RNA, 15 nt, Streptococcus pneumoniae R6
uaccuuaauucucuu

SEQ ID NO: 2188166 - RNA, 19 nt, Streptococcus pneumoniae R6
uacgaccaaucuuuuccaa

SEQ ID NO: 2188167 - RNA, 15 nt, Streptococcus pneumoniae R6
uacgacaccugacaa

SEQ ID NO: 2188168 - RNA, 14 nt, Streptococcus pneumoniae R6
uacgguaaggcgac

SEQ ID NO: 2188169 - RNA, 18 nt, Streptococcus pneumoniae R6
uacggucaaagucauaga

SEQ ID NO: 2188170 - RNA, 15 nt, Streptococcus pneumoniae R6
uacuaauuaauuaac

SEQ ID NO: 2188171 - RNA, 17 nt, Streptococcus pneumoniae R6
uacuaaggaaagucaaa

SEQ ID NO: 2188172 - RNA, 18 nt, Streptococcus pneumoniae R6
uacuaaggcccaauuaaa

SEQ ID NO: 2188173 - RNA, 21 nt, Streptococcus pneumoniae R6
uacuacuaucccuuuaccauu

SEQ ID NO: 2188174 - RNA, 13 nt, Streptococcus pneumoniae R6
uaauacauuuugu

SEQ ID NO: 2188175 - RNA, 17 nt, Streptococcus pneumoniae R6
uaauaccuaccagagga

SEQ ID NO: 2188176 - RNA, 22 nt, Streptococcus pneumoniae R6
uaauacucugugaaaaucauag

SEQ ID NO: 2188177 - RNA, 20 nt, Streptococcus pneumoniae R6
uaauacucaaugaaaaucaa

SEQ ID NO: 2188178 - RNA, 20 nt, Streptococcus pneumoniae R6
uaauacuguggaauauagag

SEQ ID NO: 2188179 - RNA, 21 nt, Streptococcus pneumoniae R6
uaauagaaauuuugaaauaau

SEQ ID NO: 2188180 - RNA, 22 nt, Streptococcus pneumoniae R6
uaauagaaauuuugaaauaauc

SEQ ID NO: 2188181 - RNA, 14 nt, Streptococcus pneumoniae R6
uaauagaaaacaga

SEQ ID NO: 2188182 - RNA, 20 nt, Streptococcus pneumoniae R6
uaauaauuuucacaaacaaa

SEQ ID NO: 2188183 - RNA, 12 nt, Streptococcus pneumoniae R6
uaauacaaaaaa

SEQ ID NO: 2188184 - RNA, 15 nt, Streptococcus pneumoniae R6
uaauacaaaaaauag

SEQ ID NO: 2188185 - RNA, 13 nt, Streptococcus pneumoniae R6
uaauacaauugcu

SEQ ID NO: 2188186 - RNA, 14 nt, Streptococcus pneumoniae R6
uaauacacuucuac

SEQ ID NO: 2188187 - RNA, 23 nt, Streptococcus pneumoniae R6
uaauaaugaagacaucauauaaa

SEQ ID NO: 2188188 - RNA, 18 nt, Streptococcus pneumoniae R6
uaauaauuucaaaaucuu

SEQ ID NO: 2188189 - RNA, 17 nt, Streptococcus pneumoniae R6
uaauaagcuuugaaaau

SEQ ID NO: 2188190 - RNA, 21 nt, Streptococcus pneumoniae R6
uaauaagcuuugaaaauucca

SEQ ID NO: 2188191 - RNA, 13 nt, Streptococcus pneumoniae R6
uaauaacucucau

SEQ ID NO: 2188192 - RNA, 16 nt, Streptococcus pneumoniae R6
uaauaacucucaucua

SEQ ID NO: 2188193 - RNA, 17 nt, Streptococcus pneumoniae R6
uaauaacucucaucuau

SEQ ID NO: 2188194 - RNA, 13 nt, Streptococcus pneumoniae R6
uaauaaaaugaaa

SEQ ID NO: 2188195 - RNA, 21 nt, Streptococcus pneumoniae R6
uaauaaaaugaaauaagaaua

SEQ ID NO: 2188196 - RNA, 20 nt, Streptococcus pneumoniae R6
uaauaaagacacuaagaaga

SEQ ID NO: 2188197 - RNA, 23 nt, Streptococcus pneumoniae R6
uaauaaacuggguugaagauuuc

SEQ ID NO: 2188198 - RNA, 21 nt, Streptococcus pneumoniae R6
uaaguuuuuccaucuuuuauu

SEQ ID NO: 2188199 - RNA, 19 nt, Streptococcus pneumoniae R6
uaaguuuuguuugucaguu

SEQ ID NO: 2188200 - RNA, 19 nt, Streptococcus pneumoniae R6
uaaguuuauaucuaauaau

SEQ ID NO: 2188201 - RNA, 15 nt, Streptococcus pneumoniae R6
uaaguuucuucuuua

SEQ ID NO: 2188202 - RNA, 23 nt, Streptococcus pneumoniae R6
uaaguuguaguacugaacaauga

SEQ ID NO: 2188203 - RNA, 13 nt, Streptococcus pneumoniae R6
uaaguucuuuuug

SEQ ID NO: 2188204 - RNA, 22 nt, Streptococcus pneumoniae R6
uaaguuauuucuccuaaagaaa

SEQ ID NO: 2188205 - RNA, 16 nt, Streptococcus pneumoniae R6
uaaguucacuugagca

SEQ ID NO: 2188206 - RNA, 14 nt, Streptococcus pneumoniae R6
uaaguguuaugaau

SEQ ID NO: 2188207 - RNA, 19 nt, Streptococcus pneumoniae R6
uaaguuaaauuauuaaaau

SEQ ID NO: 2188208 - RNA, 14 nt, Streptococcus pneumoniae R6
uaaguuagaauaag

SEQ ID NO: 2188209 - RNA, 12 nt, Streptococcus pneumoniae R6
uaagugauuuaa

SEQ ID NO: 2188210 - RNA, 21 nt, Streptococcus pneumoniae R6
uaagugcguugauaaucuuau

SEQ ID NO: 2188211 - RNA, 22 nt, Streptococcus pneumoniae R6
uaaguggguggguaaaggaaag

SEQ ID NO: 2188212 - RNA, 19 nt, Streptococcus pneumoniae R6
uaagugguaucgcuagacu

SEQ ID NO: 2188213 - RNA, 21 nt, Streptococcus pneumoniae R6
uaagucaugcaaaaaaaauga

SEQ ID NO: 2188214 - RNA, 23 nt, Streptococcus pneumoniae R6
uaagucaugagaguuuuuggcau

SEQ ID NO: 2188215 - RNA, 14 nt, Streptococcus pneumoniae R6
uaagucauaacauu

SEQ ID NO: 2188216 - RNA, 12 nt, Streptococcus pneumoniae R6
uaagucaacauc

SEQ ID NO: 2188217 - RNA, 15 nt, Streptococcus pneumoniae R6
uaagucaacaucucu

SEQ ID NO: 2188218 - RNA, 17 nt, Streptococcus pneumoniae R6
uaagucauuuucuuuua

SEQ ID NO: 2188219 - RNA, 18 nt, Streptococcus pneumoniae R6
uaagucauuuucuuuuac

SEQ ID NO: 2188220 - RNA, 16 nt, Streptococcus pneumoniae R6
uaagguuguagaugga

SEQ ID NO: 2188221 - RNA, 19 nt, Streptococcus pneumoniae R6
uaagguuuuaccuucaagu

SEQ ID NO: 2188222 - RNA, 23 nt, Streptococcus pneumoniae R6
uaagguuuuaccuucaaguuguu

SEQ ID NO: 2188223 - RNA, 15 nt, Streptococcus pneumoniae R6
uaagguucaaaaaau

SEQ ID NO: 2188224 - RNA, 12 nt, Streptococcus pneumoniae R6
uaagguugcaua

SEQ ID NO: 2188225 - RNA, 16 nt, Streptococcus pneumoniae R6
uaagguaccuccuaau

SEQ ID NO: 2188226 - RNA, 22 nt, Streptococcus pneumoniae R6
uaagguaggagugaaaaacuag

SEQ ID NO: 2188227 - RNA, 18 nt, Streptococcus pneumoniae R6
uaaggucauuugaaucau

SEQ ID NO: 2188228 - RNA, 21 nt, Streptococcus pneumoniae R6
uaaguaaguacaugcaaagua

SEQ ID NO: 2188229 - RNA, 16 nt, Streptococcus pneumoniae R6
uaaguaccgacuucug

SEQ ID NO: 2188230 - RNA, 21 nt, Streptococcus pneumoniae R6
uaaguauagacgaaaagucau

SEQ ID NO: 2188231 - RNA, 14 nt, Streptococcus pneumoniae R6
uaaguaguaaccac

SEQ ID NO: 2188232 - RNA, 16 nt, Streptococcus pneumoniae R6
uaaguaguaaccaccu

SEQ ID NO: 2188233 - RNA, 21 nt, Streptococcus pneumoniae R6
uaaggauauucagaaaucuag

SEQ ID NO: 2188234 - RNA, 21 nt, Streptococcus pneumoniae R6
uaaggacuuccgccaucuugu

SEQ ID NO: 2188235 - RNA, 20 nt, Streptococcus pneumoniae R6
uaaggacacgcuucuuuaug

SEQ ID NO: 2188236 - RNA, 21 nt, Streptococcus pneumoniae R6
uaaggacaggugcuuaaauag

SEQ ID NO: 2188237 - RNA, 22 nt, Streptococcus pneumoniae R6
uaaggacaggugcuuaaauagg

SEQ ID NO: 2188238 - RNA, 18 nt, Streptococcus pneumoniae R6
uaaggaggcaaagaaaaa

SEQ ID NO: 2188239 - RNA, 18 nt, Streptococcus pneumoniae R6
uaaggcacuagcuccaaa

SEQ ID NO: 2188240 - RNA, 22 nt, Streptococcus pneumoniae R6
uaaggcacuagcuccaaacaua

SEQ ID NO: 2188241 - RNA, 14 nt, Streptococcus pneumoniae R6
uaaggcucauuagu

SEQ ID NO: 2188242 - RNA, 19 nt, Streptococcus pneumoniae R6
uaagggaaaaguggucugg

SEQ ID NO: 2188243 - RNA, 15 nt, Streptococcus pneumoniae R6
uaaucaauuaucauu

SEQ ID NO: 2188244 - RNA, 19 nt, Streptococcus pneumoniae R6
uaaucaauuaucauuucca

SEQ ID NO: 2188245 - RNA, 15 nt, Streptococcus pneumoniae R6
uaaucaauauagaag

SEQ ID NO: 2188246 - RNA, 18 nt, Streptococcus pneumoniae R6
uaaucaaucguuucaagu

SEQ ID NO: 2188247 - RNA, 15 nt, Streptococcus pneumoniae R6
uaaucauaagcaacu

SEQ ID NO: 2188248 - RNA, 12 nt, Streptococcus pneumoniae R6
uaaucauacaca

SEQ ID NO: 2188249 - RNA, 19 nt, Streptococcus pneumoniae R6
uaauagcagaaaaaugaca

SEQ ID NO: 2188250 - RNA, 16 nt, Streptococcus pneumoniae R6
uaauagcgauagaugu

SEQ ID NO: 2188251 - RNA, 19 nt, Streptococcus pneumoniae R6
uaauagcgaugaagagaga

SEQ ID NO: 2188252 - RNA, 15 nt, Streptococcus pneumoniae R6
uaauauguaaagagu

SEQ ID NO: 2188253 - RNA, 15 nt, Streptococcus pneumoniae R6
uaauauguauuuaua

SEQ ID NO: 2188254 - RNA, 18 nt, Streptococcus pneumoniae R6
uaaucaaaauauguuuuc

SEQ ID NO: 2188255 - RNA, 19 nt, Streptococcus pneumoniae R6
uaaucaaaauauguuuucu

SEQ ID NO: 2188256 - RNA, 13 nt, Streptococcus pneumoniae R6
uaaucaaaacuau

SEQ ID NO: 2188257 - RNA, 21 nt, Streptococcus pneumoniae R6
uaauauuacuucuaaaacauu

SEQ ID NO: 2188258 - RNA, 23 nt, Streptococcus pneumoniae R6
uaauccccauuugcuucaucauu

SEQ ID NO: 2188259 - RNA, 20 nt, Streptococcus pneumoniae R6
uaaucgcuggcauuucccau

SEQ ID NO: 2188260 - RNA, 16 nt, Streptococcus pneumoniae R6
uaaucguuuaaaacac

SEQ ID NO: 2188261 - RNA, 20 nt, Streptococcus pneumoniae R6
uaaucguuuaaaacaccuuc

SEQ ID NO: 2188262 - RNA, 18 nt, Streptococcus pneumoniae R6
uaaucugcaccugauuuc

SEQ ID NO: 2188263 - RNA, 19 nt, Streptococcus pneumoniae R6
uaaucugaauguuucccuu

SEQ ID NO: 2188264 - RNA, 22 nt, Streptococcus pneumoniae R6
uaaucugaauguuucccuugcu

SEQ ID NO: 2188265 - RNA, 17 nt, Streptococcus pneumoniae R6
uaaucucuagccccucu

SEQ ID NO: 2188266 - RNA, 15 nt, Streptococcus pneumoniae R6
uaaucuucaaauuuu

SEQ ID NO: 2188267 - RNA, 12 nt, Streptococcus pneumoniae R6
uaaucuuaucuc

SEQ ID NO: 2188268 - RNA, 22 nt, Streptococcus pneumoniae R6
uaaucuggucuuaagacaccug

SEQ ID NO: 2188269 - RNA, 16 nt, Streptococcus pneumoniae R6
uaauggauugaaauaa

SEQ ID NO: 2188270 - RNA, 17 nt, Streptococcus pneumoniae R6
uaaucuugacaaucuuu

SEQ ID NO: 2188271 - RNA, 20 nt, Streptococcus pneumoniae R6
uaaucuugacuauauuucuu

SEQ ID NO: 2188272 - RNA, 18 nt, Streptococcus pneumoniae R6
uaaugucucugcuauuuc

SEQ ID NO: 2188273 - RNA, 22 nt, Streptococcus pneumoniae R6
uaauguucuucggcuuccuuaa

SEQ ID NO: 2188274 - RNA, 18 nt, Streptococcus pneumoniae R6
uaauguuaaccacaaaaa

SEQ ID NO: 2188275 - RNA, 13 nt, Streptococcus pneumoniae R6
uaauuagaaaaaa

SEQ ID NO: 2188276 - RNA, 14 nt, Streptococcus pneumoniae R6
uaauuagaaaaaaa

SEQ ID NO: 2188277 - RNA, 18 nt, Streptococcus pneumoniae R6
uaauuguaaacaaaaauc

SEQ ID NO: 2188278 - RNA, 13 nt, Streptococcus pneumoniae R6
uaauugguugaga

SEQ ID NO: 2188279 - RNA, 15 nt, Streptococcus pneumoniae R6
uaauugguacauuuu

SEQ ID NO: 2188280 - RNA, 19 nt, Streptococcus pneumoniae R6
uaauugguacauuuugauu

SEQ ID NO: 2188281 - RNA, 18 nt, Streptococcus pneumoniae R6
uaauugggccuuaguaaa

SEQ ID NO: 2188282 - RNA, 16 nt, Streptococcus pneumoniae R6
uaauuggaaaauaaau

SEQ ID NO: 2188283 - RNA, 21 nt, Streptococcus pneumoniae R6
uaauugcgcggguucaauaca

SEQ ID NO: 2188284 - RNA, 22 nt, Streptococcus pneumoniae R6
uaauugcgcggguucaauacaa

SEQ ID NO: 2188285 - RNA, 14 nt, Streptococcus pneumoniae R6
uaauugacgaagaa

SEQ ID NO: 2188286 - RNA, 19 nt, Streptococcus pneumoniae R6
uaauugacgaagaaaccaa

SEQ ID NO: 2188287 - RNA, 14 nt, Streptococcus pneumoniae R6
uaauucuucauaga

SEQ ID NO: 2188288 - RNA, 13 nt, Streptococcus pneumoniae R6
uaauucauaugga

SEQ ID NO: 2188289 - RNA, 14 nt, Streptococcus pneumoniae R6
uaauuccacacaga

SEQ ID NO: 2188290 - RNA, 18 nt, Streptococcus pneumoniae R6
uaauuagucguaaauaau

SEQ ID NO: 2188291 - RNA, 15 nt, Streptococcus pneumoniae R6
ggcuuuuucucaucu

SEQ ID NO: 2188292 - RNA, 22 nt, Streptococcus pneumoniae R6
gggaaaaauuuucaaaaucaga

SEQ ID NO: 2188293 - RNA, 12 nt, Streptococcus pneumoniae R6
ggcuuccugugc

SEQ ID NO: 2188294 - RNA, 12 nt, Streptococcus pneumoniae R6
ggcuguguagau

SEQ ID NO: 2188295 - RNA, 16 nt, Streptococcus pneumoniae R6
ggcuguguagaugaga

SEQ ID NO: 2188296 - RNA, 19 nt, Streptococcus pneumoniae R6
ggcuguuucaaaugaaaua

SEQ ID NO: 2188297 - RNA, 16 nt, Streptococcus pneumoniae R6
ggcuguuuuggcaacg

SEQ ID NO: 2188298 - RNA, 15 nt, Streptococcus pneumoniae R6
ggcuguaguuuuacc

SEQ ID NO: 2188299 - RNA, 18 nt, Streptococcus pneumoniae R6
ggcugaauauauucucca

SEQ ID NO: 2188300 - RNA, 19 nt, Streptococcus pneumoniae R6
ggcugaauauauucuccag

SEQ ID NO: 2188301 - RNA, 15 nt, Streptococcus pneumoniae R6
ggcugacaauaaaga

SEQ ID NO: 2188302 - RNA, 20 nt, Streptococcus pneumoniae R6
ggcugaaacugcguuuugau

SEQ ID NO: 2188303 - RNA, 21 nt, Streptococcus pneumoniae R6
ggcugacgcgaucuggcaggc

SEQ ID NO: 2188304 - RNA, 15 nt, Streptococcus pneumoniae R6
ggcugagaaggcugg

SEQ ID NO: 2188305 - RNA, 20 nt, Streptococcus pneumoniae R6
ggcuccguuuuggacgucuu

SEQ ID NO: 2188306 - RNA, 23 nt, Streptococcus pneumoniae R6
ggcuauuuuaggaaacucuuaca

SEQ ID NO: 2188307 - RNA, 16 nt, Streptococcus pneumoniae R6
ggcucauguaaaucau

SEQ ID NO: 2188308 - RNA, 16 nt, Streptococcus pneumoniae R6
ggcucauaaauggagc

SEQ ID NO: 2188309 - RNA, 18 nt, Streptococcus pneumoniae R6
gggcuuuucuaucacucc

SEQ ID NO: 2188310 - RNA, 22 nt, Streptococcus pneumoniae R6
gggcugcguugaggacagguau

SEQ ID NO: 2188311 - RNA, 20 nt, Streptococcus pneumoniae R6
gggcugcucaaaacacuguu

SEQ ID NO: 2188312 - RNA, 13 nt, Streptococcus pneumoniae R6
gggcgaugaagac

SEQ ID NO: 2188313 - RNA, 22 nt, Streptococcus pneumoniae R6
gggccuuagcagacuucuuuuu

SEQ ID NO: 2188314 - RNA, 11 nt, Streptococcus pneumoniae R6
gggaaauucca

SEQ ID NO: 2188315 - RNA, 22 nt, Streptococcus pneumoniae R6
gggaaauucuaauuaaauaaaa

SEQ ID NO: 2188316 - RNA, 17 nt, Streptococcus pneumoniae R6
gggcaccaaacuuagga

SEQ ID NO: 2188317 - RNA, 13 nt, Streptococcus pneumoniae R6
gggauaaugagga

SEQ ID NO: 2188318 - RNA, 20 nt, Streptococcus pneumoniae R6
gggcacgacgggcuuggaaa

SEQ ID NO: 2188319 - RNA, 21 nt, Streptococcus pneumoniae R6
gguacccacaaagauaaaauu

SEQ ID NO: 2188320 - RNA, 23 nt, Streptococcus pneumoniae R6
gguaccgcugaaagcaaggcuug

SEQ ID NO: 2188321 - RNA, 14 nt, Streptococcus pneumoniae R6
gguagauaccucgu

SEQ ID NO: 2188322 - RNA, 20 nt, Streptococcus pneumoniae R6
ggucacgaggaggagaaaaa

SEQ ID NO: 2188323 - RNA, 14 nt, Streptococcus pneumoniae R6
gguauaaaagaguu

SEQ ID NO: 2188324 - RNA, 19 nt, Streptococcus pneumoniae R6
gguaguuguuaguucuuga

SEQ ID NO: 2188325 - RNA, 20 nt, Streptococcus pneumoniae R6
gguaggcauaaacaggcucg

SEQ ID NO: 2188326 - RNA, 13 nt, Streptococcus pneumoniae R6
gguaggaguuuga

SEQ ID NO: 2188327 - RNA, 15 nt, Streptococcus pneumoniae R6
gguaggauuucuccu

SEQ ID NO: 2188328 - RNA, 15 nt, Streptococcus pneumoniae R6
gguagcaacagcugg

SEQ ID NO: 2188329 - RNA, 21 nt, Streptococcus pneumoniae R6
gguaaccgaugacaaaaauag

SEQ ID NO: 2188330 - RNA, 14 nt, Streptococcus pneumoniae R6
gguaagagaacuuc

SEQ ID NO: 2188331 - RNA, 15 nt, Streptococcus pneumoniae R6
gguaaaagagcaaga

SEQ ID NO: 2188332 - RNA, 16 nt, Streptococcus pneumoniae R6
gguaaaagagcaagaa

SEQ ID NO: 2188333 - RNA, 18 nt, Streptococcus pneumoniae R6
gguaaaagagcaagaacu

SEQ ID NO: 2188334 - RNA, 14 nt, Streptococcus pneumoniae R6
ggguuucuucuagc

SEQ ID NO: 2188335 - RNA, 14 nt, Streptococcus pneumoniae R6
ggguugaaguaacu

SEQ ID NO: 2188336 - RNA, 20 nt, Streptococcus pneumoniae R6
ggguugagaagugggagaaa

SEQ ID NO: 2188337 - RNA, 14 nt, Streptococcus pneumoniae R6
ggguuaagacaccg

SEQ ID NO: 2188338 - RNA, 20 nt, Streptococcus pneumoniae R6
ggguucuucgaaagucaauu

SEQ ID NO: 2188339 - RNA, 24 nt, Streptococcus pneumoniae R6
gggucguaaaccuucaagaccuuc

SEQ ID NO: 2188340 - RNA, 20 nt, Streptococcus pneumoniae R6
ggugcguuuuuugauuaagu

SEQ ID NO: 2188341 - RNA, 19 nt, Streptococcus pneumoniae R6
ggugcaauuuuuuauggau

SEQ ID NO: 2188342 - RNA, 18 nt, Streptococcus pneumoniae R6
ggugcgagacaaaaaaaa

SEQ ID NO: 2188343 - RNA, 13 nt, Streptococcus pneumoniae R6
ggucuuuuguccu

SEQ ID NO: 2188344 - RNA, 13 nt, Streptococcus pneumoniae R6
ggucuuuguucug

SEQ ID NO: 2188345 - RNA, 20 nt, Streptococcus pneumoniae R6
ggucuuucaagcgaacaucu

SEQ ID NO: 2188346 - RNA, 18 nt, Streptococcus pneumoniae R6
ggucgauuggcagccucu

SEQ ID NO: 2188347 - RNA, 20 nt, Streptococcus pneumoniae R6
ggucgcuuccaauuuuugcg

SEQ ID NO: 2188348 - RNA, 23 nt, Streptococcus pneumoniae R6
guaagccauauuggaugaguuua

SEQ ID NO: 2188349 - RNA, 16 nt, Streptococcus pneumoniae R6
guaaggacuuugcuua

SEQ ID NO: 2188350 - RNA, 21 nt, Streptococcus pneumoniae R6
guaaguaccugacgaaagacu

SEQ ID NO: 2188351 - RNA, 20 nt, Streptococcus pneumoniae R6
guaauaaacuggguugaaga

SEQ ID NO: 2188352 - RNA, 21 nt, Streptococcus pneumoniae R6
guaagugguaucgcuagacug

SEQ ID NO: 2188353 - RNA, 21 nt, Streptococcus pneumoniae R6
guaaguuuaauguccaugcuu

SEQ ID NO: 2188354 - RNA, 19 nt, Streptococcus pneumoniae R6
guaagucauuuucuuuuac

SEQ ID NO: 2188355 - RNA, 11 nt, Streptococcus pneumoniae R6
guaagucugcu

SEQ ID NO: 2188356 - RNA, 15 nt, Streptococcus pneumoniae R6
guaagucugcuuuau

SEQ ID NO: 2188357 - RNA, 21 nt, Streptococcus pneumoniae R6
guaagugaguaccagauauac

SEQ ID NO: 2188358 - RNA, 14 nt, Streptococcus pneumoniae R6
guaaucaaaaggac

SEQ ID NO: 2188359 - RNA, 13 nt, Streptococcus pneumoniae R6
guaacuucugucu

SEQ ID NO: 2188360 - RNA, 21 nt, Streptococcus pneumoniae R6
guaacuugccugcuuuuucaa

SEQ ID NO: 2188361 - RNA, 22 nt, Streptococcus pneumoniae R6
guaacuuuaccaaaaccuucuu

SEQ ID NO: 2188362 - RNA, 14 nt, Streptococcus pneumoniae R6
guaacuauuuuuga

SEQ ID NO: 2188363 - RNA, 20 nt, Streptococcus pneumoniae R6
guaagaaagcagcuuaucuc

SEQ ID NO: 2188364 - RNA, 22 nt, Streptococcus pneumoniae R6
guaagagaaauuucugaaacua

SEQ ID NO: 2188365 - RNA, 19 nt, Streptococcus pneumoniae R6
guaagauagggcugaagga

SEQ ID NO: 2188366 - RNA, 20 nt, Streptococcus pneumoniae R6
guaacggcuuucaguuucau

SEQ ID NO: 2188367 - RNA, 16 nt, Streptococcus pneumoniae R6
guaaccaaaucagaua

SEQ ID NO: 2188368 - RNA, 17 nt, Streptococcus pneumoniae R6
guaaccaauuucucaaa

SEQ ID NO: 2188369 - RNA, 19 nt, Streptococcus pneumoniae R6
guaacauauuuucaaaacu

SEQ ID NO: 2188370 - RNA, 18 nt, Streptococcus pneumoniae R6
guaaaggguuuggucaga

SEQ ID NO: 2188371 - RNA, 12 nt, Streptococcus pneumoniae R6
guaaagggcuuu

SEQ ID NO: 2188372 - RNA, 15 nt, Streptococcus pneumoniae R6
guaaauaaauaucaa

SEQ ID NO: 2188373 - RNA, 16 nt, Streptococcus pneumoniae R6
guaaauaaauaucaaa

SEQ ID NO: 2188374 - RNA, 17 nt, Streptococcus pneumoniae R6
guaaaguuaauugaauu

SEQ ID NO: 2188375 - RNA, 21 nt, Streptococcus pneumoniae R6
guaaauauuucuaugauaaaa

SEQ ID NO: 2188376 - RNA, 17 nt, Streptococcus pneumoniae R6
guaaaucuucagauuca

SEQ ID NO: 2188377 - RNA, 22 nt, Streptococcus pneumoniae R6
guaaaucauacgauugaaagga

SEQ ID NO: 2188378 - RNA, 17 nt, Streptococcus pneumoniae R6
guaaauccgauauaucu

SEQ ID NO: 2188379 - RNA, 17 nt, Streptococcus pneumoniae R6
guaaauugucuaaaaau

SEQ ID NO: 2188380 - RNA, 20 nt, Streptococcus pneumoniae R6
guaaauucuucauacucaau

SEQ ID NO: 2188381 - RNA, 18 nt, Streptococcus pneumoniae R6
guaaacguggauuuaaga

SEQ ID NO: 2188382 - RNA, 22 nt, Streptococcus pneumoniae R6
guaaacuagaaagcuagucgca

SEQ ID NO: 2188383 - RNA, 17 nt, Streptococcus pneumoniae R6
guaaacuucuucuucca

SEQ ID NO: 2188384 - RNA, 17 nt, Streptococcus pneumoniae R6
guaaagacauuauaauc

SEQ ID NO: 2188385 - RNA, 14 nt, Streptococcus pneumoniae R6
guaaagacuagacu

SEQ ID NO: 2188386 - RNA, 17 nt, Streptococcus pneumoniae R6
guaaacaguaauaaaga

SEQ ID NO: 2188387 - RNA, 22 nt, Streptococcus pneumoniae R6
guaaacaucaucugcauuacau

SEQ ID NO: 2188388 - RNA, 17 nt, Streptococcus pneumoniae R6
guaaacgaauacuuugu

SEQ ID NO: 2188389 - RNA, 20 nt, Streptococcus pneumoniae R6
gguguuucaagucuucugaa

SEQ ID NO: 2188390 - RNA, 15 nt, Streptococcus pneumoniae R6
gguguuuugagcuga

SEQ ID NO: 2188391 - RNA, 12 nt, Streptococcus pneumoniae R6
gguuaaaauuuu

SEQ ID NO: 2188392 - RNA, 19 nt, Streptococcus pneumoniae R6
guaaaaugcaccaaaacag

SEQ ID NO: 2188393 - RNA, 14 nt, Streptococcus pneumoniae R6
guaaaaugaaacaa

SEQ ID NO: 2188394 - RNA, 21 nt, Streptococcus pneumoniae R6
guaaaaugaaauaagaacagg

SEQ ID NO: 2188395 - RNA, 11 nt, Streptococcus pneumoniae R6
guaaaauacuc

SEQ ID NO: 2188396 - RNA, 17 nt, Streptococcus pneumoniae R6
guaaugcuccaauacaa

SEQ ID NO: 2188397 - RNA, 22 nt, Streptococcus pneumoniae R6
guaaucugcaccugauuucucc

SEQ ID NO: 2188398 - RNA, 16 nt, Streptococcus pneumoniae R6
guacauugaaauuaaa

SEQ ID NO: 2188399 - RNA, 13 nt, Streptococcus pneumoniae R6
guacauucaacac

SEQ ID NO: 2188400 - RNA, 18 nt, Streptococcus pneumoniae R6
guaaugggcgcauuuucc

SEQ ID NO: 2188401 - RNA, 13 nt, Streptococcus pneumoniae R6
guaccaugauaca

SEQ ID NO: 2188402 - RNA, 14 nt, Streptococcus pneumoniae R6
guaccgccaaaccu

SEQ ID NO: 2188403 - RNA, 14 nt, Streptococcus pneumoniae R6
guaccgacuucuga

SEQ ID NO: 2188404 - RNA, 15 nt, Streptococcus pneumoniae R6
guacuuaaacgugcu

SEQ ID NO: 2188405 - RNA, 12 nt, Streptococcus pneumoniae R6
guacuguauacu

SEQ ID NO: 2188406 - RNA, 17 nt, Streptococcus pneumoniae R6
guacuauucuaguuuca

SEQ ID NO: 2188407 - RNA, 17 nt, Streptococcus pneumoniae R6
guacucaacagaagaau

SEQ ID NO: 2188408 - RNA, 17 nt, Streptococcus pneumoniae R6
guacuagggcauuuuga

SEQ ID NO: 2188409 - RNA, 14 nt, Streptococcus pneumoniae R6
guacucacuuacau

SEQ ID NO: 2188410 - RNA, 15 nt, Streptococcus pneumoniae R6
guacucacuuacaua

SEQ ID NO: 2188411 - RNA, 15 nt, Streptococcus pneumoniae R6
guacuaagcaugaua

SEQ ID NO: 2188412 - RNA, 23 nt, Streptococcus pneumoniae R6
guacuaagcaugauaugaaguuu

SEQ ID NO: 2188413 - RNA, 21 nt, Streptococcus pneumoniae R6
guacgguaaucaagugaguua

SEQ ID NO: 2188414 - RNA, 20 nt, Streptococcus pneumoniae R6
guaguacugaacaaugaaaa

SEQ ID NO: 2188415 - RNA, 22 nt, Streptococcus pneumoniae R6
guaguacacaacugcuucuaag

SEQ ID NO: 2188416 - RNA, 16 nt, Streptococcus pneumoniae R6
guaguaaaagaauuca

SEQ ID NO: 2188417 - RNA, 14 nt, Streptococcus pneumoniae R6
guaguaaaccugua

SEQ ID NO: 2188418 - RNA, 15 nt, Streptococcus pneumoniae R6
guaguaaccaccuac

SEQ ID NO: 2188419 - RNA, 18 nt, Streptococcus pneumoniae R6
guaguaacuuuuucagga

SEQ ID NO: 2188420 - RNA, 14 nt, Streptococcus pneumoniae R6
guagguugcucaaa

SEQ ID NO: 2188421 - RNA, 17 nt, Streptococcus pneumoniae R6
guagguugggugaagug

SEQ ID NO: 2188422 - RNA, 13 nt, Streptococcus pneumoniae R6
guaggugcuuauu

SEQ ID NO: 2188423 - RNA, 19 nt, Streptococcus pneumoniae R6
guaggugcuuauuucacau

SEQ ID NO: 2188424 - RNA, 18 nt, Streptococcus pneumoniae R6
guagucuccguaaaagac

SEQ ID NO: 2188425 - RNA, 14 nt, Streptococcus pneumoniae R6
guagucuaggauau

SEQ ID NO: 2188426 - RNA, 16 nt, Streptococcus pneumoniae R6
guaguuguuaguucuu

SEQ ID NO: 2188427 - RNA, 19 nt, Streptococcus pneumoniae R6
guaguuuaccccaaauucc

SEQ ID NO: 2188428 - RNA, 20 nt, Streptococcus pneumoniae R6
guaguuuaccccaaauuccu

SEQ ID NO: 2188429 - RNA, 15 nt, Streptococcus pneumoniae R6
guaguugagcuggcu

SEQ ID NO: 2188430 - RNA, 12 nt, Streptococcus pneumoniae R6
guaguucaaaac

SEQ ID NO: 2188431 - RNA, 15 nt, Streptococcus pneumoniae R6
guauaaaacuuauga

SEQ ID NO: 2188432 - RNA, 12 nt, Streptococcus pneumoniae R6
guauaaaccacg

SEQ ID NO: 2188433 - RNA, 19 nt, Streptococcus pneumoniae R6
guauaaaaaagucugggaa

SEQ ID NO: 2188434 - RNA, 17 nt, Streptococcus pneumoniae R6
guagaugaaacugacga

SEQ ID NO: 2188435 - RNA, 16 nt, Streptococcus pneumoniae R6
guagccugugauuuuc

SEQ ID NO: 2188436 - RNA, 22 nt, Streptococcus pneumoniae R6
guagaguuuugguugaugaaga

SEQ ID NO: 2188437 - RNA, 17 nt, Streptococcus pneumoniae R6
guagaguccaaagacca

SEQ ID NO: 2188438 - RNA, 16 nt, Streptococcus pneumoniae R6
guagaggaggauagaa

SEQ ID NO: 2188439 - RNA, 16 nt, Streptococcus pneumoniae R6
guagaggcgccugcug

SEQ ID NO: 2188440 - RNA, 13 nt, Streptococcus pneumoniae R6
guagcuauuaaag

SEQ ID NO: 2188441 - RNA, 18 nt, Streptococcus pneumoniae R6
guaggggauaaugaggaa

SEQ ID NO: 2188442 - RNA, 16 nt, Streptococcus pneumoniae R6
guagguacuugcugua

SEQ ID NO: 2188443 - RNA, 19 nt, Streptococcus pneumoniae R6
guagguauaaaccacgagg

SEQ ID NO: 2188444 - RNA, 18 nt, Streptococcus pneumoniae R6
guagcugagaagcccaua

SEQ ID NO: 2188445 - RNA, 22 nt, Streptococcus pneumoniae R6
guaggcauaaaucaaaucgaua

SEQ ID NO: 2188446 - RNA, 21 nt, Streptococcus pneumoniae R6
guaggauuucuccuguuucaa

SEQ ID NO: 2188447 - RNA, 14 nt, Streptococcus pneumoniae R6
guccuuaaccuuga

SEQ ID NO: 2188448 - RNA, 18 nt, Streptococcus pneumoniae R6
guccuuaugacgaaugau

SEQ ID NO: 2188449 - RNA, 16 nt, Streptococcus pneumoniae R6
guccuuacucaaauaa

SEQ ID NO: 2188450 - RNA, 13 nt, Streptococcus pneumoniae R6
gucgcauauuuca

SEQ ID NO: 2188451 - RNA, 20 nt, Streptococcus pneumoniae R6
gucgcaaagaggaagaggac

SEQ ID NO: 2188452 - RNA, 18 nt, Streptococcus pneumoniae R6
gucgauuggcagccucuu

SEQ ID NO: 2188453 - RNA, 14 nt, Streptococcus pneumoniae R6
guccucaauuugaa

SEQ ID NO: 2188454 - RNA, 13 nt, Streptococcus pneumoniae R6
guccuaauaaacu

SEQ ID NO: 2188455 - RNA, 20 nt, Streptococcus pneumoniae R6
guccuaaauagaagauaaag

SEQ ID NO: 2188456 - RNA, 17 nt, Streptococcus pneumoniae R6
guccucuaguaaagugu

SEQ ID NO: 2188457 - RNA, 14 nt, Streptococcus pneumoniae R6
guccucuucagccu

SEQ ID NO: 2188458 - RNA, 21 nt, Streptococcus pneumoniae R6
guccucauuucaauagaaauc

SEQ ID NO: 2188459 - RNA, 21 nt, Streptococcus pneumoniae R6
guccucggugggcaccuacua

SEQ ID NO: 2188460 - RNA, 15 nt, Streptococcus pneumoniae R6
guccugcccacuaaa

SEQ ID NO: 2188461 - RNA, 19 nt, Streptococcus pneumoniae R6
guccgcauagccaaauaag

SEQ ID NO: 2188462 - RNA, 13 nt, Streptococcus pneumoniae R6
gucauuuuccaca

SEQ ID NO: 2188463 - RNA, 13 nt, Streptococcus pneumoniae R6
guccaaaagaccg

SEQ ID NO: 2188464 - RNA, 21 nt, Streptococcus pneumoniae R6
guccauauuagggcaaauaaa

SEQ ID NO: 2188465 - RNA, 19 nt, Streptococcus pneumoniae R6
guccauagcgucaaagaag

SEQ ID NO: 2188466 - RNA, 22 nt, Streptococcus pneumoniae R6
guccauccaagcgucugaggca

SEQ ID NO: 2188467 - RNA, 18 nt, Streptococcus pneumoniae R6
gucauuugagauaaggac

SEQ ID NO: 2188468 - RNA, 13 nt, Streptococcus pneumoniae R6
gucauuccaauuc

SEQ ID NO: 2188469 - RNA, 14 nt, Streptococcus pneumoniae R6
gucauucaauccau

SEQ ID NO: 2188470 - RNA, 14 nt, Streptococcus pneumoniae R6
gucccauaaaacua

SEQ ID NO: 2188471 - RNA, 13 nt, Streptococcus pneumoniae R6
gucccagcuucuu

SEQ ID NO: 2188472 - RNA, 16 nt, Streptococcus pneumoniae R6
gucccagcuucuuuuu

SEQ ID NO: 2188473 - RNA, 13 nt, Streptococcus pneumoniae R6
gucccauuuucag

SEQ ID NO: 2188474 - RNA, 18 nt, Streptococcus pneumoniae R6
guccccucacaucuucag

SEQ ID NO: 2188475 - RNA, 21 nt, Streptococcus pneumoniae R6
guauauucugaaugcuuucca

SEQ ID NO: 2188476 - RNA, 22 nt, Streptococcus pneumoniae R6
guauauucugaaugcuuuccaa

SEQ ID NO: 2188477 - RNA, 17 nt, Streptococcus pneumoniae R6
guauauugaaaugaaau

SEQ ID NO: 2188478 - RNA, 11 nt, Streptococcus pneumoniae R6
guauauuuuuc

SEQ ID NO: 2188479 - RNA, 12 nt, Streptococcus pneumoniae R6
guauauucaaaa

SEQ ID NO: 2188480 - RNA, 17 nt, Streptococcus pneumoniae R6
guauauucaaaauacaa

SEQ ID NO: 2188481 - RNA, 21 nt, Streptococcus pneumoniae R6
guauaauggauugaaauaaga

SEQ ID NO: 2188482 - RNA, 23 nt, Streptococcus pneumoniae R6
guauaucacuuuauaguuuucac

SEQ ID NO: 2188483 - RNA, 22 nt, Streptococcus pneumoniae R6
guauaugaagauucuguauggu

SEQ ID NO: 2188484 - RNA, 15 nt, Streptococcus pneumoniae R6
guauauaagcuuagu

SEQ ID NO: 2188485 - RNA, 12 nt, Streptococcus pneumoniae R6
gucaagcucuug

SEQ ID NO: 2188486 - RNA, 23 nt, Streptococcus pneumoniae R6
gucaaggauuucuuugaaaucuu

SEQ ID NO: 2188487 - RNA, 22 nt, Streptococcus pneumoniae R6
gucaagaagagcuugguaagag

SEQ ID NO: 2188488 - RNA, 15 nt, Streptococcus pneumoniae R6
gucaagaccauggcg

SEQ ID NO: 2188489 - RNA, 20 nt, Streptococcus pneumoniae R6
gucaacuuuuguauuuugaa

SEQ ID NO: 2188490 - RNA, 14 nt, Streptococcus pneumoniae R6
gucaagagaaaacc

SEQ ID NO: 2188491 - RNA, 14 nt, Streptococcus pneumoniae R6
gucaagaguugggc

SEQ ID NO: 2188492 - RNA, 22 nt, Streptococcus pneumoniae R6
gucaagaguugguagguauauu

SEQ ID NO: 2188493 - RNA, 13 nt, Streptococcus pneumoniae R6
gucaacuguagug

SEQ ID NO: 2188494 - RNA, 18 nt, Streptococcus pneumoniae R6
gucaacuguaguggguug

SEQ ID NO: 2188495 - RNA, 20 nt, Streptococcus pneumoniae R6
gucaacuguaguggguugaa

SEQ ID NO: 2188496 - RNA, 14 nt, Streptococcus pneumoniae R6
gucaacgucaucuu

SEQ ID NO: 2188497 - RNA, 23 nt, Streptococcus pneumoniae R6
gucacuugccucuuuaagagacu

SEQ ID NO: 2188498 - RNA, 17 nt, Streptococcus pneumoniae R6
gucacugacagcauugg

SEQ ID NO: 2188499 - RNA, 20 nt, Streptococcus pneumoniae R6
gucacuacuuccaucuacac

SEQ ID NO: 2188500 - RNA, 16 nt, Streptococcus pneumoniae R6
gucagaaagaaguuua

SEQ ID NO: 2188501 - RNA, 14 nt, Streptococcus pneumoniae R6
gucaauugaaacaa

SEQ ID NO: 2188502 - RNA, 19 nt, Streptococcus pneumoniae R6
gucaauuuccauuuacaga

SEQ ID NO: 2188503 - RNA, 22 nt, Streptococcus pneumoniae R6
gucaauuuccauuuacagaagc

SEQ ID NO: 2188504 - RNA, 19 nt, Streptococcus pneumoniae R6
gucaauuucucuacaaaua

SEQ ID NO: 2188505 - RNA, 14 nt, Streptococcus pneumoniae R6
gucaccgacaacuu

SEQ ID NO: 2188506 - RNA, 17 nt, Streptococcus pneumoniae R6
gucacggaguuucuugg

SEQ ID NO: 2188507 - RNA, 17 nt, Streptococcus pneumoniae R6
gucagcuuccaucugca

SEQ ID NO: 2188508 - RNA, 15 nt, Streptococcus pneumoniae R6
gucagcuuuaucugc

SEQ ID NO: 2188509 - RNA, 16 nt, Streptococcus pneumoniae R6
gucagcuuuaucugca

SEQ ID NO: 2188510 - RNA, 21 nt, Streptococcus pneumoniae R6
gucagcuuuaucugcaaccuc

SEQ ID NO: 2188511 - RNA, 14 nt, Streptococcus pneumoniae R6
gucaggccugcacu

SEQ ID NO: 2188512 - RNA, 18 nt, Streptococcus pneumoniae R6
gucagcucaaaacacugu

SEQ ID NO: 2188513 - RNA, 22 nt, Streptococcus pneumoniae R6
gucauaauugaguugggauaaa

SEQ ID NO: 2188514 - RNA, 13 nt, Streptococcus pneumoniae R6
gucauaacauucu

SEQ ID NO: 2188515 - RNA, 14 nt, Streptococcus pneumoniae R6
gucauaaacaucug

SEQ ID NO: 2188516 - RNA, 16 nt, Streptococcus pneumoniae R6
gucauaaacaucuguc

SEQ ID NO: 2188517 - RNA, 20 nt, Streptococcus pneumoniae R6
gucaucuuauagcgacuaua

SEQ ID NO: 2188518 - RNA, 12 nt, Streptococcus pneumoniae R6
gucaucuuccaa

SEQ ID NO: 2188519 - RNA, 12 nt, Streptococcus pneumoniae R6
gucaucuaucaa

SEQ ID NO: 2188520 - RNA, 16 nt, Streptococcus pneumoniae R6
gucauguuagaaaaau

SEQ ID NO: 2188521 - RNA, 20 nt, Streptococcus pneumoniae R6
gucaucuuggauuauauaug

SEQ ID NO: 2188522 - RNA, 20 nt, Streptococcus pneumoniae R6
gucaugaaguggggcaccau

SEQ ID NO: 2188523 - RNA, 19 nt, Streptococcus pneumoniae R6
gucaugaccccuaaauaua

SEQ ID NO: 2188524 - RNA, 14 nt, Streptococcus pneumoniae R6
gucaguaagauaca

SEQ ID NO: 2188525 - RNA, 22 nt, Streptococcus pneumoniae R6
gucagucuuaucugcaaccuca

SEQ ID NO: 2188526 - RNA, 22 nt, Streptococcus pneumoniae R6
gucaguuccauccacaaccuua

SEQ ID NO: 2188527 - RNA, 23 nt, Streptococcus pneumoniae R6
gucaguuucauccacaaccucaa

SEQ ID NO: 2188528 - RNA, 22 nt, Streptococcus pneumoniae R6
gucaguuucaucuacaaccuca

SEQ ID NO: 2188529 - RNA, 23 nt, Streptococcus pneumoniae R6
gucaguuucaucuacaaccucaa

SEQ ID NO: 2188530 - RNA, 16 nt, Streptococcus pneumoniae R6
gucaguucuauccaca

SEQ ID NO: 2188531 - RNA, 19 nt, Streptococcus pneumoniae R6
gucaguucuauccacaacc

SEQ ID NO: 2188532 - RNA, 22 nt, Streptococcus pneumoniae R6
gucaguucuauccacaaccuca

SEQ ID NO: 2188533 - RNA, 14 nt, Streptococcus pneumoniae R6
gucaguucuaucug

SEQ ID NO: 2188534 - RNA, 17 nt, Streptococcus pneumoniae R6
gucaguucuaucugcaa

SEQ ID NO: 2188535 - RNA, 16 nt, Streptococcus pneumoniae R6
ggccuuguggaagaag

SEQ ID NO: 2188536 - RNA, 12 nt, Streptococcus pneumoniae R6
ggccuuuuugcc

SEQ ID NO: 2188537 - RNA, 23 nt, Streptococcus pneumoniae R6
ggccuaaggcuguuucaaaugaa

SEQ ID NO: 2188538 - RNA, 16 nt, Streptococcus pneumoniae R6
ggccuucuuuuuaauu

SEQ ID NO: 2188539 - RNA, 13 nt, Streptococcus pneumoniae R6
ggcgcauuuuccu

SEQ ID NO: 2188540 - RNA, 16 nt, Streptococcus pneumoniae R6
ggcguuaccuccaccu

SEQ ID NO: 2188541 - RNA, 19 nt, Streptococcus pneumoniae R6
ggcuagcaacaaccugcac

SEQ ID NO: 2188542 - RNA, 23 nt, Streptococcus pneumoniae R6
ggcuagucccugguaaaagagca

SEQ ID NO: 2188543 - RNA, 15 nt, Streptococcus pneumoniae R6
ggcuauuauuaaugu

SEQ ID NO: 2188544 - RNA, 21 nt, Streptococcus pneumoniae R6
ggcuacagaugcugcauuuug

SEQ ID NO: 2188545 - RNA, 19 nt, Streptococcus pneumoniae R6
ggcgugggucaucaagcuu

SEQ ID NO: 2188546 - RNA, 11 nt, Streptococcus pneumoniae R6
ggcgugcuccc

SEQ ID NO: 2188547 - RNA, 21 nt, Streptococcus pneumoniae R6
ggcggugcuuugagcaaccug

SEQ ID NO: 2188548 - RNA, 10 nt, Streptococcus pneumoniae R6
ggccacugag

SEQ ID NO: 2188549 - RNA, 15 nt, Streptococcus pneumoniae R6
ggccagaacucccug

SEQ ID NO: 2188550 - RNA, 21 nt, Streptococcus pneumoniae R6
ggccaaaucaucauaaaaaua

SEQ ID NO: 2188551 - RNA, 22 nt, Streptococcus pneumoniae R6
ggccaaaucaucauaaaaauaa

SEQ ID NO: 2188552 - RNA, 17 nt, Streptococcus pneumoniae R6
ggccaaguccagaggac

SEQ ID NO: 2188553 - RNA, 17 nt, Streptococcus pneumoniae R6
ggccaagguucauuucu

SEQ ID NO: 2188554 - RNA, 12 nt, Streptococcus pneumoniae R6
ggcaucuaagca

SEQ ID NO: 2188555 - RNA, 22 nt, Streptococcus pneumoniae R6
ggcauccuaucaagguuuuuga

SEQ ID NO: 2188556 - RNA, 17 nt, Streptococcus pneumoniae R6
ggcaucuugucaaagag

SEQ ID NO: 2188557 - RNA, 18 nt, Streptococcus pneumoniae R6
ggcaggcugguuccuccu

SEQ ID NO: 2188558 - RNA, 17 nt, Streptococcus pneumoniae R6
ggcaucaacagcuccau

SEQ ID NO: 2188559 - RNA, 22 nt, Streptococcus pneumoniae R6
ggcaucacgaaaauauuuggaa

SEQ ID NO: 2188560 - RNA, 18 nt, Streptococcus pneumoniae R6
ggaauaaauccagcugag

SEQ ID NO: 2188561 - RNA, 16 nt, Streptococcus pneumoniae R6
ggaauaaagguaaaac

SEQ ID NO: 2188562 - RNA, 18 nt, Streptococcus pneumoniae R6
ggaagucuguuauuucuu

SEQ ID NO: 2188563 - RNA, 15 nt, Streptococcus pneumoniae R6
ggaaggugagggcug

SEQ ID NO: 2188564 - RNA, 16 nt, Streptococcus pneumoniae R6
gcucggcuuuuuguuu

SEQ ID NO: 2188565 - RNA, 20 nt, Streptococcus pneumoniae R6
ggacaaaucgaucaggacag

SEQ ID NO: 2188566 - RNA, 20 nt, Streptococcus pneumoniae R6
ggacaaaucguucaggacag

SEQ ID NO: 2188567 - RNA, 18 nt, Streptococcus pneumoniae R6
ggacaaaacuuuuuaaaa

SEQ ID NO: 2188568 - RNA, 19 nt, Streptococcus pneumoniae R6
ggaaugacgaaacgaagaa

SEQ ID NO: 2188569 - RNA, 14 nt, Streptococcus pneumoniae R6
ggacagauaagagc

SEQ ID NO: 2188570 - RNA, 22 nt, Streptococcus pneumoniae R6
ggacaauagcgaguaggcugga

SEQ ID NO: 2188571 - RNA, 23 nt, Streptococcus pneumoniae R6
ggaccgacaccaguauucuuuuu

SEQ ID NO: 2188572 - RNA, 20 nt, Streptococcus pneumoniae R6
ggauagcuccuccaagucca

SEQ ID NO: 2188573 - RNA, 14 nt, Streptococcus pneumoniae R6
ggauagaacugacg

SEQ ID NO: 2188574 - RNA, 16 nt, Streptococcus pneumoniae R6
ggauacuccauaaaaa

SEQ ID NO: 2188575 - RNA, 19 nt, Streptococcus pneumoniae R6
ggaguguucuaaaauaagu

SEQ ID NO: 2188576 - RNA, 13 nt, Streptococcus pneumoniae R6
ggaguucuuuuca

SEQ ID NO: 2188577 - RNA, 18 nt, Streptococcus pneumoniae R6
ggauaccuauccuaccca

SEQ ID NO: 2188578 - RNA, 15 nt, Streptococcus pneumoniae R6
ggagugauagaaaag

SEQ ID NO: 2188579 - RNA, 18 nt, Streptococcus pneumoniae R6
ggagugauagaaaagccc

SEQ ID NO: 2188580 - RNA, 15 nt, Streptococcus pneumoniae R6
ggaguaaaaaaagag

SEQ ID NO: 2188581 - RNA, 19 nt, Streptococcus pneumoniae R6
ggaguacccucggcuguuu

SEQ ID NO: 2188582 - RNA, 17 nt, Streptococcus pneumoniae R6
ggaggcaaagaaaaaag

SEQ ID NO: 2188583 - RNA, 18 nt, Streptococcus pneumoniae R6
ggaggcaaagaaaaaagc

SEQ ID NO: 2188584 - RNA, 22 nt, Streptococcus pneumoniae R6
ggacucgaaccaccgaccucac

SEQ ID NO: 2188585 - RNA, 18 nt, Streptococcus pneumoniae R6
ggagaaccaggaaaccag

SEQ ID NO: 2188586 - RNA, 15 nt, Streptococcus pneumoniae R6
ggagauggacuagaa

SEQ ID NO: 2188587 - RNA, 18 nt, Streptococcus pneumoniae R6
ggacuugauauaaaugac

SEQ ID NO: 2188588 - RNA, 17 nt, Streptococcus pneumoniae R6
ggacuuagcucugugca

SEQ ID NO: 2188589 - RNA, 20 nt, Streptococcus pneumoniae R6
ggacuguuucauggcaaauu

SEQ ID NO: 2188590 - RNA, 16 nt, Streptococcus pneumoniae R6
ggcaagaucaaguuca

SEQ ID NO: 2188591 - RNA, 10 nt, Streptococcus pneumoniae R6
ggcaacugcu

SEQ ID NO: 2188592 - RNA, 16 nt, Streptococcus pneumoniae R6
ggcaauuuaucccaau

SEQ ID NO: 2188593 - RNA, 13 nt, Streptococcus pneumoniae R6
ggcaauuuaucuc

SEQ ID NO: 2188594 - RNA, 10 nt, Streptococcus pneumoniae R6
ggcaauuuua

SEQ ID NO: 2188595 - RNA, 16 nt, Streptococcus pneumoniae R6
ggcaccgaauuuuuca

SEQ ID NO: 2188596 - RNA, 20 nt, Streptococcus pneumoniae R6
ggcaacaaaguaaccaucug

SEQ ID NO: 2188597 - RNA, 13 nt, Streptococcus pneumoniae R6
ggcaaaggcaugg

SEQ ID NO: 2188598 - RNA, 14 nt, Streptococcus pneumoniae R6
ggcaaagauguucu

SEQ ID NO: 2188599 - RNA, 17 nt, Streptococcus pneumoniae R6
ggcaaagauguucucaa

SEQ ID NO: 2188600 - RNA, 22 nt, Streptococcus pneumoniae R6
ggauuuucuuacacguuuuugu

SEQ ID NO: 2188601 - RNA, 12 nt, Streptococcus pneumoniae R6
ggauuuuauccg

SEQ ID NO: 2188602 - RNA, 23 nt, Streptococcus pneumoniae R6
ggauuuuucuucuuuucuuuuau

SEQ ID NO: 2188603 - RNA, 13 nt, Streptococcus pneumoniae R6
ggauuuuucuuuu

SEQ ID NO: 2188604 - RNA, 21 nt, Streptococcus pneumoniae R6
ggauuucuccuguuucaaagu

SEQ ID NO: 2188605 - RNA, 18 nt, Streptococcus pneumoniae R6
ggauuucugcuuuuuaua

SEQ ID NO: 2188606 - RNA, 19 nt, Streptococcus pneumoniae R6
ggauuuccacuaaagguug

SEQ ID NO: 2188607 - RNA, 19 nt, Streptococcus pneumoniae R6
ggaucuccaguuuggacca

SEQ ID NO: 2188608 - RNA, 23 nt, Streptococcus pneumoniae R6
ggaugauucuuuucaaaauaagu

SEQ ID NO: 2188609 - RNA, 14 nt, Streptococcus pneumoniae R6
ggauggaacugacg

SEQ ID NO: 2188610 - RNA, 15 nt, Streptococcus pneumoniae R6
ggauuguuaaacaau

SEQ ID NO: 2188611 - RNA, 13 nt, Streptococcus pneumoniae R6
ggauuacauagac

SEQ ID NO: 2188612 - RNA, 15 nt, Streptococcus pneumoniae R6
cucuuccgaggucau

SEQ ID NO: 2188613 - RNA, 20 nt, Streptococcus pneumoniae R6
cucuucgaaaaucucuucaa

SEQ ID NO: 2188614 - RNA, 12 nt, Streptococcus pneumoniae R6
cucuucuaaaaa

SEQ ID NO: 2188615 - RNA, 21 nt, Streptococcus pneumoniae R6
cucuuguucugccuauuuuuu

SEQ ID NO: 2188616 - RNA, 18 nt, Streptococcus pneumoniae R6
cucuugauuuuuuuuaaa

SEQ ID NO: 2188617 - RNA, 21 nt, Streptococcus pneumoniae R6
cucuugauuuuuuuuaaaaaa

SEQ ID NO: 2188618 - RNA, 15 nt, Streptococcus pneumoniae R6
cucuugcccuuggcu

SEQ ID NO: 2188619 - RNA, 12 nt, Streptococcus pneumoniae R6
cucuucuucugg

SEQ ID NO: 2188620 - RNA, 20 nt, Streptococcus pneumoniae R6
cucuugaaguucauuuucuu

SEQ ID NO: 2188621 - RNA, 20 nt, Streptococcus pneumoniae R6
cucuguagagaguuaaaaaa

SEQ ID NO: 2188622 - RNA, 16 nt, Streptococcus pneumoniae R6
cucuguaaaacucuua

SEQ ID NO: 2188623 - RNA, 14 nt, Streptococcus pneumoniae R6
cucuguuaccacag

SEQ ID NO: 2188624 - RNA, 17 nt, Streptococcus pneumoniae R6
cucugucccaucauuuc

SEQ ID NO: 2188625 - RNA, 14 nt, Streptococcus pneumoniae R6
cucugucacaaaga

SEQ ID NO: 2188626 - RNA, 20 nt, Streptococcus pneumoniae R6
cucuuagaaaaucucuucaa

SEQ ID NO: 2188627 - RNA, 13 nt, Streptococcus pneumoniae R6
cucuucaaacuac

SEQ ID NO: 2188628 - RNA, 22 nt, Streptococcus pneumoniae R6
cucuguuuucacccuugauuuc

SEQ ID NO: 2188629 - RNA, 19 nt, Streptococcus pneumoniae R6
cucuuaaaaaaguccaaaa

SEQ ID NO: 2188630 - RNA, 14 nt, Streptococcus pneumoniae R6
cucuuacaagucgu

SEQ ID NO: 2188631 - RNA, 22 nt, Streptococcus pneumoniae R6
cucuuacaguuugcucagcauu

SEQ ID NO: 2188632 - RNA, 18 nt, Streptococcus pneumoniae R6
cucuuaaugucagucugg

SEQ ID NO: 2188633 - RNA, 18 nt, Streptococcus pneumoniae R6
cugaacaaugaaaaaaac

SEQ ID NO: 2188634 - RNA, 20 nt, Streptococcus pneumoniae R6
cugaaccauguccuggauag

SEQ ID NO: 2188635 - RNA, 19 nt, Streptococcus pneumoniae R6
cugaaauugagucuuuuuc

SEQ ID NO: 2188636 - RNA, 21 nt, Streptococcus pneumoniae R6
cugaaauuggcucaucugcaa

SEQ ID NO: 2188637 - RNA, 20 nt, Streptococcus pneumoniae R6
cugaaaucccauaguagucu

SEQ ID NO: 2188638 - RNA, 16 nt, Streptococcus pneumoniae R6
cugaaaucagugugac

SEQ ID NO: 2188639 - RNA, 17 nt, Streptococcus pneumoniae R6
cugaaauauacucauaa

SEQ ID NO: 2188640 - RNA, 21 nt, Streptococcus pneumoniae R6
cugaaauauacucauaaaguc

SEQ ID NO: 2188641 - RNA, 15 nt, Streptococcus pneumoniae R6
cugaacuaaaaaauc

SEQ ID NO: 2188642 - RNA, 21 nt, Streptococcus pneumoniae R6
cugaacuaaaaaaucuucuua

SEQ ID NO: 2188643 - RNA, 21 nt, Streptococcus pneumoniae R6
cugaagcauauuccacauuca

SEQ ID NO: 2188644 - RNA, 16 nt, Streptococcus pneumoniae R6
cugaagaaagcaauuu

SEQ ID NO: 2188645 - RNA, 12 nt, Streptococcus pneumoniae R6
cucuuuguucuu

SEQ ID NO: 2188646 - RNA, 21 nt, Streptococcus pneumoniae R6
cucuuuguucuuuagaaaggu

SEQ ID NO: 2188647 - RNA, 15 nt, Streptococcus pneumoniae R6
cucuuugauuuuaau

SEQ ID NO: 2188648 - RNA, 13 nt, Streptococcus pneumoniae R6
cucuuugauuuuc

SEQ ID NO: 2188649 - RNA, 14 nt, Streptococcus pneumoniae R6
cucuuuguccuuua

SEQ ID NO: 2188650 - RNA, 18 nt, Streptococcus pneumoniae R6
cucuuugauuuuuauuga

SEQ ID NO: 2188651 - RNA, 13 nt, Streptococcus pneumoniae R6
cucuuugcauuuc

SEQ ID NO: 2188652 - RNA, 16 nt, Streptococcus pneumoniae R6
cucuuugcauuucauc

SEQ ID NO: 2188653 - RNA, 21 nt, Streptococcus pneumoniae R6
cucuuuuuacaauuguaaaaa

SEQ ID NO: 2188654 - RNA, 12 nt, Streptococcus pneumoniae R6
cucuuuuuacuu

SEQ ID NO: 2188655 - RNA, 23 nt, Streptococcus pneumoniae R6
cucuuuuuauucuuuuucaaagg

SEQ ID NO: 2188656 - RNA, 22 nt, Streptococcus pneumoniae R6
cucuuuucuuaucuggguucca

SEQ ID NO: 2188657 - RNA, 14 nt, Streptococcus pneumoniae R6
cucuuuuugauuuu

SEQ ID NO: 2188658 - RNA, 15 nt, Streptococcus pneumoniae R6
cucuuuuuucaugua

SEQ ID NO: 2188659 - RNA, 14 nt, Streptococcus pneumoniae R6
cucuuucuuucuca

SEQ ID NO: 2188660 - RNA, 15 nt, Streptococcus pneumoniae R6
cucuuuauugguuaa

SEQ ID NO: 2188661 - RNA, 16 nt, Streptococcus pneumoniae R6
cugaaacuaagcuuca

SEQ ID NO: 2188662 - RNA, 14 nt, Streptococcus pneumoniae R6
cucuuuuuucucca

SEQ ID NO: 2188663 - RNA, 21 nt, Streptococcus pneumoniae R6
cucuuuuuugauaucuuccuc

SEQ ID NO: 2188664 - RNA, 19 nt, Streptococcus pneumoniae R6
cugaaaacaaguucuuuuc

SEQ ID NO: 2188665 - RNA, 14 nt, Streptococcus pneumoniae R6
cugacuccauagcc

SEQ ID NO: 2188666 - RNA, 17 nt, Streptococcus pneumoniae R6
cugacuaucuuguugaa

SEQ ID NO: 2188667 - RNA, 19 nt, Streptococcus pneumoniae R6
cugacuaucuuguugaaug

SEQ ID NO: 2188668 - RNA, 13 nt, Streptococcus pneumoniae R6
cugacgaaaucag

SEQ ID NO: 2188669 - RNA, 13 nt, Streptococcus pneumoniae R6
cugacgaagucag

SEQ ID NO: 2188670 - RNA, 23 nt, Streptococcus pneumoniae R6
cugacgaagucagucacauauau

SEQ ID NO: 2188671 - RNA, 14 nt, Streptococcus pneumoniae R6
cugagaucuucuuc

SEQ ID NO: 2188672 - RNA, 17 nt, Streptococcus pneumoniae R6
cugagauggauuuuccu

SEQ ID NO: 2188673 - RNA, 14 nt, Streptococcus pneumoniae R6
cugagaaggagaac

SEQ ID NO: 2188674 - RNA, 14 nt, Streptococcus pneumoniae R6
cugagaaggcuggu

SEQ ID NO: 2188675 - RNA, 21 nt, Streptococcus pneumoniae R6
cugagauacuccaaaacaucu

SEQ ID NO: 2188676 - RNA, 21 nt, Streptococcus pneumoniae R6
cugagaccuuuauuggcugcc

SEQ ID NO: 2188677 - RNA, 20 nt, Streptococcus pneumoniae R6
cugacaauuuaaccaaacca

SEQ ID NO: 2188678 - RNA, 20 nt, Streptococcus pneumoniae R6
cugaagcuuuauugucucua

SEQ ID NO: 2188679 - RNA, 18 nt, Streptococcus pneumoniae R6
cugaaggaacuaacucau

SEQ ID NO: 2188680 - RNA, 15 nt, Streptococcus pneumoniae R6
cugauaauauuuucu

SEQ ID NO: 2188681 - RNA, 22 nt, Streptococcus pneumoniae R6
cugauaccaaccaguugccaua

SEQ ID NO: 2188682 - RNA, 22 nt, Streptococcus pneumoniae R6
cugauauuguuaauggucuuca

SEQ ID NO: 2188683 - RNA, 23 nt, Streptococcus pneumoniae R6
cugaucaauauucuccgaaguca

SEQ ID NO: 2188684 - RNA, 20 nt, Streptococcus pneumoniae R6
cugaucaagcguuuuucuuc

SEQ ID NO: 2188685 - RNA, 16 nt, Streptococcus pneumoniae R6
cugauucuacuuuuuc

SEQ ID NO: 2188686 - RNA, 15 nt, Streptococcus pneumoniae R6
cugauuuacaaauau

SEQ ID NO: 2188687 - RNA, 20 nt, Streptococcus pneumoniae R6
cugaugauucaaggaguugu

SEQ ID NO: 2188688 - RNA, 15 nt, Streptococcus pneumoniae R6
cugcaaaauuuugag

SEQ ID NO: 2188689 - RNA, 20 nt, Streptococcus pneumoniae R6
cugcaaccuuaaaacagugu

SEQ ID NO: 2188690 - RNA, 20 nt, Streptococcus pneumoniae R6
cugcuucaaauuguuuacga

SEQ ID NO: 2188691 - RNA, 15 nt, Streptococcus pneumoniae R6
cugcuuucaaaaagc

SEQ ID NO: 2188692 - RNA, 18 nt, Streptococcus pneumoniae R6
cugcuuuauaguggguug

SEQ ID NO: 2188693 - RNA, 20 nt, Streptococcus pneumoniae R6
cugcuuugagaucuuuuucg

SEQ ID NO: 2188694 - RNA, 17 nt, Streptococcus pneumoniae R6
cugcuguuuucauguuc

SEQ ID NO: 2188695 - RNA, 15 nt, Streptococcus pneumoniae R6
cugcugcuaaggauu

SEQ ID NO: 2188696 - RNA, 15 nt, Streptococcus pneumoniae R6
cugcuuuuucaauca

SEQ ID NO: 2188697 - RNA, 13 nt, Streptococcus pneumoniae R6
cugcuuuuaaaua

SEQ ID NO: 2188698 - RNA, 18 nt, Streptococcus pneumoniae R6
cuggaaagauaacugcua

SEQ ID NO: 2188699 - RNA, 23 nt, Streptococcus pneumoniae R6
cuggaaauagauguuaagcucca

SEQ ID NO: 2188700 - RNA, 20 nt, Streptococcus pneumoniae R6
cuggacaaaaacucaauuuc

SEQ ID NO: 2188701 - RNA, 19 nt, Streptococcus pneumoniae R6
cuggcaagauuuguucagg

SEQ ID NO: 2188702 - RNA, 14 nt, Streptococcus pneumoniae R6
cuggcaaaggcaug

SEQ ID NO: 2188703 - RNA, 22 nt, Streptococcus pneumoniae R6
cuggcauuaaggcuuugaacau

SEQ ID NO: 2188704 - RNA, 14 nt, Streptococcus pneumoniae R6
cuggcauccccagc

SEQ ID NO: 2188705 - RNA, 17 nt, Streptococcus pneumoniae R6
cuggauuuucaacuuga

SEQ ID NO: 2188706 - RNA, 17 nt, Streptococcus pneumoniae R6
cuggaucuacuuuuuuc

SEQ ID NO: 2188707 - RNA, 17 nt, Streptococcus pneumoniae R6
cuggaucuagauaguac

SEQ ID NO: 2188708 - RNA, 16 nt, Streptococcus pneumoniae R6
cuggacguucuucaag

SEQ ID NO: 2188709 - RNA, 17 nt, Streptococcus pneumoniae R6
cugcucuccaucuuggc

SEQ ID NO: 2188710 - RNA, 13 nt, Streptococcus pneumoniae R6
cugcucucaagaa

SEQ ID NO: 2188711 - RNA, 17 nt, Streptococcus pneumoniae R6
cugcucgguaaaacaua

SEQ ID NO: 2188712 - RNA, 12 nt, Streptococcus pneumoniae R6
cugcuccuccgc

SEQ ID NO: 2188713 - RNA, 15 nt, Streptococcus pneumoniae R6
aaacucaaauguaag

SEQ ID NO: 2188714 - RNA, 16 nt, Streptococcus pneumoniae R6
aaacucaaauguaagu

SEQ ID NO: 2188715 - RNA, 19 nt, Streptococcus pneumoniae R6
aaacucaauuguauaguga

SEQ ID NO: 2188716 - RNA, 22 nt, Streptococcus pneumoniae R6
aaacucaauuucaggagaaaau

SEQ ID NO: 2188717 - RNA, 23 nt, Streptococcus pneumoniae R6
cugcuaaaacaaaauucuuccua

SEQ ID NO: 2188718 - RNA, 18 nt, Streptococcus pneumoniae R6
cugcuaacugcuggauag

SEQ ID NO: 2188719 - RNA, 20 nt, Streptococcus pneumoniae R6
cugcucaaucuuaucaauca

SEQ ID NO: 2188720 - RNA, 21 nt, Streptococcus pneumoniae R6
cugcucaaucuuaucaaucaa

SEQ ID NO: 2188721 - RNA, 17 nt, Streptococcus pneumoniae R6
cugcucaaaacacuguu

SEQ ID NO: 2188722 - RNA, 20 nt, Streptococcus pneumoniae R6
cugcucaaaacacuguuuua

SEQ ID NO: 2188723 - RNA, 17 nt, Streptococcus pneumoniae R6
cugcguuaacuucaaga

SEQ ID NO: 2188724 - RNA, 20 nt, Streptococcus pneumoniae R6
cugcaguuucucuacuaacu

SEQ ID NO: 2188725 - RNA, 16 nt, Streptococcus pneumoniae R6
cugcagggggcaguaa

SEQ ID NO: 2188726 - RNA, 21 nt, Streptococcus pneumoniae R6
cugcaaucauugcaaaggaga

SEQ ID NO: 2188727 - RNA, 21 nt, Streptococcus pneumoniae R6
cugcaauuaguaugagcacua

SEQ ID NO: 2188728 - RNA, 14 nt, Streptococcus pneumoniae R6
cugcauuuuuucau

SEQ ID NO: 2188729 - RNA, 18 nt, Streptococcus pneumoniae R6
cugcauccaccuucaucu

SEQ ID NO: 2188730 - RNA, 18 nt, Streptococcus pneumoniae R6
cugccaauugcucaacuu

SEQ ID NO: 2188731 - RNA, 19 nt, Streptococcus pneumoniae R6
cugccaauugcucaacuuc

SEQ ID NO: 2188732 - RNA, 20 nt, Streptococcus pneumoniae R6
cugccaacuuaucagcuagc

SEQ ID NO: 2188733 - RNA, 14 nt, Streptococcus pneumoniae R6
cugccacaccaccu

SEQ ID NO: 2188734 - RNA, 22 nt, Streptococcus pneumoniae R6
cugccagugcggacggucuuug

SEQ ID NO: 2188735 - RNA, 17 nt, Streptococcus pneumoniae R6
cugccuuccaagauaau

SEQ ID NO: 2188736 - RNA, 19 nt, Streptococcus pneumoniae R6
cugccucaauccuuuucug

SEQ ID NO: 2188737 - RNA, 15 nt, Streptococcus pneumoniae R6
cugcgccaaaacuaa

SEQ ID NO: 2188738 - RNA, 15 nt, Streptococcus pneumoniae R6
cuacgaacaggaacg

SEQ ID NO: 2188739 - RNA, 22 nt, Streptococcus pneumoniae R6
cuaacaucuuuugauagaugac

SEQ ID NO: 2188740 - RNA, 18 nt, Streptococcus pneumoniae R6
cuacugcauccaacaauu

SEQ ID NO: 2188741 - RNA, 22 nt, Streptococcus pneumoniae R6
cuacugaaauugagucuuuuuc

SEQ ID NO: 2188742 - RNA, 18 nt, Streptococcus pneumoniae R6
cuacucuguuuucacccu

SEQ ID NO: 2188743 - RNA, 15 nt, Streptococcus pneumoniae R6
cuacugauaucuuua

SEQ ID NO: 2188744 - RNA, 16 nt, Streptococcus pneumoniae R6
cuacugauaucuuuag

SEQ ID NO: 2188745 - RNA, 15 nt, Streptococcus pneumoniae R6
cuacuauauuuuugg

SEQ ID NO: 2188746 - RNA, 17 nt, Streptococcus pneumoniae R6
cuacucuaacuucaaua

SEQ ID NO: 2188747 - RNA, 19 nt, Streptococcus pneumoniae R6
cuacuuuuuucuaaagcaa

SEQ ID NO: 2188748 - RNA, 12 nt, Streptococcus pneumoniae R6
cuacuuuuucaa

SEQ ID NO: 2188749 - RNA, 15 nt, Streptococcus pneumoniae R6
cuacuuuuucaaagu

SEQ ID NO: 2188750 - RNA, 16 nt, Streptococcus pneumoniae R6
cuacuucccacccaua

SEQ ID NO: 2188751 - RNA, 22 nt, Streptococcus pneumoniae R6
cuacuucccacccauauuuuuc

SEQ ID NO: 2188752 - RNA, 14 nt, Streptococcus pneumoniae R6
cuacuugcuuccca

SEQ ID NO: 2188753 - RNA, 19 nt, Streptococcus pneumoniae R6
cuacuugguugucccaaga

SEQ ID NO: 2188754 - RNA, 14 nt, Streptococcus pneumoniae R6
cuacuuguucaggu

SEQ ID NO: 2188755 - RNA, 14 nt, Streptococcus pneumoniae R6
cuacuuugaaauuu

SEQ ID NO: 2188756 - RNA, 14 nt, Streptococcus pneumoniae R6
cuacuuuagauaca

SEQ ID NO: 2188757 - RNA, 15 nt, Streptococcus pneumoniae R6
cuagauaguaccaug

SEQ ID NO: 2188758 - RNA, 19 nt, Streptococcus pneumoniae R6
cuagauggcuaacuucauu

SEQ ID NO: 2188759 - RNA, 18 nt, Streptococcus pneumoniae R6
cuagaugauuacucaaaa

SEQ ID NO: 2188760 - RNA, 17 nt, Streptococcus pneumoniae R6
cuagauacauuuuuucu

SEQ ID NO: 2188761 - RNA, 13 nt, Streptococcus pneumoniae R6
cuagauauuucca

SEQ ID NO: 2188762 - RNA, 15 nt, Streptococcus pneumoniae R6
cuagauauuuccaau

SEQ ID NO: 2188763 - RNA, 23 nt, Streptococcus pneumoniae R6
cuagauauuuugaaaggaaagca

SEQ ID NO: 2188764 - RNA, 13 nt, Streptococcus pneumoniae R6
cuagauaaaagaa

SEQ ID NO: 2188765 - RNA, 17 nt, Streptococcus pneumoniae R6
cuagauaaaagaaugcu

SEQ ID NO: 2188766 - RNA, 19 nt, Streptococcus pneumoniae R6
cuaggcaggaaggaaauag

SEQ ID NO: 2188767 - RNA, 22 nt, Streptococcus pneumoniae R6
cuagcuguuggauauaaggauu

SEQ ID NO: 2188768 - RNA, 13 nt, Streptococcus pneumoniae R6
cuaggcggcuggu

SEQ ID NO: 2188769 - RNA, 13 nt, Streptococcus pneumoniae R6
cuaggcuaacacu

SEQ ID NO: 2188770 - RNA, 19 nt, Streptococcus pneumoniae R6
cuaggcuaucgauaucaau

SEQ ID NO: 2188771 - RNA, 15 nt, Streptococcus pneumoniae R6
cuagcaaauuuaaua

SEQ ID NO: 2188772 - RNA, 17 nt, Streptococcus pneumoniae R6
cuagcaaauuuaauaua

SEQ ID NO: 2188773 - RNA, 15 nt, Streptococcus pneumoniae R6
cuagcaaaguuuuag

SEQ ID NO: 2188774 - RNA, 18 nt, Streptococcus pneumoniae R6
cuagcaaaaucauagcau

SEQ ID NO: 2188775 - RNA, 18 nt, Streptococcus pneumoniae R6
cuagcaagaguuuuucuc

SEQ ID NO: 2188776 - RNA, 17 nt, Streptococcus pneumoniae R6
cuagcaacaaccugcac

SEQ ID NO: 2188777 - RNA, 20 nt, Streptococcus pneumoniae R6
cuagcaacaaccugcacauu

SEQ ID NO: 2188778 - RNA, 18 nt, Streptococcus pneumoniae R6
cuagggacaccuuggcaa

SEQ ID NO: 2188779 - RNA, 13 nt, Streptococcus pneumoniae R6
cuaggucuagacu

SEQ ID NO: 2188780 - RNA, 15 nt, Streptococcus pneumoniae R6
cuauaauauaauaaa

SEQ ID NO: 2188781 - RNA, 20 nt, Streptococcus pneumoniae R6
cuagguuagucaaaaagaag

SEQ ID NO: 2188782 - RNA, 22 nt, Streptococcus pneumoniae R6
cuaggucaaccaacuuuuccuu

SEQ ID NO: 2188783 - RNA, 21 nt, Streptococcus pneumoniae R6
cuagguuaaagguuuuaucug

SEQ ID NO: 2188784 - RNA, 20 nt, Streptococcus pneumoniae R6
cuaguaaagcuagauuuaaa

SEQ ID NO: 2188785 - RNA, 13 nt, Streptococcus pneumoniae R6
cuaguaaaagaau

SEQ ID NO: 2188786 - RNA, 21 nt, Streptococcus pneumoniae R6
cuauaguauauugaaacuaga

SEQ ID NO: 2188787 - RNA, 11 nt, Streptococcus pneumoniae R6
cuauaguagau

SEQ ID NO: 2188788 - RNA, 14 nt, Streptococcus pneumoniae R6
cuauaguagauuga

SEQ ID NO: 2188789 - RNA, 18 nt, Streptococcus pneumoniae R6
cuauaguagauugaaacu

SEQ ID NO: 2188790 - RNA, 16 nt, Streptococcus pneumoniae R6
cuauaguagcucagaa

SEQ ID NO: 2188791 - RNA, 20 nt, Streptococcus pneumoniae R6
cuauaauuauucugcaauca

SEQ ID NO: 2188792 - RNA, 21 nt, Streptococcus pneumoniae R6
cuauaauuauucugcaaucaa

SEQ ID NO: 2188793 - RNA, 22 nt, Streptococcus pneumoniae R6
cuauaucuaaugacuaauucua

SEQ ID NO: 2188794 - RNA, 14 nt, Streptococcus pneumoniae R6
cuauauaucaugcu

SEQ ID NO: 2188795 - RNA, 13 nt, Streptococcus pneumoniae R6
cuauauaguuuaa

SEQ ID NO: 2188796 - RNA, 22 nt, Streptococcus pneumoniae R6
cuauauaguuuaaucaaaauaa

SEQ ID NO: 2188797 - RNA, 22 nt, Streptococcus pneumoniae R6
cuaucaaaagauguuagaaaaa

SEQ ID NO: 2188798 - RNA, 20 nt, Streptococcus pneumoniae R6
cuaucaaacaggauguguaa

SEQ ID NO: 2188799 - RNA, 17 nt, Streptococcus pneumoniae R6
cuaucaauuauaauaaa

SEQ ID NO: 2188800 - RNA, 13 nt, Streptococcus pneumoniae R6
cuaucaacuagau

SEQ ID NO: 2188801 - RNA, 17 nt, Streptococcus pneumoniae R6
cuaucaacuagaucaac

SEQ ID NO: 2188802 - RNA, 19 nt, Streptococcus pneumoniae R6
cuauauuucuauacuuuuu

SEQ ID NO: 2188803 - RNA, 21 nt, Streptococcus pneumoniae R6
cuauauuucuauacuuuuucu

SEQ ID NO: 2188804 - RNA, 22 nt, Streptococcus pneumoniae R6
cuauauuucaagaauuaaguga

SEQ ID NO: 2188805 - RNA, 11 nt, Streptococcus pneumoniae R6
cuauauugauu

SEQ ID NO: 2188806 - RNA, 15 nt, Streptococcus pneumoniae R6
cuauauuauaagacu

SEQ ID NO: 2188807 - RNA, 22 nt, Streptococcus pneumoniae R6
cuauauuaucagcguaauaguc

SEQ ID NO: 2188808 - RNA, 14 nt, Streptococcus pneumoniae R6
cuaugcguuuuaau

SEQ ID NO: 2188809 - RNA, 11 nt, Streptococcus pneumoniae R6
cuauuaaaauu

SEQ ID NO: 2188810 - RNA, 16 nt, Streptococcus pneumoniae R6
cuauguugcaaauuua

SEQ ID NO: 2188811 - RNA, 23 nt, Streptococcus pneumoniae R6
cuaugaugugcuauucuaaauuc

SEQ ID NO: 2188812 - RNA, 18 nt, Streptococcus pneumoniae R6
cuaucguagcuuuucuua

SEQ ID NO: 2188813 - RNA, 16 nt, Streptococcus pneumoniae R6
cuauccacaaccucaa

SEQ ID NO: 2188814 - RNA, 16 nt, Streptococcus pneumoniae R6
cuaucaugcgaaucaa

SEQ ID NO: 2188815 - RNA, 19 nt, Streptococcus pneumoniae R6
cuaucaugcgaaucaauuu

SEQ ID NO: 2188816 - RNA, 19 nt, Streptococcus pneumoniae R6
cuaucgauaucaauuccac

SEQ ID NO: 2188817 - RNA, 18 nt, Streptococcus pneumoniae R6
cucacaucuucagacaca

SEQ ID NO: 2188818 - RNA, 19 nt, Streptococcus pneumoniae R6
cucaauaggauuguacuca

SEQ ID NO: 2188819 - RNA, 20 nt, Streptococcus pneumoniae R6
cucaaucccauauuuuuccu

SEQ ID NO: 2188820 - RNA, 22 nt, Streptococcus pneumoniae R6
cucacacggaaacagcuucagu

SEQ ID NO: 2188821 - RNA, 23 nt, Streptococcus pneumoniae R6
cucaauauuaugcguuuuuucug

SEQ ID NO: 2188822 - RNA, 16 nt, Streptococcus pneumoniae R6
cucaaucaguuuuuuc

SEQ ID NO: 2188823 - RNA, 23 nt, Streptococcus pneumoniae R6
cucaccuguugcuggcaagauuu

SEQ ID NO: 2188824 - RNA, 13 nt, Streptococcus pneumoniae R6
cucacugaugaaa

SEQ ID NO: 2188825 - RNA, 18 nt, Streptococcus pneumoniae R6
cucacuaucgaaaaauau

SEQ ID NO: 2188826 - RNA, 17 nt, Streptococcus pneumoniae R6
cuauuaacgauugaaau

SEQ ID NO: 2188827 - RNA, 14 nt, Streptococcus pneumoniae R6
cucaaauguaaguu

SEQ ID NO: 2188828 - RNA, 18 nt, Streptococcus pneumoniae R6
cucaacaaaucuuccuag

SEQ ID NO: 2188829 - RNA, 12 nt, Streptococcus pneumoniae R6
cucaacagaaga

SEQ ID NO: 2188830 - RNA, 14 nt, Streptococcus pneumoniae R6
cucaaccacaaaaa

SEQ ID NO: 2188831 - RNA, 17 nt, Streptococcus pneumoniae R6
cucaaccacaaaaaagc

SEQ ID NO: 2188832 - RNA, 16 nt, Streptococcus pneumoniae R6
cucaacgcuagaagca

SEQ ID NO: 2188833 - RNA, 13 nt, Streptococcus pneumoniae R6
cucaacuuccuua

SEQ ID NO: 2188834 - RNA, 13 nt, Streptococcus pneumoniae R6
cucaacuucuuuu

SEQ ID NO: 2188835 - RNA, 21 nt, Streptococcus pneumoniae R6
cucaaggagagcuuuuauuuc

SEQ ID NO: 2188836 - RNA, 20 nt, Streptococcus pneumoniae R6
cucaaggcaguacuuugagc

SEQ ID NO: 2188837 - RNA, 22 nt, Streptococcus pneumoniae R6
cucaaggcaguacuuugagcaa

SEQ ID NO: 2188838 - RNA, 17 nt, Streptococcus pneumoniae R6
cucaaggcggugcuuug

SEQ ID NO: 2188839 - RNA, 23 nt, Streptococcus pneumoniae R6
cucauaucugucuuaccacaaac

SEQ ID NO: 2188840 - RNA, 21 nt, Streptococcus pneumoniae R6
cucauauucaagaaucgucac

SEQ ID NO: 2188841 - RNA, 15 nt, Streptococcus pneumoniae R6
cucauauuuauuaau

SEQ ID NO: 2188842 - RNA, 23 nt, Streptococcus pneumoniae R6
cucaucaaaggucucuucuucug

SEQ ID NO: 2188843 - RNA, 15 nt, Streptococcus pneumoniae R6
cucaucuuugauuuc

SEQ ID NO: 2188844 - RNA, 18 nt, Streptococcus pneumoniae R6
cucaucuuugauuucuug

SEQ ID NO: 2188845 - RNA, 15 nt, Streptococcus pneumoniae R6
cucaucugcuuagaa

SEQ ID NO: 2188846 - RNA, 16 nt, Streptococcus pneumoniae R6
cucaucugcuuucaaa

SEQ ID NO: 2188847 - RNA, 17 nt, Streptococcus pneumoniae R6
cucaucugcuuucaaaa

SEQ ID NO: 2188848 - RNA, 23 nt, Streptococcus pneumoniae R6
cucaucuguuuucaaaaagcauu

SEQ ID NO: 2188849 - RNA, 19 nt, Streptococcus pneumoniae R6
cucaucgacuuguuuuuug

SEQ ID NO: 2188850 - RNA, 23 nt, Streptococcus pneumoniae R6
cucauccuuugcauccacaucca

SEQ ID NO: 2188851 - RNA, 16 nt, Streptococcus pneumoniae R6
cucauagccauaaaac

SEQ ID NO: 2188852 - RNA, 20 nt, Streptococcus pneumoniae R6
cucauagccauaaaacauuu

SEQ ID NO: 2188853 - RNA, 17 nt, Streptococcus pneumoniae R6
cucaguauuacauccac

SEQ ID NO: 2188854 - RNA, 11 nt, Streptococcus pneumoniae R6
cucagucugac

SEQ ID NO: 2188855 - RNA, 22 nt, Streptococcus pneumoniae R6
cucagucugaccaccauuuuua

SEQ ID NO: 2188856 - RNA, 16 nt, Streptococcus pneumoniae R6
cucagugggcuauucc

SEQ ID NO: 2188857 - RNA, 15 nt, Streptococcus pneumoniae R6
cucagggucuuuguu

SEQ ID NO: 2188858 - RNA, 12 nt, Streptococcus pneumoniae R6
cucccuucuuua

SEQ ID NO: 2188859 - RNA, 24 nt, Streptococcus pneumoniae R6
cuccgccgaggauuucacgcaccu

SEQ ID NO: 2188860 - RNA, 19 nt, Streptococcus pneumoniae R6
cucccacuaucuaaaaaaa

SEQ ID NO: 2188861 - RNA, 14 nt, Streptococcus pneumoniae R6
cuccccuuuagaac

SEQ ID NO: 2188862 - RNA, 17 nt, Streptococcus pneumoniae R6
cucccaagcucugaaug

SEQ ID NO: 2188863 - RNA, 14 nt, Streptococcus pneumoniae R6
cuccagugaaaaca

SEQ ID NO: 2188864 - RNA, 20 nt, Streptococcus pneumoniae R6
cuccaguaacuuuaccaaaa

SEQ ID NO: 2188865 - RNA, 17 nt, Streptococcus pneumoniae R6
cuccaguuuuaaucuua

SEQ ID NO: 2188866 - RNA, 13 nt, Streptococcus pneumoniae R6
cuccauaaaaaga

SEQ ID NO: 2188867 - RNA, 21 nt, Streptococcus pneumoniae R6
cuccauaaacgcaagcaacaa

SEQ ID NO: 2188868 - RNA, 20 nt, Streptococcus pneumoniae R6
cucauguaaaucauuuucuu

SEQ ID NO: 2188869 - RNA, 14 nt, Streptococcus pneumoniae R6
cuccucuguaucaa

SEQ ID NO: 2188870 - RNA, 13 nt, Streptococcus pneumoniae R6
cuccucuccagca

SEQ ID NO: 2188871 - RNA, 22 nt, Streptococcus pneumoniae R6
cuccucgagcaguuccaucaau

SEQ ID NO: 2188872 - RNA, 12 nt, Streptococcus pneumoniae R6
cuccugcaauug

SEQ ID NO: 2188873 - RNA, 20 nt, Streptococcus pneumoniae R6
cuccuuuagugauaucuuga

SEQ ID NO: 2188874 - RNA, 16 nt, Streptococcus pneumoniae R6
cuccuguuucaaagua

SEQ ID NO: 2188875 - RNA, 14 nt, Streptococcus pneumoniae R6
cuccuucauuaagu

SEQ ID NO: 2188876 - RNA, 18 nt, Streptococcus pneumoniae R6
cuccuucuuuuuuauccu

SEQ ID NO: 2188877 - RNA, 22 nt, Streptococcus pneumoniae R6
cucgagaaaggggcucuuuguc

SEQ ID NO: 2188878 - RNA, 20 nt, Streptococcus pneumoniae R6
cucgagaaagguaacuccuu

SEQ ID NO: 2188879 - RNA, 21 nt, Streptococcus pneumoniae R6
cucgacugguaaagaauggau

SEQ ID NO: 2188880 - RNA, 17 nt, Streptococcus pneumoniae R6
cucgacacuagaugcau

SEQ ID NO: 2188881 - RNA, 18 nt, Streptococcus pneumoniae R6
cucgauaaaggacaaaau

SEQ ID NO: 2188882 - RNA, 23 nt, Streptococcus pneumoniae R6
cucgagcuuagcuuuucuucaac

SEQ ID NO: 2188883 - RNA, 15 nt, Streptococcus pneumoniae R6
cucuauucuuuuuug

SEQ ID NO: 2188884 - RNA, 18 nt, Streptococcus pneumoniae R6
cucuauacacauccagug

SEQ ID NO: 2188885 - RNA, 22 nt, Streptococcus pneumoniae R6
cucuaggaagcgaugauaagaa

SEQ ID NO: 2188886 - RNA, 14 nt, Streptococcus pneumoniae R6
cucuaguaaagugu

SEQ ID NO: 2188887 - RNA, 15 nt, Streptococcus pneumoniae R6
cucuaguuuaugaac

SEQ ID NO: 2188888 - RNA, 23 nt, Streptococcus pneumoniae R6
cucuagcuuuuuaauuuugaguc

SEQ ID NO: 2188889 - RNA, 21 nt, Streptococcus pneumoniae R6
cucuccaaauccccaagugac

SEQ ID NO: 2188890 - RNA, 15 nt, Streptococcus pneumoniae R6
cucucaauuccuuau

SEQ ID NO: 2188891 - RNA, 16 nt, Streptococcus pneumoniae R6
cucuccuccauaaaaa

SEQ ID NO: 2188892 - RNA, 22 nt, Streptococcus pneumoniae R6
cucugccagcugagcuaaggag

SEQ ID NO: 2188893 - RNA, 21 nt, Streptococcus pneumoniae R6
cucugaguauuuagcaaccau

SEQ ID NO: 2188894 - RNA, 20 nt, Streptococcus pneumoniae R6
cucugaggaaucaaucuuca

SEQ ID NO: 2188895 - RNA, 14 nt, Streptococcus pneumoniae R6
cucugagaccuuua

SEQ ID NO: 2188896 - RNA, 16 nt, Streptococcus pneumoniae R6
cucugcacuagcuuca

SEQ ID NO: 2188897 - RNA, 13 nt, Streptococcus pneumoniae R6
cucucuauaauaa

SEQ ID NO: 2188898 - RNA, 18 nt, Streptococcus pneumoniae R6
cucugaaaacaaguucuu

SEQ ID NO: 2188899 - RNA, 20 nt, Streptococcus pneumoniae R6
cucugaagucacuacuucca

SEQ ID NO: 2188900 - RNA, 23 nt, Streptococcus pneumoniae R6
cucugaagucacuacuuccaucu

SEQ ID NO: 2188901 - RNA, 23 nt, Streptococcus pneumoniae R6
cucucuucaaauuugacuaaaaa

SEQ ID NO: 2188902 - RNA, 15 nt, Streptococcus pneumoniae R6
cucggacuuuuucca

SEQ ID NO: 2188903 - RNA, 13 nt, Streptococcus pneumoniae R6
cucggcauuguga

SEQ ID NO: 2188904 - RNA, 15 nt, Streptococcus pneumoniae R6
cucgucacuugccuc

SEQ ID NO: 2188905 - RNA, 19 nt, Streptococcus pneumoniae R6
cucggucuuggaccaggau

SEQ ID NO: 2188906 - RNA, 16 nt, Streptococcus pneumoniae R6
cucggucaucaucacu

SEQ ID NO: 2188907 - RNA, 20 nt, Streptococcus pneumoniae R6
cguaugguucuggagaagca

SEQ ID NO: 2188908 - RNA, 17 nt, Streptococcus pneumoniae R6
cguauuccauuggaagu

SEQ ID NO: 2188909 - RNA, 13 nt, Streptococcus pneumoniae R6
cgucaaagaaggc

SEQ ID NO: 2188910 - RNA, 11 nt, Streptococcus pneumoniae R6
cgucaguucua

SEQ ID NO: 2188911 - RNA, 16 nt, Streptococcus pneumoniae R6
cgucaguucuaucugc

SEQ ID NO: 2188912 - RNA, 16 nt, Streptococcus pneumoniae R6
cgucaguuucaucuac

SEQ ID NO: 2188913 - RNA, 18 nt, Streptococcus pneumoniae R6
cgucaaauccauaguaaa

SEQ ID NO: 2188914 - RNA, 12 nt, Streptococcus pneumoniae R6
cgucacaaagaa

SEQ ID NO: 2188915 - RNA, 14 nt, Streptococcus pneumoniae R6
cguccuuucuuuuu

SEQ ID NO: 2188916 - RNA, 15 nt, Streptococcus pneumoniae R6
cguccuuucuuuuuu

SEQ ID NO: 2188917 - RNA, 19 nt, Streptococcus pneumoniae R6
cgguuuaucucccauacca

SEQ ID NO: 2188918 - RNA, 13 nt, Streptococcus pneumoniae R6
cguaaauugcccu

SEQ ID NO: 2188919 - RNA, 19 nt, Streptococcus pneumoniae R6
cguaacugguaagaaguaa

SEQ ID NO: 2188920 - RNA, 23 nt, Streptococcus pneumoniae R6
cguaagauagggcugaaggaaug

SEQ ID NO: 2188921 - RNA, 21 nt, Streptococcus pneumoniae R6
cguaaaccuucaagaccuucu

SEQ ID NO: 2188922 - RNA, 16 nt, Streptococcus pneumoniae R6
cgguuuggcguuagaa

SEQ ID NO: 2188923 - RNA, 12 nt, Streptococcus pneumoniae R6
cgguuuguauug

SEQ ID NO: 2188924 - RNA, 16 nt, Streptococcus pneumoniae R6
cgucugaguuuuuaug

SEQ ID NO: 2188925 - RNA, 13 nt, Streptococcus pneumoniae R6
cgucuuuuuuccg

SEQ ID NO: 2188926 - RNA, 17 nt, Streptococcus pneumoniae R6
cgugaguuccuguuuca

SEQ ID NO: 2188927 - RNA, 18 nt, Streptococcus pneumoniae R6
cgugcgcucuaaccaccu

SEQ ID NO: 2188928 - RNA, 22 nt, Streptococcus pneumoniae R6
cguguaugugcauaguauuugu

SEQ ID NO: 2188929 - RNA, 16 nt, Streptococcus pneumoniae R6
cgugguuuaaaaagag

SEQ ID NO: 2188930 - RNA, 18 nt, Streptococcus pneumoniae R6
cguguaggggauaaugag

SEQ ID NO: 2188931 - RNA, 14 nt, Streptococcus pneumoniae R6
cguguaguucuuua

SEQ ID NO: 2188932 - RNA, 20 nt, Streptococcus pneumoniae R6
cguguggguucauccagcag

SEQ ID NO: 2188933 - RNA, 22 nt, Streptococcus pneumoniae R6
cgugugagacggccuacaugcu

SEQ ID NO: 2188934 - RNA, 14 nt, Streptococcus pneumoniae R6
cgugugauaucaau

SEQ ID NO: 2188935 - RNA, 22 nt, Streptococcus pneumoniae R6
cgugcuaauucggcuugguucg

SEQ ID NO: 2188936 - RNA, 13 nt, Streptococcus pneumoniae R6
cgugggucaucaa

SEQ ID NO: 2188937 - RNA, 24 nt, Streptococcus pneumoniae R6
cguggguguagauggaaguaguga

SEQ ID NO: 2188938 - RNA, 16 nt, Streptococcus pneumoniae R6
cguugaaucuauaaca

SEQ ID NO: 2188939 - RNA, 20 nt, Streptococcus pneumoniae R6
cguugaaugaaaugaggcug

SEQ ID NO: 2188940 - RNA, 22 nt, Streptococcus pneumoniae R6
cguugacuguuucgucuuccau

SEQ ID NO: 2188941 - RNA, 13 nt, Streptococcus pneumoniae R6
cguucuucaacau

SEQ ID NO: 2188942 - RNA, 19 nt, Streptococcus pneumoniae R6
cguugaaaaagugagauau

SEQ ID NO: 2188943 - RNA, 15 nt, Streptococcus pneumoniae R6
cguucuucugcaguu

SEQ ID NO: 2188944 - RNA, 12 nt, Streptococcus pneumoniae R6
cguucucuuauu

SEQ ID NO: 2188945 - RNA, 22 nt, Streptococcus pneumoniae R6
cguuccaaagguccagaagccu

SEQ ID NO: 2188946 - RNA, 16 nt, Streptococcus pneumoniae R6
cguuccaagauuggau

SEQ ID NO: 2188947 - RNA, 19 nt, Streptococcus pneumoniae R6
cguuccaagauuggaucug

SEQ ID NO: 2188948 - RNA, 22 nt, Streptococcus pneumoniae R6
cguuccaguuuggcaaauagaa

SEQ ID NO: 2188949 - RNA, 20 nt, Streptococcus pneumoniae R6
cguuccagcgguaucaauca

SEQ ID NO: 2188950 - RNA, 17 nt, Streptococcus pneumoniae R6
cguugguaaaagcgcac

SEQ ID NO: 2188951 - RNA, 16 nt, Streptococcus pneumoniae R6
cguuggcuaaagauaa

SEQ ID NO: 2188952 - RNA, 20 nt, Streptococcus pneumoniae R6
cguuuacgaaucucuuucca

SEQ ID NO: 2188953 - RNA, 13 nt, Streptococcus pneumoniae R6
cguuuagcaucuu

SEQ ID NO: 2188954 - RNA, 20 nt, Streptococcus pneumoniae R6
cguuuagcaucuucuucugg

SEQ ID NO: 2188955 - RNA, 12 nt, Streptococcus pneumoniae R6
cguuuauauagu

SEQ ID NO: 2188956 - RNA, 19 nt, Streptococcus pneumoniae R6
cguuggaauaaggcagcuu

SEQ ID NO: 2188957 - RNA, 10 nt, Streptococcus pneumoniae R6
cguugcuuga

SEQ ID NO: 2188958 - RNA, 20 nt, Streptococcus pneumoniae R6
cguuucauggacuguuucau

SEQ ID NO: 2188959 - RNA, 17 nt, Streptococcus pneumoniae R6
cguuucagcauauuucc

SEQ ID NO: 2188960 - RNA, 18 nt, Streptococcus pneumoniae R6
cguuucagcauauuuccc

SEQ ID NO: 2188961 - RNA, 19 nt, Streptococcus pneumoniae R6
cguuucagcauauuuccca

SEQ ID NO: 2188962 - RNA, 11 nt, Streptococcus pneumoniae R6
cuaaaaauaaa

SEQ ID NO: 2188963 - RNA, 13 nt, Streptococcus pneumoniae R6
cuaaaaauaaaaa

SEQ ID NO: 2188964 - RNA, 19 nt, Streptococcus pneumoniae R6
cuaaaacauuuauagaaau

SEQ ID NO: 2188965 - RNA, 15 nt, Streptococcus pneumoniae R6
cuaaaacaguuacau

SEQ ID NO: 2188966 - RNA, 16 nt, Streptococcus pneumoniae R6
cuaaaaacucuucuuu

SEQ ID NO: 2188967 - RNA, 19 nt, Streptococcus pneumoniae R6
cuaaaaucaggucuuauag

SEQ ID NO: 2188968 - RNA, 16 nt, Streptococcus pneumoniae R6
cuaaaauguuuuucgu

SEQ ID NO: 2188969 - RNA, 19 nt, Streptococcus pneumoniae R6
cuaaaauuauguuuuugaa

SEQ ID NO: 2188970 - RNA, 20 nt, Streptococcus pneumoniae R6
cuaaagcaauuuugaaagau

SEQ ID NO: 2188971 - RNA, 19 nt, Streptococcus pneumoniae R6
cuaaagaauuugaaaaaaa

SEQ ID NO: 2188972 - RNA, 18 nt, Streptococcus pneumoniae R6
cuaaacuguacaagaaca

SEQ ID NO: 2188973 - RNA, 19 nt, Streptococcus pneumoniae R6
cuaaacuguacaagaacaa

SEQ ID NO: 2188974 - RNA, 9 nt, Streptococcus pneumoniae R6
cuaaauaca

SEQ ID NO: 2188975 - RNA, 14 nt, Streptococcus pneumoniae R6
cuaaauacaaaaac

SEQ ID NO: 2188976 - RNA, 20 nt, Streptococcus pneumoniae R6
cuaaauacaaaaacaaagag

SEQ ID NO: 2188977 - RNA, 12 nt, Streptococcus pneumoniae R6
cuaaauaaaucu

SEQ ID NO: 2188978 - RNA, 13 nt, Streptococcus pneumoniae R6
cuaaaguuccuaa

SEQ ID NO: 2188979 - RNA, 18 nt, Streptococcus pneumoniae R6
cuaaaguuccuaauuguu

SEQ ID NO: 2188980 - RNA, 17 nt, Streptococcus pneumoniae R6
cuaaauauaaucgauuu

SEQ ID NO: 2188981 - RNA, 15 nt, Streptococcus pneumoniae R6
cuaaauaccuuaucc

SEQ ID NO: 2188982 - RNA, 22 nt, Streptococcus pneumoniae R6
cuaaagggauccucauauucuu

SEQ ID NO: 2188983 - RNA, 16 nt, Streptococcus pneumoniae R6
cuaaaggcuuaauauu

SEQ ID NO: 2188984 - RNA, 18 nt, Streptococcus pneumoniae R6
cuaaaggcuuaauauuac

SEQ ID NO: 2188985 - RNA, 19 nt, Streptococcus pneumoniae R6
cuaaauuccaaauuagaaa

SEQ ID NO: 2188986 - RNA, 16 nt, Streptococcus pneumoniae R6
cuaaauucaauucacu

SEQ ID NO: 2188987 - RNA, 21 nt, Streptococcus pneumoniae R6
cuaaauucaauucacuauaac

SEQ ID NO: 2188988 - RNA, 19 nt, Streptococcus pneumoniae R6
cuaaauugaauaaagucaa

SEQ ID NO: 2188989 - RNA, 18 nt, Streptococcus pneumoniae R6
cuaaauuacgauucauag

SEQ ID NO: 2188990 - RNA, 16 nt, Streptococcus pneumoniae R6
cuaaaugcugaaaagu

SEQ ID NO: 2188991 - RNA, 14 nt, Streptococcus pneumoniae R6
cuaaaucuugcccu

SEQ ID NO: 2188992 - RNA, 17 nt, Streptococcus pneumoniae R6
cuaaaucgauuauauuu

SEQ ID NO: 2188993 - RNA, 15 nt, Streptococcus pneumoniae R6
cuaaauccuuuuuuc

SEQ ID NO: 2188994 - RNA, 16 nt, Streptococcus pneumoniae R6
cuaaauccuuuuuucu

SEQ ID NO: 2188995 - RNA, 17 nt, Streptococcus pneumoniae R6
cuaaauccuuuuuucuu

SEQ ID NO: 2188996 - RNA, 21 nt, Streptococcus pneumoniae R6
cuaaauccuuuuuucuuuacu

SEQ ID NO: 2188997 - RNA, 23 nt, Streptococcus pneumoniae R6
cuaaauccuuuuuucuuuacucu

SEQ ID NO: 2188998 - RNA, 12 nt, Streptococcus pneumoniae R6
cggcuuucacaa

SEQ ID NO: 2188999 - RNA, 13 nt, Streptococcus pneumoniae R6
cggcuguucuuuu

SEQ ID NO: 2189000 - RNA, 16 nt, Streptococcus pneumoniae R6
cggcuucaucuggauu

SEQ ID NO: 2189001 - RNA, 18 nt, Streptococcus pneumoniae R6
cggcugguuaaaggcugc

SEQ ID NO: 2189002 - RNA, 19 nt, Streptococcus pneumoniae R6
cggcugguuaaaggcugcg

SEQ ID NO: 2189003 - RNA, 18 nt, Streptococcus pneumoniae R6
aaacuaguuuaaaagacu

SEQ ID NO: 2189004 - RNA, 15 nt, Streptococcus pneumoniae R6
aaacuaguuuaaauc

SEQ ID NO: 2189005 - RNA, 16 nt, Streptococcus pneumoniae R6
aaacuaguuuugagaa

SEQ ID NO: 2189006 - RNA, 12 nt, Streptococcus pneumoniae R6
cggucaucauca

SEQ ID NO: 2189007 - RNA, 16 nt, Streptococcus pneumoniae R6
cggucgccguuuacgu

SEQ ID NO: 2189008 - RNA, 12 nt, Streptococcus pneumoniae R6
cgguauuuucau

SEQ ID NO: 2189009 - RNA, 20 nt, Streptococcus pneumoniae R6
cggucaaucgcuuaauuucu

SEQ ID NO: 2189010 - RNA, 19 nt, Streptococcus pneumoniae R6
cggucaccgacaacuucaa

SEQ ID NO: 2189011 - RNA, 20 nt, Streptococcus pneumoniae R6
aaacuagcugcaggcugcuc

SEQ ID NO: 2189012 - RNA, 16 nt, Streptococcus pneumoniae R6
aaacuaggauuuucuu

SEQ ID NO: 2189013 - RNA, 17 nt, Streptococcus pneumoniae R6
aaacuagaauagaaaca

SEQ ID NO: 2189014 - RNA, 20 nt, Streptococcus pneumoniae R6
aaacuagaauaggacaucau

SEQ ID NO: 2189015 - RNA, 19 nt, Streptococcus pneumoniae R6
aaacuagcaagugcuaaga

SEQ ID NO: 2189016 - RNA, 16 nt, Streptococcus pneumoniae R6
aaacuagaaagcuagu

SEQ ID NO: 2189017 - RNA, 13 nt, Streptococcus pneumoniae R6
aaacuacuauuua

SEQ ID NO: 2189018 - RNA, 20 nt, Streptococcus pneumoniae R6
aaacuacgucagcuuccauc

SEQ ID NO: 2189019 - RNA, 22 nt, Streptococcus pneumoniae R6
aaacuacacccgcauaaauacu

SEQ ID NO: 2189020 - RNA, 23 nt, Streptococcus pneumoniae R6
aaacuaaagcuuuuuucuuuuau

SEQ ID NO: 2189021 - RNA, 19 nt, Streptococcus pneumoniae R6
aaacguuuuucaaaccuuc

SEQ ID NO: 2189022 - RNA, 18 nt, Streptococcus pneumoniae R6
aaacuaauagguacaaaa

SEQ ID NO: 2189023 - RNA, 11 nt, Streptococcus pneumoniae R6
aaacuaaugag

SEQ ID NO: 2189024 - RNA, 16 nt, Streptococcus pneumoniae R6
aaacuaauguaaaaaa

SEQ ID NO: 2189025 - RNA, 21 nt, Streptococcus pneumoniae R6
aaacuaauuuagagaaugaaa

SEQ ID NO: 2189026 - RNA, 19 nt, Streptococcus pneumoniae R6
cgguaagaaagcaacuaaa

SEQ ID NO: 2189027 - RNA, 22 nt, Streptococcus pneumoniae R6
cgguaaccgaugacaaaaauag

SEQ ID NO: 2189028 - RNA, 12 nt, Streptococcus pneumoniae R6
cggguuuuaaac

SEQ ID NO: 2189029 - RNA, 15 nt, Streptococcus pneumoniae R6
cuucugcuucuaaaa

SEQ ID NO: 2189030 - RNA, 19 nt, Streptococcus pneumoniae R6
cuucucggacuuuuuccaa

SEQ ID NO: 2189031 - RNA, 23 nt, Streptococcus pneumoniae R6
cuucuccuaaaauugacuuucuu

SEQ ID NO: 2189032 - RNA, 16 nt, Streptococcus pneumoniae R6
cuucuccaguuuuaau

SEQ ID NO: 2189033 - RNA, 14 nt, Streptococcus pneumoniae R6
cuucuccaucuuag

SEQ ID NO: 2189034 - RNA, 16 nt, Streptococcus pneumoniae R6
cuucucaggcuuuuuc

SEQ ID NO: 2189035 - RNA, 18 nt, Streptococcus pneumoniae R6
cuucucaggcuuuuucug

SEQ ID NO: 2189036 - RNA, 22 nt, Streptococcus pneumoniae R6
cuucucaggcuuuuucuguacu

SEQ ID NO: 2189037 - RNA, 20 nt, Streptococcus pneumoniae R6
cuucgucguaaccuucuucu

SEQ ID NO: 2189038 - RNA, 20 nt, Streptococcus pneumoniae R6
cuucgucauuuaaagauguc

SEQ ID NO: 2189039 - RNA, 14 nt, Streptococcus pneumoniae R6
cuucgucaguucca

SEQ ID NO: 2189040 - RNA, 15 nt, Streptococcus pneumoniae R6
cuucgucaguucuau

SEQ ID NO: 2189041 - RNA, 19 nt, Streptococcus pneumoniae R6
cuucgucaguucuauccac

SEQ ID NO: 2189042 - RNA, 21 nt, Streptococcus pneumoniae R6
cuucguaaauaagcucuguuu

SEQ ID NO: 2189043 - RNA, 15 nt, Streptococcus pneumoniae R6
cuucuaaaacauugu

SEQ ID NO: 2189044 - RNA, 18 nt, Streptococcus pneumoniae R6
cuucguguuccaaagcca

SEQ ID NO: 2189045 - RNA, 15 nt, Streptococcus pneumoniae R6
cuucguucacccuug

SEQ ID NO: 2189046 - RNA, 19 nt, Streptococcus pneumoniae R6
cuucuaagcucuuaaaagc

SEQ ID NO: 2189047 - RNA, 16 nt, Streptococcus pneumoniae R6
cuucuaaauuaacuag

SEQ ID NO: 2189048 - RNA, 20 nt, Streptococcus pneumoniae R6
cuucuacaacgucuuuugcc

SEQ ID NO: 2189049 - RNA, 21 nt, Streptococcus pneumoniae R6
cuucuacaacgucuuuugccu

SEQ ID NO: 2189050 - RNA, 18 nt, Streptococcus pneumoniae R6
cuucuacagcuagcuaga

SEQ ID NO: 2189051 - RNA, 14 nt, Streptococcus pneumoniae R6
cuucuaucuucuug

SEQ ID NO: 2189052 - RNA, 15 nt, Streptococcus pneumoniae R6
cuucuagcuucauau

SEQ ID NO: 2189053 - RNA, 15 nt, Streptococcus pneumoniae R6
cuucuacuuccugcu

SEQ ID NO: 2189054 - RNA, 21 nt, Streptococcus pneumoniae R6
cuucuagcuaucuccucauau

SEQ ID NO: 2189055 - RNA, 23 nt, Streptococcus pneumoniae R6
cuucuugaguaguuccagugauu

SEQ ID NO: 2189056 - RNA, 17 nt, Streptococcus pneumoniae R6
cuucuugaccaacuuua

SEQ ID NO: 2189057 - RNA, 18 nt, Streptococcus pneumoniae R6
cuucuugaccaacuuuaa

SEQ ID NO: 2189058 - RNA, 21 nt, Streptococcus pneumoniae R6
cuucuuggaauucuggauuuu

SEQ ID NO: 2189059 - RNA, 18 nt, Streptococcus pneumoniae R6
cuucuuguccaagcaagg

SEQ ID NO: 2189060 - RNA, 12 nt, Streptococcus pneumoniae R6
cuucuucuucca

SEQ ID NO: 2189061 - RNA, 10 nt, Streptococcus pneumoniae R6
cuucuucccc

SEQ ID NO: 2189062 - RNA, 15 nt, Streptococcus pneumoniae R6
cuucuucgcuuucuu

SEQ ID NO: 2189063 - RNA, 14 nt, Streptococcus pneumoniae R6
cuucuucgaugacc

SEQ ID NO: 2189064 - RNA, 20 nt, Streptococcus pneumoniae R6
cuucugugauauaaucuuua

SEQ ID NO: 2189065 - RNA, 19 nt, Streptococcus pneumoniae R6
cuucugucuauuugcuuuu

SEQ ID NO: 2189066 - RNA, 20 nt, Streptococcus pneumoniae R6
cuucugucuauuugcuuuuc

SEQ ID NO: 2189067 - RNA, 16 nt, Streptococcus pneumoniae R6
cuucuguaagucauuu

SEQ ID NO: 2189068 - RNA, 20 nt, Streptococcus pneumoniae R6
cuucuguaagucauuuucuu

SEQ ID NO: 2189069 - RNA, 17 nt, Streptococcus pneumoniae R6
cuucuguacauuagaau

SEQ ID NO: 2189070 - RNA, 14 nt, Streptococcus pneumoniae R6
cuucuggcacagaa

SEQ ID NO: 2189071 - RNA, 18 nt, Streptococcus pneumoniae R6
cuucuggcuuaacaaugg

SEQ ID NO: 2189072 - RNA, 13 nt, Streptococcus pneumoniae R6
cuucugggagaaa

SEQ ID NO: 2189073 - RNA, 15 nt, Streptococcus pneumoniae R6
cuucuuauuagcaac

SEQ ID NO: 2189074 - RNA, 14 nt, Streptococcus pneumoniae R6
cuucuuuucuuuua

SEQ ID NO: 2189075 - RNA, 21 nt, Streptococcus pneumoniae R6
cuucuuuauguucaucuucuu

SEQ ID NO: 2189076 - RNA, 22 nt, Streptococcus pneumoniae R6
cuugaaaccaguuccuuugucu

SEQ ID NO: 2189077 - RNA, 18 nt, Streptococcus pneumoniae R6
cuugaaauaucuggacuu

SEQ ID NO: 2189078 - RNA, 11 nt, Streptococcus pneumoniae R6
cuugaaaucaa

SEQ ID NO: 2189079 - RNA, 22 nt, Streptococcus pneumoniae R6
cuugaaacucaucuuggucagg

SEQ ID NO: 2189080 - RNA, 15 nt, Streptococcus pneumoniae R6
cuugaaacaaauaaa

SEQ ID NO: 2189081 - RNA, 22 nt, Streptococcus pneumoniae R6
cuucuuuuuguauuucuucuuc

SEQ ID NO: 2189082 - RNA, 23 nt, Streptococcus pneumoniae R6
cuucuuuuuguauuucuucuucu

SEQ ID NO: 2189083 - RNA, 17 nt, Streptococcus pneumoniae R6
cuucuuuuuugagauga

SEQ ID NO: 2189084 - RNA, 18 nt, Streptococcus pneumoniae R6
cuucuuuuuauauauaaa

SEQ ID NO: 2189085 - RNA, 12 nt, Streptococcus pneumoniae R6
cuucuuuuucuc

SEQ ID NO: 2189086 - RNA, 13 nt, Streptococcus pneumoniae R6
cuucuuuuucucc

SEQ ID NO: 2189087 - RNA, 18 nt, Streptococcus pneumoniae R6
cuucuuuuuguccuucuu

SEQ ID NO: 2189088 - RNA, 22 nt, Streptococcus pneumoniae R6
cuucuuuuuuauccucaaaauu

SEQ ID NO: 2189089 - RNA, 16 nt, Streptococcus pneumoniae R6
cuugaccacguucugc

SEQ ID NO: 2189090 - RNA, 15 nt, Streptococcus pneumoniae R6
cuugaccaacuuuaa

SEQ ID NO: 2189091 - RNA, 16 nt, Streptococcus pneumoniae R6
cuugaccaaguccuca

SEQ ID NO: 2189092 - RNA, 20 nt, Streptococcus pneumoniae R6
cuugacauacaacuuaaaaa

SEQ ID NO: 2189093 - RNA, 23 nt, Streptococcus pneumoniae R6
cuugaccagcuacuguacuuccc

SEQ ID NO: 2189094 - RNA, 21 nt, Streptococcus pneumoniae R6
cuugaauagauacaaaaccaa

SEQ ID NO: 2189095 - RNA, 22 nt, Streptococcus pneumoniae R6
cuugaauagauacaaaaccaaa

SEQ ID NO: 2189096 - RNA, 14 nt, Streptococcus pneumoniae R6
cuugaaugauaaaa

SEQ ID NO: 2189097 - RNA, 20 nt, Streptococcus pneumoniae R6
cuugaauuuacguccuugga

SEQ ID NO: 2189098 - RNA, 13 nt, Streptococcus pneumoniae R6
cuugaauuagaag

SEQ ID NO: 2189099 - RNA, 19 nt, Streptococcus pneumoniae R6
cuugacaaagaaaaaacaa

SEQ ID NO: 2189100 - RNA, 22 nt, Streptococcus pneumoniae R6
cuugacaaagaaaaaacaaagu

SEQ ID NO: 2189101 - RNA, 14 nt, Streptococcus pneumoniae R6
cuugaacuucuuga

SEQ ID NO: 2189102 - RNA, 16 nt, Streptococcus pneumoniae R6
cuugaaguugauucau

SEQ ID NO: 2189103 - RNA, 15 nt, Streptococcus pneumoniae R6
cuugaaguucauuuu

SEQ ID NO: 2189104 - RNA, 12 nt, Streptococcus pneumoniae R6
cuugaagaguug

SEQ ID NO: 2189105 - RNA, 19 nt, Streptococcus pneumoniae R6
cuugaaggacuuccaauuc

SEQ ID NO: 2189106 - RNA, 18 nt, Streptococcus pneumoniae R6
cuugaaggggcaacucuu

SEQ ID NO: 2189107 - RNA, 17 nt, Streptococcus pneumoniae R6
cuugagcgaauccuuga

SEQ ID NO: 2189108 - RNA, 22 nt, Streptococcus pneumoniae R6
cuugagcgaauccuugauaaca

SEQ ID NO: 2189109 - RNA, 15 nt, Streptococcus pneumoniae R6
cuugagcaaacugaa

SEQ ID NO: 2189110 - RNA, 21 nt, Streptococcus pneumoniae R6
cuugagcaaacugaauccgca

SEQ ID NO: 2189111 - RNA, 22 nt, Streptococcus pneumoniae R6
cuugagagaagcaagugacaaa

SEQ ID NO: 2189112 - RNA, 14 nt, Streptococcus pneumoniae R6
cuugagaagagcuu

SEQ ID NO: 2189113 - RNA, 16 nt, Streptococcus pneumoniae R6
cuugauaacagcugcg

SEQ ID NO: 2189114 - RNA, 22 nt, Streptococcus pneumoniae R6
cuugauacugaucaaaaaauuu

SEQ ID NO: 2189115 - RNA, 23 nt, Streptococcus pneumoniae R6
cuugauauuaugcguuuuacuau

SEQ ID NO: 2189116 - RNA, 22 nt, Streptococcus pneumoniae R6
cuugauagcagaauuuaacucu

SEQ ID NO: 2189117 - RNA, 19 nt, Streptococcus pneumoniae R6
cuugauagccuuguauuca

SEQ ID NO: 2189118 - RNA, 18 nt, Streptococcus pneumoniae R6
cuugauauaguuaaaaaa

SEQ ID NO: 2189119 - RNA, 22 nt, Streptococcus pneumoniae R6
cuugaguugauagaaagcaagg

SEQ ID NO: 2189120 - RNA, 13 nt, Streptococcus pneumoniae R6
cuugaguggaaaa

SEQ ID NO: 2189121 - RNA, 18 nt, Streptococcus pneumoniae R6
cuugaguggaaaaaccuu

SEQ ID NO: 2189122 - RNA, 20 nt, Streptococcus pneumoniae R6
cuugaguggauuuuuaagaa

SEQ ID NO: 2189123 - RNA, 23 nt, Streptococcus pneumoniae R6
cuugagguuuuagauaagacuga

SEQ ID NO: 2189124 - RNA, 21 nt, Streptococcus pneumoniae R6
cuugaguaaauaaaacaaaaa

SEQ ID NO: 2189125 - RNA, 22 nt, Streptococcus pneumoniae R6
cuugaguaaauaaaacaaaaaa

SEQ ID NO: 2189126 - RNA, 20 nt, Streptococcus pneumoniae R6
cuugagcuaggguguuuuca

SEQ ID NO: 2189127 - RNA, 22 nt, Streptococcus pneumoniae R6
cuugagcuaggguguuuucaau

SEQ ID NO: 2189128 - RNA, 16 nt, Streptococcus pneumoniae R6
cuugagcugcugugau

SEQ ID NO: 2189129 - RNA, 22 nt, Streptococcus pneumoniae R6
cuugaugugacuguuucagaga

SEQ ID NO: 2189130 - RNA, 16 nt, Streptococcus pneumoniae R6
cuugauggacaacaau

SEQ ID NO: 2189131 - RNA, 20 nt, Streptococcus pneumoniae R6
cuugaugaaagauauuuugc

SEQ ID NO: 2189132 - RNA, 18 nt, Streptococcus pneumoniae R6
cuugaugagcaaaggauu

SEQ ID NO: 2189133 - RNA, 17 nt, Streptococcus pneumoniae R6
cuugaugcgauugauuu

SEQ ID NO: 2189134 - RNA, 21 nt, Streptococcus pneumoniae R6
cuugcaaugagccaaggaagu

SEQ ID NO: 2189135 - RNA, 15 nt, Streptococcus pneumoniae R6
cuugauuuuuuccua

SEQ ID NO: 2189136 - RNA, 22 nt, Streptococcus pneumoniae R6
cuugauuuuuuuuaaaaaagug

SEQ ID NO: 2189137 - RNA, 13 nt, Streptococcus pneumoniae R6
cuugcaaaaaaac

SEQ ID NO: 2189138 - RNA, 15 nt, Streptococcus pneumoniae R6
cuugcaaacuuuuua

SEQ ID NO: 2189139 - RNA, 13 nt, Streptococcus pneumoniae R6
cuugauuuaucca

SEQ ID NO: 2189140 - RNA, 15 nt, Streptococcus pneumoniae R6
cuugauugcaaagca

SEQ ID NO: 2189141 - RNA, 15 nt, Streptococcus pneumoniae R6
cuugcaggaaauuuu

SEQ ID NO: 2189142 - RNA, 16 nt, Streptococcus pneumoniae R6
cuugcaggaaauuuuu

SEQ ID NO: 2189143 - RNA, 19 nt, Streptococcus pneumoniae R6
cuugcauuuuaauuucaau

SEQ ID NO: 2189144 - RNA, 12 nt, Streptococcus pneumoniae R6
cuugcauuuuuu

SEQ ID NO: 2189145 - RNA, 18 nt, Streptococcus pneumoniae R6
cuugccaacccucucuuc

SEQ ID NO: 2189146 - RNA, 14 nt, Streptococcus pneumoniae R6
cuugccuucaacac

SEQ ID NO: 2189147 - RNA, 16 nt, Streptococcus pneumoniae R6
cuugccgauugauuua

SEQ ID NO: 2189148 - RNA, 22 nt, Streptococcus pneumoniae R6
aaacuuuauaauauguauuuau

SEQ ID NO: 2189149 - RNA, 21 nt, Streptococcus pneumoniae R6
aaacuugguaauuugaacaaa

SEQ ID NO: 2189150 - RNA, 16 nt, Streptococcus pneumoniae R6
aaacuuguaagucaag

SEQ ID NO: 2189151 - RNA, 20 nt, Streptococcus pneumoniae R6
aaacuugugauuuaguagca

SEQ ID NO: 2189152 - RNA, 18 nt, Streptococcus pneumoniae R6
aaacuugcaggaaauuuu

SEQ ID NO: 2189153 - RNA, 15 nt, Streptococcus pneumoniae R6
aaacuugcucagagg

SEQ ID NO: 2189154 - RNA, 13 nt, Streptococcus pneumoniae R6
cuugcccauacga

SEQ ID NO: 2189155 - RNA, 15 nt, Streptococcus pneumoniae R6
cuugcuccaaaggag

SEQ ID NO: 2189156 - RNA, 14 nt, Streptococcus pneumoniae R6
cuugcucucccccu

SEQ ID NO: 2189157 - RNA, 21 nt, Streptococcus pneumoniae R6
cuugcucagaggagaugaauu

SEQ ID NO: 2189158 - RNA, 22 nt, Streptococcus pneumoniae R6
cuugcuagucauaacugcuuug

SEQ ID NO: 2189159 - RNA, 14 nt, Streptococcus pneumoniae R6
cuugcuucccauuu

SEQ ID NO: 2189160 - RNA, 18 nt, Streptococcus pneumoniae R6
cuugcuuuuucuuuuuag

SEQ ID NO: 2189161 - RNA, 11 nt, Streptococcus pneumoniae R6
cuuggaaaaau

SEQ ID NO: 2189162 - RNA, 20 nt, Streptococcus pneumoniae R6
cuugcuguuuucuuggucau

SEQ ID NO: 2189163 - RNA, 23 nt, Streptococcus pneumoniae R6
cuugcguugagcgaaaucugucu

SEQ ID NO: 2189164 - RNA, 23 nt, Streptococcus pneumoniae R6
cuguuuaaauucauuaaacucug

SEQ ID NO: 2189165 - RNA, 22 nt, Streptococcus pneumoniae R6
cuguugucacauagacuccaua

SEQ ID NO: 2189166 - RNA, 21 nt, Streptococcus pneumoniae R6
cuguucgcaagauagaaccca

SEQ ID NO: 2189167 - RNA, 22 nt, Streptococcus pneumoniae R6
cuguuucaggaaguuuuuucuc

SEQ ID NO: 2189168 - RNA, 12 nt, Streptococcus pneumoniae R6
cuguuucagaga

SEQ ID NO: 2189169 - RNA, 23 nt, Streptococcus pneumoniae R6
cuguuucugcaaccucuacaaua

SEQ ID NO: 2189170 - RNA, 22 nt, Streptococcus pneumoniae R6
cuguuuauuuuuuaauuaauca

SEQ ID NO: 2189171 - RNA, 16 nt, Streptococcus pneumoniae R6
cuguuucaaaugaaau

SEQ ID NO: 2189172 - RNA, 20 nt, Streptococcus pneumoniae R6
cuguuucaaaugaaauauuu

SEQ ID NO: 2189173 - RNA, 22 nt, Streptococcus pneumoniae R6
cuuaacccgcucaaaaucauca

SEQ ID NO: 2189174 - RNA, 15 nt, Streptococcus pneumoniae R6
cuuaacccuuuuuau

SEQ ID NO: 2189175 - RNA, 21 nt, Streptococcus pneumoniae R6
cuuaaucaauuaucauuucca

SEQ ID NO: 2189176 - RNA, 22 nt, Streptococcus pneumoniae R6
cuuaauaucagccagagcacca

SEQ ID NO: 2189177 - RNA, 22 nt, Streptococcus pneumoniae R6
cuuaauagugggaauuuguaaa

SEQ ID NO: 2189178 - RNA, 22 nt, Streptococcus pneumoniae R6
cuuaaauugguguuguuuauua

SEQ ID NO: 2189179 - RNA, 14 nt, Streptococcus pneumoniae R6
aaacugcuuagaac

SEQ ID NO: 2189180 - RNA, 12 nt, Streptococcus pneumoniae R6
cuuaaaaccaug

SEQ ID NO: 2189181 - RNA, 17 nt, Streptococcus pneumoniae R6
cuuaaagccacuauaau

SEQ ID NO: 2189182 - RNA, 21 nt, Streptococcus pneumoniae R6
cuuaaauaaaauuuuuuucaa

SEQ ID NO: 2189183 - RNA, 20 nt, Streptococcus pneumoniae R6
cuuaaaugacauuccugucu

SEQ ID NO: 2189184 - RNA, 16 nt, Streptococcus pneumoniae R6
cuuaaaaaucuucaaa

SEQ ID NO: 2189185 - RNA, 13 nt, Streptococcus pneumoniae R6
cuuaaaaaguuac

SEQ ID NO: 2189186 - RNA, 15 nt, Streptococcus pneumoniae R6
cuuacaucaaaaaca

SEQ ID NO: 2189187 - RNA, 17 nt, Streptococcus pneumoniae R6
cuuacaucaaaaacauc

SEQ ID NO: 2189188 - RNA, 21 nt, Streptococcus pneumoniae R6
cuuacauuaugcguuuuugug

SEQ ID NO: 2189189 - RNA, 18 nt, Streptococcus pneumoniae R6
cuuacaguuugcucagca

SEQ ID NO: 2189190 - RNA, 21 nt, Streptococcus pneumoniae R6
cuuacauaaaguauuauaaua

SEQ ID NO: 2189191 - RNA, 14 nt, Streptococcus pneumoniae R6
cuuaaucuuggcaa

SEQ ID NO: 2189192 - RNA, 17 nt, Streptococcus pneumoniae R6
cuuagcagacuucuuuu

SEQ ID NO: 2189193 - RNA, 19 nt, Streptococcus pneumoniae R6
cuuagcagacuucuuuuuu

SEQ ID NO: 2189194 - RNA, 23 nt, Streptococcus pneumoniae R6
cuuagcagacuucuuuuuuacuu

SEQ ID NO: 2189195 - RNA, 24 nt, Streptococcus pneumoniae R6
cuuagccaagucaguuuuccguuc

SEQ ID NO: 2189196 - RNA, 13 nt, Streptococcus pneumoniae R6
cuuagcauggaac

SEQ ID NO: 2189197 - RNA, 23 nt, Streptococcus pneumoniae R6
cuuagauugcuuugcaaucaagu

SEQ ID NO: 2189198 - RNA, 23 nt, Streptococcus pneumoniae R6
cuuacuuaacccuuuuuauacuc

SEQ ID NO: 2189199 - RNA, 23 nt, Streptococcus pneumoniae R6
cuuagacgguuuaccaauuuuuc

SEQ ID NO: 2189200 - RNA, 19 nt, Streptococcus pneumoniae R6
cuuacucuuucgaucaguc

SEQ ID NO: 2189201 - RNA, 17 nt, Streptococcus pneumoniae R6
cuuacucuacagauuuc

SEQ ID NO: 2189202 - RNA, 18 nt, Streptococcus pneumoniae R6
cuuacucuacagauuuca

SEQ ID NO: 2189203 - RNA, 17 nt, Streptococcus pneumoniae R6
cuuacuauucacucaaa

SEQ ID NO: 2189204 - RNA, 13 nt, Streptococcus pneumoniae R6
cuuacuauacuua

SEQ ID NO: 2189205 - RNA, 21 nt, Streptococcus pneumoniae R6
cuuacgaaugaguucaaagcu

SEQ ID NO: 2189206 - RNA, 14 nt, Streptococcus pneumoniae R6
cuuagcuuuucuuc

SEQ ID NO: 2189207 - RNA, 22 nt, Streptococcus pneumoniae R6
cuuagcuuuucuucaacccacu

SEQ ID NO: 2189208 - RNA, 21 nt, Streptococcus pneumoniae R6
cuuauaugcuagaauguaguu

SEQ ID NO: 2189209 - RNA, 19 nt, Streptococcus pneumoniae R6
cuuauauuaaaaaaagggg

SEQ ID NO: 2189210 - RNA, 22 nt, Streptococcus pneumoniae R6
cuuauaguaacgagucaaaaaa

SEQ ID NO: 2189211 - RNA, 20 nt, Streptococcus pneumoniae R6
cuuauaguacuaaucuuugc

SEQ ID NO: 2189212 - RNA, 20 nt, Streptococcus pneumoniae R6
cuuauauauccauucuuaaa

SEQ ID NO: 2189213 - RNA, 23 nt, Streptococcus pneumoniae R6
cuuauauauccauucuuaaaauu

SEQ ID NO: 2189214 - RNA, 23 nt, Streptococcus pneumoniae R6
cuuauaguuugucuuucauuucu

SEQ ID NO: 2189215 - RNA, 16 nt, Streptococcus pneumoniae R6
cuuaucagaaaauaaa

SEQ ID NO: 2189216 - RNA, 14 nt, Streptococcus pneumoniae R6
cuuauuucaaaaaa

SEQ ID NO: 2189217 - RNA, 15 nt, Streptococcus pneumoniae R6
cuuauuucaaaaaau

SEQ ID NO: 2189218 - RNA, 16 nt, Streptococcus pneumoniae R6
cuuauuucaaaaaaug

SEQ ID NO: 2189219 - RNA, 16 nt, Streptococcus pneumoniae R6
cuuauuucauuucacu

SEQ ID NO: 2189220 - RNA, 12 nt, Streptococcus pneumoniae R6
cuuauuucacau

SEQ ID NO: 2189221 - RNA, 18 nt, Streptococcus pneumoniae R6
cuuauuucacauuuucaa

SEQ ID NO: 2189222 - RNA, 22 nt, Streptococcus pneumoniae R6
cuuauuguuguaauaaucaaua

SEQ ID NO: 2189223 - RNA, 21 nt, Streptococcus pneumoniae R6
cuuaugcauaaucuuggucaa

SEQ ID NO: 2189224 - RNA, 12 nt, Streptococcus pneumoniae R6
cuuauccuuguc

SEQ ID NO: 2189225 - RNA, 13 nt, Streptococcus pneumoniae R6
cuuauccuuguca

SEQ ID NO: 2189226 - RNA, 13 nt, Streptococcus pneumoniae R6
cuuccacuuccag

SEQ ID NO: 2189227 - RNA, 15 nt, Streptococcus pneumoniae R6
cuuccacuuccagaa

SEQ ID NO: 2189228 - RNA, 22 nt, Streptococcus pneumoniae R6
aaacuucgucauuuaaagaugu

SEQ ID NO: 2189229 - RNA, 18 nt, Streptococcus pneumoniae R6
cuucauuuccaaugauga

SEQ ID NO: 2189230 - RNA, 11 nt, Streptococcus pneumoniae R6
cuucauuuuug

SEQ ID NO: 2189231 - RNA, 14 nt, Streptococcus pneumoniae R6
cuucauuuuugccu

SEQ ID NO: 2189232 - RNA, 12 nt, Streptococcus pneumoniae R6
cuucauuuuguu

SEQ ID NO: 2189233 - RNA, 15 nt, Streptococcus pneumoniae R6
cuucccucucagauu

SEQ ID NO: 2189234 - RNA, 16 nt, Streptococcus pneumoniae R6
cuuccuaccuauucac

SEQ ID NO: 2189235 - RNA, 20 nt, Streptococcus pneumoniae R6
cuuccuacugauaucuuuag

SEQ ID NO: 2189236 - RNA, 17 nt, Streptococcus pneumoniae R6
cuuccucaacaaaaugu

SEQ ID NO: 2189237 - RNA, 18 nt, Streptococcus pneumoniae R6
cuucgacuauuugaguaa

SEQ ID NO: 2189238 - RNA, 23 nt, Streptococcus pneumoniae R6
cuucagcuuuuuuggcagauuua

SEQ ID NO: 2189239 - RNA, 15 nt, Streptococcus pneumoniae R6
cuucaggauuuuuac

SEQ ID NO: 2189240 - RNA, 18 nt, Streptococcus pneumoniae R6
cuucaggauugauaaaau

SEQ ID NO: 2189241 - RNA, 15 nt, Streptococcus pneumoniae R6
cuucaggagauaaaa

SEQ ID NO: 2189242 - RNA, 23 nt, Streptococcus pneumoniae R6
cuucagauuaguaauucaauuaa

SEQ ID NO: 2189243 - RNA, 16 nt, Streptococcus pneumoniae R6
cuucaucaaagcuagu

SEQ ID NO: 2189244 - RNA, 17 nt, Streptococcus pneumoniae R6
cuucaucauuuuauuca

SEQ ID NO: 2189245 - RNA, 20 nt, Streptococcus pneumoniae R6
cuucaucauuuuauucauau

SEQ ID NO: 2189246 - RNA, 18 nt, Streptococcus pneumoniae R6
cuucaucccaguggcuaa

SEQ ID NO: 2189247 - RNA, 17 nt, Streptococcus pneumoniae R6
cuucauuuagaacacca

SEQ ID NO: 2189248 - RNA, 15 nt, Streptococcus pneumoniae R6
cuucauuuaucuucu

SEQ ID NO: 2189249 - RNA, 21 nt, Streptococcus pneumoniae R6
cuucauugacagaaccuugga

SEQ ID NO: 2189250 - RNA, 16 nt, Streptococcus pneumoniae R6
cuucaacccacuacag

SEQ ID NO: 2189251 - RNA, 23 nt, Streptococcus pneumoniae R6
cuucaacccacuacaguugacaa

SEQ ID NO: 2189252 - RNA, 22 nt, Streptococcus pneumoniae R6
cuucaaaaucgagguauuucuu

SEQ ID NO: 2189253 - RNA, 19 nt, Streptococcus pneumoniae R6
cuucaaaaucaaagaacaa

SEQ ID NO: 2189254 - RNA, 14 nt, Streptococcus pneumoniae R6
cuuauuuuugcaag

SEQ ID NO: 2189255 - RNA, 13 nt, Streptococcus pneumoniae R6
cuucaaaaaagug

SEQ ID NO: 2189256 - RNA, 15 nt, Streptococcus pneumoniae R6
cuuauuuucuacucu

SEQ ID NO: 2189257 - RNA, 20 nt, Streptococcus pneumoniae R6
cuuauuuucuacucuuucga

SEQ ID NO: 2189258 - RNA, 13 nt, Streptococcus pneumoniae R6
cuucaacuucuau

SEQ ID NO: 2189259 - RNA, 15 nt, Streptococcus pneumoniae R6
cuucacguucuucca

SEQ ID NO: 2189260 - RNA, 16 nt, Streptococcus pneumoniae R6
cuucacgguuuguauu

SEQ ID NO: 2189261 - RNA, 17 nt, Streptococcus pneumoniae R6
cuucaauggacuauagu

SEQ ID NO: 2189262 - RNA, 20 nt, Streptococcus pneumoniae R6
cuucaauggaguaaaaaaag

SEQ ID NO: 2189263 - RNA, 23 nt, Streptococcus pneumoniae R6
cuucaauggaguaaaaaaagagu

SEQ ID NO: 2189264 - RNA, 13 nt, Streptococcus pneumoniae R6
cuucaauuccuuc

SEQ ID NO: 2189265 - RNA, 21 nt, Streptococcus pneumoniae R6
aaagaaccacgguaaaauacu

SEQ ID NO: 2189266 - RNA, 22 nt, Streptococcus pneumoniae R6
aaagaacaucuacaauugaaac

SEQ ID NO: 2189267 - RNA, 23 nt, Streptococcus pneumoniae R6
cuuguucuuggagaaacuccuug

SEQ ID NO: 2189268 - RNA, 20 nt, Streptococcus pneumoniae R6
cuuguucugccuauuuuuuc

SEQ ID NO: 2189269 - RNA, 21 nt, Streptococcus pneumoniae R6
aaagaaccugcaguucccaca

SEQ ID NO: 2189270 - RNA, 22 nt, Streptococcus pneumoniae R6
cuuguugauguagauugagagc

SEQ ID NO: 2189271 - RNA, 20 nt, Streptococcus pneumoniae R6
cuuguugaaugagcuuccag

SEQ ID NO: 2189272 - RNA, 21 nt, Streptococcus pneumoniae R6
cuuguugaaugagcuuccagu

SEQ ID NO: 2189273 - RNA, 23 nt, Streptococcus pneumoniae R6
cuuuaaacauacugaacucaacu

SEQ ID NO: 2189274 - RNA, 20 nt, Streptococcus pneumoniae R6
cuuuaaaucgcuauaaauaa

SEQ ID NO: 2189275 - RNA, 13 nt, Streptococcus pneumoniae R6
cuuuaaaauccuc

SEQ ID NO: 2189276 - RNA, 13 nt, Streptococcus pneumoniae R6
cuuuaaaaauuuu

SEQ ID NO: 2189277 - RNA, 19 nt, Streptococcus pneumoniae R6
cuuuaaaaauuuuuuucua

SEQ ID NO: 2189278 - RNA, 13 nt, Streptococcus pneumoniae R6
cuuuaaaaaauuu

SEQ ID NO: 2189279 - RNA, 13 nt, Streptococcus pneumoniae R6
cuuuaaaaacaau

SEQ ID NO: 2189280 - RNA, 22 nt, Streptococcus pneumoniae R6
cuuguuuuuauaugauuucaau

SEQ ID NO: 2189281 - RNA, 11 nt, Streptococcus pneumoniae R6
cuuguuuuuua

SEQ ID NO: 2189282 - RNA, 18 nt, Streptococcus pneumoniae R6
cuuguuguugugauaaag

SEQ ID NO: 2189283 - RNA, 21 nt, Streptococcus pneumoniae R6
cuuguuuaguaaacaaaggau

SEQ ID NO: 2189284 - RNA, 18 nt, Streptococcus pneumoniae R6
cuuguuucuaaaacauug

SEQ ID NO: 2189285 - RNA, 18 nt, Streptococcus pneumoniae R6
cuuguuucaauugacuau

SEQ ID NO: 2189286 - RNA, 23 nt, Streptococcus pneumoniae R6
aaacuuuuucucucugaauagaa

SEQ ID NO: 2189287 - RNA, 21 nt, Streptococcus pneumoniae R6
aaacuuuuuaaaaaaucuuuu

SEQ ID NO: 2189288 - RNA, 11 nt, Streptococcus pneumoniae R6
aaagaaaaagu

SEQ ID NO: 2189289 - RNA, 12 nt, Streptococcus pneumoniae R6
aaagaaaaaaca

SEQ ID NO: 2189290 - RNA, 16 nt, Streptococcus pneumoniae R6
cuugucguugaaaaag

SEQ ID NO: 2189291 - RNA, 19 nt, Streptococcus pneumoniae R6
cuugucguugaaaaaguga

SEQ ID NO: 2189292 - RNA, 21 nt, Streptococcus pneumoniae R6
cuugucguugaaaaagugaga

SEQ ID NO: 2189293 - RNA, 17 nt, Streptococcus pneumoniae R6
cuugucuacauucuuuu

SEQ ID NO: 2189294 - RNA, 18 nt, Streptococcus pneumoniae R6
cuugugaaagcucuucua

SEQ ID NO: 2189295 - RNA, 21 nt, Streptococcus pneumoniae R6
cuugugaaagcucuucuaaaa

SEQ ID NO: 2189296 - RNA, 13 nt, Streptococcus pneumoniae R6
cuugucuuuuuca

SEQ ID NO: 2189297 - RNA, 22 nt, Streptococcus pneumoniae R6
cuugucuuuuucaucuuuuucg

SEQ ID NO: 2189298 - RNA, 13 nt, Streptococcus pneumoniae R6
cuugucugcaugg

SEQ ID NO: 2189299 - RNA, 18 nt, Streptococcus pneumoniae R6
cuugugcacacucagaac

SEQ ID NO: 2189300 - RNA, 23 nt, Streptococcus pneumoniae R6
cuuguggggccagaauaauuaaa

SEQ ID NO: 2189301 - RNA, 15 nt, Streptococcus pneumoniae R6
cuuguguuuuuccuu

SEQ ID NO: 2189302 - RNA, 16 nt, Streptococcus pneumoniae R6
cuuguguuuuuccuuu

SEQ ID NO: 2189303 - RNA, 15 nt, Streptococcus pneumoniae R6
cuuguuccaauugau

SEQ ID NO: 2189304 - RNA, 14 nt, Streptococcus pneumoniae R6
cuuggccacuuccc

SEQ ID NO: 2189305 - RNA, 22 nt, Streptococcus pneumoniae R6
cuuggcauccaguaaaaacugu

SEQ ID NO: 2189306 - RNA, 19 nt, Streptococcus pneumoniae R6
cuuggcagagcuaaaaacu

SEQ ID NO: 2189307 - RNA, 19 nt, Streptococcus pneumoniae R6
cuuggacuuggccaauucu

SEQ ID NO: 2189308 - RNA, 13 nt, Streptococcus pneumoniae R6
cuuggaccaggau

SEQ ID NO: 2189309 - RNA, 20 nt, Streptococcus pneumoniae R6
cuuggaccaggaucuuaucu

SEQ ID NO: 2189310 - RNA, 17 nt, Streptococcus pneumoniae R6
cuuggaaguuuuccuuu

SEQ ID NO: 2189311 - RNA, 18 nt, Streptococcus pneumoniae R6
cuuggcagaaagguaagg

SEQ ID NO: 2189312 - RNA, 16 nt, Streptococcus pneumoniae R6
cuuggcuguuuccuuu

SEQ ID NO: 2189313 - RNA, 13 nt, Streptococcus pneumoniae R6
cuuggcuaauuuc

SEQ ID NO: 2189314 - RNA, 21 nt, Streptococcus pneumoniae R6
cuuguaaccgauauuuccugc

SEQ ID NO: 2189315 - RNA, 15 nt, Streptococcus pneumoniae R6
cuuguaagucaaguc

SEQ ID NO: 2189316 - RNA, 21 nt, Streptococcus pneumoniae R6
cuuguaagucaagucuucuug

SEQ ID NO: 2189317 - RNA, 15 nt, Streptococcus pneumoniae R6
cuuguaguucucaau

SEQ ID NO: 2189318 - RNA, 13 nt, Streptococcus pneumoniae R6
cuuguaggcuucu

SEQ ID NO: 2189319 - RNA, 21 nt, Streptococcus pneumoniae R6
cuugucaucuuccaagaccug

SEQ ID NO: 2189320 - RNA, 13 nt, Streptococcus pneumoniae R6
cuugguuacauca

SEQ ID NO: 2189321 - RNA, 17 nt, Streptococcus pneumoniae R6
cuuguaaagacuagaaa

SEQ ID NO: 2189322 - RNA, 16 nt, Streptococcus pneumoniae R6
cuugguuuuugccaug

SEQ ID NO: 2189323 - RNA, 19 nt, Streptococcus pneumoniae R6
cuugguuuuuuaggacaau

SEQ ID NO: 2189324 - RNA, 23 nt, Streptococcus pneumoniae R6
cuuggggaacauuugaaacgaua

SEQ ID NO: 2189325 - RNA, 22 nt, Streptococcus pneumoniae R6
cuugggucguaaaccuucaaga

SEQ ID NO: 2189326 - RNA, 17 nt, Streptococcus pneumoniae R6
cuuggucauuugagaua

SEQ ID NO: 2189327 - RNA, 23 nt, Streptococcus pneumoniae R6
cuuuggaggcaauacguuuucaa

SEQ ID NO: 2189328 - RNA, 22 nt, Streptococcus pneumoniae R6
cuuuggaggcaauggccuguuc

SEQ ID NO: 2189329 - RNA, 23 nt, Streptococcus pneumoniae R6
cuuuggaggcaauggccuguucu

SEQ ID NO: 2189330 - RNA, 15 nt, Streptococcus pneumoniae R6
cuuuggauauuuuga

SEQ ID NO: 2189331 - RNA, 19 nt, Streptococcus pneumoniae R6
cuuugggacgauuuucaaa

SEQ ID NO: 2189332 - RNA, 21 nt, Streptococcus pneumoniae R6
cuuuuaaucgauuauuuuuuc

SEQ ID NO: 2189333 - RNA, 21 nt, Streptococcus pneumoniae R6
cuuuuaacuucagcuuuuuug

SEQ ID NO: 2189334 - RNA, 18 nt, Streptococcus pneumoniae R6
cuuuuaagaaaucauaca

SEQ ID NO: 2189335 - RNA, 13 nt, Streptococcus pneumoniae R6
cuuuuaagaguua

SEQ ID NO: 2189336 - RNA, 21 nt, Streptococcus pneumoniae R6
cuuugguugcuacaucuucuc

SEQ ID NO: 2189337 - RNA, 19 nt, Streptococcus pneumoniae R6
cuuugagguuguagauaga

SEQ ID NO: 2189338 - RNA, 15 nt, Streptococcus pneumoniae R6
cuuugauacaaagcu

SEQ ID NO: 2189339 - RNA, 20 nt, Streptococcus pneumoniae R6
cuuugccaccuagcuucuca

SEQ ID NO: 2189340 - RNA, 16 nt, Streptococcus pneumoniae R6
cuuugagauauuucuu

SEQ ID NO: 2189341 - RNA, 19 nt, Streptococcus pneumoniae R6
cuuugagauauuucuucuu

SEQ ID NO: 2189342 - RNA, 21 nt, Streptococcus pneumoniae R6
cuuugagauauuucuucuuuu

SEQ ID NO: 2189343 - RNA, 16 nt, Streptococcus pneumoniae R6
cuuugagaucuuuuuc

SEQ ID NO: 2189344 - RNA, 23 nt, Streptococcus pneumoniae R6
cuuugagcaaccuacggcuagcu

SEQ ID NO: 2189345 - RNA, 14 nt, Streptococcus pneumoniae R6
cuuugagcaaccug

SEQ ID NO: 2189346 - RNA, 18 nt, Streptococcus pneumoniae R6
cuuugaggaagguuuuaa

SEQ ID NO: 2189347 - RNA, 19 nt, Streptococcus pneumoniae R6
cuuugaggaagguuuuaaa

SEQ ID NO: 2189348 - RNA, 23 nt, Streptococcus pneumoniae R6
cuuugaggaagguuuuaaacaaa

SEQ ID NO: 2189349 - RNA, 17 nt, Streptococcus pneumoniae R6
cuuugagccuagugucu

SEQ ID NO: 2189350 - RNA, 21 nt, Streptococcus pneumoniae R6
cuuugcccccaucuccuuggc

SEQ ID NO: 2189351 - RNA, 15 nt, Streptococcus pneumoniae R6
cuuugcgaaguauuc

SEQ ID NO: 2189352 - RNA, 15 nt, Streptococcus pneumoniae R6
cuuuggacauagcca

SEQ ID NO: 2189353 - RNA, 13 nt, Streptococcus pneumoniae R6
cuuugcuuuccuc

SEQ ID NO: 2189354 - RNA, 16 nt, Streptococcus pneumoniae R6
cuuuccuccgauaauu

SEQ ID NO: 2189355 - RNA, 19 nt, Streptococcus pneumoniae R6
cuuuccuaaucgauuuguu

SEQ ID NO: 2189356 - RNA, 20 nt, Streptococcus pneumoniae R6
cuuugaaggugauaaucauc

SEQ ID NO: 2189357 - RNA, 21 nt, Streptococcus pneumoniae R6
cuuugaaggugauaaucaucg

SEQ ID NO: 2189358 - RNA, 14 nt, Streptococcus pneumoniae R6
cuuugaaauuuauc

SEQ ID NO: 2189359 - RNA, 21 nt, Streptococcus pneumoniae R6
cuuugaaauuuaucaaccacu

SEQ ID NO: 2189360 - RNA, 22 nt, Streptococcus pneumoniae R6
cuuucuucauuuuguuagccau

SEQ ID NO: 2189361 - RNA, 22 nt, Streptococcus pneumoniae R6
cuuucugauagauuuauuuuug

SEQ ID NO: 2189362 - RNA, 23 nt, Streptococcus pneumoniae R6
aaagaauagagggauucuccaua

SEQ ID NO: 2189363 - RNA, 17 nt, Streptococcus pneumoniae R6
aaagaaggguuagucau

SEQ ID NO: 2189364 - RNA, 15 nt, Streptococcus pneumoniae R6
aaagaauccaauuca

SEQ ID NO: 2189365 - RNA, 19 nt, Streptococcus pneumoniae R6
aaagaauccaauucaaagu

SEQ ID NO: 2189366 - RNA, 21 nt, Streptococcus pneumoniae R6
aaagaaguaaaucuucccaua

SEQ ID NO: 2189367 - RNA, 21 nt, Streptococcus pneumoniae R6
aaagaaggagccagcugaaaa

SEQ ID NO: 2189368 - RNA, 23 nt, Streptococcus pneumoniae R6
aaagaaggagccagcugaaaaaa

SEQ ID NO: 2189369 - RNA, 20 nt, Streptococcus pneumoniae R6
aaagaaggcuuuaccaaaaa

SEQ ID NO: 2189370 - RNA, 22 nt, Streptococcus pneumoniae R6
aaagaaggcuuuaccaaaaaug

SEQ ID NO: 2189371 - RNA, 18 nt, Streptococcus pneumoniae R6
aaagaauuugaaaaaaau

SEQ ID NO: 2189372 - RNA, 14 nt, Streptococcus pneumoniae R6
aaagacaaagguca

SEQ ID NO: 2189373 - RNA, 20 nt, Streptococcus pneumoniae R6
aaagacaccaccgaaggcuu

SEQ ID NO: 2189374 - RNA, 14 nt, Streptococcus pneumoniae R6
aaagacagucugaa

SEQ ID NO: 2189375 - RNA, 19 nt, Streptococcus pneumoniae R6
aaagacagucugaaaaaga

SEQ ID NO: 2189376 - RNA, 15 nt, Streptococcus pneumoniae R6
aaagacaguugcauu

SEQ ID NO: 2189377 - RNA, 19 nt, Streptococcus pneumoniae R6
aaagaauuaggaaaacaug

SEQ ID NO: 2189378 - RNA, 19 nt, Streptococcus pneumoniae R6
aaagaauguuaugcaacuu

SEQ ID NO: 2189379 - RNA, 20 nt, Streptococcus pneumoniae R6
cuuuaagagaguuacggguu

SEQ ID NO: 2189380 - RNA, 19 nt, Streptococcus pneumoniae R6
cuuuacuaguucucaaauu

SEQ ID NO: 2189381 - RNA, 18 nt, Streptococcus pneumoniae R6
cuuuaccaaaaaugugaa

SEQ ID NO: 2189382 - RNA, 17 nt, Streptococcus pneumoniae R6
cuuuaccaaaaccuucu

SEQ ID NO: 2189383 - RNA, 20 nt, Streptococcus pneumoniae R6
cuuuaccaaaaccuucuuug

SEQ ID NO: 2189384 - RNA, 17 nt, Streptococcus pneumoniae R6
cuuuaucugcaaccuca

SEQ ID NO: 2189385 - RNA, 14 nt, Streptococcus pneumoniae R6
cuuuagucuuaucc

SEQ ID NO: 2189386 - RNA, 11 nt, Streptococcus pneumoniae R6
cuuuacuucug

SEQ ID NO: 2189387 - RNA, 22 nt, Streptococcus pneumoniae R6
cuuuacuucugagguuaaaauc

SEQ ID NO: 2189388 - RNA, 23 nt, Streptococcus pneumoniae R6
cuuuacuucugagguuaaaaucu

SEQ ID NO: 2189389 - RNA, 19 nt, Streptococcus pneumoniae R6
cuuuauuuuuuuacuuaau

SEQ ID NO: 2189390 - RNA, 23 nt, Streptococcus pneumoniae R6
cuuuauuuuuuuauccauuuuuc

SEQ ID NO: 2189391 - RNA, 14 nt, Streptococcus pneumoniae R6
cuuuauuuuuucug

SEQ ID NO: 2189392 - RNA, 17 nt, Streptococcus pneumoniae R6
cuuucaaaccagcacca

SEQ ID NO: 2189393 - RNA, 20 nt, Streptococcus pneumoniae R6
cuuucaaagcgggauuuaaa

SEQ ID NO: 2189394 - RNA, 15 nt, Streptococcus pneumoniae R6
cuuucaacucagcau

SEQ ID NO: 2189395 - RNA, 19 nt, Streptococcus pneumoniae R6
cuuuccaauauguucuaaa

SEQ ID NO: 2189396 - RNA, 13 nt, Streptococcus pneumoniae R6
gaaaaucaaguag

SEQ ID NO: 2189397 - RNA, 21 nt, Streptococcus pneumoniae R6
gaaaauauuucgcuuauaaac

SEQ ID NO: 2189398 - RNA, 22 nt, Streptococcus pneumoniae R6
gaaaauauuucgcuuauaaacu

SEQ ID NO: 2189399 - RNA, 20 nt, Streptococcus pneumoniae R6
gaaaauaaaauuccuuuaaa

SEQ ID NO: 2189400 - RNA, 21 nt, Streptococcus pneumoniae R6
gaaaauaaaauuccuuuaaaa

SEQ ID NO: 2189401 - RNA, 15 nt, Streptococcus pneumoniae R6
gaaaaguaggacgau

SEQ ID NO: 2189402 - RNA, 20 nt, Streptococcus pneumoniae R6
gaaaaguaggacgauaaaaa

SEQ ID NO: 2189403 - RNA, 20 nt, Streptococcus pneumoniae R6
gaaaagucuuauaauauagg

SEQ ID NO: 2189404 - RNA, 20 nt, Streptococcus pneumoniae R6
gaaaaggguggaaucacgaa

SEQ ID NO: 2189405 - RNA, 14 nt, Streptococcus pneumoniae R6
gaaaaggaguagaa

SEQ ID NO: 2189406 - RNA, 17 nt, Streptococcus pneumoniae R6
gaaaaggcagauucucu

SEQ ID NO: 2189407 - RNA, 16 nt, Streptococcus pneumoniae R6
gaaaagcccuucauaa

SEQ ID NO: 2189408 - RNA, 12 nt, Streptococcus pneumoniae R6
gaaaaaugcaaa

SEQ ID NO: 2189409 - RNA, 14 nt, Streptococcus pneumoniae R6
gaaaaauggucacu

SEQ ID NO: 2189410 - RNA, 21 nt, Streptococcus pneumoniae R6
gaaaaauaggaugaaccugcu

SEQ ID NO: 2189411 - RNA, 21 nt, Streptococcus pneumoniae R6
gaaaaauaugcauaauuucca

SEQ ID NO: 2189412 - RNA, 13 nt, Streptococcus pneumoniae R6
gaaaaaucuccag

SEQ ID NO: 2189413 - RNA, 21 nt, Streptococcus pneumoniae R6
gaaacaugaaguguuguaaag

SEQ ID NO: 2189414 - RNA, 17 nt, Streptococcus pneumoniae R6
gaaacaaaauauauaau

SEQ ID NO: 2189415 - RNA, 18 nt, Streptococcus pneumoniae R6
gaaacaaccgauaagaau

SEQ ID NO: 2189416 - RNA, 17 nt, Streptococcus pneumoniae R6
gaaacaauaaaaucaaa

SEQ ID NO: 2189417 - RNA, 21 nt, Streptococcus pneumoniae R6
gaaacacauuuuuagaaggau

SEQ ID NO: 2189418 - RNA, 19 nt, Streptococcus pneumoniae R6
gaaacaauugcuaaaacau

SEQ ID NO: 2189419 - RNA, 20 nt, Streptococcus pneumoniae R6
gaaaccuaaucauagugaga

SEQ ID NO: 2189420 - RNA, 15 nt, Streptococcus pneumoniae R6
gaaacauucaaaucc

SEQ ID NO: 2189421 - RNA, 23 nt, Streptococcus pneumoniae R6
gaaaccaguccacguuuuuccag

SEQ ID NO: 2189422 - RNA, 14 nt, Streptococcus pneumoniae R6
cuuuuucagaacuu

SEQ ID NO: 2189423 - RNA, 16 nt, Streptococcus pneumoniae R6
cuuuuuccaaaucuuu

SEQ ID NO: 2189424 - RNA, 23 nt, Streptococcus pneumoniae R6
cuuuuugauaacgugcuaauucg

SEQ ID NO: 2189425 - RNA, 21 nt, Streptococcus pneumoniae R6
cuuuuugauaagauaauaaau

SEQ ID NO: 2189426 - RNA, 15 nt, Streptococcus pneumoniae R6
cuuuuugcucauaua

SEQ ID NO: 2189427 - RNA, 16 nt, Streptococcus pneumoniae R6
cuuuuugauuuuaaau

SEQ ID NO: 2189428 - RNA, 11 nt, Streptococcus pneumoniae R6
cuuuuugcaac

SEQ ID NO: 2189429 - RNA, 23 nt, Streptococcus pneumoniae R6
cuuuuuucuaaagcaauuuugaa

SEQ ID NO: 2189430 - RNA, 16 nt, Streptococcus pneumoniae R6
cuuuuuuggcagauuu

SEQ ID NO: 2189431 - RNA, 16 nt, Streptococcus pneumoniae R6
cuuuuuugauguucaa

SEQ ID NO: 2189432 - RNA, 19 nt, Streptococcus pneumoniae R6
cuuuuuugauguucaaagu

SEQ ID NO: 2189433 - RNA, 19 nt, Streptococcus pneumoniae R6
cuuuuuugauguucagagc

SEQ ID NO: 2189434 - RNA, 17 nt, Streptococcus pneumoniae R6
cuuuuuuccgaauaaau

SEQ ID NO: 2189435 - RNA, 15 nt, Streptococcus pneumoniae R6
cuuuuugugaauaca

SEQ ID NO: 2189436 - RNA, 14 nt, Streptococcus pneumoniae R6
cuuuuuguaucaau

SEQ ID NO: 2189437 - RNA, 19 nt, Streptococcus pneumoniae R6
cuuuuuguccuucuucuug

SEQ ID NO: 2189438 - RNA, 13 nt, Streptococcus pneumoniae R6
gaaaaacuuacua

SEQ ID NO: 2189439 - RNA, 15 nt, Streptococcus pneumoniae R6
gaaaaacuuacuaca

SEQ ID NO: 2189440 - RNA, 18 nt, Streptococcus pneumoniae R6
gaaaaagaaggauugaga

SEQ ID NO: 2189441 - RNA, 19 nt, Streptococcus pneumoniae R6
gaaaaagaaggauugagaa

SEQ ID NO: 2189442 - RNA, 23 nt, Streptococcus pneumoniae R6
gaaaaagaaggauugagaagcca

SEQ ID NO: 2189443 - RNA, 22 nt, Streptococcus pneumoniae R6
gaaaaaauaggcagaacaagag

SEQ ID NO: 2189444 - RNA, 19 nt, Streptococcus pneumoniae R6
cuuuuuuuaauauaagaau

SEQ ID NO: 2189445 - RNA, 16 nt, Streptococcus pneumoniae R6
gaaaaaagucuuuaaa

SEQ ID NO: 2189446 - RNA, 23 nt, Streptococcus pneumoniae R6
gaaaaaagucuuuaaaaucugaa

SEQ ID NO: 2189447 - RNA, 19 nt, Streptococcus pneumoniae R6
gaaaaaagucuuuaaaauu

SEQ ID NO: 2189448 - RNA, 14 nt, Streptococcus pneumoniae R6
cuuuuuuguuucuu

SEQ ID NO: 2189449 - RNA, 15 nt, Streptococcus pneumoniae R6
cuuuuguauuuugaa

SEQ ID NO: 2189450 - RNA, 14 nt, Streptococcus pneumoniae R6
cuuuugggacagaa

SEQ ID NO: 2189451 - RNA, 22 nt, Streptococcus pneumoniae R6
cuuuuggucagaggggugcuga

SEQ ID NO: 2189452 - RNA, 12 nt, Streptococcus pneumoniae R6
cuuuuuaaguuu

SEQ ID NO: 2189453 - RNA, 14 nt, Streptococcus pneumoniae R6
cuuuuuauccaaaa

SEQ ID NO: 2189454 - RNA, 23 nt, Streptococcus pneumoniae R6
cuuuuuauccaaaauaugcucca

SEQ ID NO: 2189455 - RNA, 21 nt, Streptococcus pneumoniae R6
cuuuuuauauauaaaauuuua

SEQ ID NO: 2189456 - RNA, 13 nt, Streptococcus pneumoniae R6
cuuuuuacuuaua

SEQ ID NO: 2189457 - RNA, 13 nt, Streptococcus pneumoniae R6
cuuuuucaaaagc

SEQ ID NO: 2189458 - RNA, 20 nt, Streptococcus pneumoniae R6
cuuuuuauacucaaugaaaa

SEQ ID NO: 2189459 - RNA, 16 nt, Streptococcus pneumoniae R6
cuuuugauagaugacu

SEQ ID NO: 2189460 - RNA, 21 nt, Streptococcus pneumoniae R6
cuuuugauagaugacuucuua

SEQ ID NO: 2189461 - RNA, 11 nt, Streptococcus pneumoniae R6
cuuuugauuug

SEQ ID NO: 2189462 - RNA, 21 nt, Streptococcus pneumoniae R6
cuuuugauggguucuuugcca

SEQ ID NO: 2189463 - RNA, 15 nt, Streptococcus pneumoniae R6
cuuuuauccaccuau

SEQ ID NO: 2189464 - RNA, 19 nt, Streptococcus pneumoniae R6
cuuuugaaugcucccuucu

SEQ ID NO: 2189465 - RNA, 17 nt, Streptococcus pneumoniae R6
cuuuuauaaauuuucca

SEQ ID NO: 2189466 - RNA, 18 nt, Streptococcus pneumoniae R6
cuuuuauaauagaaagau

SEQ ID NO: 2189467 - RNA, 20 nt, Streptococcus pneumoniae R6
cuuuuauaauagaaagauuu

SEQ ID NO: 2189468 - RNA, 17 nt, Streptococcus pneumoniae R6
cuuuuacaauguuguca

SEQ ID NO: 2189469 - RNA, 20 nt, Streptococcus pneumoniae R6
gaaaucucuuuuuucuccaa

SEQ ID NO: 2189470 - RNA, 20 nt, Streptococcus pneumoniae R6
gaaaugcgccaccaacugca

SEQ ID NO: 2189471 - RNA, 18 nt, Streptococcus pneumoniae R6
gaaauggcuccacggagu

SEQ ID NO: 2189472 - RNA, 14 nt, Streptococcus pneumoniae R6
gaacaaauaauaug

SEQ ID NO: 2189473 - RNA, 16 nt, Streptococcus pneumoniae R6
gaacaaaucaauuaga

SEQ ID NO: 2189474 - RNA, 21 nt, Streptococcus pneumoniae R6
gaacaaaucaauuagaaaauu

SEQ ID NO: 2189475 - RNA, 19 nt, Streptococcus pneumoniae R6
gaaauuggcucaucugcaa

SEQ ID NO: 2189476 - RNA, 14 nt, Streptococcus pneumoniae R6
gaaauuuaaaaaga

SEQ ID NO: 2189477 - RNA, 20 nt, Streptococcus pneumoniae R6
gaaauugucugagcauucuu

SEQ ID NO: 2189478 - RNA, 15 nt, Streptococcus pneumoniae R6
aaagagccaaaaaag

SEQ ID NO: 2189479 - RNA, 16 nt, Streptococcus pneumoniae R6
aaagagccaaaaaaga

SEQ ID NO: 2189480 - RNA, 17 nt, Streptococcus pneumoniae R6
aaagagccaaaaaagaa

SEQ ID NO: 2189481 - RNA, 20 nt, Streptococcus pneumoniae R6
aaagagccagaaaaaucccu

SEQ ID NO: 2189482 - RNA, 23 nt, Streptococcus pneumoniae R6
aaagagccgggauuuuuuagcuu

SEQ ID NO: 2189483 - RNA, 14 nt, Streptococcus pneumoniae R6
gaaauuaaauauga

SEQ ID NO: 2189484 - RNA, 16 nt, Streptococcus pneumoniae R6
aaagaggaagaggaca

SEQ ID NO: 2189485 - RNA, 21 nt, Streptococcus pneumoniae R6
gaacagugauagcacuugaau

SEQ ID NO: 2189486 - RNA, 12 nt, Streptococcus pneumoniae R6
gaacaaauguug

SEQ ID NO: 2189487 - RNA, 15 nt, Streptococcus pneumoniae R6
gaacaauuucacaac

SEQ ID NO: 2189488 - RNA, 12 nt, Streptococcus pneumoniae R6
gaaacguccaag

SEQ ID NO: 2189489 - RNA, 21 nt, Streptococcus pneumoniae R6
gaaacguccaaggcugaaauu

SEQ ID NO: 2189490 - RNA, 14 nt, Streptococcus pneumoniae R6
gaaagaaaaacugc

SEQ ID NO: 2189491 - RNA, 20 nt, Streptococcus pneumoniae R6
gaaagaaaaacugcuuagaa

SEQ ID NO: 2189492 - RNA, 12 nt, Streptococcus pneumoniae R6
gaaacggcagcu

SEQ ID NO: 2189493 - RNA, 14 nt, Streptococcus pneumoniae R6
gaaacgaagaagga

SEQ ID NO: 2189494 - RNA, 21 nt, Streptococcus pneumoniae R6
gaaagauaacugcuagaaaug

SEQ ID NO: 2189495 - RNA, 18 nt, Streptococcus pneumoniae R6
gaaagcgaagaucuagaa

SEQ ID NO: 2189496 - RNA, 18 nt, Streptococcus pneumoniae R6
gaaagagcaggaguugau

SEQ ID NO: 2189497 - RNA, 20 nt, Streptococcus pneumoniae R6
gaaagaggaguaggaguagu

SEQ ID NO: 2189498 - RNA, 17 nt, Streptococcus pneumoniae R6
gaaagaccaguucauca

SEQ ID NO: 2189499 - RNA, 14 nt, Streptococcus pneumoniae R6
gaaagaagagggcu

SEQ ID NO: 2189500 - RNA, 20 nt, Streptococcus pneumoniae R6
gaaagaauccaauucaaagu

SEQ ID NO: 2189501 - RNA, 21 nt, Streptococcus pneumoniae R6
gaaaucauacugccaagauag

SEQ ID NO: 2189502 - RNA, 24 nt, Streptococcus pneumoniae R6
gaaaucauacugccaagauagaga

SEQ ID NO: 2189503 - RNA, 22 nt, Streptococcus pneumoniae R6
gaaaucauuugaaucaaaaauu

SEQ ID NO: 2189504 - RNA, 14 nt, Streptococcus pneumoniae R6
gaaaucauuggaua

SEQ ID NO: 2189505 - RNA, 16 nt, Streptococcus pneumoniae R6
gaaauaaaauuugaac

SEQ ID NO: 2189506 - RNA, 19 nt, Streptococcus pneumoniae R6
gaaauauagaguauuucuc

SEQ ID NO: 2189507 - RNA, 21 nt, Streptococcus pneumoniae R6
gaaauauaggccaagauauug

SEQ ID NO: 2189508 - RNA, 21 nt, Streptococcus pneumoniae R6
gaaauaguuuagauaaaacua

SEQ ID NO: 2189509 - RNA, 17 nt, Streptococcus pneumoniae R6
gaaagucggaaggcaug

SEQ ID NO: 2189510 - RNA, 16 nt, Streptococcus pneumoniae R6
gaaagucgugauuucu

SEQ ID NO: 2189511 - RNA, 14 nt, Streptococcus pneumoniae R6
gaaagguaacuccu

SEQ ID NO: 2189512 - RNA, 18 nt, Streptococcus pneumoniae R6
gaaagucauauuucuuca

SEQ ID NO: 2189513 - RNA, 23 nt, Streptococcus pneumoniae R6
gaaaggcuuuauucuuaaaucca

SEQ ID NO: 2189514 - RNA, 13 nt, Streptococcus pneumoniae R6
gaaaggagaaaaa

SEQ ID NO: 2189515 - RNA, 14 nt, Streptococcus pneumoniae R6
gaaaggagaaaaaa

SEQ ID NO: 2189516 - RNA, 17 nt, Streptococcus pneumoniae R6
gaaaggagaaaaaauau

SEQ ID NO: 2189517 - RNA, 14 nt, Streptococcus pneumoniae R6
gaaaggagaaaaau

SEQ ID NO: 2189518 - RNA, 21 nt, Streptococcus pneumoniae R6
gaaaggauaugaggagaaaga

SEQ ID NO: 2189519 - RNA, 21 nt, Streptococcus pneumoniae R6
gaagagauuuucgaagaguau

SEQ ID NO: 2189520 - RNA, 16 nt, Streptococcus pneumoniae R6
gaagagcauaggaagu

SEQ ID NO: 2189521 - RNA, 21 nt, Streptococcus pneumoniae R6
gaagagcauaggaaguugagc

SEQ ID NO: 2189522 - RNA, 16 nt, Streptococcus pneumoniae R6
gaagagcuucuuucau

SEQ ID NO: 2189523 - RNA, 14 nt, Streptococcus pneumoniae R6
gaagagcuuugcuu

SEQ ID NO: 2189524 - RNA, 12 nt, Streptococcus pneumoniae R6
gaagaaggccaa

SEQ ID NO: 2189525 - RNA, 14 nt, Streptococcus pneumoniae R6
gaagaaggaagagu

SEQ ID NO: 2189526 - RNA, 19 nt, Streptococcus pneumoniae R6
gaagaaugggauacuaucu

SEQ ID NO: 2189527 - RNA, 15 nt, Streptococcus pneumoniae R6
gaagaauguuuucag

SEQ ID NO: 2189528 - RNA, 18 nt, Streptococcus pneumoniae R6
gaagaauguuuucagcgu

SEQ ID NO: 2189529 - RNA, 17 nt, Streptococcus pneumoniae R6
gaacaucuccaacugca

SEQ ID NO: 2189530 - RNA, 15 nt, Streptococcus pneumoniae R6
gaagauuuccuccau

SEQ ID NO: 2189531 - RNA, 16 nt, Streptococcus pneumoniae R6
gaagauuucagaaaua

SEQ ID NO: 2189532 - RNA, 17 nt, Streptococcus pneumoniae R6
gaagauuggucaaucuu

SEQ ID NO: 2189533 - RNA, 19 nt, Streptococcus pneumoniae R6
gaagauugauaaaggcaga

SEQ ID NO: 2189534 - RNA, 15 nt, Streptococcus pneumoniae R6
gaagccaaucaaacu

SEQ ID NO: 2189535 - RNA, 22 nt, Streptococcus pneumoniae R6
gaagcuauccuggcguaguaaa

SEQ ID NO: 2189536 - RNA, 23 nt, Streptococcus pneumoniae R6
gaagcgagucgcaggcuguacuu

SEQ ID NO: 2189537 - RNA, 15 nt, Streptococcus pneumoniae R6
gaagcgaugauaaga

SEQ ID NO: 2189538 - RNA, 20 nt, Streptococcus pneumoniae R6
gaagcuguaaaucuaggaca

SEQ ID NO: 2189539 - RNA, 13 nt, Streptococcus pneumoniae R6
gaagcugcuuuca

SEQ ID NO: 2189540 - RNA, 15 nt, Streptococcus pneumoniae R6
gaaguggggcaccau

SEQ ID NO: 2189541 - RNA, 21 nt, Streptococcus pneumoniae R6
gaagugccaguguacuagucu

SEQ ID NO: 2189542 - RNA, 23 nt, Streptococcus pneumoniae R6
gaagugccaguguacuagucuaa

SEQ ID NO: 2189543 - RNA, 16 nt, Streptococcus pneumoniae R6
gaagugauaaugauuu

SEQ ID NO: 2189544 - RNA, 14 nt, Streptococcus pneumoniae R6
gaagucaucuauca

SEQ ID NO: 2189545 - RNA, 18 nt, Streptococcus pneumoniae R6
gaagucagucacauauau

SEQ ID NO: 2189546 - RNA, 17 nt, Streptococcus pneumoniae R6
gaagucagcuaagcucg

SEQ ID NO: 2189547 - RNA, 15 nt, Streptococcus pneumoniae R6
gaagucagcucaaaa

SEQ ID NO: 2189548 - RNA, 21 nt, Streptococcus pneumoniae R6
gaagucagcucaaaacacugu

SEQ ID NO: 2189549 - RNA, 22 nt, Streptococcus pneumoniae R6
gaagucagcucaaaacacuguu

SEQ ID NO: 2189550 - RNA, 24 nt, Streptococcus pneumoniae R6
gaagucagcucaaaacaguguuuu

SEQ ID NO: 2189551 - RNA, 13 nt, Streptococcus pneumoniae R6
gaagucaagccuc

SEQ ID NO: 2189552 - RNA, 14 nt, Streptococcus pneumoniae R6
gaaguauucaagag

SEQ ID NO: 2189553 - RNA, 20 nt, Streptococcus pneumoniae R6
gaaguagugacuucagaguc

SEQ ID NO: 2189554 - RNA, 13 nt, Streptococcus pneumoniae R6
gaauacuaaaaua

SEQ ID NO: 2189555 - RNA, 14 nt, Streptococcus pneumoniae R6
gaauacuaaaauau

SEQ ID NO: 2189556 - RNA, 22 nt, Streptococcus pneumoniae R6
gaauacuaaaauauuucuagaa

SEQ ID NO: 2189557 - RNA, 21 nt, Streptococcus pneumoniae R6
gaauaaagaaacuuggcaaaa

SEQ ID NO: 2189558 - RNA, 21 nt, Streptococcus pneumoniae R6
gaauaaugauuccugacugaa

SEQ ID NO: 2189559 - RNA, 15 nt, Streptococcus pneumoniae R6
aaagauagaugauuu

SEQ ID NO: 2189560 - RNA, 20 nt, Streptococcus pneumoniae R6
aaagauaagcgcuagcaaaa

SEQ ID NO: 2189561 - RNA, 19 nt, Streptococcus pneumoniae R6
aaagauaagguucaaaaaa

SEQ ID NO: 2189562 - RNA, 20 nt, Streptococcus pneumoniae R6
aaagauaagguucaaaaaau

SEQ ID NO: 2189563 - RNA, 19 nt, Streptococcus pneumoniae R6
gaaguuagguuuuguuucu

SEQ ID NO: 2189564 - RNA, 20 nt, Streptococcus pneumoniae R6
gaaguuaaguuuuuugacuu

SEQ ID NO: 2189565 - RNA, 19 nt, Streptococcus pneumoniae R6
gaaguguuguaaagucuau

SEQ ID NO: 2189566 - RNA, 24 nt, Streptococcus pneumoniae R6
gaaguugauucaugacaucuucca

SEQ ID NO: 2189567 - RNA, 16 nt, Streptococcus pneumoniae R6
gaaguuggucucccaa

SEQ ID NO: 2189568 - RNA, 14 nt, Streptococcus pneumoniae R6
gaaugauuucucuu

SEQ ID NO: 2189569 - RNA, 16 nt, Streptococcus pneumoniae R6
gaaugccaaaauucca

SEQ ID NO: 2189570 - RNA, 14 nt, Streptococcus pneumoniae R6
gaaugccaaagaca

SEQ ID NO: 2189571 - RNA, 14 nt, Streptococcus pneumoniae R6
gaaugaucaguagu

SEQ ID NO: 2189572 - RNA, 19 nt, Streptococcus pneumoniae R6
gaaugauaacauugacauc

SEQ ID NO: 2189573 - RNA, 16 nt, Streptococcus pneumoniae R6
gaaugauaaucaaacu

SEQ ID NO: 2189574 - RNA, 14 nt, Streptococcus pneumoniae R6
gaaucugaaucaaa

SEQ ID NO: 2189575 - RNA, 17 nt, Streptococcus pneumoniae R6
gaaucugaugaaccuuc

SEQ ID NO: 2189576 - RNA, 20 nt, Streptococcus pneumoniae R6
gaaucguuucugacagagcu

SEQ ID NO: 2189577 - RNA, 16 nt, Streptococcus pneumoniae R6
gaaucguaauuuagaa

SEQ ID NO: 2189578 - RNA, 19 nt, Streptococcus pneumoniae R6
gaaucagaacacuuccaau

SEQ ID NO: 2189579 - RNA, 16 nt, Streptococcus pneumoniae R6
gaauccgaaaaauuuc

SEQ ID NO: 2189580 - RNA, 24 nt, Streptococcus pneumoniae R6
gaaucccuggaggauagcacauga

SEQ ID NO: 2189581 - RNA, 17 nt, Streptococcus pneumoniae R6
gaauaugaacaaauuga

SEQ ID NO: 2189582 - RNA, 18 nt, Streptococcus pneumoniae R6
gaauauccuuauauaucc

SEQ ID NO: 2189583 - RNA, 16 nt, Streptococcus pneumoniae R6
gaauaugucuagccag

SEQ ID NO: 2189584 - RNA, 22 nt, Streptococcus pneumoniae R6
gaauauuaguaaauagaaguuc

SEQ ID NO: 2189585 - RNA, 22 nt, Streptococcus pneumoniae R6
gaauauguauuucauuuucuac

SEQ ID NO: 2189586 - RNA, 23 nt, Streptococcus pneumoniae R6
gaauauuuacuaauuaauuaacu

SEQ ID NO: 2189587 - RNA, 19 nt, Streptococcus pneumoniae R6
gaaucacgaaccuaauuau

SEQ ID NO: 2189588 - RNA, 17 nt, Streptococcus pneumoniae R6
gaauaguugaaaucaag

SEQ ID NO: 2189589 - RNA, 21 nt, Streptococcus pneumoniae R6
gaauaguggaccgaaucugaa

SEQ ID NO: 2189590 - RNA, 19 nt, Streptococcus pneumoniae R6
gaauauagaggauauuucc

SEQ ID NO: 2189591 - RNA, 15 nt, Streptococcus pneumoniae R6
gaauauagacaaaau

SEQ ID NO: 2189592 - RNA, 15 nt, Streptococcus pneumoniae R6
gaauaucaagauaag

SEQ ID NO: 2189593 - RNA, 17 nt, Streptococcus pneumoniae R6
gaauauauucuccagcu

SEQ ID NO: 2189594 - RNA, 19 nt, Streptococcus pneumoniae R6
gaauauauuucucaauagc

SEQ ID NO: 2189595 - RNA, 12 nt, Streptococcus pneumoniae R6
gaauagaaaaau

SEQ ID NO: 2189596 - RNA, 21 nt, Streptococcus pneumoniae R6
gaauagcugcggcuuucuuca

SEQ ID NO: 2189597 - RNA, 19 nt, Streptococcus pneumoniae R6
gaauaggcccgauguuauu

SEQ ID NO: 2189598 - RNA, 18 nt, Streptococcus pneumoniae R6
gaauacucuuuacuuugc

SEQ ID NO: 2189599 - RNA, 15 nt, Streptococcus pneumoniae R6
gaauacuaaggaaag

SEQ ID NO: 2189600 - RNA, 13 nt, Streptococcus pneumoniae R6
aaagaugauauca

SEQ ID NO: 2189601 - RNA, 22 nt, Streptococcus pneumoniae R6
gaauaguacacuucuacuucua

SEQ ID NO: 2189602 - RNA, 21 nt, Streptococcus pneumoniae R6
gaauaguacacuucugcuucu

SEQ ID NO: 2189603 - RNA, 21 nt, Streptococcus pneumoniae R6
gaauaguaucugaugcugaca

SEQ ID NO: 2189604 - RNA, 20 nt, Streptococcus pneumoniae R6
gaauaguccucccuucuuuc

SEQ ID NO: 2189605 - RNA, 21 nt, Streptococcus pneumoniae R6
gaauaguccucccuucuuucu

SEQ ID NO: 2189606 - RNA, 16 nt, Streptococcus pneumoniae R6
gacaaaucguuccagc

SEQ ID NO: 2189607 - RNA, 18 nt, Streptococcus pneumoniae R6
gacaaaucuaagucaaau

SEQ ID NO: 2189608 - RNA, 19 nt, Streptococcus pneumoniae R6
gacaaaucuaagucaaaua

SEQ ID NO: 2189609 - RNA, 21 nt, Streptococcus pneumoniae R6
gacaaaucuaagucaaauaag

SEQ ID NO: 2189610 - RNA, 21 nt, Streptococcus pneumoniae R6
gacaaauccauucuuuaccag

SEQ ID NO: 2189611 - RNA, 15 nt, Streptococcus pneumoniae R6
gacaaauucuccaca

SEQ ID NO: 2189612 - RNA, 15 nt, Streptococcus pneumoniae R6
gacaaaguuugaaaa

SEQ ID NO: 2189613 - RNA, 16 nt, Streptococcus pneumoniae R6
gacaaaguuugaaaag

SEQ ID NO: 2189614 - RNA, 22 nt, Streptococcus pneumoniae R6
gacaaauaauuuauccaaagga

SEQ ID NO: 2189615 - RNA, 18 nt, Streptococcus pneumoniae R6
gacaaagagccgaaaaaa

SEQ ID NO: 2189616 - RNA, 18 nt, Streptococcus pneumoniae R6
gacaaagaccuuugaaaa

SEQ ID NO: 2189617 - RNA, 12 nt, Streptococcus pneumoniae R6
gacaaagagcca

SEQ ID NO: 2189618 - RNA, 19 nt, Streptococcus pneumoniae R6
gacaaagagccaaaaaaga

SEQ ID NO: 2189619 - RNA, 21 nt, Streptococcus pneumoniae R6
gacaaagagccauaaaaauaa

SEQ ID NO: 2189620 - RNA, 15 nt, Streptococcus pneumoniae R6
gacaacuucaacccu

SEQ ID NO: 2189621 - RNA, 14 nt, Streptococcus pneumoniae R6
gacaagcaaucucu

SEQ ID NO: 2189622 - RNA, 14 nt, Streptococcus pneumoniae R6
gacaaucauuucag

SEQ ID NO: 2189623 - RNA, 17 nt, Streptococcus pneumoniae R6
gacacaaugguuagaaa

SEQ ID NO: 2189624 - RNA, 19 nt, Streptococcus pneumoniae R6
gacacaccacuauuagcau

SEQ ID NO: 2189625 - RNA, 18 nt, Streptococcus pneumoniae R6
gaauggcaaauucuguca

SEQ ID NO: 2189626 - RNA, 18 nt, Streptococcus pneumoniae R6
gaauggauuuaucaguau

SEQ ID NO: 2189627 - RNA, 21 nt, Streptococcus pneumoniae R6
gaauggauuuaucaguauauu

SEQ ID NO: 2189628 - RNA, 15 nt, Streptococcus pneumoniae R6
gaaugcuuuuugaaa

SEQ ID NO: 2189629 - RNA, 14 nt, Streptococcus pneumoniae R6
gaaugcuuacuuca

SEQ ID NO: 2189630 - RNA, 16 nt, Streptococcus pneumoniae R6
gaaugcuuacuucacu

SEQ ID NO: 2189631 - RNA, 21 nt, Streptococcus pneumoniae R6
gaauggguuaaaauuuuaucu

SEQ ID NO: 2189632 - RNA, 22 nt, Streptococcus pneumoniae R6
gaauggcuagaaccacaccucc

SEQ ID NO: 2189633 - RNA, 20 nt, Streptococcus pneumoniae R6
gaauucauuuucuuaaaagc

SEQ ID NO: 2189634 - RNA, 22 nt, Streptococcus pneumoniae R6
gaauucauuuucuuaaaagcuu

SEQ ID NO: 2189635 - RNA, 14 nt, Streptococcus pneumoniae R6
gaauucaauugcag

SEQ ID NO: 2189636 - RNA, 20 nt, Streptococcus pneumoniae R6
gaauucuccaaucaaauugu

SEQ ID NO: 2189637 - RNA, 16 nt, Streptococcus pneumoniae R6
gaauuugcuacaaaua

SEQ ID NO: 2189638 - RNA, 19 nt, Streptococcus pneumoniae R6
gaauuucuuuauuagucaa

SEQ ID NO: 2189639 - RNA, 20 nt, Streptococcus pneumoniae R6
gaauuugaaacaaugaaaau

SEQ ID NO: 2189640 - RNA, 18 nt, Streptococcus pneumoniae R6
gaauuuuagugaguccaa

SEQ ID NO: 2189641 - RNA, 13 nt, Streptococcus pneumoniae R6
gacccaagauagg

SEQ ID NO: 2189642 - RNA, 19 nt, Streptococcus pneumoniae R6
gacccugcgccagagcaau

SEQ ID NO: 2189643 - RNA, 14 nt, Streptococcus pneumoniae R6
gaccaagcuaucag

SEQ ID NO: 2189644 - RNA, 18 nt, Streptococcus pneumoniae R6
gaccaacuuuaagagcuu

SEQ ID NO: 2189645 - RNA, 15 nt, Streptococcus pneumoniae R6
gaccaaauccccauc

SEQ ID NO: 2189646 - RNA, 23 nt, Streptococcus pneumoniae R6
gaccacguucugcaacaacagcu

SEQ ID NO: 2189647 - RNA, 14 nt, Streptococcus pneumoniae R6
gaccaaguccucaa

SEQ ID NO: 2189648 - RNA, 16 nt, Streptococcus pneumoniae R6
gaccaaguuuaaggau

SEQ ID NO: 2189649 - RNA, 21 nt, Streptococcus pneumoniae R6
gacagccucaaugauaccauc

SEQ ID NO: 2189650 - RNA, 17 nt, Streptococcus pneumoniae R6
gacagccuuaccaccuu

SEQ ID NO: 2189651 - RNA, 12 nt, Streptococcus pneumoniae R6
gacagcaccaac

SEQ ID NO: 2189652 - RNA, 13 nt, Streptococcus pneumoniae R6
gacagcaccaacu

SEQ ID NO: 2189653 - RNA, 23 nt, Streptococcus pneumoniae R6
gacacuugccuaaacacuucacu

SEQ ID NO: 2189654 - RNA, 19 nt, Streptococcus pneumoniae R6
gacagaaaaaaucuaacuu

SEQ ID NO: 2189655 - RNA, 16 nt, Streptococcus pneumoniae R6
gacagaagaagugaca

SEQ ID NO: 2189656 - RNA, 13 nt, Streptococcus pneumoniae R6
gacagaagauuga

SEQ ID NO: 2189657 - RNA, 22 nt, Streptococcus pneumoniae R6
gacagaauuuugaggauaaaaa

SEQ ID NO: 2189658 - RNA, 18 nt, Streptococcus pneumoniae R6
gacacuagacagugaaau

SEQ ID NO: 2189659 - RNA, 20 nt, Streptococcus pneumoniae R6
gacacuagaugcaucugcca

SEQ ID NO: 2189660 - RNA, 21 nt, Streptococcus pneumoniae R6
gacacuagaugcaucugccag

SEQ ID NO: 2189661 - RNA, 22 nt, Streptococcus pneumoniae R6
gacacuagaugcaucugccaga

SEQ ID NO: 2189662 - RNA, 23 nt, Streptococcus pneumoniae R6
gacacggcaagacgaagcugaca

SEQ ID NO: 2189663 - RNA, 17 nt, Streptococcus pneumoniae R6
gacacauucguuccuuu

SEQ ID NO: 2189664 - RNA, 18 nt, Streptococcus pneumoniae R6
gacacauucguuccuuua

SEQ ID NO: 2189665 - RNA, 17 nt, Streptococcus pneumoniae R6
gacauaccauuuuccaa

SEQ ID NO: 2189666 - RNA, 21 nt, Streptococcus pneumoniae R6
gacauaaucgcuggcauuucc

SEQ ID NO: 2189667 - RNA, 17 nt, Streptococcus pneumoniae R6
gacaucugugauuucag

SEQ ID NO: 2189668 - RNA, 13 nt, Streptococcus pneumoniae R6
gacaucuucuacu

SEQ ID NO: 2189669 - RNA, 22 nt, Streptococcus pneumoniae R6
gacaucuucucaggcuuuuucu

SEQ ID NO: 2189670 - RNA, 23 nt, Streptococcus pneumoniae R6
gacaucuucucaggcuuuuucug

SEQ ID NO: 2189671 - RNA, 22 nt, Streptococcus pneumoniae R6
gacauaggucacgaggaggaga

SEQ ID NO: 2189672 - RNA, 20 nt, Streptococcus pneumoniae R6
gacauagccaauaaauguuu

SEQ ID NO: 2189673 - RNA, 23 nt, Streptococcus pneumoniae R6
gacaucagaaccaaaccaaacag

SEQ ID NO: 2189674 - RNA, 14 nt, Streptococcus pneumoniae R6
gaccgaugauuaca

SEQ ID NO: 2189675 - RNA, 22 nt, Streptococcus pneumoniae R6
gaccucagcucccgcuucauuu

SEQ ID NO: 2189676 - RNA, 14 nt, Streptococcus pneumoniae R6
gaccguuugaaaaa

SEQ ID NO: 2189677 - RNA, 20 nt, Streptococcus pneumoniae R6
gacgaauuuuuuggcuaaaa

SEQ ID NO: 2189678 - RNA, 14 nt, Streptococcus pneumoniae R6
gacgaaugauaauc

SEQ ID NO: 2189679 - RNA, 20 nt, Streptococcus pneumoniae R6
gaccuguuuggucagacugg

SEQ ID NO: 2189680 - RNA, 22 nt, Streptococcus pneumoniae R6
gacgauuccaaacaacaauacu

SEQ ID NO: 2189681 - RNA, 14 nt, Streptococcus pneumoniae R6
gacgagaaucgaac

SEQ ID NO: 2189682 - RNA, 14 nt, Streptococcus pneumoniae R6
gacgauuuucucuu

SEQ ID NO: 2189683 - RNA, 16 nt, Streptococcus pneumoniae R6
gacgauuuucucuuua

SEQ ID NO: 2189684 - RNA, 16 nt, Streptococcus pneumoniae R6
gacgauuuucucuuug

SEQ ID NO: 2189685 - RNA, 18 nt, Streptococcus pneumoniae R6
gacgauuuucucuuuguc

SEQ ID NO: 2189686 - RNA, 22 nt, Streptococcus pneumoniae R6
gacgauuaaauaguucuuccaa

SEQ ID NO: 2189687 - RNA, 16 nt, Streptococcus pneumoniae R6
gacgcgguuugaagag

SEQ ID NO: 2189688 - RNA, 17 nt, Streptococcus pneumoniae R6
gacugagagcuacacgu

SEQ ID NO: 2189689 - RNA, 16 nt, Streptococcus pneumoniae R6
gacugagccaauuaaa

SEQ ID NO: 2189690 - RNA, 18 nt, Streptococcus pneumoniae R6
gacugcgauuggggauug

SEQ ID NO: 2189691 - RNA, 16 nt, Streptococcus pneumoniae R6
gacugccucucuucug

SEQ ID NO: 2189692 - RNA, 18 nt, Streptococcus pneumoniae R6
gacugccucucuucuguu

SEQ ID NO: 2189693 - RNA, 15 nt, Streptococcus pneumoniae R6
gacugucaauauaga

SEQ ID NO: 2189694 - RNA, 17 nt, Streptococcus pneumoniae R6
gacuguuauagauucaa

SEQ ID NO: 2189695 - RNA, 16 nt, Streptococcus pneumoniae R6
gacugggauuccuuuu

SEQ ID NO: 2189696 - RNA, 21 nt, Streptococcus pneumoniae R6
gacuggaauucucuaagugau

SEQ ID NO: 2189697 - RNA, 13 nt, Streptococcus pneumoniae R6
gacguuuucagau

SEQ ID NO: 2189698 - RNA, 21 nt, Streptococcus pneumoniae R6
gacguuuaucaauaauagcga

SEQ ID NO: 2189699 - RNA, 23 nt, Streptococcus pneumoniae R6
gacuaaaaaacucugcuuuucag

SEQ ID NO: 2189700 - RNA, 14 nt, Streptococcus pneumoniae R6
gacuccuacaaagc

SEQ ID NO: 2189701 - RNA, 15 nt, Streptococcus pneumoniae R6
gacuccuacaaagcc

SEQ ID NO: 2189702 - RNA, 18 nt, Streptococcus pneumoniae R6
gacguucuucaagagcuu

SEQ ID NO: 2189703 - RNA, 17 nt, Streptococcus pneumoniae R6
gacguucuucugcaguu

SEQ ID NO: 2189704 - RNA, 15 nt, Streptococcus pneumoniae R6
gacucuguuccccaa

SEQ ID NO: 2189705 - RNA, 16 nt, Streptococcus pneumoniae R6
gacucuuagucuuuau

SEQ ID NO: 2189706 - RNA, 15 nt, Streptococcus pneumoniae R6
gacugaaaauauuuc

SEQ ID NO: 2189707 - RNA, 19 nt, Streptococcus pneumoniae R6
gacugaaaauauuucgcuu

SEQ ID NO: 2189708 - RNA, 18 nt, Streptococcus pneumoniae R6
gacuugaaauacuaaaaa

SEQ ID NO: 2189709 - RNA, 16 nt, Streptococcus pneumoniae R6
gacuugccuucaacac

SEQ ID NO: 2189710 - RNA, 15 nt, Streptococcus pneumoniae R6
gacuugcuugccaug

SEQ ID NO: 2189711 - RNA, 19 nt, Streptococcus pneumoniae R6
gacuugcuugccaugagcu

SEQ ID NO: 2189712 - RNA, 18 nt, Streptococcus pneumoniae R6
gacuucugagcuacuaua

SEQ ID NO: 2189713 - RNA, 18 nt, Streptococcus pneumoniae R6
gacuugauauaaaugaca

SEQ ID NO: 2189714 - RNA, 22 nt, Streptococcus pneumoniae R6
gacuuuggcuaggcgcuucacu

SEQ ID NO: 2189715 - RNA, 15 nt, Streptococcus pneumoniae R6
gacuuucucacgaau

SEQ ID NO: 2189716 - RNA, 22 nt, Streptococcus pneumoniae R6
gacuuucuuguuuucuuaucuu

SEQ ID NO: 2189717 - RNA, 22 nt, Streptococcus pneumoniae R6
gacuuucuaauuauuucaauua

SEQ ID NO: 2189718 - RNA, 23 nt, Streptococcus pneumoniae R6
gacuuucuaauuauuucaauuag

SEQ ID NO: 2189719 - RNA, 22 nt, Streptococcus pneumoniae R6
gacuuuaugugaauauucuugg

SEQ ID NO: 2189720 - RNA, 14 nt, Streptococcus pneumoniae R6
gacuuuccacaauu

SEQ ID NO: 2189721 - RNA, 15 nt, Streptococcus pneumoniae R6
gacuuucaauucuuc

SEQ ID NO: 2189722 - RNA, 16 nt, Streptococcus pneumoniae R6
gacuuucaauucuuca

SEQ ID NO: 2189723 - RNA, 18 nt, Streptococcus pneumoniae R6
gacuuaaauagaaaaaca

SEQ ID NO: 2189724 - RNA, 14 nt, Streptococcus pneumoniae R6
gacuguuucagaga

SEQ ID NO: 2189725 - RNA, 15 nt, Streptococcus pneumoniae R6
gacuucaacccacua

SEQ ID NO: 2189726 - RNA, 15 nt, Streptococcus pneumoniae R6
gacuucaauaaaaua

SEQ ID NO: 2189727 - RNA, 16 nt, Streptococcus pneumoniae R6
gacuucacacuuaagu

SEQ ID NO: 2189728 - RNA, 20 nt, Streptococcus pneumoniae R6
gacuucacacuuaaguguug

SEQ ID NO: 2189729 - RNA, 17 nt, Streptococcus pneumoniae R6
gacuucaggaaaaaaug

SEQ ID NO: 2189730 - RNA, 20 nt, Streptococcus pneumoniae R6
gacuuccaaaauuaaaaugu

SEQ ID NO: 2189731 - RNA, 19 nt, Streptococcus pneumoniae R6
gacuuccgccaucuuguuu

SEQ ID NO: 2189732 - RNA, 21 nt, Streptococcus pneumoniae R6
gacuuccuugccuucaaucuu

SEQ ID NO: 2189733 - RNA, 13 nt, Streptococcus pneumoniae R6
gacuucgucaguc

SEQ ID NO: 2189734 - RNA, 16 nt, Streptococcus pneumoniae R6
gacuucgucaguucua

SEQ ID NO: 2189735 - RNA, 20 nt, Streptococcus pneumoniae R6
gacuucgucaguuucaucua

SEQ ID NO: 2189736 - RNA, 17 nt, Streptococcus pneumoniae R6
gacuuuuauccaccuau

SEQ ID NO: 2189737 - RNA, 13 nt, Streptococcus pneumoniae R6
gacuuuugaaaaa

SEQ ID NO: 2189738 - RNA, 19 nt, Streptococcus pneumoniae R6
gagaaacagcuccugaaau

SEQ ID NO: 2189739 - RNA, 14 nt, Streptococcus pneumoniae R6
gagaaaguuaaaaa

SEQ ID NO: 2189740 - RNA, 20 nt, Streptococcus pneumoniae R6
gagaaaguuugguuugcgca

SEQ ID NO: 2189741 - RNA, 12 nt, Streptococcus pneumoniae R6
gagaaagucagc

SEQ ID NO: 2189742 - RNA, 22 nt, Streptococcus pneumoniae R6
aaagauuuuauccaaucuauuu

SEQ ID NO: 2189743 - RNA, 15 nt, Streptococcus pneumoniae R6
aaagauuuuuuaaaa

SEQ ID NO: 2189744 - RNA, 15 nt, Streptococcus pneumoniae R6
aaagauuuuuuccuu

SEQ ID NO: 2189745 - RNA, 17 nt, Streptococcus pneumoniae R6
aaagauuuuuuccuugc

SEQ ID NO: 2189746 - RNA, 18 nt, Streptococcus pneumoniae R6
aaagauuuuuuccuugcu

SEQ ID NO: 2189747 - RNA, 17 nt, Streptococcus pneumoniae R6
gagaaacuuagcgaaau

SEQ ID NO: 2189748 - RNA, 10 nt, Streptococcus pneumoniae R6
gagaaagcac

SEQ ID NO: 2189749 - RNA, 16 nt, Streptococcus pneumoniae R6
gagaaagaagagggcu

SEQ ID NO: 2189750 - RNA, 16 nt, Streptococcus pneumoniae R6
gagaaagaaaaacugc

SEQ ID NO: 2189751 - RNA, 17 nt, Streptococcus pneumoniae R6
gagaaagaaaaacugcu

SEQ ID NO: 2189752 - RNA, 18 nt, Streptococcus pneumoniae R6
gagaaagaaaaacugcuu

SEQ ID NO: 2189753 - RNA, 23 nt, Streptococcus pneumoniae R6
gagaaagaaaaacugcuuagaac

SEQ ID NO: 2189754 - RNA, 13 nt, Streptococcus pneumoniae R6
gagaaagaucauu

SEQ ID NO: 2189755 - RNA, 18 nt, Streptococcus pneumoniae R6
gagaaagauuuucaaagu

SEQ ID NO: 2189756 - RNA, 14 nt, Streptococcus pneumoniae R6
aaagcaacuaaaau

SEQ ID NO: 2189757 - RNA, 19 nt, Streptococcus pneumoniae R6
aaagcaacuaaaaucauag

SEQ ID NO: 2189758 - RNA, 13 nt, Streptococcus pneumoniae R6
aaagcaaauagca

SEQ ID NO: 2189759 - RNA, 19 nt, Streptococcus pneumoniae R6
aaagcaaauuuaauauuua

SEQ ID NO: 2189760 - RNA, 14 nt, Streptococcus pneumoniae R6
aaagcaaaagaaca

SEQ ID NO: 2189761 - RNA, 19 nt, Streptococcus pneumoniae R6
aaagcaaaagaacaaguaa

SEQ ID NO: 2189762 - RNA, 12 nt, Streptococcus pneumoniae R6
aaagcaaaaugg

SEQ ID NO: 2189763 - RNA, 12 nt, Streptococcus pneumoniae R6
aaagauuugaaa

SEQ ID NO: 2189764 - RNA, 18 nt, Streptococcus pneumoniae R6
aaagauuugaaacuaaau

SEQ ID NO: 2189765 - RNA, 19 nt, Streptococcus pneumoniae R6
gagaaauuucugaaacuaa

SEQ ID NO: 2189766 - RNA, 18 nt, Streptococcus pneumoniae R6
aaagcaaguuuugaacuu

SEQ ID NO: 2189767 - RNA, 18 nt, Streptococcus pneumoniae R6
gagaaccaggaaaccagc

SEQ ID NO: 2189768 - RNA, 16 nt, Streptococcus pneumoniae R6
gagacaaaaaaaacac

SEQ ID NO: 2189769 - RNA, 21 nt, Streptococcus pneumoniae R6
gagacaacgcacaccagagau

SEQ ID NO: 2189770 - RNA, 20 nt, Streptococcus pneumoniae R6
gagacagaaacgaaccuugg

SEQ ID NO: 2189771 - RNA, 14 nt, Streptococcus pneumoniae R6
gagacagaagauag

SEQ ID NO: 2189772 - RNA, 13 nt, Streptococcus pneumoniae R6
gagacagcaguua

SEQ ID NO: 2189773 - RNA, 21 nt, Streptococcus pneumoniae R6
gagaaucuucccguagguuuu

SEQ ID NO: 2189774 - RNA, 22 nt, Streptococcus pneumoniae R6
gagaaugcuugcgacaaaaaga

SEQ ID NO: 2189775 - RNA, 23 nt, Streptococcus pneumoniae R6
gagaaugcuugcgacaaaaagag

SEQ ID NO: 2189776 - RNA, 11 nt, Streptococcus pneumoniae R6
gagaauauuua

SEQ ID NO: 2189777 - RNA, 22 nt, Streptococcus pneumoniae R6
gagaagccaccgccagaacuuc

SEQ ID NO: 2189778 - RNA, 15 nt, Streptococcus pneumoniae R6
gagaagcccauaucu

SEQ ID NO: 2189779 - RNA, 19 nt, Streptococcus pneumoniae R6
gagaagcccauaucuccag

SEQ ID NO: 2189780 - RNA, 11 nt, Streptococcus pneumoniae R6
gagaagagcuu

SEQ ID NO: 2189781 - RNA, 14 nt, Streptococcus pneumoniae R6
gagaagaaaacaga

SEQ ID NO: 2189782 - RNA, 15 nt, Streptococcus pneumoniae R6
gagaagaaaacagaa

SEQ ID NO: 2189783 - RNA, 19 nt, Streptococcus pneumoniae R6
gagaagaaaacagaaaaau

SEQ ID NO: 2189784 - RNA, 15 nt, Streptococcus pneumoniae R6
gagaagaaauuccac

SEQ ID NO: 2189785 - RNA, 16 nt, Streptococcus pneumoniae R6
gagagauucauucugc

SEQ ID NO: 2189786 - RNA, 19 nt, Streptococcus pneumoniae R6
gagagauaaauaucggcag

SEQ ID NO: 2189787 - RNA, 15 nt, Streptococcus pneumoniae R6
gagagacagcaguua

SEQ ID NO: 2189788 - RNA, 20 nt, Streptococcus pneumoniae R6
gagauaggucacagcccccu

SEQ ID NO: 2189789 - RNA, 19 nt, Streptococcus pneumoniae R6
gagauacuccaaaacaucu

SEQ ID NO: 2189790 - RNA, 17 nt, Streptococcus pneumoniae R6
gagauacuuuuuucuua

SEQ ID NO: 2189791 - RNA, 13 nt, Streptococcus pneumoniae R6
gagaguucugaaa

SEQ ID NO: 2189792 - RNA, 17 nt, Streptococcus pneumoniae R6
gagauaauacaauugcu

SEQ ID NO: 2189793 - RNA, 16 nt, Streptococcus pneumoniae R6
gagaguucuuguuucu

SEQ ID NO: 2189794 - RNA, 20 nt, Streptococcus pneumoniae R6
gagaguggaacguagaucau

SEQ ID NO: 2189795 - RNA, 16 nt, Streptococcus pneumoniae R6
gagagcuccaaagaag

SEQ ID NO: 2189796 - RNA, 21 nt, Streptococcus pneumoniae R6
gagauaguauuuuaaaacgaa

SEQ ID NO: 2189797 - RNA, 19 nt, Streptococcus pneumoniae R6
gagaugggacuaaagauug

SEQ ID NO: 2189798 - RNA, 17 nt, Streptococcus pneumoniae R6
gagauggacuagaaugc

SEQ ID NO: 2189799 - RNA, 16 nt, Streptococcus pneumoniae R6
gagauggauuuuccuu

SEQ ID NO: 2189800 - RNA, 16 nt, Streptococcus pneumoniae R6
gagcccaauauucucu

SEQ ID NO: 2189801 - RNA, 24 nt, Streptococcus pneumoniae R6
gagccaguuuucguagcauaucca

SEQ ID NO: 2189802 - RNA, 18 nt, Streptococcus pneumoniae R6
gagcauaggaaguugagc

SEQ ID NO: 2189803 - RNA, 15 nt, Streptococcus pneumoniae R6
gagcccauguuuucu

SEQ ID NO: 2189804 - RNA, 19 nt, Streptococcus pneumoniae R6
gagcccauguuuucucaau

SEQ ID NO: 2189805 - RNA, 13 nt, Streptococcus pneumoniae R6
gagccuucuucca

SEQ ID NO: 2189806 - RNA, 14 nt, Streptococcus pneumoniae R6
aaagccaaaucaau

SEQ ID NO: 2189807 - RNA, 21 nt, Streptococcus pneumoniae R6
aaagccaaucaaaaaaucuca

SEQ ID NO: 2189808 - RNA, 14 nt, Streptococcus pneumoniae R6
aaagcagugcuuug

SEQ ID NO: 2189809 - RNA, 19 nt, Streptococcus pneumoniae R6
aaagcagugcuuugagcaa

SEQ ID NO: 2189810 - RNA, 15 nt, Streptococcus pneumoniae R6
gauaauuucuuuaau

SEQ ID NO: 2189811 - RNA, 14 nt, Streptococcus pneumoniae R6
gauaauuucgcugu

SEQ ID NO: 2189812 - RNA, 22 nt, Streptococcus pneumoniae R6
gauacaguuagcauggucaaag

SEQ ID NO: 2189813 - RNA, 11 nt, Streptococcus pneumoniae R6
gauaccaacca

SEQ ID NO: 2189814 - RNA, 14 nt, Streptococcus pneumoniae R6
gauaccaaccaguu

SEQ ID NO: 2189815 - RNA, 13 nt, Streptococcus pneumoniae R6
gauaccagagcga

SEQ ID NO: 2189816 - RNA, 15 nt, Streptococcus pneumoniae R6
gauaacagucaguuc

SEQ ID NO: 2189817 - RNA, 11 nt, Streptococcus pneumoniae R6
gauaacauaac

SEQ ID NO: 2189818 - RNA, 12 nt, Streptococcus pneumoniae R6
gauaagcuucuu

SEQ ID NO: 2189819 - RNA, 18 nt, Streptococcus pneumoniae R6
gauaaggacgguagcagg

SEQ ID NO: 2189820 - RNA, 18 nt, Streptococcus pneumoniae R6
gauaaggugggaagaguu

SEQ ID NO: 2189821 - RNA, 17 nt, Streptococcus pneumoniae R6
gauaaggcgaugcugac

SEQ ID NO: 2189822 - RNA, 18 nt, Streptococcus pneumoniae R6
gauaaggcgaugcugacg

SEQ ID NO: 2189823 - RNA, 18 nt, Streptococcus pneumoniae R6
gauaauagcacuuaaaaa

SEQ ID NO: 2189824 - RNA, 20 nt, Streptococcus pneumoniae R6
gauaauauauagguuuugcu

SEQ ID NO: 2189825 - RNA, 23 nt, Streptococcus pneumoniae R6
gauaauaucuaauugauuuaaau

SEQ ID NO: 2189826 - RNA, 19 nt, Streptococcus pneumoniae R6
gauaauauuacuucuaaaa

SEQ ID NO: 2189827 - RNA, 22 nt, Streptococcus pneumoniae R6
gauaauauuacuucuaaaacau

SEQ ID NO: 2189828 - RNA, 22 nt, Streptococcus pneumoniae R6
gauaaugguaucacauucaaug

SEQ ID NO: 2189829 - RNA, 14 nt, Streptococcus pneumoniae R6
gauaauuauuuuuu

SEQ ID NO: 2189830 - RNA, 14 nt, Streptococcus pneumoniae R6
gauaaucgcaaggu

SEQ ID NO: 2189831 - RNA, 23 nt, Streptococcus pneumoniae R6
gauaaucgcaagguagagacaga

SEQ ID NO: 2189832 - RNA, 16 nt, Streptococcus pneumoniae R6
gauaaucauaaagccu

SEQ ID NO: 2189833 - RNA, 14 nt, Streptococcus pneumoniae R6
gauagcauuuggaa

SEQ ID NO: 2189834 - RNA, 22 nt, Streptococcus pneumoniae R6
gauagccaugaacgucuaaacu

SEQ ID NO: 2189835 - RNA, 18 nt, Streptococcus pneumoniae R6
gauauaauuguaaacaaa

SEQ ID NO: 2189836 - RNA, 20 nt, Streptococcus pneumoniae R6
gauaucaauuccacgagcca

SEQ ID NO: 2189837 - RNA, 18 nt, Streptococcus pneumoniae R6
gauaucacggcauuucug

SEQ ID NO: 2189838 - RNA, 20 nt, Streptococcus pneumoniae R6
gauaguuucgcggaauagag

SEQ ID NO: 2189839 - RNA, 11 nt, Streptococcus pneumoniae R6
gauaguuuuuc

SEQ ID NO: 2189840 - RNA, 22 nt, Streptococcus pneumoniae R6
gauagcuccaucuccaacugcu

SEQ ID NO: 2189841 - RNA, 23 nt, Streptococcus pneumoniae R6
gauauuguccguagcaggaccag

SEQ ID NO: 2189842 - RNA, 12 nt, Streptococcus pneumoniae R6
gauauuucucca

SEQ ID NO: 2189843 - RNA, 17 nt, Streptococcus pneumoniae R6
gauauugcaguauaucu

SEQ ID NO: 2189844 - RNA, 14 nt, Streptococcus pneumoniae R6
gauauucuuuucaa

SEQ ID NO: 2189845 - RNA, 17 nt, Streptococcus pneumoniae R6
gauauucuuuucaaagu

SEQ ID NO: 2189846 - RNA, 17 nt, Streptococcus pneumoniae R6
gauauuuucaaaaaaau

SEQ ID NO: 2189847 - RNA, 21 nt, Streptococcus pneumoniae R6
gauauucagagcgauaaaaau

SEQ ID NO: 2189848 - RNA, 17 nt, Streptococcus pneumoniae R6
gauauuauuucaaagaa

SEQ ID NO: 2189849 - RNA, 19 nt, Streptococcus pneumoniae R6
gauaucauguuucaacaug

SEQ ID NO: 2189850 - RNA, 23 nt, Streptococcus pneumoniae R6
gagucuuuuuccaagaucuuuuu

SEQ ID NO: 2189851 - RNA, 16 nt, Streptococcus pneumoniae R6
gagugaaaaacuagca

SEQ ID NO: 2189852 - RNA, 16 nt, Streptococcus pneumoniae R6
gagucuugauggacaa

SEQ ID NO: 2189853 - RNA, 14 nt, Streptococcus pneumoniae R6
gaguccaaagacca

SEQ ID NO: 2189854 - RNA, 19 nt, Streptococcus pneumoniae R6
gagucagcucuuuuuugau

SEQ ID NO: 2189855 - RNA, 14 nt, Streptococcus pneumoniae R6
gaguaaaaaaagag

SEQ ID NO: 2189856 - RNA, 17 nt, Streptococcus pneumoniae R6
gaguaguaaaacuguau

SEQ ID NO: 2189857 - RNA, 15 nt, Streptococcus pneumoniae R6
gaguauaaaaucaaa

SEQ ID NO: 2189858 - RNA, 12 nt, Streptococcus pneumoniae R6
gaguauaaaauu

SEQ ID NO: 2189859 - RNA, 16 nt, Streptococcus pneumoniae R6
gaguauaaauggacaa

SEQ ID NO: 2189860 - RNA, 16 nt, Streptococcus pneumoniae R6
gaguauaagauacaaa

SEQ ID NO: 2189861 - RNA, 20 nt, Streptococcus pneumoniae R6
gaguauaagauacaaauuua

SEQ ID NO: 2189862 - RNA, 20 nt, Streptococcus pneumoniae R6
gagguugcugucguagucua

SEQ ID NO: 2189863 - RNA, 23 nt, Streptococcus pneumoniae R6
gagguuguagauagaacugacga

SEQ ID NO: 2189864 - RNA, 19 nt, Streptococcus pneumoniae R6
gagguuguagaugaaacug

SEQ ID NO: 2189865 - RNA, 18 nt, Streptococcus pneumoniae R6
gagguuguggauagaacu

SEQ ID NO: 2189866 - RNA, 23 nt, Streptococcus pneumoniae R6
gagguuguggauagaacugacga

SEQ ID NO: 2189867 - RNA, 19 nt, Streptococcus pneumoniae R6
gagguuguggaugaaacug

SEQ ID NO: 2189868 - RNA, 20 nt, Streptococcus pneumoniae R6
gaguuacggguuuuaaacua

SEQ ID NO: 2189869 - RNA, 15 nt, Streptococcus pneumoniae R6
gaguuaccuaaauua

SEQ ID NO: 2189870 - RNA, 16 nt, Streptococcus pneumoniae R6
gaguuaccuaaauuau

SEQ ID NO: 2189871 - RNA, 17 nt, Streptococcus pneumoniae R6
gaguugauaugagagau

SEQ ID NO: 2189872 - RNA, 11 nt, Streptococcus pneumoniae R6
gaguuuugcua

SEQ ID NO: 2189873 - RNA, 14 nt, Streptococcus pneumoniae R6
gaguucuuguuucu

SEQ ID NO: 2189874 - RNA, 14 nt, Streptococcus pneumoniae R6
gaguucuuuaacaa

SEQ ID NO: 2189875 - RNA, 14 nt, Streptococcus pneumoniae R6
gaguucuuuuacaa

SEQ ID NO: 2189876 - RNA, 20 nt, Streptococcus pneumoniae R6
gauaaaguuaugaaaaagau

SEQ ID NO: 2189877 - RNA, 18 nt, Streptococcus pneumoniae R6
gauaaauugcuggagaau

SEQ ID NO: 2189878 - RNA, 22 nt, Streptococcus pneumoniae R6
gauaaauugcuggagaaucauc

SEQ ID NO: 2189879 - RNA, 12 nt, Streptococcus pneumoniae R6
gaguuuuucagc

SEQ ID NO: 2189880 - RNA, 20 nt, Streptococcus pneumoniae R6
gauaaaaccuguuugaauca

SEQ ID NO: 2189881 - RNA, 16 nt, Streptococcus pneumoniae R6
gagggcaaaaaaggga

SEQ ID NO: 2189882 - RNA, 18 nt, Streptococcus pneumoniae R6
gaggucagugacuugugu

SEQ ID NO: 2189883 - RNA, 17 nt, Streptococcus pneumoniae R6
gagggagaccggagaga

SEQ ID NO: 2189884 - RNA, 21 nt, Streptococcus pneumoniae R6
gaggcuggacaaaaacucaau

SEQ ID NO: 2189885 - RNA, 18 nt, Streptococcus pneumoniae R6
gaggcacuugaugugacu

SEQ ID NO: 2189886 - RNA, 19 nt, Streptococcus pneumoniae R6
gagcuggaucuugaggaag

SEQ ID NO: 2189887 - RNA, 19 nt, Streptococcus pneumoniae R6
gagcuggccgacaucagaa

SEQ ID NO: 2189888 - RNA, 18 nt, Streptococcus pneumoniae R6
gagcgaauccuugauaac

SEQ ID NO: 2189889 - RNA, 17 nt, Streptococcus pneumoniae R6
gagccuuuuuaaagaua

SEQ ID NO: 2189890 - RNA, 21 nt, Streptococcus pneumoniae R6
gagcuucuuuuggauuuucaa

SEQ ID NO: 2189891 - RNA, 22 nt, Streptococcus pneumoniae R6
gagcuuccaguagcgcuugaua

SEQ ID NO: 2189892 - RNA, 19 nt, Streptococcus pneumoniae R6
gaggaauaaugcccaugaa

SEQ ID NO: 2189893 - RNA, 19 nt, Streptococcus pneumoniae R6
gagcuuugacauccuuuuc

SEQ ID NO: 2189894 - RNA, 20 nt, Streptococcus pneumoniae R6
gaggaagguuuuaaacaaag

SEQ ID NO: 2189895 - RNA, 15 nt, Streptococcus pneumoniae R6
gaggauuucacgcac

SEQ ID NO: 2189896 - RNA, 14 nt, Streptococcus pneumoniae R6
gaggcaaagaaaaa

SEQ ID NO: 2189897 - RNA, 15 nt, Streptococcus pneumoniae R6
gaggcaaagaaaaaa

SEQ ID NO: 2189898 - RNA, 17 nt, Streptococcus pneumoniae R6
gaggauuuuaaaguaau

SEQ ID NO: 2189899 - RNA, 22 nt, Streptococcus pneumoniae R6
gaggauuuuaaaguaaucucua

SEQ ID NO: 2189900 - RNA, 16 nt, Streptococcus pneumoniae R6
gaggauggcuuucuuu

SEQ ID NO: 2189901 - RNA, 21 nt, Streptococcus pneumoniae R6
aaaguucucuuucuaaaauag

SEQ ID NO: 2189902 - RNA, 13 nt, Streptococcus pneumoniae R6
aaaguucuucccc

SEQ ID NO: 2189903 - RNA, 15 nt, Streptococcus pneumoniae R6
aaaguucuuccccua

SEQ ID NO: 2189904 - RNA, 23 nt, Streptococcus pneumoniae R6
aaaguuuccagucaucugauugg

SEQ ID NO: 2189905 - RNA, 22 nt, Streptococcus pneumoniae R6
aaaguuuaucuagaauuucuuu

SEQ ID NO: 2189906 - RNA, 19 nt, Streptococcus pneumoniae R6
aaaguuuaucucuugccua

SEQ ID NO: 2189907 - RNA, 18 nt, Streptococcus pneumoniae R6
aaaguggucguuuuucau

SEQ ID NO: 2189908 - RNA, 15 nt, Streptococcus pneumoniae R6
aaaguggucuuuuuu

SEQ ID NO: 2189909 - RNA, 20 nt, Streptococcus pneumoniae R6
aaagugggcugauuuugaaa

SEQ ID NO: 2189910 - RNA, 17 nt, Streptococcus pneumoniae R6
aaaguggguuuuaacua

SEQ ID NO: 2189911 - RNA, 19 nt, Streptococcus pneumoniae R6
aaagugguaucauauaaau

SEQ ID NO: 2189912 - RNA, 21 nt, Streptococcus pneumoniae R6
aaagugguaucauauaaauau

SEQ ID NO: 2189913 - RNA, 14 nt, Streptococcus pneumoniae R6
aaaguggagguguu

SEQ ID NO: 2189914 - RNA, 17 nt, Streptococcus pneumoniae R6
aaaguggaaagagcaga

SEQ ID NO: 2189915 - RNA, 14 nt, Streptococcus pneumoniae R6
aaaguguagcagau

SEQ ID NO: 2189916 - RNA, 17 nt, Streptococcus pneumoniae R6
aaagugcaaauaagaaa

SEQ ID NO: 2189917 - RNA, 22 nt, Streptococcus pneumoniae R6
aaagugcaaauaagaaaucucc

SEQ ID NO: 2189918 - RNA, 17 nt, Streptococcus pneumoniae R6
aaaguuaaucucuccuu

SEQ ID NO: 2189919 - RNA, 19 nt, Streptococcus pneumoniae R6
aaaguuacuugauugcaaa

SEQ ID NO: 2189920 - RNA, 21 nt, Streptococcus pneumoniae R6
aaaguuacuugauugcaaagc

SEQ ID NO: 2189921 - RNA, 19 nt, Streptococcus pneumoniae R6
aaaguuagacaaauaauuu

SEQ ID NO: 2189922 - RNA, 20 nt, Streptococcus pneumoniae R6
aaaguuagacaaauaauuua

SEQ ID NO: 2189923 - RNA, 24 nt, Streptococcus pneumoniae R6
aaaguuagacaaauaauuuaucca

SEQ ID NO: 2189924 - RNA, 15 nt, Streptococcus pneumoniae R6
aaaguuagacagaaa

SEQ ID NO: 2189925 - RNA, 17 nt, Streptococcus pneumoniae R6
aaaguuagacagaaaaa

SEQ ID NO: 2189926 - RNA, 18 nt, Streptococcus pneumoniae R6
aaaguuagacagaaaaaa

SEQ ID NO: 2189927 - RNA, 19 nt, Streptococcus pneumoniae R6
aaaguuagacagaaaaaau

SEQ ID NO: 2189928 - RNA, 14 nt, Streptococcus pneumoniae R6
aaagugugacacua

SEQ ID NO: 2189929 - RNA, 16 nt, Streptococcus pneumoniae R6
aaaguguucugucuug

SEQ ID NO: 2189930 - RNA, 16 nt, Streptococcus pneumoniae R6
aaaguuaacuuuucca

SEQ ID NO: 2189931 - RNA, 13 nt, Streptococcus pneumoniae R6
aaaguuaaaaaaa

SEQ ID NO: 2189932 - RNA, 15 nt, Streptococcus pneumoniae R6
aaaguuaaaaaaacu

SEQ ID NO: 2189933 - RNA, 24 nt, Streptococcus pneumoniae R6
aaagugucagauaggauugcccua

SEQ ID NO: 2189934 - RNA, 18 nt, Streptococcus pneumoniae R6
aaaguuccuaaaaccaaa

SEQ ID NO: 2189935 - RNA, 20 nt, Streptococcus pneumoniae R6
aaaguuaugaaaaagauuuu

SEQ ID NO: 2189936 - RNA, 14 nt, Streptococcus pneumoniae R6
aaaguuuuugguaa

SEQ ID NO: 2189937 - RNA, 16 nt, Streptococcus pneumoniae R6
aaaguuuucuuuguuc

SEQ ID NO: 2189938 - RNA, 17 nt, Streptococcus pneumoniae R6
aaaguuucgaaaaccaa

SEQ ID NO: 2189939 - RNA, 18 nt, Streptococcus pneumoniae R6
aaaguuucgaaaaccaaa

SEQ ID NO: 2189940 - RNA, 19 nt, Streptococcus pneumoniae R6
aaaguuucgaaaaccaaag

SEQ ID NO: 2189941 - RNA, 21 nt, Streptococcus pneumoniae R6
ggccuacaauuggaaauaaca

SEQ ID NO: 2189942 - RNA, 19 nt, Streptococcus pneumoniae R6
aaauaaaauuccuuuaaaa

SEQ ID NO: 2189943 - RNA, 14 nt, Streptococcus pneumoniae R6
aaauaaaauuuuuu

SEQ ID NO: 2189944 - RNA, 13 nt, Streptococcus pneumoniae R6
aaauaaaacaaaa

SEQ ID NO: 2189945 - RNA, 15 nt, Streptococcus pneumoniae R6
aaauaaaaguaacac

SEQ ID NO: 2189946 - RNA, 16 nt, Streptococcus pneumoniae R6
aaauaaaaacaucuac

SEQ ID NO: 2189947 - RNA, 18 nt, Streptococcus pneumoniae R6
ggcgaaggucuuucaagc

SEQ ID NO: 2189948 - RNA, 13 nt, Streptococcus pneumoniae R6
aaauaaauaaaac

SEQ ID NO: 2189949 - RNA, 15 nt, Streptococcus pneumoniae R6
aaauaaaucuaucag

SEQ ID NO: 2189950 - RNA, 13 nt, Streptococcus pneumoniae R6
aaauacuaaaaaa

SEQ ID NO: 2189951 - RNA, 15 nt, Streptococcus pneumoniae R6
aaauacccucuauca

SEQ ID NO: 2189952 - RNA, 16 nt, Streptococcus pneumoniae R6
aaauacccucuaucaa

SEQ ID NO: 2189953 - RNA, 13 nt, Streptococcus pneumoniae R6
ggcgagggagacc

SEQ ID NO: 2189954 - RNA, 18 nt, Streptococcus pneumoniae R6
aaauacuaucaauaaaau

SEQ ID NO: 2189955 - RNA, 16 nt, Streptococcus pneumoniae R6
aaauacucaucaugaa

SEQ ID NO: 2189956 - RNA, 17 nt, Streptococcus pneumoniae R6
aaauacucaucaugaau

SEQ ID NO: 2189957 - RNA, 19 nt, Streptococcus pneumoniae R6
aaauacucaucaugaauau

SEQ ID NO: 2189958 - RNA, 17 nt, Streptococcus pneumoniae R6
aaauacucggaggacau

SEQ ID NO: 2189959 - RNA, 11 nt, Streptococcus pneumoniae R6
ggcgccugcug

SEQ ID NO: 2189960 - RNA, 11 nt, Streptococcus pneumoniae R6
ggcguccucua

SEQ ID NO: 2189961 - RNA, 22 nt, Streptococcus pneumoniae R6
ggcuagcuuucuaguuugcucu

SEQ ID NO: 2189962 - RNA, 17 nt, Streptococcus pneumoniae R6
ggcuaggugagauugga

SEQ ID NO: 2189963 - RNA, 21 nt, Streptococcus pneumoniae R6
ggcuaguaaauaucauuucca

SEQ ID NO: 2189964 - RNA, 22 nt, Streptococcus pneumoniae R6
ggcuagccuccuaguuugcucu

SEQ ID NO: 2189965 - RNA, 23 nt, Streptococcus pneumoniae R6
ggcuacuguaggcuugugugcca

SEQ ID NO: 2189966 - RNA, 16 nt, Streptococcus pneumoniae R6
ggcuagcacuaguaau

SEQ ID NO: 2189967 - RNA, 23 nt, Streptococcus pneumoniae R6
ggcuauaauuauucugcaaucaa

SEQ ID NO: 2189968 - RNA, 17 nt, Streptococcus pneumoniae R6
ggcuauugaagaagacu

SEQ ID NO: 2189969 - RNA, 15 nt, Streptococcus pneumoniae R6
ggcuaucugucacaa

SEQ ID NO: 2189970 - RNA, 18 nt, Streptococcus pneumoniae R6
ggcuaauuguaaacugug

SEQ ID NO: 2189971 - RNA, 17 nt, Streptococcus pneumoniae R6
ggcuacaccguaauuuc

SEQ ID NO: 2189972 - RNA, 22 nt, Streptococcus pneumoniae R6
ggcuaacacuugcuaggaagag

SEQ ID NO: 2189973 - RNA, 15 nt, Streptococcus pneumoniae R6
ggcuaaagauaagac

SEQ ID NO: 2189974 - RNA, 17 nt, Streptococcus pneumoniae R6
ggcguuucguuugauaa

SEQ ID NO: 2189975 - RNA, 21 nt, Streptococcus pneumoniae R6
ggcguguuugucaaacaucau

SEQ ID NO: 2189976 - RNA, 14 nt, Streptococcus pneumoniae R6
ggcaguacauuuaa

SEQ ID NO: 2189977 - RNA, 19 nt, Streptococcus pneumoniae R6
ggcauaagcaaucauaccu

SEQ ID NO: 2189978 - RNA, 14 nt, Streptococcus pneumoniae R6
ggcauaaacuugca

SEQ ID NO: 2189979 - RNA, 16 nt, Streptococcus pneumoniae R6
ggcauaaaucaaaucg

SEQ ID NO: 2189980 - RNA, 19 nt, Streptococcus pneumoniae R6
ggccaaacuugaaaugaug

SEQ ID NO: 2189981 - RNA, 19 nt, Streptococcus pneumoniae R6
ggcaugucguauaguagaa

SEQ ID NO: 2189982 - RNA, 23 nt, Streptococcus pneumoniae R6
ggccaacuaaccaacuucuuuuu

SEQ ID NO: 2189983 - RNA, 18 nt, Streptococcus pneumoniae R6
ggccacgguuagaagcgu

SEQ ID NO: 2189984 - RNA, 13 nt, Streptococcus pneumoniae R6
aaaguauuaaaau

SEQ ID NO: 2189985 - RNA, 18 nt, Streptococcus pneumoniae R6
ggcagaaacuguccgagc

SEQ ID NO: 2189986 - RNA, 13 nt, Streptococcus pneumoniae R6
ggcaccauuuuca

SEQ ID NO: 2189987 - RNA, 17 nt, Streptococcus pneumoniae R6
ggcaccauuuucagccc

SEQ ID NO: 2189988 - RNA, 11 nt, Streptococcus pneumoniae R6
ggcaccuucua

SEQ ID NO: 2189989 - RNA, 19 nt, Streptococcus pneumoniae R6
ggcaauaccguuaaagcau

SEQ ID NO: 2189990 - RNA, 19 nt, Streptococcus pneumoniae R6
ggcaauuuuacuucuuccc

SEQ ID NO: 2189991 - RNA, 22 nt, Streptococcus pneumoniae R6
ggcaaauucugucacaucugug

SEQ ID NO: 2189992 - RNA, 19 nt, Streptococcus pneumoniae R6
ggcaaauuugaccauuuca

SEQ ID NO: 2189993 - RNA, 16 nt, Streptococcus pneumoniae R6
ggcaacgaagcuagaa

SEQ ID NO: 2189994 - RNA, 20 nt, Streptococcus pneumoniae R6
ggcaacgaagcuagaaaugg

SEQ ID NO: 2189995 - RNA, 11 nt, Streptococcus pneumoniae R6
ggcaaauagcc

SEQ ID NO: 2189996 - RNA, 20 nt, Streptococcus pneumoniae R6
ggcaaauagcccauaaagag

SEQ ID NO: 2189997 - RNA, 13 nt, Streptococcus pneumoniae R6
ggcaaagaaaaaa

SEQ ID NO: 2189998 - RNA, 15 nt, Streptococcus pneumoniae R6
ggauuuaaaauaaga

SEQ ID NO: 2189999 - RNA, 16 nt, Streptococcus pneumoniae R6
ggauuguauagugaau

SEQ ID NO: 2190000 - RNA, 20 nt, Streptococcus pneumoniae R6
aaagggaugauguuaucaaa

SEQ ID NO: 2190001 - RNA, 22 nt, Streptococcus pneumoniae R6
ggacaucacuguuuuuuauccc

SEQ ID NO: 2190002 - RNA, 18 nt, Streptococcus pneumoniae R6
ggacaucauaacugcuaa

SEQ ID NO: 2190003 - RNA, 15 nt, Streptococcus pneumoniae R6
ggacauaaauaugau

SEQ ID NO: 2190004 - RNA, 14 nt, Streptococcus pneumoniae R6
ggacagucaaaucg

SEQ ID NO: 2190005 - RNA, 21 nt, Streptococcus pneumoniae R6
ggacagucaaaucgauuucua

SEQ ID NO: 2190006 - RNA, 20 nt, Streptococcus pneumoniae R6
ggacaggugcuuaaauaggc

SEQ ID NO: 2190007 - RNA, 19 nt, Streptococcus pneumoniae R6
ggacauuagggucuuuaau

SEQ ID NO: 2190008 - RNA, 13 nt, Streptococcus pneumoniae R6
ggacaugaguccu

SEQ ID NO: 2190009 - RNA, 12 nt, Streptococcus pneumoniae R6
ggacuaaauaca

SEQ ID NO: 2190010 - RNA, 22 nt, Streptococcus pneumoniae R6
ggacuaaauccaaaagcaggag

SEQ ID NO: 2190011 - RNA, 14 nt, Streptococcus pneumoniae R6
aaagguuuuaaaga

SEQ ID NO: 2190012 - RNA, 16 nt, Streptococcus pneumoniae R6
aaagguuuuaaagaca

SEQ ID NO: 2190013 - RNA, 17 nt, Streptococcus pneumoniae R6
aaagguuuuaaagacag

SEQ ID NO: 2190014 - RNA, 22 nt, Streptococcus pneumoniae R6
ggacuauucguuugauguacua

SEQ ID NO: 2190015 - RNA, 21 nt, Streptococcus pneumoniae R6
ggacuccuacaaagcccauac

SEQ ID NO: 2190016 - RNA, 12 nt, Streptococcus pneumoniae R6
ggagaaauuccu

SEQ ID NO: 2190017 - RNA, 13 nt, Streptococcus pneumoniae R6
aaaguaaaauaca

SEQ ID NO: 2190018 - RNA, 22 nt, Streptococcus pneumoniae R6
aaaguaaaauacaaaccaaacg

SEQ ID NO: 2190019 - RNA, 12 nt, Streptococcus pneumoniae R6
ggagaagaaaac

SEQ ID NO: 2190020 - RNA, 20 nt, Streptococcus pneumoniae R6
ggagcgaauuugaugcugca

SEQ ID NO: 2190021 - RNA, 20 nt, Streptococcus pneumoniae R6
ggagauaguaucccauucuu

SEQ ID NO: 2190022 - RNA, 14 nt, Streptococcus pneumoniae R6
ggaggcaaagaaaa

SEQ ID NO: 2190023 - RNA, 15 nt, Streptococcus pneumoniae R6
ggaggcaaagaaaaa

SEQ ID NO: 2190024 - RNA, 16 nt, Streptococcus pneumoniae R6
ggagcugguuggcuug

SEQ ID NO: 2190025 - RNA, 20 nt, Streptococcus pneumoniae R6
ggagcuuggaaugauuuggg

SEQ ID NO: 2190026 - RNA, 12 nt, Streptococcus pneumoniae R6
ggaguaaaaaaa

SEQ ID NO: 2190027 - RNA, 17 nt, Streptococcus pneumoniae R6
ggagguaaaucccaagu

SEQ ID NO: 2190028 - RNA, 13 nt, Streptococcus pneumoniae R6
ggagugauagaaa

SEQ ID NO: 2190029 - RNA, 23 nt, Streptococcus pneumoniae R6
ggauauaagguaggagugaaaaa

SEQ ID NO: 2190030 - RNA, 13 nt, Streptococcus pneumoniae R6
ggaucccauggug

SEQ ID NO: 2190031 - RNA, 14 nt, Streptococcus pneumoniae R6
ggaaaguucuuccc

SEQ ID NO: 2190032 - RNA, 14 nt, Streptococcus pneumoniae R6
ggaaagucaaauua

SEQ ID NO: 2190033 - RNA, 15 nt, Streptococcus pneumoniae R6
ggaaagucaaauuaa

SEQ ID NO: 2190034 - RNA, 23 nt, Streptococcus pneumoniae R6
ggaaagucaaauuaauuuauaga

SEQ ID NO: 2190035 - RNA, 20 nt, Streptococcus pneumoniae R6
ggaaaggcuagguaaguccu

SEQ ID NO: 2190036 - RNA, 23 nt, Streptococcus pneumoniae R6
ggaaaggaaaauugauuuauaga

SEQ ID NO: 2190037 - RNA, 14 nt, Streptococcus pneumoniae R6
ggaaagccaaauca

SEQ ID NO: 2190038 - RNA, 16 nt, Streptococcus pneumoniae R6
ggaaagccaaaucaau

SEQ ID NO: 2190039 - RNA, 19 nt, Streptococcus pneumoniae R6
ggaaauauaggccaagaua

SEQ ID NO: 2190040 - RNA, 18 nt, Streptococcus pneumoniae R6
ggaaaucauaaauauccu

SEQ ID NO: 2190041 - RNA, 17 nt, Streptococcus pneumoniae R6
ggaaaugaucagaccag

SEQ ID NO: 2190042 - RNA, 20 nt, Streptococcus pneumoniae R6
ggaaaugaucagaccaguuu

SEQ ID NO: 2190043 - RNA, 18 nt, Streptococcus pneumoniae R6
ggaaaauacugauaaaaa

SEQ ID NO: 2190044 - RNA, 22 nt, Streptococcus pneumoniae R6
ggaaaaucuucccacaauaaaa

SEQ ID NO: 2190045 - RNA, 15 nt, Streptococcus pneumoniae R6
ggaaaagucuuauaa

SEQ ID NO: 2190046 - RNA, 21 nt, Streptococcus pneumoniae R6
ggaaaaguaaugccaggccag

SEQ ID NO: 2190047 - RNA, 15 nt, Streptococcus pneumoniae R6
ggaaaacuuccaagc

SEQ ID NO: 2190048 - RNA, 18 nt, Streptococcus pneumoniae R6
ggaaacagauuucuuaga

SEQ ID NO: 2190049 - RNA, 19 nt, Streptococcus pneumoniae R6
ggaaacaaaagucuucuaa

SEQ ID NO: 2190050 - RNA, 20 nt, Streptococcus pneumoniae R6
ggaaacaaaagucuucuaac

SEQ ID NO: 2190051 - RNA, 18 nt, Streptococcus pneumoniae R6
ggaaacaaaauuaccauc

SEQ ID NO: 2190052 - RNA, 14 nt, Streptococcus pneumoniae R6
ggaaagauaacugc

SEQ ID NO: 2190053 - RNA, 21 nt, Streptococcus pneumoniae R6
ggaaagauaucgguuuaucuc

SEQ ID NO: 2190054 - RNA, 23 nt, Streptococcus pneumoniae R6
ggaaaccagcugcguaguagauu

SEQ ID NO: 2190055 - RNA, 13 nt, Streptococcus pneumoniae R6
ggaaacgcucggu

SEQ ID NO: 2190056 - RNA, 18 nt, Streptococcus pneumoniae R6
ggaaaccuaaucauagug

SEQ ID NO: 2190057 - RNA, 16 nt, Streptococcus pneumoniae R6
ggaagaugaagacauu

SEQ ID NO: 2190058 - RNA, 21 nt, Streptococcus pneumoniae R6
ggaauauugaguucuucacga

SEQ ID NO: 2190059 - RNA, 15 nt, Streptococcus pneumoniae R6
ggaaucaacauaucc

SEQ ID NO: 2190060 - RNA, 18 nt, Streptococcus pneumoniae R6
ggaauagcccacugugau

SEQ ID NO: 2190061 - RNA, 22 nt, Streptococcus pneumoniae R6
ggaauagcucaaaaguuuaucu

SEQ ID NO: 2190062 - RNA, 13 nt, Streptococcus pneumoniae R6
ggaauacuaaaau

SEQ ID NO: 2190063 - RNA, 20 nt, Streptococcus pneumoniae R6
ggaauacuaaaauauuucua

SEQ ID NO: 2190064 - RNA, 17 nt, Streptococcus pneumoniae R6
ggaaccugaaaaaauaa

SEQ ID NO: 2190065 - RNA, 18 nt, Streptococcus pneumoniae R6
ggaaccugaaaaaauaaa

SEQ ID NO: 2190066 - RNA, 15 nt, Streptococcus pneumoniae R6
ggaagaaagaggagu

SEQ ID NO: 2190067 - RNA, 18 nt, Streptococcus pneumoniae R6
ggaagaaagaggaguagg

SEQ ID NO: 2190068 - RNA, 19 nt, Streptococcus pneumoniae R6
gcuuugugaagacagauga

SEQ ID NO: 2190069 - RNA, 15 nt, Streptococcus pneumoniae R6
gcuuuggcaacugcu

SEQ ID NO: 2190070 - RNA, 17 nt, Streptococcus pneumoniae R6
gcuuuguggucuugcuu

SEQ ID NO: 2190071 - RNA, 17 nt, Streptococcus pneumoniae R6
gcuuugcgcuagauccu

SEQ ID NO: 2190072 - RNA, 18 nt, Streptococcus pneumoniae R6
gcuuugacauccuuuucu

SEQ ID NO: 2190073 - RNA, 23 nt, Streptococcus pneumoniae R6
gcuuugagggcugcaaaauuuug

SEQ ID NO: 2190074 - RNA, 16 nt, Streptococcus pneumoniae R6
gcuuugagaucuuuuu

SEQ ID NO: 2190075 - RNA, 17 nt, Streptococcus pneumoniae R6
gcuuugagcaaccugcg

SEQ ID NO: 2190076 - RNA, 22 nt, Streptococcus pneumoniae R6
gcuuucuucacaucacuuucug

SEQ ID NO: 2190077 - RNA, 15 nt, Streptococcus pneumoniae R6
gcuuucuucagauuu

SEQ ID NO: 2190078 - RNA, 19 nt, Streptococcus pneumoniae R6
gcuuucuguaaucuuacca

SEQ ID NO: 2190079 - RNA, 20 nt, Streptococcus pneumoniae R6
gcuuucuguaaucuuaccag

SEQ ID NO: 2190080 - RNA, 20 nt, Streptococcus pneumoniae R6
gcuuucugcaguuucucuac

SEQ ID NO: 2190081 - RNA, 20 nt, Streptococcus pneumoniae R6
gcugugcuuugagcaaccua

SEQ ID NO: 2190082 - RNA, 20 nt, Streptococcus pneumoniae R6
gcuuuuuuguauucacaaaa

SEQ ID NO: 2190083 - RNA, 16 nt, Streptococcus pneumoniae R6
gcuuuuucucaucuau

SEQ ID NO: 2190084 - RNA, 15 nt, Streptococcus pneumoniae R6
gcuuuuuguuuucua

SEQ ID NO: 2190085 - RNA, 16 nt, Streptococcus pneumoniae R6
gcuuuuuuaaaugcug

SEQ ID NO: 2190086 - RNA, 20 nt, Streptococcus pneumoniae R6
ggaaaaaauaaaaaaauuug

SEQ ID NO: 2190087 - RNA, 20 nt, Streptococcus pneumoniae R6
gcuuuuuuugcuuaaauaaa

SEQ ID NO: 2190088 - RNA, 19 nt, Streptococcus pneumoniae R6
ggaaaaaggcaacgaagcu

SEQ ID NO: 2190089 - RNA, 11 nt, Streptococcus pneumoniae R6
ggaaaaauuuu

SEQ ID NO: 2190090 - RNA, 19 nt, Streptococcus pneumoniae R6
gcuuuugauggguucuuug

SEQ ID NO: 2190091 - RNA, 12 nt, Streptococcus pneumoniae R6
gcuuuugcagca

SEQ ID NO: 2190092 - RNA, 14 nt, Streptococcus pneumoniae R6
gcuuuuauuucuug

SEQ ID NO: 2190093 - RNA, 15 nt, Streptococcus pneumoniae R6
gcuuuuauucagcca

SEQ ID NO: 2190094 - RNA, 11 nt, Streptococcus pneumoniae R6
gcuuuuauaaa

SEQ ID NO: 2190095 - RNA, 17 nt, Streptococcus pneumoniae R6
gcuaaaagauuucuaua

SEQ ID NO: 2190096 - RNA, 23 nt, Streptococcus pneumoniae R6
gcuaaaagauuucuauaaauuca

SEQ ID NO: 2190097 - RNA, 16 nt, Streptococcus pneumoniae R6
gcuaaaaucaggucuu

SEQ ID NO: 2190098 - RNA, 19 nt, Streptococcus pneumoniae R6
gcuaacggaauuaauagcu

SEQ ID NO: 2190099 - RNA, 24 nt, Streptococcus pneumoniae R6
gcuaagaaaguaagaaucugcaug

SEQ ID NO: 2190100 - RNA, 20 nt, Streptococcus pneumoniae R6
gcuaagcucgagaaaggaca

SEQ ID NO: 2190101 - RNA, 21 nt, Streptococcus pneumoniae R6
gcuaaggaggcaaagaaaaaa

SEQ ID NO: 2190102 - RNA, 15 nt, Streptococcus pneumoniae R6
gcuaagccuuuuucu

SEQ ID NO: 2190103 - RNA, 22 nt, Streptococcus pneumoniae R6
gcuaaucaaaacgcaguuucag

SEQ ID NO: 2190104 - RNA, 14 nt, Streptococcus pneumoniae R6
gcuaauagagcuga

SEQ ID NO: 2190105 - RNA, 18 nt, Streptococcus pneumoniae R6
gcuaccguugaaaucaau

SEQ ID NO: 2190106 - RNA, 23 nt, Streptococcus pneumoniae R6
gcuacucccaucgcgaccaagag

SEQ ID NO: 2190107 - RNA, 14 nt, Streptococcus pneumoniae R6
gcuacuauaaaaga

SEQ ID NO: 2190108 - RNA, 11 nt, Streptococcus pneumoniae R6
gcuacaagaac

SEQ ID NO: 2190109 - RNA, 16 nt, Streptococcus pneumoniae R6
gcuaauuucaagaagu

SEQ ID NO: 2190110 - RNA, 13 nt, Streptococcus pneumoniae R6
gcuacaggcaugg

SEQ ID NO: 2190111 - RNA, 15 nt, Streptococcus pneumoniae R6
gcuacaggcaugggc

SEQ ID NO: 2190112 - RNA, 15 nt, Streptococcus pneumoniae R6
gcuaccagaccaagu

SEQ ID NO: 2190113 - RNA, 16 nt, Streptococcus pneumoniae R6
gcuaccaaguaaaucu

SEQ ID NO: 2190114 - RNA, 13 nt, Streptococcus pneumoniae R6
gcuaaaaaaaggg

SEQ ID NO: 2190115 - RNA, 22 nt, Streptococcus pneumoniae R6
gcuaaaaaaagggauugaaggc

SEQ ID NO: 2190116 - RNA, 13 nt, Streptococcus pneumoniae R6
gcguuuuugugau

SEQ ID NO: 2190117 - RNA, 17 nt, Streptococcus pneumoniae R6
gcguuuagcaucuucuu

SEQ ID NO: 2190118 - RNA, 20 nt, Streptococcus pneumoniae R6
gcguuuauauaguagccaaa

SEQ ID NO: 2190119 - RNA, 22 nt, Streptococcus pneumoniae R6
gcguuugacaaguaaguagcau

SEQ ID NO: 2190120 - RNA, 22 nt, Streptococcus pneumoniae R6
gcguuggaauaaggcagcuuaa

SEQ ID NO: 2190121 - RNA, 23 nt, Streptococcus pneumoniae R6
gcguugauuccgaauggccagau

SEQ ID NO: 2190122 - RNA, 20 nt, Streptococcus pneumoniae R6
gcguugacgauuuucucuuu

SEQ ID NO: 2190123 - RNA, 17 nt, Streptococcus pneumoniae R6
gcguugacaaucuuuuc

SEQ ID NO: 2190124 - RNA, 18 nt, Streptococcus pneumoniae R6
gcguucaaagacuugccc

SEQ ID NO: 2190125 - RNA, 19 nt, Streptococcus pneumoniae R6
gcguucaccaggagccaag

SEQ ID NO: 2190126 - RNA, 18 nt, Streptococcus pneumoniae R6
gcucauuugcgcgcuuga

SEQ ID NO: 2190127 - RNA, 12 nt, Streptococcus pneumoniae R6
gcuccacccaug

SEQ ID NO: 2190128 - RNA, 18 nt, Streptococcus pneumoniae R6
gcuccacccauguaugga

SEQ ID NO: 2190129 - RNA, 21 nt, Streptococcus pneumoniae R6
gcucauguaaaucauuuucuu

SEQ ID NO: 2190130 - RNA, 22 nt, Streptococcus pneumoniae R6
gcucccauuuuuggaucauaac

SEQ ID NO: 2190131 - RNA, 16 nt, Streptococcus pneumoniae R6
gcuccacuuccccagc

SEQ ID NO: 2190132 - RNA, 19 nt, Streptococcus pneumoniae R6
gcuccacuuccccagcgau

SEQ ID NO: 2190133 - RNA, 22 nt, Streptococcus pneumoniae R6
gcucaaugaaaaucaaagagca

SEQ ID NO: 2190134 - RNA, 15 nt, Streptococcus pneumoniae R6
gcucagcugaugagu

SEQ ID NO: 2190135 - RNA, 19 nt, Streptococcus pneumoniae R6
gcucagcuggcagagcagc

SEQ ID NO: 2190136 - RNA, 13 nt, Streptococcus pneumoniae R6
gcucagcauuuuu

SEQ ID NO: 2190137 - RNA, 18 nt, Streptococcus pneumoniae R6
gcucacugaugaaacuaa

SEQ ID NO: 2190138 - RNA, 18 nt, Streptococcus pneumoniae R6
gcucagaaacaagaaauc

SEQ ID NO: 2190139 - RNA, 20 nt, Streptococcus pneumoniae R6
gcuauuuguuguaagcuagc

SEQ ID NO: 2190140 - RNA, 22 nt, Streptococcus pneumoniae R6
gcuauuuuauugucauuuuucu

SEQ ID NO: 2190141 - RNA, 21 nt, Streptococcus pneumoniae R6
gcucaaaguacagauuugaaa

SEQ ID NO: 2190142 - RNA, 12 nt, Streptococcus pneumoniae R6
gcucaaaacacu

SEQ ID NO: 2190143 - RNA, 13 nt, Streptococcus pneumoniae R6
gcucaaaacacug

SEQ ID NO: 2190144 - RNA, 16 nt, Streptococcus pneumoniae R6
gcucaaaacacuguuu

SEQ ID NO: 2190145 - RNA, 19 nt, Streptococcus pneumoniae R6
gcucaaaacauguuuuuga

SEQ ID NO: 2190146 - RNA, 22 nt, Streptococcus pneumoniae R6
gcucaaaaguuuaucuagaauu

SEQ ID NO: 2190147 - RNA, 17 nt, Streptococcus pneumoniae R6
gcucaagaccuugauua

SEQ ID NO: 2190148 - RNA, 17 nt, Streptococcus pneumoniae R6
gcuaugaauaugaguuc

SEQ ID NO: 2190149 - RNA, 18 nt, Streptococcus pneumoniae R6
gcuaucuuauugauuuuu

SEQ ID NO: 2190150 - RNA, 13 nt, Streptococcus pneumoniae R6
gcuauuucuugcu

SEQ ID NO: 2190151 - RNA, 14 nt, Streptococcus pneumoniae R6
gcuauuuaaaccaa

SEQ ID NO: 2190152 - RNA, 20 nt, Streptococcus pneumoniae R6
gcuauugaaaggaaaaugau

SEQ ID NO: 2190153 - RNA, 21 nt, Streptococcus pneumoniae R6
gcuauuagaugguauugacug

SEQ ID NO: 2190154 - RNA, 13 nt, Streptococcus pneumoniae R6
gcuauaagcccaa

SEQ ID NO: 2190155 - RNA, 14 nt, Streptococcus pneumoniae R6
gcuaguuuuuagga

SEQ ID NO: 2190156 - RNA, 18 nt, Streptococcus pneumoniae R6
gcuauauaguuuaaucaa

SEQ ID NO: 2190157 - RNA, 13 nt, Streptococcus pneumoniae R6
gcuauagucaaag

SEQ ID NO: 2190158 - RNA, 23 nt, Streptococcus pneumoniae R6
gcuaucuaggcugacaauaaaga

SEQ ID NO: 2190159 - RNA, 15 nt, Streptococcus pneumoniae R6
gcuaucgauaucaau

SEQ ID NO: 2190160 - RNA, 17 nt, Streptococcus pneumoniae R6
gcuauccagauagacau

SEQ ID NO: 2190161 - RNA, 14 nt, Streptococcus pneumoniae R6
gcuaucaaugguuu

SEQ ID NO: 2190162 - RNA, 18 nt, Streptococcus pneumoniae R6
gcuagaacuuccguauug

SEQ ID NO: 2190163 - RNA, 22 nt, Streptococcus pneumoniae R6
gcuagaaacguuguuaaaucaa

SEQ ID NO: 2190164 - RNA, 23 nt, Streptococcus pneumoniae R6
gcuagaaacguuguuaaaucaac

SEQ ID NO: 2190165 - RNA, 13 nt, Streptococcus pneumoniae R6
gcuagaagcaucg

SEQ ID NO: 2190166 - RNA, 13 nt, Streptococcus pneumoniae R6
gcuagauuuaaaa

SEQ ID NO: 2190167 - RNA, 14 nt, Streptococcus pneumoniae R6
gcuagauuuaaaac

SEQ ID NO: 2190168 - RNA, 13 nt, Streptococcus pneumoniae R6
gcuagaauguagu

SEQ ID NO: 2190169 - RNA, 19 nt, Streptococcus pneumoniae R6
gcuagacuaacuucuuauu

SEQ ID NO: 2190170 - RNA, 22 nt, Streptococcus pneumoniae R6
gcuaggugagauuggauuuucu

SEQ ID NO: 2190171 - RNA, 15 nt, Streptococcus pneumoniae R6
gcuagggauuuggcc

SEQ ID NO: 2190172 - RNA, 22 nt, Streptococcus pneumoniae R6
gcuagcuugcgaaauggcucca

SEQ ID NO: 2190173 - RNA, 13 nt, Streptococcus pneumoniae R6
gcuagcaucaucg

SEQ ID NO: 2190174 - RNA, 19 nt, Streptococcus pneumoniae R6
gcuagcuagaguuucaauu

SEQ ID NO: 2190175 - RNA, 14 nt, Streptococcus pneumoniae R6
gcucguccagcacu

SEQ ID NO: 2190176 - RNA, 19 nt, Streptococcus pneumoniae R6
gcucguacuuugggugcaa

SEQ ID NO: 2190177 - RNA, 18 nt, Streptococcus pneumoniae R6
gcucuucuggcagauaga

SEQ ID NO: 2190178 - RNA, 22 nt, Streptococcus pneumoniae R6
gcucuucuggcagauagauggu

SEQ ID NO: 2190179 - RNA, 15 nt, Streptococcus pneumoniae R6
gcucuuaaaagcaaa

SEQ ID NO: 2190180 - RNA, 13 nt, Streptococcus pneumoniae R6
gcucuguucuggu

SEQ ID NO: 2190181 - RNA, 17 nt, Streptococcus pneumoniae R6
gcucugugcaauacaga

SEQ ID NO: 2190182 - RNA, 18 nt, Streptococcus pneumoniae R6
gcucugucacuugaccug

SEQ ID NO: 2190183 - RNA, 14 nt, Streptococcus pneumoniae R6
gcucugguauaagg

SEQ ID NO: 2190184 - RNA, 18 nt, Streptococcus pneumoniae R6
gcucuaacugaagcuguu

SEQ ID NO: 2190185 - RNA, 16 nt, Streptococcus pneumoniae R6
gcucuaugauuuucac

SEQ ID NO: 2190186 - RNA, 14 nt, Streptococcus pneumoniae R6
gcucugaaccaaca

SEQ ID NO: 2190187 - RNA, 22 nt, Streptococcus pneumoniae R6
gcugagcucuuuagucccagcu

SEQ ID NO: 2190188 - RNA, 23 nt, Streptococcus pneumoniae R6
gcugacugauuuacaaauauuca

SEQ ID NO: 2190189 - RNA, 22 nt, Streptococcus pneumoniae R6
gcugacuucgucagucuuaucu

SEQ ID NO: 2190190 - RNA, 23 nt, Streptococcus pneumoniae R6
gcugacuucgucaguucuaucug

SEQ ID NO: 2190191 - RNA, 21 nt, Streptococcus pneumoniae R6
gcugacuucgucaguuucauc

SEQ ID NO: 2190192 - RNA, 23 nt, Streptococcus pneumoniae R6
gcucuuuuuugauaucuuccuca

SEQ ID NO: 2190193 - RNA, 12 nt, Streptococcus pneumoniae R6
gcucuuuuggga

SEQ ID NO: 2190194 - RNA, 14 nt, Streptococcus pneumoniae R6
gcucuuugauuuuc

SEQ ID NO: 2190195 - RNA, 16 nt, Streptococcus pneumoniae R6
gcucuuugauuuucau

SEQ ID NO: 2190196 - RNA, 18 nt, Streptococcus pneumoniae R6
gcucuuugauuuucauug

SEQ ID NO: 2190197 - RNA, 16 nt, Streptococcus pneumoniae R6
gcucuuggucauccau

SEQ ID NO: 2190198 - RNA, 19 nt, Streptococcus pneumoniae R6
gcugacgggcaaauuucau

SEQ ID NO: 2190199 - RNA, 18 nt, Streptococcus pneumoniae R6
gcugcaccuucaacugca

SEQ ID NO: 2190200 - RNA, 22 nt, Streptococcus pneumoniae R6
gcugcauuucuggauaacugaa

SEQ ID NO: 2190201 - RNA, 14 nt, Streptococcus pneumoniae R6
gcuggcauuuccca

SEQ ID NO: 2190202 - RNA, 19 nt, Streptococcus pneumoniae R6
gcuggauaguuuacuuaaa

SEQ ID NO: 2190203 - RNA, 21 nt, Streptococcus pneumoniae R6
gcugcguaguagauuggcagg

SEQ ID NO: 2190204 - RNA, 23 nt, Streptococcus pneumoniae R6
aaagcuuggcuuugauucaucuc

SEQ ID NO: 2190205 - RNA, 17 nt, Streptococcus pneumoniae R6
aaagcuuuugaguacuu

SEQ ID NO: 2190206 - RNA, 15 nt, Streptococcus pneumoniae R6
aaagcuuguuuaaaa

SEQ ID NO: 2190207 - RNA, 17 nt, Streptococcus pneumoniae R6
aaagcuuguuuaaaauc

SEQ ID NO: 2190208 - RNA, 12 nt, Streptococcus pneumoniae R6
aaagcuugaccu

SEQ ID NO: 2190209 - RNA, 18 nt, Streptococcus pneumoniae R6
aaagcuucauuuaucuuc

SEQ ID NO: 2190210 - RNA, 18 nt, Streptococcus pneumoniae R6
aaaggaaaaugauuuuuu

SEQ ID NO: 2190211 - RNA, 17 nt, Streptococcus pneumoniae R6
aaagcuuuuuucuuuua

SEQ ID NO: 2190212 - RNA, 18 nt, Streptococcus pneumoniae R6
gcuguccucaaaaugaaa

SEQ ID NO: 2190213 - RNA, 16 nt, Streptococcus pneumoniae R6
gcugucgcaccugacu

SEQ ID NO: 2190214 - RNA, 14 nt, Streptococcus pneumoniae R6
gcuguacuauuguc

SEQ ID NO: 2190215 - RNA, 16 nt, Streptococcus pneumoniae R6
gcugugauaaugguug

SEQ ID NO: 2190216 - RNA, 22 nt, Streptococcus pneumoniae R6
gcugugauaaugguugggaagg

SEQ ID NO: 2190217 - RNA, 22 nt, Streptococcus pneumoniae R6
gcugucuuuaguagucuaaaaa

SEQ ID NO: 2190218 - RNA, 17 nt, Streptococcus pneumoniae R6
gcugucuuuucaaaguu

SEQ ID NO: 2190219 - RNA, 14 nt, Streptococcus pneumoniae R6
aaagcuguauuggu

SEQ ID NO: 2190220 - RNA, 14 nt, Streptococcus pneumoniae R6
aaagcugugcuuug

SEQ ID NO: 2190221 - RNA, 14 nt, Streptococcus pneumoniae R6
aaagcuuacaucau

SEQ ID NO: 2190222 - RNA, 22 nt, Streptococcus pneumoniae R6
gcuggcuuuucagcuucuauuu

SEQ ID NO: 2190223 - RNA, 21 nt, Streptococcus pneumoniae R6
gcuggcuugaggucccaugcu

SEQ ID NO: 2190224 - RNA, 19 nt, Streptococcus pneumoniae R6
gcgguucaacuaacuuuua

SEQ ID NO: 2190225 - RNA, 15 nt, Streptococcus pneumoniae R6
gcaacugucuuaucc

SEQ ID NO: 2190226 - RNA, 19 nt, Streptococcus pneumoniae R6
gcaacuguuuuuucaacag

SEQ ID NO: 2190227 - RNA, 18 nt, Streptococcus pneumoniae R6
gcaacuuuuccaauagau

SEQ ID NO: 2190228 - RNA, 13 nt, Streptococcus pneumoniae R6
gcaacuaaaauca

SEQ ID NO: 2190229 - RNA, 22 nt, Streptococcus pneumoniae R6
gcaacuaaaaucauagcaggaa

SEQ ID NO: 2190230 - RNA, 22 nt, Streptococcus pneumoniae R6
gcaacuaaaaaggaaccagguu

SEQ ID NO: 2190231 - RNA, 22 nt, Streptococcus pneumoniae R6
gcaacuauaagauacuauggca

SEQ ID NO: 2190232 - RNA, 13 nt, Streptococcus pneumoniae R6
aaagcgauaaaaa

SEQ ID NO: 2190233 - RNA, 19 nt, Streptococcus pneumoniae R6
aaagcgauaaaaauccguu

SEQ ID NO: 2190234 - RNA, 15 nt, Streptococcus pneumoniae R6
gcaaccucaaaacag

SEQ ID NO: 2190235 - RNA, 17 nt, Streptococcus pneumoniae R6
gcaacguuaaagaguug

SEQ ID NO: 2190236 - RNA, 16 nt, Streptococcus pneumoniae R6
gcaacgccgucuucuu

SEQ ID NO: 2190237 - RNA, 13 nt, Streptococcus pneumoniae R6
gcaauaauaaugg

SEQ ID NO: 2190238 - RNA, 14 nt, Streptococcus pneumoniae R6
gcaauacagaacua

SEQ ID NO: 2190239 - RNA, 19 nt, Streptococcus pneumoniae R6
gcaaguuuuagaugagaaa

SEQ ID NO: 2190240 - RNA, 15 nt, Streptococcus pneumoniae R6
gcaagcagcuaaaag

SEQ ID NO: 2190241 - RNA, 21 nt, Streptococcus pneumoniae R6
gcaagaggucauaaaccucga

SEQ ID NO: 2190242 - RNA, 14 nt, Streptococcus pneumoniae R6
gcaagaucaaguuc

SEQ ID NO: 2190243 - RNA, 11 nt, Streptococcus pneumoniae R6
gcaagagaaau

SEQ ID NO: 2190244 - RNA, 23 nt, Streptococcus pneumoniae R6
gcaaggcuugaguauauggguga

SEQ ID NO: 2190245 - RNA, 20 nt, Streptococcus pneumoniae R6
gcaaggcuagugggagugga

SEQ ID NO: 2190246 - RNA, 19 nt, Streptococcus pneumoniae R6
gcaagguagagacagaaga

SEQ ID NO: 2190247 - RNA, 16 nt, Streptococcus pneumoniae R6
gcaagcuugaaacaaa

SEQ ID NO: 2190248 - RNA, 20 nt, Streptococcus pneumoniae R6
gcaagcuugaaacaaauaaa

SEQ ID NO: 2190249 - RNA, 17 nt, Streptococcus pneumoniae R6
gcaaucacucuaacuuc

SEQ ID NO: 2190250 - RNA, 18 nt, Streptococcus pneumoniae R6
gcaaucaagguuuccaaa

SEQ ID NO: 2190251 - RNA, 17 nt, Streptococcus pneumoniae R6
gcaaugagccaaggaag

SEQ ID NO: 2190252 - RNA, 18 nt, Streptococcus pneumoniae R6
gcaaugagccaaggaagu

SEQ ID NO: 2190253 - RNA, 22 nt, Streptococcus pneumoniae R6
gcaaucuuugcgaaguauucaa

SEQ ID NO: 2190254 - RNA, 18 nt, Streptococcus pneumoniae R6
gcaaucguugucaaguuu

SEQ ID NO: 2190255 - RNA, 23 nt, Streptococcus pneumoniae R6
gcaauuguuucguacuauuucag

SEQ ID NO: 2190256 - RNA, 20 nt, Streptococcus pneumoniae R6
gcaauucuugguugccuuuu

SEQ ID NO: 2190257 - RNA, 15 nt, Streptococcus pneumoniae R6
gcaauuuugaaagau

SEQ ID NO: 2190258 - RNA, 18 nt, Streptococcus pneumoniae R6
gcaauuuuacuucuuccc

SEQ ID NO: 2190259 - RNA, 19 nt, Streptococcus pneumoniae R6
gcaauuucgauaauaccua

SEQ ID NO: 2190260 - RNA, 11 nt, Streptococcus pneumoniae R6
gcaauuuuuga

SEQ ID NO: 2190261 - RNA, 16 nt, Streptococcus pneumoniae R6
gcaauuuuugaaagga

SEQ ID NO: 2190262 - RNA, 23 nt, Streptococcus pneumoniae R6
gcacaaaauccgcuugggaaacc

SEQ ID NO: 2190263 - RNA, 17 nt, Streptococcus pneumoniae R6
gcacaaaaucuuaaaaa

SEQ ID NO: 2190264 - RNA, 19 nt, Streptococcus pneumoniae R6
gcacaguagauuccuucuu

SEQ ID NO: 2190265 - RNA, 14 nt, Streptococcus pneumoniae R6
gcacaugacaaauu

SEQ ID NO: 2190266 - RNA, 16 nt, Streptococcus pneumoniae R6
gcacaugccuucuucg

SEQ ID NO: 2190267 - RNA, 16 nt, Streptococcus pneumoniae R6
gcacaaacuucauccc

SEQ ID NO: 2190268 - RNA, 12 nt, Streptococcus pneumoniae R6
gcacaaagaacc

SEQ ID NO: 2190269 - RNA, 15 nt, Streptococcus pneumoniae R6
gcacacgaaucugau

SEQ ID NO: 2190270 - RNA, 15 nt, Streptococcus pneumoniae R6
gcacagaaacaccuu

SEQ ID NO: 2190271 - RNA, 17 nt, Streptococcus pneumoniae R6
gcaccuacaacauagac

SEQ ID NO: 2190272 - RNA, 16 nt, Streptococcus pneumoniae R6
gcaccugauuucuccg

SEQ ID NO: 2190273 - RNA, 21 nt, Streptococcus pneumoniae R6
gcaccggcaucggauacagac

SEQ ID NO: 2190274 - RNA, 12 nt, Streptococcus pneumoniae R6
gcaccauuuuca

SEQ ID NO: 2190275 - RNA, 23 nt, Streptococcus pneumoniae R6
gcacggaucuugaacugcauuuu

SEQ ID NO: 2190276 - RNA, 23 nt, Streptococcus pneumoniae R6
gcaccuuuguauggaaacucaaa

SEQ ID NO: 2190277 - RNA, 22 nt, Streptococcus pneumoniae R6
gcaccuuuugcgucuucuacaa

SEQ ID NO: 2190278 - RNA, 16 nt, Streptococcus pneumoniae R6
gcaccuuggcauccag

SEQ ID NO: 2190279 - RNA, 18 nt, Streptococcus pneumoniae R6
gcaccuucuacagcaccu

SEQ ID NO: 2190280 - RNA, 20 nt, Streptococcus pneumoniae R6
gcagaaaaauuucauuuucu

SEQ ID NO: 2190281 - RNA, 23 nt, Streptococcus pneumoniae R6
gcacuucuuuuuguucaaaauua

SEQ ID NO: 2190282 - RNA, 18 nt, Streptococcus pneumoniae R6
gcacuugaugaaaaaaag

SEQ ID NO: 2190283 - RNA, 18 nt, Streptococcus pneumoniae R6
gcacugcuagcaucaucg

SEQ ID NO: 2190284 - RNA, 18 nt, Streptococcus pneumoniae R6
gcaggauuuuugcuucug

SEQ ID NO: 2190285 - RNA, 16 nt, Streptococcus pneumoniae R6
gcagcugaggaaaucc

SEQ ID NO: 2190286 - RNA, 23 nt, Streptococcus pneumoniae R6
gcagcgacauugacugagucacg

SEQ ID NO: 2190287 - RNA, 20 nt, Streptococcus pneumoniae R6
gcagacgaguuaaaacaaag

SEQ ID NO: 2190288 - RNA, 22 nt, Streptococcus pneumoniae R6
gcagaccauaaggauagauccc

SEQ ID NO: 2190289 - RNA, 18 nt, Streptococcus pneumoniae R6
gcagaaccccgauaacag

SEQ ID NO: 2190290 - RNA, 19 nt, Streptococcus pneumoniae R6
gcagaaccccgauaacagc

SEQ ID NO: 2190291 - RNA, 18 nt, Streptococcus pneumoniae R6
gcagaaucgugaguuccu

SEQ ID NO: 2190292 - RNA, 22 nt, Streptococcus pneumoniae R6
gcagaauacucuuucaguuuca

SEQ ID NO: 2190293 - RNA, 23 nt, Streptococcus pneumoniae R6
gcagaauacucuuucaguuucau

SEQ ID NO: 2190294 - RNA, 16 nt, Streptococcus pneumoniae R6
gcagauugaaauaaga

SEQ ID NO: 2190295 - RNA, 18 nt, Streptococcus pneumoniae R6
gcagaugcaaaagucagg

SEQ ID NO: 2190296 - RNA, 13 nt, Streptococcus pneumoniae R6
gcagaugaaagcu

SEQ ID NO: 2190297 - RNA, 19 nt, Streptococcus pneumoniae R6
gcagagcuaaaaacuucug

SEQ ID NO: 2190298 - RNA, 20 nt, Streptococcus pneumoniae R6
gcagagguguacuauucuag

SEQ ID NO: 2190299 - RNA, 20 nt, Streptococcus pneumoniae R6
gcagauagagacauaaucaa

SEQ ID NO: 2190300 - RNA, 22 nt, Streptococcus pneumoniae R6
gcagauuuguugauagaguagu

SEQ ID NO: 2190301 - RNA, 20 nt, Streptococcus pneumoniae R6
gcagauuuaacuauaguaga

SEQ ID NO: 2190302 - RNA, 16 nt, Streptococcus pneumoniae R6
gcagcaacgucuucaa

SEQ ID NO: 2190303 - RNA, 16 nt, Streptococcus pneumoniae R6
gcagccacuuuuuauc

SEQ ID NO: 2190304 - RNA, 18 nt, Streptococcus pneumoniae R6
gcagccacuuuuuauccg

SEQ ID NO: 2190305 - RNA, 22 nt, Streptococcus pneumoniae R6
gcaugucguauaguagaagugu

SEQ ID NO: 2190306 - RNA, 14 nt, Streptococcus pneumoniae R6
gcaugggccccagc

SEQ ID NO: 2190307 - RNA, 17 nt, Streptococcus pneumoniae R6
gcaugaaggucuuuugu

SEQ ID NO: 2190308 - RNA, 23 nt, Streptococcus pneumoniae R6
gcauucaaaacgccauucaucac

SEQ ID NO: 2190309 - RNA, 16 nt, Streptococcus pneumoniae R6
gcauucuauuccaucu

SEQ ID NO: 2190310 - RNA, 18 nt, Streptococcus pneumoniae R6
gcauucuauuccaucucc

SEQ ID NO: 2190311 - RNA, 22 nt, Streptococcus pneumoniae R6
gcauguucgggcacuucuuuuu

SEQ ID NO: 2190312 - RNA, 19 nt, Streptococcus pneumoniae R6
gcauuuuuuguuaguuuaa

SEQ ID NO: 2190313 - RNA, 14 nt, Streptococcus pneumoniae R6
gcauugucacaaag

SEQ ID NO: 2190314 - RNA, 16 nt, Streptococcus pneumoniae R6
gcauucuucucagcua

SEQ ID NO: 2190315 - RNA, 19 nt, Streptococcus pneumoniae R6
gcauucuucucuugaaaau

SEQ ID NO: 2190316 - RNA, 16 nt, Streptococcus pneumoniae R6
gcauaauuuccauacc

SEQ ID NO: 2190317 - RNA, 19 nt, Streptococcus pneumoniae R6
gcaguacuuugagcaaccu

SEQ ID NO: 2190318 - RNA, 22 nt, Streptococcus pneumoniae R6
gcaguacuuugagcaaccugcg

SEQ ID NO: 2190319 - RNA, 16 nt, Streptococcus pneumoniae R6
gcaucacgaaaauauu

SEQ ID NO: 2190320 - RNA, 16 nt, Streptococcus pneumoniae R6
gcauaguaucaaguuu

SEQ ID NO: 2190321 - RNA, 23 nt, Streptococcus pneumoniae R6
gcauaguaucagguauugaaaaa

SEQ ID NO: 2190322 - RNA, 17 nt, Streptococcus pneumoniae R6
gcauaguauuuguuaaa

SEQ ID NO: 2190323 - RNA, 19 nt, Streptococcus pneumoniae R6
gcauagucgccacauugag

SEQ ID NO: 2190324 - RNA, 19 nt, Streptococcus pneumoniae R6
gcauaguugcauuaaaauc

SEQ ID NO: 2190325 - RNA, 19 nt, Streptococcus pneumoniae R6
gcauccaucccauuuauau

SEQ ID NO: 2190326 - RNA, 18 nt, Streptococcus pneumoniae R6
gcauccccagugauuucu

SEQ ID NO: 2190327 - RNA, 21 nt, Streptococcus pneumoniae R6
gcaucgguaagaaagcaacua

SEQ ID NO: 2190328 - RNA, 13 nt, Streptococcus pneumoniae R6
gccaauuaaauaa

SEQ ID NO: 2190329 - RNA, 15 nt, Streptococcus pneumoniae R6
gccaauucuucuucu

SEQ ID NO: 2190330 - RNA, 14 nt, Streptococcus pneumoniae R6
gccaauacagauaa

SEQ ID NO: 2190331 - RNA, 14 nt, Streptococcus pneumoniae R6
gccaagugaguaau

SEQ ID NO: 2190332 - RNA, 16 nt, Streptococcus pneumoniae R6
gccaauacugcucggu

SEQ ID NO: 2190333 - RNA, 17 nt, Streptococcus pneumoniae R6
gccaagcgaaucuugua

SEQ ID NO: 2190334 - RNA, 20 nt, Streptococcus pneumoniae R6
gccaacuucuuuuugauuua

SEQ ID NO: 2190335 - RNA, 21 nt, Streptococcus pneumoniae R6
gccacucuuuauuccauggua

SEQ ID NO: 2190336 - RNA, 21 nt, Streptococcus pneumoniae R6
gccaccgccagaacuuccacu

SEQ ID NO: 2190337 - RNA, 14 nt, Streptococcus pneumoniae R6
gccccuaugcuuuc

SEQ ID NO: 2190338 - RNA, 16 nt, Streptococcus pneumoniae R6
gcccaauauucucuag

SEQ ID NO: 2190339 - RNA, 14 nt, Streptococcus pneumoniae R6
gccagucauuacca

SEQ ID NO: 2190340 - RNA, 22 nt, Streptococcus pneumoniae R6
gccaguagcuauuagaccugcc

SEQ ID NO: 2190341 - RNA, 18 nt, Streptococcus pneumoniae R6
gccauagcaagagcaccg

SEQ ID NO: 2190342 - RNA, 23 nt, Streptococcus pneumoniae R6
gccaguugcugcguuaaauccua

SEQ ID NO: 2190343 - RNA, 19 nt, Streptococcus pneumoniae R6
gccaugacaccguaagaua

SEQ ID NO: 2190344 - RNA, 20 nt, Streptococcus pneumoniae R6
gccauggccauaucugguuu

SEQ ID NO: 2190345 - RNA, 19 nt, Streptococcus pneumoniae R6
gccauuuggcccuaccugc

SEQ ID NO: 2190346 - RNA, 16 nt, Streptococcus pneumoniae R6
gcccucuaaauacaaa

SEQ ID NO: 2190347 - RNA, 20 nt, Streptococcus pneumoniae R6
gcccuuugcugcuuuccuuc

SEQ ID NO: 2190348 - RNA, 14 nt, Streptococcus pneumoniae R6
gcccuucauaaagg

SEQ ID NO: 2190349 - RNA, 15 nt, Streptococcus pneumoniae R6
gcccuuguucuccaa

SEQ ID NO: 2190350 - RNA, 16 nt, Streptococcus pneumoniae R6
gcccuuauuuccaucu

SEQ ID NO: 2190351 - RNA, 18 nt, Streptococcus pneumoniae R6
aaagcuacaaucuggaga

SEQ ID NO: 2190352 - RNA, 14 nt, Streptococcus pneumoniae R6
aaagcuacuuuuuu

SEQ ID NO: 2190353 - RNA, 18 nt, Streptococcus pneumoniae R6
aaagcuacuuuuuuacca

SEQ ID NO: 2190354 - RNA, 16 nt, Streptococcus pneumoniae R6
aaagcuagauuuaaaa

SEQ ID NO: 2190355 - RNA, 16 nt, Streptococcus pneumoniae R6
aaagcuaagcucgaga

SEQ ID NO: 2190356 - RNA, 18 nt, Streptococcus pneumoniae R6
aaagcuaagcucgagaaa

SEQ ID NO: 2190357 - RNA, 23 nt, Streptococcus pneumoniae R6
aaagcuaagcucgagaaaggaca

SEQ ID NO: 2190358 - RNA, 19 nt, Streptococcus pneumoniae R6
aaagcuaaagaugaugguu

SEQ ID NO: 2190359 - RNA, 15 nt, Streptococcus pneumoniae R6
aaagcguucaaagac

SEQ ID NO: 2190360 - RNA, 14 nt, Streptococcus pneumoniae R6
aaagcguuuauaua

SEQ ID NO: 2190361 - RNA, 16 nt, Streptococcus pneumoniae R6
aaagcgggauuuaaaa

SEQ ID NO: 2190362 - RNA, 22 nt, Streptococcus pneumoniae R6
aaagcgggauuuaaaauaagag

SEQ ID NO: 2190363 - RNA, 20 nt, Streptococcus pneumoniae R6
gccgaacuuuugaauuucau

SEQ ID NO: 2190364 - RNA, 13 nt, Streptococcus pneumoniae R6
gcccucagccagu

SEQ ID NO: 2190365 - RNA, 20 nt, Streptococcus pneumoniae R6
aaagcuagucgcagguugcu

SEQ ID NO: 2190366 - RNA, 23 nt, Streptococcus pneumoniae R6
aaagcuagucgcagguugcucaa

SEQ ID NO: 2190367 - RNA, 13 nt, Streptococcus pneumoniae R6
gccgauucccaaa

SEQ ID NO: 2190368 - RNA, 15 nt, Streptococcus pneumoniae R6
gcgacauugacugag

SEQ ID NO: 2190369 - RNA, 17 nt, Streptococcus pneumoniae R6
gcgaauuugaugcugca

SEQ ID NO: 2190370 - RNA, 17 nt, Streptococcus pneumoniae R6
gcgauagauguuuucaa

SEQ ID NO: 2190371 - RNA, 19 nt, Streptococcus pneumoniae R6
gcgauagcuccaucuccaa

SEQ ID NO: 2190372 - RNA, 21 nt, Streptococcus pneumoniae R6
gcgacugggauuccuuuuugc

SEQ ID NO: 2190373 - RNA, 22 nt, Streptococcus pneumoniae R6
gccugcuaggcugauuccugga

SEQ ID NO: 2190374 - RNA, 20 nt, Streptococcus pneumoniae R6
gccuauuuuuuauuucaaau

SEQ ID NO: 2190375 - RNA, 18 nt, Streptococcus pneumoniae R6
gccuaccugcggauaaaa

SEQ ID NO: 2190376 - RNA, 11 nt, Streptococcus pneumoniae R6
gccucuuucuu

SEQ ID NO: 2190377 - RNA, 12 nt, Streptococcus pneumoniae R6
gccucuuucuug

SEQ ID NO: 2190378 - RNA, 16 nt, Streptococcus pneumoniae R6
gccuggauagguugca

SEQ ID NO: 2190379 - RNA, 21 nt, Streptococcus pneumoniae R6
gccuggauagguugcaaagag

SEQ ID NO: 2190380 - RNA, 14 nt, Streptococcus pneumoniae R6
gccugcuuuuucaa

SEQ ID NO: 2190381 - RNA, 15 nt, Streptococcus pneumoniae R6
gccuguaaaaaguga

SEQ ID NO: 2190382 - RNA, 16 nt, Streptococcus pneumoniae R6
gccuguaaaaagugaa

SEQ ID NO: 2190383 - RNA, 23 nt, Streptococcus pneumoniae R6
gccuguaaaaagugaaaggaaga

SEQ ID NO: 2190384 - RNA, 17 nt, Streptococcus pneumoniae R6
gccugugauuuucuuau

SEQ ID NO: 2190385 - RNA, 15 nt, Streptococcus pneumoniae R6
gccuucaucauagaa

SEQ ID NO: 2190386 - RNA, 14 nt, Streptococcus pneumoniae R6
gccuuccaagauaa

SEQ ID NO: 2190387 - RNA, 19 nt, Streptococcus pneumoniae R6
gccuuaucaacugccuggu

SEQ ID NO: 2190388 - RNA, 20 nt, Streptococcus pneumoniae R6
gccuucauaaaagucuggcu

SEQ ID NO: 2190389 - RNA, 21 nt, Streptococcus pneumoniae R6
gccuuaccaccuuuaaauccu

SEQ ID NO: 2190390 - RNA, 14 nt, Streptococcus pneumoniae R6
gccuucuggucuga

SEQ ID NO: 2190391 - RNA, 12 nt, Streptococcus pneumoniae R6
gccuucuuccau

SEQ ID NO: 2190392 - RNA, 14 nt, Streptococcus pneumoniae R6
gccuucuuccaucu

SEQ ID NO: 2190393 - RNA, 21 nt, Streptococcus pneumoniae R6
gccuuccauauagucuuucaa

SEQ ID NO: 2190394 - RNA, 19 nt, Streptococcus pneumoniae R6
gccuuccuugucuauccag

SEQ ID NO: 2190395 - RNA, 19 nt, Streptococcus pneumoniae R6
gccuugucccaucauuccu

SEQ ID NO: 2190396 - RNA, 16 nt, Streptococcus pneumoniae R6
gccuuguagaugaaaa

SEQ ID NO: 2190397 - RNA, 18 nt, Streptococcus pneumoniae R6
gccuaaacacuucacuaa

SEQ ID NO: 2190398 - RNA, 16 nt, Streptococcus pneumoniae R6
gccguugauuuaacaa

SEQ ID NO: 2190399 - RNA, 17 nt, Streptococcus pneumoniae R6
gguucauuucuucuaug

SEQ ID NO: 2190400 - RNA, 17 nt, Streptococcus pneumoniae R6
gguucauccagcaggag

SEQ ID NO: 2190401 - RNA, 21 nt, Streptococcus pneumoniae R6
gguucaaaaaaugccuuaucu

SEQ ID NO: 2190402 - RNA, 23 nt, Streptococcus pneumoniae R6
gguuacugacuucgucaguucua

SEQ ID NO: 2190403 - RNA, 12 nt, Streptococcus pneumoniae R6
ggugugauuuuc

SEQ ID NO: 2190404 - RNA, 21 nt, Streptococcus pneumoniae R6
gguuaacgucaaaugacuacg

SEQ ID NO: 2190405 - RNA, 16 nt, Streptococcus pneumoniae R6
gguuaaaaucuuuuac

SEQ ID NO: 2190406 - RNA, 23 nt, Streptococcus pneumoniae R6
gguuaaaaucuuuuacuucugaa

SEQ ID NO: 2190407 - RNA, 15 nt, Streptococcus pneumoniae R6
gguuaaaauugcuuu

SEQ ID NO: 2190408 - RNA, 15 nt, Streptococcus pneumoniae R6
gguguaagggaaggu

SEQ ID NO: 2190409 - RNA, 14 nt, Streptococcus pneumoniae R6
gguguacuauucua

SEQ ID NO: 2190410 - RNA, 14 nt, Streptococcus pneumoniae R6
gguuguggauagaa

SEQ ID NO: 2190411 - RNA, 21 nt, Streptococcus pneumoniae R6
gguuguggauagaacugacga

SEQ ID NO: 2190412 - RNA, 20 nt, Streptococcus pneumoniae R6
gguuguccauuugaaagaac

SEQ ID NO: 2190413 - RNA, 20 nt, Streptococcus pneumoniae R6
gguuguagauagaacugacg

SEQ ID NO: 2190414 - RNA, 20 nt, Streptococcus pneumoniae R6
gguuguagaugaaacugacg

SEQ ID NO: 2190415 - RNA, 21 nt, Streptococcus pneumoniae R6
gguuguagaugaaacugacga

SEQ ID NO: 2190416 - RNA, 20 nt, Streptococcus pneumoniae R6
gguuguagauggaacugacg

SEQ ID NO: 2190417 - RNA, 21 nt, Streptococcus pneumoniae R6
gguugcuccgcggugcaauuu

SEQ ID NO: 2190418 - RNA, 18 nt, Streptococcus pneumoniae R6
gguugcucaaaguacugc

SEQ ID NO: 2190419 - RNA, 13 nt, Streptococcus pneumoniae R6
gguugaccaguau

SEQ ID NO: 2190420 - RNA, 14 nt, Streptococcus pneumoniae R6
gguuuugagguugu

SEQ ID NO: 2190421 - RNA, 10 nt, Streptococcus pneumoniae R6
gguuuuucuu

SEQ ID NO: 2190422 - RNA, 21 nt, Streptococcus pneumoniae R6
gguuuuucuuauacaaauaaa

SEQ ID NO: 2190423 - RNA, 18 nt, Streptococcus pneumoniae R6
gguuuuucuucagcaaua

SEQ ID NO: 2190424 - RNA, 13 nt, Streptococcus pneumoniae R6
gguuuuugccaug

SEQ ID NO: 2190425 - RNA, 16 nt, Streptococcus pneumoniae R6
guaaaaagugaaagga

SEQ ID NO: 2190426 - RNA, 13 nt, Streptococcus pneumoniae R6
guaaaaauuucua

SEQ ID NO: 2190427 - RNA, 13 nt, Streptococcus pneumoniae R6
gguuugaaaaugu

SEQ ID NO: 2190428 - RNA, 20 nt, Streptococcus pneumoniae R6
gguuuggaaaugaucagacc

SEQ ID NO: 2190429 - RNA, 14 nt, Streptococcus pneumoniae R6
gguuuaucucccau

SEQ ID NO: 2190430 - RNA, 13 nt, Streptococcus pneumoniae R6
ggugcacacgaau

SEQ ID NO: 2190431 - RNA, 14 nt, Streptococcus pneumoniae R6
ggugcccaaauacu

SEQ ID NO: 2190432 - RNA, 20 nt, Streptococcus pneumoniae R6
ggugacuucauuauuaugaa

SEQ ID NO: 2190433 - RNA, 14 nt, Streptococcus pneumoniae R6
gguggaaaagcaag

SEQ ID NO: 2190434 - RNA, 20 nt, Streptococcus pneumoniae R6
gguggaucaugacuggacgg

SEQ ID NO: 2190435 - RNA, 13 nt, Streptococcus pneumoniae R6
gguggauaaaagu

SEQ ID NO: 2190436 - RNA, 19 nt, Streptococcus pneumoniae R6
ggugccucauuaguaauuu

SEQ ID NO: 2190437 - RNA, 20 nt, Streptococcus pneumoniae R6
guaccugcuaccguugaaau

SEQ ID NO: 2190438 - RNA, 20 nt, Streptococcus pneumoniae R6
guaccuaaaaaggaaccagu

SEQ ID NO: 2190439 - RNA, 21 nt, Streptococcus pneumoniae R6
guaccguucauauccguucca

SEQ ID NO: 2190440 - RNA, 22 nt, Streptococcus pneumoniae R6
guaccacggcagacagagaaaa

SEQ ID NO: 2190441 - RNA, 13 nt, Streptococcus pneumoniae R6
guaccagcucguu

SEQ ID NO: 2190442 - RNA, 15 nt, Streptococcus pneumoniae R6
guacauuagaauuca

SEQ ID NO: 2190443 - RNA, 16 nt, Streptococcus pneumoniae R6
guacauucaacaccug

SEQ ID NO: 2190444 - RNA, 19 nt, Streptococcus pneumoniae R6
guacagauuugaaaacuga

SEQ ID NO: 2190445 - RNA, 23 nt, Streptococcus pneumoniae R6
guacacuucugcuucuaaaacau

SEQ ID NO: 2190446 - RNA, 15 nt, Streptococcus pneumoniae R6
aaauagauaaauacu

SEQ ID NO: 2190447 - RNA, 18 nt, Streptococcus pneumoniae R6
aaauagaaggaguugagc

SEQ ID NO: 2190448 - RNA, 15 nt, Streptococcus pneumoniae R6
guaaucacugcagca

SEQ ID NO: 2190449 - RNA, 22 nt, Streptococcus pneumoniae R6
guaaucacugcagcaaagguac

SEQ ID NO: 2190450 - RNA, 19 nt, Streptococcus pneumoniae R6
guaaucaauauagucuaca

SEQ ID NO: 2190451 - RNA, 17 nt, Streptococcus pneumoniae R6
guaaugccgugauuucc

SEQ ID NO: 2190452 - RNA, 20 nt, Streptococcus pneumoniae R6
guaaugacuuguguuuuucc

SEQ ID NO: 2190453 - RNA, 14 nt, Streptococcus pneumoniae R6
guaaucuuaaaguu

SEQ ID NO: 2190454 - RNA, 14 nt, Streptococcus pneumoniae R6
guaaugacaauuau

SEQ ID NO: 2190455 - RNA, 19 nt, Streptococcus pneumoniae R6
guaaugacaauuauauaaa

SEQ ID NO: 2190456 - RNA, 23 nt, Streptococcus pneumoniae R6
guaaugacaauuauauaaaccaa

SEQ ID NO: 2190457 - RNA, 23 nt, Streptococcus pneumoniae R6
guaaucucguucuugaaaccagu

SEQ ID NO: 2190458 - RNA, 18 nt, Streptococcus pneumoniae R6
guaaucucugauaauauu

SEQ ID NO: 2190459 - RNA, 16 nt, Streptococcus pneumoniae R6
guaaucucaaaacagu

SEQ ID NO: 2190460 - RNA, 18 nt, Streptococcus pneumoniae R6
aaauagauuggauaaaau

SEQ ID NO: 2190461 - RNA, 14 nt, Streptococcus pneumoniae R6
aaauagauuuuuaa

SEQ ID NO: 2190462 - RNA, 17 nt, Streptococcus pneumoniae R6
guacacaucuacuucua

SEQ ID NO: 2190463 - RNA, 21 nt, Streptococcus pneumoniae R6
guacacaggaauacuaaaaua

SEQ ID NO: 2190464 - RNA, 18 nt, Streptococcus pneumoniae R6
guacaaagaauaaaauag

SEQ ID NO: 2190465 - RNA, 23 nt, Streptococcus pneumoniae R6
guaauuaugaaauuuaaaaagaa

SEQ ID NO: 2190466 - RNA, 22 nt, Streptococcus pneumoniae R6
guaauuucuacuguauacuuuu

SEQ ID NO: 2190467 - RNA, 17 nt, Streptococcus pneumoniae R6
guaacgagucaaaaaag

SEQ ID NO: 2190468 - RNA, 19 nt, Streptococcus pneumoniae R6
guaacgagucaaaaaagga

SEQ ID NO: 2190469 - RNA, 18 nt, Streptococcus pneumoniae R6
guaacuaacgccaaaucc

SEQ ID NO: 2190470 - RNA, 14 nt, Streptococcus pneumoniae R6
guaacguucuucaa

SEQ ID NO: 2190471 - RNA, 18 nt, Streptococcus pneumoniae R6
guaacguucuucaacauc

SEQ ID NO: 2190472 - RNA, 14 nt, Streptococcus pneumoniae R6
guaacgucuuuucg

SEQ ID NO: 2190473 - RNA, 16 nt, Streptococcus pneumoniae R6
guaacggcuuucaguu

SEQ ID NO: 2190474 - RNA, 19 nt, Streptococcus pneumoniae R6
guaacuauuuuugaucuuc

SEQ ID NO: 2190475 - RNA, 15 nt, Streptococcus pneumoniae R6
guaagaaauuuugga

SEQ ID NO: 2190476 - RNA, 12 nt, Streptococcus pneumoniae R6
guaacuguuuua

SEQ ID NO: 2190477 - RNA, 17 nt, Streptococcus pneumoniae R6
guaagaguggauuuuca

SEQ ID NO: 2190478 - RNA, 18 nt, Streptococcus pneumoniae R6
guaagaguggauuuucac

SEQ ID NO: 2190479 - RNA, 18 nt, Streptococcus pneumoniae R6
guaagaauguugcuuugg

SEQ ID NO: 2190480 - RNA, 15 nt, Streptococcus pneumoniae R6
guaagaacuuuuuaa

SEQ ID NO: 2190481 - RNA, 19 nt, Streptococcus pneumoniae R6
guaagagaacuucacguuc

SEQ ID NO: 2190482 - RNA, 20 nt, Streptococcus pneumoniae R6
guaaguggguggguaaagga

SEQ ID NO: 2190483 - RNA, 22 nt, Streptococcus pneumoniae R6
guaaguugggguuccuuuuuug

SEQ ID NO: 2190484 - RNA, 24 nt, Streptococcus pneumoniae R6
guaaguuaaaaauccugauuucaa

SEQ ID NO: 2190485 - RNA, 16 nt, Streptococcus pneumoniae R6
guaaggagcagggcau

SEQ ID NO: 2190486 - RNA, 12 nt, Streptococcus pneumoniae R6
guaauaauccaa

SEQ ID NO: 2190487 - RNA, 19 nt, Streptococcus pneumoniae R6
guaauaaacuggguugaag

SEQ ID NO: 2190488 - RNA, 12 nt, Streptococcus pneumoniae R6
guaaucaaaagg

SEQ ID NO: 2190489 - RNA, 15 nt, Streptococcus pneumoniae R6
guaacauauuuucaa

SEQ ID NO: 2190490 - RNA, 15 nt, Streptococcus pneumoniae R6
guaacagucuuagca

SEQ ID NO: 2190491 - RNA, 23 nt, Streptococcus pneumoniae R6
guaaccaauuucucaaaaaaguu

SEQ ID NO: 2190492 - RNA, 20 nt, Streptococcus pneumoniae R6
guaaauucugucacaacuga

SEQ ID NO: 2190493 - RNA, 19 nt, Streptococcus pneumoniae R6
guaaauucuuaaagccacu

SEQ ID NO: 2190494 - RNA, 23 nt, Streptococcus pneumoniae R6
guaacaacaccgcagucuucaau

SEQ ID NO: 2190495 - RNA, 13 nt, Streptococcus pneumoniae R6
guaacaaaaauac

SEQ ID NO: 2190496 - RNA, 12 nt, Streptococcus pneumoniae R6
guaaauaucauu

SEQ ID NO: 2190497 - RNA, 23 nt, Streptococcus pneumoniae R6
guaaaucuucccacaauaaaaag

SEQ ID NO: 2190498 - RNA, 17 nt, Streptococcus pneumoniae R6
guaaaugugagcuuugg

SEQ ID NO: 2190499 - RNA, 14 nt, Streptococcus pneumoniae R6
guaaauuauacucu

SEQ ID NO: 2190500 - RNA, 15 nt, Streptococcus pneumoniae R6
guaaauuauacucuu

SEQ ID NO: 2190501 - RNA, 17 nt, Streptococcus pneumoniae R6
guaaaguguagcagauu

SEQ ID NO: 2190502 - RNA, 16 nt, Streptococcus pneumoniae R6
guaaacuagaaagcua

SEQ ID NO: 2190503 - RNA, 20 nt, Streptococcus pneumoniae R6
guaaacugcgaagaaaucau

SEQ ID NO: 2190504 - RNA, 18 nt, Streptococcus pneumoniae R6
guaaacuucuucuuccau

SEQ ID NO: 2190505 - RNA, 15 nt, Streptococcus pneumoniae R6
guaaaauacucauca

SEQ ID NO: 2190506 - RNA, 18 nt, Streptococcus pneumoniae R6
guaaaauagauaaauacu

SEQ ID NO: 2190507 - RNA, 14 nt, Streptococcus pneumoniae R6
guaaaagacacaug

SEQ ID NO: 2190508 - RNA, 19 nt, Streptococcus pneumoniae R6
guaaacaaguugcuugaaa

SEQ ID NO: 2190509 - RNA, 18 nt, Streptococcus pneumoniae R6
guaaacaaagagguuuua

SEQ ID NO: 2190510 - RNA, 18 nt, Streptococcus pneumoniae R6
guacugcccccaaacagu

SEQ ID NO: 2190511 - RNA, 19 nt, Streptococcus pneumoniae R6
guacugccccccaaaaaag

SEQ ID NO: 2190512 - RNA, 13 nt, Streptococcus pneumoniae R6
guacuggauaaag

SEQ ID NO: 2190513 - RNA, 15 nt, Streptococcus pneumoniae R6
guacugaacaaugaa

SEQ ID NO: 2190514 - RNA, 21 nt, Streptococcus pneumoniae R6
guacuagggcauuuugaccug

SEQ ID NO: 2190515 - RNA, 23 nt, Streptococcus pneumoniae R6
guacuauucuaguuucaaucuau

SEQ ID NO: 2190516 - RNA, 13 nt, Streptococcus pneumoniae R6
guacuauuucaga

SEQ ID NO: 2190517 - RNA, 19 nt, Streptococcus pneumoniae R6
guacucaaugaaaaucaaa

SEQ ID NO: 2190518 - RNA, 17 nt, Streptococcus pneumoniae R6
guacucacuuacauauu

SEQ ID NO: 2190519 - RNA, 18 nt, Streptococcus pneumoniae R6
guacucaggugaguagga

SEQ ID NO: 2190520 - RNA, 22 nt, Streptococcus pneumoniae R6
guacuuucagaacauuacccau

SEQ ID NO: 2190521 - RNA, 12 nt, Streptococcus pneumoniae R6
guacuuuccaau

SEQ ID NO: 2190522 - RNA, 22 nt, Streptococcus pneumoniae R6
guacuugagacuguuugagaug

SEQ ID NO: 2190523 - RNA, 14 nt, Streptococcus pneumoniae R6
guacuguuauagau

SEQ ID NO: 2190524 - RNA, 21 nt, Streptococcus pneumoniae R6
guacuguuauagauucaacga

SEQ ID NO: 2190525 - RNA, 15 nt, Streptococcus pneumoniae R6
guagaaaaugaaauu

SEQ ID NO: 2190526 - RNA, 16 nt, Streptococcus pneumoniae R6
guagaaaaugaaauuu

SEQ ID NO: 2190527 - RNA, 9 nt, Streptococcus pneumoniae R6
guagaaaau

SEQ ID NO: 2190528 - RNA, 10 nt, Streptococcus pneumoniae R6
guagaaaagc

SEQ ID NO: 2190529 - RNA, 12 nt, Streptococcus pneumoniae R6
guagaaaagcaa

SEQ ID NO: 2190530 - RNA, 12 nt, Streptococcus pneumoniae R6
guagaguuugua

SEQ ID NO: 2190531 - RNA, 14 nt, Streptococcus pneumoniae R6
guagagucuguucu

SEQ ID NO: 2190532 - RNA, 14 nt, Streptococcus pneumoniae R6
guagagagauaacg

SEQ ID NO: 2190533 - RNA, 18 nt, Streptococcus pneumoniae R6
guagaggcgccugcugcu

SEQ ID NO: 2190534 - RNA, 23 nt, Streptococcus pneumoniae R6
guagacgaguugguccagcuuca

SEQ ID NO: 2190535 - RNA, 22 nt, Streptococcus pneumoniae R6
guagauuauaugcuaaaaugua

SEQ ID NO: 2190536 - RNA, 14 nt, Streptococcus pneumoniae R6
guagaugaaaaaua

SEQ ID NO: 2190537 - RNA, 13 nt, Streptococcus pneumoniae R6
guagcaaaacacu

SEQ ID NO: 2190538 - RNA, 16 nt, Streptococcus pneumoniae R6
guagcacuuuuccauu

SEQ ID NO: 2190539 - RNA, 22 nt, Streptococcus pneumoniae R6
guagccacucuggcaauuuauc

SEQ ID NO: 2190540 - RNA, 14 nt, Streptococcus pneumoniae R6
guagucuuuuaaac

SEQ ID NO: 2190541 - RNA, 16 nt, Streptococcus pneumoniae R6
guaguagucagugauu

SEQ ID NO: 2190542 - RNA, 21 nt, Streptococcus pneumoniae R6
guaguacugaacaaugaaaaa

SEQ ID NO: 2190543 - RNA, 17 nt, Streptococcus pneumoniae R6
guaguaguuagauaacu

SEQ ID NO: 2190544 - RNA, 13 nt, Streptococcus pneumoniae R6
guaguaguuucag

SEQ ID NO: 2190545 - RNA, 17 nt, Streptococcus pneumoniae R6
guaggcuuuaucaagca

SEQ ID NO: 2190546 - RNA, 19 nt, Streptococcus pneumoniae R6
guaggcuuuaucaagcaaa

SEQ ID NO: 2190547 - RNA, 17 nt, Streptococcus pneumoniae R6
guaggcuuucaacugcu

SEQ ID NO: 2190548 - RNA, 16 nt, Streptococcus pneumoniae R6
guagggcgauaaaauc

SEQ ID NO: 2190549 - RNA, 15 nt, Streptococcus pneumoniae R6
guagguugcucaaag

SEQ ID NO: 2190550 - RNA, 17 nt, Streptococcus pneumoniae R6
guagguugcucaaagca

SEQ ID NO: 2190551 - RNA, 20 nt, Streptococcus pneumoniae R6
guagggggcauauaaauaca

SEQ ID NO: 2190552 - RNA, 17 nt, Streptococcus pneumoniae R6
guaggaguccucuguau

SEQ ID NO: 2190553 - RNA, 13 nt, Streptococcus pneumoniae R6
guaggaugacaac

SEQ ID NO: 2190554 - RNA, 14 nt, Streptococcus pneumoniae R6
guaggauuucuccu

SEQ ID NO: 2190555 - RNA, 15 nt, Streptococcus pneumoniae R6
guagcucuuuuguua

SEQ ID NO: 2190556 - RNA, 15 nt, Streptococcus pneumoniae R6
guagcuauuaaagau

SEQ ID NO: 2190557 - RNA, 18 nt, Streptococcus pneumoniae R6
guagcccuucauaaagga

SEQ ID NO: 2190558 - RNA, 14 nt, Streptococcus pneumoniae R6
guagcggauuuuca

SEQ ID NO: 2190559 - RNA, 22 nt, Streptococcus pneumoniae R6
guauaauagguggauaaaaguc

SEQ ID NO: 2190560 - RNA, 23 nt, Streptococcus pneumoniae R6
guauaaucccauugagaaaauau

SEQ ID NO: 2190561 - RNA, 22 nt, Streptococcus pneumoniae R6
guaguuuuaccacuaaacuaca

SEQ ID NO: 2190562 - RNA, 15 nt, Streptococcus pneumoniae R6
guauaguagaagugu

SEQ ID NO: 2190563 - RNA, 17 nt, Streptococcus pneumoniae R6
guauaggucuggcuauu

SEQ ID NO: 2190564 - RNA, 14 nt, Streptococcus pneumoniae R6
guaucaaaggcaag

SEQ ID NO: 2190565 - RNA, 13 nt, Streptococcus pneumoniae R6
guauauucugugu

SEQ ID NO: 2190566 - RNA, 18 nt, Streptococcus pneumoniae R6
guauauugaaaugaaaua

SEQ ID NO: 2190567 - RNA, 12 nt, Streptococcus pneumoniae R6
guauagagcaau

SEQ ID NO: 2190568 - RNA, 15 nt, Streptococcus pneumoniae R6
guauagacaggauau

SEQ ID NO: 2190569 - RNA, 12 nt, Streptococcus pneumoniae R6
guauacuuugca

SEQ ID NO: 2190570 - RNA, 19 nt, Streptococcus pneumoniae R6
guauacuuuuucaguuuua

SEQ ID NO: 2190571 - RNA, 18 nt, Streptococcus pneumoniae R6
guauaccagucguuucaa

SEQ ID NO: 2190572 - RNA, 16 nt, Streptococcus pneumoniae R6
guaucugcuaaaacaa

SEQ ID NO: 2190573 - RNA, 13 nt, Streptococcus pneumoniae R6
guaugaaauagcc

SEQ ID NO: 2190574 - RNA, 20 nt, Streptococcus pneumoniae R6
guaugagcacuauuguuauu

SEQ ID NO: 2190575 - RNA, 13 nt, Streptococcus pneumoniae R6
guaugagaaacag

SEQ ID NO: 2190576 - RNA, 17 nt, Streptococcus pneumoniae R6
guaugaaggaguuucac

SEQ ID NO: 2190577 - RNA, 21 nt, Streptococcus pneumoniae R6
guaugaaggaguuucaccuug

SEQ ID NO: 2190578 - RNA, 19 nt, Streptococcus pneumoniae R6
guaugacaucuuggaguug

SEQ ID NO: 2190579 - RNA, 19 nt, Streptococcus pneumoniae R6
guaucggaaauauuuugcu

SEQ ID NO: 2190580 - RNA, 14 nt, Streptococcus pneumoniae R6
guauccuauuucac

SEQ ID NO: 2190581 - RNA, 21 nt, Streptococcus pneumoniae R6
guaucaagguuuuucuguacu

SEQ ID NO: 2190582 - RNA, 19 nt, Streptococcus pneumoniae R6
guaucaccaagcauuuuca

SEQ ID NO: 2190583 - RNA, 14 nt, Streptococcus pneumoniae R6
guaucauucuuauu

SEQ ID NO: 2190584 - RNA, 14 nt, Streptococcus pneumoniae R6
guaucauauaaaua

SEQ ID NO: 2190585 - RNA, 19 nt, Streptococcus pneumoniae R6
guauccaaaacaaccaauu

SEQ ID NO: 2190586 - RNA, 15 nt, Streptococcus pneumoniae R6
guaucccauucuuca

SEQ ID NO: 2190587 - RNA, 13 nt, Streptococcus pneumoniae R6
guauggagcuuuu

SEQ ID NO: 2190588 - RNA, 16 nt, Streptococcus pneumoniae R6
guauggaggaauaaau

SEQ ID NO: 2190589 - RNA, 23 nt, Streptococcus pneumoniae R6
guaugcuauaucuuauuuuucua

SEQ ID NO: 2190590 - RNA, 16 nt, Streptococcus pneumoniae R6
guauuaucaauaucaa

SEQ ID NO: 2190591 - RNA, 13 nt, Streptococcus pneumoniae R6
guauuacauccac

SEQ ID NO: 2190592 - RNA, 12 nt, Streptococcus pneumoniae R6
guauuaaaauaa

SEQ ID NO: 2190593 - RNA, 22 nt, Streptococcus pneumoniae R6
guauuaaaauaaguucaacaaa

SEQ ID NO: 2190594 - RNA, 22 nt, Streptococcus pneumoniae R6
guauuaagaacucuuuccaacu

SEQ ID NO: 2190595 - RNA, 22 nt, Streptococcus pneumoniae R6
guauucucguagugcuucucuu

SEQ ID NO: 2190596 - RNA, 17 nt, Streptococcus pneumoniae R6
guauucgcuuacauaaa

SEQ ID NO: 2190597 - RNA, 15 nt, Streptococcus pneumoniae R6
guauugaaaaaacuu

SEQ ID NO: 2190598 - RNA, 16 nt, Streptococcus pneumoniae R6
guauugaaaaaacuug

SEQ ID NO: 2190599 - RNA, 12 nt, Streptococcus pneumoniae R6
guauugaacccg

SEQ ID NO: 2190600 - RNA, 17 nt, Streptococcus pneumoniae R6
guauucauugaaaaaau

SEQ ID NO: 2190601 - RNA, 17 nt, Streptococcus pneumoniae R6
guauucagucaucucug

SEQ ID NO: 2190602 - RNA, 15 nt, Streptococcus pneumoniae R6
guauucauaaaauac

SEQ ID NO: 2190603 - RNA, 18 nt, Streptococcus pneumoniae R6
guauuauucuaguuucaa

SEQ ID NO: 2190604 - RNA, 13 nt, Streptococcus pneumoniae R6
guauugacugccc

SEQ ID NO: 2190605 - RNA, 19 nt, Streptococcus pneumoniae R6
guauugggaugacuuucca

SEQ ID NO: 2190606 - RNA, 17 nt, Streptococcus pneumoniae R6
guauuucuucuucugaa

SEQ ID NO: 2190607 - RNA, 15 nt, Streptococcus pneumoniae R6
guauuuuuucuuccc

SEQ ID NO: 2190608 - RNA, 14 nt, Streptococcus pneumoniae R6
gucaaaaagaagga

SEQ ID NO: 2190609 - RNA, 21 nt, Streptococcus pneumoniae R6
gucaaaauauuuggagcaagu

SEQ ID NO: 2190610 - RNA, 12 nt, Streptococcus pneumoniae R6
gucaaacaucau

SEQ ID NO: 2190611 - RNA, 21 nt, Streptococcus pneumoniae R6
gucaaagaaggcuuuaccaaa

SEQ ID NO: 2190612 - RNA, 22 nt, Streptococcus pneumoniae R6
gucaaauuaauuuauagaaaaa

SEQ ID NO: 2190613 - RNA, 23 nt, Streptococcus pneumoniae R6
gucaaauuaauuuauagaaaaau

SEQ ID NO: 2190614 - RNA, 11 nt, Streptococcus pneumoniae R6
gucaaauuacg

SEQ ID NO: 2190615 - RNA, 19 nt, Streptococcus pneumoniae R6
gucaaaucgauuucuaaaa

SEQ ID NO: 2190616 - RNA, 13 nt, Streptococcus pneumoniae R6
gucaacaguuagu

SEQ ID NO: 2190617 - RNA, 20 nt, Streptococcus pneumoniae R6
gucaacaggauuuuguucuu

SEQ ID NO: 2190618 - RNA, 15 nt, Streptococcus pneumoniae R6
gucaaccaacuuuuc

SEQ ID NO: 2190619 - RNA, 15 nt, Streptococcus pneumoniae R6
gucgaagcuuccaau

SEQ ID NO: 2190620 - RNA, 21 nt, Streptococcus pneumoniae R6
gucgaagguuauaccaaaaaa

SEQ ID NO: 2190621 - RNA, 18 nt, Streptococcus pneumoniae R6
gucgagacauaccauuuu

SEQ ID NO: 2190622 - RNA, 20 nt, Streptococcus pneumoniae R6
gucgauguuuugguuuuuaa

SEQ ID NO: 2190623 - RNA, 19 nt, Streptococcus pneumoniae R6
guccuggucuuauuucauu

SEQ ID NO: 2190624 - RNA, 16 nt, Streptococcus pneumoniae R6
guccugaaaaucaucu

SEQ ID NO: 2190625 - RNA, 19 nt, Streptococcus pneumoniae R6
guccuguugcuucaucucc

SEQ ID NO: 2190626 - RNA, 14 nt, Streptococcus pneumoniae R6
guccgagugcaaga

SEQ ID NO: 2190627 - RNA, 19 nt, Streptococcus pneumoniae R6
guccucgcaagagacuauu

SEQ ID NO: 2190628 - RNA, 22 nt, Streptococcus pneumoniae R6
guccguagcaggaccagaaaga

SEQ ID NO: 2190629 - RNA, 16 nt, Streptococcus pneumoniae R6
gucuacaaauucaaac

SEQ ID NO: 2190630 - RNA, 23 nt, Streptococcus pneumoniae R6
gucuacaauagcuuguuccaauu

SEQ ID NO: 2190631 - RNA, 22 nt, Streptococcus pneumoniae R6
gucuacauucuuuuuaaggagu

SEQ ID NO: 2190632 - RNA, 19 nt, Streptococcus pneumoniae R6
gucuacuauauaucauaau

SEQ ID NO: 2190633 - RNA, 19 nt, Streptococcus pneumoniae R6
gucuaacuguuugggggca

SEQ ID NO: 2190634 - RNA, 20 nt, Streptococcus pneumoniae R6
gucguaccuaaaaaggaacc

SEQ ID NO: 2190635 - RNA, 17 nt, Streptococcus pneumoniae R6
gucaaguguagugggua

SEQ ID NO: 2190636 - RNA, 19 nt, Streptococcus pneumoniae R6
gucaagggguuaagacacc

SEQ ID NO: 2190637 - RNA, 21 nt, Streptococcus pneumoniae R6
gucaagguguacuguuauaga

SEQ ID NO: 2190638 - RNA, 14 nt, Streptococcus pneumoniae R6
gucaacgucaagaa

SEQ ID NO: 2190639 - RNA, 19 nt, Streptococcus pneumoniae R6
gucaauaauauaggucaga

SEQ ID NO: 2190640 - RNA, 11 nt, Streptococcus pneumoniae R6
gucacacaaaa

SEQ ID NO: 2190641 - RNA, 14 nt, Streptococcus pneumoniae R6
gucacauauauaau

SEQ ID NO: 2190642 - RNA, 17 nt, Streptococcus pneumoniae R6
gucacauauauaaucca

SEQ ID NO: 2190643 - RNA, 22 nt, Streptococcus pneumoniae R6
gucaccuuaucacgaauuucuu

SEQ ID NO: 2190644 - RNA, 20 nt, Streptococcus pneumoniae R6
gucacgaggaggagaaaaag

SEQ ID NO: 2190645 - RNA, 21 nt, Streptococcus pneumoniae R6
gucacuugaccuguuuucaca

SEQ ID NO: 2190646 - RNA, 22 nt, Streptococcus pneumoniae R6
gucacuguauuggucguauuuu

SEQ ID NO: 2190647 - RNA, 17 nt, Streptococcus pneumoniae R6
gucacauucgaaugaua

SEQ ID NO: 2190648 - RNA, 18 nt, Streptococcus pneumoniae R6
gucaccaaauuucauauu

SEQ ID NO: 2190649 - RNA, 21 nt, Streptococcus pneumoniae R6
gucaccaaauuucauauuuuc

SEQ ID NO: 2190650 - RNA, 22 nt, Streptococcus pneumoniae R6
gucaccaaauuucauauuuuca

SEQ ID NO: 2190651 - RNA, 22 nt, Streptococcus pneumoniae R6
gucaccaucuaagguauauuca

SEQ ID NO: 2190652 - RNA, 17 nt, Streptococcus pneumoniae R6
gucagaggggugcugag

SEQ ID NO: 2190653 - RNA, 14 nt, Streptococcus pneumoniae R6
gucagauaggauug

SEQ ID NO: 2190654 - RNA, 21 nt, Streptococcus pneumoniae R6
gucagaaagaaguuuaagagc

SEQ ID NO: 2190655 - RNA, 22 nt, Streptococcus pneumoniae R6
gucagaaugaugauagucaugu

SEQ ID NO: 2190656 - RNA, 16 nt, Streptococcus pneumoniae R6
gucagcucaaaacacu

SEQ ID NO: 2190657 - RNA, 24 nt, Streptococcus pneumoniae R6
gucaguaaaaaaaacauauauuca

SEQ ID NO: 2190658 - RNA, 18 nt, Streptococcus pneumoniae R6
gucagcuuccaucugcag

SEQ ID NO: 2190659 - RNA, 17 nt, Streptococcus pneumoniae R6
gucagcugucuuuucaa

SEQ ID NO: 2190660 - RNA, 22 nt, Streptococcus pneumoniae R6
gucagcuuuaucugcaaccuca

SEQ ID NO: 2190661 - RNA, 17 nt, Streptococcus pneumoniae R6
gucagucuuaucuaaaa

SEQ ID NO: 2190662 - RNA, 21 nt, Streptococcus pneumoniae R6
gucagucuuaucuaaaaccuc

SEQ ID NO: 2190663 - RNA, 22 nt, Streptococcus pneumoniae R6
gucagucuuaucuaaaaccuca

SEQ ID NO: 2190664 - RNA, 22 nt, Streptococcus pneumoniae R6
gucaguuccaucuacaaccuua

SEQ ID NO: 2190665 - RNA, 13 nt, Streptococcus pneumoniae R6
gucaguucuaucc

SEQ ID NO: 2190666 - RNA, 13 nt, Streptococcus pneumoniae R6
gucaguucuaucu

SEQ ID NO: 2190667 - RNA, 22 nt, Streptococcus pneumoniae R6
gucaguucuaucuacaaccuca

SEQ ID NO: 2190668 - RNA, 15 nt, Streptococcus pneumoniae R6
gucaguucuaucugc

SEQ ID NO: 2190669 - RNA, 21 nt, Streptococcus pneumoniae R6
gucaguucuaucugcaaccuc

SEQ ID NO: 2190670 - RNA, 22 nt, Streptococcus pneumoniae R6
gucaguucuaucugcaaccuca

SEQ ID NO: 2190671 - RNA, 22 nt, Streptococcus pneumoniae R6
gucaguucuaucugcaaccuua

SEQ ID NO: 2190672 - RNA, 19 nt, Streptococcus pneumoniae R6
gucaguugaaaaggcaucu

SEQ ID NO: 2190673 - RNA, 18 nt, Streptococcus pneumoniae R6
gucagugguucacuggca

SEQ ID NO: 2190674 - RNA, 14 nt, Streptococcus pneumoniae R6
guccauaacugcug

SEQ ID NO: 2190675 - RNA, 15 nt, Streptococcus pneumoniae R6
guccagcagcuaaga

SEQ ID NO: 2190676 - RNA, 20 nt, Streptococcus pneumoniae R6
guccagcacuaaaacguugu

SEQ ID NO: 2190677 - RNA, 15 nt, Streptococcus pneumoniae R6
gucaugccuuuuuca

SEQ ID NO: 2190678 - RNA, 15 nt, Streptococcus pneumoniae R6
gucaugacuagugaa

SEQ ID NO: 2190679 - RNA, 16 nt, Streptococcus pneumoniae R6
gucaugacuagugaag

SEQ ID NO: 2190680 - RNA, 22 nt, Streptococcus pneumoniae R6
gucaugcaaaaaaaaugaaaaa

SEQ ID NO: 2190681 - RNA, 22 nt, Streptococcus pneumoniae R6
gucaguuucauccacaaccuca

SEQ ID NO: 2190682 - RNA, 18 nt, Streptococcus pneumoniae R6
gucauacaaggacuggag

SEQ ID NO: 2190683 - RNA, 13 nt, Streptococcus pneumoniae R6
gucauaccaguuu

SEQ ID NO: 2190684 - RNA, 12 nt, Streptococcus pneumoniae R6
gucauucccugu

SEQ ID NO: 2190685 - RNA, 19 nt, Streptococcus pneumoniae R6
guccacugcaauuucuaaa

SEQ ID NO: 2190686 - RNA, 13 nt, Streptococcus pneumoniae R6
gugccacaauacc

SEQ ID NO: 2190687 - RNA, 16 nt, Streptococcus pneumoniae R6
gugccccaguucuuca

SEQ ID NO: 2190688 - RNA, 19 nt, Streptococcus pneumoniae R6
gugcccuggggucggcaga

SEQ ID NO: 2190689 - RNA, 22 nt, Streptococcus pneumoniae R6
gugcacacgaaucugauggguu

SEQ ID NO: 2190690 - RNA, 17 nt, Streptococcus pneumoniae R6
aaauaguuuuugcaaua

SEQ ID NO: 2190691 - RNA, 19 nt, Streptococcus pneumoniae R6
gugcaguuuucauucuacu

SEQ ID NO: 2190692 - RNA, 13 nt, Streptococcus pneumoniae R6
gugcagucuuuuu

SEQ ID NO: 2190693 - RNA, 17 nt, Streptococcus pneumoniae R6
gugcauuucauccccau

SEQ ID NO: 2190694 - RNA, 18 nt, Streptococcus pneumoniae R6
aaauauaguagauugaaa

SEQ ID NO: 2190695 - RNA, 15 nt, Streptococcus pneumoniae R6
gugauuuuaaauuua

SEQ ID NO: 2190696 - RNA, 15 nt, Streptococcus pneumoniae R6
gugauguaauuucug

SEQ ID NO: 2190697 - RNA, 16 nt, Streptococcus pneumoniae R6
gucuauucuuuccuuu

SEQ ID NO: 2190698 - RNA, 20 nt, Streptococcus pneumoniae R6
gucuauucuuuccuuuuaca

SEQ ID NO: 2190699 - RNA, 15 nt, Streptococcus pneumoniae R6
gucuaucaaacagga

SEQ ID NO: 2190700 - RNA, 16 nt, Streptococcus pneumoniae R6
gucuaucaaacaggau

SEQ ID NO: 2190701 - RNA, 19 nt, Streptococcus pneumoniae R6
gucuauagaacuaguaaau

SEQ ID NO: 2190702 - RNA, 23 nt, Streptococcus pneumoniae R6
gucuauagaacuaguaaauuguc

SEQ ID NO: 2190703 - RNA, 17 nt, Streptococcus pneumoniae R6
gucuagccaguauuuuu

SEQ ID NO: 2190704 - RNA, 17 nt, Streptococcus pneumoniae R6
gucuagacuauaacaga

SEQ ID NO: 2190705 - RNA, 20 nt, Streptococcus pneumoniae R6
gucucaaaaucaaagacuua

SEQ ID NO: 2190706 - RNA, 16 nt, Streptococcus pneumoniae R6
gugauauaauaaaaag

SEQ ID NO: 2190707 - RNA, 15 nt, Streptococcus pneumoniae R6
gugcgagacaaaaaa

SEQ ID NO: 2190708 - RNA, 15 nt, Streptococcus pneumoniae R6
gugcugcgucugcuc

SEQ ID NO: 2190709 - RNA, 14 nt, Streptococcus pneumoniae R6
gugcucuuaaacaa

SEQ ID NO: 2190710 - RNA, 12 nt, Streptococcus pneumoniae R6
gugcuagcuugc

SEQ ID NO: 2190711 - RNA, 14 nt, Streptococcus pneumoniae R6
gugcuagggcaagg

SEQ ID NO: 2190712 - RNA, 19 nt, Streptococcus pneumoniae R6
guguaggggauaaugagga

SEQ ID NO: 2190713 - RNA, 19 nt, Streptococcus pneumoniae R6
guguaauaaacuggguuga

SEQ ID NO: 2190714 - RNA, 18 nt, Streptococcus pneumoniae R6
guggacaugaguccugcg

SEQ ID NO: 2190715 - RNA, 17 nt, Streptococcus pneumoniae R6
gugggcuauuccauauu

SEQ ID NO: 2190716 - RNA, 21 nt, Streptococcus pneumoniae R6
gugguaaugcuuuccauuaau

SEQ ID NO: 2190717 - RNA, 16 nt, Streptococcus pneumoniae R6
guuauaccaaaaaaac

SEQ ID NO: 2190718 - RNA, 18 nt, Streptococcus pneumoniae R6
guuauacauagcuaaaau

SEQ ID NO: 2190719 - RNA, 16 nt, Streptococcus pneumoniae R6
guucaaagauaucauc

SEQ ID NO: 2190720 - RNA, 18 nt, Streptococcus pneumoniae R6
guuauuaacaaaagagcu

SEQ ID NO: 2190721 - RNA, 14 nt, Streptococcus pneumoniae R6
guuauucaaaaaca

SEQ ID NO: 2190722 - RNA, 15 nt, Streptococcus pneumoniae R6
guuagccucucuaaa

SEQ ID NO: 2190723 - RNA, 18 nt, Streptococcus pneumoniae R6
guuagauuuauaauuuca

SEQ ID NO: 2190724 - RNA, 15 nt, Streptococcus pneumoniae R6
guuagacagaaaaaa

SEQ ID NO: 2190725 - RNA, 18 nt, Streptococcus pneumoniae R6
guuagauaguucaaucau

SEQ ID NO: 2190726 - RNA, 16 nt, Streptococcus pneumoniae R6
guuacggguuuuaaac

SEQ ID NO: 2190727 - RNA, 21 nt, Streptococcus pneumoniae R6
guuaccaauacaggaaaacca

SEQ ID NO: 2190728 - RNA, 15 nt, Streptococcus pneumoniae R6
guuaccacaggagcu

SEQ ID NO: 2190729 - RNA, 17 nt, Streptococcus pneumoniae R6
guuaccacaggagcugg

SEQ ID NO: 2190730 - RNA, 21 nt, Streptococcus pneumoniae R6
guuacauaucuagguaaaaau

SEQ ID NO: 2190731 - RNA, 22 nt, Streptococcus pneumoniae R6
guuacaauucauaaagugcugu

SEQ ID NO: 2190732 - RNA, 20 nt, Streptococcus pneumoniae R6
guuacacguacuuuaaaauc

SEQ ID NO: 2190733 - RNA, 15 nt, Streptococcus pneumoniae R6
guguuuugagcugac

SEQ ID NO: 2190734 - RNA, 14 nt, Streptococcus pneumoniae R6
guuaaauuauuaaa

SEQ ID NO: 2190735 - RNA, 14 nt, Streptococcus pneumoniae R6
guuccuaauuguua

SEQ ID NO: 2190736 - RNA, 18 nt, Streptococcus pneumoniae R6
guuccucuuuuuccccag

SEQ ID NO: 2190737 - RNA, 12 nt, Streptococcus pneumoniae R6
guuccuccauug

SEQ ID NO: 2190738 - RNA, 16 nt, Streptococcus pneumoniae R6
guuccccaaaaaguag

SEQ ID NO: 2190739 - RNA, 18 nt, Streptococcus pneumoniae R6
guucauucuugguaaaga

SEQ ID NO: 2190740 - RNA, 13 nt, Streptococcus pneumoniae R6
guucauuacucaa

SEQ ID NO: 2190741 - RNA, 22 nt, Streptococcus pneumoniae R6
guucauuuucuuuacuucugag

SEQ ID NO: 2190742 - RNA, 15 nt, Streptococcus pneumoniae R6
guucauuuuuccuuc

SEQ ID NO: 2190743 - RNA, 21 nt, Streptococcus pneumoniae R6
guuccaaacuuaguauccuug

SEQ ID NO: 2190744 - RNA, 16 nt, Streptococcus pneumoniae R6
guucaguagauuaaag

SEQ ID NO: 2190745 - RNA, 23 nt, Streptococcus pneumoniae R6
guucaguagauuaaaggcauaau

SEQ ID NO: 2190746 - RNA, 16 nt, Streptococcus pneumoniae R6
guucauaguucuaucu

SEQ ID NO: 2190747 - RNA, 15 nt, Streptococcus pneumoniae R6
guucauaacuucacu

SEQ ID NO: 2190748 - RNA, 19 nt, Streptococcus pneumoniae R6
guucauaucuuauuucaau

SEQ ID NO: 2190749 - RNA, 20 nt, Streptococcus pneumoniae R6
guucaagccuuauugcucuu

SEQ ID NO: 2190750 - RNA, 21 nt, Streptococcus pneumoniae R6
guucaacaugaccaccaggaa

SEQ ID NO: 2190751 - RNA, 20 nt, Streptococcus pneumoniae R6
guucaacaaaucagaaaagu

SEQ ID NO: 2190752 - RNA, 14 nt, Streptococcus pneumoniae R6
guucaagguaugaa

SEQ ID NO: 2190753 - RNA, 15 nt, Streptococcus pneumoniae R6
guucacucaaaccug

SEQ ID NO: 2190754 - RNA, 18 nt, Streptococcus pneumoniae R6
guucaaugggguucaucu

SEQ ID NO: 2190755 - RNA, 21 nt, Streptococcus pneumoniae R6
guucaaugggguucaucucug

SEQ ID NO: 2190756 - RNA, 18 nt, Streptococcus pneumoniae R6
guucagaauuuucuuacu

SEQ ID NO: 2190757 - RNA, 14 nt, Streptococcus pneumoniae R6
guucuggagaagca

SEQ ID NO: 2190758 - RNA, 17 nt, Streptococcus pneumoniae R6
guucugggcuuucaucc

SEQ ID NO: 2190759 - RNA, 23 nt, Streptococcus pneumoniae R6
guucuguaaugaaauacugaugu

SEQ ID NO: 2190760 - RNA, 19 nt, Streptococcus pneumoniae R6
guucuguucuuauuucauu

SEQ ID NO: 2190761 - RNA, 16 nt, Streptococcus pneumoniae R6
guucugguaggaguuu

SEQ ID NO: 2190762 - RNA, 18 nt, Streptococcus pneumoniae R6
guucuguuuagccuccau

SEQ ID NO: 2190763 - RNA, 16 nt, Streptococcus pneumoniae R6
guucgugccaaucuca

SEQ ID NO: 2190764 - RNA, 20 nt, Streptococcus pneumoniae R6
guucucugagauacuccaaa

SEQ ID NO: 2190765 - RNA, 21 nt, Streptococcus pneumoniae R6
guucucuuugcauuucaucuu

SEQ ID NO: 2190766 - RNA, 21 nt, Streptococcus pneumoniae R6
guugaaaaccuuguuuuaaaa

SEQ ID NO: 2190767 - RNA, 17 nt, Streptococcus pneumoniae R6
guucuuuuuuguuucuu

SEQ ID NO: 2190768 - RNA, 20 nt, Streptococcus pneumoniae R6
guucuuuagaaagguuuuaa

SEQ ID NO: 2190769 - RNA, 19 nt, Streptococcus pneumoniae R6
guugaaaaaaagcuaagcu

SEQ ID NO: 2190770 - RNA, 12 nt, Streptococcus pneumoniae R6
guucuuuuugcu

SEQ ID NO: 2190771 - RNA, 12 nt, Streptococcus pneumoniae R6
guucuuuuucaa

SEQ ID NO: 2190772 - RNA, 18 nt, Streptococcus pneumoniae R6
guucuuuucauaaagaga

SEQ ID NO: 2190773 - RNA, 17 nt, Streptococcus pneumoniae R6
guucuuguuuugacauu

SEQ ID NO: 2190774 - RNA, 23 nt, Streptococcus pneumoniae R6
guucuugaaaccaguuccuuugu

SEQ ID NO: 2190775 - RNA, 16 nt, Streptococcus pneumoniae R6
guucuuauuucauuuu

SEQ ID NO: 2190776 - RNA, 12 nt, Streptococcus pneumoniae R6
guucuuccacuc

SEQ ID NO: 2190777 - RNA, 24 nt, Streptococcus pneumoniae R6
guucuuccacucaaaucauuucuu

SEQ ID NO: 2190778 - RNA, 16 nt, Streptococcus pneumoniae R6
guugcaaauuuauaaa

SEQ ID NO: 2190779 - RNA, 20 nt, Streptococcus pneumoniae R6
guugcauagcgaagaacaau

SEQ ID NO: 2190780 - RNA, 23 nt, Streptococcus pneumoniae R6
guugauuuaacaacguuucuagc

SEQ ID NO: 2190781 - RNA, 15 nt, Streptococcus pneumoniae R6
guugaagauuucauc

SEQ ID NO: 2190782 - RNA, 18 nt, Streptococcus pneumoniae R6
guugaagucagcuaagcu

SEQ ID NO: 2190783 - RNA, 21 nt, Streptococcus pneumoniae R6
guugaagucagcuaagcucga

SEQ ID NO: 2190784 - RNA, 16 nt, Streptococcus pneumoniae R6
guugaacuuuagaaac

SEQ ID NO: 2190785 - RNA, 15 nt, Streptococcus pneumoniae R6
guugaagaaaagcua

SEQ ID NO: 2190786 - RNA, 16 nt, Streptococcus pneumoniae R6
guugaagaaaagcuaa

SEQ ID NO: 2190787 - RNA, 19 nt, Streptococcus pneumoniae R6
guugacaaagagccaaaaa

SEQ ID NO: 2190788 - RNA, 22 nt, Streptococcus pneumoniae R6
guugacaaagagccagaaaaau

SEQ ID NO: 2190789 - RNA, 16 nt, Streptococcus pneumoniae R6
guugacaaagagccau

SEQ ID NO: 2190790 - RNA, 21 nt, Streptococcus pneumoniae R6
guugacaaagagccauaaaaa

SEQ ID NO: 2190791 - RNA, 23 nt, Streptococcus pneumoniae R6
guugacaaagagccgaaaaaaua

SEQ ID NO: 2190792 - RNA, 17 nt, Streptococcus pneumoniae R6
guugacuuguacucaau

SEQ ID NO: 2190793 - RNA, 14 nt, Streptococcus pneumoniae R6
guugaccauuucaa

SEQ ID NO: 2190794 - RNA, 16 nt, Streptococcus pneumoniae R6
guuuaaacucagguuu

SEQ ID NO: 2190795 - RNA, 18 nt, Streptococcus pneumoniae R6
guuguuaguucuugaaau

SEQ ID NO: 2190796 - RNA, 17 nt, Streptococcus pneumoniae R6
guuguguuugaccacuc

SEQ ID NO: 2190797 - RNA, 14 nt, Streptococcus pneumoniae R6
guuguggaugaaac

SEQ ID NO: 2190798 - RNA, 15 nt, Streptococcus pneumoniae R6
guuuagacauuauag

SEQ ID NO: 2190799 - RNA, 23 nt, Streptococcus pneumoniae R6
guuuacgaaucucuuuccacacu

SEQ ID NO: 2190800 - RNA, 19 nt, Streptococcus pneumoniae R6
guuuaccaauuuuuccuuu

SEQ ID NO: 2190801 - RNA, 19 nt, Streptococcus pneumoniae R6
guuuauuaccuuucuugua

SEQ ID NO: 2190802 - RNA, 17 nt, Streptococcus pneumoniae R6
guuuauacccaaacucu

SEQ ID NO: 2190803 - RNA, 18 nt, Streptococcus pneumoniae R6
guuuaugguauuuguaaa

SEQ ID NO: 2190804 - RNA, 20 nt, Streptococcus pneumoniae R6
guuuauugaguuuuuugacu

SEQ ID NO: 2190805 - RNA, 24 nt, Streptococcus pneumoniae R6
guuuauugaguuuuuugacuucaa

SEQ ID NO: 2190806 - RNA, 21 nt, Streptococcus pneumoniae R6
guugcauuuuuuauugcaauu

SEQ ID NO: 2190807 - RNA, 17 nt, Streptococcus pneumoniae R6
guuguaagcuagcaaca

SEQ ID NO: 2190808 - RNA, 19 nt, Streptococcus pneumoniae R6
guuguaaucuuagcaaaga

SEQ ID NO: 2190809 - RNA, 23 nt, Streptococcus pneumoniae R6
guuguaaucuuagcaaagauauu

SEQ ID NO: 2190810 - RNA, 17 nt, Streptococcus pneumoniae R6
guugguaagagaaauuu

SEQ ID NO: 2190811 - RNA, 20 nt, Streptococcus pneumoniae R6
guugguaagagaaauuucug

SEQ ID NO: 2190812 - RNA, 13 nt, Streptococcus pneumoniae R6
guuggcugucauu

SEQ ID NO: 2190813 - RNA, 20 nt, Streptococcus pneumoniae R6
uaaaaagaccggauugcucc

SEQ ID NO: 2190814 - RNA, 12 nt, Streptococcus pneumoniae R6
uaaaaagaaaua

SEQ ID NO: 2190815 - RNA, 14 nt, Streptococcus pneumoniae R6
uaaaaagaaagucc

SEQ ID NO: 2190816 - RNA, 22 nt, Streptococcus pneumoniae R6
uaaaaagaaaguccucauuuca

SEQ ID NO: 2190817 - RNA, 19 nt, Streptococcus pneumoniae R6
uaaaaauaacuucagauua

SEQ ID NO: 2190818 - RNA, 14 nt, Streptococcus pneumoniae R6
uaaaaauaaaaaag

SEQ ID NO: 2190819 - RNA, 15 nt, Streptococcus pneumoniae R6
uaaaaauaaaaaaga

SEQ ID NO: 2190820 - RNA, 16 nt, Streptococcus pneumoniae R6
uaaaaauaaaaaagag

SEQ ID NO: 2190821 - RNA, 18 nt, Streptococcus pneumoniae R6
uaaaaaguuuugucccuu

SEQ ID NO: 2190822 - RNA, 21 nt, Streptococcus pneumoniae R6
uaaaaaggguagccaauuccu

SEQ ID NO: 2190823 - RNA, 20 nt, Streptococcus pneumoniae R6
uaaaaaaguuuccaaucaga

SEQ ID NO: 2190824 - RNA, 19 nt, Streptococcus pneumoniae R6
uaaaaaaucauuuuccuuu

SEQ ID NO: 2190825 - RNA, 16 nt, Streptococcus pneumoniae R6
uaaaaaauaacucugu

SEQ ID NO: 2190826 - RNA, 16 nt, Streptococcus pneumoniae R6
uaaaaacaaucacgga

SEQ ID NO: 2190827 - RNA, 21 nt, Streptococcus pneumoniae R6
uaaaaacucucuaauucccuu

SEQ ID NO: 2190828 - RNA, 17 nt, Streptococcus pneumoniae R6
uaaaaacugaacaaauu

SEQ ID NO: 2190829 - RNA, 20 nt, Streptococcus pneumoniae R6
uaaaaacugaacaaauuaau

SEQ ID NO: 2190830 - RNA, 17 nt, Streptococcus pneumoniae R6
uaaaaaccuaucauauc

SEQ ID NO: 2190831 - RNA, 23 nt, Streptococcus pneumoniae R6
uaaaaacagaggcuggacaaaaa

SEQ ID NO: 2190832 - RNA, 10 nt, Streptococcus pneumoniae R6
uaaaaaaagg

SEQ ID NO: 2190833 - RNA, 16 nt, Streptococcus pneumoniae R6
uaaaaaaauuuggaaa

SEQ ID NO: 2190834 - RNA, 20 nt, Streptococcus pneumoniae R6
uaaaaaaauuuggaaaauag

SEQ ID NO: 2190835 - RNA, 21 nt, Streptococcus pneumoniae R6
uaaaaaaauuuggaaaauagu

SEQ ID NO: 2190836 - RNA, 19 nt, Streptococcus pneumoniae R6
uaaaaaaacugguagaaag

SEQ ID NO: 2190837 - RNA, 20 nt, Streptococcus pneumoniae R6
uaaaaaaacuuaaaaaucuu

SEQ ID NO: 2190838 - RNA, 14 nt, Streptococcus pneumoniae R6
uaaaaaaaacauau

SEQ ID NO: 2190839 - RNA, 18 nt, Streptococcus pneumoniae R6
uaaaaaaaacauauauuc

SEQ ID NO: 2190840 - RNA, 13 nt, Streptococcus pneumoniae R6
uaaaaaaaaaaag

SEQ ID NO: 2190841 - RNA, 19 nt, Streptococcus pneumoniae R6
uaaaaaagucugggaaaaa

SEQ ID NO: 2190842 - RNA, 14 nt, Streptococcus pneumoniae R6
uaaaaaagugaaca

SEQ ID NO: 2190843 - RNA, 18 nt, Streptococcus pneumoniae R6
guuuuuguaguaaaagaa

SEQ ID NO: 2190844 - RNA, 19 nt, Streptococcus pneumoniae R6
guuuuuuaacaaaaauuug

SEQ ID NO: 2190845 - RNA, 14 nt, Streptococcus pneumoniae R6
guuuuuugauuuua

SEQ ID NO: 2190846 - RNA, 13 nt, Streptococcus pneumoniae R6
guuuuuucuuucu

SEQ ID NO: 2190847 - RNA, 12 nt, Streptococcus pneumoniae R6
guuuuuuccuau

SEQ ID NO: 2190848 - RNA, 18 nt, Streptococcus pneumoniae R6
guuuuugccucaauaucu

SEQ ID NO: 2190849 - RNA, 20 nt, Streptococcus pneumoniae R6
guuuuuggauuuuguuucuu

SEQ ID NO: 2190850 - RNA, 15 nt, Streptococcus pneumoniae R6
guuuuugugauuuua

SEQ ID NO: 2190851 - RNA, 15 nt, Streptococcus pneumoniae R6
guuuuugaaaaaccu

SEQ ID NO: 2190852 - RNA, 14 nt, Streptococcus pneumoniae R6
guuuuugagguugu

SEQ ID NO: 2190853 - RNA, 16 nt, Streptococcus pneumoniae R6
guuuuugauauggugc

SEQ ID NO: 2190854 - RNA, 11 nt, Streptococcus pneumoniae R6
guuuuucuucu

SEQ ID NO: 2190855 - RNA, 16 nt, Streptococcus pneumoniae R6
guuuuuaauuuuucuu

SEQ ID NO: 2190856 - RNA, 21 nt, Streptococcus pneumoniae R6
guuuuuccuuugaguaagagu

SEQ ID NO: 2190857 - RNA, 19 nt, Streptococcus pneumoniae R6
guuuuucgucaccaaauuu

SEQ ID NO: 2190858 - RNA, 19 nt, Streptococcus pneumoniae R6
guuuggccaagguucauuu

SEQ ID NO: 2190859 - RNA, 20 nt, Streptococcus pneumoniae R6
guuuggcuucaguaauaucu

SEQ ID NO: 2190860 - RNA, 22 nt, Streptococcus pneumoniae R6
guuugguaagaguugaaaaguc

SEQ ID NO: 2190861 - RNA, 12 nt, Streptococcus pneumoniae R6
guuuuaaaaugu

SEQ ID NO: 2190862 - RNA, 14 nt, Streptococcus pneumoniae R6
guuuuaagcugacu

SEQ ID NO: 2190863 - RNA, 14 nt, Streptococcus pneumoniae R6
guuuuaaucucaaa

SEQ ID NO: 2190864 - RNA, 21 nt, Streptococcus pneumoniae R6
aaaucagcuaagccuuuuucu

SEQ ID NO: 2190865 - RNA, 22 nt, Streptococcus pneumoniae R6
aaaucagcuaagccuuuuucuu

SEQ ID NO: 2190866 - RNA, 16 nt, Streptococcus pneumoniae R6
aaaucaggaaaucuuc

SEQ ID NO: 2190867 - RNA, 21 nt, Streptococcus pneumoniae R6
aaaucagccauugaaaauccu

SEQ ID NO: 2190868 - RNA, 19 nt, Streptococcus pneumoniae R6
guuucuuggccacuuccca

SEQ ID NO: 2190869 - RNA, 24 nt, Streptococcus pneumoniae R6
guuucuuuaaaucgcuauaaauaa

SEQ ID NO: 2190870 - RNA, 19 nt, Streptococcus pneumoniae R6
guuucuugaugaaagauau

SEQ ID NO: 2190871 - RNA, 14 nt, Streptococcus pneumoniae R6
guuucaaaguaaug

SEQ ID NO: 2190872 - RNA, 12 nt, Streptococcus pneumoniae R6
guuugaugagau

SEQ ID NO: 2190873 - RNA, 13 nt, Streptococcus pneumoniae R6
guuuggcaaauag

SEQ ID NO: 2190874 - RNA, 13 nt, Streptococcus pneumoniae R6
guuuuccguucuc

SEQ ID NO: 2190875 - RNA, 14 nt, Streptococcus pneumoniae R6
guuuuguuggaaag

SEQ ID NO: 2190876 - RNA, 17 nt, Streptococcus pneumoniae R6
guuuuguuucuuaucca

SEQ ID NO: 2190877 - RNA, 17 nt, Streptococcus pneumoniae R6
guuuuuaaaggaauuuu

SEQ ID NO: 2190878 - RNA, 16 nt, Streptococcus pneumoniae R6
guuuugguuuuucuuc

SEQ ID NO: 2190879 - RNA, 16 nt, Streptococcus pneumoniae R6
guuuucugaugcacua

SEQ ID NO: 2190880 - RNA, 14 nt, Streptococcus pneumoniae R6
guuuuauuacauaa

SEQ ID NO: 2190881 - RNA, 21 nt, Streptococcus pneumoniae R6
guuuuaucauagaaauauuua

SEQ ID NO: 2190882 - RNA, 17 nt, Streptococcus pneumoniae R6
aaauccauaauuaccac

SEQ ID NO: 2190883 - RNA, 18 nt, Streptococcus pneumoniae R6
guuuuauauccuaaaaaa

SEQ ID NO: 2190884 - RNA, 12 nt, Streptococcus pneumoniae R6
aaauccagcuga

SEQ ID NO: 2190885 - RNA, 17 nt, Streptococcus pneumoniae R6
aaaucaucgccaaauca

SEQ ID NO: 2190886 - RNA, 13 nt, Streptococcus pneumoniae R6
aaaucauccauau

SEQ ID NO: 2190887 - RNA, 22 nt, Streptococcus pneumoniae R6
aaaucagugugacccaagauag

SEQ ID NO: 2190888 - RNA, 22 nt, Streptococcus pneumoniae R6
uaaaaauagauuuuuaaauucu

SEQ ID NO: 2190889 - RNA, 23 nt, Streptococcus pneumoniae R6
uaaaaauagauuuuuaaauucuu

SEQ ID NO: 2190890 - RNA, 20 nt, Streptococcus pneumoniae R6
uaaaaauccuuuuuuugaag

SEQ ID NO: 2190891 - RNA, 22 nt, Streptococcus pneumoniae R6
uaaaaauccacuugggaaacca

SEQ ID NO: 2190892 - RNA, 20 nt, Streptococcus pneumoniae R6
uaaaaauccguuuuuugaag

SEQ ID NO: 2190893 - RNA, 22 nt, Streptococcus pneumoniae R6
uaaaaauccuaagauuacuguc

SEQ ID NO: 2190894 - RNA, 13 nt, Streptococcus pneumoniae R6
uaaaaauguuuua

SEQ ID NO: 2190895 - RNA, 20 nt, Streptococcus pneumoniae R6
uaaaaauuuuuuucuaauua

SEQ ID NO: 2190896 - RNA, 22 nt, Streptococcus pneumoniae R6
uaaaaauuuuuuucuaauuaaa

SEQ ID NO: 2190897 - RNA, 11 nt, Streptococcus pneumoniae R6
uaaaacaaaaa

SEQ ID NO: 2190898 - RNA, 12 nt, Streptococcus pneumoniae R6
uaaaacaaagaa

SEQ ID NO: 2190899 - RNA, 14 nt, Streptococcus pneumoniae R6
uaaaacaaagaaaa

SEQ ID NO: 2190900 - RNA, 15 nt, Streptococcus pneumoniae R6
uaaaacaaagaaaaa

SEQ ID NO: 2190901 - RNA, 21 nt, Streptococcus pneumoniae R6
uaaaaccagguucuucaauca

SEQ ID NO: 2190902 - RNA, 20 nt, Streptococcus pneumoniae R6
uaaaaccauguuuuucaaua

SEQ ID NO: 2190903 - RNA, 23 nt, Streptococcus pneumoniae R6
uaaaacauucuuagaaaucgauu

SEQ ID NO: 2190904 - RNA, 14 nt, Streptococcus pneumoniae R6
uaaaacauugugag

SEQ ID NO: 2190905 - RNA, 17 nt, Streptococcus pneumoniae R6
uaaaacauuguuagaaa

SEQ ID NO: 2190906 - RNA, 23 nt, Streptococcus pneumoniae R6
uaaaacauuguuagaauucgauu

SEQ ID NO: 2190907 - RNA, 23 nt, Streptococcus pneumoniae R6
uaaaacauacugugccagccaua

SEQ ID NO: 2190908 - RNA, 22 nt, Streptococcus pneumoniae R6
uaaaagcgauuggaccagccaa

SEQ ID NO: 2190909 - RNA, 21 nt, Streptococcus pneumoniae R6
uaaaagauuucuauaaauuca

SEQ ID NO: 2190910 - RNA, 22 nt, Streptococcus pneumoniae R6
uaaaagauuucuauaaauucau

SEQ ID NO: 2190911 - RNA, 23 nt, Streptococcus pneumoniae R6
uaaaagauuucuauaaauucauu

SEQ ID NO: 2190912 - RNA, 17 nt, Streptococcus pneumoniae R6
uaaaagauaaucaucug

SEQ ID NO: 2190913 - RNA, 19 nt, Streptococcus pneumoniae R6
uaaaagauaaucaucugga

SEQ ID NO: 2190914 - RNA, 11 nt, Streptococcus pneumoniae R6
uaaaagagcaa

SEQ ID NO: 2190915 - RNA, 17 nt, Streptococcus pneumoniae R6
uaaaagaggagguaaau

SEQ ID NO: 2190916 - RNA, 21 nt, Streptococcus pneumoniae R6
uaaaagaggagguaaauccca

SEQ ID NO: 2190917 - RNA, 19 nt, Streptococcus pneumoniae R6
uaaaacuuuuaaaauccau

SEQ ID NO: 2190918 - RNA, 14 nt, Streptococcus pneumoniae R6
uaaaagagaauagu

SEQ ID NO: 2190919 - RNA, 15 nt, Streptococcus pneumoniae R6
uaaaacucauuaaua

SEQ ID NO: 2190920 - RNA, 16 nt, Streptococcus pneumoniae R6
uaaaacuguaugagaa

SEQ ID NO: 2190921 - RNA, 17 nt, Streptococcus pneumoniae R6
uaaaacuguaugagaaa

SEQ ID NO: 2190922 - RNA, 19 nt, Streptococcus pneumoniae R6
uaaaacuguaugagaaaca

SEQ ID NO: 2190923 - RNA, 14 nt, Streptococcus pneumoniae R6
uaaaacuagugaag

SEQ ID NO: 2190924 - RNA, 17 nt, Streptococcus pneumoniae R6
uaaaaccuugauacugu

SEQ ID NO: 2190925 - RNA, 14 nt, Streptococcus pneumoniae R6
uaaaacuaaagcuu

SEQ ID NO: 2190926 - RNA, 14 nt, Streptococcus pneumoniae R6
uaaaaccuuuauac

SEQ ID NO: 2190927 - RNA, 15 nt, Streptococcus pneumoniae R6
uaaaaccuguuugaa

SEQ ID NO: 2190928 - RNA, 13 nt, Streptococcus pneumoniae R6
uaaaauaaguuca

SEQ ID NO: 2190929 - RNA, 23 nt, Streptococcus pneumoniae R6
uaaaauaaguucaacaaaucaga

SEQ ID NO: 2190930 - RNA, 14 nt, Streptococcus pneumoniae R6
uaaaauaacucaau

SEQ ID NO: 2190931 - RNA, 21 nt, Streptococcus pneumoniae R6
uaaaauaacucaauuaagaaa

SEQ ID NO: 2190932 - RNA, 17 nt, Streptococcus pneumoniae R6
uaaaauaacuguaauuu

SEQ ID NO: 2190933 - RNA, 16 nt, Streptococcus pneumoniae R6
uaaaauauaguagauu

SEQ ID NO: 2190934 - RNA, 23 nt, Streptococcus pneumoniae R6
uaaaauaguacgaaacaauugcu

SEQ ID NO: 2190935 - RNA, 14 nt, Streptococcus pneumoniae R6
uaaaauaguucacu

SEQ ID NO: 2190936 - RNA, 16 nt, Streptococcus pneumoniae R6
uaaaauaguucacuga

SEQ ID NO: 2190937 - RNA, 19 nt, Streptococcus pneumoniae R6
uaaaauaguggcugaaacu

SEQ ID NO: 2190938 - RNA, 17 nt, Streptococcus pneumoniae R6
uaaaauagauaaauacu

SEQ ID NO: 2190939 - RNA, 17 nt, Streptococcus pneumoniae R6
uaaaagucuccugugcu

SEQ ID NO: 2190940 - RNA, 19 nt, Streptococcus pneumoniae R6
uaaaagucuccugugcucc

SEQ ID NO: 2190941 - RNA, 15 nt, Streptococcus pneumoniae R6
uaaaagucuucacaa

SEQ ID NO: 2190942 - RNA, 20 nt, Streptococcus pneumoniae R6
uaaaaguacuuucagaacau

SEQ ID NO: 2190943 - RNA, 14 nt, Streptococcus pneumoniae R6
uaaaagguauugca

SEQ ID NO: 2190944 - RNA, 13 nt, Streptococcus pneumoniae R6
uaaaagucauacu

SEQ ID NO: 2190945 - RNA, 14 nt, Streptococcus pneumoniae R6
uaaaaguaagagaa

SEQ ID NO: 2190946 - RNA, 16 nt, Streptococcus pneumoniae R6
uaaaaguaagagaaac

SEQ ID NO: 2190947 - RNA, 12 nt, Streptococcus pneumoniae R6
uaaaaguacuuu

SEQ ID NO: 2190948 - RNA, 16 nt, Streptococcus pneumoniae R6
uaaaauguucuguaau

SEQ ID NO: 2190949 - RNA, 13 nt, Streptococcus pneumoniae R6
uaaaaucucuuua

SEQ ID NO: 2190950 - RNA, 18 nt, Streptococcus pneumoniae R6
uaaaaucucuuuauuggu

SEQ ID NO: 2190951 - RNA, 20 nt, Streptococcus pneumoniae R6
uaaaaucugaagaaagcaau

SEQ ID NO: 2190952 - RNA, 13 nt, Streptococcus pneumoniae R6
uaaaaugaaauaa

SEQ ID NO: 2190953 - RNA, 17 nt, Streptococcus pneumoniae R6
uaaaaugaaauaagaau

SEQ ID NO: 2190954 - RNA, 14 nt, Streptococcus pneumoniae R6
uaaaaugaaauaau

SEQ ID NO: 2190955 - RNA, 15 nt, Streptococcus pneumoniae R6
uaaaaucuugucaag

SEQ ID NO: 2190956 - RNA, 16 nt, Streptococcus pneumoniae R6
uaaaaucuuuuacuuc

SEQ ID NO: 2190957 - RNA, 20 nt, Streptococcus pneumoniae R6
uaaaaucuuuuacuucugaa

SEQ ID NO: 2190958 - RNA, 21 nt, Streptococcus pneumoniae R6
uaaaaugccaaagaaagauuc

SEQ ID NO: 2190959 - RNA, 19 nt, Streptococcus pneumoniae R6
uaaaaugcaccaaaacagg

SEQ ID NO: 2190960 - RNA, 17 nt, Streptococcus pneumoniae R6
uaaaaugagucuaucaa

SEQ ID NO: 2190961 - RNA, 20 nt, Streptococcus pneumoniae R6
uaaaaucaucgccaaaucau

SEQ ID NO: 2190962 - RNA, 15 nt, Streptococcus pneumoniae R6
uaaaauccgagccaa

SEQ ID NO: 2190963 - RNA, 14 nt, Streptococcus pneumoniae R6
uaaaaucaaaaagg

SEQ ID NO: 2190964 - RNA, 12 nt, Streptococcus pneumoniae R6
uaaaaucaggaa

SEQ ID NO: 2190965 - RNA, 20 nt, Streptococcus pneumoniae R6
uaaaaucaggucuuauagaa

SEQ ID NO: 2190966 - RNA, 21 nt, Streptococcus pneumoniae R6
uaaaaucagguguucaaaaac

SEQ ID NO: 2190967 - RNA, 13 nt, Streptococcus pneumoniae R6
uaaaauauuagca

SEQ ID NO: 2190968 - RNA, 14 nt, Streptococcus pneumoniae R6
uaaaauauuucuag

SEQ ID NO: 2190969 - RNA, 23 nt, Streptococcus pneumoniae R6
uaaaauauuucuagaaauuaauu

SEQ ID NO: 2190970 - RNA, 16 nt, Streptococcus pneumoniae R6
uaaaggacuuuaaagc

SEQ ID NO: 2190971 - RNA, 16 nt, Streptococcus pneumoniae R6
uaaagggcuuuaaagc

SEQ ID NO: 2190972 - RNA, 22 nt, Streptococcus pneumoniae R6
uaaagccuguaucgaaacauuc

SEQ ID NO: 2190973 - RNA, 15 nt, Streptococcus pneumoniae R6
uaaagcaauuuugaa

SEQ ID NO: 2190974 - RNA, 20 nt, Streptococcus pneumoniae R6
uaaagagucuggaacaaaau

SEQ ID NO: 2190975 - RNA, 16 nt, Streptococcus pneumoniae R6
uaaagaggaaaucuuu

SEQ ID NO: 2190976 - RNA, 19 nt, Streptococcus pneumoniae R6
uaaagaggucgaagccauc

SEQ ID NO: 2190977 - RNA, 20 nt, Streptococcus pneumoniae R6
uaaagacuagaaaaagcuuc

SEQ ID NO: 2190978 - RNA, 17 nt, Streptococcus pneumoniae R6
uaaagacuagacuugcc

SEQ ID NO: 2190979 - RNA, 22 nt, Streptococcus pneumoniae R6
uaaagguaucaacugggaagau

SEQ ID NO: 2190980 - RNA, 16 nt, Streptococcus pneumoniae R6
uaaaguaaaaauuucu

SEQ ID NO: 2190981 - RNA, 20 nt, Streptococcus pneumoniae R6
uaaagguuuuaucugagaug

SEQ ID NO: 2190982 - RNA, 16 nt, Streptococcus pneumoniae R6
uaaauaaauaucaaaa

SEQ ID NO: 2190983 - RNA, 15 nt, Streptococcus pneumoniae R6
uaaauaaaucucugg

SEQ ID NO: 2190984 - RNA, 16 nt, Streptococcus pneumoniae R6
uaaauaaaucucugga

SEQ ID NO: 2190985 - RNA, 16 nt, Streptococcus pneumoniae R6
uaaauacaaaaauagc

SEQ ID NO: 2190986 - RNA, 17 nt, Streptococcus pneumoniae R6
uaaauacaaaaauagcc

SEQ ID NO: 2190987 - RNA, 20 nt, Streptococcus pneumoniae R6
uaaauacaaaaauagcccuu

SEQ ID NO: 2190988 - RNA, 12 nt, Streptococcus pneumoniae R6
uaaauacaaaaa

SEQ ID NO: 2190989 - RNA, 14 nt, Streptococcus pneumoniae R6
uaaauacaaaaaca

SEQ ID NO: 2190990 - RNA, 24 nt, Streptococcus pneumoniae R6
uaaauaaucuccacgcuccacuuc

SEQ ID NO: 2190991 - RNA, 20 nt, Streptococcus pneumoniae R6
uaaauaauuauagaaaugag

SEQ ID NO: 2190992 - RNA, 13 nt, Streptococcus pneumoniae R6
uaaauauuucuau

SEQ ID NO: 2190993 - RNA, 15 nt, Streptococcus pneumoniae R6
uaaauacuuuuuccu

SEQ ID NO: 2190994 - RNA, 18 nt, Streptococcus pneumoniae R6
uaaauacuagucuuucuu

SEQ ID NO: 2190995 - RNA, 14 nt, Streptococcus pneumoniae R6
uaaauaccuuaucc

SEQ ID NO: 2190996 - RNA, 23 nt, Streptococcus pneumoniae R6
uaaauaccuuauccaauucuuca

SEQ ID NO: 2190997 - RNA, 13 nt, Streptococcus pneumoniae R6
uaaauagaaacca

SEQ ID NO: 2190998 - RNA, 15 nt, Streptococcus pneumoniae R6
uaaauagaaaccagc

SEQ ID NO: 2190999 - RNA, 19 nt, Streptococcus pneumoniae R6
uaaauagauuggauaaaau

SEQ ID NO: 2191000 - RNA, 22 nt, Streptococcus pneumoniae R6
uaaauagauuggauaaaaucuu

SEQ ID NO: 2191001 - RNA, 18 nt, Streptococcus pneumoniae R6
uaaauagcuacagucauu

SEQ ID NO: 2191002 - RNA, 21 nt, Streptococcus pneumoniae R6
uaaauagcguagucuuuuaaa

SEQ ID NO: 2191003 - RNA, 21 nt, Streptococcus pneumoniae R6
uaaacagggcaucuaagcauu

SEQ ID NO: 2191004 - RNA, 12 nt, Streptococcus pneumoniae R6
uaaacaucuguc

SEQ ID NO: 2191005 - RNA, 17 nt, Streptococcus pneumoniae R6
uaaaauucguuucauua

SEQ ID NO: 2191006 - RNA, 20 nt, Streptococcus pneumoniae R6
uaaaauucguuucauuauuu

SEQ ID NO: 2191007 - RNA, 19 nt, Streptococcus pneumoniae R6
uaaaauuccuuuaaaaaca

SEQ ID NO: 2191008 - RNA, 22 nt, Streptococcus pneumoniae R6
uaaaauuccuuuaaaaacaauc

SEQ ID NO: 2191009 - RNA, 20 nt, Streptococcus pneumoniae R6
uaaaauucaauguuuacuca

SEQ ID NO: 2191010 - RNA, 13 nt, Streptococcus pneumoniae R6
uaaaauuauaaaa

SEQ ID NO: 2191011 - RNA, 16 nt, Streptococcus pneumoniae R6
uaaaauuuaaaaauag

SEQ ID NO: 2191012 - RNA, 23 nt, Streptococcus pneumoniae R6
uaaaauugcuuucuucagauuuu

SEQ ID NO: 2191013 - RNA, 15 nt, Streptococcus pneumoniae R6
uaaaauugauaauag

SEQ ID NO: 2191014 - RNA, 20 nt, Streptococcus pneumoniae R6
uaaaauuugaacaaauuaau

SEQ ID NO: 2191015 - RNA, 21 nt, Streptococcus pneumoniae R6
uaaaauuugaacaaauuaauu

SEQ ID NO: 2191016 - RNA, 14 nt, Streptococcus pneumoniae R6
uaaaccuuccaaga

SEQ ID NO: 2191017 - RNA, 14 nt, Streptococcus pneumoniae R6
uaaaccaucgugua

SEQ ID NO: 2191018 - RNA, 17 nt, Streptococcus pneumoniae R6
uaaagaaauagaaaaca

SEQ ID NO: 2191019 - RNA, 14 nt, Streptococcus pneumoniae R6
uaaacuuuuucaua

SEQ ID NO: 2191020 - RNA, 18 nt, Streptococcus pneumoniae R6
uaaacuuuuucauaaaua

SEQ ID NO: 2191021 - RNA, 19 nt, Streptococcus pneumoniae R6
uaaagaaaaaguucucuuu

SEQ ID NO: 2191022 - RNA, 16 nt, Streptococcus pneumoniae R6
uaaacuaagcuuauau

SEQ ID NO: 2191023 - RNA, 15 nt, Streptococcus pneumoniae R6
uaaacuaauguaaaa

SEQ ID NO: 2191024 - RNA, 14 nt, Streptococcus pneumoniae R6
uaaacuuuauaucc

SEQ ID NO: 2191025 - RNA, 21 nt, Streptococcus pneumoniae R6
uaaacuacacccgcauaaaua

SEQ ID NO: 2191026 - RNA, 14 nt, Streptococcus pneumoniae R6
uaaacuucuucuuc

SEQ ID NO: 2191027 - RNA, 17 nt, Streptococcus pneumoniae R6
uaaacuucuucuuccau

SEQ ID NO: 2191028 - RNA, 19 nt, Streptococcus pneumoniae R6
uaacgaagucuauugaaaa

SEQ ID NO: 2191029 - RNA, 17 nt, Streptococcus pneumoniae R6
uaacgaauccaacucuu

SEQ ID NO: 2191030 - RNA, 18 nt, Streptococcus pneumoniae R6
uaacgaauccaacucuug

SEQ ID NO: 2191031 - RNA, 16 nt, Streptococcus pneumoniae R6
uaacgacauagucaaa

SEQ ID NO: 2191032 - RNA, 19 nt, Streptococcus pneumoniae R6
uaacgacauagucaaagag

SEQ ID NO: 2191033 - RNA, 22 nt, Streptococcus pneumoniae R6
uaacgacauagucaaagaguuu

SEQ ID NO: 2191034 - RNA, 19 nt, Streptococcus pneumoniae R6
uaaccuuaggaaugaauuu

SEQ ID NO: 2191035 - RNA, 19 nt, Streptococcus pneumoniae R6
uaaccuuauuucucaagau

SEQ ID NO: 2191036 - RNA, 22 nt, Streptococcus pneumoniae R6
uaaccucuugaaguucauuuuc

SEQ ID NO: 2191037 - RNA, 12 nt, Streptococcus pneumoniae R6
uaacccaaacaa

SEQ ID NO: 2191038 - RNA, 15 nt, Streptococcus pneumoniae R6
uaacccaaacaagcc

SEQ ID NO: 2191039 - RNA, 21 nt, Streptococcus pneumoniae R6
uaaccaauuucucaaaaaagu

SEQ ID NO: 2191040 - RNA, 13 nt, Streptococcus pneumoniae R6
uaaccacaaaaag

SEQ ID NO: 2191041 - RNA, 12 nt, Streptococcus pneumoniae R6
uaaccaaauaau

SEQ ID NO: 2191042 - RNA, 19 nt, Streptococcus pneumoniae R6
uaaccgaugacaaaaauag

SEQ ID NO: 2191043 - RNA, 23 nt, Streptococcus pneumoniae R6
uaaccgaugacaaaaauaguaua

SEQ ID NO: 2191044 - RNA, 20 nt, Streptococcus pneumoniae R6
uaacaucaauaaccaucauu

SEQ ID NO: 2191045 - RNA, 21 nt, Streptococcus pneumoniae R6
uaacauauuucuagaaauuaa

SEQ ID NO: 2191046 - RNA, 22 nt, Streptococcus pneumoniae R6
uaacauauuucuagaaauuaau

SEQ ID NO: 2191047 - RNA, 23 nt, Streptococcus pneumoniae R6
uaacauauuucuagaaauuaauu

SEQ ID NO: 2191048 - RNA, 21 nt, Streptococcus pneumoniae R6
uaacauaucaaccuuucucag

SEQ ID NO: 2191049 - RNA, 17 nt, Streptococcus pneumoniae R6
uaacauuugagugagca

SEQ ID NO: 2191050 - RNA, 14 nt, Streptococcus pneumoniae R6
uaacauuauugauu

SEQ ID NO: 2191051 - RNA, 17 nt, Streptococcus pneumoniae R6
uaacauucuacaucauu

SEQ ID NO: 2191052 - RNA, 20 nt, Streptococcus pneumoniae R6
uaacaggccaauacagauaa

SEQ ID NO: 2191053 - RNA, 17 nt, Streptococcus pneumoniae R6
uaacagucuuagcaaaa

SEQ ID NO: 2191054 - RNA, 15 nt, Streptococcus pneumoniae R6
uaacaguuuuuaauu

SEQ ID NO: 2191055 - RNA, 21 nt, Streptococcus pneumoniae R6
uaacaguuuuuaauuuuucuu

SEQ ID NO: 2191056 - RNA, 18 nt, Streptococcus pneumoniae R6
uaacaguauacuggagaa

SEQ ID NO: 2191057 - RNA, 22 nt, Streptococcus pneumoniae R6
uaacagucaguucauucucuaa

SEQ ID NO: 2191058 - RNA, 23 nt, Streptococcus pneumoniae R6
uaacaaucuaucuuuuaauucau

SEQ ID NO: 2191059 - RNA, 22 nt, Streptococcus pneumoniae R6
uaacaauauuuuagaagcagag

SEQ ID NO: 2191060 - RNA, 16 nt, Streptococcus pneumoniae R6
uaacaauguuuuagaa

SEQ ID NO: 2191061 - RNA, 13 nt, Streptococcus pneumoniae R6
uaacagccaaaag

SEQ ID NO: 2191062 - RNA, 21 nt, Streptococcus pneumoniae R6
uaacagccaaaaguccaaaga

SEQ ID NO: 2191063 - RNA, 22 nt, Streptococcus pneumoniae R6
uaacagccaaaaguccaaagau

SEQ ID NO: 2191064 - RNA, 21 nt, Streptococcus pneumoniae R6
uaaauuuagaucaucaaccuc

SEQ ID NO: 2191065 - RNA, 17 nt, Streptococcus pneumoniae R6
uaaauuuacuuaaaauu

SEQ ID NO: 2191066 - RNA, 19 nt, Streptococcus pneumoniae R6
uaaauugcuggagaaucau

SEQ ID NO: 2191067 - RNA, 20 nt, Streptococcus pneumoniae R6
uaaauugucuaaaaauuuaa

SEQ ID NO: 2191068 - RNA, 17 nt, Streptococcus pneumoniae R6
uaaauugcgauuuugcc

SEQ ID NO: 2191069 - RNA, 18 nt, Streptococcus pneumoniae R6
uaaauuauacucuuagaa

SEQ ID NO: 2191070 - RNA, 16 nt, Streptococcus pneumoniae R6
uaaauuauaaauuauu

SEQ ID NO: 2191071 - RNA, 19 nt, Streptococcus pneumoniae R6
uaaauuucgaaaaaugcuc

SEQ ID NO: 2191072 - RNA, 17 nt, Streptococcus pneumoniae R6
uaaauuuauugguauua

SEQ ID NO: 2191073 - RNA, 19 nt, Streptococcus pneumoniae R6
uaaauuuggugcuaagucc

SEQ ID NO: 2191074 - RNA, 23 nt, Streptococcus pneumoniae R6
uaacaaagcuacgacuuucaagu

SEQ ID NO: 2191075 - RNA, 18 nt, Streptococcus pneumoniae R6
uaacaauagcgaaauucu

SEQ ID NO: 2191076 - RNA, 16 nt, Streptococcus pneumoniae R6
uaacaacccaauucau

SEQ ID NO: 2191077 - RNA, 16 nt, Streptococcus pneumoniae R6
uaaaugcauacgaaaa

SEQ ID NO: 2191078 - RNA, 20 nt, Streptococcus pneumoniae R6
uaaaugcauacgaaaaguag

SEQ ID NO: 2191079 - RNA, 14 nt, Streptococcus pneumoniae R6
uaaaugaauauauu

SEQ ID NO: 2191080 - RNA, 21 nt, Streptococcus pneumoniae R6
uaaaugaauauauuccauucc

SEQ ID NO: 2191081 - RNA, 22 nt, Streptococcus pneumoniae R6
uaaauguaguuggauuuccacu

SEQ ID NO: 2191082 - RNA, 14 nt, Streptococcus pneumoniae R6
uaaaucuuuaacau

SEQ ID NO: 2191083 - RNA, 21 nt, Streptococcus pneumoniae R6
uaaaucuucggauaaauuaau

SEQ ID NO: 2191084 - RNA, 22 nt, Streptococcus pneumoniae R6
uaaaucuucggauaaauuaauu

SEQ ID NO: 2191085 - RNA, 21 nt, Streptococcus pneumoniae R6
uaaaucuugaugucuuggauu

SEQ ID NO: 2191086 - RNA, 14 nt, Streptococcus pneumoniae R6
uaaaucuugcccuu

SEQ ID NO: 2191087 - RNA, 20 nt, Streptococcus pneumoniae R6
uaaaucucagaaaaaccuug

SEQ ID NO: 2191088 - RNA, 15 nt, Streptococcus pneumoniae R6
uaaaucuccagacca

SEQ ID NO: 2191089 - RNA, 19 nt, Streptococcus pneumoniae R6
uaaaucuaggacaaagcgc

SEQ ID NO: 2191090 - RNA, 12 nt, Streptococcus pneumoniae R6
uaaaucuaucag

SEQ ID NO: 2191091 - RNA, 18 nt, Streptococcus pneumoniae R6
uaaaucuguacuaagcau

SEQ ID NO: 2191092 - RNA, 14 nt, Streptococcus pneumoniae R6
uaaaucuuauauuu

SEQ ID NO: 2191093 - RNA, 17 nt, Streptococcus pneumoniae R6
uaggcauaaacaggcuc

SEQ ID NO: 2191094 - RNA, 15 nt, Streptococcus pneumoniae R6
uaggcagaacaagag

SEQ ID NO: 2191095 - RNA, 21 nt, Streptococcus pneumoniae R6
uaggcgcaaauccgaaaauca

SEQ ID NO: 2191096 - RNA, 13 nt, Streptococcus pneumoniae R6
uaggcgcuucacu

SEQ ID NO: 2191097 - RNA, 15 nt, Streptococcus pneumoniae R6
uaggcgcuucacuag

SEQ ID NO: 2191098 - RNA, 20 nt, Streptococcus pneumoniae R6
uaggcgcuucacuaguuuua

SEQ ID NO: 2191099 - RNA, 22 nt, Streptococcus pneumoniae R6
uaggccuuguggaagaaguuuu

SEQ ID NO: 2191100 - RNA, 23 nt, Streptococcus pneumoniae R6
uaggccuuguggaagaaguuuuc

SEQ ID NO: 2191101 - RNA, 21 nt, Streptococcus pneumoniae R6
uaggcucgagaaaggacaaau

SEQ ID NO: 2191102 - RNA, 18 nt, Streptococcus pneumoniae R6
uaggcuagcaaauuuaau

SEQ ID NO: 2191103 - RNA, 14 nt, Streptococcus pneumoniae R6
uaggcuucuucucc

SEQ ID NO: 2191104 - RNA, 15 nt, Streptococcus pneumoniae R6
uaggcuuucaacugc

SEQ ID NO: 2191105 - RNA, 16 nt, Streptococcus pneumoniae R6
uaggcuuucaacugcu

SEQ ID NO: 2191106 - RNA, 11 nt, Streptococcus pneumoniae R6
uagguuuuguu

SEQ ID NO: 2191107 - RNA, 13 nt, Streptococcus pneumoniae R6
uaguaaaaugaaa

SEQ ID NO: 2191108 - RNA, 11 nt, Streptococcus pneumoniae R6
uaguaaauaga

SEQ ID NO: 2191109 - RNA, 20 nt, Streptococcus pneumoniae R6
uaguaaagcuagauuuaaaa

SEQ ID NO: 2191110 - RNA, 18 nt, Streptococcus pneumoniae R6
uaguaaaggacaccagca

SEQ ID NO: 2191111 - RNA, 21 nt, Streptococcus pneumoniae R6
uaguagaaguguauuauucua

SEQ ID NO: 2191112 - RNA, 19 nt, Streptococcus pneumoniae R6
uaguagacugaaucugaaa

SEQ ID NO: 2191113 - RNA, 23 nt, Streptococcus pneumoniae R6
uaguagaucaugacugagagcua

SEQ ID NO: 2191114 - RNA, 15 nt, Streptococcus pneumoniae R6
uaguagccaaaaucc

SEQ ID NO: 2191115 - RNA, 19 nt, Streptococcus pneumoniae R6
uaguagccaaaauccuuga

SEQ ID NO: 2191116 - RNA, 16 nt, Streptococcus pneumoniae R6
uaguaguuucagcgau

SEQ ID NO: 2191117 - RNA, 22 nt, Streptococcus pneumoniae R6
uaguaucaaguguaucaggaau

SEQ ID NO: 2191118 - RNA, 19 nt, Streptococcus pneumoniae R6
uaguaucagguauugaaaa

SEQ ID NO: 2191119 - RNA, 22 nt, Streptococcus pneumoniae R6
uaguagggaaaccacuagcaua

SEQ ID NO: 2191120 - RNA, 18 nt, Streptococcus pneumoniae R6
uaguauucaucuuaucaa

SEQ ID NO: 2191121 - RNA, 16 nt, Streptococcus pneumoniae R6
uaguaugucugaauau

SEQ ID NO: 2191122 - RNA, 14 nt, Streptococcus pneumoniae R6
uaggucuagacuau

SEQ ID NO: 2191123 - RNA, 19 nt, Streptococcus pneumoniae R6
uaggucuggcuauuuuuau

SEQ ID NO: 2191124 - RNA, 18 nt, Streptococcus pneumoniae R6
uaggugagcaucaggaaa

SEQ ID NO: 2191125 - RNA, 17 nt, Streptococcus pneumoniae R6
uaggugaauuagugaag

SEQ ID NO: 2191126 - RNA, 23 nt, Streptococcus pneumoniae R6
uaggucacgaggaggagaaaaag

SEQ ID NO: 2191127 - RNA, 13 nt, Streptococcus pneumoniae R6
uaggucauauggg

SEQ ID NO: 2191128 - RNA, 18 nt, Streptococcus pneumoniae R6
uaggucaaccaacuuuuc

SEQ ID NO: 2191129 - RNA, 22 nt, Streptococcus pneumoniae R6
uaggucaaccaacuuuuccuug

SEQ ID NO: 2191130 - RNA, 14 nt, Streptococcus pneumoniae R6
uagguauaaaccac

SEQ ID NO: 2191131 - RNA, 16 nt, Streptococcus pneumoniae R6
uaggguacuuucucuu

SEQ ID NO: 2191132 - RNA, 14 nt, Streptococcus pneumoniae R6
uaggggcuauuuua

SEQ ID NO: 2191133 - RNA, 14 nt, Streptococcus pneumoniae R6
uaggguguuuucaa

SEQ ID NO: 2191134 - RNA, 13 nt, Streptococcus pneumoniae R6
uaguuuaugaaca

SEQ ID NO: 2191135 - RNA, 20 nt, Streptococcus pneumoniae R6
uaguuuaugguauuuguaaa

SEQ ID NO: 2191136 - RNA, 22 nt, Streptococcus pneumoniae R6
uaguuuaugguauuuguaaaau

SEQ ID NO: 2191137 - RNA, 15 nt, Streptococcus pneumoniae R6
uaguuuaaucaaaau

SEQ ID NO: 2191138 - RNA, 12 nt, Streptococcus pneumoniae R6
uaguuuaaaaca

SEQ ID NO: 2191139 - RNA, 12 nt, Streptococcus pneumoniae R6
uaguuuaaauca

SEQ ID NO: 2191140 - RNA, 20 nt, Streptococcus pneumoniae R6
uaguugucgcuugagagaag

SEQ ID NO: 2191141 - RNA, 23 nt, Streptococcus pneumoniae R6
uaguugguauucuucgugaaaga

SEQ ID NO: 2191142 - RNA, 16 nt, Streptococcus pneumoniae R6
uaguucagaauuuucu

SEQ ID NO: 2191143 - RNA, 14 nt, Streptococcus pneumoniae R6
uaguucaugauuga

SEQ ID NO: 2191144 - RNA, 13 nt, Streptococcus pneumoniae R6
uaguguuucucug

SEQ ID NO: 2191145 - RNA, 13 nt, Streptococcus pneumoniae R6
uaguuaaaaaaga

SEQ ID NO: 2191146 - RNA, 17 nt, Streptococcus pneumoniae R6
uaguuaaacuaauguaa

SEQ ID NO: 2191147 - RNA, 17 nt, Streptococcus pneumoniae R6
uagugugggacuccuac

SEQ ID NO: 2191148 - RNA, 15 nt, Streptococcus pneumoniae R6
uaguucaagugcuuu

SEQ ID NO: 2191149 - RNA, 22 nt, Streptococcus pneumoniae R6
uaguucaagugcuuuugugauu

SEQ ID NO: 2191150 - RNA, 18 nt, Streptococcus pneumoniae R6
uagucccagcuucuuuuu

SEQ ID NO: 2191151 - RNA, 19 nt, Streptococcus pneumoniae R6
uagucccauuuucagaaag

SEQ ID NO: 2191152 - RNA, 17 nt, Streptococcus pneumoniae R6
uaguauuuuaaaacgaa

SEQ ID NO: 2191153 - RNA, 14 nt, Streptococcus pneumoniae R6
uagucaaagggaaa

SEQ ID NO: 2191154 - RNA, 23 nt, Streptococcus pneumoniae R6
uagucauucgaaugauuucucuu

SEQ ID NO: 2191155 - RNA, 19 nt, Streptococcus pneumoniae R6
uaguccaaacguccagccu

SEQ ID NO: 2191156 - RNA, 22 nt, Streptococcus pneumoniae R6
uaguccaagacguucaaagaua

SEQ ID NO: 2191157 - RNA, 20 nt, Streptococcus pneumoniae R6
uagugcuauaguagauugaa

SEQ ID NO: 2191158 - RNA, 23 nt, Streptococcus pneumoniae R6
uaguguagaggcguuauuugaaa

SEQ ID NO: 2191159 - RNA, 14 nt, Streptococcus pneumoniae R6
uaguguauaagguu

SEQ ID NO: 2191160 - RNA, 14 nt, Streptococcus pneumoniae R6
uauaaauuuuccag

SEQ ID NO: 2191161 - RNA, 20 nt, Streptococcus pneumoniae R6
uauaaaacgcaucauaucaa

SEQ ID NO: 2191162 - RNA, 17 nt, Streptococcus pneumoniae R6
uauaaaacauucuuauc

SEQ ID NO: 2191163 - RNA, 19 nt, Streptococcus pneumoniae R6
uauaaaccaaaggaagcug

SEQ ID NO: 2191164 - RNA, 23 nt, Streptococcus pneumoniae R6
uauaaaccacgaggguaaagggu

SEQ ID NO: 2191165 - RNA, 14 nt, Streptococcus pneumoniae R6
uauaaacuuugguu

SEQ ID NO: 2191166 - RNA, 22 nt, Streptococcus pneumoniae R6
uauaaacuuugguuauaaaaaa

SEQ ID NO: 2191167 - RNA, 19 nt, Streptococcus pneumoniae R6
uaguuuuugaaguuuucua

SEQ ID NO: 2191168 - RNA, 23 nt, Streptococcus pneumoniae R6
uaguuuuuagaagcuucuuggaa

SEQ ID NO: 2191169 - RNA, 14 nt, Streptococcus pneumoniae R6
uauaaaaacucucu

SEQ ID NO: 2191170 - RNA, 20 nt, Streptococcus pneumoniae R6
uauaaaaaagucugggaaaa

SEQ ID NO: 2191171 - RNA, 14 nt, Streptococcus pneumoniae R6
uauaaaaaagugaa

SEQ ID NO: 2191172 - RNA, 17 nt, Streptococcus pneumoniae R6
uaguuuccuaguuugcu

SEQ ID NO: 2191173 - RNA, 21 nt, Streptococcus pneumoniae R6
uaguuugguagggugaagagu

SEQ ID NO: 2191174 - RNA, 15 nt, Streptococcus pneumoniae R6
uaguuugcaaauuau

SEQ ID NO: 2191175 - RNA, 22 nt, Streptococcus pneumoniae R6
uaguuugcucuuugauuuuuau

SEQ ID NO: 2191176 - RNA, 20 nt, Streptococcus pneumoniae R6
uaguuuuaccacuaaacuac

SEQ ID NO: 2191177 - RNA, 13 nt, Streptococcus pneumoniae R6
uauccacaaccuc

SEQ ID NO: 2191178 - RNA, 17 nt, Streptococcus pneumoniae R6
uauccacaaccucaaaa

SEQ ID NO: 2191179 - RNA, 23 nt, Streptococcus pneumoniae R6
uauccacaaccucaaaacagugu

SEQ ID NO: 2191180 - RNA, 22 nt, Streptococcus pneumoniae R6
uauccaaucuauuuaugaaaaa

SEQ ID NO: 2191181 - RNA, 15 nt, Streptococcus pneumoniae R6
uauccaguuauucuu

SEQ ID NO: 2191182 - RNA, 24 nt, Streptococcus pneumoniae R6
uauccaguuauucuuaaaugacau

SEQ ID NO: 2191183 - RNA, 17 nt, Streptococcus pneumoniae R6
uauccaacucaggaaag

SEQ ID NO: 2191184 - RNA, 18 nt, Streptococcus pneumoniae R6
uauccaacagagaaaauu

SEQ ID NO: 2191185 - RNA, 18 nt, Streptococcus pneumoniae R6
uauccaaagauuaaucuu

SEQ ID NO: 2191186 - RNA, 21 nt, Streptococcus pneumoniae R6
uauccaaagauuaaucuucaa

SEQ ID NO: 2191187 - RNA, 12 nt, Streptococcus pneumoniae R6
uaucauuuccau

SEQ ID NO: 2191188 - RNA, 12 nt, Streptococcus pneumoniae R6
uaucauuuugaa

SEQ ID NO: 2191189 - RNA, 20 nt, Streptococcus pneumoniae R6
uaucauuuugaaaucuauuu

SEQ ID NO: 2191190 - RNA, 16 nt, Streptococcus pneumoniae R6
uauccaaaacaaccaa

SEQ ID NO: 2191191 - RNA, 16 nt, Streptococcus pneumoniae R6
uaucauucgacuaauu

SEQ ID NO: 2191192 - RNA, 16 nt, Streptococcus pneumoniae R6
uaucagguauugaaaa

SEQ ID NO: 2191193 - RNA, 21 nt, Streptococcus pneumoniae R6
uaucagguauugaaaaaacuu

SEQ ID NO: 2191194 - RNA, 14 nt, Streptococcus pneumoniae R6
uaucaguaaucuca

SEQ ID NO: 2191195 - RNA, 23 nt, Streptococcus pneumoniae R6
uaucaguaaucucaaaacagugu

SEQ ID NO: 2191196 - RNA, 20 nt, Streptococcus pneumoniae R6
uaucagaaaauaaaauuccu

SEQ ID NO: 2191197 - RNA, 13 nt, Streptococcus pneumoniae R6
uaucauuaaagac

SEQ ID NO: 2191198 - RNA, 21 nt, Streptococcus pneumoniae R6
uaucaugcuuuacuaguucuc

SEQ ID NO: 2191199 - RNA, 19 nt, Streptococcus pneumoniae R6
uaucauccagauuuuucug

SEQ ID NO: 2191200 - RNA, 21 nt, Streptococcus pneumoniae R6
uaucauccagauuuuucuggg

SEQ ID NO: 2191201 - RNA, 17 nt, Streptococcus pneumoniae R6
uaucaucgauuuuuuca

SEQ ID NO: 2191202 - RNA, 16 nt, Streptococcus pneumoniae R6
uaucaaugauuuauuu

SEQ ID NO: 2191203 - RNA, 13 nt, Streptococcus pneumoniae R6
uaucaaucucugc

SEQ ID NO: 2191204 - RNA, 21 nt, Streptococcus pneumoniae R6
uaucaaucucugcaauuucua

SEQ ID NO: 2191205 - RNA, 14 nt, Streptococcus pneumoniae R6
uaucacuccaaaaa

SEQ ID NO: 2191206 - RNA, 16 nt, Streptococcus pneumoniae R6
uaucacuccaaaaaua

SEQ ID NO: 2191207 - RNA, 20 nt, Streptococcus pneumoniae R6
uaucaaacuuuuuaguuuuu

SEQ ID NO: 2191208 - RNA, 12 nt, Streptococcus pneumoniae R6
uaucaaacagga

SEQ ID NO: 2191209 - RNA, 16 nt, Streptococcus pneumoniae R6
uaucaaaucccuagcu

SEQ ID NO: 2191210 - RNA, 23 nt, Streptococcus pneumoniae R6
uaucaaaucccuagcucauggca

SEQ ID NO: 2191211 - RNA, 12 nt, Streptococcus pneumoniae R6
uaucaauaauag

SEQ ID NO: 2191212 - RNA, 16 nt, Streptococcus pneumoniae R6
uauauuuuucaaauaa

SEQ ID NO: 2191213 - RNA, 17 nt, Streptococcus pneumoniae R6
uaucaaaaaaagaaguu

SEQ ID NO: 2191214 - RNA, 22 nt, Streptococcus pneumoniae R6
uaucaaaagauguuagaaaaag

SEQ ID NO: 2191215 - RNA, 23 nt, Streptococcus pneumoniae R6
uauaucauauagauaaaaaacaa

SEQ ID NO: 2191216 - RNA, 19 nt, Streptococcus pneumoniae R6
uauaucacuuuauaguuuu

SEQ ID NO: 2191217 - RNA, 15 nt, Streptococcus pneumoniae R6
uauauugcaagagaa

SEQ ID NO: 2191218 - RNA, 15 nt, Streptococcus pneumoniae R6
uauagucuugaauag

SEQ ID NO: 2191219 - RNA, 14 nt, Streptococcus pneumoniae R6
uauagucuuucaaa

SEQ ID NO: 2191220 - RNA, 11 nt, Streptococcus pneumoniae R6
uauagucuaau

SEQ ID NO: 2191221 - RNA, 17 nt, Streptococcus pneumoniae R6
uauagucaauuaguuua

SEQ ID NO: 2191222 - RNA, 22 nt, Streptococcus pneumoniae R6
uauaguagguugcaguugaaau

SEQ ID NO: 2191223 - RNA, 21 nt, Streptococcus pneumoniae R6
uauaguagcucagaagucggu

SEQ ID NO: 2191224 - RNA, 18 nt, Streptococcus pneumoniae R6
uauaguagauugaaauaa

SEQ ID NO: 2191225 - RNA, 21 nt, Streptococcus pneumoniae R6
uauaguagauugaaauaagau

SEQ ID NO: 2191226 - RNA, 13 nt, Streptococcus pneumoniae R6
uauagucaaaggg

SEQ ID NO: 2191227 - RNA, 23 nt, Streptococcus pneumoniae R6
uauagucaaagggaaaucugaaa

SEQ ID NO: 2191228 - RNA, 19 nt, Streptococcus pneumoniae R6
uauagugguguuucaaguc

SEQ ID NO: 2191229 - RNA, 18 nt, Streptococcus pneumoniae R6
uauagugaauugaaauaa

SEQ ID NO: 2191230 - RNA, 22 nt, Streptococcus pneumoniae R6
uauaguuaaaaaagauuugaaa

SEQ ID NO: 2191231 - RNA, 19 nt, Streptococcus pneumoniae R6
uauaguuaaauuaguuuuu

SEQ ID NO: 2191232 - RNA, 17 nt, Streptococcus pneumoniae R6
uauauaauagauugaaa

SEQ ID NO: 2191233 - RNA, 21 nt, Streptococcus pneumoniae R6
uauauaauuauauauaaaaag

SEQ ID NO: 2191234 - RNA, 16 nt, Streptococcus pneumoniae R6
uauagaguguuaucug

SEQ ID NO: 2191235 - RNA, 15 nt, Streptococcus pneumoniae R6
uauagauaaaaaaca

SEQ ID NO: 2191236 - RNA, 20 nt, Streptococcus pneumoniae R6
uauagaggagauuuaaaaau

SEQ ID NO: 2191237 - RNA, 21 nt, Streptococcus pneumoniae R6
uauagauucaauauacuauac

SEQ ID NO: 2191238 - RNA, 17 nt, Streptococcus pneumoniae R6
uauagauucaauauauu

SEQ ID NO: 2191239 - RNA, 14 nt, Streptococcus pneumoniae R6
uauagaccugauca

SEQ ID NO: 2191240 - RNA, 14 nt, Streptococcus pneumoniae R6
uauagaaggcaauu

SEQ ID NO: 2191241 - RNA, 18 nt, Streptococcus pneumoniae R6
uauagaauauauuucuca

SEQ ID NO: 2191242 - RNA, 19 nt, Streptococcus pneumoniae R6
uauagacacauucguuccu

SEQ ID NO: 2191243 - RNA, 14 nt, Streptococcus pneumoniae R6
uauagacaggauau

SEQ ID NO: 2191244 - RNA, 16 nt, Streptococcus pneumoniae R6
uauagacaggauauca

SEQ ID NO: 2191245 - RNA, 16 nt, Streptococcus pneumoniae R6
uauagcagauugaaau

SEQ ID NO: 2191246 - RNA, 15 nt, Streptococcus pneumoniae R6
uauagcauucuucuc

SEQ ID NO: 2191247 - RNA, 19 nt, Streptococcus pneumoniae R6
uauagcauuguccauaacg

SEQ ID NO: 2191248 - RNA, 21 nt, Streptococcus pneumoniae R6
uauagccccuaugcuuuccuu

SEQ ID NO: 2191249 - RNA, 14 nt, Streptococcus pneumoniae R6
uauagcguuuugaa

SEQ ID NO: 2191250 - RNA, 17 nt, Streptococcus pneumoniae R6
uauagcguuuugaaacu

SEQ ID NO: 2191251 - RNA, 15 nt, Streptococcus pneumoniae R6
uauacuuuuaauauu

SEQ ID NO: 2191252 - RNA, 17 nt, Streptococcus pneumoniae R6
uauacuuuucucuuaca

SEQ ID NO: 2191253 - RNA, 15 nt, Streptococcus pneumoniae R6
uauacuuacucuuau

SEQ ID NO: 2191254 - RNA, 17 nt, Streptococcus pneumoniae R6
uauagaaaaauccccca

SEQ ID NO: 2191255 - RNA, 23 nt, Streptococcus pneumoniae R6
uauagaaaacaacuuauaaaaaa

SEQ ID NO: 2191256 - RNA, 12 nt, Streptococcus pneumoniae R6
uauacuuuuuca

SEQ ID NO: 2191257 - RNA, 14 nt, Streptococcus pneumoniae R6
uauacuuuuuuaau

SEQ ID NO: 2191258 - RNA, 19 nt, Streptococcus pneumoniae R6
uauagaaaaaagucuuuaa

SEQ ID NO: 2191259 - RNA, 15 nt, Streptococcus pneumoniae R6
uauagaaauguuuua

SEQ ID NO: 2191260 - RNA, 23 nt, Streptococcus pneumoniae R6
uauacucaaugaaaaucauagaa

SEQ ID NO: 2191261 - RNA, 13 nt, Streptococcus pneumoniae R6
uauacucaucugc

SEQ ID NO: 2191262 - RNA, 13 nt, Streptococcus pneumoniae R6
uauacucuuagaa

SEQ ID NO: 2191263 - RNA, 20 nt, Streptococcus pneumoniae R6
uauacucuuagaaaaucucu

SEQ ID NO: 2191264 - RNA, 13 nt, Streptococcus pneumoniae R6
uauacguuuucuu

SEQ ID NO: 2191265 - RNA, 20 nt, Streptococcus pneumoniae R6
uauacguuuuuugauuuuaa

SEQ ID NO: 2191266 - RNA, 19 nt, Streptococcus pneumoniae R6
uauacuauaguagcucaga

SEQ ID NO: 2191267 - RNA, 15 nt, Streptococcus pneumoniae R6
uauacuaauacauuu

SEQ ID NO: 2191268 - RNA, 16 nt, Streptococcus pneumoniae R6
uauacuauuuuuguca

SEQ ID NO: 2191269 - RNA, 12 nt, Streptococcus pneumoniae R6
uauaccauaaua

SEQ ID NO: 2191270 - RNA, 16 nt, Streptococcus pneumoniae R6
uauacccaaaacacaa

SEQ ID NO: 2191271 - RNA, 20 nt, Streptococcus pneumoniae R6
uauacagucccuuuugaggg

SEQ ID NO: 2191272 - RNA, 12 nt, Streptococcus pneumoniae R6
uauaccacacua

SEQ ID NO: 2191273 - RNA, 21 nt, Streptococcus pneumoniae R6
uauaccacucuugcauuucuu

SEQ ID NO: 2191274 - RNA, 18 nt, Streptococcus pneumoniae R6
uauaccaaaaaaacucca

SEQ ID NO: 2191275 - RNA, 19 nt, Streptococcus pneumoniae R6
uauacaggggauugauuau

SEQ ID NO: 2191276 - RNA, 17 nt, Streptococcus pneumoniae R6
uauaacuuguuuacguu

SEQ ID NO: 2191277 - RNA, 21 nt, Streptococcus pneumoniae R6
uagcgcuugaaacucaucuug

SEQ ID NO: 2191278 - RNA, 21 nt, Streptococcus pneumoniae R6
uagcguaacugguaagaagua

SEQ ID NO: 2191279 - RNA, 20 nt, Streptococcus pneumoniae R6
uagcgauagauguuuucaaa

SEQ ID NO: 2191280 - RNA, 19 nt, Streptococcus pneumoniae R6
uagcgcccuuguucuccaa

SEQ ID NO: 2191281 - RNA, 24 nt, Streptococcus pneumoniae R6
uagccuuugucguuccaaguggca

SEQ ID NO: 2191282 - RNA, 14 nt, Streptococcus pneumoniae R6
uagcgacuauaaaa

SEQ ID NO: 2191283 - RNA, 15 nt, Streptococcus pneumoniae R6
uagcgaaauuccauu

SEQ ID NO: 2191284 - RNA, 15 nt, Streptococcus pneumoniae R6
uagccuuccauauag

SEQ ID NO: 2191285 - RNA, 23 nt, Streptococcus pneumoniae R6
uagccuucuggucugauuuucau

SEQ ID NO: 2191286 - RNA, 16 nt, Streptococcus pneumoniae R6
uagccugugauuuucu

SEQ ID NO: 2191287 - RNA, 17 nt, Streptococcus pneumoniae R6
uagccugugauuuucuu

SEQ ID NO: 2191288 - RNA, 14 nt, Streptococcus pneumoniae R6
uagccucucuaaag

SEQ ID NO: 2191289 - RNA, 17 nt, Streptococcus pneumoniae R6
uagccuccuaguuugcu

SEQ ID NO: 2191290 - RNA, 13 nt, Streptococcus pneumoniae R6
uagccucagcaaa

SEQ ID NO: 2191291 - RNA, 14 nt, Streptococcus pneumoniae R6
uagccuccauucag

SEQ ID NO: 2191292 - RNA, 12 nt, Streptococcus pneumoniae R6
uagcccuucaua

SEQ ID NO: 2191293 - RNA, 14 nt, Streptococcus pneumoniae R6
uagccgcaaacuug

SEQ ID NO: 2191294 - RNA, 19 nt, Streptococcus pneumoniae R6
uagccgcacgugcucaaaa

SEQ ID NO: 2191295 - RNA, 18 nt, Streptococcus pneumoniae R6
uagccgacuccaugccaa

SEQ ID NO: 2191296 - RNA, 15 nt, Streptococcus pneumoniae R6
uagccagugagaaga

SEQ ID NO: 2191297 - RNA, 17 nt, Streptococcus pneumoniae R6
uagccagugagaagaag

SEQ ID NO: 2191298 - RNA, 14 nt, Streptococcus pneumoniae R6
uagccauaaaacau

SEQ ID NO: 2191299 - RNA, 16 nt, Streptococcus pneumoniae R6
uagccauaaaacauuu

SEQ ID NO: 2191300 - RNA, 16 nt, Streptococcus pneumoniae R6
uagccauacguuucau

SEQ ID NO: 2191301 - RNA, 17 nt, Streptococcus pneumoniae R6
uagccauguuuuucucc

SEQ ID NO: 2191302 - RNA, 23 nt, Streptococcus pneumoniae R6
uagccauucccaucaauaucgua

SEQ ID NO: 2191303 - RNA, 19 nt, Streptococcus pneumoniae R6
uagccacucuggcaauuua

SEQ ID NO: 2191304 - RNA, 18 nt, Streptococcus pneumoniae R6
uagcccgagcucaaauca

SEQ ID NO: 2191305 - RNA, 22 nt, Streptococcus pneumoniae R6
uagcuaaaccuuauuuuuuaug

SEQ ID NO: 2191306 - RNA, 17 nt, Streptococcus pneumoniae R6
uagcguugacaauggca

SEQ ID NO: 2191307 - RNA, 20 nt, Streptococcus pneumoniae R6
uagcuccaucuccaacugcu

SEQ ID NO: 2191308 - RNA, 22 nt, Streptococcus pneumoniae R6
uagcuagucuucacuuucccuu

SEQ ID NO: 2191309 - RNA, 17 nt, Streptococcus pneumoniae R6
uagcuagaguuucaauu

SEQ ID NO: 2191310 - RNA, 19 nt, Streptococcus pneumoniae R6
uagcuauuagaccugccau

SEQ ID NO: 2191311 - RNA, 13 nt, Streptococcus pneumoniae R6
uagcuaugaauau

SEQ ID NO: 2191312 - RNA, 20 nt, Streptococcus pneumoniae R6
uagcuuccuaguuugcucuu

SEQ ID NO: 2191313 - RNA, 18 nt, Streptococcus pneumoniae R6
uagcugcggcuuucuuca

SEQ ID NO: 2191314 - RNA, 14 nt, Streptococcus pneumoniae R6
uagcugucaaauca

SEQ ID NO: 2191315 - RNA, 11 nt, Streptococcus pneumoniae R6
uagcuggucaa

SEQ ID NO: 2191316 - RNA, 20 nt, Streptococcus pneumoniae R6
uagcuggugagaagagggag

SEQ ID NO: 2191317 - RNA, 16 nt, Streptococcus pneumoniae R6
uagcugaaccaugucc

SEQ ID NO: 2191318 - RNA, 19 nt, Streptococcus pneumoniae R6
uagcucuuuuguuaauaac

SEQ ID NO: 2191319 - RNA, 16 nt, Streptococcus pneumoniae R6
uagcugcaccacagua

SEQ ID NO: 2191320 - RNA, 18 nt, Streptococcus pneumoniae R6
uagcugauuuuuuacaau

SEQ ID NO: 2191321 - RNA, 18 nt, Streptococcus pneumoniae R6
uagcuccuccaaguccaa

SEQ ID NO: 2191322 - RNA, 18 nt, Streptococcus pneumoniae R6
uagcuccuugugcacacu

SEQ ID NO: 2191323 - RNA, 22 nt, Streptococcus pneumoniae R6
uagcuccuuuaacauuugagug

SEQ ID NO: 2191324 - RNA, 13 nt, Streptococcus pneumoniae R6
uagcucucucuga

SEQ ID NO: 2191325 - RNA, 22 nt, Streptococcus pneumoniae R6
uagcuugaacaaaauuaucaac

SEQ ID NO: 2191326 - RNA, 16 nt, Streptococcus pneumoniae R6
uagcuuucaaguuuug

SEQ ID NO: 2191327 - RNA, 19 nt, Streptococcus pneumoniae R6
uagcuuucaaguuuugaua

SEQ ID NO: 2191328 - RNA, 17 nt, Streptococcus pneumoniae R6
uagcuuucuaguuugcu

SEQ ID NO: 2191329 - RNA, 12 nt, Streptococcus pneumoniae R6
uaggaaaccaau

SEQ ID NO: 2191330 - RNA, 20 nt, Streptococcus pneumoniae R6
uaggaaagaagguguuuuua

SEQ ID NO: 2191331 - RNA, 13 nt, Streptococcus pneumoniae R6
uaggaaaggaaaa

SEQ ID NO: 2191332 - RNA, 13 nt, Streptococcus pneumoniae R6
uagcuuuuuaauu

SEQ ID NO: 2191333 - RNA, 18 nt, Streptococcus pneumoniae R6
uagcuuuuuauauauaau

SEQ ID NO: 2191334 - RNA, 14 nt, Streptococcus pneumoniae R6
uagcuuuuauaaau

SEQ ID NO: 2191335 - RNA, 11 nt, Streptococcus pneumoniae R6
uagcuuuucuu

SEQ ID NO: 2191336 - RNA, 14 nt, Streptococcus pneumoniae R6
uagcuuuucuucaa

SEQ ID NO: 2191337 - RNA, 17 nt, Streptococcus pneumoniae R6
uagcuuuugcagcacca

SEQ ID NO: 2191338 - RNA, 18 nt, Streptococcus pneumoniae R6
uagcuuuugcagcaccag

SEQ ID NO: 2191339 - RNA, 18 nt, Streptococcus pneumoniae R6
uagcuuuuuaauuuugag

SEQ ID NO: 2191340 - RNA, 15 nt, Streptococcus pneumoniae R6
uaggaaucccuggag

SEQ ID NO: 2191341 - RNA, 16 nt, Streptococcus pneumoniae R6
uaggaaucccuggagg

SEQ ID NO: 2191342 - RNA, 15 nt, Streptococcus pneumoniae R6
uaggaaguuuagauu

SEQ ID NO: 2191343 - RNA, 16 nt, Streptococcus pneumoniae R6
uaggaauauuauauaa

SEQ ID NO: 2191344 - RNA, 13 nt, Streptococcus pneumoniae R6
uaggaauauugaa

SEQ ID NO: 2191345 - RNA, 14 nt, Streptococcus pneumoniae R6
uaggaauauugaaa

SEQ ID NO: 2191346 - RNA, 16 nt, Streptococcus pneumoniae R6
uaggaacuuuaguucc

SEQ ID NO: 2191347 - RNA, 18 nt, Streptococcus pneumoniae R6
uaggaaauucaaaugaau

SEQ ID NO: 2191348 - RNA, 23 nt, Streptococcus pneumoniae R6
uaggaacgauguuugcagcacca

SEQ ID NO: 2191349 - RNA, 16 nt, Streptococcus pneumoniae R6
uaggauuucuccuguu

SEQ ID NO: 2191350 - RNA, 17 nt, Streptococcus pneumoniae R6
uaggauuuauuuuucuu

SEQ ID NO: 2191351 - RNA, 22 nt, Streptococcus pneumoniae R6
uaggauuuauuuuucuuuuuca

SEQ ID NO: 2191352 - RNA, 19 nt, Streptococcus pneumoniae R6
uaggauuuggcguuaguua

SEQ ID NO: 2191353 - RNA, 19 nt, Streptococcus pneumoniae R6
uaggauggcuccagaaaua

SEQ ID NO: 2191354 - RNA, 21 nt, Streptococcus pneumoniae R6
uaggauggcuccagaaauaau

SEQ ID NO: 2191355 - RNA, 19 nt, Streptococcus pneumoniae R6
uaggacaagaagaucagag

SEQ ID NO: 2191356 - RNA, 17 nt, Streptococcus pneumoniae R6
uaggacaauuucucgga

SEQ ID NO: 2191357 - RNA, 22 nt, Streptococcus pneumoniae R6
uaggacuuccuuuucuuaucca

SEQ ID NO: 2191358 - RNA, 18 nt, Streptococcus pneumoniae R6
uaggagaaaaagaaguaa

SEQ ID NO: 2191359 - RNA, 23 nt, Streptococcus pneumoniae R6
uaggagaaaaagaaguaaaucuu

SEQ ID NO: 2191360 - RNA, 17 nt, Streptococcus pneumoniae R6
uaggagugaaaaacuag

SEQ ID NO: 2191361 - RNA, 21 nt, Streptococcus pneumoniae R6
uaggauaauauuacuucuaaa

SEQ ID NO: 2191362 - RNA, 14 nt, Streptococcus pneumoniae R6
uaggagagcuaggg

SEQ ID NO: 2191363 - RNA, 13 nt, Streptococcus pneumoniae R6
uaggagauucugu

SEQ ID NO: 2191364 - RNA, 18 nt, Streptococcus pneumoniae R6
uaggagauucuuauaaau

SEQ ID NO: 2191365 - RNA, 13 nt, Streptococcus pneumoniae R6
uagcauccaccac

SEQ ID NO: 2191366 - RNA, 21 nt, Streptococcus pneumoniae R6
uagcauccaucccauuuauau

SEQ ID NO: 2191367 - RNA, 15 nt, Streptococcus pneumoniae R6
uagcaucuucuucug

SEQ ID NO: 2191368 - RNA, 23 nt, Streptococcus pneumoniae R6
uagcaucuugcucgaccaagcca

SEQ ID NO: 2191369 - RNA, 17 nt, Streptococcus pneumoniae R6
uagcaucgcccauggcc

SEQ ID NO: 2191370 - RNA, 13 nt, Streptococcus pneumoniae R6
uagcacuuuucca

SEQ ID NO: 2191371 - RNA, 14 nt, Streptococcus pneumoniae R6
uagcacuuuuccau

SEQ ID NO: 2191372 - RNA, 21 nt, Streptococcus pneumoniae R6
uagcacuuuuccauuguuuua

SEQ ID NO: 2191373 - RNA, 16 nt, Streptococcus pneumoniae R6
uagcagagacauuaga

SEQ ID NO: 2191374 - RNA, 15 nt, Streptococcus pneumoniae R6
uagcagcgguuccau

SEQ ID NO: 2191375 - RNA, 17 nt, Streptococcus pneumoniae R6
uagcagcgguuccauua

SEQ ID NO: 2191376 - RNA, 16 nt, Streptococcus pneumoniae R6
uagcagcuuucaaagc

SEQ ID NO: 2191377 - RNA, 18 nt, Streptococcus pneumoniae R6
uagcagccacuuuuuauc

SEQ ID NO: 2191378 - RNA, 14 nt, Streptococcus pneumoniae R6
uagcauauuuuguu

SEQ ID NO: 2191379 - RNA, 15 nt, Streptococcus pneumoniae R6
uagcauaauagcaga

SEQ ID NO: 2191380 - RNA, 20 nt, Streptococcus pneumoniae R6
uagcauaauagcagaaaaau

SEQ ID NO: 2191381 - RNA, 14 nt, Streptococcus pneumoniae R6
uagcaguaacuucu

SEQ ID NO: 2191382 - RNA, 15 nt, Streptococcus pneumoniae R6
uagcaguaacuucug

SEQ ID NO: 2191383 - RNA, 14 nt, Streptococcus pneumoniae R6
uagauuuauaauuu

SEQ ID NO: 2191384 - RNA, 21 nt, Streptococcus pneumoniae R6
uagauuuuucaaggugaaguu

SEQ ID NO: 2191385 - RNA, 13 nt, Streptococcus pneumoniae R6
uagauuucugaau

SEQ ID NO: 2191386 - RNA, 23 nt, Streptococcus pneumoniae R6
uagcaaagucaacucgggcgagg

SEQ ID NO: 2191387 - RNA, 17 nt, Streptococcus pneumoniae R6
uagcaaagacuucaacc

SEQ ID NO: 2191388 - RNA, 20 nt, Streptococcus pneumoniae R6
uagcaaacuaaauaccuuau

SEQ ID NO: 2191389 - RNA, 13 nt, Streptococcus pneumoniae R6
uagauuuuuucug

SEQ ID NO: 2191390 - RNA, 17 nt, Streptococcus pneumoniae R6
uagcaaaaaagcaaaua

SEQ ID NO: 2191391 - RNA, 22 nt, Streptococcus pneumoniae R6
uagcaacuguuuuuucaacagc

SEQ ID NO: 2191392 - RNA, 14 nt, Streptococcus pneumoniae R6
uagcaaccuuuuuu

SEQ ID NO: 2191393 - RNA, 18 nt, Streptococcus pneumoniae R6
uagcaagaguuuuucucg

SEQ ID NO: 2191394 - RNA, 23 nt, Streptococcus pneumoniae R6
uagcaaucuuccuuacuagcaaa

SEQ ID NO: 2191395 - RNA, 20 nt, Streptococcus pneumoniae R6
uagcaaucacucuaacuucu

SEQ ID NO: 2191396 - RNA, 22 nt, Streptococcus pneumoniae R6
uagcaaucacucuaacuucugc

SEQ ID NO: 2191397 - RNA, 18 nt, Streptococcus pneumoniae R6
uagcaaugccaaagguaa

SEQ ID NO: 2191398 - RNA, 19 nt, Streptococcus pneumoniae R6
uagcaccuguggcuguuuu

SEQ ID NO: 2191399 - RNA, 13 nt, Streptococcus pneumoniae R6
uagcacuuaaaaa

SEQ ID NO: 2191400 - RNA, 14 nt, Streptococcus pneumoniae R6
uagcaccaaaagca

SEQ ID NO: 2191401 - RNA, 21 nt, Streptococcus pneumoniae R6
uagcacaugacaaauucucca

SEQ ID NO: 2191402 - RNA, 18 nt, Streptococcus pneumoniae R6
uagcaauucuugguugcc

SEQ ID NO: 2191403 - RNA, 14 nt, Streptococcus pneumoniae R6
uagcaauuguuucg

SEQ ID NO: 2191404 - RNA, 16 nt, Streptococcus pneumoniae R6
uagauauaauuguaaa

SEQ ID NO: 2191405 - RNA, 12 nt, Streptococcus pneumoniae R6
uagauauagaau

SEQ ID NO: 2191406 - RNA, 15 nt, Streptococcus pneumoniae R6
uagauaguuuugcaa

SEQ ID NO: 2191407 - RNA, 16 nt, Streptococcus pneumoniae R6
uagauaguuaaaugua

SEQ ID NO: 2191408 - RNA, 23 nt, Streptococcus pneumoniae R6
uagaucugauagugguguuucaa

SEQ ID NO: 2191409 - RNA, 14 nt, Streptococcus pneumoniae R6
uagaucuuuacuug

SEQ ID NO: 2191410 - RNA, 14 nt, Streptococcus pneumoniae R6
uagauccuuuuaau

SEQ ID NO: 2191411 - RNA, 11 nt, Streptococcus pneumoniae R6
uagaucaucug

SEQ ID NO: 2191412 - RNA, 19 nt, Streptococcus pneumoniae R6
uagaucaucugcuuugauu

SEQ ID NO: 2191413 - RNA, 15 nt, Streptococcus pneumoniae R6
uagauugaaacuaga

SEQ ID NO: 2191414 - RNA, 16 nt, Streptococcus pneumoniae R6
uagauuggauaaaauc

SEQ ID NO: 2191415 - RNA, 19 nt, Streptococcus pneumoniae R6
uagauuggauaaaaucuuu

SEQ ID NO: 2191416 - RNA, 23 nt, Streptococcus pneumoniae R6
uagauuggcaggcguuuuuugau

SEQ ID NO: 2191417 - RNA, 15 nt, Streptococcus pneumoniae R6
uagauuccuucuugu

SEQ ID NO: 2191418 - RNA, 13 nt, Streptococcus pneumoniae R6
uagauuacaaaaa

SEQ ID NO: 2191419 - RNA, 13 nt, Streptococcus pneumoniae R6
uagauguuuucaa

SEQ ID NO: 2191420 - RNA, 14 nt, Streptococcus pneumoniae R6
uagaugauuggaaa

SEQ ID NO: 2191421 - RNA, 15 nt, Streptococcus pneumoniae R6
uagaugauuuuucug

SEQ ID NO: 2191422 - RNA, 17 nt, Streptococcus pneumoniae R6
uagaugauuuuucuguu

SEQ ID NO: 2191423 - RNA, 20 nt, Streptococcus pneumoniae R6
uagaugagaaaaagccucca

SEQ ID NO: 2191424 - RNA, 22 nt, Streptococcus pneumoniae R6
uagaugagauuucgcuccagca

SEQ ID NO: 2191425 - RNA, 22 nt, Streptococcus pneumoniae R6
uagaugaucgagcagauuucuu

SEQ ID NO: 2191426 - RNA, 17 nt, Streptococcus pneumoniae R6
uagaguagucugggugc

SEQ ID NO: 2191427 - RNA, 22 nt, Streptococcus pneumoniae R6
uagaguagugcucguaaaauuc

SEQ ID NO: 2191428 - RNA, 15 nt, Streptococcus pneumoniae R6
uagaguccaaagacc

SEQ ID NO: 2191429 - RNA, 16 nt, Streptococcus pneumoniae R6
uagaguccaaagacca

SEQ ID NO: 2191430 - RNA, 21 nt, Streptococcus pneumoniae R6
uagagguguacuauucuaguu

SEQ ID NO: 2191431 - RNA, 17 nt, Streptococcus pneumoniae R6
uagagcuaacuuuuccu

SEQ ID NO: 2191432 - RNA, 18 nt, Streptococcus pneumoniae R6
uagagcuaacuuuuccuu

SEQ ID NO: 2191433 - RNA, 15 nt, Streptococcus pneumoniae R6
uagagccuucuucca

SEQ ID NO: 2191434 - RNA, 16 nt, Streptococcus pneumoniae R6
uagagccuucuuccau

SEQ ID NO: 2191435 - RNA, 11 nt, Streptococcus pneumoniae R6
uagagagacag

SEQ ID NO: 2191436 - RNA, 17 nt, Streptococcus pneumoniae R6
uagagagcuccaaagaa

SEQ ID NO: 2191437 - RNA, 17 nt, Streptococcus pneumoniae R6
uagagaguuaaaaaaag

SEQ ID NO: 2191438 - RNA, 20 nt, Streptococcus pneumoniae R6
uagagaguucugaaaucagu

SEQ ID NO: 2191439 - RNA, 22 nt, Streptococcus pneumoniae R6
uagagauaccuuuuccuucauu

SEQ ID NO: 2191440 - RNA, 17 nt, Streptococcus pneumoniae R6
uagagauuauaguggug

SEQ ID NO: 2191441 - RNA, 21 nt, Streptococcus pneumoniae R6
uagagauuauccccuacucga

SEQ ID NO: 2191442 - RNA, 12 nt, Streptococcus pneumoniae R6
uagauaaaagaa

SEQ ID NO: 2191443 - RNA, 20 nt, Streptococcus pneumoniae R6
uagauaaaagaaugcucaga

SEQ ID NO: 2191444 - RNA, 20 nt, Streptococcus pneumoniae R6
uagauaaaacuauugacuuu

SEQ ID NO: 2191445 - RNA, 13 nt, Streptococcus pneumoniae R6
uagaguuuugguu

SEQ ID NO: 2191446 - RNA, 23 nt, Streptococcus pneumoniae R6
uagaguguuaucugaaaauuaau

SEQ ID NO: 2191447 - RNA, 20 nt, Streptococcus pneumoniae R6
uagagucucuuaauaucagc

SEQ ID NO: 2191448 - RNA, 14 nt, Streptococcus pneumoniae R6
uagauaagacugac

SEQ ID NO: 2191449 - RNA, 12 nt, Streptococcus pneumoniae R6
uagauagaacug

SEQ ID NO: 2191450 - RNA, 18 nt, Streptococcus pneumoniae R6
uagauaccugguucagca

SEQ ID NO: 2191451 - RNA, 22 nt, Streptococcus pneumoniae R6
uagauacccaagguauuucagu

SEQ ID NO: 2191452 - RNA, 13 nt, Streptococcus pneumoniae R6
uagauacauuuuu

SEQ ID NO: 2191453 - RNA, 17 nt, Streptococcus pneumoniae R6
uagauacaaaaccaaac

SEQ ID NO: 2191454 - RNA, 22 nt, Streptococcus pneumoniae R6
uagauacagugaaggcuuuaaa

SEQ ID NO: 2191455 - RNA, 19 nt, Streptococcus pneumoniae R6
uaccaccuuuaaauccugc

SEQ ID NO: 2191456 - RNA, 20 nt, Streptococcus pneumoniae R6
uaccacuuccuaccuauuca

SEQ ID NO: 2191457 - RNA, 21 nt, Streptococcus pneumoniae R6
uaccuacgauaucugaagaua

SEQ ID NO: 2191458 - RNA, 19 nt, Streptococcus pneumoniae R6
uaccuauucauauaugcua

SEQ ID NO: 2191459 - RNA, 14 nt, Streptococcus pneumoniae R6
uaccucauaucucu

SEQ ID NO: 2191460 - RNA, 19 nt, Streptococcus pneumoniae R6
uaccucauaucucuuguau

SEQ ID NO: 2191461 - RNA, 16 nt, Streptococcus pneumoniae R6
uaccuucuuuaucauu

SEQ ID NO: 2191462 - RNA, 18 nt, Streptococcus pneumoniae R6
uaccuugaucggaagcua

SEQ ID NO: 2191463 - RNA, 20 nt, Streptococcus pneumoniae R6
uaccuugaauuuugugagga

SEQ ID NO: 2191464 - RNA, 24 nt, Streptococcus pneumoniae R6
uaccuucagccacggcacguucca

SEQ ID NO: 2191465 - RNA, 18 nt, Streptococcus pneumoniae R6
uaccuucaaguuguuuga

SEQ ID NO: 2191466 - RNA, 22 nt, Streptococcus pneumoniae R6
uaccuuuccuccgauaauuauu

SEQ ID NO: 2191467 - RNA, 13 nt, Streptococcus pneumoniae R6
uaccuuucucgag

SEQ ID NO: 2191468 - RNA, 14 nt, Streptococcus pneumoniae R6
uaccuuucuuguaa

SEQ ID NO: 2191469 - RNA, 22 nt, Streptococcus pneumoniae R6
uacgaaacaauugcuaaaacau

SEQ ID NO: 2191470 - RNA, 18 nt, Streptococcus pneumoniae R6
uaccucuuuuuauucuuu

SEQ ID NO: 2191471 - RNA, 20 nt, Streptococcus pneumoniae R6
uaccugaaauauacucauaa

SEQ ID NO: 2191472 - RNA, 23 nt, Streptococcus pneumoniae R6
uaccugauaagauuuuuggaaaa

SEQ ID NO: 2191473 - RNA, 14 nt, Streptococcus pneumoniae R6
uaccugccuuccaa

SEQ ID NO: 2191474 - RNA, 15 nt, Streptococcus pneumoniae R6
uaccugccuuccaag

SEQ ID NO: 2191475 - RNA, 21 nt, Streptococcus pneumoniae R6
uaccugcggauaaaagagaau

SEQ ID NO: 2191476 - RNA, 23 nt, Streptococcus pneumoniae R6
uaccugcucgccccauuucuuca

SEQ ID NO: 2191477 - RNA, 23 nt, Streptococcus pneumoniae R6
uaccugcuaccguugaaaucaau

SEQ ID NO: 2191478 - RNA, 20 nt, Streptococcus pneumoniae R6
uacuccaaaacaucugguuu

SEQ ID NO: 2191479 - RNA, 16 nt, Streptococcus pneumoniae R6
uacucauaaagucuuu

SEQ ID NO: 2191480 - RNA, 16 nt, Streptococcus pneumoniae R6
uacucaucugcuuuca

SEQ ID NO: 2191481 - RNA, 14 nt, Streptococcus pneumoniae R6
uacucaggauaaaa

SEQ ID NO: 2191482 - RNA, 22 nt, Streptococcus pneumoniae R6
uacucaggauaaaaccaaaaag

SEQ ID NO: 2191483 - RNA, 23 nt, Streptococcus pneumoniae R6
uacucaguauuuggauuaugaaa

SEQ ID NO: 2191484 - RNA, 22 nt, Streptococcus pneumoniae R6
uacucaaucccauauuuuuccu

SEQ ID NO: 2191485 - RNA, 14 nt, Streptococcus pneumoniae R6
uacucaaugaaaau

SEQ ID NO: 2191486 - RNA, 16 nt, Streptococcus pneumoniae R6
uacucaaugaaaauca

SEQ ID NO: 2191487 - RNA, 19 nt, Streptococcus pneumoniae R6
uacucaaggacuaaguuca

SEQ ID NO: 2191488 - RNA, 16 nt, Streptococcus pneumoniae R6
uacucaaguccuuuug

SEQ ID NO: 2191489 - RNA, 20 nt, Streptococcus pneumoniae R6
uacuaugggaagauuuacuu

SEQ ID NO: 2191490 - RNA, 18 nt, Streptococcus pneumoniae R6
uacuaugcguuuuauugu

SEQ ID NO: 2191491 - RNA, 16 nt, Streptococcus pneumoniae R6
uacuaugcguuuucua

SEQ ID NO: 2191492 - RNA, 21 nt, Streptococcus pneumoniae R6
uacuauugaguucacaaauga

SEQ ID NO: 2191493 - RNA, 17 nt, Streptococcus pneumoniae R6
uacuauucuaguuucaa

SEQ ID NO: 2191494 - RNA, 14 nt, Streptococcus pneumoniae R6
uacguuuuaaaaaa

SEQ ID NO: 2191495 - RNA, 14 nt, Streptococcus pneumoniae R6
uacguuuuaucaua

SEQ ID NO: 2191496 - RNA, 13 nt, Streptococcus pneumoniae R6
uacguuuuuacua

SEQ ID NO: 2191497 - RNA, 13 nt, Streptococcus pneumoniae R6
uacguucaaauuc

SEQ ID NO: 2191498 - RNA, 19 nt, Streptococcus pneumoniae R6
uacguucauccauaucuuu

SEQ ID NO: 2191499 - RNA, 20 nt, Streptococcus pneumoniae R6
uacuauccucauuagauagu

SEQ ID NO: 2191500 - RNA, 14 nt, Streptococcus pneumoniae R6
uacuauauaucaua

SEQ ID NO: 2191501 - RNA, 17 nt, Streptococcus pneumoniae R6
uacuauacgacaugccu

SEQ ID NO: 2191502 - RNA, 20 nt, Streptococcus pneumoniae R6
uacuauacgacaugccuguc

SEQ ID NO: 2191503 - RNA, 17 nt, Streptococcus pneumoniae R6
uacuaaaacauuucuau

SEQ ID NO: 2191504 - RNA, 15 nt, Streptococcus pneumoniae R6
uacgaucugaaauaa

SEQ ID NO: 2191505 - RNA, 20 nt, Streptococcus pneumoniae R6
uacgaaucaauacagaagaa

SEQ ID NO: 2191506 - RNA, 16 nt, Streptococcus pneumoniae R6
uacgaaucucuuucca

SEQ ID NO: 2191507 - RNA, 12 nt, Streptococcus pneumoniae R6
uacgaauuauuu

SEQ ID NO: 2191508 - RNA, 15 nt, Streptococcus pneumoniae R6
uacgaauuauuuccu

SEQ ID NO: 2191509 - RNA, 18 nt, Streptococcus pneumoniae R6
uacgaauuauuuccuuga

SEQ ID NO: 2191510 - RNA, 15 nt, Streptococcus pneumoniae R6
uacgugucaaagcau

SEQ ID NO: 2191511 - RNA, 18 nt, Streptococcus pneumoniae R6
uacggauaacgucuucag

SEQ ID NO: 2191512 - RNA, 23 nt, Streptococcus pneumoniae R6
uagaaucgucuguacaaauccca

SEQ ID NO: 2191513 - RNA, 18 nt, Streptococcus pneumoniae R6
uagaauuggagaaugaua

SEQ ID NO: 2191514 - RNA, 23 nt, Streptococcus pneumoniae R6
uagaauucgauuugacuguccug

SEQ ID NO: 2191515 - RNA, 15 nt, Streptococcus pneumoniae R6
uagaaugucuuccaa

SEQ ID NO: 2191516 - RNA, 17 nt, Streptococcus pneumoniae R6
uagaauaaggaaaacau

SEQ ID NO: 2191517 - RNA, 22 nt, Streptococcus pneumoniae R6
uagaagcuucuuggaauucugg

SEQ ID NO: 2191518 - RNA, 15 nt, Streptococcus pneumoniae R6
uagaaggucaagaga

SEQ ID NO: 2191519 - RNA, 18 nt, Streptococcus pneumoniae R6
uagaaggucaagagaaaa

SEQ ID NO: 2191520 - RNA, 19 nt, Streptococcus pneumoniae R6
uagaaggucaagagaaaac

SEQ ID NO: 2191521 - RNA, 20 nt, Streptococcus pneumoniae R6
uagaauagaaacaaaauaua

SEQ ID NO: 2191522 - RNA, 21 nt, Streptococcus pneumoniae R6
uagaauaugaacauuuuccga

SEQ ID NO: 2191523 - RNA, 14 nt, Streptococcus pneumoniae R6
uagaauaguacacu

SEQ ID NO: 2191524 - RNA, 20 nt, Streptococcus pneumoniae R6
uagaacaggacaacauaacu

SEQ ID NO: 2191525 - RNA, 15 nt, Streptococcus pneumoniae R6
uagaagacuuuuguu

SEQ ID NO: 2191526 - RNA, 19 nt, Streptococcus pneumoniae R6
uagaacugacgaagucagu

SEQ ID NO: 2191527 - RNA, 16 nt, Streptococcus pneumoniae R6
uagaagauuuccucca

SEQ ID NO: 2191528 - RNA, 18 nt, Streptococcus pneumoniae R6
uagaagauuuccuccaua

SEQ ID NO: 2191529 - RNA, 17 nt, Streptococcus pneumoniae R6
uagaagcaagacaaaaa

SEQ ID NO: 2191530 - RNA, 16 nt, Streptococcus pneumoniae R6
uagaagauaaagaguc

SEQ ID NO: 2191531 - RNA, 14 nt, Streptococcus pneumoniae R6
uagaagcagaggug

SEQ ID NO: 2191532 - RNA, 21 nt, Streptococcus pneumoniae R6
uagacaggauaucaucgcuug

SEQ ID NO: 2191533 - RNA, 22 nt, Streptococcus pneumoniae R6
uagaccaagaacucuucugguu

SEQ ID NO: 2191534 - RNA, 22 nt, Streptococcus pneumoniae R6
uagacccuauauuucaagaauu

SEQ ID NO: 2191535 - RNA, 13 nt, Streptococcus pneumoniae R6
uagacagaaaaaa

SEQ ID NO: 2191536 - RNA, 20 nt, Streptococcus pneumoniae R6
uagacaauuuucauccauga

SEQ ID NO: 2191537 - RNA, 15 nt, Streptococcus pneumoniae R6
uagaauuucuuuauu

SEQ ID NO: 2191538 - RNA, 18 nt, Streptococcus pneumoniae R6
uagaauuucuuuauuagu

SEQ ID NO: 2191539 - RNA, 12 nt, Streptococcus pneumoniae R6
uagacuucaaca

SEQ ID NO: 2191540 - RNA, 17 nt, Streptococcus pneumoniae R6
uagacucuuauuucuca

SEQ ID NO: 2191541 - RNA, 18 nt, Streptococcus pneumoniae R6
uagacugaaucuaaaaua

SEQ ID NO: 2191542 - RNA, 17 nt, Streptococcus pneumoniae R6
uagacugaaucugaaau

SEQ ID NO: 2191543 - RNA, 17 nt, Streptococcus pneumoniae R6
uagacuaacuucuuauu

SEQ ID NO: 2191544 - RNA, 16 nt, Streptococcus pneumoniae R6
uagacuauaacagaga

SEQ ID NO: 2191545 - RNA, 17 nt, Streptococcus pneumoniae R6
uagaccugaucaaaggg

SEQ ID NO: 2191546 - RNA, 13 nt, Streptococcus pneumoniae R6
uagacgaauaaag

SEQ ID NO: 2191547 - RNA, 19 nt, Streptococcus pneumoniae R6
uagacgaauaaagaaacuu

SEQ ID NO: 2191548 - RNA, 18 nt, Streptococcus pneumoniae R6
uagacuuccugcaaaacu

SEQ ID NO: 2191549 - RNA, 18 nt, Streptococcus pneumoniae R6
uagagaaagaaaaacugc

SEQ ID NO: 2191550 - RNA, 19 nt, Streptococcus pneumoniae R6
uagagaaagaaaaacugcu

SEQ ID NO: 2191551 - RNA, 20 nt, Streptococcus pneumoniae R6
uagagaaagaaaaacugcuu

SEQ ID NO: 2191552 - RNA, 11 nt, Streptococcus pneumoniae R6
uagagaagcca

SEQ ID NO: 2191553 - RNA, 22 nt, Streptococcus pneumoniae R6
uagagaaggacagguuuaucuu

SEQ ID NO: 2191554 - RNA, 20 nt, Streptococcus pneumoniae R6
uagagagaaaggagcacagu

SEQ ID NO: 2191555 - RNA, 22 nt, Streptococcus pneumoniae R6
uagagaccaacuccucucuccu

SEQ ID NO: 2191556 - RNA, 14 nt, Streptococcus pneumoniae R6
uagaaaauucaaau

SEQ ID NO: 2191557 - RNA, 16 nt, Streptococcus pneumoniae R6
uagaaaauucaaauua

SEQ ID NO: 2191558 - RNA, 20 nt, Streptococcus pneumoniae R6
uagaaacaucgaaagcaaau

SEQ ID NO: 2191559 - RNA, 13 nt, Streptococcus pneumoniae R6
uagaaaaucucuu

SEQ ID NO: 2191560 - RNA, 15 nt, Streptococcus pneumoniae R6
uagaaaaucucuuca

SEQ ID NO: 2191561 - RNA, 16 nt, Streptococcus pneumoniae R6
uagaaaaucucuucaa

SEQ ID NO: 2191562 - RNA, 13 nt, Streptococcus pneumoniae R6
uagaaaaugaaau

SEQ ID NO: 2191563 - RNA, 16 nt, Streptococcus pneumoniae R6
uagaaaaugaaauaca

SEQ ID NO: 2191564 - RNA, 20 nt, Streptococcus pneumoniae R6
uagaaaaugaaauacauauu

SEQ ID NO: 2191565 - RNA, 19 nt, Streptococcus pneumoniae R6
uagaaaaugaaauuuuucu

SEQ ID NO: 2191566 - RNA, 15 nt, Streptococcus pneumoniae R6
uagaaaaugaggaaa

SEQ ID NO: 2191567 - RNA, 20 nt, Streptococcus pneumoniae R6
uagaaagauuugcuggauag

SEQ ID NO: 2191568 - RNA, 20 nt, Streptococcus pneumoniae R6
uagaaagguaaaauauagaa

SEQ ID NO: 2191569 - RNA, 21 nt, Streptococcus pneumoniae R6
uagaaaggagcagauuuguug

SEQ ID NO: 2191570 - RNA, 15 nt, Streptococcus pneumoniae R6
uagaaauaaaacucu

SEQ ID NO: 2191571 - RNA, 12 nt, Streptococcus pneumoniae R6
uagaaagucuuu

SEQ ID NO: 2191572 - RNA, 17 nt, Streptococcus pneumoniae R6
uagaaagguuuuaaaga

SEQ ID NO: 2191573 - RNA, 19 nt, Streptococcus pneumoniae R6
uagaaagguuuuaaagaca

SEQ ID NO: 2191574 - RNA, 21 nt, Streptococcus pneumoniae R6
uagaaagguuuuaaagacagu

SEQ ID NO: 2191575 - RNA, 19 nt, Streptococcus pneumoniae R6
uagaaaguauagucaauua

SEQ ID NO: 2191576 - RNA, 15 nt, Streptococcus pneumoniae R6
uagaaauguuuuagu

SEQ ID NO: 2191577 - RNA, 11 nt, Streptococcus pneumoniae R6
uagaaauuaau

SEQ ID NO: 2191578 - RNA, 21 nt, Streptococcus pneumoniae R6
uagaaaucucuuuuuucucca

SEQ ID NO: 2191579 - RNA, 23 nt, Streptococcus pneumoniae R6
uagaaauagcagagacauuagaa

SEQ ID NO: 2191580 - RNA, 21 nt, Streptococcus pneumoniae R6
uagaaauagagguguacuauu

SEQ ID NO: 2191581 - RNA, 14 nt, Streptococcus pneumoniae R6
uagaaauauaguaa

SEQ ID NO: 2191582 - RNA, 12 nt, Streptococcus pneumoniae R6
uagaaauaucug

SEQ ID NO: 2191583 - RNA, 20 nt, Streptococcus pneumoniae R6
uagaaaagcccuucauaagc

SEQ ID NO: 2191584 - RNA, 21 nt, Streptococcus pneumoniae R6
uagaaaacaacuuauaaaaaa

SEQ ID NO: 2191585 - RNA, 23 nt, Streptococcus pneumoniae R6
uagaaaacaacuuauaaaaaaca

SEQ ID NO: 2191586 - RNA, 18 nt, Streptococcus pneumoniae R6
uagaaaaaugcaaagacc

SEQ ID NO: 2191587 - RNA, 16 nt, Streptococcus pneumoniae R6
uagaaaaagcuucauu

SEQ ID NO: 2191588 - RNA, 23 nt, Streptococcus pneumoniae R6
uagaaaaagcuucauuuaucuuc

SEQ ID NO: 2191589 - RNA, 11 nt, Streptococcus pneumoniae R6
uagaaaaagua

SEQ ID NO: 2191590 - RNA, 14 nt, Streptococcus pneumoniae R6
uagaaaaagucuga

SEQ ID NO: 2191591 - RNA, 15 nt, Streptococcus pneumoniae R6
uagaaaaaguucaau

SEQ ID NO: 2191592 - RNA, 17 nt, Streptococcus pneumoniae R6
uagaaaaaguucaauuu

SEQ ID NO: 2191593 - RNA, 11 nt, Streptococcus pneumoniae R6
uagaaaaaagc

SEQ ID NO: 2191594 - RNA, 14 nt, Streptococcus pneumoniae R6
uacuuuuuccuggu

SEQ ID NO: 2191595 - RNA, 20 nt, Streptococcus pneumoniae R6
uacuuuuuauuacaucuauc

SEQ ID NO: 2191596 - RNA, 17 nt, Streptococcus pneumoniae R6
uacuuugagcaaccugc

SEQ ID NO: 2191597 - RNA, 12 nt, Streptococcus pneumoniae R6
uacuucuaaaac

SEQ ID NO: 2191598 - RNA, 12 nt, Streptococcus pneumoniae R6
uacuugcuuccc

SEQ ID NO: 2191599 - RNA, 18 nt, Streptococcus pneumoniae R6
uacuuagcuaauuuucua

SEQ ID NO: 2191600 - RNA, 18 nt, Streptococcus pneumoniae R6
uacuucauguuuuccuaa

SEQ ID NO: 2191601 - RNA, 20 nt, Streptococcus pneumoniae R6
uacuucauguuuuccuaauu

SEQ ID NO: 2191602 - RNA, 16 nt, Streptococcus pneumoniae R6
uacuuccuuuuuaaau

SEQ ID NO: 2191603 - RNA, 18 nt, Streptococcus pneumoniae R6
uacuuccguaaucuuguu

SEQ ID NO: 2191604 - RNA, 17 nt, Streptococcus pneumoniae R6
uacuuccugcucaaaau

SEQ ID NO: 2191605 - RNA, 19 nt, Streptococcus pneumoniae R6
uacuucccacccauauuuu

SEQ ID NO: 2191606 - RNA, 20 nt, Streptococcus pneumoniae R6
uacugggcacggugauuuuu

SEQ ID NO: 2191607 - RNA, 13 nt, Streptococcus pneumoniae R6
uacuccuuuucua

SEQ ID NO: 2191608 - RNA, 21 nt, Streptococcus pneumoniae R6
uacuccgugaagugaaaggag

SEQ ID NO: 2191609 - RNA, 17 nt, Streptococcus pneumoniae R6
uacuuaaacgugcuaua

SEQ ID NO: 2191610 - RNA, 14 nt, Streptococcus pneumoniae R6
uacuguauuucuuu

SEQ ID NO: 2191611 - RNA, 14 nt, Streptococcus pneumoniae R6
uacuguccuucuuu

SEQ ID NO: 2191612 - RNA, 21 nt, Streptococcus pneumoniae R6
uacuguccuucuuuuacuucu

SEQ ID NO: 2191613 - RNA, 23 nt, Streptococcus pneumoniae R6
uacuguccuucuuuuacuucuuu

SEQ ID NO: 2191614 - RNA, 15 nt, Streptococcus pneumoniae R6
uacuguacguuuuau

SEQ ID NO: 2191615 - RNA, 20 nt, Streptococcus pneumoniae R6
uacuguacguuuuaucauag

SEQ ID NO: 2191616 - RNA, 15 nt, Streptococcus pneumoniae R6
uacuuagccaaguca

SEQ ID NO: 2191617 - RNA, 14 nt, Streptococcus pneumoniae R6
uacuuaccgagaau

SEQ ID NO: 2191618 - RNA, 15 nt, Streptococcus pneumoniae R6
uaauuggaaaauaaa

SEQ ID NO: 2191619 - RNA, 19 nt, Streptococcus pneumoniae R6
uaauuggaaaauaaaucca

SEQ ID NO: 2191620 - RNA, 23 nt, Streptococcus pneumoniae R6
uaauuguagcuuuauuaagcccu

SEQ ID NO: 2191621 - RNA, 16 nt, Streptococcus pneumoniae R6
uaauuguaaacaaaaa

SEQ ID NO: 2191622 - RNA, 15 nt, Streptococcus pneumoniae R6
uaauuguaaagacuu

SEQ ID NO: 2191623 - RNA, 17 nt, Streptococcus pneumoniae R6
uaauuguuccauaugau

SEQ ID NO: 2191624 - RNA, 21 nt, Streptococcus pneumoniae R6
uaauugaaaacgguaacaaaa

SEQ ID NO: 2191625 - RNA, 14 nt, Streptococcus pneumoniae R6
uaauugaauuucaa

SEQ ID NO: 2191626 - RNA, 15 nt, Streptococcus pneumoniae R6
uaauuuaaagagauu

SEQ ID NO: 2191627 - RNA, 19 nt, Streptococcus pneumoniae R6
uaauuuaauccacuauaau

SEQ ID NO: 2191628 - RNA, 22 nt, Streptococcus pneumoniae R6
uaauuuagagaaugaaauauag

SEQ ID NO: 2191629 - RNA, 19 nt, Streptococcus pneumoniae R6
uaauuucuacuguauacuu

SEQ ID NO: 2191630 - RNA, 13 nt, Streptococcus pneumoniae R6
uaauuucugaaau

SEQ ID NO: 2191631 - RNA, 15 nt, Streptococcus pneumoniae R6
uaauuucugaaauca

SEQ ID NO: 2191632 - RNA, 21 nt, Streptococcus pneumoniae R6
uaauuuauagaaauauuuuag

SEQ ID NO: 2191633 - RNA, 15 nt, Streptococcus pneumoniae R6
uaauuuccucugaga

SEQ ID NO: 2191634 - RNA, 16 nt, Streptococcus pneumoniae R6
uaauuuccucugagaa

SEQ ID NO: 2191635 - RNA, 18 nt, Streptococcus pneumoniae R6
uaauuucgcuguuaaagc

SEQ ID NO: 2191636 - RNA, 20 nt, Streptococcus pneumoniae R6
uaauuucgcuguuaaagcca

SEQ ID NO: 2191637 - RNA, 18 nt, Streptococcus pneumoniae R6
uaauuuccauaccaaagu

SEQ ID NO: 2191638 - RNA, 16 nt, Streptococcus pneumoniae R6
uaauucucuaaauaag

SEQ ID NO: 2191639 - RNA, 14 nt, Streptococcus pneumoniae R6
uaauucuaaaucuu

SEQ ID NO: 2191640 - RNA, 16 nt, Streptococcus pneumoniae R6
uaauucuaacaccuuu

SEQ ID NO: 2191641 - RNA, 19 nt, Streptococcus pneumoniae R6
uaauucuaacaccuuuauu

SEQ ID NO: 2191642 - RNA, 20 nt, Streptococcus pneumoniae R6
uaauucggugguauuuagau

SEQ ID NO: 2191643 - RNA, 22 nt, Streptococcus pneumoniae R6
uaauucggugguauuuagauuc

SEQ ID NO: 2191644 - RNA, 15 nt, Streptococcus pneumoniae R6
uaauuaguucagaau

SEQ ID NO: 2191645 - RNA, 21 nt, Streptococcus pneumoniae R6
uaauuaguucagaauuuucuu

SEQ ID NO: 2191646 - RNA, 22 nt, Streptococcus pneumoniae R6
uaauuauaggacguuuucagau

SEQ ID NO: 2191647 - RNA, 16 nt, Streptococcus pneumoniae R6
uaauuaaaucauccau

SEQ ID NO: 2191648 - RNA, 19 nt, Streptococcus pneumoniae R6
uaauuaacugguuaauuaa

SEQ ID NO: 2191649 - RNA, 19 nt, Streptococcus pneumoniae R6
uaauuagucguaaauaaua

SEQ ID NO: 2191650 - RNA, 14 nt, Streptococcus pneumoniae R6
uaaugguugggaag

SEQ ID NO: 2191651 - RNA, 15 nt, Streptococcus pneumoniae R6
uaaugguaucacauu

SEQ ID NO: 2191652 - RNA, 15 nt, Streptococcus pneumoniae R6
uaaugguuauaucug

SEQ ID NO: 2191653 - RNA, 14 nt, Streptococcus pneumoniae R6
uaauggcuuguucc

SEQ ID NO: 2191654 - RNA, 16 nt, Streptococcus pneumoniae R6
uaaugggccaaaucau

SEQ ID NO: 2191655 - RNA, 19 nt, Streptococcus pneumoniae R6
uaaugggcgcauuuuccuu

SEQ ID NO: 2191656 - RNA, 18 nt, Streptococcus pneumoniae R6
uaauggguguuuauaggc

SEQ ID NO: 2191657 - RNA, 22 nt, Streptococcus pneumoniae R6
uaaugacuuguguuuuuccuuu

SEQ ID NO: 2191658 - RNA, 14 nt, Streptococcus pneumoniae R6
uaaugcaguaaauc

SEQ ID NO: 2191659 - RNA, 14 nt, Streptococcus pneumoniae R6
uaaugcuuuccauu

SEQ ID NO: 2191660 - RNA, 19 nt, Streptococcus pneumoniae R6
uaauggauugaaauaagau

SEQ ID NO: 2191661 - RNA, 16 nt, Streptococcus pneumoniae R6
uaauggauugauacuc

SEQ ID NO: 2191662 - RNA, 16 nt, Streptococcus pneumoniae R6
uaauggccaccuucaa

SEQ ID NO: 2191663 - RNA, 13 nt, Streptococcus pneumoniae R6
uaaugaagacauc

SEQ ID NO: 2191664 - RNA, 22 nt, Streptococcus pneumoniae R6
uaaugaagacaucauauaaaua

SEQ ID NO: 2191665 - RNA, 22 nt, Streptococcus pneumoniae R6
uaaugacaauuauauaaaccaa

SEQ ID NO: 2191666 - RNA, 14 nt, Streptococcus pneumoniae R6
uaaugacagugauu

SEQ ID NO: 2191667 - RNA, 18 nt, Streptococcus pneumoniae R6
uaaugacagugauuaaaa

SEQ ID NO: 2191668 - RNA, 23 nt, Streptococcus pneumoniae R6
uaaucuucaaauuuuucauaauu

SEQ ID NO: 2191669 - RNA, 16 nt, Streptococcus pneumoniae R6
uaaucuuaaaguuauu

SEQ ID NO: 2191670 - RNA, 18 nt, Streptococcus pneumoniae R6
uaaucuuggcaaaacgug

SEQ ID NO: 2191671 - RNA, 17 nt, Streptococcus pneumoniae R6
uaaucuuggucaacaua

SEQ ID NO: 2191672 - RNA, 15 nt, Streptococcus pneumoniae R6
uaaucuugacuauau

SEQ ID NO: 2191673 - RNA, 19 nt, Streptococcus pneumoniae R6
uaaucuugacuauauuucu

SEQ ID NO: 2191674 - RNA, 14 nt, Streptococcus pneumoniae R6
uaaucuauacauuu

SEQ ID NO: 2191675 - RNA, 13 nt, Streptococcus pneumoniae R6
uaaucucaaaaca

SEQ ID NO: 2191676 - RNA, 21 nt, Streptococcus pneumoniae R6
uaaucucaaaagaaagcauag

SEQ ID NO: 2191677 - RNA, 11 nt, Streptococcus pneumoniae R6
uaaucucuagc

SEQ ID NO: 2191678 - RNA, 19 nt, Streptococcus pneumoniae R6
uaaucucuccuuaucaaaa

SEQ ID NO: 2191679 - RNA, 22 nt, Streptococcus pneumoniae R6
uaaucugcaccugauuucuccg

SEQ ID NO: 2191680 - RNA, 19 nt, Streptococcus pneumoniae R6
uaaucuacgcuuuaaaaau

SEQ ID NO: 2191681 - RNA, 16 nt, Streptococcus pneumoniae R6
uaaucgguaggaugac

SEQ ID NO: 2191682 - RNA, 14 nt, Streptococcus pneumoniae R6
uaaucggagaugga

SEQ ID NO: 2191683 - RNA, 18 nt, Streptococcus pneumoniae R6
uaacgauagauccuucaa

SEQ ID NO: 2191684 - RNA, 21 nt, Streptococcus pneumoniae R6
uaacgagugggacauguucau

SEQ ID NO: 2191685 - RNA, 15 nt, Streptococcus pneumoniae R6
uaacgagucaaaaaa

SEQ ID NO: 2191686 - RNA, 20 nt, Streptococcus pneumoniae R6
uaacgagucaaaaaaggagu

SEQ ID NO: 2191687 - RNA, 14 nt, Streptococcus pneumoniae R6
uaauccuuaaccca

SEQ ID NO: 2191688 - RNA, 17 nt, Streptococcus pneumoniae R6
uacauuugaguuucucu

SEQ ID NO: 2191689 - RNA, 18 nt, Streptococcus pneumoniae R6
uacauuugaguuucucuu

SEQ ID NO: 2191690 - RNA, 22 nt, Streptococcus pneumoniae R6
uacauuuagaaagguaaaauau

SEQ ID NO: 2191691 - RNA, 16 nt, Streptococcus pneumoniae R6
uaccaagcccucagcc

SEQ ID NO: 2191692 - RNA, 23 nt, Streptococcus pneumoniae R6
uaccaaggauugucugaacugcc

SEQ ID NO: 2191693 - RNA, 19 nt, Streptococcus pneumoniae R6
uaccaauacaggaaaacca

SEQ ID NO: 2191694 - RNA, 13 nt, Streptococcus pneumoniae R6
uaccaaagaaguc

SEQ ID NO: 2191695 - RNA, 17 nt, Streptococcus pneumoniae R6
uacauuuuuugaaauaa

SEQ ID NO: 2191696 - RNA, 18 nt, Streptococcus pneumoniae R6
uacauuuuuugaaauaag

SEQ ID NO: 2191697 - RNA, 17 nt, Streptococcus pneumoniae R6
uacauauguaagaagau

SEQ ID NO: 2191698 - RNA, 23 nt, Streptococcus pneumoniae R6
uacaugcaaaguaaaguaaggag

SEQ ID NO: 2191699 - RNA, 16 nt, Streptococcus pneumoniae R6
uacaugcgcaaaauaa

SEQ ID NO: 2191700 - RNA, 19 nt, Streptococcus pneumoniae R6
uacaugcgcaaaauaauuu

SEQ ID NO: 2191701 - RNA, 20 nt, Streptococcus pneumoniae R6
uacauaucuagguaaaaauu

SEQ ID NO: 2191702 - RNA, 17 nt, Streptococcus pneumoniae R6
uacauaaccagauauag

SEQ ID NO: 2191703 - RNA, 13 nt, Streptococcus pneumoniae R6
uacagcaaaaaau

SEQ ID NO: 2191704 - RNA, 16 nt, Streptococcus pneumoniae R6
uacaguugacaaagag

SEQ ID NO: 2191705 - RNA, 13 nt, Streptococcus pneumoniae R6
uacaguuagcaug

SEQ ID NO: 2191706 - RNA, 14 nt, Streptococcus pneumoniae R6
uacaguuauuuuag

SEQ ID NO: 2191707 - RNA, 21 nt, Streptococcus pneumoniae R6
uacaggcaggacaaaagauaa

SEQ ID NO: 2191708 - RNA, 19 nt, Streptococcus pneumoniae R6
uacaggcaugggcaggguc

SEQ ID NO: 2191709 - RNA, 20 nt, Streptococcus pneumoniae R6
uacagcuuuuuucuuugccu

SEQ ID NO: 2191710 - RNA, 18 nt, Streptococcus pneumoniae R6
uacacaagauccaauccu

SEQ ID NO: 2191711 - RNA, 17 nt, Streptococcus pneumoniae R6
uacacaucuacuucuaa

SEQ ID NO: 2191712 - RNA, 23 nt, Streptococcus pneumoniae R6
uacacauguuaacaaauucgacu

SEQ ID NO: 2191713 - RNA, 20 nt, Streptococcus pneumoniae R6
uacaaugucuaaaucuuuaa

SEQ ID NO: 2191714 - RNA, 13 nt, Streptococcus pneumoniae R6
uacaauauaucca

SEQ ID NO: 2191715 - RNA, 17 nt, Streptococcus pneumoniae R6
uacaauauauccaaaac

SEQ ID NO: 2191716 - RNA, 16 nt, Streptococcus pneumoniae R6
uaauuuuaguagaaaa

SEQ ID NO: 2191717 - RNA, 22 nt, Streptococcus pneumoniae R6
uacaauaauugguacauuuuga

SEQ ID NO: 2191718 - RNA, 15 nt, Streptococcus pneumoniae R6
uacaacgucuuuugc

SEQ ID NO: 2191719 - RNA, 18 nt, Streptococcus pneumoniae R6
uacaacgucuuuugccuu

SEQ ID NO: 2191720 - RNA, 14 nt, Streptococcus pneumoniae R6
uacaaccuuaaaac

SEQ ID NO: 2191721 - RNA, 13 nt, Streptococcus pneumoniae R6
uacagaagaaaaa

SEQ ID NO: 2191722 - RNA, 14 nt, Streptococcus pneumoniae R6
uacagaagaaaaac

SEQ ID NO: 2191723 - RNA, 14 nt, Streptococcus pneumoniae R6
uacagaacauuuua

SEQ ID NO: 2191724 - RNA, 20 nt, Streptococcus pneumoniae R6
uacacuucugcuucuaaaac

SEQ ID NO: 2191725 - RNA, 22 nt, Streptococcus pneumoniae R6
uacacuucugcuucuaaaacau

SEQ ID NO: 2191726 - RNA, 16 nt, Streptococcus pneumoniae R6
uacagaguacuaaaua

SEQ ID NO: 2191727 - RNA, 16 nt, Streptococcus pneumoniae R6
uacagauaaaaccugc

SEQ ID NO: 2191728 - RNA, 15 nt, Streptococcus pneumoniae R6
uacagagaaagucag

SEQ ID NO: 2191729 - RNA, 20 nt, Streptococcus pneumoniae R6
uacagaagcuuuaccauccu

SEQ ID NO: 2191730 - RNA, 20 nt, Streptococcus pneumoniae R6
uacagaaucccagauaaagc

SEQ ID NO: 2191731 - RNA, 20 nt, Streptococcus pneumoniae R6
uacagaaucuucauauacac

SEQ ID NO: 2191732 - RNA, 21 nt, Streptococcus pneumoniae R6
uacaccuaaaacuuugaugau

SEQ ID NO: 2191733 - RNA, 15 nt, Streptococcus pneumoniae R6
uacaccuaauccacu

SEQ ID NO: 2191734 - RNA, 14 nt, Streptococcus pneumoniae R6
uacaccaucccuua

SEQ ID NO: 2191735 - RNA, 16 nt, Streptococcus pneumoniae R6
uacaccauaaauauuu

SEQ ID NO: 2191736 - RNA, 20 nt, Streptococcus pneumoniae R6
uacacccacgucacaaagaa

SEQ ID NO: 2191737 - RNA, 12 nt, Streptococcus pneumoniae R6
uacacuggaugu

SEQ ID NO: 2191738 - RNA, 16 nt, Streptococcus pneumoniae R6
uacacguuuuugucua

SEQ ID NO: 2191739 - RNA, 17 nt, Streptococcus pneumoniae R6
uacacguacuuuaaaau

SEQ ID NO: 2191740 - RNA, 16 nt, Streptococcus pneumoniae R6
uauuugaaaaauauac

SEQ ID NO: 2191741 - RNA, 22 nt, Streptococcus pneumoniae R6
uauuugaaaaauauacaaaaaa

SEQ ID NO: 2191742 - RNA, 21 nt, Streptococcus pneumoniae R6
uauuugaaaggguagugaaag

SEQ ID NO: 2191743 - RNA, 16 nt, Streptococcus pneumoniae R6
uauuucuuuuuaugau

SEQ ID NO: 2191744 - RNA, 16 nt, Streptococcus pneumoniae R6
uauuugauauagaguu

SEQ ID NO: 2191745 - RNA, 23 nt, Streptococcus pneumoniae R6
uauuugaguaacggcuuccugug

SEQ ID NO: 2191746 - RNA, 23 nt, Streptococcus pneumoniae R6
uauuuggcaauucaauuauagac

SEQ ID NO: 2191747 - RNA, 14 nt, Streptococcus pneumoniae R6
uauuuguaaaauug

SEQ ID NO: 2191748 - RNA, 15 nt, Streptococcus pneumoniae R6
uauuuggcauauuuu

SEQ ID NO: 2191749 - RNA, 14 nt, Streptococcus pneumoniae R6
uauuucuaugauaa

SEQ ID NO: 2191750 - RNA, 18 nt, Streptococcus pneumoniae R6
uauuucuaagcuaccucu

SEQ ID NO: 2191751 - RNA, 22 nt, Streptococcus pneumoniae R6
uauuucuccuaaagaaaaaguu

SEQ ID NO: 2191752 - RNA, 15 nt, Streptococcus pneumoniae R6
uauuucuuauuucaa

SEQ ID NO: 2191753 - RNA, 16 nt, Streptococcus pneumoniae R6
uauuucuucuucugaa

SEQ ID NO: 2191754 - RNA, 21 nt, Streptococcus pneumoniae R6
uauuucuucuuuucauaauuu

SEQ ID NO: 2191755 - RNA, 15 nt, Streptococcus pneumoniae R6
uauuucuuaauugua

SEQ ID NO: 2191756 - RNA, 17 nt, Streptococcus pneumoniae R6
uauuucguaagaaauuu

SEQ ID NO: 2191757 - RNA, 15 nt, Streptococcus pneumoniae R6
uauuuccugcuuuag

SEQ ID NO: 2191758 - RNA, 13 nt, Streptococcus pneumoniae R6
uauuucauuuuaa

SEQ ID NO: 2191759 - RNA, 14 nt, Streptococcus pneumoniae R6
uauuucauuuuaau

SEQ ID NO: 2191760 - RNA, 16 nt, Streptococcus pneumoniae R6
uauuucauuuuacuau

SEQ ID NO: 2191761 - RNA, 18 nt, Streptococcus pneumoniae R6
uauuucauuuuacuauaa

SEQ ID NO: 2191762 - RNA, 13 nt, Streptococcus pneumoniae R6
uauuuucaaaaua

SEQ ID NO: 2191763 - RNA, 15 nt, Streptococcus pneumoniae R6
uauuuguugcucuua

SEQ ID NO: 2191764 - RNA, 17 nt, Streptococcus pneumoniae R6
uauuuggcgauuuuuuu

SEQ ID NO: 2191765 - RNA, 18 nt, Streptococcus pneumoniae R6
uauuuggauuaaucccca

SEQ ID NO: 2191766 - RNA, 14 nt, Streptococcus pneumoniae R6
uauuuuuacucaag

SEQ ID NO: 2191767 - RNA, 23 nt, Streptococcus pneumoniae R6
uauuuuaucccgaaccaugaaau

SEQ ID NO: 2191768 - RNA, 21 nt, Streptococcus pneumoniae R6
uauuuucaguguaucauugau

SEQ ID NO: 2191769 - RNA, 16 nt, Streptococcus pneumoniae R6
ucaaacuuuuuaguuu

SEQ ID NO: 2191770 - RNA, 15 nt, Streptococcus pneumoniae R6
ucaaacuuuuucucu

SEQ ID NO: 2191771 - RNA, 21 nt, Streptococcus pneumoniae R6
ucaaacuuuuucucucugaau

SEQ ID NO: 2191772 - RNA, 17 nt, Streptococcus pneumoniae R6
ucaaacuuuuaaugaga

SEQ ID NO: 2191773 - RNA, 15 nt, Streptococcus pneumoniae R6
ucaaagaacaaacua

SEQ ID NO: 2191774 - RNA, 11 nt, Streptococcus pneumoniae R6
ucaaaauauuu

SEQ ID NO: 2191775 - RNA, 14 nt, Streptococcus pneumoniae R6
ucaaaauaguguga

SEQ ID NO: 2191776 - RNA, 15 nt, Streptococcus pneumoniae R6
ucaaaauaggaauca

SEQ ID NO: 2191777 - RNA, 19 nt, Streptococcus pneumoniae R6
ucaaaauaaagcaaaucuu

SEQ ID NO: 2191778 - RNA, 16 nt, Streptococcus pneumoniae R6
ucaaaaguuagaaaua

SEQ ID NO: 2191779 - RNA, 16 nt, Streptococcus pneumoniae R6
ucaaagugcaaacuag

SEQ ID NO: 2191780 - RNA, 16 nt, Streptococcus pneumoniae R6
ucaaaguagucauuuu

SEQ ID NO: 2191781 - RNA, 18 nt, Streptococcus pneumoniae R6
ucaaaguagugaaugauu

SEQ ID NO: 2191782 - RNA, 19 nt, Streptococcus pneumoniae R6
ucaaagucauaaacaucug

SEQ ID NO: 2191783 - RNA, 22 nt, Streptococcus pneumoniae R6
ucaaagucauaaacaucugucg

SEQ ID NO: 2191784 - RNA, 14 nt, Streptococcus pneumoniae R6
ucaaagucaucaaa

SEQ ID NO: 2191785 - RNA, 14 nt, Streptococcus pneumoniae R6
ucaaaguaaugguu

SEQ ID NO: 2191786 - RNA, 16 nt, Streptococcus pneumoniae R6
ucaaaguacugcuuug

SEQ ID NO: 2191787 - RNA, 16 nt, Streptococcus pneumoniae R6
ucaaaggcuuuuucuu

SEQ ID NO: 2191788 - RNA, 20 nt, Streptococcus pneumoniae R6
ucaaaggcuuuuucuucuuc

SEQ ID NO: 2191789 - RNA, 22 nt, Streptococcus pneumoniae R6
ucaaaguuuacgacacauucua

SEQ ID NO: 2191790 - RNA, 22 nt, Streptococcus pneumoniae R6
ucaaaguuccgaaaaccaaagg

SEQ ID NO: 2191791 - RNA, 12 nt, Streptococcus pneumoniae R6
uauuuuuuacuu

SEQ ID NO: 2191792 - RNA, 15 nt, Streptococcus pneumoniae R6
uauuuuuuaacagau

SEQ ID NO: 2191793 - RNA, 14 nt, Streptococcus pneumoniae R6
uauuuuugagcaga

SEQ ID NO: 2191794 - RNA, 14 nt, Streptococcus pneumoniae R6
uauuuuucuuuuuc

SEQ ID NO: 2191795 - RNA, 20 nt, Streptococcus pneumoniae R6
uauuuuucuauuuaaaucgc

SEQ ID NO: 2191796 - RNA, 13 nt, Streptococcus pneumoniae R6
uauuuuuccucua

SEQ ID NO: 2191797 - RNA, 14 nt, Streptococcus pneumoniae R6
uauuuuuuuacuua

SEQ ID NO: 2191798 - RNA, 18 nt, Streptococcus pneumoniae R6
uauuuuuugaaucaauuu

SEQ ID NO: 2191799 - RNA, 14 nt, Streptococcus pneumoniae R6
ucaaaaaaaucgua

SEQ ID NO: 2191800 - RNA, 14 nt, Streptococcus pneumoniae R6
ucaaaaaaagaagu

SEQ ID NO: 2191801 - RNA, 15 nt, Streptococcus pneumoniae R6
ucaaaaaaagaaguu

SEQ ID NO: 2191802 - RNA, 17 nt, Streptococcus pneumoniae R6
ucaaaaaaguuaaaucu

SEQ ID NO: 2191803 - RNA, 14 nt, Streptococcus pneumoniae R6
ucaaaaaauaugau

SEQ ID NO: 2191804 - RNA, 20 nt, Streptococcus pneumoniae R6
ucaaaaacaucucagaauaa

SEQ ID NO: 2191805 - RNA, 22 nt, Streptococcus pneumoniae R6
ucaaaaacaucucagaauaaua

SEQ ID NO: 2191806 - RNA, 13 nt, Streptococcus pneumoniae R6
ucaaaaacauguu

SEQ ID NO: 2191807 - RNA, 12 nt, Streptococcus pneumoniae R6
ucaaaaagggaa

SEQ ID NO: 2191808 - RNA, 17 nt, Streptococcus pneumoniae R6
ucaaaaauagaaauaaa

SEQ ID NO: 2191809 - RNA, 20 nt, Streptococcus pneumoniae R6
ucaaaaauagaaauaaaaau

SEQ ID NO: 2191810 - RNA, 11 nt, Streptococcus pneumoniae R6
ucaaaaagaag

SEQ ID NO: 2191811 - RNA, 21 nt, Streptococcus pneumoniae R6
ucaaaaagaucaguucauuuu

SEQ ID NO: 2191812 - RNA, 15 nt, Streptococcus pneumoniae R6
ucaaaaagcauucua

SEQ ID NO: 2191813 - RNA, 20 nt, Streptococcus pneumoniae R6
ucaaaaaucauuauauuucu

SEQ ID NO: 2191814 - RNA, 20 nt, Streptococcus pneumoniae R6
ucaaaaaucucuucaaacaa

SEQ ID NO: 2191815 - RNA, 16 nt, Streptococcus pneumoniae R6
ucaaaacacuguuuug

SEQ ID NO: 2191816 - RNA, 21 nt, Streptococcus pneumoniae R6
ucaaaaauugguguaaauaga

SEQ ID NO: 2191817 - RNA, 18 nt, Streptococcus pneumoniae R6
ucaaaaccaguccuggaa

SEQ ID NO: 2191818 - RNA, 22 nt, Streptococcus pneumoniae R6
ucaaaaccaucauaaucuggau

SEQ ID NO: 2191819 - RNA, 16 nt, Streptococcus pneumoniae R6
ucaaaaccauguuuug

SEQ ID NO: 2191820 - RNA, 13 nt, Streptococcus pneumoniae R6
ucaaaacaguguu

SEQ ID NO: 2191821 - RNA, 16 nt, Streptococcus pneumoniae R6
ucaaaacaguguuuug

SEQ ID NO: 2191822 - RNA, 18 nt, Streptococcus pneumoniae R6
ucaaaacaguguuuugau

SEQ ID NO: 2191823 - RNA, 13 nt, Streptococcus pneumoniae R6
uauuuauuuacuu

SEQ ID NO: 2191824 - RNA, 14 nt, Streptococcus pneumoniae R6
uauuuauuuacuua

SEQ ID NO: 2191825 - RNA, 12 nt, Streptococcus pneumoniae R6
uauuucaaucca

SEQ ID NO: 2191826 - RNA, 18 nt, Streptococcus pneumoniae R6
uauuucaauuugaugauu

SEQ ID NO: 2191827 - RNA, 22 nt, Streptococcus pneumoniae R6
uauuucacaguuaaauuauaaa

SEQ ID NO: 2191828 - RNA, 16 nt, Streptococcus pneumoniae R6
uauuucacauuuucaa

SEQ ID NO: 2191829 - RNA, 22 nt, Streptococcus pneumoniae R6
uauuucaaagaacaucuacaau

SEQ ID NO: 2191830 - RNA, 19 nt, Streptococcus pneumoniae R6
uauuucagauucagucuac

SEQ ID NO: 2191831 - RNA, 21 nt, Streptococcus pneumoniae R6
uauuucauacgauaaaaauca

SEQ ID NO: 2191832 - RNA, 24 nt, Streptococcus pneumoniae R6
uauuucaugcuugccugaacgcua

SEQ ID NO: 2191833 - RNA, 17 nt, Streptococcus pneumoniae R6
uauuucauuacagaaca

SEQ ID NO: 2191834 - RNA, 18 nt, Streptococcus pneumoniae R6
uauuuauagaauuuuuug

SEQ ID NO: 2191835 - RNA, 13 nt, Streptococcus pneumoniae R6
uauuuacuuacca

SEQ ID NO: 2191836 - RNA, 15 nt, Streptococcus pneumoniae R6
uauuuacuguuuuag

SEQ ID NO: 2191837 - RNA, 18 nt, Streptococcus pneumoniae R6
uauuuacuaauuaauuaa

SEQ ID NO: 2191838 - RNA, 21 nt, Streptococcus pneumoniae R6
uauuuacaaguguuuucacuu

SEQ ID NO: 2191839 - RNA, 22 nt, Streptococcus pneumoniae R6
uauuuacgaauuauuuccuuga

SEQ ID NO: 2191840 - RNA, 22 nt, Streptococcus pneumoniae R6
uauuuacgacaacgguaucuug

SEQ ID NO: 2191841 - RNA, 18 nt, Streptococcus pneumoniae R6
uauuggucgcuucaaguu

SEQ ID NO: 2191842 - RNA, 18 nt, Streptococcus pneumoniae R6
uauuguacuguauacuuu

SEQ ID NO: 2191843 - RNA, 15 nt, Streptococcus pneumoniae R6
uauuguacuuuccaa

SEQ ID NO: 2191844 - RNA, 16 nt, Streptococcus pneumoniae R6
uauuguagcauauuuu

SEQ ID NO: 2191845 - RNA, 21 nt, Streptococcus pneumoniae R6
uauugucacgaaccacacuuu

SEQ ID NO: 2191846 - RNA, 15 nt, Streptococcus pneumoniae R6
uauuguauaguagau

SEQ ID NO: 2191847 - RNA, 13 nt, Streptococcus pneumoniae R6
uauuguauuuaug

SEQ ID NO: 2191848 - RNA, 18 nt, Streptococcus pneumoniae R6
uauuuaaaccaauuuuaa

SEQ ID NO: 2191849 - RNA, 16 nt, Streptococcus pneumoniae R6
uauugucuacauugau

SEQ ID NO: 2191850 - RNA, 14 nt, Streptococcus pneumoniae R6
uauugaguucacaa

SEQ ID NO: 2191851 - RNA, 13 nt, Streptococcus pneumoniae R6
uauugaguuuuuu

SEQ ID NO: 2191852 - RNA, 21 nt, Streptococcus pneumoniae R6
uauugagcgcaggaagaaaga

SEQ ID NO: 2191853 - RNA, 22 nt, Streptococcus pneumoniae R6
uauugagcgcaggaagaaagag

SEQ ID NO: 2191854 - RNA, 20 nt, Streptococcus pneumoniae R6
uauugccgauaucaccaaac

SEQ ID NO: 2191855 - RNA, 18 nt, Streptococcus pneumoniae R6
aaauccuuuuuuugaagu

SEQ ID NO: 2191856 - RNA, 19 nt, Streptococcus pneumoniae R6
aaauccuuuuuuugaaguu

SEQ ID NO: 2191857 - RNA, 14 nt, Streptococcus pneumoniae R6
uauucucucuuacu

SEQ ID NO: 2191858 - RNA, 18 nt, Streptococcus pneumoniae R6
uauuacuucaauuucuaa

SEQ ID NO: 2191859 - RNA, 18 nt, Streptococcus pneumoniae R6
uauuacuucuaaaacauu

SEQ ID NO: 2191860 - RNA, 12 nt, Streptococcus pneumoniae R6
uauuacuuacca

SEQ ID NO: 2191861 - RNA, 19 nt, Streptococcus pneumoniae R6
uauuacguccuguugcuuc

SEQ ID NO: 2191862 - RNA, 15 nt, Streptococcus pneumoniae R6
uauuaccuuucuugu

SEQ ID NO: 2191863 - RNA, 23 nt, Streptococcus pneumoniae R6
uauccgcaaccucaaaacagugu

SEQ ID NO: 2191864 - RNA, 15 nt, Streptococcus pneumoniae R6
uauccauucacaaca

SEQ ID NO: 2191865 - RNA, 17 nt, Streptococcus pneumoniae R6
uauccauucacaacauc

SEQ ID NO: 2191866 - RNA, 14 nt, Streptococcus pneumoniae R6
uauccauucuuaaa

SEQ ID NO: 2191867 - RNA, 19 nt, Streptococcus pneumoniae R6
uauccauuuuucaaaucaa

SEQ ID NO: 2191868 - RNA, 16 nt, Streptococcus pneumoniae R6
uauccauguuaugauu

SEQ ID NO: 2191869 - RNA, 16 nt, Streptococcus pneumoniae R6
uauccaucacaguuua

SEQ ID NO: 2191870 - RNA, 18 nt, Streptococcus pneumoniae R6
uauuauacguuuuuugau

SEQ ID NO: 2191871 - RNA, 14 nt, Streptococcus pneumoniae R6
uauuauaauauaau

SEQ ID NO: 2191872 - RNA, 15 nt, Streptococcus pneumoniae R6
uauuauaauauaauu

SEQ ID NO: 2191873 - RNA, 22 nt, Streptococcus pneumoniae R6
uauuauagugugggacuccuac

SEQ ID NO: 2191874 - RNA, 16 nt, Streptococcus pneumoniae R6
uauuagagguuugcuu

SEQ ID NO: 2191875 - RNA, 17 nt, Streptococcus pneumoniae R6
uauuauauuuauagaau

SEQ ID NO: 2191876 - RNA, 19 nt, Streptococcus pneumoniae R6
uauuauaugcaauuucuuu

SEQ ID NO: 2191877 - RNA, 20 nt, Streptococcus pneumoniae R6
uauuaucagcguaauagucu

SEQ ID NO: 2191878 - RNA, 18 nt, Streptococcus pneumoniae R6
uauucgcuuacauaaagu

SEQ ID NO: 2191879 - RNA, 16 nt, Streptococcus pneumoniae R6
uauucauauccccaga

SEQ ID NO: 2191880 - RNA, 20 nt, Streptococcus pneumoniae R6
uauucauauccccagacaua

SEQ ID NO: 2191881 - RNA, 21 nt, Streptococcus pneumoniae R6
uauucauauccccagacauaa

SEQ ID NO: 2191882 - RNA, 15 nt, Streptococcus pneumoniae R6
uauucauaaaauacc

SEQ ID NO: 2191883 - RNA, 13 nt, Streptococcus pneumoniae R6
uauucaucagguu

SEQ ID NO: 2191884 - RNA, 16 nt, Streptococcus pneumoniae R6
uauucauugaaaaaau

SEQ ID NO: 2191885 - RNA, 20 nt, Streptococcus pneumoniae R6
uauucaauucuuuaacaaaa

SEQ ID NO: 2191886 - RNA, 19 nt, Streptococcus pneumoniae R6
uauuauuucaaagaacauc

SEQ ID NO: 2191887 - RNA, 13 nt, Streptococcus pneumoniae R6
uauuauuuccuca

SEQ ID NO: 2191888 - RNA, 19 nt, Streptococcus pneumoniae R6
uauuauucucuauauaguu

SEQ ID NO: 2191889 - RNA, 18 nt, Streptococcus pneumoniae R6
uauucagaaaucuaguug

SEQ ID NO: 2191890 - RNA, 15 nt, Streptococcus pneumoniae R6
ucaagaccauggcgu

SEQ ID NO: 2191891 - RNA, 21 nt, Streptococcus pneumoniae R6
ucaagaaucgucacgcuacca

SEQ ID NO: 2191892 - RNA, 14 nt, Streptococcus pneumoniae R6
ucaagaaugaaagu

SEQ ID NO: 2191893 - RNA, 17 nt, Streptococcus pneumoniae R6
ucaagaaugaaaguuua

SEQ ID NO: 2191894 - RNA, 18 nt, Streptococcus pneumoniae R6
ucaagacaaggauaaaaa

SEQ ID NO: 2191895 - RNA, 20 nt, Streptococcus pneumoniae R6
ucaagacaaggauaaaaagu

SEQ ID NO: 2191896 - RNA, 22 nt, Streptococcus pneumoniae R6
ucaagagucuccucaaaaacag

SEQ ID NO: 2191897 - RNA, 11 nt, Streptococcus pneumoniae R6
ucaagagaaaa

SEQ ID NO: 2191898 - RNA, 13 nt, Streptococcus pneumoniae R6
ucaagacuugggc

SEQ ID NO: 2191899 - RNA, 14 nt, Streptococcus pneumoniae R6
ucaagaagagggcu

SEQ ID NO: 2191900 - RNA, 21 nt, Streptococcus pneumoniae R6
ucaagaagagggcuucuucaa

SEQ ID NO: 2191901 - RNA, 16 nt, Streptococcus pneumoniae R6
ucaagaagcgaauagc

SEQ ID NO: 2191902 - RNA, 15 nt, Streptococcus pneumoniae R6
ucaagaacaauuuca

SEQ ID NO: 2191903 - RNA, 15 nt, Streptococcus pneumoniae R6
ucaacuguagugggu

SEQ ID NO: 2191904 - RNA, 18 nt, Streptococcus pneumoniae R6
ucaacuggcauccccagc

SEQ ID NO: 2191905 - RNA, 15 nt, Streptococcus pneumoniae R6
ucaacugcuguuuuc

SEQ ID NO: 2191906 - RNA, 18 nt, Streptococcus pneumoniae R6
ucaacugcuguuuucaug

SEQ ID NO: 2191907 - RNA, 17 nt, Streptococcus pneumoniae R6
ucaacugcuuuuucaau

SEQ ID NO: 2191908 - RNA, 19 nt, Streptococcus pneumoniae R6
ucaacugcuuuuucaauca

SEQ ID NO: 2191909 - RNA, 19 nt, Streptococcus pneumoniae R6
ucaacugcguauuccauug

SEQ ID NO: 2191910 - RNA, 20 nt, Streptococcus pneumoniae R6
ucaacugccugguaaagacu

SEQ ID NO: 2191911 - RNA, 15 nt, Streptococcus pneumoniae R6
ucaaaugacuaaccu

SEQ ID NO: 2191912 - RNA, 15 nt, Streptococcus pneumoniae R6
ucaaaugaaauauuu

SEQ ID NO: 2191913 - RNA, 23 nt, Streptococcus pneumoniae R6
ucaaaugaaauauuuuuuacuuu

SEQ ID NO: 2191914 - RNA, 15 nt, Streptococcus pneumoniae R6
ucaaaucgaucuguu

SEQ ID NO: 2191915 - RNA, 16 nt, Streptococcus pneumoniae R6
ucaaaucgauuucuaa

SEQ ID NO: 2191916 - RNA, 21 nt, Streptococcus pneumoniae R6
ucaaauccuucagcuuuggca

SEQ ID NO: 2191917 - RNA, 16 nt, Streptococcus pneumoniae R6
ucaaauccauaguaaa

SEQ ID NO: 2191918 - RNA, 20 nt, Streptococcus pneumoniae R6
ucaaaucccaugucuuuuaa

SEQ ID NO: 2191919 - RNA, 18 nt, Streptococcus pneumoniae R6
ucaaaucccuagcucaug

SEQ ID NO: 2191920 - RNA, 14 nt, Streptococcus pneumoniae R6
ucaaauccuuuauu

SEQ ID NO: 2191921 - RNA, 19 nt, Streptococcus pneumoniae R6
ucaagccgagcucuuuuug

SEQ ID NO: 2191922 - RNA, 18 nt, Streptococcus pneumoniae R6
ucaagcgaacaucuccaa

SEQ ID NO: 2191923 - RNA, 17 nt, Streptococcus pneumoniae R6
ucaagccuuauugcucu

SEQ ID NO: 2191924 - RNA, 24 nt, Streptococcus pneumoniae R6
ucaagauagcugugaagcguucca

SEQ ID NO: 2191925 - RNA, 15 nt, Streptococcus pneumoniae R6
ucaagauaaggaauu

SEQ ID NO: 2191926 - RNA, 22 nt, Streptococcus pneumoniae R6
ucaagcaacuaaaaaggaacca

SEQ ID NO: 2191927 - RNA, 16 nt, Streptococcus pneumoniae R6
ucaagcaaaacaaauu

SEQ ID NO: 2191928 - RNA, 17 nt, Streptococcus pneumoniae R6
ucaagcaaaucaaagcu

SEQ ID NO: 2191929 - RNA, 23 nt, Streptococcus pneumoniae R6
ucaagcugugaguucauuaugau

SEQ ID NO: 2191930 - RNA, 21 nt, Streptococcus pneumoniae R6
ucaaggauuucuuugaaaucu

SEQ ID NO: 2191931 - RNA, 19 nt, Streptococcus pneumoniae R6
ucaagguuuuucuguacug

SEQ ID NO: 2191932 - RNA, 15 nt, Streptococcus pneumoniae R6
ucaagggaaaaugaa

SEQ ID NO: 2191933 - RNA, 16 nt, Streptococcus pneumoniae R6
ucaagggcagacauau

SEQ ID NO: 2191934 - RNA, 16 nt, Streptococcus pneumoniae R6
ucaagguaauaaucca

SEQ ID NO: 2191935 - RNA, 17 nt, Streptococcus pneumoniae R6
ucaauccguucugagau

SEQ ID NO: 2191936 - RNA, 18 nt, Streptococcus pneumoniae R6
ucaauccguucugagaua

SEQ ID NO: 2191937 - RNA, 15 nt, Streptococcus pneumoniae R6
ucaauccugaagaau

SEQ ID NO: 2191938 - RNA, 14 nt, Streptococcus pneumoniae R6
ucaauccuuuucug

SEQ ID NO: 2191939 - RNA, 18 nt, Streptococcus pneumoniae R6
ucaauccuuuucugagga

SEQ ID NO: 2191940 - RNA, 18 nt, Streptococcus pneumoniae R6
ucaauccgaguuuuucag

SEQ ID NO: 2191941 - RNA, 13 nt, Streptococcus pneumoniae R6
ucaaucaauuuaa

SEQ ID NO: 2191942 - RNA, 14 nt, Streptococcus pneumoniae R6
ucaaucaagacaga

SEQ ID NO: 2191943 - RNA, 23 nt, Streptococcus pneumoniae R6
ucaagugcuuuugugauuuuaaa

SEQ ID NO: 2191944 - RNA, 22 nt, Streptococcus pneumoniae R6
ucaagugccaagaagguuucau

SEQ ID NO: 2191945 - RNA, 20 nt, Streptococcus pneumoniae R6
ucaagugaguuaggagccaa

SEQ ID NO: 2191946 - RNA, 19 nt, Streptococcus pneumoniae R6
ucaagucuuccgaauaacu

SEQ ID NO: 2191947 - RNA, 22 nt, Streptococcus pneumoniae R6
ucaagugacauaugauugucuc

SEQ ID NO: 2191948 - RNA, 14 nt, Streptococcus pneumoniae R6
ucaaguguugaaaa

SEQ ID NO: 2191949 - RNA, 22 nt, Streptococcus pneumoniae R6
ucaauauuaugcguuuuuucug

SEQ ID NO: 2191950 - RNA, 21 nt, Streptococcus pneumoniae R6
ucaauauuagaugauuuuucu

SEQ ID NO: 2191951 - RNA, 19 nt, Streptococcus pneumoniae R6
ucaauggaguaaaaaaaga

SEQ ID NO: 2191952 - RNA, 22 nt, Streptococcus pneumoniae R6
ucaauggcaaaaaauugagaaa

SEQ ID NO: 2191953 - RNA, 20 nt, Streptococcus pneumoniae R6
ucaaugaaaaucaaagagca

SEQ ID NO: 2191954 - RNA, 20 nt, Streptococcus pneumoniae R6
ucaaugaaaaucaaagugca

SEQ ID NO: 2191955 - RNA, 23 nt, Streptococcus pneumoniae R6
ucaaugcccuugauaauaaagaa

SEQ ID NO: 2191956 - RNA, 15 nt, Streptococcus pneumoniae R6
ucaaucgcuuaauuu

SEQ ID NO: 2191957 - RNA, 17 nt, Streptococcus pneumoniae R6
ucaaucuacuauauuuu

SEQ ID NO: 2191958 - RNA, 20 nt, Streptococcus pneumoniae R6
ucaaucuugucuaaaaauag

SEQ ID NO: 2191959 - RNA, 17 nt, Streptococcus pneumoniae R6
ucaaucuuaucaaucaa

SEQ ID NO: 2191960 - RNA, 18 nt, Streptococcus pneumoniae R6
ucaaucuuaucaaucaaa

SEQ ID NO: 2191961 - RNA, 17 nt, Streptococcus pneumoniae R6
ucaaucugcuauaguca

SEQ ID NO: 2191962 - RNA, 18 nt, Streptococcus pneumoniae R6
ucaaucucugcaauuucu

SEQ ID NO: 2191963 - RNA, 18 nt, Streptococcus pneumoniae R6
ucaauuaguuuaagacau

SEQ ID NO: 2191964 - RNA, 18 nt, Streptococcus pneumoniae R6
ucaauuaucauuuccauu

SEQ ID NO: 2191965 - RNA, 19 nt, Streptococcus pneumoniae R6
ucaauuaucauuuccauug

SEQ ID NO: 2191966 - RNA, 22 nt, Streptococcus pneumoniae R6
ucaauuucuauuuuaaaaauag

SEQ ID NO: 2191967 - RNA, 11 nt, Streptococcus pneumoniae R6
ucaauuucuag

SEQ ID NO: 2191968 - RNA, 16 nt, Streptococcus pneumoniae R6
ucaauuucucuacaaa

SEQ ID NO: 2191969 - RNA, 17 nt, Streptococcus pneumoniae R6
ucaauuagaaaauucaa

SEQ ID NO: 2191970 - RNA, 18 nt, Streptococcus pneumoniae R6
ucaauuagaaaauucaaa

SEQ ID NO: 2191971 - RNA, 19 nt, Streptococcus pneumoniae R6
ucaauuagaaaauucaaau

SEQ ID NO: 2191972 - RNA, 12 nt, Streptococcus pneumoniae R6
ucaauuaagaaa

SEQ ID NO: 2191973 - RNA, 18 nt, Streptococcus pneumoniae R6
ucaauguuuuauuacaua

SEQ ID NO: 2191974 - RNA, 19 nt, Streptococcus pneumoniae R6
ucaauguuuuauuacauaa

SEQ ID NO: 2191975 - RNA, 23 nt, Streptococcus pneumoniae R6
ucaauguuuuauuacauaaguuu

SEQ ID NO: 2191976 - RNA, 17 nt, Streptococcus pneumoniae R6
ucacaaauucuggcauu

SEQ ID NO: 2191977 - RNA, 18 nt, Streptococcus pneumoniae R6
ucacaaagaguucccugc

SEQ ID NO: 2191978 - RNA, 20 nt, Streptococcus pneumoniae R6
ucaauuuuauacucaucugu

SEQ ID NO: 2191979 - RNA, 19 nt, Streptococcus pneumoniae R6
ucacaauccagccugccug

SEQ ID NO: 2191980 - RNA, 17 nt, Streptococcus pneumoniae R6
ucacaacucuuauacuu

SEQ ID NO: 2191981 - RNA, 24 nt, Streptococcus pneumoniae R6
ucacaacucuuauacuuuucucuu

SEQ ID NO: 2191982 - RNA, 10 nt, Streptococcus pneumoniae R6
ucacacaaaa

SEQ ID NO: 2191983 - RNA, 14 nt, Streptococcus pneumoniae R6
ucacacaaaaaaga

SEQ ID NO: 2191984 - RNA, 19 nt, Streptococcus pneumoniae R6
ucacacaaaaaagaggcuc

SEQ ID NO: 2191985 - RNA, 15 nt, Streptococcus pneumoniae R6
ucacaauuccuaaga

SEQ ID NO: 2191986 - RNA, 14 nt, Streptococcus pneumoniae R6
ucaccagauagaau

SEQ ID NO: 2191987 - RNA, 16 nt, Streptococcus pneumoniae R6
ucaccaauuuuaccuu

SEQ ID NO: 2191988 - RNA, 20 nt, Streptococcus pneumoniae R6
ucacccaaaacuucugcaau

SEQ ID NO: 2191989 - RNA, 12 nt, Streptococcus pneumoniae R6
ucaccaaauuuc

SEQ ID NO: 2191990 - RNA, 15 nt, Streptococcus pneumoniae R6
ucaccaaauuucaua

SEQ ID NO: 2191991 - RNA, 15 nt, Streptococcus pneumoniae R6
ucaccaaucaaauca

SEQ ID NO: 2191992 - RNA, 20 nt, Streptococcus pneumoniae R6
ucaccaaucaaaucaauaac

SEQ ID NO: 2191993 - RNA, 18 nt, Streptococcus pneumoniae R6
ucacagaccgacacacca

SEQ ID NO: 2191994 - RNA, 18 nt, Streptococcus pneumoniae R6
ucacauugaaaaugugaa

SEQ ID NO: 2191995 - RNA, 21 nt, Streptococcus pneumoniae R6
ucaccguuaucuggugcuagg

SEQ ID NO: 2191996 - RNA, 16 nt, Streptococcus pneumoniae R6
ucaccguccccaaaaa

SEQ ID NO: 2191997 - RNA, 15 nt, Streptococcus pneumoniae R6
ucaccgaccaauucu

SEQ ID NO: 2191998 - RNA, 16 nt, Streptococcus pneumoniae R6
ucaccccacgaaggac

SEQ ID NO: 2191999 - RNA, 19 nt, Streptococcus pneumoniae R6
ucacgaggaggagaaaaag

SEQ ID NO: 2192000 - RNA, 19 nt, Streptococcus pneumoniae R6
ucacgauucaucaagagac

SEQ ID NO: 2192001 - RNA, 19 nt, Streptococcus pneumoniae R6
ucacgauuggggucagaaa

SEQ ID NO: 2192002 - RNA, 22 nt, Streptococcus pneumoniae R6
ucacgauacuguaguuuuuccu

SEQ ID NO: 2192003 - RNA, 22 nt, Streptococcus pneumoniae R6
ucacgaauauucaccaaucugc

SEQ ID NO: 2192004 - RNA, 23 nt, Streptococcus pneumoniae R6
ucacgaagauacugaaucaaaaa

SEQ ID NO: 2192005 - RNA, 15 nt, Streptococcus pneumoniae R6
ucacgaaaauauuug

SEQ ID NO: 2192006 - RNA, 15 nt, Streptococcus pneumoniae R6
ucacgaaccacacuu

SEQ ID NO: 2192007 - RNA, 14 nt, Streptococcus pneumoniae R6
ucaccuauucuaag

SEQ ID NO: 2192008 - RNA, 21 nt, Streptococcus pneumoniae R6
ucaccuauucuaaguccauca

SEQ ID NO: 2192009 - RNA, 22 nt, Streptococcus pneumoniae R6
ucacgcuaaguagaaaguuaau

SEQ ID NO: 2192010 - RNA, 21 nt, Streptococcus pneumoniae R6
ucacgcaccuugguaauuccu

SEQ ID NO: 2192011 - RNA, 22 nt, Streptococcus pneumoniae R6
ucacgguuuguauugaacccgc

SEQ ID NO: 2192012 - RNA, 21 nt, Streptococcus pneumoniae R6
ucacuacuuugacccugacuc

SEQ ID NO: 2192013 - RNA, 13 nt, Streptococcus pneumoniae R6
ucacuauguuuua

SEQ ID NO: 2192014 - RNA, 14 nt, Streptococcus pneumoniae R6
ucacuauucaucag

SEQ ID NO: 2192015 - RNA, 15 nt, Streptococcus pneumoniae R6
ucacucaguuucuga

SEQ ID NO: 2192016 - RNA, 20 nt, Streptococcus pneumoniae R6
ucauaaucuguuuaaauuca

SEQ ID NO: 2192017 - RNA, 21 nt, Streptococcus pneumoniae R6
ucauaauccaacaccaauuuu

SEQ ID NO: 2192018 - RNA, 16 nt, Streptococcus pneumoniae R6
ucauaauuuuuuucau

SEQ ID NO: 2192019 - RNA, 22 nt, Streptococcus pneumoniae R6
ucauaccagagguagcuuagaa

SEQ ID NO: 2192020 - RNA, 17 nt, Streptococcus pneumoniae R6
ucauaccaguuuuugau

SEQ ID NO: 2192021 - RNA, 21 nt, Streptococcus pneumoniae R6
ucauacacauguuaacaaauu

SEQ ID NO: 2192022 - RNA, 15 nt, Streptococcus pneumoniae R6
ucauacgauugaaag

SEQ ID NO: 2192023 - RNA, 15 nt, Streptococcus pneumoniae R6
ucauacgauaaaaau

SEQ ID NO: 2192024 - RNA, 17 nt, Streptococcus pneumoniae R6
ucauauaaauaauuaua

SEQ ID NO: 2192025 - RNA, 21 nt, Streptococcus pneumoniae R6
ucauauacacuaaacaaauga

SEQ ID NO: 2192026 - RNA, 13 nt, Streptococcus pneumoniae R6
ucauauaauaaau

SEQ ID NO: 2192027 - RNA, 17 nt, Streptococcus pneumoniae R6
ucauacuuggagaaccu

SEQ ID NO: 2192028 - RNA, 14 nt, Streptococcus pneumoniae R6
ucauagaaauuuuu

SEQ ID NO: 2192029 - RNA, 14 nt, Streptococcus pneumoniae R6
ucauagaaauauuu

SEQ ID NO: 2192030 - RNA, 18 nt, Streptococcus pneumoniae R6
ucauagaaauauuuacuu

SEQ ID NO: 2192031 - RNA, 17 nt, Streptococcus pneumoniae R6
ucauagccgaugaccuu

SEQ ID NO: 2192032 - RNA, 20 nt, Streptococcus pneumoniae R6
ucauagcauagaugacaaag

SEQ ID NO: 2192033 - RNA, 17 nt, Streptococcus pneumoniae R6
ucauagccauaaaacau

SEQ ID NO: 2192034 - RNA, 19 nt, Streptococcus pneumoniae R6
ucaucacgacuaauuucaa

SEQ ID NO: 2192035 - RNA, 12 nt, Streptococcus pneumoniae R6
ucaucaagcuuu

SEQ ID NO: 2192036 - RNA, 14 nt, Streptococcus pneumoniae R6
ucaucaacccccau

SEQ ID NO: 2192037 - RNA, 18 nt, Streptococcus pneumoniae R6
ucaucaaaauccguuuuu

SEQ ID NO: 2192038 - RNA, 19 nt, Streptococcus pneumoniae R6
ucauaucugucuuaccaca

SEQ ID NO: 2192039 - RNA, 16 nt, Streptococcus pneumoniae R6
ucauaucuuauuucaa

SEQ ID NO: 2192040 - RNA, 22 nt, Streptococcus pneumoniae R6
ucauaucuaccugcaccagauu

SEQ ID NO: 2192041 - RNA, 17 nt, Streptococcus pneumoniae R6
ucauauccccagacaua

SEQ ID NO: 2192042 - RNA, 15 nt, Streptococcus pneumoniae R6
ucauaucaagguuuu

SEQ ID NO: 2192043 - RNA, 17 nt, Streptococcus pneumoniae R6
ucauaucaaucucugca

SEQ ID NO: 2192044 - RNA, 15 nt, Streptococcus pneumoniae R6
ucauaucaucaauca

SEQ ID NO: 2192045 - RNA, 21 nt, Streptococcus pneumoniae R6
ucauauuuauuaauuucauua

SEQ ID NO: 2192046 - RNA, 15 nt, Streptococcus pneumoniae R6
ucauauuuucagaua

SEQ ID NO: 2192047 - RNA, 22 nt, Streptococcus pneumoniae R6
ucauauuuucugggaagacugu

SEQ ID NO: 2192048 - RNA, 24 nt, Streptococcus pneumoniae R6
ucauauuuucugggaagacuguca

SEQ ID NO: 2192049 - RNA, 13 nt, Streptococcus pneumoniae R6
ucauauuuucaga

SEQ ID NO: 2192050 - RNA, 19 nt, Streptococcus pneumoniae R6
ucauauuuuuugggaacag

SEQ ID NO: 2192051 - RNA, 21 nt, Streptococcus pneumoniae R6
ucauccgaagcaaaaauggca

SEQ ID NO: 2192052 - RNA, 19 nt, Streptococcus pneumoniae R6
ucauccaugauaaugguau

SEQ ID NO: 2192053 - RNA, 22 nt, Streptococcus pneumoniae R6
ucauccauucuuuuuuaauucu

SEQ ID NO: 2192054 - RNA, 18 nt, Streptococcus pneumoniae R6
ucaucccuugucuuugau

SEQ ID NO: 2192055 - RNA, 23 nt, Streptococcus pneumoniae R6
ucaucggaaugguaaucaucuca

SEQ ID NO: 2192056 - RNA, 21 nt, Streptococcus pneumoniae R6
ucaucgcuuggaaguuuuccu

SEQ ID NO: 2192057 - RNA, 14 nt, Streptococcus pneumoniae R6
ucaucgauuuuuuc

SEQ ID NO: 2192058 - RNA, 16 nt, Streptococcus pneumoniae R6
ucaucgauuuuuucac

SEQ ID NO: 2192059 - RNA, 22 nt, Streptococcus pneumoniae R6
ucaucgacuuguuuuuugaugu

SEQ ID NO: 2192060 - RNA, 11 nt, Streptococcus pneumoniae R6
ucaucaugaaa

SEQ ID NO: 2192061 - RNA, 15 nt, Streptococcus pneumoniae R6
ucaucauuaacaaua

SEQ ID NO: 2192062 - RNA, 13 nt, Streptococcus pneumoniae R6
ucauccacaaccu

SEQ ID NO: 2192063 - RNA, 22 nt, Streptococcus pneumoniae R6
ucauccacaaccucaaaacagu

SEQ ID NO: 2192064 - RNA, 14 nt, Streptococcus pneumoniae R6
ucauccagcaggag

SEQ ID NO: 2192065 - RNA, 16 nt, Streptococcus pneumoniae R6
ucaucagcauaaucug

SEQ ID NO: 2192066 - RNA, 13 nt, Streptococcus pneumoniae R6
ucaucauaaaaau

SEQ ID NO: 2192067 - RNA, 14 nt, Streptococcus pneumoniae R6
ucaucauaaaaaua

SEQ ID NO: 2192068 - RNA, 22 nt, Streptococcus pneumoniae R6
ucaucauaucagugaagguauu

SEQ ID NO: 2192069 - RNA, 17 nt, Streptococcus pneumoniae R6
ucauaauaaccaagcua

SEQ ID NO: 2192070 - RNA, 18 nt, Streptococcus pneumoniae R6
ucauaagauuaauuucag

SEQ ID NO: 2192071 - RNA, 22 nt, Streptococcus pneumoniae R6
ucauaagcaacuuuacgaaauu

SEQ ID NO: 2192072 - RNA, 16 nt, Streptococcus pneumoniae R6
ucauaaggaagucugu

SEQ ID NO: 2192073 - RNA, 20 nt, Streptococcus pneumoniae R6
ucauaagcuagucuacuugu

SEQ ID NO: 2192074 - RNA, 13 nt, Streptococcus pneumoniae R6
ucauaacuacagu

SEQ ID NO: 2192075 - RNA, 19 nt, Streptococcus pneumoniae R6
ucauaacuacaguauagca

SEQ ID NO: 2192076 - RNA, 16 nt, Streptococcus pneumoniae R6
ucauaacauucuacau

SEQ ID NO: 2192077 - RNA, 18 nt, Streptococcus pneumoniae R6
ucauaaaguuuucugagu

SEQ ID NO: 2192078 - RNA, 15 nt, Streptococcus pneumoniae R6
ucauaaagucuuuaa

SEQ ID NO: 2192079 - RNA, 14 nt, Streptococcus pneumoniae R6
ucauaaacuaucca

SEQ ID NO: 2192080 - RNA, 15 nt, Streptococcus pneumoniae R6
ucauaaagagaagga

SEQ ID NO: 2192081 - RNA, 20 nt, Streptococcus pneumoniae R6
ucauaaacaucugucgcaag

SEQ ID NO: 2192082 - RNA, 17 nt, Streptococcus pneumoniae R6
ucagucacauauauaau

SEQ ID NO: 2192083 - RNA, 13 nt, Streptococcus pneumoniae R6
ucaguauuuggau

SEQ ID NO: 2192084 - RNA, 20 nt, Streptococcus pneumoniae R6
ucaguauuuggauuaugaaa

SEQ ID NO: 2192085 - RNA, 19 nt, Streptococcus pneumoniae R6
ucaguuccccaaaaaguag

SEQ ID NO: 2192086 - RNA, 16 nt, Streptococcus pneumoniae R6
ucaguucauuuuuccu

SEQ ID NO: 2192087 - RNA, 15 nt, Streptococcus pneumoniae R6
ucaguuuuauuuuug

SEQ ID NO: 2192088 - RNA, 13 nt, Streptococcus pneumoniae R6
ucaguuuuuucac

SEQ ID NO: 2192089 - RNA, 20 nt, Streptococcus pneumoniae R6
ucaguuuuuucacaaauucu

SEQ ID NO: 2192090 - RNA, 16 nt, Streptococcus pneumoniae R6
ucagggucuuuguucu

SEQ ID NO: 2192091 - RNA, 21 nt, Streptococcus pneumoniae R6
ucagggucuuuguucugaaag

SEQ ID NO: 2192092 - RNA, 22 nt, Streptococcus pneumoniae R6
ucagggucuuuguucugaaagu

SEQ ID NO: 2192093 - RNA, 21 nt, Streptococcus pneumoniae R6
ucaguacaccuaaaacuuuga

SEQ ID NO: 2192094 - RNA, 22 nt, Streptococcus pneumoniae R6
ucaguaaaaaaaacauauauuc

SEQ ID NO: 2192095 - RNA, 13 nt, Streptococcus pneumoniae R6
ucagguguucaaa

SEQ ID NO: 2192096 - RNA, 14 nt, Streptococcus pneumoniae R6
ucagguguugaaac

SEQ ID NO: 2192097 - RNA, 15 nt, Streptococcus pneumoniae R6
ucagcuagcuuagga

SEQ ID NO: 2192098 - RNA, 17 nt, Streptococcus pneumoniae R6
ucagcuagcuuaggaaa

SEQ ID NO: 2192099 - RNA, 20 nt, Streptococcus pneumoniae R6
ucagcucaaaacauguuuuu

SEQ ID NO: 2192100 - RNA, 18 nt, Streptococcus pneumoniae R6
ucagcugggcuaaugggc

SEQ ID NO: 2192101 - RNA, 20 nt, Streptococcus pneumoniae R6
ucagcugggcuaaugggcca

SEQ ID NO: 2192102 - RNA, 17 nt, Streptococcus pneumoniae R6
ucagcuaaaauguuuuu

SEQ ID NO: 2192103 - RNA, 19 nt, Streptococcus pneumoniae R6
ucagcuuuggcaacugcuu

SEQ ID NO: 2192104 - RNA, 17 nt, Streptococcus pneumoniae R6
ucagcuuccaucugcag

SEQ ID NO: 2192105 - RNA, 15 nt, Streptococcus pneumoniae R6
ucagcuucguaauca

SEQ ID NO: 2192106 - RNA, 13 nt, Streptococcus pneumoniae R6
ucagcuuuuucag

SEQ ID NO: 2192107 - RNA, 12 nt, Streptococcus pneumoniae R6
ucaggaaagacu

SEQ ID NO: 2192108 - RNA, 14 nt, Streptococcus pneumoniae R6
ucaggaaagucaaa

SEQ ID NO: 2192109 - RNA, 20 nt, Streptococcus pneumoniae R6
ucaggaaagucaaauuaauu

SEQ ID NO: 2192110 - RNA, 13 nt, Streptococcus pneumoniae R6
ucaggaaaucuuc

SEQ ID NO: 2192111 - RNA, 14 nt, Streptococcus pneumoniae R6
ucaggaauaaaucc

SEQ ID NO: 2192112 - RNA, 15 nt, Streptococcus pneumoniae R6
ucacucuaacuucug

SEQ ID NO: 2192113 - RNA, 17 nt, Streptococcus pneumoniae R6
ucacugagaucuucuuc

SEQ ID NO: 2192114 - RNA, 18 nt, Streptococcus pneumoniae R6
ucacuuaguugaauuauc

SEQ ID NO: 2192115 - RNA, 17 nt, Streptococcus pneumoniae R6
ucagccuuauauuuuuu

SEQ ID NO: 2192116 - RNA, 15 nt, Streptococcus pneumoniae R6
ucauuucaauagaaa

SEQ ID NO: 2192117 - RNA, 21 nt, Streptococcus pneumoniae R6
ucauuucaauagaaaucacga

SEQ ID NO: 2192118 - RNA, 19 nt, Streptococcus pneumoniae R6
ucauuggaaaagauagaga

SEQ ID NO: 2192119 - RNA, 24 nt, Streptococcus pneumoniae R6
ucauuggaguuguaaucuuagcaa

SEQ ID NO: 2192120 - RNA, 12 nt, Streptococcus pneumoniae R6
ucauucugcuag

SEQ ID NO: 2192121 - RNA, 16 nt, Streptococcus pneumoniae R6
ucauuuuauuauuaau

SEQ ID NO: 2192122 - RNA, 23 nt, Streptococcus pneumoniae R6
ucauuuuauuauuaauauauaaa

SEQ ID NO: 2192123 - RNA, 24 nt, Streptococcus pneumoniae R6
ucauuuuacuauauaucaugcuuu

SEQ ID NO: 2192124 - RNA, 14 nt, Streptococcus pneumoniae R6
ucauuuuacaucug

SEQ ID NO: 2192125 - RNA, 15 nt, Streptococcus pneumoniae R6
uccaaaaauaaaucu

SEQ ID NO: 2192126 - RNA, 12 nt, Streptococcus pneumoniae R6
uccaaaacaucu

SEQ ID NO: 2192127 - RNA, 18 nt, Streptococcus pneumoniae R6
uccaaaacaaccaauuuc

SEQ ID NO: 2192128 - RNA, 21 nt, Streptococcus pneumoniae R6
uccaaaaguuggacaaaauga

SEQ ID NO: 2192129 - RNA, 13 nt, Streptococcus pneumoniae R6
ucauuuuuuccug

SEQ ID NO: 2192130 - RNA, 21 nt, Streptococcus pneumoniae R6
ucauuuuugaacagugauagc

SEQ ID NO: 2192131 - RNA, 17 nt, Streptococcus pneumoniae R6
ucauuuuuuaugguguu

SEQ ID NO: 2192132 - RNA, 17 nt, Streptococcus pneumoniae R6
ucauuaagucaacaucu

SEQ ID NO: 2192133 - RNA, 22 nt, Streptococcus pneumoniae R6
ucauguagcgcuugaaacucau

SEQ ID NO: 2192134 - RNA, 18 nt, Streptococcus pneumoniae R6
ucaugucauguuagaaaa

SEQ ID NO: 2192135 - RNA, 20 nt, Streptococcus pneumoniae R6
ucaugucauguuagaaaaau

SEQ ID NO: 2192136 - RNA, 22 nt, Streptococcus pneumoniae R6
ucaugguucgggauaaaauagu

SEQ ID NO: 2192137 - RNA, 14 nt, Streptococcus pneumoniae R6
ucauucuacuauau

SEQ ID NO: 2192138 - RNA, 17 nt, Streptococcus pneumoniae R6
ucauucugaacuaaaaa

SEQ ID NO: 2192139 - RNA, 18 nt, Streptococcus pneumoniae R6
ucauucugaacuaaaaaa

SEQ ID NO: 2192140 - RNA, 13 nt, Streptococcus pneumoniae R6
ucauucguaaucc

SEQ ID NO: 2192141 - RNA, 21 nt, Streptococcus pneumoniae R6
ucauucgacuaauuuggaaau

SEQ ID NO: 2192142 - RNA, 15 nt, Streptococcus pneumoniae R6
ucaugcgaaucaauu

SEQ ID NO: 2192143 - RNA, 19 nt, Streptococcus pneumoniae R6
ucaugcgauagaugaucga

SEQ ID NO: 2192144 - RNA, 18 nt, Streptococcus pneumoniae R6
ucaugcuuggauccauug

SEQ ID NO: 2192145 - RNA, 19 nt, Streptococcus pneumoniae R6
ucaugcuuuacuaguucuc

SEQ ID NO: 2192146 - RNA, 19 nt, Streptococcus pneumoniae R6
ucauggccacgguuagaag

SEQ ID NO: 2192147 - RNA, 21 nt, Streptococcus pneumoniae R6
ucaugaguggagccccuugau

SEQ ID NO: 2192148 - RNA, 20 nt, Streptococcus pneumoniae R6
ucaugagugggcucauguaa

SEQ ID NO: 2192149 - RNA, 22 nt, Streptococcus pneumoniae R6
ucaugcaaaaaaaaugaaaaaa

SEQ ID NO: 2192150 - RNA, 23 nt, Streptococcus pneumoniae R6
ucaugcaaaaaaaaugaaaaaaa

SEQ ID NO: 2192151 - RNA, 16 nt, Streptococcus pneumoniae R6
ucaugcaggaaguuca

SEQ ID NO: 2192152 - RNA, 20 nt, Streptococcus pneumoniae R6
ucaugaaguggggcaccauu

SEQ ID NO: 2192153 - RNA, 18 nt, Streptococcus pneumoniae R6
ucaugaaaggauuucucu

SEQ ID NO: 2192154 - RNA, 12 nt, Streptococcus pneumoniae R6
ucaugaaaccac

SEQ ID NO: 2192155 - RNA, 17 nt, Streptococcus pneumoniae R6
ucaugaaaccaccgaca

SEQ ID NO: 2192156 - RNA, 15 nt, Streptococcus pneumoniae R6
ucaugacuagugaag

SEQ ID NO: 2192157 - RNA, 16 nt, Streptococcus pneumoniae R6
ucaugacuagugaagc

SEQ ID NO: 2192158 - RNA, 18 nt, Streptococcus pneumoniae R6
ucaugacugagagcuaca

SEQ ID NO: 2192159 - RNA, 16 nt, Streptococcus pneumoniae R6
ucaugacaucuuccaa

SEQ ID NO: 2192160 - RNA, 21 nt, Streptococcus pneumoniae R6
ucaugaggauggcuuucuuuc

SEQ ID NO: 2192161 - RNA, 18 nt, Streptococcus pneumoniae R6
ucaugacagccucaauga

SEQ ID NO: 2192162 - RNA, 22 nt, Streptococcus pneumoniae R6
ucaucucaccgaccaauucuuc

SEQ ID NO: 2192163 - RNA, 23 nt, Streptococcus pneumoniae R6
ucaucucaggcuuggucauuaaa

SEQ ID NO: 2192164 - RNA, 14 nt, Streptococcus pneumoniae R6
ucaucuauuuuuac

SEQ ID NO: 2192165 - RNA, 22 nt, Streptococcus pneumoniae R6
ucaucuauuuuuacucaaggac

SEQ ID NO: 2192166 - RNA, 15 nt, Streptococcus pneumoniae R6
ucaucuauaaucaau

SEQ ID NO: 2192167 - RNA, 13 nt, Streptococcus pneumoniae R6
ucaucuacaaccu

SEQ ID NO: 2192168 - RNA, 19 nt, Streptococcus pneumoniae R6
ucaucuggcuuucuguaau

SEQ ID NO: 2192169 - RNA, 16 nt, Streptococcus pneumoniae R6
ucaucuggaguagcau

SEQ ID NO: 2192170 - RNA, 23 nt, Streptococcus pneumoniae R6
ucaucuggaguagcauccccagu

SEQ ID NO: 2192171 - RNA, 11 nt, Streptococcus pneumoniae R6
ucaucuggaua

SEQ ID NO: 2192172 - RNA, 15 nt, Streptococcus pneumoniae R6
ucaucugcaauaaca

SEQ ID NO: 2192173 - RNA, 21 nt, Streptococcus pneumoniae R6
ucaucugcaauaacaaagucu

SEQ ID NO: 2192174 - RNA, 22 nt, Streptococcus pneumoniae R6
ucaucuuauagcgacuauaaaa

SEQ ID NO: 2192175 - RNA, 17 nt, Streptococcus pneumoniae R6
ucaucuuaucaacgcua

SEQ ID NO: 2192176 - RNA, 14 nt, Streptococcus pneumoniae R6
ucaucuguuuucaa

SEQ ID NO: 2192177 - RNA, 22 nt, Streptococcus pneumoniae R6
ucaucuuccaagaccuguaaau

SEQ ID NO: 2192178 - RNA, 23 nt, Streptococcus pneumoniae R6
uccaaaguagcuugcuccauucu

SEQ ID NO: 2192179 - RNA, 22 nt, Streptococcus pneumoniae R6
uccaaagguucaaucauuuugu

SEQ ID NO: 2192180 - RNA, 14 nt, Streptococcus pneumoniae R6
uccaaaguaaaaua

SEQ ID NO: 2192181 - RNA, 17 nt, Streptococcus pneumoniae R6
uccaaaguaaaauacaa

SEQ ID NO: 2192182 - RNA, 19 nt, Streptococcus pneumoniae R6
uccaaaguaaaauacaaac

SEQ ID NO: 2192183 - RNA, 16 nt, Streptococcus pneumoniae R6
uccaaauuagaaaaag

SEQ ID NO: 2192184 - RNA, 22 nt, Streptococcus pneumoniae R6
uccaauucugcuuuuaaauagu

SEQ ID NO: 2192185 - RNA, 13 nt, Streptococcus pneumoniae R6
uccaauucuucgu

SEQ ID NO: 2192186 - RNA, 11 nt, Streptococcus pneumoniae R6
uccaauuucua

SEQ ID NO: 2192187 - RNA, 17 nt, Streptococcus pneumoniae R6
uccaauuucuuuucauu

SEQ ID NO: 2192188 - RNA, 15 nt, Streptococcus pneumoniae R6
uccaauuuugucucu

SEQ ID NO: 2192189 - RNA, 19 nt, Streptococcus pneumoniae R6
uccaauuuugucucugaaa

SEQ ID NO: 2192190 - RNA, 19 nt, Streptococcus pneumoniae R6
uccaaauggcaugaggaga

SEQ ID NO: 2192191 - RNA, 16 nt, Streptococcus pneumoniae R6
uccacaaccucaaaac

SEQ ID NO: 2192192 - RNA, 18 nt, Streptococcus pneumoniae R6
uccacaaccucaaaacaa

SEQ ID NO: 2192193 - RNA, 18 nt, Streptococcus pneumoniae R6
uccacaaccucaaaacag

SEQ ID NO: 2192194 - RNA, 22 nt, Streptococcus pneumoniae R6
uccacaaccuuaaaacgguguu

SEQ ID NO: 2192195 - RNA, 14 nt, Streptococcus pneumoniae R6
uccaccacaaaaga

SEQ ID NO: 2192196 - RNA, 23 nt, Streptococcus pneumoniae R6
uccaccacaaaagagaaagacuu

SEQ ID NO: 2192197 - RNA, 18 nt, Streptococcus pneumoniae R6
uccaccuucaucucucua

SEQ ID NO: 2192198 - RNA, 15 nt, Streptococcus pneumoniae R6
uccaccuugaucuuc

SEQ ID NO: 2192199 - RNA, 18 nt, Streptococcus pneumoniae R6
uccaccuugaucuuccau

SEQ ID NO: 2192200 - RNA, 20 nt, Streptococcus pneumoniae R6
uccaccuugcaaaaaaacuu

SEQ ID NO: 2192201 - RNA, 13 nt, Streptococcus pneumoniae R6
uccacucaacauu

SEQ ID NO: 2192202 - RNA, 20 nt, Streptococcus pneumoniae R6
uccacucaguauuacaucca

SEQ ID NO: 2192203 - RNA, 15 nt, Streptococcus pneumoniae R6
uccacucagacagcu

SEQ ID NO: 2192204 - RNA, 13 nt, Streptococcus pneumoniae R6
uccagauuggagg

SEQ ID NO: 2192205 - RNA, 18 nt, Streptococcus pneumoniae R6
uccagacucaauugugca

SEQ ID NO: 2192206 - RNA, 14 nt, Streptococcus pneumoniae R6
uccaguuuggacca

SEQ ID NO: 2192207 - RNA, 13 nt, Streptococcus pneumoniae R6
uccaguuuuguuu

SEQ ID NO: 2192208 - RNA, 14 nt, Streptococcus pneumoniae R6
uccaguuuuguuuu

SEQ ID NO: 2192209 - RNA, 13 nt, Streptococcus pneumoniae R6
uccauaaaaagac

SEQ ID NO: 2192210 - RNA, 15 nt, Streptococcus pneumoniae R6
uccauaaugagcugu

SEQ ID NO: 2192211 - RNA, 20 nt, Streptococcus pneumoniae R6
uccauaaaaucacaucugcu

SEQ ID NO: 2192212 - RNA, 18 nt, Streptococcus pneumoniae R6
uccauaacgaguaaaaga

SEQ ID NO: 2192213 - RNA, 20 nt, Streptococcus pneumoniae R6
uccauaacgaguaaaagaua

SEQ ID NO: 2192214 - RNA, 14 nt, Streptococcus pneumoniae R6
uccagcuuuuucuu

SEQ ID NO: 2192215 - RNA, 11 nt, Streptococcus pneumoniae R6
uccagcugaga

SEQ ID NO: 2192216 - RNA, 18 nt, Streptococcus pneumoniae R6
uccagcuauuaaguccuu

SEQ ID NO: 2192217 - RNA, 16 nt, Streptococcus pneumoniae R6
uccagcacuaaaacgu

SEQ ID NO: 2192218 - RNA, 12 nt, Streptococcus pneumoniae R6
ugcagaaggcuu

SEQ ID NO: 2192219 - RNA, 14 nt, Streptococcus pneumoniae R6
ugcacggacuucug

SEQ ID NO: 2192220 - RNA, 19 nt, Streptococcus pneumoniae R6
ugauuuguccaucuguaau

SEQ ID NO: 2192221 - RNA, 17 nt, Streptococcus pneumoniae R6
ugauuugguugaagagg

SEQ ID NO: 2192222 - RNA, 19 nt, Streptococcus pneumoniae R6
ugauuugguugaagaggua

SEQ ID NO: 2192223 - RNA, 22 nt, Streptococcus pneumoniae R6
ugauuugcaggcuguuuuggau

SEQ ID NO: 2192224 - RNA, 14 nt, Streptococcus pneumoniae R6
ugauuugagugaau

SEQ ID NO: 2192225 - RNA, 18 nt, Streptococcus pneumoniae R6
ugauuuggacuauucguu

SEQ ID NO: 2192226 - RNA, 22 nt, Streptococcus pneumoniae R6
ugauuuggcgaugauuuuagag

SEQ ID NO: 2192227 - RNA, 21 nt, Streptococcus pneumoniae R6
ugauuugaaugccaaaauucc

SEQ ID NO: 2192228 - RNA, 19 nt, Streptococcus pneumoniae R6
ugauuucuuggaacuugcc

SEQ ID NO: 2192229 - RNA, 19 nt, Streptococcus pneumoniae R6
ugauuucuugugcugacau

SEQ ID NO: 2192230 - RNA, 11 nt, Streptococcus pneumoniae R6
ugauuucuucu

SEQ ID NO: 2192231 - RNA, 17 nt, Streptococcus pneumoniae R6
ugauuucuucuggauga

SEQ ID NO: 2192232 - RNA, 11 nt, Streptococcus pneumoniae R6
ugauuucugga

SEQ ID NO: 2192233 - RNA, 12 nt, Streptococcus pneumoniae R6
ugauuucuggau

SEQ ID NO: 2192234 - RNA, 18 nt, Streptococcus pneumoniae R6
ugauuucuggauuuccau

SEQ ID NO: 2192235 - RNA, 20 nt, Streptococcus pneumoniae R6
ugcagcuuguuguuaaacaa

SEQ ID NO: 2192236 - RNA, 13 nt, Streptococcus pneumoniae R6
ugcagauaagacu

SEQ ID NO: 2192237 - RNA, 19 nt, Streptococcus pneumoniae R6
ugcagagagauaaauauug

SEQ ID NO: 2192238 - RNA, 14 nt, Streptococcus pneumoniae R6
ugcagauaaagcug

SEQ ID NO: 2192239 - RNA, 11 nt, Streptococcus pneumoniae R6
ugcauuaaaaa

SEQ ID NO: 2192240 - RNA, 14 nt, Streptococcus pneumoniae R6
ugcaucaaaucacg

SEQ ID NO: 2192241 - RNA, 10 nt, Streptococcus pneumoniae R6
ugccacaacu

SEQ ID NO: 2192242 - RNA, 17 nt, Streptococcus pneumoniae R6
ugccaagaaaguugagc

SEQ ID NO: 2192243 - RNA, 21 nt, Streptococcus pneumoniae R6
ugccagauggacugaccaccu

SEQ ID NO: 2192244 - RNA, 14 nt, Streptococcus pneumoniae R6
ugcccacuaaaaau

SEQ ID NO: 2192245 - RNA, 20 nt, Streptococcus pneumoniae R6
ugccauuguuucguuucuuc

SEQ ID NO: 2192246 - RNA, 22 nt, Streptococcus pneumoniae R6
ugcccaaagacagguuucacau

SEQ ID NO: 2192247 - RNA, 14 nt, Streptococcus pneumoniae R6
ugcccaagagacuc

SEQ ID NO: 2192248 - RNA, 16 nt, Streptococcus pneumoniae R6
ugcccaagagacucuu

SEQ ID NO: 2192249 - RNA, 16 nt, Streptococcus pneumoniae R6
ugccaugguuucaucu

SEQ ID NO: 2192250 - RNA, 21 nt, Streptococcus pneumoniae R6
ugccauggccauaucugguuu

SEQ ID NO: 2192251 - RNA, 12 nt, Streptococcus pneumoniae R6
ugccaugagaau

SEQ ID NO: 2192252 - RNA, 11 nt, Streptococcus pneumoniae R6
ugccagccuua

SEQ ID NO: 2192253 - RNA, 18 nt, Streptococcus pneumoniae R6
ugccagcugagcuaagga

SEQ ID NO: 2192254 - RNA, 20 nt, Streptococcus pneumoniae R6
ugccuaaacacuucacuaau

SEQ ID NO: 2192255 - RNA, 18 nt, Streptococcus pneumoniae R6
ugccuaauuuuucaauau

SEQ ID NO: 2192256 - RNA, 22 nt, Streptococcus pneumoniae R6
ugccuaauacaugcaaguagaa

SEQ ID NO: 2192257 - RNA, 15 nt, Streptococcus pneumoniae R6
ugccucaauccuuuu

SEQ ID NO: 2192258 - RNA, 13 nt, Streptococcus pneumoniae R6
ugccucauuagua

SEQ ID NO: 2192259 - RNA, 19 nt, Streptococcus pneumoniae R6
ugccuccaagaaagagaau

SEQ ID NO: 2192260 - RNA, 20 nt, Streptococcus pneumoniae R6
ugccgugauuuccaaucuuc

SEQ ID NO: 2192261 - RNA, 14 nt, Streptococcus pneumoniae R6
ugccgcuccuuuau

SEQ ID NO: 2192262 - RNA, 13 nt, Streptococcus pneumoniae R6
ugcccucuucuuu

SEQ ID NO: 2192263 - RNA, 16 nt, Streptococcus pneumoniae R6
ugccgauaucaccaaa

SEQ ID NO: 2192264 - RNA, 14 nt, Streptococcus pneumoniae R6
ugcgccuagcuuuc

SEQ ID NO: 2192265 - RNA, 20 nt, Streptococcus pneumoniae R6
ugcgccuagcuuucuaguuu

SEQ ID NO: 2192266 - RNA, 16 nt, Streptococcus pneumoniae R6
ugcgacuacuaguucu

SEQ ID NO: 2192267 - RNA, 18 nt, Streptococcus pneumoniae R6
ugcgacuacuaguucugc

SEQ ID NO: 2192268 - RNA, 17 nt, Streptococcus pneumoniae R6
ugccucccacuaucuaa

SEQ ID NO: 2192269 - RNA, 23 nt, Streptococcus pneumoniae R6
ugcgcaacacacuguuuugaggu

SEQ ID NO: 2192270 - RNA, 18 nt, Streptococcus pneumoniae R6
ugcgagacaaaaaaaaca

SEQ ID NO: 2192271 - RNA, 19 nt, Streptococcus pneumoniae R6
ugcgacugguuuccuaguu

SEQ ID NO: 2192272 - RNA, 17 nt, Streptococcus pneumoniae R6
ugcggauaaaagagaau

SEQ ID NO: 2192273 - RNA, 21 nt, Streptococcus pneumoniae R6
ugcggacggucuuuggaaaua

SEQ ID NO: 2192274 - RNA, 14 nt, Streptococcus pneumoniae R6
ugcgcucaagcacc

SEQ ID NO: 2192275 - RNA, 15 nt, Streptococcus pneumoniae R6
ugcgcgugguccaga

SEQ ID NO: 2192276 - RNA, 20 nt, Streptococcus pneumoniae R6
ugagccacuauuuauuuaau

SEQ ID NO: 2192277 - RNA, 17 nt, Streptococcus pneumoniae R6
ugagccacaacuuuuaa

SEQ ID NO: 2192278 - RNA, 23 nt, Streptococcus pneumoniae R6
ugagcauguagucaaucaaaaug

SEQ ID NO: 2192279 - RNA, 16 nt, Streptococcus pneumoniae R6
ugagccguuucuuugg

SEQ ID NO: 2192280 - RNA, 20 nt, Streptococcus pneumoniae R6
ugagccuagugucucaaagu

SEQ ID NO: 2192281 - RNA, 21 nt, Streptococcus pneumoniae R6
ugagauuacugauaaaacuga

SEQ ID NO: 2192282 - RNA, 16 nt, Streptococcus pneumoniae R6
ugagauuggauuuucu

SEQ ID NO: 2192283 - RNA, 19 nt, Streptococcus pneumoniae R6
ugagauuauugguggcuuc

SEQ ID NO: 2192284 - RNA, 21 nt, Streptococcus pneumoniae R6
ugagaucuucuucuagaaaca

SEQ ID NO: 2192285 - RNA, 16 nt, Streptococcus pneumoniae R6
ugagaugacaacaugg

SEQ ID NO: 2192286 - RNA, 14 nt, Streptococcus pneumoniae R6
ugagaugagacagc

SEQ ID NO: 2192287 - RNA, 17 nt, Streptococcus pneumoniae R6
ugagaugagacagcaua

SEQ ID NO: 2192288 - RNA, 13 nt, Streptococcus pneumoniae R6
ugagaugaggcgc

SEQ ID NO: 2192289 - RNA, 17 nt, Streptococcus pneumoniae R6
ugagauggauuuuccuu

SEQ ID NO: 2192290 - RNA, 20 nt, Streptococcus pneumoniae R6
ugagauguccgccuuugaua

SEQ ID NO: 2192291 - RNA, 13 nt, Streptococcus pneumoniae R6
ugagcagaacaau

SEQ ID NO: 2192292 - RNA, 13 nt, Streptococcus pneumoniae R6
ugacuuucuaauu

SEQ ID NO: 2192293 - RNA, 15 nt, Streptococcus pneumoniae R6
ugacuuuugaaaaaa

SEQ ID NO: 2192294 - RNA, 20 nt, Streptococcus pneumoniae R6
ugacuuuugaaaaaaauguc

SEQ ID NO: 2192295 - RNA, 13 nt, Streptococcus pneumoniae R6
ugagaauugcuuu

SEQ ID NO: 2192296 - RNA, 15 nt, Streptococcus pneumoniae R6
ugagaauugcuuuaa

SEQ ID NO: 2192297 - RNA, 17 nt, Streptococcus pneumoniae R6
ugagaauggccgcagca

SEQ ID NO: 2192298 - RNA, 21 nt, Streptococcus pneumoniae R6
ugagacaguuuguguuucuuu

SEQ ID NO: 2192299 - RNA, 20 nt, Streptococcus pneumoniae R6
ugagaaacuuagcgaaauuc

SEQ ID NO: 2192300 - RNA, 22 nt, Streptococcus pneumoniae R6
ugagaauauuuacuucauuuuu

SEQ ID NO: 2192301 - RNA, 19 nt, Streptococcus pneumoniae R6
ugaccuuaucuauagcuuu

SEQ ID NO: 2192302 - RNA, 16 nt, Streptococcus pneumoniae R6
ugaccuuggcuuccga

SEQ ID NO: 2192303 - RNA, 18 nt, Streptococcus pneumoniae R6
ugaccuugaugaucuaaa

SEQ ID NO: 2192304 - RNA, 23 nt, Streptococcus pneumoniae R6
ugacugcaucagaugggucaaga

SEQ ID NO: 2192305 - RNA, 15 nt, Streptococcus pneumoniae R6
ugacuuguacucaau

SEQ ID NO: 2192306 - RNA, 19 nt, Streptococcus pneumoniae R6
ugacuuuccacaauuuuca

SEQ ID NO: 2192307 - RNA, 20 nt, Streptococcus pneumoniae R6
ugacuuuccacaauuuucau

SEQ ID NO: 2192308 - RNA, 21 nt, Streptococcus pneumoniae R6
ugacuuuccacaauuuucaua

SEQ ID NO: 2192309 - RNA, 13 nt, Streptococcus pneumoniae R6
ugaggaaagaaug

SEQ ID NO: 2192310 - RNA, 19 nt, Streptococcus pneumoniae R6
ugaggauggcuuucuuuca

SEQ ID NO: 2192311 - RNA, 11 nt, Streptococcus pneumoniae R6
ugagcuggcuc

SEQ ID NO: 2192312 - RNA, 14 nt, Streptococcus pneumoniae R6
ugagcuggaagaau

SEQ ID NO: 2192313 - RNA, 21 nt, Streptococcus pneumoniae R6
ugagguugcagauaagacuga

SEQ ID NO: 2192314 - RNA, 18 nt, Streptococcus pneumoniae R6
ugaguaacggcuuccugu

SEQ ID NO: 2192315 - RNA, 19 nt, Streptococcus pneumoniae R6
ugaguaacggcuuccugug

SEQ ID NO: 2192316 - RNA, 21 nt, Streptococcus pneumoniae R6
ugaguaacggcuuccugugcu

SEQ ID NO: 2192317 - RNA, 20 nt, Streptococcus pneumoniae R6
ugauacaaguucaucuucaa

SEQ ID NO: 2192318 - RNA, 22 nt, Streptococcus pneumoniae R6
ugauacaaguucaucuucaaaa

SEQ ID NO: 2192319 - RNA, 18 nt, Streptococcus pneumoniae R6
ugauaaccacagacugag

SEQ ID NO: 2192320 - RNA, 15 nt, Streptococcus pneumoniae R6
ugauaaaguuucugu

SEQ ID NO: 2192321 - RNA, 19 nt, Streptococcus pneumoniae R6
ugauaaauuucaaaguaga

SEQ ID NO: 2192322 - RNA, 16 nt, Streptococcus pneumoniae R6
ugauaacgaagagcug

SEQ ID NO: 2192323 - RNA, 19 nt, Streptococcus pneumoniae R6
ugauaacgaauccaacucu

SEQ ID NO: 2192324 - RNA, 17 nt, Streptococcus pneumoniae R6
ugauaauauuuucuuua

SEQ ID NO: 2192325 - RNA, 13 nt, Streptococcus pneumoniae R6
ugauaaucauaaa

SEQ ID NO: 2192326 - RNA, 17 nt, Streptococcus pneumoniae R6
ugauaauccaggaauca

SEQ ID NO: 2192327 - RNA, 18 nt, Streptococcus pneumoniae R6
ugauaauccaggaaucaa

SEQ ID NO: 2192328 - RNA, 21 nt, Streptococcus pneumoniae R6
ugauaauccaggaaucaacau

SEQ ID NO: 2192329 - RNA, 19 nt, Streptococcus pneumoniae R6
ugauaaugcguuuagcauc

SEQ ID NO: 2192330 - RNA, 18 nt, Streptococcus pneumoniae R6
ugaguucuuuaacaaaga

SEQ ID NO: 2192331 - RNA, 13 nt, Streptococcus pneumoniae R6
ugaguuucugcau

SEQ ID NO: 2192332 - RNA, 14 nt, Streptococcus pneumoniae R6
ugaguuuuaaucuc

SEQ ID NO: 2192333 - RNA, 21 nt, Streptococcus pneumoniae R6
ugaguuuuacaauguaauauu

SEQ ID NO: 2192334 - RNA, 19 nt, Streptococcus pneumoniae R6
ugaguuuggcuucaguaau

SEQ ID NO: 2192335 - RNA, 16 nt, Streptococcus pneumoniae R6
ugaguaugaaaagaga

SEQ ID NO: 2192336 - RNA, 19 nt, Streptococcus pneumoniae R6
ugagucagggaaaaaacuc

SEQ ID NO: 2192337 - RNA, 13 nt, Streptococcus pneumoniae R6
ugaguauuuagca

SEQ ID NO: 2192338 - RNA, 14 nt, Streptococcus pneumoniae R6
ugaguccgaaaaau

SEQ ID NO: 2192339 - RNA, 16 nt, Streptococcus pneumoniae R6
ugagucguucucuuau

SEQ ID NO: 2192340 - RNA, 14 nt, Streptococcus pneumoniae R6
ugaucaagaugaga

SEQ ID NO: 2192341 - RNA, 14 nt, Streptococcus pneumoniae R6
ugaucaaucauguu

SEQ ID NO: 2192342 - RNA, 22 nt, Streptococcus pneumoniae R6
ugaucaaucauguuaacccacu

SEQ ID NO: 2192343 - RNA, 19 nt, Streptococcus pneumoniae R6
ugauauugcaguauaucug

SEQ ID NO: 2192344 - RNA, 13 nt, Streptococcus pneumoniae R6
ugauauucuuauc

SEQ ID NO: 2192345 - RNA, 15 nt, Streptococcus pneumoniae R6
ugauauuggucagau

SEQ ID NO: 2192346 - RNA, 19 nt, Streptococcus pneumoniae R6
ugaucuauuguugcauuaa

SEQ ID NO: 2192347 - RNA, 17 nt, Streptococcus pneumoniae R6
ugaucuaaauguauugu

SEQ ID NO: 2192348 - RNA, 14 nt, Streptococcus pneumoniae R6
ugaucagaguuuug

SEQ ID NO: 2192349 - RNA, 20 nt, Streptococcus pneumoniae R6
ugaucagaguuuugaaaacu

SEQ ID NO: 2192350 - RNA, 11 nt, Streptococcus pneumoniae R6
ugauggaagac

SEQ ID NO: 2192351 - RNA, 14 nt, Streptococcus pneumoniae R6
ugauggaagacuga

SEQ ID NO: 2192352 - RNA, 12 nt, Streptococcus pneumoniae R6
ugaugcugcauu

SEQ ID NO: 2192353 - RNA, 16 nt, Streptococcus pneumoniae R6
ugauggaguuuucaau

SEQ ID NO: 2192354 - RNA, 23 nt, Streptococcus pneumoniae R6
ugaugaaccuucaucaaaugacu

SEQ ID NO: 2192355 - RNA, 17 nt, Streptococcus pneumoniae R6
ugaugaacggagauagu

SEQ ID NO: 2192356 - RNA, 21 nt, Streptococcus pneumoniae R6
ugaugaacggagauaguacca

SEQ ID NO: 2192357 - RNA, 22 nt, Streptococcus pneumoniae R6
ugaugaacggagauaguaccau

SEQ ID NO: 2192358 - RNA, 14 nt, Streptococcus pneumoniae R6
ugaugaaaaaaagu

SEQ ID NO: 2192359 - RNA, 21 nt, Streptococcus pneumoniae R6
ugaugaagggcuuuucuauca

SEQ ID NO: 2192360 - RNA, 22 nt, Streptococcus pneumoniae R6
ugaugaagggcuuuucuaucac

SEQ ID NO: 2192361 - RNA, 21 nt, Streptococcus pneumoniae R6
ugauuggaaugacgaaacgaa

SEQ ID NO: 2192362 - RNA, 19 nt, Streptococcus pneumoniae R6
ugauuggugucaaaaagga

SEQ ID NO: 2192363 - RNA, 17 nt, Streptococcus pneumoniae R6
ugauuuauagaaauguu

SEQ ID NO: 2192364 - RNA, 21 nt, Streptococcus pneumoniae R6
ugauuuauagaaauguuuuag

SEQ ID NO: 2192365 - RNA, 21 nt, Streptococcus pneumoniae R6
ugauuucauaagguaccuccu

SEQ ID NO: 2192366 - RNA, 16 nt, Streptococcus pneumoniae R6
ugauuucaauuuuaaa

SEQ ID NO: 2192367 - RNA, 17 nt, Streptococcus pneumoniae R6
ugauuucaagaccauuu

SEQ ID NO: 2192368 - RNA, 15 nt, Streptococcus pneumoniae R6
ugauuucaaguaaaa

SEQ ID NO: 2192369 - RNA, 16 nt, Streptococcus pneumoniae R6
ugauuucaaguaaaau

SEQ ID NO: 2192370 - RNA, 19 nt, Streptococcus pneumoniae R6
ugauuucuccgcuuccaga

SEQ ID NO: 2192371 - RNA, 15 nt, Streptococcus pneumoniae R6
ugauuucucuugcaa

SEQ ID NO: 2192372 - RNA, 11 nt, Streptococcus pneumoniae R6
ugauuaggaga

SEQ ID NO: 2192373 - RNA, 20 nt, Streptococcus pneumoniae R6
ugauuauguuuuaaauaaac

SEQ ID NO: 2192374 - RNA, 22 nt, Streptococcus pneumoniae R6
ugauuauuacaacaauaagaga

SEQ ID NO: 2192375 - RNA, 22 nt, Streptococcus pneumoniae R6
ugauucaaagucauaaacaucu

SEQ ID NO: 2192376 - RNA, 21 nt, Streptococcus pneumoniae R6
ugauucaaggaguugucuaua

SEQ ID NO: 2192377 - RNA, 22 nt, Streptococcus pneumoniae R6
ugauucaaggaguugucuauag

SEQ ID NO: 2192378 - RNA, 17 nt, Streptococcus pneumoniae R6
ugauucagauucaucau

SEQ ID NO: 2192379 - RNA, 14 nt, Streptococcus pneumoniae R6
ugauucucagguuu

SEQ ID NO: 2192380 - RNA, 21 nt, Streptococcus pneumoniae R6
ugauucaugacaucuuccaaa

SEQ ID NO: 2192381 - RNA, 14 nt, Streptococcus pneumoniae R6
ugauguuaaaauga

SEQ ID NO: 2192382 - RNA, 22 nt, Streptococcus pneumoniae R6
ugauguuaagugcuucuuugua

SEQ ID NO: 2192383 - RNA, 20 nt, Streptococcus pneumoniae R6
ugauguuacuucugaaucug

SEQ ID NO: 2192384 - RNA, 16 nt, Streptococcus pneumoniae R6
ugauguuaucaaaucg

SEQ ID NO: 2192385 - RNA, 21 nt, Streptococcus pneumoniae R6
ugaugucuuggauuuuugauu

SEQ ID NO: 2192386 - RNA, 20 nt, Streptococcus pneumoniae R6
ugauggguuagguucaaucc

SEQ ID NO: 2192387 - RNA, 21 nt, Streptococcus pneumoniae R6
ugaauuucaagaaugaaaguu

SEQ ID NO: 2192388 - RNA, 17 nt, Streptococcus pneumoniae R6
ugaauuugaaacaauga

SEQ ID NO: 2192389 - RNA, 22 nt, Streptococcus pneumoniae R6
ugaauuucuacaaauguuuuag

SEQ ID NO: 2192390 - RNA, 13 nt, Streptococcus pneumoniae R6
ugaauugaaauaa

SEQ ID NO: 2192391 - RNA, 17 nt, Streptococcus pneumoniae R6
ugaauugaaauaagaug

SEQ ID NO: 2192392 - RNA, 12 nt, Streptococcus pneumoniae R6
ugaauucuaaug

SEQ ID NO: 2192393 - RNA, 12 nt, Streptococcus pneumoniae R6
ugaauucuccaa

SEQ ID NO: 2192394 - RNA, 14 nt, Streptococcus pneumoniae R6
ugaauuagugaagu

SEQ ID NO: 2192395 - RNA, 17 nt, Streptococcus pneumoniae R6
ugaauggccuccuucau

SEQ ID NO: 2192396 - RNA, 21 nt, Streptococcus pneumoniae R6
ugaauggauuuaucaguauau

SEQ ID NO: 2192397 - RNA, 18 nt, Streptococcus pneumoniae R6
ugaaugcucccuucuuua

SEQ ID NO: 2192398 - RNA, 23 nt, Streptococcus pneumoniae R6
ugaaugcuuacuucacuucugua

SEQ ID NO: 2192399 - RNA, 15 nt, Streptococcus pneumoniae R6
ugaaugccuccaaga

SEQ ID NO: 2192400 - RNA, 19 nt, Streptococcus pneumoniae R6
ugaaugccuccaagaaaga

SEQ ID NO: 2192401 - RNA, 16 nt, Streptococcus pneumoniae R6
ugaaugauuucuucuu

SEQ ID NO: 2192402 - RNA, 23 nt, Streptococcus pneumoniae R6
ugaaucugccucaagaagugguu

SEQ ID NO: 2192403 - RNA, 18 nt, Streptococcus pneumoniae R6
ugaaucugaaauaguacg

SEQ ID NO: 2192404 - RNA, 16 nt, Streptococcus pneumoniae R6
ugaaucugaaucaaaa

SEQ ID NO: 2192405 - RNA, 17 nt, Streptococcus pneumoniae R6
ugaaucugaaucaaaau

SEQ ID NO: 2192406 - RNA, 19 nt, Streptococcus pneumoniae R6
ugaaucugaaucaaaauua

SEQ ID NO: 2192407 - RNA, 16 nt, Streptococcus pneumoniae R6
ugaaugauaaaacaua

SEQ ID NO: 2192408 - RNA, 19 nt, Streptococcus pneumoniae R6
ugaaugauguuuaagucuu

SEQ ID NO: 2192409 - RNA, 21 nt, Streptococcus pneumoniae R6
ugaaugacaaauccauucuuu

SEQ ID NO: 2192410 - RNA, 16 nt, Streptococcus pneumoniae R6
ugaaugagcuuccagu

SEQ ID NO: 2192411 - RNA, 16 nt, Streptococcus pneumoniae R6
ugaaucaaaaaugaag

SEQ ID NO: 2192412 - RNA, 21 nt, Streptococcus pneumoniae R6
ugaaucauuuccuucguuuuc

SEQ ID NO: 2192413 - RNA, 14 nt, Streptococcus pneumoniae R6
ugaauccgaaaaau

SEQ ID NO: 2192414 - RNA, 20 nt, Streptococcus pneumoniae R6
ugaauccgaaaaauuucucc

SEQ ID NO: 2192415 - RNA, 18 nt, Streptococcus pneumoniae R6
ugaaucgacgcuuucuaa

SEQ ID NO: 2192416 - RNA, 18 nt, Streptococcus pneumoniae R6
ugaaucuaaaauaguacg

SEQ ID NO: 2192417 - RNA, 17 nt, Streptococcus pneumoniae R6
ugaaucuccucaggaac

SEQ ID NO: 2192418 - RNA, 14 nt, Streptococcus pneumoniae R6
ugacaaagagccua

SEQ ID NO: 2192419 - RNA, 16 nt, Streptococcus pneumoniae R6
ugacaaagaaaaaaca

SEQ ID NO: 2192420 - RNA, 19 nt, Streptococcus pneumoniae R6
ugacaaagagccaaaaaag

SEQ ID NO: 2192421 - RNA, 19 nt, Streptococcus pneumoniae R6
ugacaaagagccauaaaaa

SEQ ID NO: 2192422 - RNA, 22 nt, Streptococcus pneumoniae R6
ugacaaagagccauaaaaauaa

SEQ ID NO: 2192423 - RNA, 19 nt, Streptococcus pneumoniae R6
ugacaaagagccccuuucu

SEQ ID NO: 2192424 - RNA, 15 nt, Streptococcus pneumoniae R6
ugacaaaauaaaaac

SEQ ID NO: 2192425 - RNA, 23 nt, Streptococcus pneumoniae R6
ugacaaaauaaaaacaucuaccu

SEQ ID NO: 2192426 - RNA, 20 nt, Streptococcus pneumoniae R6
ugacaacaagggcguuaccu

SEQ ID NO: 2192427 - RNA, 14 nt, Streptococcus pneumoniae R6
ugacaacguaaaau

SEQ ID NO: 2192428 - RNA, 15 nt, Streptococcus pneumoniae R6
ugacaacauaaggca

SEQ ID NO: 2192429 - RNA, 19 nt, Streptococcus pneumoniae R6
ugacaauuuuuccagcuuu

SEQ ID NO: 2192430 - RNA, 15 nt, Streptococcus pneumoniae R6
ugacaauuauauaaa

SEQ ID NO: 2192431 - RNA, 19 nt, Streptococcus pneumoniae R6
ugacaauguaccugcaaau

SEQ ID NO: 2192432 - RNA, 17 nt, Streptococcus pneumoniae R6
ugacaagguuuccugca

SEQ ID NO: 2192433 - RNA, 17 nt, Streptococcus pneumoniae R6
ugacaaguaaguagcau

SEQ ID NO: 2192434 - RNA, 21 nt, Streptococcus pneumoniae R6
ugacaaguaaguagcaucuug

SEQ ID NO: 2192435 - RNA, 15 nt, Streptococcus pneumoniae R6
ugacaauaaagauaa

SEQ ID NO: 2192436 - RNA, 18 nt, Streptococcus pneumoniae R6
ugacaaucauuucaguug

SEQ ID NO: 2192437 - RNA, 20 nt, Streptococcus pneumoniae R6
ugacaccacuuuuggucaga

SEQ ID NO: 2192438 - RNA, 23 nt, Streptococcus pneumoniae R6
ugacacgaucauccauucuuuuu

SEQ ID NO: 2192439 - RNA, 16 nt, Streptococcus pneumoniae R6
ugacacuagacaguga

SEQ ID NO: 2192440 - RNA, 15 nt, Streptococcus pneumoniae R6
ugacagauucaucac

SEQ ID NO: 2192441 - RNA, 19 nt, Streptococcus pneumoniae R6
ugacauacaacuuaaaaag

SEQ ID NO: 2192442 - RNA, 23 nt, Streptococcus pneumoniae R6
ugacauacaacuuaaaaagaggu

SEQ ID NO: 2192443 - RNA, 16 nt, Streptococcus pneumoniae R6
ugacagugauuaaaac

SEQ ID NO: 2192444 - RNA, 14 nt, Streptococcus pneumoniae R6
ugaccagugauaac

SEQ ID NO: 2192445 - RNA, 12 nt, Streptococcus pneumoniae R6
ugaccauuucaa

SEQ ID NO: 2192446 - RNA, 23 nt, Streptococcus pneumoniae R6
ugaccauuucaauagcuccuugu

SEQ ID NO: 2192447 - RNA, 14 nt, Streptococcus pneumoniae R6
ugaccuguuuucac

SEQ ID NO: 2192448 - RNA, 19 nt, Streptococcus pneumoniae R6
ugaaaccauuagauuucag

SEQ ID NO: 2192449 - RNA, 13 nt, Streptococcus pneumoniae R6
ugaaaccccaaga

SEQ ID NO: 2192450 - RNA, 21 nt, Streptococcus pneumoniae R6
ugaaaccccaagaaacaacaa

SEQ ID NO: 2192451 - RNA, 22 nt, Streptococcus pneumoniae R6
ucuucuaaaaaggcguucaucc

SEQ ID NO: 2192452 - RNA, 23 nt, Streptococcus pneumoniae R6
ucuucguuucgucauuccaauca

SEQ ID NO: 2192453 - RNA, 15 nt, Streptococcus pneumoniae R6
ugaaacuguggaaaa

SEQ ID NO: 2192454 - RNA, 18 nt, Streptococcus pneumoniae R6
ugaaacuguggaaaauag

SEQ ID NO: 2192455 - RNA, 19 nt, Streptococcus pneumoniae R6
ugaaacuguggaaaauaga

SEQ ID NO: 2192456 - RNA, 20 nt, Streptococcus pneumoniae R6
ugaaacuguggaaaauagaa

SEQ ID NO: 2192457 - RNA, 17 nt, Streptococcus pneumoniae R6
ugaaacccuugauuuuu

SEQ ID NO: 2192458 - RNA, 16 nt, Streptococcus pneumoniae R6
ucuucgguuaggaugu

SEQ ID NO: 2192459 - RNA, 21 nt, Streptococcus pneumoniae R6
ucuucgguuaggauguaggau

SEQ ID NO: 2192460 - RNA, 23 nt, Streptococcus pneumoniae R6
ucuucgguuaggauguaggauug

SEQ ID NO: 2192461 - RNA, 20 nt, Streptococcus pneumoniae R6
ugaaagugagaagcccagua

SEQ ID NO: 2192462 - RNA, 22 nt, Streptococcus pneumoniae R6
ugaaagugagaagcccaguacu

SEQ ID NO: 2192463 - RNA, 14 nt, Streptococcus pneumoniae R6
ugaaagugaaaaag

SEQ ID NO: 2192464 - RNA, 20 nt, Streptococcus pneumoniae R6
ugaaauacugauguaacugu

SEQ ID NO: 2192465 - RNA, 17 nt, Streptococcus pneumoniae R6
ugaaauacuaaaaaaaa

SEQ ID NO: 2192466 - RNA, 22 nt, Streptococcus pneumoniae R6
ugaaauacuaaaaaaaaaaagu

SEQ ID NO: 2192467 - RNA, 17 nt, Streptococcus pneumoniae R6
ugaaagaaacucuaaac

SEQ ID NO: 2192468 - RNA, 20 nt, Streptococcus pneumoniae R6
ugaaagaugaagcaaucaau

SEQ ID NO: 2192469 - RNA, 17 nt, Streptococcus pneumoniae R6
ugaaaggguagugaaag

SEQ ID NO: 2192470 - RNA, 14 nt, Streptococcus pneumoniae R6
ugaaauauuuuuua

SEQ ID NO: 2192471 - RNA, 22 nt, Streptococcus pneumoniae R6
ugaaauauuuuuuacuuuugca

SEQ ID NO: 2192472 - RNA, 17 nt, Streptococcus pneumoniae R6
ugaaaucaaggcaguga

SEQ ID NO: 2192473 - RNA, 15 nt, Streptococcus pneumoniae R6
ugaaauuaaauauga

SEQ ID NO: 2192474 - RNA, 19 nt, Streptococcus pneumoniae R6
ugaaaugguguauuaucaa

SEQ ID NO: 2192475 - RNA, 15 nt, Streptococcus pneumoniae R6
ugaaauguuccaagu

SEQ ID NO: 2192476 - RNA, 17 nt, Streptococcus pneumoniae R6
ugaaauguuccaagucc

SEQ ID NO: 2192477 - RNA, 19 nt, Streptococcus pneumoniae R6
ugaaauuccucuaguuggu

SEQ ID NO: 2192478 - RNA, 20 nt, Streptococcus pneumoniae R6
ugaaauuccucuaguuggua

SEQ ID NO: 2192479 - RNA, 17 nt, Streptococcus pneumoniae R6
ugaaauucgcuuuuuua

SEQ ID NO: 2192480 - RNA, 22 nt, Streptococcus pneumoniae R6
ugaaauucgcuuuuuuaaaugc

SEQ ID NO: 2192481 - RNA, 23 nt, Streptococcus pneumoniae R6
ugaaauuggaguguguccaugug

SEQ ID NO: 2192482 - RNA, 15 nt, Streptococcus pneumoniae R6
ugaaauuuaaaaaga

SEQ ID NO: 2192483 - RNA, 16 nt, Streptococcus pneumoniae R6
ugaaauuuaaaaagaa

SEQ ID NO: 2192484 - RNA, 17 nt, Streptococcus pneumoniae R6
ugaacauguccauucau

SEQ ID NO: 2192485 - RNA, 20 nt, Streptococcus pneumoniae R6
ugaacaucucuaucaggaaa

SEQ ID NO: 2192486 - RNA, 23 nt, Streptococcus pneumoniae R6
ugaacauuuuccgagacagagac

SEQ ID NO: 2192487 - RNA, 12 nt, Streptococcus pneumoniae R6
ugaacaaauuaa

SEQ ID NO: 2192488 - RNA, 13 nt, Streptococcus pneumoniae R6
ugaacaaauuaau

SEQ ID NO: 2192489 - RNA, 20 nt, Streptococcus pneumoniae R6
ugaacaaauuaauucggaaa

SEQ ID NO: 2192490 - RNA, 17 nt, Streptococcus pneumoniae R6
ugaacaagccuagucuu

SEQ ID NO: 2192491 - RNA, 16 nt, Streptococcus pneumoniae R6
ugaacaaggacagcaa

SEQ ID NO: 2192492 - RNA, 15 nt, Streptococcus pneumoniae R6
ugaacaaugaaaaaa

SEQ ID NO: 2192493 - RNA, 20 nt, Streptococcus pneumoniae R6
ugaacaaugguaacagucuu

SEQ ID NO: 2192494 - RNA, 19 nt, Streptococcus pneumoniae R6
ugaaguugauucaugacau

SEQ ID NO: 2192495 - RNA, 21 nt, Streptococcus pneumoniae R6
ugaaguugacgaaguuguucu

SEQ ID NO: 2192496 - RNA, 15 nt, Streptococcus pneumoniae R6
ugaaguucauuuucu

SEQ ID NO: 2192497 - RNA, 18 nt, Streptococcus pneumoniae R6
ugaaguucauuuucuuua

SEQ ID NO: 2192498 - RNA, 23 nt, Streptococcus pneumoniae R6
ugaaguucauuuucuuuacuucu

SEQ ID NO: 2192499 - RNA, 19 nt, Streptococcus pneumoniae R6
ugaaguuccucuuuuuccc

SEQ ID NO: 2192500 - RNA, 20 nt, Streptococcus pneumoniae R6
ugaaguuccucuuuuucccc

SEQ ID NO: 2192501 - RNA, 14 nt, Streptococcus pneumoniae R6
ugaaguguuuuuuc

SEQ ID NO: 2192502 - RNA, 16 nt, Streptococcus pneumoniae R6
ugaaguguuuuuucau

SEQ ID NO: 2192503 - RNA, 13 nt, Streptococcus pneumoniae R6
ugaaguaaauauu

SEQ ID NO: 2192504 - RNA, 16 nt, Streptococcus pneumoniae R6
ugaaguaaauauuucu

SEQ ID NO: 2192505 - RNA, 14 nt, Streptococcus pneumoniae R6
ugaaguaaauguga

SEQ ID NO: 2192506 - RNA, 15 nt, Streptococcus pneumoniae R6
ugaauaccuaaucuu

SEQ ID NO: 2192507 - RNA, 16 nt, Streptococcus pneumoniae R6
ugaauaccuaaucuuu

SEQ ID NO: 2192508 - RNA, 23 nt, Streptococcus pneumoniae R6
ugaauagcugcggcuuucuucac

SEQ ID NO: 2192509 - RNA, 22 nt, Streptococcus pneumoniae R6
ugaauagcuuaaaaucuuguca

SEQ ID NO: 2192510 - RNA, 13 nt, Streptococcus pneumoniae R6
ugaauagugaaga

SEQ ID NO: 2192511 - RNA, 18 nt, Streptococcus pneumoniae R6
ugaauauggauaauugaa

SEQ ID NO: 2192512 - RNA, 19 nt, Streptococcus pneumoniae R6
ugaauauaccuuagauggu

SEQ ID NO: 2192513 - RNA, 14 nt, Streptococcus pneumoniae R6
ugaauauauucucc

SEQ ID NO: 2192514 - RNA, 15 nt, Streptococcus pneumoniae R6
ugaauauauucucca

SEQ ID NO: 2192515 - RNA, 16 nt, Streptococcus pneumoniae R6
ugaauauauucuccag

SEQ ID NO: 2192516 - RNA, 16 nt, Streptococcus pneumoniae R6
ugaauauccuuauaua

SEQ ID NO: 2192517 - RNA, 14 nt, Streptococcus pneumoniae R6
ugaauauccccuga

SEQ ID NO: 2192518 - RNA, 16 nt, Streptococcus pneumoniae R6
ugaaggcuuuaaaugc

SEQ ID NO: 2192519 - RNA, 18 nt, Streptococcus pneumoniae R6
ugaaggcuuuaaaugcug

SEQ ID NO: 2192520 - RNA, 14 nt, Streptococcus pneumoniae R6
ugaaggucuucuug

SEQ ID NO: 2192521 - RNA, 17 nt, Streptococcus pneumoniae R6
ugaagauugauaaaggc

SEQ ID NO: 2192522 - RNA, 19 nt, Streptococcus pneumoniae R6
ugaagaaagcgaagaucua

SEQ ID NO: 2192523 - RNA, 15 nt, Streptococcus pneumoniae R6
ugaacuuuuucuaac

SEQ ID NO: 2192524 - RNA, 18 nt, Streptococcus pneumoniae R6
ugaagaguauuauucuuc

SEQ ID NO: 2192525 - RNA, 21 nt, Streptococcus pneumoniae R6
ugaagacuuuuauccaccuau

SEQ ID NO: 2192526 - RNA, 16 nt, Streptococcus pneumoniae R6
ugaagacuuuuuaaag

SEQ ID NO: 2192527 - RNA, 15 nt, Streptococcus pneumoniae R6
ugaaccuuucuucau

SEQ ID NO: 2192528 - RNA, 22 nt, Streptococcus pneumoniae R6
ugaaccuuucuucauagcagca

SEQ ID NO: 2192529 - RNA, 20 nt, Streptococcus pneumoniae R6
ugaacuugaccuaaaucacu

SEQ ID NO: 2192530 - RNA, 13 nt, Streptococcus pneumoniae R6
ugaacuuuagaaa

SEQ ID NO: 2192531 - RNA, 22 nt, Streptococcus pneumoniae R6
ugaacuuucgaaugguguuaau

SEQ ID NO: 2192532 - RNA, 18 nt, Streptococcus pneumoniae R6
ucgccuaguaagaugagu

SEQ ID NO: 2192533 - RNA, 22 nt, Streptococcus pneumoniae R6
ucgccuuaccguauauauguua

SEQ ID NO: 2192534 - RNA, 20 nt, Streptococcus pneumoniae R6
ucgccuggagcuucaucagu

SEQ ID NO: 2192535 - RNA, 16 nt, Streptococcus pneumoniae R6
ucgcgaccaagagcaa

SEQ ID NO: 2192536 - RNA, 19 nt, Streptococcus pneumoniae R6
ucgcgauugauuuccaaaa

SEQ ID NO: 2192537 - RNA, 20 nt, Streptococcus pneumoniae R6
ucgcgauugauuuccaaaaa

SEQ ID NO: 2192538 - RNA, 13 nt, Streptococcus pneumoniae R6
uccauaccaucaa

SEQ ID NO: 2192539 - RNA, 20 nt, Streptococcus pneumoniae R6
uccauaccaucaaagaccac

SEQ ID NO: 2192540 - RNA, 18 nt, Streptococcus pneumoniae R6
ucgccaauucuuucaagc

SEQ ID NO: 2192541 - RNA, 16 nt, Streptococcus pneumoniae R6
ucgcucgucaucgucu

SEQ ID NO: 2192542 - RNA, 18 nt, Streptococcus pneumoniae R6
ucgcucuaacugaagcug

SEQ ID NO: 2192543 - RNA, 14 nt, Streptococcus pneumoniae R6
ucgcuaucaauggu

SEQ ID NO: 2192544 - RNA, 18 nt, Streptococcus pneumoniae R6
ucgcuuucuucauuuugu

SEQ ID NO: 2192545 - RNA, 22 nt, Streptococcus pneumoniae R6
ucgcuuuucauuauaggucaua

SEQ ID NO: 2192546 - RNA, 13 nt, Streptococcus pneumoniae R6
ucgcuuuuuuaaa

SEQ ID NO: 2192547 - RNA, 19 nt, Streptococcus pneumoniae R6
ucgcuuuuuuaguuugcau

SEQ ID NO: 2192548 - RNA, 16 nt, Streptococcus pneumoniae R6
ucgcuuggauuuucaa

SEQ ID NO: 2192549 - RNA, 22 nt, Streptococcus pneumoniae R6
ucgcuugcuagauauuguucua

SEQ ID NO: 2192550 - RNA, 20 nt, Streptococcus pneumoniae R6
ucgcuucuguaacaaagcua

SEQ ID NO: 2192551 - RNA, 15 nt, Streptococcus pneumoniae R6
ucgcuuaauuucuau

SEQ ID NO: 2192552 - RNA, 13 nt, Streptococcus pneumoniae R6
ucgcuuacauaaa

SEQ ID NO: 2192553 - RNA, 17 nt, Streptococcus pneumoniae R6
ucggaaagccaaaucaa

SEQ ID NO: 2192554 - RNA, 12 nt, Streptococcus pneumoniae R6
ucggauaaaauc

SEQ ID NO: 2192555 - RNA, 11 nt, Streptococcus pneumoniae R6
ucggcagucuu

SEQ ID NO: 2192556 - RNA, 22 nt, Streptococcus pneumoniae R6
ucggcauucuucucuugaaaau

SEQ ID NO: 2192557 - RNA, 20 nt, Streptococcus pneumoniae R6
ucggcaugcugacaaagaga

SEQ ID NO: 2192558 - RNA, 17 nt, Streptococcus pneumoniae R6
ucggccaauucuucuuc

SEQ ID NO: 2192559 - RNA, 19 nt, Streptococcus pneumoniae R6
ucggauuuuucuuuuaaaa

SEQ ID NO: 2192560 - RNA, 22 nt, Streptococcus pneumoniae R6
ucggauggaaauaaucuuucac

SEQ ID NO: 2192561 - RNA, 20 nt, Streptococcus pneumoniae R6
ucggauacuugcaaacuuuu

SEQ ID NO: 2192562 - RNA, 12 nt, Streptococcus pneumoniae R6
ucguaaaaaagu

SEQ ID NO: 2192563 - RNA, 15 nt, Streptococcus pneumoniae R6
ucguaaaaaagucuu

SEQ ID NO: 2192564 - RNA, 17 nt, Streptococcus pneumoniae R6
ucguaaaccuucaagac

SEQ ID NO: 2192565 - RNA, 17 nt, Streptococcus pneumoniae R6
ucggucuuggaccagga

SEQ ID NO: 2192566 - RNA, 17 nt, Streptococcus pneumoniae R6
ucggcugguauuuuuuc

SEQ ID NO: 2192567 - RNA, 19 nt, Streptococcus pneumoniae R6
ucggcugguauuuuuucaa

SEQ ID NO: 2192568 - RNA, 14 nt, Streptococcus pneumoniae R6
ucggcuguuuuuuc

SEQ ID NO: 2192569 - RNA, 16 nt, Streptococcus pneumoniae R6
ucggcuguuuuuucuu

SEQ ID NO: 2192570 - RNA, 19 nt, Streptococcus pneumoniae R6
ucggcuguuuuuucuuauc

SEQ ID NO: 2192571 - RNA, 13 nt, Streptococcus pneumoniae R6
ucgggauaaaaua

SEQ ID NO: 2192572 - RNA, 13 nt, Streptococcus pneumoniae R6
ucgucagaggaag

SEQ ID NO: 2192573 - RNA, 13 nt, Streptococcus pneumoniae R6
ucgucaguuucau

SEQ ID NO: 2192574 - RNA, 16 nt, Streptococcus pneumoniae R6
ucgucaguuucaucca

SEQ ID NO: 2192575 - RNA, 18 nt, Streptococcus pneumoniae R6
ucgucaguucuaucugca

SEQ ID NO: 2192576 - RNA, 13 nt, Streptococcus pneumoniae R6
ucgucauuuaaag

SEQ ID NO: 2192577 - RNA, 14 nt, Streptococcus pneumoniae R6
ucgucauuuaaaga

SEQ ID NO: 2192578 - RNA, 16 nt, Streptococcus pneumoniae R6
ucguccagcacuaaaa

SEQ ID NO: 2192579 - RNA, 15 nt, Streptococcus pneumoniae R6
ucguccuuucuuuuu

SEQ ID NO: 2192580 - RNA, 14 nt, Streptococcus pneumoniae R6
ucguagauuaaaac

SEQ ID NO: 2192581 - RNA, 16 nt, Streptococcus pneumoniae R6
ucguacuauuucagau

SEQ ID NO: 2192582 - RNA, 14 nt, Streptococcus pneumoniae R6
ucguacaauauuug

SEQ ID NO: 2192583 - RNA, 18 nt, Streptococcus pneumoniae R6
ucguacacucaaaucaaa

SEQ ID NO: 2192584 - RNA, 23 nt, Streptococcus pneumoniae R6
ucguacacucaaaucaaaauaua

SEQ ID NO: 2192585 - RNA, 16 nt, Streptococcus pneumoniae R6
ucguaaccuucuucug

SEQ ID NO: 2192586 - RNA, 12 nt, Streptococcus pneumoniae R6
ucguauugaaug

SEQ ID NO: 2192587 - RNA, 15 nt, Streptococcus pneumoniae R6
ucguaugcuugccaa

SEQ ID NO: 2192588 - RNA, 15 nt, Streptococcus pneumoniae R6
ucguauggcaagauc

SEQ ID NO: 2192589 - RNA, 19 nt, Streptococcus pneumoniae R6
ucgucaauaauagcuugca

SEQ ID NO: 2192590 - RNA, 21 nt, Streptococcus pneumoniae R6
ucgucacgacgcaguucuuca

SEQ ID NO: 2192591 - RNA, 22 nt, Streptococcus pneumoniae R6
ucgucacgacgcaguucuucau

SEQ ID NO: 2192592 - RNA, 16 nt, Streptococcus pneumoniae R6
ucguauaguagaagug

SEQ ID NO: 2192593 - RNA, 23 nt, Streptococcus pneumoniae R6
ucguauaguagaaguguauuauu

SEQ ID NO: 2192594 - RNA, 19 nt, Streptococcus pneumoniae R6
ucguagucuuucaccacuu

SEQ ID NO: 2192595 - RNA, 16 nt, Streptococcus pneumoniae R6
ucgucugaguuuuuau

SEQ ID NO: 2192596 - RNA, 12 nt, Streptococcus pneumoniae R6
ucgugaauagag

SEQ ID NO: 2192597 - RNA, 15 nt, Streptococcus pneumoniae R6
ucgugaauagagucu

SEQ ID NO: 2192598 - RNA, 13 nt, Streptococcus pneumoniae R6
ucgugccaaucuc

SEQ ID NO: 2192599 - RNA, 16 nt, Streptococcus pneumoniae R6
ucgugcauuucauccc

SEQ ID NO: 2192600 - RNA, 20 nt, Streptococcus pneumoniae R6
ucgugcauuucauccccauu

SEQ ID NO: 2192601 - RNA, 11 nt, Streptococcus pneumoniae R6
ucguuaucauu

SEQ ID NO: 2192602 - RNA, 22 nt, Streptococcus pneumoniae R6
ucguuacggggguaagagacuu

SEQ ID NO: 2192603 - RNA, 16 nt, Streptococcus pneumoniae R6
ucguuacuauaagacu

SEQ ID NO: 2192604 - RNA, 20 nt, Streptococcus pneumoniae R6
ucguucaggacagucaaauc

SEQ ID NO: 2192605 - RNA, 14 nt, Streptococcus pneumoniae R6
ucguuccuuuaaaa

SEQ ID NO: 2192606 - RNA, 15 nt, Streptococcus pneumoniae R6
ucguuccuuuaaaau

SEQ ID NO: 2192607 - RNA, 17 nt, Streptococcus pneumoniae R6
ucguuggauauaggagg

SEQ ID NO: 2192608 - RNA, 20 nt, Streptococcus pneumoniae R6
ucguuuccuuccaugauaga

SEQ ID NO: 2192609 - RNA, 12 nt, Streptococcus pneumoniae R6
ucguuuaaaaca

SEQ ID NO: 2192610 - RNA, 21 nt, Streptococcus pneumoniae R6
ucuccaaucaaauugugcagu

SEQ ID NO: 2192611 - RNA, 22 nt, Streptococcus pneumoniae R6
ucuccacagaccuguccaacag

SEQ ID NO: 2192612 - RNA, 21 nt, Streptococcus pneumoniae R6
ucuccagaccaccuuccuugg

SEQ ID NO: 2192613 - RNA, 15 nt, Streptococcus pneumoniae R6
ucucauuugaugaga

SEQ ID NO: 2192614 - RNA, 22 nt, Streptococcus pneumoniae R6
ucuccaaaccauuuuuggcuga

SEQ ID NO: 2192615 - RNA, 14 nt, Streptococcus pneumoniae R6
ucuccaguaacuuu

SEQ ID NO: 2192616 - RNA, 22 nt, Streptococcus pneumoniae R6
ucuccaguccuuguaugacauc

SEQ ID NO: 2192617 - RNA, 22 nt, Streptococcus pneumoniae R6
ucuccauuuuggauauaagaag

SEQ ID NO: 2192618 - RNA, 18 nt, Streptococcus pneumoniae R6
ucuccgaagacuuuaaaa

SEQ ID NO: 2192619 - RNA, 20 nt, Streptococcus pneumoniae R6
ucuccgaagacuuuaaaaau

SEQ ID NO: 2192620 - RNA, 21 nt, Streptococcus pneumoniae R6
ucuccgaagacuuuaaaaauu

SEQ ID NO: 2192621 - RNA, 20 nt, Streptococcus pneumoniae R6
ucuccgaggauuucccaagu

SEQ ID NO: 2192622 - RNA, 14 nt, Streptococcus pneumoniae R6
ucucccguugucuu

SEQ ID NO: 2192623 - RNA, 22 nt, Streptococcus pneumoniae R6
ucucccgcccuuuuuucucaau

SEQ ID NO: 2192624 - RNA, 19 nt, Streptococcus pneumoniae R6
ucucccccugauaauacuu

SEQ ID NO: 2192625 - RNA, 17 nt, Streptococcus pneumoniae R6
ucucgcaagaggucaua

SEQ ID NO: 2192626 - RNA, 20 nt, Streptococcus pneumoniae R6
ucucgagcuuagcuuuucuu

SEQ ID NO: 2192627 - RNA, 21 nt, Streptococcus pneumoniae R6
ucuccuuugagguuaaucaau

SEQ ID NO: 2192628 - RNA, 16 nt, Streptococcus pneumoniae R6
ucuccuuuaguuuauu

SEQ ID NO: 2192629 - RNA, 13 nt, Streptococcus pneumoniae R6
ucuccguuuuuaa

SEQ ID NO: 2192630 - RNA, 16 nt, Streptococcus pneumoniae R6
ucuccuccauaaaaag

SEQ ID NO: 2192631 - RNA, 17 nt, Streptococcus pneumoniae R6
ucuccuaaaauuguguu

SEQ ID NO: 2192632 - RNA, 18 nt, Streptococcus pneumoniae R6
ucuccuagucuacaaauu

SEQ ID NO: 2192633 - RNA, 17 nt, Streptococcus pneumoniae R6
ucuccggcuuucacaaa

SEQ ID NO: 2192634 - RNA, 14 nt, Streptococcus pneumoniae R6
ucuccgcuuuuauc

SEQ ID NO: 2192635 - RNA, 14 nt, Streptococcus pneumoniae R6
ucuccuguuucaaa

SEQ ID NO: 2192636 - RNA, 19 nt, Streptococcus pneumoniae R6
ucuccuguuucaaaguaau

SEQ ID NO: 2192637 - RNA, 16 nt, Streptococcus pneumoniae R6
ucuccugggaaauucc

SEQ ID NO: 2192638 - RNA, 16 nt, Streptococcus pneumoniae R6
ucucuaaaucuucuaa

SEQ ID NO: 2192639 - RNA, 18 nt, Streptococcus pneumoniae R6
ucucuaaaucuucuaaua

SEQ ID NO: 2192640 - RNA, 17 nt, Streptococcus pneumoniae R6
ucucuaacaaugcuuua

SEQ ID NO: 2192641 - RNA, 15 nt, Streptococcus pneumoniae R6
ucucuaucucuuaaa

SEQ ID NO: 2192642 - RNA, 13 nt, Streptococcus pneumoniae R6
ucucucugauuuc

SEQ ID NO: 2192643 - RNA, 12 nt, Streptococcus pneumoniae R6
ucucuaaaaaua

SEQ ID NO: 2192644 - RNA, 20 nt, Streptococcus pneumoniae R6
ucucuaaaaauaaaaaagag

SEQ ID NO: 2192645 - RNA, 20 nt, Streptococcus pneumoniae R6
ucucgugcauuucaucccca

SEQ ID NO: 2192646 - RNA, 18 nt, Streptococcus pneumoniae R6
ucucuggguacucuuuuu

SEQ ID NO: 2192647 - RNA, 13 nt, Streptococcus pneumoniae R6
ucucugaaaacaa

SEQ ID NO: 2192648 - RNA, 14 nt, Streptococcus pneumoniae R6
ucucucuauaauaa

SEQ ID NO: 2192649 - RNA, 16 nt, Streptococcus pneumoniae R6
ucucugauaauauuuu

SEQ ID NO: 2192650 - RNA, 16 nt, Streptococcus pneumoniae R6
aaaugcuucuuugaua

SEQ ID NO: 2192651 - RNA, 22 nt, Streptococcus pneumoniae R6
aaauggaaguuucaaaauuccc

SEQ ID NO: 2192652 - RNA, 20 nt, Streptococcus pneumoniae R6
ucucuugaagacuuuuuaaa

SEQ ID NO: 2192653 - RNA, 15 nt, Streptococcus pneumoniae R6
ucugaaagugaaaaa

SEQ ID NO: 2192654 - RNA, 23 nt, Streptococcus pneumoniae R6
ucugaaaagacguauucagucau

SEQ ID NO: 2192655 - RNA, 20 nt, Streptococcus pneumoniae R6
ucugcaauggcaauaaacau

SEQ ID NO: 2192656 - RNA, 12 nt, Streptococcus pneumoniae R6
ucugcaaucaag

SEQ ID NO: 2192657 - RNA, 21 nt, Streptococcus pneumoniae R6
ucugcaccugauuucuccgcu

SEQ ID NO: 2192658 - RNA, 13 nt, Streptococcus pneumoniae R6
ucugcacucucau

SEQ ID NO: 2192659 - RNA, 14 nt, Streptococcus pneumoniae R6
ucugcacucucauu

SEQ ID NO: 2192660 - RNA, 21 nt, Streptococcus pneumoniae R6
ucugcaaccucuacaauaaca

SEQ ID NO: 2192661 - RNA, 15 nt, Streptococcus pneumoniae R6
ucugcaaccuuaaaa

SEQ ID NO: 2192662 - RNA, 16 nt, Streptococcus pneumoniae R6
ucugcaaccuuaaaac

SEQ ID NO: 2192663 - RNA, 22 nt, Streptococcus pneumoniae R6
ucugagguaggaguccucugua

SEQ ID NO: 2192664 - RNA, 21 nt, Streptococcus pneumoniae R6
ucuuaucacccaaaacuucug

SEQ ID NO: 2192665 - RNA, 16 nt, Streptococcus pneumoniae R6
ucuuaucagaaaauaa

SEQ ID NO: 2192666 - RNA, 17 nt, Streptococcus pneumoniae R6
ucuuauacuuuucucuu

SEQ ID NO: 2192667 - RNA, 13 nt, Streptococcus pneumoniae R6
ucuuaucaacgcu

SEQ ID NO: 2192668 - RNA, 15 nt, Streptococcus pneumoniae R6
ucuuauauuaaaaaa

SEQ ID NO: 2192669 - RNA, 20 nt, Streptococcus pneumoniae R6
ucuuauagcgacuauaaaaa

SEQ ID NO: 2192670 - RNA, 22 nt, Streptococcus pneumoniae R6
ucuucaaucaaagcucccaaau

SEQ ID NO: 2192671 - RNA, 19 nt, Streptococcus pneumoniae R6
ucuucaagguuuuauacuc

SEQ ID NO: 2192672 - RNA, 16 nt, Streptococcus pneumoniae R6
ucuucaauaccaaaga

SEQ ID NO: 2192673 - RNA, 21 nt, Streptococcus pneumoniae R6
ucuucaacccacuacaguuga

SEQ ID NO: 2192674 - RNA, 17 nt, Streptococcus pneumoniae R6
ucuuaucugcaaccuca

SEQ ID NO: 2192675 - RNA, 23 nt, Streptococcus pneumoniae R6
ucuuaucuggguuccagaugaag

SEQ ID NO: 2192676 - RNA, 16 nt, Streptococcus pneumoniae R6
ucuuaucuugauauuc

SEQ ID NO: 2192677 - RNA, 14 nt, Streptococcus pneumoniae R6
ucuuaccacaaaca

SEQ ID NO: 2192678 - RNA, 14 nt, Streptococcus pneumoniae R6
ucuguucuauaaaa

SEQ ID NO: 2192679 - RNA, 17 nt, Streptococcus pneumoniae R6
ucuguucuaugcgucua

SEQ ID NO: 2192680 - RNA, 16 nt, Streptococcus pneumoniae R6
ucuguuccccaaucgg

SEQ ID NO: 2192681 - RNA, 16 nt, Streptococcus pneumoniae R6
ucuguuaaaaaauaau

SEQ ID NO: 2192682 - RNA, 19 nt, Streptococcus pneumoniae R6
ucuuccuacauauguaaga

SEQ ID NO: 2192683 - RNA, 23 nt, Streptococcus pneumoniae R6
ucuuccuucuucguuucgucauu

SEQ ID NO: 2192684 - RNA, 19 nt, Streptococcus pneumoniae R6
ucuucgaaaaucucugcaa

SEQ ID NO: 2192685 - RNA, 16 nt, Streptococcus pneumoniae R6
ucuucgaaaaucucuu

SEQ ID NO: 2192686 - RNA, 19 nt, Streptococcus pneumoniae R6
ucuucgaaaaucucuucaa

SEQ ID NO: 2192687 - RNA, 22 nt, Streptococcus pneumoniae R6
ucuucggagaagaaaacagaaa

SEQ ID NO: 2192688 - RNA, 16 nt, Streptococcus pneumoniae R6
ucuucggauuuuucuu

SEQ ID NO: 2192689 - RNA, 20 nt, Streptococcus pneumoniae R6
ucuucggauuuuucuuuuaa

SEQ ID NO: 2192690 - RNA, 20 nt, Streptococcus pneumoniae R6
ucuucgcuuucuucauuuug

SEQ ID NO: 2192691 - RNA, 12 nt, Streptococcus pneumoniae R6
ucuucccacaau

SEQ ID NO: 2192692 - RNA, 14 nt, Streptococcus pneumoniae R6
ucuuccauuucuuu

SEQ ID NO: 2192693 - RNA, 16 nt, Streptococcus pneumoniae R6
ucuuccauaucugcuu

SEQ ID NO: 2192694 - RNA, 17 nt, Streptococcus pneumoniae R6
ucuuccagcucaucauc

SEQ ID NO: 2192695 - RNA, 15 nt, Streptococcus pneumoniae R6
ucuucacaaucaaaa

SEQ ID NO: 2192696 - RNA, 14 nt, Streptococcus pneumoniae R6
ucuuccaagaccug

SEQ ID NO: 2192697 - RNA, 20 nt, Streptococcus pneumoniae R6
ucuuccaauuucuuuucauu

SEQ ID NO: 2192698 - RNA, 18 nt, Streptococcus pneumoniae R6
ucuucagaaauuuucuua

SEQ ID NO: 2192699 - RNA, 18 nt, Streptococcus pneumoniae R6
ucuuccaacucuuccuua

SEQ ID NO: 2192700 - RNA, 20 nt, Streptococcus pneumoniae R6
ucugguuaaaauugcuuucu

SEQ ID NO: 2192701 - RNA, 23 nt, Streptococcus pneumoniae R6
ucugguucccagcauggucaggc

SEQ ID NO: 2192702 - RNA, 20 nt, Streptococcus pneumoniae R6
ucugguuuggcaaauuugac

SEQ ID NO: 2192703 - RNA, 18 nt, Streptococcus pneumoniae R6
ucuguaacccaaaagaua

SEQ ID NO: 2192704 - RNA, 14 nt, Streptococcus pneumoniae R6
ucuguaaaacucuu

SEQ ID NO: 2192705 - RNA, 16 nt, Streptococcus pneumoniae R6
ucuguaauauacaugu

SEQ ID NO: 2192706 - RNA, 23 nt, Streptococcus pneumoniae R6
ucuguaauaugaacaaaaccugg

SEQ ID NO: 2192707 - RNA, 16 nt, Streptococcus pneumoniae R6
ucuguaaugaaauacu

SEQ ID NO: 2192708 - RNA, 19 nt, Streptococcus pneumoniae R6
ucuguagagaguuaaaaaa

SEQ ID NO: 2192709 - RNA, 16 nt, Streptococcus pneumoniae R6
ucuguauaaauagcua

SEQ ID NO: 2192710 - RNA, 22 nt, Streptococcus pneumoniae R6
ucuguauaggucuggcuauuuu

SEQ ID NO: 2192711 - RNA, 19 nt, Streptococcus pneumoniae R6
ucuguguagcacuuuucca

SEQ ID NO: 2192712 - RNA, 18 nt, Streptococcus pneumoniae R6
ucugugcuuuuucaaugc

SEQ ID NO: 2192713 - RNA, 21 nt, Streptococcus pneumoniae R6
ucugugguaaugcuuuccauu

SEQ ID NO: 2192714 - RNA, 23 nt, Streptococcus pneumoniae R6
ucugucugcugacugauuuacaa

SEQ ID NO: 2192715 - RNA, 14 nt, Streptococcus pneumoniae R6
ucugucuauuugcu

SEQ ID NO: 2192716 - RNA, 15 nt, Streptococcus pneumoniae R6
ucugucuuuauuaau

SEQ ID NO: 2192717 - RNA, 15 nt, Streptococcus pneumoniae R6
ucugucuuaccacaa

SEQ ID NO: 2192718 - RNA, 20 nt, Streptococcus pneumoniae R6
ucugucuuagacuuucucac

SEQ ID NO: 2192719 - RNA, 22 nt, Streptococcus pneumoniae R6
ucuguauugauucguauugaau

SEQ ID NO: 2192720 - RNA, 18 nt, Streptococcus pneumoniae R6
ucugccagaaauucccuc

SEQ ID NO: 2192721 - RNA, 20 nt, Streptococcus pneumoniae R6
ucugcauaagcuggucuuuu

SEQ ID NO: 2192722 - RNA, 22 nt, Streptococcus pneumoniae R6
ucugcauaagcuggucuuuuuu

SEQ ID NO: 2192723 - RNA, 23 nt, Streptococcus pneumoniae R6
ucugcauaagcuggucuuuuuug

SEQ ID NO: 2192724 - RNA, 15 nt, Streptococcus pneumoniae R6
ucugcauggacaacc

SEQ ID NO: 2192725 - RNA, 21 nt, Streptococcus pneumoniae R6
ucugcaucguucaauggaaug

SEQ ID NO: 2192726 - RNA, 16 nt, Streptococcus pneumoniae R6
ucuggaugauucuuuu

SEQ ID NO: 2192727 - RNA, 19 nt, Streptococcus pneumoniae R6
ucugcuuucaaaaagcauu

SEQ ID NO: 2192728 - RNA, 15 nt, Streptococcus pneumoniae R6
ucugcuucuaaaaca

SEQ ID NO: 2192729 - RNA, 12 nt, Streptococcus pneumoniae R6
ucugcuucuuuu

SEQ ID NO: 2192730 - RNA, 15 nt, Streptococcus pneumoniae R6
ucugcugucagcaau

SEQ ID NO: 2192731 - RNA, 20 nt, Streptococcus pneumoniae R6
ucugcugucagcaauuccuu

SEQ ID NO: 2192732 - RNA, 20 nt, Streptococcus pneumoniae R6
ucuggcaauuuaucuccuac

SEQ ID NO: 2192733 - RNA, 13 nt, Streptococcus pneumoniae R6
ucuggcacagaaa

SEQ ID NO: 2192734 - RNA, 24 nt, Streptococcus pneumoniae R6
ucuggcacagaaacaccuuuauca

SEQ ID NO: 2192735 - RNA, 15 nt, Streptococcus pneumoniae R6
ucuggauuuucuccc

SEQ ID NO: 2192736 - RNA, 15 nt, Streptococcus pneumoniae R6
ucuggauuuccauuu

SEQ ID NO: 2192737 - RNA, 15 nt, Streptococcus pneumoniae R6
ucuggcgucuuaccu

SEQ ID NO: 2192738 - RNA, 17 nt, Streptococcus pneumoniae R6
ucuggcagauagagaca

SEQ ID NO: 2192739 - RNA, 16 nt, Streptococcus pneumoniae R6
ucuggcagauuuugaa

SEQ ID NO: 2192740 - RNA, 19 nt, Streptococcus pneumoniae R6
ucuggcagauuuugaagau

SEQ ID NO: 2192741 - RNA, 20 nt, Streptococcus pneumoniae R6
ucuggcagauuuugaagaug

SEQ ID NO: 2192742 - RNA, 22 nt, Streptococcus pneumoniae R6
ucuggucuagcuauuucuugcu

SEQ ID NO: 2192743 - RNA, 17 nt, Streptococcus pneumoniae R6
ucuggugcuagggcaag

SEQ ID NO: 2192744 - RNA, 13 nt, Streptococcus pneumoniae R6
ucuggugcuggaa

SEQ ID NO: 2192745 - RNA, 16 nt, Streptococcus pneumoniae R6
ucuggcucuuugucaa

SEQ ID NO: 2192746 - RNA, 16 nt, Streptococcus pneumoniae R6
ucugggagaaauuccu

SEQ ID NO: 2192747 - RNA, 19 nt, Streptococcus pneumoniae R6
ucugggauggucacagaac

SEQ ID NO: 2192748 - RNA, 14 nt, Streptococcus pneumoniae R6
ucugggaagacugu

SEQ ID NO: 2192749 - RNA, 12 nt, Streptococcus pneumoniae R6
ucuaaaauagua

SEQ ID NO: 2192750 - RNA, 20 nt, Streptococcus pneumoniae R6
ucuaaaauaguacgaaacaa

SEQ ID NO: 2192751 - RNA, 22 nt, Streptococcus pneumoniae R6
ucuaaaaucaucgccaaaucau

SEQ ID NO: 2192752 - RNA, 19 nt, Streptococcus pneumoniae R6
ucuaaacaauguucucaua

SEQ ID NO: 2192753 - RNA, 19 nt, Streptococcus pneumoniae R6
ucuaaaacauugugagaaa

SEQ ID NO: 2192754 - RNA, 23 nt, Streptococcus pneumoniae R6
ucuaaaacauuguuagaaaucaa

SEQ ID NO: 2192755 - RNA, 18 nt, Streptococcus pneumoniae R6
ucuaaaaauaaaaaagag

SEQ ID NO: 2192756 - RNA, 13 nt, Streptococcus pneumoniae R6
ucuaaaaauguuu

SEQ ID NO: 2192757 - RNA, 21 nt, Streptococcus pneumoniae R6
ucguuuguuuuuuccuauaau

SEQ ID NO: 2192758 - RNA, 20 nt, Streptococcus pneumoniae R6
ucguuugguguaauaaacug

SEQ ID NO: 2192759 - RNA, 15 nt, Streptococcus pneumoniae R6
ucguuuuucaugaau

SEQ ID NO: 2192760 - RNA, 17 nt, Streptococcus pneumoniae R6
ucuaaauucaauucacu

SEQ ID NO: 2192761 - RNA, 13 nt, Streptococcus pneumoniae R6
ucuaaauuaacua

SEQ ID NO: 2192762 - RNA, 15 nt, Streptococcus pneumoniae R6
ucuaaccaauccaua

SEQ ID NO: 2192763 - RNA, 11 nt, Streptococcus pneumoniae R6
ucuaacaucuu

SEQ ID NO: 2192764 - RNA, 16 nt, Streptococcus pneumoniae R6
ucuaacaucuuuugau

SEQ ID NO: 2192765 - RNA, 13 nt, Streptococcus pneumoniae R6
ucuaacauauuuc

SEQ ID NO: 2192766 - RNA, 17 nt, Streptococcus pneumoniae R6
ucuaacauauuucuaga

SEQ ID NO: 2192767 - RNA, 12 nt, Streptococcus pneumoniae R6
ucuaaaguaagu

SEQ ID NO: 2192768 - RNA, 16 nt, Streptococcus pneumoniae R6
ucuaaauacaaaaaua

SEQ ID NO: 2192769 - RNA, 17 nt, Streptococcus pneumoniae R6
ucuaaauacaaaaauag

SEQ ID NO: 2192770 - RNA, 21 nt, Streptococcus pneumoniae R6
ucuaaauaagguuuagcaaaa

SEQ ID NO: 2192771 - RNA, 18 nt, Streptococcus pneumoniae R6
ucuaaaucuugcccuucu

SEQ ID NO: 2192772 - RNA, 20 nt, Streptococcus pneumoniae R6
ucuaaagaauuugaaaaaaa

SEQ ID NO: 2192773 - RNA, 15 nt, Streptococcus pneumoniae R6
aaaucuucuuacaua

SEQ ID NO: 2192774 - RNA, 15 nt, Streptococcus pneumoniae R6
aaaucuuugauuucu

SEQ ID NO: 2192775 - RNA, 15 nt, Streptococcus pneumoniae R6
aaaucuuuuucauaa

SEQ ID NO: 2192776 - RNA, 15 nt, Streptococcus pneumoniae R6
aaaugaaagaaacuc

SEQ ID NO: 2192777 - RNA, 20 nt, Streptococcus pneumoniae R6
aaaugaaacaaaaacaggac

SEQ ID NO: 2192778 - RNA, 15 nt, Streptococcus pneumoniae R6
aaaugaaaaggcaga

SEQ ID NO: 2192779 - RNA, 21 nt, Streptococcus pneumoniae R6
ucuaauaauuuuucauuuaau

SEQ ID NO: 2192780 - RNA, 20 nt, Streptococcus pneumoniae R6
ucuaaguaacuaacgccaaa

SEQ ID NO: 2192781 - RNA, 12 nt, Streptococcus pneumoniae R6
aaaugaaauuuu

SEQ ID NO: 2192782 - RNA, 15 nt, Streptococcus pneumoniae R6
aaaugaaauaagaac

SEQ ID NO: 2192783 - RNA, 20 nt, Streptococcus pneumoniae R6
aaaugaaauaagaacaggac

SEQ ID NO: 2192784 - RNA, 15 nt, Streptococcus pneumoniae R6
aaaugaaauaagaau

SEQ ID NO: 2192785 - RNA, 14 nt, Streptococcus pneumoniae R6
aaaugaaauauuuu

SEQ ID NO: 2192786 - RNA, 18 nt, Streptococcus pneumoniae R6
ucuaagguauauucaaaa

SEQ ID NO: 2192787 - RNA, 15 nt, Streptococcus pneumoniae R6
ucuaacugaagcugu

SEQ ID NO: 2192788 - RNA, 20 nt, Streptococcus pneumoniae R6
ucuaacuucaauagacuaua

SEQ ID NO: 2192789 - RNA, 17 nt, Streptococcus pneumoniae R6
ucuaagauguucaaucu

SEQ ID NO: 2192790 - RNA, 16 nt, Streptococcus pneumoniae R6
ucuaagcgaaacaacc

SEQ ID NO: 2192791 - RNA, 18 nt, Streptococcus pneumoniae R6
ucuaagcgaccaucuuga

SEQ ID NO: 2192792 - RNA, 22 nt, Streptococcus pneumoniae R6
ucuaacuggaaagauaacugcu

SEQ ID NO: 2192793 - RNA, 14 nt, Streptococcus pneumoniae R6
aaaucuucucuuga

SEQ ID NO: 2192794 - RNA, 20 nt, Streptococcus pneumoniae R6
aaaucuuccuacauauguaa

SEQ ID NO: 2192795 - RNA, 20 nt, Streptococcus pneumoniae R6
aaaucuuccuagaauaugaa

SEQ ID NO: 2192796 - RNA, 17 nt, Streptococcus pneumoniae R6
aaaucuucccacaauaa

SEQ ID NO: 2192797 - RNA, 20 nt, Streptococcus pneumoniae R6
aaaucuucccacaauaaaaa

SEQ ID NO: 2192798 - RNA, 23 nt, Streptococcus pneumoniae R6
aaaucuucccacaauaaaaagca

SEQ ID NO: 2192799 - RNA, 16 nt, Streptococcus pneumoniae R6
aaaucuucaaaaaagu

SEQ ID NO: 2192800 - RNA, 21 nt, Streptococcus pneumoniae R6
aaaucuucagauucagcuaaa

SEQ ID NO: 2192801 - RNA, 16 nt, Streptococcus pneumoniae R6
aaaugacuacgcgacc

SEQ ID NO: 2192802 - RNA, 15 nt, Streptococcus pneumoniae R6
aaaugacauuccugu

SEQ ID NO: 2192803 - RNA, 15 nt, Streptococcus pneumoniae R6
aaaugacaauaaaau

SEQ ID NO: 2192804 - RNA, 18 nt, Streptococcus pneumoniae R6
aaaugaauuugaaacaau

SEQ ID NO: 2192805 - RNA, 19 nt, Streptococcus pneumoniae R6
aaaugaauuugaaacaaug

SEQ ID NO: 2192806 - RNA, 23 nt, Streptococcus pneumoniae R6
aaaugacuuucuaauuauuucaa

SEQ ID NO: 2192807 - RNA, 14 nt, Streptococcus pneumoniae R6
ucuaccaagcccuc

SEQ ID NO: 2192808 - RNA, 15 nt, Streptococcus pneumoniae R6
ucuaccaagcccuca

SEQ ID NO: 2192809 - RNA, 14 nt, Streptococcus pneumoniae R6
ucuacuuuuucaaa

SEQ ID NO: 2192810 - RNA, 14 nt, Streptococcus pneumoniae R6
aaaugagaaauuau

SEQ ID NO: 2192811 - RNA, 13 nt, Streptococcus pneumoniae R6
aaaugaguaugaa

SEQ ID NO: 2192812 - RNA, 19 nt, Streptococcus pneumoniae R6
aaaugaguaugaaaagaga

SEQ ID NO: 2192813 - RNA, 11 nt, Streptococcus pneumoniae R6
aaaugagucua

SEQ ID NO: 2192814 - RNA, 21 nt, Streptococcus pneumoniae R6
aaaugaggguccgaaccacaa

SEQ ID NO: 2192815 - RNA, 20 nt, Streptococcus pneumoniae R6
aaaugagguaauuaugaaau

SEQ ID NO: 2192816 - RNA, 23 nt, Streptococcus pneumoniae R6
ucuacuaaaauuauguuuuugaa

SEQ ID NO: 2192817 - RNA, 15 nt, Streptococcus pneumoniae R6
ucuacuccuuagugu

SEQ ID NO: 2192818 - RNA, 14 nt, Streptococcus pneumoniae R6
ucuacgacaaccuu

SEQ ID NO: 2192819 - RNA, 20 nt, Streptococcus pneumoniae R6
ucuacaucauugucaaacaa

SEQ ID NO: 2192820 - RNA, 15 nt, Streptococcus pneumoniae R6
ucuacaaccucaaaa

SEQ ID NO: 2192821 - RNA, 19 nt, Streptococcus pneumoniae R6
ucuacaaccucaaaaacau

SEQ ID NO: 2192822 - RNA, 21 nt, Streptococcus pneumoniae R6
ucuacaaccucaaaaacaugu

SEQ ID NO: 2192823 - RNA, 18 nt, Streptococcus pneumoniae R6
ucuacaaccucaaaacac

SEQ ID NO: 2192824 - RNA, 19 nt, Streptococcus pneumoniae R6
ucuacaaccucaaaaccau

SEQ ID NO: 2192825 - RNA, 16 nt, Streptococcus pneumoniae R6
ucuacaaccuuaaaac

SEQ ID NO: 2192826 - RNA, 14 nt, Streptococcus pneumoniae R6
ucuaauuuuugagc

SEQ ID NO: 2192827 - RNA, 22 nt, Streptococcus pneumoniae R6
ucuacaauuucucguguaaugc

SEQ ID NO: 2192828 - RNA, 17 nt, Streptococcus pneumoniae R6
ucuacaccauaaauauu

SEQ ID NO: 2192829 - RNA, 19 nt, Streptococcus pneumoniae R6
ucuacaccauaaauauuug

SEQ ID NO: 2192830 - RNA, 22 nt, Streptococcus pneumoniae R6
ucuacacccacgucacaaagaa

SEQ ID NO: 2192831 - RNA, 12 nt, Streptococcus pneumoniae R6
ucuaauugaaaa

SEQ ID NO: 2192832 - RNA, 14 nt, Streptococcus pneumoniae R6
ucuaauucccuuaa

SEQ ID NO: 2192833 - RNA, 15 nt, Streptococcus pneumoniae R6
ucuaaugucucugcu

SEQ ID NO: 2192834 - RNA, 15 nt, Streptococcus pneumoniae R6
ucuaauguaauucuc

SEQ ID NO: 2192835 - RNA, 17 nt, Streptococcus pneumoniae R6
ucuaauuaaauaaaaua

SEQ ID NO: 2192836 - RNA, 15 nt, Streptococcus pneumoniae R6
ucuaauuaaaucauc

SEQ ID NO: 2192837 - RNA, 15 nt, Streptococcus pneumoniae R6
ucucaaccuugcuuc

SEQ ID NO: 2192838 - RNA, 21 nt, Streptococcus pneumoniae R6
ucucaacgcuagaagcaucga

SEQ ID NO: 2192839 - RNA, 21 nt, Streptococcus pneumoniae R6
ucucaacuuuuuuugauguac

SEQ ID NO: 2192840 - RNA, 18 nt, Streptococcus pneumoniae R6
ucucaaggagagcuuuua

SEQ ID NO: 2192841 - RNA, 14 nt, Streptococcus pneumoniae R6
ucucaauuccuuau

SEQ ID NO: 2192842 - RNA, 20 nt, Streptococcus pneumoniae R6
ucucaauuucuauuuuaaaa

SEQ ID NO: 2192843 - RNA, 12 nt, Streptococcus pneumoniae R6
ucucaauaggau

SEQ ID NO: 2192844 - RNA, 19 nt, Streptococcus pneumoniae R6
ucucaauaggauuguacuc

SEQ ID NO: 2192845 - RNA, 22 nt, Streptococcus pneumoniae R6
ucuauuuuuuauaauaucacua

SEQ ID NO: 2192846 - RNA, 17 nt, Streptococcus pneumoniae R6
ucuauuuuugagcagaa

SEQ ID NO: 2192847 - RNA, 18 nt, Streptococcus pneumoniae R6
ucuauuuuugagcagaac

SEQ ID NO: 2192848 - RNA, 23 nt, Streptococcus pneumoniae R6
ucuauuuuugagcagaacaauga

SEQ ID NO: 2192849 - RNA, 20 nt, Streptococcus pneumoniae R6
ucucaaaaaaguuaaaucuu

SEQ ID NO: 2192850 - RNA, 15 nt, Streptococcus pneumoniae R6
ucucaaaacaguguu

SEQ ID NO: 2192851 - RNA, 20 nt, Streptococcus pneumoniae R6
ucucaaauuuucauacucgu

SEQ ID NO: 2192852 - RNA, 19 nt, Streptococcus pneumoniae R6
ucucaaacauugugaggaa

SEQ ID NO: 2192853 - RNA, 16 nt, Streptococcus pneumoniae R6
ucucaaaaucaaagac

SEQ ID NO: 2192854 - RNA, 16 nt, Streptococcus pneumoniae R6
ucucaaaaguuagaaa

SEQ ID NO: 2192855 - RNA, 18 nt, Streptococcus pneumoniae R6
ucucaaaaguuagaaaua

SEQ ID NO: 2192856 - RNA, 20 nt, Streptococcus pneumoniae R6
ucucaaaaguuagaaauaaa

SEQ ID NO: 2192857 - RNA, 22 nt, Streptococcus pneumoniae R6
ucucaaaaguuagaaauaaaac

SEQ ID NO: 2192858 - RNA, 13 nt, Streptococcus pneumoniae R6
ucuauuuuuaaua

SEQ ID NO: 2192859 - RNA, 14 nt, Streptococcus pneumoniae R6
ucuauuuuaaaaau

SEQ ID NO: 2192860 - RNA, 16 nt, Streptococcus pneumoniae R6
ucuauuguugcauuaa

SEQ ID NO: 2192861 - RNA, 13 nt, Streptococcus pneumoniae R6
ucuauugcauaua

SEQ ID NO: 2192862 - RNA, 22 nt, Streptococcus pneumoniae R6
ucuauugcauauacuuuaucac

SEQ ID NO: 2192863 - RNA, 22 nt, Streptococcus pneumoniae R6
ucuauugaaguuagaguaguac

SEQ ID NO: 2192864 - RNA, 22 nt, Streptococcus pneumoniae R6
ucuauuccuagucagaauagau

SEQ ID NO: 2192865 - RNA, 14 nt, Streptococcus pneumoniae R6
ucuauucuuuccuu

SEQ ID NO: 2192866 - RNA, 16 nt, Streptococcus pneumoniae R6
ucuauucuuuccuuuu

SEQ ID NO: 2192867 - RNA, 17 nt, Streptococcus pneumoniae R6
ucuauucuuuuuugguu

SEQ ID NO: 2192868 - RNA, 13 nt, Streptococcus pneumoniae R6
ucuauuauauaua

SEQ ID NO: 2192869 - RNA, 17 nt, Streptococcus pneumoniae R6
ucuauuauuuaaguguu

SEQ ID NO: 2192870 - RNA, 17 nt, Streptococcus pneumoniae R6
ucuauuccaucuccgau

SEQ ID NO: 2192871 - RNA, 18 nt, Streptococcus pneumoniae R6
ucucacguccuagcucuc

SEQ ID NO: 2192872 - RNA, 13 nt, Streptococcus pneumoniae R6
ucucacuauucau

SEQ ID NO: 2192873 - RNA, 22 nt, Streptococcus pneumoniae R6
ucucagcuagucgugaaagagc

SEQ ID NO: 2192874 - RNA, 21 nt, Streptococcus pneumoniae R6
ucucagggucuuuguucugaa

SEQ ID NO: 2192875 - RNA, 21 nt, Streptococcus pneumoniae R6
ucucagcagucguuccuuuug

SEQ ID NO: 2192876 - RNA, 15 nt, Streptococcus pneumoniae R6
ucucagaauaauauu

SEQ ID NO: 2192877 - RNA, 15 nt, Streptococcus pneumoniae R6
ucucagugggcuauu

SEQ ID NO: 2192878 - RNA, 17 nt, Streptococcus pneumoniae R6
ucucauagccauaaaac

SEQ ID NO: 2192879 - RNA, 18 nt, Streptococcus pneumoniae R6
ucucaucuauuuuuacuc

SEQ ID NO: 2192880 - RNA, 22 nt, Streptococcus pneumoniae R6
ucuagcuuuuauaaauuuucca

SEQ ID NO: 2192881 - RNA, 21 nt, Streptococcus pneumoniae R6
ucuagcuaucuccucauauuu

SEQ ID NO: 2192882 - RNA, 14 nt, Streptococcus pneumoniae R6
ucuagcgcaaagcu

SEQ ID NO: 2192883 - RNA, 13 nt, Streptococcus pneumoniae R6
ucuaguagguaua

SEQ ID NO: 2192884 - RNA, 22 nt, Streptococcus pneumoniae R6
ucuaguaaagcuagauuuaaaa

SEQ ID NO: 2192885 - RNA, 23 nt, Streptococcus pneumoniae R6
ucuaggucaacaggauuuuguuc

SEQ ID NO: 2192886 - RNA, 19 nt, Streptococcus pneumoniae R6
ucuaguuuagcacauuucc

SEQ ID NO: 2192887 - RNA, 15 nt, Streptococcus pneumoniae R6
ucuagucaucagaaa

SEQ ID NO: 2192888 - RNA, 14 nt, Streptococcus pneumoniae R6
ucuaguccaucucc

SEQ ID NO: 2192889 - RNA, 16 nt, Streptococcus pneumoniae R6
ucuagauaguaccaug

SEQ ID NO: 2192890 - RNA, 17 nt, Streptococcus pneumoniae R6
ucuagauuuggaaacuc

SEQ ID NO: 2192891 - RNA, 22 nt, Streptococcus pneumoniae R6
ucuagacuaggguuuccaccuu

SEQ ID NO: 2192892 - RNA, 19 nt, Streptococcus pneumoniae R6
ucuagaagcaagacaaaaa

SEQ ID NO: 2192893 - RNA, 15 nt, Streptococcus pneumoniae R6
ucuagaaauuaauuu

SEQ ID NO: 2192894 - RNA, 21 nt, Streptococcus pneumoniae R6
ucuagaaauuaauuugaauuu

SEQ ID NO: 2192895 - RNA, 21 nt, Streptococcus pneumoniae R6
aaaugauaauugauuaagaag

SEQ ID NO: 2192896 - RNA, 14 nt, Streptococcus pneumoniae R6
aaaugaucagacca

SEQ ID NO: 2192897 - RNA, 17 nt, Streptococcus pneumoniae R6
ucuaucaacucaagaau

SEQ ID NO: 2192898 - RNA, 12 nt, Streptococcus pneumoniae R6
ucuaucaaaaga

SEQ ID NO: 2192899 - RNA, 13 nt, Streptococcus pneumoniae R6
ucuaucaaaagau

SEQ ID NO: 2192900 - RNA, 20 nt, Streptococcus pneumoniae R6
ucuaucaaaagauguuagaa

SEQ ID NO: 2192901 - RNA, 13 nt, Streptococcus pneumoniae R6
ucuaucagaaagu

SEQ ID NO: 2192902 - RNA, 15 nt, Streptococcus pneumoniae R6
ucuaucugcaaccuc

SEQ ID NO: 2192903 - RNA, 16 nt, Streptococcus pneumoniae R6
ucuaucugcaaccuca

SEQ ID NO: 2192904 - RNA, 21 nt, Streptococcus pneumoniae R6
ucuaucugcaaccucaaaaca

SEQ ID NO: 2192905 - RNA, 17 nt, Streptococcus pneumoniae R6
ucuaucugcaaccuuaa

SEQ ID NO: 2192906 - RNA, 12 nt, Streptococcus pneumoniae R6
ucuaucuauuuu

SEQ ID NO: 2192907 - RNA, 22 nt, Streptococcus pneumoniae R6
ucuaucucaccaggcauuauuu

SEQ ID NO: 2192908 - RNA, 23 nt, Streptococcus pneumoniae R6
ucuaucugccaccucaaaacggu

SEQ ID NO: 2192909 - RNA, 15 nt, Streptococcus pneumoniae R6
ucuaucuuaguaguu

SEQ ID NO: 2192910 - RNA, 17 nt, Streptococcus pneumoniae R6
ucuauggcuuguucaau

SEQ ID NO: 2192911 - RNA, 13 nt, Streptococcus pneumoniae R6
ucuaugauaaaac

SEQ ID NO: 2192912 - RNA, 23 nt, Streptococcus pneumoniae R6
ucuauagcguuuugaaacuagaa

SEQ ID NO: 2192913 - RNA, 23 nt, Streptococcus pneumoniae R6
ucuauagaaaacaacuuauaaaa

SEQ ID NO: 2192914 - RNA, 21 nt, Streptococcus pneumoniae R6
ucuauagaacuaguaaauugu

SEQ ID NO: 2192915 - RNA, 13 nt, Streptococcus pneumoniae R6
ucuauacacaucc

SEQ ID NO: 2192916 - RNA, 14 nt, Streptococcus pneumoniae R6
ucuauacacaucca

SEQ ID NO: 2192917 - RNA, 15 nt, Streptococcus pneumoniae R6
ucuauacauuuagaa

SEQ ID NO: 2192918 - RNA, 22 nt, Streptococcus pneumoniae R6
ucuauaaucaauauagaaguag

SEQ ID NO: 2192919 - RNA, 13 nt, Streptococcus pneumoniae R6
ucuauaaaauaua

SEQ ID NO: 2192920 - RNA, 22 nt, Streptococcus pneumoniae R6
ucuaguuuuuugcguuucugga

SEQ ID NO: 2192921 - RNA, 18 nt, Streptococcus pneumoniae R6
ucuaguuuugguuuuucu

SEQ ID NO: 2192922 - RNA, 19 nt, Streptococcus pneumoniae R6
ucuaguuugcucuuugauu

SEQ ID NO: 2192923 - RNA, 13 nt, Streptococcus pneumoniae R6
ucuauaaacaaag

SEQ ID NO: 2192924 - RNA, 23 nt, Streptococcus pneumoniae R6
uuaacaaaaucgcuaagaggguc

SEQ ID NO: 2192925 - RNA, 17 nt, Streptococcus pneumoniae R6
uuaaauuuuucugcaaa

SEQ ID NO: 2192926 - RNA, 22 nt, Streptococcus pneumoniae R6
uuaaauuuuucugcaaaaaaua

SEQ ID NO: 2192927 - RNA, 13 nt, Streptococcus pneumoniae R6
uuaacaaaaauuu

SEQ ID NO: 2192928 - RNA, 20 nt, Streptococcus pneumoniae R6
uuaaauuuuauacaaauuaa

SEQ ID NO: 2192929 - RNA, 21 nt, Streptococcus pneumoniae R6
uuaacaauaaucuaugauagg

SEQ ID NO: 2192930 - RNA, 14 nt, Streptococcus pneumoniae R6
uuaacaauggcugg

SEQ ID NO: 2192931 - RNA, 20 nt, Streptococcus pneumoniae R6
uuaacaauguuuuagaaauc

SEQ ID NO: 2192932 - RNA, 17 nt, Streptococcus pneumoniae R6
uuaaauugcgauuuugc

SEQ ID NO: 2192933 - RNA, 20 nt, Streptococcus pneumoniae R6
uuaaauugcgauuuugccaa

SEQ ID NO: 2192934 - RNA, 17 nt, Streptococcus pneumoniae R6
uuaaauguuuucucaua

SEQ ID NO: 2192935 - RNA, 16 nt, Streptococcus pneumoniae R6
uuaaaugaguaugaaa

SEQ ID NO: 2192936 - RNA, 13 nt, Streptococcus pneumoniae R6
uuaaauaaaucuc

SEQ ID NO: 2192937 - RNA, 21 nt, Streptococcus pneumoniae R6
uuaaauaaaauuuuuuucaaa

SEQ ID NO: 2192938 - RNA, 17 nt, Streptococcus pneumoniae R6
uuaaaguuaauagaaga

SEQ ID NO: 2192939 - RNA, 16 nt, Streptococcus pneumoniae R6
uuaaaggaauuuuauu

SEQ ID NO: 2192940 - RNA, 15 nt, Streptococcus pneumoniae R6
uuaaagcggucuuua

SEQ ID NO: 2192941 - RNA, 18 nt, Streptococcus pneumoniae R6
uuaaaucgcuucuguaac

SEQ ID NO: 2192942 - RNA, 18 nt, Streptococcus pneumoniae R6
uuaaauccgauaauauau

SEQ ID NO: 2192943 - RNA, 20 nt, Streptococcus pneumoniae R6
uuaaauccgauaauauauag

SEQ ID NO: 2192944 - RNA, 23 nt, Streptococcus pneumoniae R6
uuaaauccaagccugucuguaag

SEQ ID NO: 2192945 - RNA, 16 nt, Streptococcus pneumoniae R6
uuaaaucauccauaua

SEQ ID NO: 2192946 - RNA, 22 nt, Streptococcus pneumoniae R6
uuaaauagagccuucuuccauc

SEQ ID NO: 2192947 - RNA, 17 nt, Streptococcus pneumoniae R6
uuaaauaguucuuccaa

SEQ ID NO: 2192948 - RNA, 20 nt, Streptococcus pneumoniae R6
uuaaguaaucucugauaaua

SEQ ID NO: 2192949 - RNA, 23 nt, Streptococcus pneumoniae R6
uuaagguugcagauagaacugac

SEQ ID NO: 2192950 - RNA, 19 nt, Streptococcus pneumoniae R6
uuaagguuguagauggaac

SEQ ID NO: 2192951 - RNA, 19 nt, Streptococcus pneumoniae R6
uuaagguuguggauggaac

SEQ ID NO: 2192952 - RNA, 15 nt, Streptococcus pneumoniae R6
uuaauauauaaaaaa

SEQ ID NO: 2192953 - RNA, 14 nt, Streptococcus pneumoniae R6
uuaauauauaaaau

SEQ ID NO: 2192954 - RNA, 13 nt, Streptococcus pneumoniae R6
uuaauaauuuuca

SEQ ID NO: 2192955 - RNA, 16 nt, Streptococcus pneumoniae R6
uuaaucauguaccuaa

SEQ ID NO: 2192956 - RNA, 15 nt, Streptococcus pneumoniae R6
uuaaucauuuaauaa

SEQ ID NO: 2192957 - RNA, 20 nt, Streptococcus pneumoniae R6
uuaaucauuuaauaaugaag

SEQ ID NO: 2192958 - RNA, 21 nt, Streptococcus pneumoniae R6
uuaaucauuuaauaaugaaga

SEQ ID NO: 2192959 - RNA, 17 nt, Streptococcus pneumoniae R6
uuaaucacuaauuaucu

SEQ ID NO: 2192960 - RNA, 15 nt, Streptococcus pneumoniae R6
uuaacagauuuuucu

SEQ ID NO: 2192961 - RNA, 21 nt, Streptococcus pneumoniae R6
uuaacaggauauuucuccaaa

SEQ ID NO: 2192962 - RNA, 17 nt, Streptococcus pneumoniae R6
uuaaccacaaaaagugu

SEQ ID NO: 2192963 - RNA, 21 nt, Streptococcus pneumoniae R6
uuaacgauugaaauaacccac

SEQ ID NO: 2192964 - RNA, 19 nt, Streptococcus pneumoniae R6
uuaacgccucccaauuaaa

SEQ ID NO: 2192965 - RNA, 15 nt, Streptococcus pneumoniae R6
uuaacucuuuuuugg

SEQ ID NO: 2192966 - RNA, 14 nt, Streptococcus pneumoniae R6
uuaagcaaaaaaag

SEQ ID NO: 2192967 - RNA, 18 nt, Streptococcus pneumoniae R6
uuaagauuuuaccuauaa

SEQ ID NO: 2192968 - RNA, 13 nt, Streptococcus pneumoniae R6
uuaagcaaaaaaa

SEQ ID NO: 2192969 - RNA, 17 nt, Streptococcus pneumoniae R6
uuaagauuguccucaau

SEQ ID NO: 2192970 - RNA, 11 nt, Streptococcus pneumoniae R6
uuaacuuuuuu

SEQ ID NO: 2192971 - RNA, 13 nt, Streptococcus pneumoniae R6
uuaagaacaucuu

SEQ ID NO: 2192972 - RNA, 12 nt, Streptococcus pneumoniae R6
uuaagaacucuu

SEQ ID NO: 2192973 - RNA, 12 nt, Streptococcus pneumoniae R6
uuaacuuuguau

SEQ ID NO: 2192974 - RNA, 15 nt, Streptococcus pneumoniae R6
uuaacuuuguauaau

SEQ ID NO: 2192975 - RNA, 19 nt, Streptococcus pneumoniae R6
uuacguccaccacaaaaga

SEQ ID NO: 2192976 - RNA, 15 nt, Streptococcus pneumoniae R6
uuacuaauuaauuaa

SEQ ID NO: 2192977 - RNA, 15 nt, Streptococcus pneumoniae R6
uuacggguuuuaaac

SEQ ID NO: 2192978 - RNA, 20 nt, Streptococcus pneumoniae R6
uuacggguuuuaaacuauua

SEQ ID NO: 2192979 - RNA, 21 nt, Streptococcus pneumoniae R6
uuacugaacggugaacuucuu

SEQ ID NO: 2192980 - RNA, 23 nt, Streptococcus pneumoniae R6
uuacugaacggugaacuucuuca

SEQ ID NO: 2192981 - RNA, 23 nt, Streptococcus pneumoniae R6
uuacugucuucagccuuauauuu

SEQ ID NO: 2192982 - RNA, 23 nt, Streptococcus pneumoniae R6
uuacuucaauuucuaaugucucu

SEQ ID NO: 2192983 - RNA, 14 nt, Streptococcus pneumoniae R6
uuacuauaaaauaa

SEQ ID NO: 2192984 - RNA, 18 nt, Streptococcus pneumoniae R6
uuacuauaagacuccucu

SEQ ID NO: 2192985 - RNA, 14 nt, Streptococcus pneumoniae R6
uuacuacuuuuguc

SEQ ID NO: 2192986 - RNA, 21 nt, Streptococcus pneumoniae R6
uuacuaucaagaaguccauaa

SEQ ID NO: 2192987 - RNA, 24 nt, Streptococcus pneumoniae R6
uuacuaucaaugauuuauuuguuu

SEQ ID NO: 2192988 - RNA, 12 nt, Streptococcus pneumoniae R6
uuacucucauuc

SEQ ID NO: 2192989 - RNA, 15 nt, Streptococcus pneumoniae R6
uuacucucauucuua

SEQ ID NO: 2192990 - RNA, 23 nt, Streptococcus pneumoniae R6
uuacucuccuccauaaaaagacc

SEQ ID NO: 2192991 - RNA, 18 nt, Streptococcus pneumoniae R6
uuacucuuauuauucucu

SEQ ID NO: 2192992 - RNA, 23 nt, Streptococcus pneumoniae R6
uuagauagauaaaggccaagucc

SEQ ID NO: 2192993 - RNA, 13 nt, Streptococcus pneumoniae R6
uuagauaaaacua

SEQ ID NO: 2192994 - RNA, 16 nt, Streptococcus pneumoniae R6
uuagauaaaacuauug

SEQ ID NO: 2192995 - RNA, 15 nt, Streptococcus pneumoniae R6
uuagaccugccaugc

SEQ ID NO: 2192996 - RNA, 13 nt, Streptococcus pneumoniae R6
uuagacagaaaaa

SEQ ID NO: 2192997 - RNA, 14 nt, Streptococcus pneumoniae R6
uuagacagaaaaaa

SEQ ID NO: 2192998 - RNA, 16 nt, Streptococcus pneumoniae R6
uuagaauauguaagug

SEQ ID NO: 2192999 - RNA, 20 nt, Streptococcus pneumoniae R6
uuagaaauaucugcacucuc

SEQ ID NO: 2193000 - RNA, 22 nt, Streptococcus pneumoniae R6
uuagaaauaucugcacucucau

SEQ ID NO: 2193001 - RNA, 18 nt, Streptococcus pneumoniae R6
uuagaaagguaaaauaua

SEQ ID NO: 2193002 - RNA, 17 nt, Streptococcus pneumoniae R6
uuagaaagguuuuaaag

SEQ ID NO: 2193003 - RNA, 20 nt, Streptococcus pneumoniae R6
uuagaaagguuuuaaagaca

SEQ ID NO: 2193004 - RNA, 18 nt, Streptococcus pneumoniae R6
uuagaaaaagacuugaaa

SEQ ID NO: 2193005 - RNA, 19 nt, Streptococcus pneumoniae R6
uuagaaaaagacuugaaau

SEQ ID NO: 2193006 - RNA, 23 nt, Streptococcus pneumoniae R6
uuagaaaaagacuugaaauacua

SEQ ID NO: 2193007 - RNA, 12 nt, Streptococcus pneumoniae R6
uuagaaaaagua

SEQ ID NO: 2193008 - RNA, 17 nt, Streptococcus pneumoniae R6
uuagaaaaucucuucaa

SEQ ID NO: 2193009 - RNA, 11 nt, Streptococcus pneumoniae R6
uuacuuccuuu

SEQ ID NO: 2193010 - RNA, 18 nt, Streptococcus pneumoniae R6
uuagauugagaucucuua

SEQ ID NO: 2193011 - RNA, 15 nt, Streptococcus pneumoniae R6
uuagauuuauaauuu

SEQ ID NO: 2193012 - RNA, 21 nt, Streptococcus pneumoniae R6
uuagaugguauugacugccca

SEQ ID NO: 2193013 - RNA, 15 nt, Streptococcus pneumoniae R6
uuagaugauuuuucu

SEQ ID NO: 2193014 - RNA, 19 nt, Streptococcus pneumoniae R6
uuagaucaucaaccucacu

SEQ ID NO: 2193015 - RNA, 23 nt, Streptococcus pneumoniae R6
uuagcuaauuuucuaccgaucuc

SEQ ID NO: 2193016 - RNA, 14 nt, Streptococcus pneumoniae R6
uuagcuauuucuag

SEQ ID NO: 2193017 - RNA, 20 nt, Streptococcus pneumoniae R6
uuagcucaaaacacuguuuu

SEQ ID NO: 2193018 - RNA, 14 nt, Streptococcus pneumoniae R6
uuagcaacuguuuu

SEQ ID NO: 2193019 - RNA, 17 nt, Streptococcus pneumoniae R6
uuaccuuucuuguaaua

SEQ ID NO: 2193020 - RNA, 19 nt, Streptococcus pneumoniae R6
uuacgacauccuauuuauu

SEQ ID NO: 2193021 - RNA, 17 nt, Streptococcus pneumoniae R6
uuacauaauuuaaaaua

SEQ ID NO: 2193022 - RNA, 24 nt, Streptococcus pneumoniae R6
uuacauaauuuaaaauacgcaaaa

SEQ ID NO: 2193023 - RNA, 22 nt, Streptococcus pneumoniae R6
uuacagacaaaacuggcaaaau

SEQ ID NO: 2193024 - RNA, 23 nt, Streptococcus pneumoniae R6
uuacagacaaaacuggcaaaauu

SEQ ID NO: 2193025 - RNA, 17 nt, Streptococcus pneumoniae R6
uuacaucaguauuucau

SEQ ID NO: 2193026 - RNA, 15 nt, Streptococcus pneumoniae R6
uuaccauaguuccga

SEQ ID NO: 2193027 - RNA, 17 nt, Streptococcus pneumoniae R6
uuaccguauauauguua

SEQ ID NO: 2193028 - RNA, 13 nt, Streptococcus pneumoniae R6
uuaauuguauacg

SEQ ID NO: 2193029 - RNA, 15 nt, Streptococcus pneumoniae R6
uuaauuggaaaauaa

SEQ ID NO: 2193030 - RNA, 14 nt, Streptococcus pneumoniae R6
uuaauuuaagagua

SEQ ID NO: 2193031 - RNA, 16 nt, Streptococcus pneumoniae R6
uuaauuuaaugcagua

SEQ ID NO: 2193032 - RNA, 14 nt, Streptococcus pneumoniae R6
uuaauuucaaugua

SEQ ID NO: 2193033 - RNA, 14 nt, Streptococcus pneumoniae R6
uuaaucucuccuua

SEQ ID NO: 2193034 - RNA, 19 nt, Streptococcus pneumoniae R6
uuaaucuucaaauuuuuca

SEQ ID NO: 2193035 - RNA, 17 nt, Streptococcus pneumoniae R6
uuaaucugcuuacaugc

SEQ ID NO: 2193036 - RNA, 19 nt, Streptococcus pneumoniae R6
uuacacguacuuuaaaauc

SEQ ID NO: 2193037 - RNA, 17 nt, Streptococcus pneumoniae R6
uuacacucaauuuaucu

SEQ ID NO: 2193038 - RNA, 16 nt, Streptococcus pneumoniae R6
uuacagaaagaacaaa

SEQ ID NO: 2193039 - RNA, 18 nt, Streptococcus pneumoniae R6
uuacaaaaaaucaaaaaa

SEQ ID NO: 2193040 - RNA, 14 nt, Streptococcus pneumoniae R6
uuacaaauaccaua

SEQ ID NO: 2193041 - RNA, 15 nt, Streptococcus pneumoniae R6
uuacaaauaccauaa

SEQ ID NO: 2193042 - RNA, 20 nt, Streptococcus pneumoniae R6
uguuucguacuauuucagau

SEQ ID NO: 2193043 - RNA, 21 nt, Streptococcus pneumoniae R6
uguuucggaucauauuuucug

SEQ ID NO: 2193044 - RNA, 15 nt, Streptococcus pneumoniae R6
uguuucguuucuucg

SEQ ID NO: 2193045 - RNA, 16 nt, Streptococcus pneumoniae R6
uguuucguuucuucgu

SEQ ID NO: 2193046 - RNA, 12 nt, Streptococcus pneumoniae R6
uguuucuaaaac

SEQ ID NO: 2193047 - RNA, 17 nt, Streptococcus pneumoniae R6
uguuucuaaaacauugu

SEQ ID NO: 2193048 - RNA, 19 nt, Streptococcus pneumoniae R6
uguuucuaaaacauuguga

SEQ ID NO: 2193049 - RNA, 19 nt, Streptococcus pneumoniae R6
uguuucuugagaagagcuu

SEQ ID NO: 2193050 - RNA, 23 nt, Streptococcus pneumoniae R6
uguuucucggucuuguuuuuaua

SEQ ID NO: 2193051 - RNA, 17 nt, Streptococcus pneumoniae R6
uguuucucugugaaugc

SEQ ID NO: 2193052 - RNA, 15 nt, Streptococcus pneumoniae R6
uguuugcuucauuuu

SEQ ID NO: 2193053 - RNA, 13 nt, Streptococcus pneumoniae R6
uguuugcagcacc

SEQ ID NO: 2193054 - RNA, 20 nt, Streptococcus pneumoniae R6
uguuugacgagugaagaauu

SEQ ID NO: 2193055 - RNA, 21 nt, Streptococcus pneumoniae R6
uguuucauggcaaauucacca

SEQ ID NO: 2193056 - RNA, 21 nt, Streptococcus pneumoniae R6
uguuuccaguuaucugcaaaa

SEQ ID NO: 2193057 - RNA, 22 nt, Streptococcus pneumoniae R6
uguuuauaaucauuaaaauaac

SEQ ID NO: 2193058 - RNA, 12 nt, Streptococcus pneumoniae R6
uguuuauaucua

SEQ ID NO: 2193059 - RNA, 21 nt, Streptococcus pneumoniae R6
uguuuuggcaacgacaggagu

SEQ ID NO: 2193060 - RNA, 18 nt, Streptococcus pneumoniae R6
uguuuugagguuguagau

SEQ ID NO: 2193061 - RNA, 22 nt, Streptococcus pneumoniae R6
uguuuucacuggaguucuuuuc

SEQ ID NO: 2193062 - RNA, 19 nt, Streptococcus pneumoniae R6
uguuuucuauagaaagcuu

SEQ ID NO: 2193063 - RNA, 16 nt, Streptococcus pneumoniae R6
uguuuucuuaucuugu

SEQ ID NO: 2193064 - RNA, 22 nt, Streptococcus pneumoniae R6
uguuuucuuggucauuugagau

SEQ ID NO: 2193065 - RNA, 15 nt, Streptococcus pneumoniae R6
uguuuuuaugauaua

SEQ ID NO: 2193066 - RNA, 21 nt, Streptococcus pneumoniae R6
uguuuuuccugauuaaaauca

SEQ ID NO: 2193067 - RNA, 12 nt, Streptococcus pneumoniae R6
uguuuuuucaca

SEQ ID NO: 2193068 - RNA, 15 nt, Streptococcus pneumoniae R6
uguuuggauuauuac

SEQ ID NO: 2193069 - RNA, 17 nt, Streptococcus pneumoniae R6
uguuuuaauauaauauc

SEQ ID NO: 2193070 - RNA, 18 nt, Streptococcus pneumoniae R6
uguuuucacauuuucaaa

SEQ ID NO: 2193071 - RNA, 15 nt, Streptococcus pneumoniae R6
uguuuucauaucucc

SEQ ID NO: 2193072 - RNA, 20 nt, Streptococcus pneumoniae R6
uguuuuaggagguuauuggc

SEQ ID NO: 2193073 - RNA, 15 nt, Streptococcus pneumoniae R6
uguuuuagcaaucgc

SEQ ID NO: 2193074 - RNA, 15 nt, Streptococcus pneumoniae R6
uguuuuagaaaucac

SEQ ID NO: 2193075 - RNA, 11 nt, Streptococcus pneumoniae R6
uuaaacuuuuc

SEQ ID NO: 2193076 - RNA, 16 nt, Streptococcus pneumoniae R6
uuaaagaaauagaaaa

SEQ ID NO: 2193077 - RNA, 19 nt, Streptococcus pneumoniae R6
uuaaagacagucugaaaaa

SEQ ID NO: 2193078 - RNA, 22 nt, Streptococcus pneumoniae R6
uuaaagacagucugaaaaagag

SEQ ID NO: 2193079 - RNA, 11 nt, Streptococcus pneumoniae R6
uuaaagauucc

SEQ ID NO: 2193080 - RNA, 22 nt, Streptococcus pneumoniae R6
uuaaagauuccuccgagaagua

SEQ ID NO: 2193081 - RNA, 16 nt, Streptococcus pneumoniae R6
uuaaacucuccaauau

SEQ ID NO: 2193082 - RNA, 18 nt, Streptococcus pneumoniae R6
uuaaacucagguuucucu

SEQ ID NO: 2193083 - RNA, 20 nt, Streptococcus pneumoniae R6
uuaaacgugcuauaucaaaa

SEQ ID NO: 2193084 - RNA, 18 nt, Streptococcus pneumoniae R6
uuaaacuaauguaaaaaa

SEQ ID NO: 2193085 - RNA, 18 nt, Streptococcus pneumoniae R6
uuaaaccaauuuuaagaa

SEQ ID NO: 2193086 - RNA, 17 nt, Streptococcus pneumoniae R6
uuaaaauguucuguaau

SEQ ID NO: 2193087 - RNA, 19 nt, Streptococcus pneumoniae R6
uuaaaauguucuguaauga

SEQ ID NO: 2193088 - RNA, 12 nt, Streptococcus pneumoniae R6
uuaaaauguugg

SEQ ID NO: 2193089 - RNA, 15 nt, Streptococcus pneumoniae R6
uuaaaauuaaaaaga

SEQ ID NO: 2193090 - RNA, 15 nt, Streptococcus pneumoniae R6
uuaaaaugccaaaga

SEQ ID NO: 2193091 - RNA, 15 nt, Streptococcus pneumoniae R6
uuaaacaaagucuga

SEQ ID NO: 2193092 - RNA, 18 nt, Streptococcus pneumoniae R6
uuaaaaaauaaucaaaac

SEQ ID NO: 2193093 - RNA, 11 nt, Streptococcus pneumoniae R6
uuaaaaaagau

SEQ ID NO: 2193094 - RNA, 23 nt, Streptococcus pneumoniae R6
uuaaaaaagugguaucauauaaa

SEQ ID NO: 2193095 - RNA, 18 nt, Streptococcus pneumoniae R6
uuaaaaauagauuuuuaa

SEQ ID NO: 2193096 - RNA, 13 nt, Streptococcus pneumoniae R6
uuaaaaaaccaau

SEQ ID NO: 2193097 - RNA, 14 nt, Streptococcus pneumoniae R6
uuaaaaaaccaauu

SEQ ID NO: 2193098 - RNA, 13 nt, Streptococcus pneumoniae R6
uguuuuuucuugc

SEQ ID NO: 2193099 - RNA, 22 nt, Streptococcus pneumoniae R6
uuaaaaaaagggcuguaucugu

SEQ ID NO: 2193100 - RNA, 21 nt, Streptococcus pneumoniae R6
uuaaaaguagcgcccuuguuc

SEQ ID NO: 2193101 - RNA, 15 nt, Streptococcus pneumoniae R6
uuaaaaguaagagaa

SEQ ID NO: 2193102 - RNA, 16 nt, Streptococcus pneumoniae R6
uuaaaaguaagagaaa

SEQ ID NO: 2193103 - RNA, 22 nt, Streptococcus pneumoniae R6
uuaaaauaaguucaacaaauca

SEQ ID NO: 2193104 - RNA, 21 nt, Streptococcus pneumoniae R6
uuaaaaucaaaaaacguauaa

SEQ ID NO: 2193105 - RNA, 21 nt, Streptococcus pneumoniae R6
uuaaaaucaccugcaauaaua

SEQ ID NO: 2193106 - RNA, 17 nt, Streptococcus pneumoniae R6
uuaaaaucguagucuuu

SEQ ID NO: 2193107 - RNA, 18 nt, Streptococcus pneumoniae R6
uuaaaauccauaauuacc

SEQ ID NO: 2193108 - RNA, 16 nt, Streptococcus pneumoniae R6
uuaaaaauuacaaaca

SEQ ID NO: 2193109 - RNA, 15 nt, Streptococcus pneumoniae R6
uuaaaacaaagaaaa

SEQ ID NO: 2193110 - RNA, 19 nt, Streptococcus pneumoniae R6
uuaaaacaaagaaaaagaa

SEQ ID NO: 2193111 - RNA, 18 nt, Streptococcus pneumoniae R6
uguuauugaaacagcuaa

SEQ ID NO: 2193112 - RNA, 13 nt, Streptococcus pneumoniae R6
uguuauuucuuga

SEQ ID NO: 2193113 - RNA, 14 nt, Streptococcus pneumoniae R6
uguuaugauucucc

SEQ ID NO: 2193114 - RNA, 18 nt, Streptococcus pneumoniae R6
uguuaugcaacuuuuuua

SEQ ID NO: 2193115 - RNA, 13 nt, Streptococcus pneumoniae R6
uguuaucugaaaa

SEQ ID NO: 2193116 - RNA, 13 nt, Streptococcus pneumoniae R6
uguuauagauuca

SEQ ID NO: 2193117 - RNA, 15 nt, Streptococcus pneumoniae R6
uguuauagguaaaau

SEQ ID NO: 2193118 - RNA, 23 nt, Streptococcus pneumoniae R6
uguuauacauccguuuuucuccu

SEQ ID NO: 2193119 - RNA, 15 nt, Streptococcus pneumoniae R6
uguuauagaaguacu

SEQ ID NO: 2193120 - RNA, 23 nt, Streptococcus pneumoniae R6
uguuauagaaguacuaaugcccu

SEQ ID NO: 2193121 - RNA, 20 nt, Streptococcus pneumoniae R6
uguuagauuaggaauuagag

SEQ ID NO: 2193122 - RNA, 22 nt, Streptococcus pneumoniae R6
uguucacuuuuuguuuaauacu

SEQ ID NO: 2193123 - RNA, 22 nt, Streptococcus pneumoniae R6
uguucagagcgauaaaaauccu

SEQ ID NO: 2193124 - RNA, 18 nt, Streptococcus pneumoniae R6
uguucaauccacuuguaa

SEQ ID NO: 2193125 - RNA, 20 nt, Streptococcus pneumoniae R6
uguucaaugggguucaucuc

SEQ ID NO: 2193126 - RNA, 19 nt, Streptococcus pneumoniae R6
uguucaauggguucaucuc

SEQ ID NO: 2193127 - RNA, 23 nt, Streptococcus pneumoniae R6
uguuccacucgcugacacuggca

SEQ ID NO: 2193128 - RNA, 19 nt, Streptococcus pneumoniae R6
uguuccaaagccacuugcg

SEQ ID NO: 2193129 - RNA, 20 nt, Streptococcus pneumoniae R6
uguuccaacauuguuuguac

SEQ ID NO: 2193130 - RNA, 20 nt, Streptococcus pneumoniae R6
uguucaucuucuuucuccuu

SEQ ID NO: 2193131 - RNA, 20 nt, Streptococcus pneumoniae R6
uguucauguucgaucuaagg

SEQ ID NO: 2193132 - RNA, 13 nt, Streptococcus pneumoniae R6
uguucaucauuaa

SEQ ID NO: 2193133 - RNA, 22 nt, Streptococcus pneumoniae R6
uguucaucaucuagaugaauua

SEQ ID NO: 2193134 - RNA, 19 nt, Streptococcus pneumoniae R6
uguuccgauuuuauuucau

SEQ ID NO: 2193135 - RNA, 20 nt, Streptococcus pneumoniae R6
uguuccgauuuuauuucauu

SEQ ID NO: 2193136 - RNA, 21 nt, Streptococcus pneumoniae R6
uguucuaaaauaaguucuguu

SEQ ID NO: 2193137 - RNA, 17 nt, Streptococcus pneumoniae R6
uguucuaagguuucaaa

SEQ ID NO: 2193138 - RNA, 14 nt, Streptococcus pneumoniae R6
uguucucauauuuu

SEQ ID NO: 2193139 - RNA, 16 nt, Streptococcus pneumoniae R6
uguucuaugaguaugu

SEQ ID NO: 2193140 - RNA, 22 nt, Streptococcus pneumoniae R6
uguucucaaccuugcuucuuuc

SEQ ID NO: 2193141 - RNA, 13 nt, Streptococcus pneumoniae R6
uguucuucugcug

SEQ ID NO: 2193142 - RNA, 20 nt, Streptococcus pneumoniae R6
uguucuuguuucaauugacu

SEQ ID NO: 2193143 - RNA, 18 nt, Streptococcus pneumoniae R6
uguucuuuagaaagguuu

SEQ ID NO: 2193144 - RNA, 18 nt, Streptococcus pneumoniae R6
uguucuguaaugaaauac

SEQ ID NO: 2193145 - RNA, 14 nt, Streptococcus pneumoniae R6
uguucuuauuucau

SEQ ID NO: 2193146 - RNA, 13 nt, Streptococcus pneumoniae R6
uguugcugaaaug

SEQ ID NO: 2193147 - RNA, 21 nt, Streptococcus pneumoniae R6
uguugcuggcaagauuuguuc

SEQ ID NO: 2193148 - RNA, 21 nt, Streptococcus pneumoniae R6
uguugcuuuggagucaauaau

SEQ ID NO: 2193149 - RNA, 15 nt, Streptococcus pneumoniae R6
uguugcuuuucuuca

SEQ ID NO: 2193150 - RNA, 13 nt, Streptococcus pneumoniae R6
uguugcauuaaaa

SEQ ID NO: 2193151 - RNA, 13 nt, Streptococcus pneumoniae R6
uguuguaugaaaa

SEQ ID NO: 2193152 - RNA, 14 nt, Streptococcus pneumoniae R6
uguuguaauuuuaa

SEQ ID NO: 2193153 - RNA, 18 nt, Streptococcus pneumoniae R6
uguuguaagcuagcaaca

SEQ ID NO: 2193154 - RNA, 22 nt, Streptococcus pneumoniae R6
uguugguaagagaaauuucuga

SEQ ID NO: 2193155 - RNA, 13 nt, Streptococcus pneumoniae R6
uguuggauauaag

SEQ ID NO: 2193156 - RNA, 13 nt, Streptococcus pneumoniae R6
uguuguuguaaua

SEQ ID NO: 2193157 - RNA, 18 nt, Streptococcus pneumoniae R6
uguuuaaagucucugucc

SEQ ID NO: 2193158 - RNA, 19 nt, Streptococcus pneumoniae R6
uguuuaaauacuuuuuccu

SEQ ID NO: 2193159 - RNA, 22 nt, Streptococcus pneumoniae R6
uguuuaagguggcgauuuuuuc

SEQ ID NO: 2193160 - RNA, 17 nt, Streptococcus pneumoniae R6
uguuuaagagcacaaaa

SEQ ID NO: 2193161 - RNA, 20 nt, Streptococcus pneumoniae R6
uguuuaauacucaaugaaaa

SEQ ID NO: 2193162 - RNA, 19 nt, Streptococcus pneumoniae R6
uguuuaauucuugaaaauc

SEQ ID NO: 2193163 - RNA, 15 nt, Streptococcus pneumoniae R6
uguuuacgaauaucu

SEQ ID NO: 2193164 - RNA, 19 nt, Streptococcus pneumoniae R6
uguacuuagccaagucagu

SEQ ID NO: 2193165 - RNA, 22 nt, Streptococcus pneumoniae R6
uguacgaauuagguugaccauu

SEQ ID NO: 2193166 - RNA, 21 nt, Streptococcus pneumoniae R6
uguaaugcguucaccaggagc

SEQ ID NO: 2193167 - RNA, 20 nt, Streptococcus pneumoniae R6
uguacacauuauguaaacaa

SEQ ID NO: 2193168 - RNA, 19 nt, Streptococcus pneumoniae R6
uguacccaaguaaucugca

SEQ ID NO: 2193169 - RNA, 20 nt, Streptococcus pneumoniae R6
uguacccaaguaaucugcac

SEQ ID NO: 2193170 - RNA, 15 nt, Streptococcus pneumoniae R6
uguaaugacagugau

SEQ ID NO: 2193171 - RNA, 19 nt, Streptococcus pneumoniae R6
uguaauuucugaaaucaac

SEQ ID NO: 2193172 - RNA, 12 nt, Streptococcus pneumoniae R6
uguaauuugguu

SEQ ID NO: 2193173 - RNA, 13 nt, Streptococcus pneumoniae R6
uguaaugaaauac

SEQ ID NO: 2193174 - RNA, 16 nt, Streptococcus pneumoniae R6
uguaaugaaauacuga

SEQ ID NO: 2193175 - RNA, 17 nt, Streptococcus pneumoniae R6
uguaaucuuagcaaaga

SEQ ID NO: 2193176 - RNA, 15 nt, Streptococcus pneumoniae R6
uguaacguucuucaa

SEQ ID NO: 2193177 - RNA, 19 nt, Streptococcus pneumoniae R6
ugguuuuuacugucuucag

SEQ ID NO: 2193178 - RNA, 17 nt, Streptococcus pneumoniae R6
ugguuuauuggcuacga

SEQ ID NO: 2193179 - RNA, 18 nt, Streptococcus pneumoniae R6
uggugacauggacacaua

SEQ ID NO: 2193180 - RNA, 18 nt, Streptococcus pneumoniae R6
uggucuugcuuuuuuaua

SEQ ID NO: 2193181 - RNA, 23 nt, Streptococcus pneumoniae R6
uguaaacaaguugcuugaaaacu

SEQ ID NO: 2193182 - RNA, 20 nt, Streptococcus pneumoniae R6
uguaacccaaacaagccuuu

SEQ ID NO: 2193183 - RNA, 20 nt, Streptococcus pneumoniae R6
uguaaaaaaguaaaaagggu

SEQ ID NO: 2193184 - RNA, 21 nt, Streptococcus pneumoniae R6
ugguuuuuuaacaaaaauuug

SEQ ID NO: 2193185 - RNA, 23 nt, Streptococcus pneumoniae R6
uguaaaaagagggauuuuguauu

SEQ ID NO: 2193186 - RNA, 13 nt, Streptococcus pneumoniae R6
uguaaaaagugaa

SEQ ID NO: 2193187 - RNA, 14 nt, Streptococcus pneumoniae R6
uguaaaaagugaaa

SEQ ID NO: 2193188 - RNA, 20 nt, Streptococcus pneumoniae R6
uguaaaaucuuugcauuauc

SEQ ID NO: 2193189 - RNA, 21 nt, Streptococcus pneumoniae R6
uguaaaaucuuugcauuaucu

SEQ ID NO: 2193190 - RNA, 13 nt, Streptococcus pneumoniae R6
uguaguaaaagaa

SEQ ID NO: 2193191 - RNA, 15 nt, Streptococcus pneumoniae R6
uguaguaaaagaauu

SEQ ID NO: 2193192 - RNA, 15 nt, Streptococcus pneumoniae R6
uguaguggguaggcg

SEQ ID NO: 2193193 - RNA, 15 nt, Streptococcus pneumoniae R6
uguaguggguugaaa

SEQ ID NO: 2193194 - RNA, 19 nt, Streptococcus pneumoniae R6
uguaguggguugaagaaaa

SEQ ID NO: 2193195 - RNA, 20 nt, Streptococcus pneumoniae R6
uguaguggguugaagucagc

SEQ ID NO: 2193196 - RNA, 16 nt, Streptococcus pneumoniae R6
uguaggcuuucaacug

SEQ ID NO: 2193197 - RNA, 15 nt, Streptococcus pneumoniae R6
uguauaauaggugga

SEQ ID NO: 2193198 - RNA, 20 nt, Streptococcus pneumoniae R6
uguaguuggauuuccacuaa

SEQ ID NO: 2193199 - RNA, 16 nt, Streptococcus pneumoniae R6
uguaguuaguguauaa

SEQ ID NO: 2193200 - RNA, 18 nt, Streptococcus pneumoniae R6
uguauauuuuucaaauaa

SEQ ID NO: 2193201 - RNA, 16 nt, Streptococcus pneumoniae R6
uguauagugaauugaa

SEQ ID NO: 2193202 - RNA, 13 nt, Streptococcus pneumoniae R6
uguauacuuugca

SEQ ID NO: 2193203 - RNA, 18 nt, Streptococcus pneumoniae R6
uguauaggucuggcuauu

SEQ ID NO: 2193204 - RNA, 22 nt, Streptococcus pneumoniae R6
ugucacgaaccacacuuucauu

SEQ ID NO: 2193205 - RNA, 23 nt, Streptococcus pneumoniae R6
ugucacgaaccacacuuucauug

SEQ ID NO: 2193206 - RNA, 18 nt, Streptococcus pneumoniae R6
ugucaaaucaaaaucacg

SEQ ID NO: 2193207 - RNA, 19 nt, Streptococcus pneumoniae R6
ugucaaagaguugaggcaa

SEQ ID NO: 2193208 - RNA, 21 nt, Streptococcus pneumoniae R6
ugucaacuguaguggguugaa

SEQ ID NO: 2193209 - RNA, 16 nt, Streptococcus pneumoniae R6
ugucaagucuugcucu

SEQ ID NO: 2193210 - RNA, 14 nt, Streptococcus pneumoniae R6
uguauuaucaauau

SEQ ID NO: 2193211 - RNA, 12 nt, Streptococcus pneumoniae R6
uguauuaagaac

SEQ ID NO: 2193212 - RNA, 20 nt, Streptococcus pneumoniae R6
uguaugagaaacagcuccug

SEQ ID NO: 2193213 - RNA, 15 nt, Streptococcus pneumoniae R6
ugucagugacagaaa

SEQ ID NO: 2193214 - RNA, 20 nt, Streptococcus pneumoniae R6
ugucaucguuuuccuagaau

SEQ ID NO: 2193215 - RNA, 13 nt, Streptococcus pneumoniae R6
ugucaucuuccaa

SEQ ID NO: 2193216 - RNA, 22 nt, Streptococcus pneumoniae R6
ugucauggcugaaagggcagua

SEQ ID NO: 2193217 - RNA, 16 nt, Streptococcus pneumoniae R6
ugucuacauucuuuuu

SEQ ID NO: 2193218 - RNA, 20 nt, Streptococcus pneumoniae R6
ugucuagauucgaucugaua

SEQ ID NO: 2193219 - RNA, 14 nt, Streptococcus pneumoniae R6
ugucuauuugcuuu

SEQ ID NO: 2193220 - RNA, 15 nt, Streptococcus pneumoniae R6
ugucauuuuuuccaa

SEQ ID NO: 2193221 - RNA, 21 nt, Streptococcus pneumoniae R6
ugucauuuuuuccaauucuuc

SEQ ID NO: 2193222 - RNA, 20 nt, Streptococcus pneumoniae R6
ugucauuccaauucugcuuu

SEQ ID NO: 2193223 - RNA, 13 nt, Streptococcus pneumoniae R6
ugugauaaaaugu

SEQ ID NO: 2193224 - RNA, 14 nt, Streptococcus pneumoniae R6
ugugauaaaaugua

SEQ ID NO: 2193225 - RNA, 18 nt, Streptococcus pneumoniae R6
ugugagauaguaucaaau

SEQ ID NO: 2193226 - RNA, 16 nt, Streptococcus pneumoniae R6
ugugccaauucuuauc

SEQ ID NO: 2193227 - RNA, 20 nt, Streptococcus pneumoniae R6
ugugaauauucuuggcaaag

SEQ ID NO: 2193228 - RNA, 15 nt, Streptococcus pneumoniae R6
ugucuuauccaaacu

SEQ ID NO: 2193229 - RNA, 18 nt, Streptococcus pneumoniae R6
ugugaaugccuguuccaa

SEQ ID NO: 2193230 - RNA, 21 nt, Streptococcus pneumoniae R6
ugugaauuuucaauuugauua

SEQ ID NO: 2193231 - RNA, 20 nt, Streptococcus pneumoniae R6
ugugacaaaauaaaaacauc

SEQ ID NO: 2193232 - RNA, 16 nt, Streptococcus pneumoniae R6
ugucuuaccacaaaca

SEQ ID NO: 2193233 - RNA, 17 nt, Streptococcus pneumoniae R6
ugucuuaccacaaacaa

SEQ ID NO: 2193234 - RNA, 17 nt, Streptococcus pneumoniae R6
ugucuuacguucaucca

SEQ ID NO: 2193235 - RNA, 20 nt, Streptococcus pneumoniae R6
ugucuuaacaaaauuauuaa

SEQ ID NO: 2193236 - RNA, 16 nt, Streptococcus pneumoniae R6
ugucuggaaugauaac

SEQ ID NO: 2193237 - RNA, 13 nt, Streptococcus pneumoniae R6
uguuagaaaaaug

SEQ ID NO: 2193238 - RNA, 15 nt, Streptococcus pneumoniae R6
uguuagaaaaaugca

SEQ ID NO: 2193239 - RNA, 20 nt, Streptococcus pneumoniae R6
uguuagaaaaaugcaaagac

SEQ ID NO: 2193240 - RNA, 19 nt, Streptococcus pneumoniae R6
uguuacugauuucgucagu

SEQ ID NO: 2193241 - RNA, 16 nt, Streptococcus pneumoniae R6
uguuacagacaaaacu

SEQ ID NO: 2193242 - RNA, 20 nt, Streptococcus pneumoniae R6
uguuacacguacuuuaaaau

SEQ ID NO: 2193243 - RNA, 17 nt, Streptococcus pneumoniae R6
uguuaccacuuccuacc

SEQ ID NO: 2193244 - RNA, 22 nt, Streptococcus pneumoniae R6
uguuaccacuuccuaccuauuc

SEQ ID NO: 2193245 - RNA, 16 nt, Streptococcus pneumoniae R6
uguuaccugauaagau

SEQ ID NO: 2193246 - RNA, 13 nt, Streptococcus pneumoniae R6
uguuaagaaauaa

SEQ ID NO: 2193247 - RNA, 16 nt, Streptococcus pneumoniae R6
uguuaagcguuuucua

SEQ ID NO: 2193248 - RNA, 20 nt, Streptococcus pneumoniae R6
uguuaagcuccaauuuauuu

SEQ ID NO: 2193249 - RNA, 17 nt, Streptococcus pneumoniae R6
uguuaaaguuccggaaa

SEQ ID NO: 2193250 - RNA, 19 nt, Streptococcus pneumoniae R6
uguuaaaugaauauauucc

SEQ ID NO: 2193251 - RNA, 13 nt, Streptococcus pneumoniae R6
uguguuuuuucuu

SEQ ID NO: 2193252 - RNA, 16 nt, Streptococcus pneumoniae R6
uguguuggguagcaua

SEQ ID NO: 2193253 - RNA, 16 nt, Streptococcus pneumoniae R6
uguguugcuuuuugau

SEQ ID NO: 2193254 - RNA, 12 nt, Streptococcus pneumoniae R6
uguguucuacuc

SEQ ID NO: 2193255 - RNA, 15 nt, Streptococcus pneumoniae R6
uguguucuacucuaa

SEQ ID NO: 2193256 - RNA, 23 nt, Streptococcus pneumoniae R6
ugugucuucgucuggauugacca

SEQ ID NO: 2193257 - RNA, 22 nt, Streptococcus pneumoniae R6
ugugcucaaucaaguaagccau

SEQ ID NO: 2193258 - RNA, 14 nt, Streptococcus pneumoniae R6
uguggaugaaacug

SEQ ID NO: 2193259 - RNA, 18 nt, Streptococcus pneumoniae R6
uguggcuaucugucacaa

SEQ ID NO: 2193260 - RNA, 17 nt, Streptococcus pneumoniae R6
uguguauucguccaucc

SEQ ID NO: 2193261 - RNA, 17 nt, Streptococcus pneumoniae R6
uguguacuguucuaaau

SEQ ID NO: 2193262 - RNA, 18 nt, Streptococcus pneumoniae R6
uguguagcacuuuuccau

SEQ ID NO: 2193263 - RNA, 20 nt, Streptococcus pneumoniae R6
uguguaaaaaaguaaaaagg

SEQ ID NO: 2193264 - RNA, 16 nt, Streptococcus pneumoniae R6
ugugguauuaacagcu

SEQ ID NO: 2193265 - RNA, 13 nt, Streptococcus pneumoniae R6
uguggugcuucug

SEQ ID NO: 2193266 - RNA, 18 nt, Streptococcus pneumoniae R6
uggggaucgguuagacca

SEQ ID NO: 2193267 - RNA, 22 nt, Streptococcus pneumoniae R6
uggggcgauaggauugacaaaa

SEQ ID NO: 2193268 - RNA, 18 nt, Streptococcus pneumoniae R6
ugggugaaguguuuuuuc

SEQ ID NO: 2193269 - RNA, 14 nt, Streptococcus pneumoniae R6
ugggcacguacaga

SEQ ID NO: 2193270 - RNA, 17 nt, Streptococcus pneumoniae R6
uggcguuggaauaaggu

SEQ ID NO: 2193271 - RNA, 14 nt, Streptococcus pneumoniae R6
uggcuuaucagucu

SEQ ID NO: 2193272 - RNA, 15 nt, Streptococcus pneumoniae R6
uggcuuaucagucuc

SEQ ID NO: 2193273 - RNA, 19 nt, Streptococcus pneumoniae R6
uggcuuauuccaauugauu

SEQ ID NO: 2193274 - RNA, 15 nt, Streptococcus pneumoniae R6
uggcuuucacguugu

SEQ ID NO: 2193275 - RNA, 19 nt, Streptococcus pneumoniae R6
uggcuuucacguuguucaa

SEQ ID NO: 2193276 - RNA, 17 nt, Streptococcus pneumoniae R6
uggcuuugauucaucuc

SEQ ID NO: 2193277 - RNA, 20 nt, Streptococcus pneumoniae R6
ugggcaaucgccaauucuuu

SEQ ID NO: 2193278 - RNA, 15 nt, Streptococcus pneumoniae R6
ugggaugacuuucca

SEQ ID NO: 2193279 - RNA, 19 nt, Streptococcus pneumoniae R6
ugggauggucacagaacca

SEQ ID NO: 2193280 - RNA, 14 nt, Streptococcus pneumoniae R6
ugguauuuuuucaa

SEQ ID NO: 2193281 - RNA, 19 nt, Streptococcus pneumoniae R6
uggucaauccgaguuuuuc

SEQ ID NO: 2193282 - RNA, 19 nt, Streptococcus pneumoniae R6
uggucacauugaaaaugug

SEQ ID NO: 2193283 - RNA, 21 nt, Streptococcus pneumoniae R6
uggucacauugaaaaugugaa

SEQ ID NO: 2193284 - RNA, 19 nt, Streptococcus pneumoniae R6
uggucagaggggugcugag

SEQ ID NO: 2193285 - RNA, 19 nt, Streptococcus pneumoniae R6
uggucacuauggagaaucg

SEQ ID NO: 2193286 - RNA, 14 nt, Streptococcus pneumoniae R6
uggucgcuuccaau

SEQ ID NO: 2193287 - RNA, 14 nt, Streptococcus pneumoniae R6
uggucgauaucuuc

SEQ ID NO: 2193288 - RNA, 16 nt, Streptococcus pneumoniae R6
uggucgauaucuucca

SEQ ID NO: 2193289 - RNA, 14 nt, Streptococcus pneumoniae R6
ugguaagaaguaac

SEQ ID NO: 2193290 - RNA, 18 nt, Streptococcus pneumoniae R6
ugguaaugcuuuccauua

SEQ ID NO: 2193291 - RNA, 16 nt, Streptococcus pneumoniae R6
ugguacaguugggauu

SEQ ID NO: 2193292 - RNA, 19 nt, Streptococcus pneumoniae R6
uggguuucuucuagcuuca

SEQ ID NO: 2193293 - RNA, 11 nt, Streptococcus pneumoniae R6
ugguaaagaau

SEQ ID NO: 2193294 - RNA, 13 nt, Streptococcus pneumoniae R6
ugguaaagacucu

SEQ ID NO: 2193295 - RNA, 22 nt, Streptococcus pneumoniae R6
ugguaucugcuaaaacaaaauu

SEQ ID NO: 2193296 - RNA, 17 nt, Streptococcus pneumoniae R6
ugguauccaaaacaacc

SEQ ID NO: 2193297 - RNA, 18 nt, Streptococcus pneumoniae R6
ugguaugaucuauuccua

SEQ ID NO: 2193298 - RNA, 15 nt, Streptococcus pneumoniae R6
ugguauguguauucg

SEQ ID NO: 2193299 - RNA, 19 nt, Streptococcus pneumoniae R6
ugguauguguauucgucca

SEQ ID NO: 2193300 - RNA, 14 nt, Streptococcus pneumoniae R6
ugguauuaauaauu

SEQ ID NO: 2193301 - RNA, 19 nt, Streptococcus pneumoniae R6
ugguauugguugugaaggu

SEQ ID NO: 2193302 - RNA, 16 nt, Streptococcus pneumoniae R6
ugguauuuguaaaauu

SEQ ID NO: 2193303 - RNA, 13 nt, Streptococcus pneumoniae R6
ugguauuuagauu

SEQ ID NO: 2193304 - RNA, 14 nt, Streptococcus pneumoniae R6
ugguacuauuuaau

SEQ ID NO: 2193305 - RNA, 21 nt, Streptococcus pneumoniae R6
ugguagggugaagaguugggu

SEQ ID NO: 2193306 - RNA, 16 nt, Streptococcus pneumoniae R6
ugguaggcuuuaucaa

SEQ ID NO: 2193307 - RNA, 17 nt, Streptococcus pneumoniae R6
uggcgaaggucuuucaa

SEQ ID NO: 2193308 - RNA, 16 nt, Streptococcus pneumoniae R6
uggccaacuucuuuuu

SEQ ID NO: 2193309 - RNA, 18 nt, Streptococcus pneumoniae R6
uggccgcaagcagcuaaa

SEQ ID NO: 2193310 - RNA, 15 nt, Streptococcus pneumoniae R6
uggccgaugauggua

SEQ ID NO: 2193311 - RNA, 16 nt, Streptococcus pneumoniae R6
uggccgauaacagcca

SEQ ID NO: 2193312 - RNA, 21 nt, Streptococcus pneumoniae R6
uggcaaaauuagcucaaaaca

SEQ ID NO: 2193313 - RNA, 23 nt, Streptococcus pneumoniae R6
uggcaaauagaagauuuccucca

SEQ ID NO: 2193314 - RNA, 19 nt, Streptococcus pneumoniae R6
uggauuucuuuagucccau

SEQ ID NO: 2193315 - RNA, 21 nt, Streptococcus pneumoniae R6
uggauuuccacuaaagguuga

SEQ ID NO: 2193316 - RNA, 19 nt, Streptococcus pneumoniae R6
uggauuuauaguaaaauga

SEQ ID NO: 2193317 - RNA, 21 nt, Streptococcus pneumoniae R6
uggauuuaucaguauauugaa

SEQ ID NO: 2193318 - RNA, 14 nt, Streptococcus pneumoniae R6
ugcguucaccagga

SEQ ID NO: 2193319 - RNA, 19 nt, Streptococcus pneumoniae R6
uggauucuuuguuaaauga

SEQ ID NO: 2193320 - RNA, 20 nt, Streptococcus pneumoniae R6
uggauucuuuguuaaaugaa

SEQ ID NO: 2193321 - RNA, 14 nt, Streptococcus pneumoniae R6
uggauugaaauaag

SEQ ID NO: 2193322 - RNA, 18 nt, Streptococcus pneumoniae R6
uggauugaccaagcuauc

SEQ ID NO: 2193323 - RNA, 20 nt, Streptococcus pneumoniae R6
uggcacaaaagguucuuuua

SEQ ID NO: 2193324 - RNA, 14 nt, Streptococcus pneumoniae R6
uggcaauucaauua

SEQ ID NO: 2193325 - RNA, 23 nt, Streptococcus pneumoniae R6
uggcaauuuuacuucuuccccag

SEQ ID NO: 2193326 - RNA, 17 nt, Streptococcus pneumoniae R6
uggcaccgaauuuuuca

SEQ ID NO: 2193327 - RNA, 12 nt, Streptococcus pneumoniae R6
uucaaaucccau

SEQ ID NO: 2193328 - RNA, 18 nt, Streptococcus pneumoniae R6
uucaaauccgacuucaau

SEQ ID NO: 2193329 - RNA, 13 nt, Streptococcus pneumoniae R6
uucaaauccuuua

SEQ ID NO: 2193330 - RNA, 21 nt, Streptococcus pneumoniae R6
uucaaaguuccuaaaaccaaa

SEQ ID NO: 2193331 - RNA, 16 nt, Streptococcus pneumoniae R6
uucaaaguuucgaaaa

SEQ ID NO: 2193332 - RNA, 17 nt, Streptococcus pneumoniae R6
uucaaagcgauaaaaau

SEQ ID NO: 2193333 - RNA, 13 nt, Streptococcus pneumoniae R6
uucaaagccuucc

SEQ ID NO: 2193334 - RNA, 17 nt, Streptococcus pneumoniae R6
uucaaagauaucaucca

SEQ ID NO: 2193335 - RNA, 21 nt, Streptococcus pneumoniae R6
uucaaagcuacuuuuuuacca

SEQ ID NO: 2193336 - RNA, 19 nt, Streptococcus pneumoniae R6
uucaaagcgggauuuaaaa

SEQ ID NO: 2193337 - RNA, 12 nt, Streptococcus pneumoniae R6
uuauuuuauaga

SEQ ID NO: 2193338 - RNA, 16 nt, Streptococcus pneumoniae R6
uuauuuucuacucuuu

SEQ ID NO: 2193339 - RNA, 15 nt, Streptococcus pneumoniae R6
uucaaagacuucuug

SEQ ID NO: 2193340 - RNA, 21 nt, Streptococcus pneumoniae R6
uucaaagaguauuaaacaaaa

SEQ ID NO: 2193341 - RNA, 17 nt, Streptococcus pneumoniae R6
uucaacucuauuuuuga

SEQ ID NO: 2193342 - RNA, 20 nt, Streptococcus pneumoniae R6
uucaacugcuuuuucaauca

SEQ ID NO: 2193343 - RNA, 22 nt, Streptococcus pneumoniae R6
uucaacagcaccagcuuccgca

SEQ ID NO: 2193344 - RNA, 15 nt, Streptococcus pneumoniae R6
uucaaaugaauuucu

SEQ ID NO: 2193345 - RNA, 19 nt, Streptococcus pneumoniae R6
uucaaauuaauuucuagaa

SEQ ID NO: 2193346 - RNA, 22 nt, Streptococcus pneumoniae R6
uucaaauucuuuagaaaacuag

SEQ ID NO: 2193347 - RNA, 23 nt, Streptococcus pneumoniae R6
uuagggaaacaaaagucuucuaa

SEQ ID NO: 2193348 - RNA, 22 nt, Streptococcus pneumoniae R6
uuauuaucaaguucuuccacuc

SEQ ID NO: 2193349 - RNA, 14 nt, Streptococcus pneumoniae R6
uuauuauuuccuca

SEQ ID NO: 2193350 - RNA, 22 nt, Streptococcus pneumoniae R6
uuauuaugguauacgaaaaauc

SEQ ID NO: 2193351 - RNA, 14 nt, Streptococcus pneumoniae R6
uuauucagacuaua

SEQ ID NO: 2193352 - RNA, 16 nt, Streptococcus pneumoniae R6
uuauugguauuaauaa

SEQ ID NO: 2193353 - RNA, 14 nt, Streptococcus pneumoniae R6
uuauuguacuguau

SEQ ID NO: 2193354 - RNA, 23 nt, Streptococcus pneumoniae R6
uuauuucaaaucauaaagccagu

SEQ ID NO: 2193355 - RNA, 12 nt, Streptococcus pneumoniae R6
uuauuucauuug

SEQ ID NO: 2193356 - RNA, 20 nt, Streptococcus pneumoniae R6
uuauuuccuugaccaagucc

SEQ ID NO: 2193357 - RNA, 21 nt, Streptococcus pneumoniae R6
uuauuggcuacgacugcuucu

SEQ ID NO: 2193358 - RNA, 18 nt, Streptococcus pneumoniae R6
uucaaucucgcuguuuau

SEQ ID NO: 2193359 - RNA, 18 nt, Streptococcus pneumoniae R6
uucaauggaguaaaaaaa

SEQ ID NO: 2193360 - RNA, 21 nt, Streptococcus pneumoniae R6
uucaaggugaaguucacguaa

SEQ ID NO: 2193361 - RNA, 18 nt, Streptococcus pneumoniae R6
uucaagguuuuauacucu

SEQ ID NO: 2193362 - RNA, 15 nt, Streptococcus pneumoniae R6
uucaaggcauuuuuu

SEQ ID NO: 2193363 - RNA, 18 nt, Streptococcus pneumoniae R6
uucaaucuacuauagaaa

SEQ ID NO: 2193364 - RNA, 18 nt, Streptococcus pneumoniae R6
uucaaucguuucuggcag

SEQ ID NO: 2193365 - RNA, 22 nt, Streptococcus pneumoniae R6
uucaaguucugucuugcugucu

SEQ ID NO: 2193366 - RNA, 16 nt, Streptococcus pneumoniae R6
uucaagucuuccgaau

SEQ ID NO: 2193367 - RNA, 16 nt, Streptococcus pneumoniae R6
uucaagucuucugaau

SEQ ID NO: 2193368 - RNA, 19 nt, Streptococcus pneumoniae R6
uucaagucuucugaauagc

SEQ ID NO: 2193369 - RNA, 16 nt, Streptococcus pneumoniae R6
uucaagucuugugaau

SEQ ID NO: 2193370 - RNA, 23 nt, Streptococcus pneumoniae R6
uucaauugcaggagaaaaugaaa

SEQ ID NO: 2193371 - RNA, 17 nt, Streptococcus pneumoniae R6
uucaauuguuuauaaaa

SEQ ID NO: 2193372 - RNA, 20 nt, Streptococcus pneumoniae R6
uucaauucacuauaacuugu

SEQ ID NO: 2193373 - RNA, 21 nt, Streptococcus pneumoniae R6
uucaauuugauuaaaguucga

SEQ ID NO: 2193374 - RNA, 16 nt, Streptococcus pneumoniae R6
uucaauuuuauacuca

SEQ ID NO: 2193375 - RNA, 16 nt, Streptococcus pneumoniae R6
uucacaaaauccuuug

SEQ ID NO: 2193376 - RNA, 15 nt, Streptococcus pneumoniae R6
uucacacaagaguuc

SEQ ID NO: 2193377 - RNA, 14 nt, Streptococcus pneumoniae R6
uucacaaucaaaaa

SEQ ID NO: 2193378 - RNA, 15 nt, Streptococcus pneumoniae R6
uucacaaauucuggc

SEQ ID NO: 2193379 - RNA, 19 nt, Streptococcus pneumoniae R6
uucacaacaucuucuguac

SEQ ID NO: 2193380 - RNA, 17 nt, Streptococcus pneumoniae R6
uucagaacuuuuaacuu

SEQ ID NO: 2193381 - RNA, 14 nt, Streptococcus pneumoniae R6
uucagauucacuag

SEQ ID NO: 2193382 - RNA, 15 nt, Streptococcus pneumoniae R6
uucagauucagucua

SEQ ID NO: 2193383 - RNA, 17 nt, Streptococcus pneumoniae R6
uucagauuguccucaau

SEQ ID NO: 2193384 - RNA, 22 nt, Streptococcus pneumoniae R6
uucacuuucccuuuccaagaau

SEQ ID NO: 2193385 - RNA, 20 nt, Streptococcus pneumoniae R6
uucaccaguaaaguguucug

SEQ ID NO: 2193386 - RNA, 22 nt, Streptococcus pneumoniae R6
uucacgcgcauucguuucuuua

SEQ ID NO: 2193387 - RNA, 19 nt, Streptococcus pneumoniae R6
uucacugagaucuucuucu

SEQ ID NO: 2193388 - RNA, 15 nt, Streptococcus pneumoniae R6
uucaucauuuuauuc

SEQ ID NO: 2193389 - RNA, 16 nt, Streptococcus pneumoniae R6
uucaucauaucaguga

SEQ ID NO: 2193390 - RNA, 21 nt, Streptococcus pneumoniae R6
uucaucaccacaccgauaucu

SEQ ID NO: 2193391 - RNA, 20 nt, Streptococcus pneumoniae R6
uucaucagguuaaaggaaac

SEQ ID NO: 2193392 - RNA, 15 nt, Streptococcus pneumoniae R6
uucauccacaaccuc

SEQ ID NO: 2193393 - RNA, 18 nt, Streptococcus pneumoniae R6
uucauauguaaacaguaa

SEQ ID NO: 2193394 - RNA, 17 nt, Streptococcus pneumoniae R6
uucauaucuuauuucaa

SEQ ID NO: 2193395 - RNA, 18 nt, Streptococcus pneumoniae R6
uucauaucuuauuucaau

SEQ ID NO: 2193396 - RNA, 14 nt, Streptococcus pneumoniae R6
uucauauccccaga

SEQ ID NO: 2193397 - RNA, 15 nt, Streptococcus pneumoniae R6
uucaucaagagacag

SEQ ID NO: 2193398 - RNA, 18 nt, Streptococcus pneumoniae R6
uucaucaagagacagaaa

SEQ ID NO: 2193399 - RNA, 20 nt, Streptococcus pneumoniae R6
uucauaccagaagccuuguu

SEQ ID NO: 2193400 - RNA, 21 nt, Streptococcus pneumoniae R6
uucauaccagaagccuuguuu

SEQ ID NO: 2193401 - RNA, 15 nt, Streptococcus pneumoniae R6
uucauagcacuauug

SEQ ID NO: 2193402 - RNA, 15 nt, Streptococcus pneumoniae R6
uucauagcagcaauu

SEQ ID NO: 2193403 - RNA, 17 nt, Streptococcus pneumoniae R6
uucauauaauaaauugu

SEQ ID NO: 2193404 - RNA, 20 nt, Streptococcus pneumoniae R6
uucagcgaccaucauuuuug

SEQ ID NO: 2193405 - RNA, 14 nt, Streptococcus pneumoniae R6
uucagcguuuucua

SEQ ID NO: 2193406 - RNA, 18 nt, Streptococcus pneumoniae R6
uucagcuaaaauguuuuu

SEQ ID NO: 2193407 - RNA, 22 nt, Streptococcus pneumoniae R6
uucagguggguuuucuguuuau

SEQ ID NO: 2193408 - RNA, 19 nt, Streptococcus pneumoniae R6
uucaguaauaucuccagau

SEQ ID NO: 2193409 - RNA, 19 nt, Streptococcus pneumoniae R6
uucauaaagagaaggagga

SEQ ID NO: 2193410 - RNA, 20 nt, Streptococcus pneumoniae R6
uucauaagguaccuccuaau

SEQ ID NO: 2193411 - RNA, 13 nt, Streptococcus pneumoniae R6
uucauaacuucac

SEQ ID NO: 2193412 - RNA, 16 nt, Streptococcus pneumoniae R6
uucaguuuacuauacu

SEQ ID NO: 2193413 - RNA, 13 nt, Streptococcus pneumoniae R6
uucaguuucuauu

SEQ ID NO: 2193414 - RNA, 15 nt, Streptococcus pneumoniae R6
uucaguuucauaauc

SEQ ID NO: 2193415 - RNA, 16 nt, Streptococcus pneumoniae R6
uucaguuucauaauca

SEQ ID NO: 2193416 - RNA, 23 nt, Streptococcus pneumoniae R6
uucaguugccucagauucugaca

SEQ ID NO: 2193417 - RNA, 15 nt, Streptococcus pneumoniae R6
uucaucuacaaccuc

SEQ ID NO: 2193418 - RNA, 18 nt, Streptococcus pneumoniae R6
uucaucuacaaccucaaa

SEQ ID NO: 2193419 - RNA, 19 nt, Streptococcus pneumoniae R6
uucaucuacaaccucaaaa

SEQ ID NO: 2193420 - RNA, 13 nt, Streptococcus pneumoniae R6
uucaucuuaucaa

SEQ ID NO: 2193421 - RNA, 19 nt, Streptococcus pneumoniae R6
uucaucuucaaaaucaaag

SEQ ID NO: 2193422 - RNA, 20 nt, Streptococcus pneumoniae R6
uucaucuggauuuucagccu

SEQ ID NO: 2193423 - RNA, 16 nt, Streptococcus pneumoniae R6
uucaucucucuauaau

SEQ ID NO: 2193424 - RNA, 14 nt, Streptococcus pneumoniae R6
uucaugaaauuauu

SEQ ID NO: 2193425 - RNA, 20 nt, Streptococcus pneumoniae R6
uucauguggcuaucugucac

SEQ ID NO: 2193426 - RNA, 19 nt, Streptococcus pneumoniae R6
uucauguuuuccuaauucu

SEQ ID NO: 2193427 - RNA, 18 nt, Streptococcus pneumoniae R6
uucauuacagaacauuuu

SEQ ID NO: 2193428 - RNA, 24 nt, Streptococcus pneumoniae R6
uucauuaaauggaauaguaucuga

SEQ ID NO: 2193429 - RNA, 19 nt, Streptococcus pneumoniae R6
uucaugauugauaauacca

SEQ ID NO: 2193430 - RNA, 20 nt, Streptococcus pneumoniae R6
uucaugcuugccugaacgcu

SEQ ID NO: 2193431 - RNA, 13 nt, Streptococcus pneumoniae R6
uucauggaugcaa

SEQ ID NO: 2193432 - RNA, 15 nt, Streptococcus pneumoniae R6
uucauggaugcaauu

SEQ ID NO: 2193433 - RNA, 22 nt, Streptococcus pneumoniae R6
uucauggcaaauucaccaauuu

SEQ ID NO: 2193434 - RNA, 22 nt, Streptococcus pneumoniae R6
uucauggcauggaaagcaucuc

SEQ ID NO: 2193435 - RNA, 15 nt, Streptococcus pneumoniae R6
uucauuuuacaucug

SEQ ID NO: 2193436 - RNA, 13 nt, Streptococcus pneumoniae R6
uucauuuuacuau

SEQ ID NO: 2193437 - RNA, 16 nt, Streptococcus pneumoniae R6
uucauuuuacuauaaa

SEQ ID NO: 2193438 - RNA, 18 nt, Streptococcus pneumoniae R6
uucauuuuaauauauaaa

SEQ ID NO: 2193439 - RNA, 20 nt, Streptococcus pneumoniae R6
uucauuuuaauauauaaaaa

SEQ ID NO: 2193440 - RNA, 15 nt, Streptococcus pneumoniae R6
uucauuuucuuuacu

SEQ ID NO: 2193441 - RNA, 17 nt, Streptococcus pneumoniae R6
uucauuuucuacuaaaa

SEQ ID NO: 2193442 - RNA, 17 nt, Streptococcus pneumoniae R6
uuccaaaacgguugagc

SEQ ID NO: 2193443 - RNA, 20 nt, Streptococcus pneumoniae R6
uuccaaaaggcaucuuguca

SEQ ID NO: 2193444 - RNA, 19 nt, Streptococcus pneumoniae R6
uucauuuuugccuaaaauu

SEQ ID NO: 2193445 - RNA, 12 nt, Streptococcus pneumoniae R6
uucauuuuuccu

SEQ ID NO: 2193446 - RNA, 13 nt, Streptococcus pneumoniae R6
uucauuuuuccuu

SEQ ID NO: 2193447 - RNA, 17 nt, Streptococcus pneumoniae R6
uucauuuuuccuuccca

SEQ ID NO: 2193448 - RNA, 14 nt, Streptococcus pneumoniae R6
uuccaaauuagaaa

SEQ ID NO: 2193449 - RNA, 12 nt, Streptococcus pneumoniae R6
uuccaaagaagu

SEQ ID NO: 2193450 - RNA, 18 nt, Streptococcus pneumoniae R6
uuccaaaauuaaaauguu

SEQ ID NO: 2193451 - RNA, 14 nt, Streptococcus pneumoniae R6
uuccaacauuguuu

SEQ ID NO: 2193452 - RNA, 12 nt, Streptococcus pneumoniae R6
uuccaaggaaag

SEQ ID NO: 2193453 - RNA, 14 nt, Streptococcus pneumoniae R6
uucauuauuucuua

SEQ ID NO: 2193454 - RNA, 16 nt, Streptococcus pneumoniae R6
uucauuccaugaaaau

SEQ ID NO: 2193455 - RNA, 14 nt, Streptococcus pneumoniae R6
uucauucuacuaua

SEQ ID NO: 2193456 - RNA, 22 nt, Streptococcus pneumoniae R6
uucauuuggucaaaaucauacu

SEQ ID NO: 2193457 - RNA, 21 nt, Streptococcus pneumoniae R6
uucauuucgacugaaaauauu

SEQ ID NO: 2193458 - RNA, 15 nt, Streptococcus pneumoniae R6
uuccugagaugacaa

SEQ ID NO: 2193459 - RNA, 17 nt, Streptococcus pneumoniae R6
uuccugagaugacaaca

SEQ ID NO: 2193460 - RNA, 14 nt, Streptococcus pneumoniae R6
uuccucuuuuuccc

SEQ ID NO: 2193461 - RNA, 18 nt, Streptococcus pneumoniae R6
uuccugaaauaaaaugcu

SEQ ID NO: 2193462 - RNA, 23 nt, Streptococcus pneumoniae R6
uuccucugguagcaacuaucuga

SEQ ID NO: 2193463 - RNA, 19 nt, Streptococcus pneumoniae R6
uuccugaagucgaguuuuu

SEQ ID NO: 2193464 - RNA, 19 nt, Streptococcus pneumoniae R6
uuccuaaucgauuuguuca

SEQ ID NO: 2193465 - RNA, 17 nt, Streptococcus pneumoniae R6
uuccuaaaacaguuaca

SEQ ID NO: 2193466 - RNA, 20 nt, Streptococcus pneumoniae R6
uuccuaaacagaauuggcua

SEQ ID NO: 2193467 - RNA, 17 nt, Streptococcus pneumoniae R6
uuccguuugagaagaac

SEQ ID NO: 2193468 - RNA, 16 nt, Streptococcus pneumoniae R6
uuccuugaccaagucc

SEQ ID NO: 2193469 - RNA, 22 nt, Streptococcus pneumoniae R6
uucgaagaguauaaaaucaaau

SEQ ID NO: 2193470 - RNA, 13 nt, Streptococcus pneumoniae R6
uucgaagauaucu

SEQ ID NO: 2193471 - RNA, 15 nt, Streptococcus pneumoniae R6
uucgaagauaucucu

SEQ ID NO: 2193472 - RNA, 15 nt, Streptococcus pneumoniae R6
uuccuuauucugaaa

SEQ ID NO: 2193473 - RNA, 16 nt, Streptococcus pneumoniae R6
uucgaaugauuucucu

SEQ ID NO: 2193474 - RNA, 20 nt, Streptococcus pneumoniae R6
uucgacauuuggauagucca

SEQ ID NO: 2193475 - RNA, 16 nt, Streptococcus pneumoniae R6
uucccuacaaauacca

SEQ ID NO: 2193476 - RNA, 17 nt, Streptococcus pneumoniae R6
uuccaauagucauucca

SEQ ID NO: 2193477 - RNA, 21 nt, Streptococcus pneumoniae R6
uucccuugcuagucauaacug

SEQ ID NO: 2193478 - RNA, 15 nt, Streptococcus pneumoniae R6
uucccugcauuucuu

SEQ ID NO: 2193479 - RNA, 15 nt, Streptococcus pneumoniae R6
uucgauuuaaugaua

SEQ ID NO: 2193480 - RNA, 19 nt, Streptococcus pneumoniae R6
uucgccauagaauuuugga

SEQ ID NO: 2193481 - RNA, 17 nt, Streptococcus pneumoniae R6
uucgacugaaaauauuu

SEQ ID NO: 2193482 - RNA, 19 nt, Streptococcus pneumoniae R6
uucgaugucaccaaacaaa

SEQ ID NO: 2193483 - RNA, 13 nt, Streptococcus pneumoniae R6
uucgugaaagaca

SEQ ID NO: 2193484 - RNA, 17 nt, Streptococcus pneumoniae R6
uucgucuuccauuucuu

SEQ ID NO: 2193485 - RNA, 17 nt, Streptococcus pneumoniae R6
uucgucguaaccuucuu

SEQ ID NO: 2193486 - RNA, 19 nt, Streptococcus pneumoniae R6
uucgucguaaccuucuucu

SEQ ID NO: 2193487 - RNA, 21 nt, Streptococcus pneumoniae R6
uucggcuguuuuugaugugga

SEQ ID NO: 2193488 - RNA, 17 nt, Streptococcus pneumoniae R6
uucggcuguucuuuuuu

SEQ ID NO: 2193489 - RNA, 14 nt, Streptococcus pneumoniae R6
uucggauuuuaaaa

SEQ ID NO: 2193490 - RNA, 23 nt, Streptococcus pneumoniae R6
uucggauaaguuuuguuugucag

SEQ ID NO: 2193491 - RNA, 16 nt, Streptococcus pneumoniae R6
uucugugauauaaucu

SEQ ID NO: 2193492 - RNA, 18 nt, Streptococcus pneumoniae R6
uucugugcuuuuucaaug

SEQ ID NO: 2193493 - RNA, 21 nt, Streptococcus pneumoniae R6
uucuguacugccccccaaaag

SEQ ID NO: 2193494 - RNA, 17 nt, Streptococcus pneumoniae R6
uucuguacuuagccaag

SEQ ID NO: 2193495 - RNA, 14 nt, Streptococcus pneumoniae R6
uucuguaauuucua

SEQ ID NO: 2193496 - RNA, 14 nt, Streptococcus pneumoniae R6
uucuggcucuuugu

SEQ ID NO: 2193497 - RNA, 17 nt, Streptococcus pneumoniae R6
uucuggucuagcuauuu

SEQ ID NO: 2193498 - RNA, 20 nt, Streptococcus pneumoniae R6
uucuggucuagcuauuucuu

SEQ ID NO: 2193499 - RNA, 17 nt, Streptococcus pneumoniae R6
uucuggucugauuuuca

SEQ ID NO: 2193500 - RNA, 21 nt, Streptococcus pneumoniae R6
uucuuaaaauugguuuaaaua

SEQ ID NO: 2193501 - RNA, 12 nt, Streptococcus pneumoniae R6
uucuuaauagcu

SEQ ID NO: 2193502 - RNA, 23 nt, Streptococcus pneumoniae R6
uucuuaaguuaaauuauuaaaau

SEQ ID NO: 2193503 - RNA, 18 nt, Streptococcus pneumoniae R6
uucuuaccaucuagccau

SEQ ID NO: 2193504 - RNA, 14 nt, Streptococcus pneumoniae R6
uucuuauccagaaa

SEQ ID NO: 2193505 - RNA, 20 nt, Streptococcus pneumoniae R6
uucuuaucucgaacguuguu

SEQ ID NO: 2193506 - RNA, 15 nt, Streptococcus pneumoniae R6
uucuuauacaaauaa

SEQ ID NO: 2193507 - RNA, 18 nt, Streptococcus pneumoniae R6
uucuuauacaaauaaacg

SEQ ID NO: 2193508 - RNA, 18 nt, Streptococcus pneumoniae R6
uucuuauauuaaaaaaag

SEQ ID NO: 2193509 - RNA, 14 nt, Streptococcus pneumoniae R6
uucuuagcaauucu

SEQ ID NO: 2193510 - RNA, 21 nt, Streptococcus pneumoniae R6
uucuuagcaauucuaaaaaca

SEQ ID NO: 2193511 - RNA, 21 nt, Streptococcus pneumoniae R6
uucuuagugaguuuuacaaug

SEQ ID NO: 2193512 - RNA, 17 nt, Streptococcus pneumoniae R6
uucuuagaaaucgauuu

SEQ ID NO: 2193513 - RNA, 16 nt, Streptococcus pneumoniae R6
uucuuauuucaaaaaa

SEQ ID NO: 2193514 - RNA, 20 nt, Streptococcus pneumoniae R6
uucuuauuucauuuuacuau

SEQ ID NO: 2193515 - RNA, 15 nt, Streptococcus pneumoniae R6
uucuucacauccucu

SEQ ID NO: 2193516 - RNA, 13 nt, Streptococcus pneumoniae R6
uucuucacaaccu

SEQ ID NO: 2193517 - RNA, 19 nt, Streptococcus pneumoniae R6
uucuucauacauuucgaua

SEQ ID NO: 2193518 - RNA, 15 nt, Streptococcus pneumoniae R6
uucuucauagaguug

SEQ ID NO: 2193519 - RNA, 21 nt, Streptococcus pneumoniae R6
uucuucaggauugauaaaauu

SEQ ID NO: 2193520 - RNA, 23 nt, Streptococcus pneumoniae R6
uucuuccacucaaaucauuucuu

SEQ ID NO: 2193521 - RNA, 19 nt, Streptococcus pneumoniae R6
uucuucguaagauucuucu

SEQ ID NO: 2193522 - RNA, 20 nt, Streptococcus pneumoniae R6
uucuucgucaccgauugcca

SEQ ID NO: 2193523 - RNA, 15 nt, Streptococcus pneumoniae R6
uucuucucuuuucuu

SEQ ID NO: 2193524 - RNA, 19 nt, Streptococcus pneumoniae R6
uucuucuccgugaacaagu

SEQ ID NO: 2193525 - RNA, 20 nt, Streptococcus pneumoniae R6
uucuucuucgucaaauccau

SEQ ID NO: 2193526 - RNA, 14 nt, Streptococcus pneumoniae R6
uucuucuuggucug

SEQ ID NO: 2193527 - RNA, 17 nt, Streptococcus pneumoniae R6
uucuucuuuauaauauu

SEQ ID NO: 2193528 - RNA, 19 nt, Streptococcus pneumoniae R6
uucuucuuuauaauauuua

SEQ ID NO: 2193529 - RNA, 14 nt, Streptococcus pneumoniae R6
uucuucuuucacuu

SEQ ID NO: 2193530 - RNA, 18 nt, Streptococcus pneumoniae R6
uucuuccgacaauacagu

SEQ ID NO: 2193531 - RNA, 14 nt, Streptococcus pneumoniae R6
uucuccgaagucaa

SEQ ID NO: 2193532 - RNA, 21 nt, Streptococcus pneumoniae R6
uucuccuacuugcuucccauu

SEQ ID NO: 2193533 - RNA, 13 nt, Streptococcus pneumoniae R6
uucuccgcuucca

SEQ ID NO: 2193534 - RNA, 22 nt, Streptococcus pneumoniae R6
uucuccgcuuccagagcucuuu

SEQ ID NO: 2193535 - RNA, 17 nt, Streptococcus pneumoniae R6
uucuccuaaagaaaaag

SEQ ID NO: 2193536 - RNA, 15 nt, Streptococcus pneumoniae R6
uucugaaauaacuca

SEQ ID NO: 2193537 - RNA, 22 nt, Streptococcus pneumoniae R6
uucugaaauaacucauaauagu

SEQ ID NO: 2193538 - RNA, 21 nt, Streptococcus pneumoniae R6
uucugaauagcuuaaaaucuu

SEQ ID NO: 2193539 - RNA, 19 nt, Streptococcus pneumoniae R6
uucugaagcaucaaauccu

SEQ ID NO: 2193540 - RNA, 16 nt, Streptococcus pneumoniae R6
uucugaaagugaaaca

SEQ ID NO: 2193541 - RNA, 18 nt, Streptococcus pneumoniae R6
uucugaaagugaaacagc

SEQ ID NO: 2193542 - RNA, 20 nt, Streptococcus pneumoniae R6
uucugaaaagacguauucag

SEQ ID NO: 2193543 - RNA, 15 nt, Streptococcus pneumoniae R6
uucugcugucagcaa

SEQ ID NO: 2193544 - RNA, 18 nt, Streptococcus pneumoniae R6
uucugagucugugauuga

SEQ ID NO: 2193545 - RNA, 13 nt, Streptococcus pneumoniae R6
uucugcuucuaaa

SEQ ID NO: 2193546 - RNA, 14 nt, Streptococcus pneumoniae R6
uucugcuucuaaaa

SEQ ID NO: 2193547 - RNA, 14 nt, Streptococcus pneumoniae R6
uucugcuucuaaau

SEQ ID NO: 2193548 - RNA, 18 nt, Streptococcus pneumoniae R6
uucuggaagugaaacagc

SEQ ID NO: 2193549 - RNA, 14 nt, Streptococcus pneumoniae R6
uucuggaaguucga

SEQ ID NO: 2193550 - RNA, 17 nt, Streptococcus pneumoniae R6
uucuggcagauuuugaa

SEQ ID NO: 2193551 - RNA, 20 nt, Streptococcus pneumoniae R6
uucuggcaggucgguuuuau

SEQ ID NO: 2193552 - RNA, 23 nt, Streptococcus pneumoniae R6
uucuaucaacucaagaauuauuu

SEQ ID NO: 2193553 - RNA, 13 nt, Streptococcus pneumoniae R6
uucuauauuuaua

SEQ ID NO: 2193554 - RNA, 17 nt, Streptococcus pneumoniae R6
uucuauccacaaccuca

SEQ ID NO: 2193555 - RNA, 18 nt, Streptococcus pneumoniae R6
uucuaugauaaaaggcau

SEQ ID NO: 2193556 - RNA, 17 nt, Streptococcus pneumoniae R6
uucuaucugcaaccuca

SEQ ID NO: 2193557 - RNA, 19 nt, Streptococcus pneumoniae R6
uucuaucugcaaccucaaa

SEQ ID NO: 2193558 - RNA, 13 nt, Streptococcus pneumoniae R6
uucuccaaagaua

SEQ ID NO: 2193559 - RNA, 13 nt, Streptococcus pneumoniae R6
uucuccaauaagc

SEQ ID NO: 2193560 - RNA, 20 nt, Streptococcus pneumoniae R6
uucuccaaucaaauugugca

SEQ ID NO: 2193561 - RNA, 18 nt, Streptococcus pneumoniae R6
uucucaaccacaaaaaag

SEQ ID NO: 2193562 - RNA, 13 nt, Streptococcus pneumoniae R6
uucucaaagcguu

SEQ ID NO: 2193563 - RNA, 17 nt, Streptococcus pneumoniae R6
uucucaaacauugugag

SEQ ID NO: 2193564 - RNA, 15 nt, Streptococcus pneumoniae R6
uucucaucuauuuuu

SEQ ID NO: 2193565 - RNA, 23 nt, Streptococcus pneumoniae R6
uucucaucuauuuuuacucaagg

SEQ ID NO: 2193566 - RNA, 23 nt, Streptococcus pneumoniae R6
uucucaauagcacgcgcaacgcc

SEQ ID NO: 2193567 - RNA, 15 nt, Streptococcus pneumoniae R6
uucuaaaacuccuau

SEQ ID NO: 2193568 - RNA, 13 nt, Streptococcus pneumoniae R6
uucuaaaacauug

SEQ ID NO: 2193569 - RNA, 17 nt, Streptococcus pneumoniae R6
uucuaaaacauugugag

SEQ ID NO: 2193570 - RNA, 16 nt, Streptococcus pneumoniae R6
uucuaaaacauuguua

SEQ ID NO: 2193571 - RNA, 16 nt, Streptococcus pneumoniae R6
uucuaaaauaaguucu

SEQ ID NO: 2193572 - RNA, 19 nt, Streptococcus pneumoniae R6
uucuaaaaucugauuccuu

SEQ ID NO: 2193573 - RNA, 15 nt, Streptococcus pneumoniae R6
uucguuuuuacuaca

SEQ ID NO: 2193574 - RNA, 21 nt, Streptococcus pneumoniae R6
uucuagccccucggauuuuau

SEQ ID NO: 2193575 - RNA, 17 nt, Streptococcus pneumoniae R6
uucuauaggauuuauuu

SEQ ID NO: 2193576 - RNA, 19 nt, Streptococcus pneumoniae R6
uucuauaguagauugaaau

SEQ ID NO: 2193577 - RNA, 23 nt, Streptococcus pneumoniae R6
uucuauagaaagcuuacaucauc

SEQ ID NO: 2193578 - RNA, 23 nt, Streptococcus pneumoniae R6
uucuagaguccaagauucaacau

SEQ ID NO: 2193579 - RNA, 16 nt, Streptococcus pneumoniae R6
uucuagaaacacacga

SEQ ID NO: 2193580 - RNA, 16 nt, Streptococcus pneumoniae R6
uucuacuucuaaaaca

SEQ ID NO: 2193581 - RNA, 12 nt, Streptococcus pneumoniae R6
uucuacuuuuuc

SEQ ID NO: 2193582 - RNA, 18 nt, Streptococcus pneumoniae R6
uucuacuugccgauuauc

SEQ ID NO: 2193583 - RNA, 15 nt, Streptococcus pneumoniae R6
uucuacucuguuuuc

SEQ ID NO: 2193584 - RNA, 15 nt, Streptococcus pneumoniae R6
uucuacuccaagcaa

SEQ ID NO: 2193585 - RNA, 14 nt, Streptococcus pneumoniae R6
uucuacugaaauug

SEQ ID NO: 2193586 - RNA, 13 nt, Streptococcus pneumoniae R6
uucuaaagaauuu

SEQ ID NO: 2193587 - RNA, 21 nt, Streptococcus pneumoniae R6
uucuaaagaauuugaaaaaaa

SEQ ID NO: 2193588 - RNA, 22 nt, Streptococcus pneumoniae R6
uugugcaguuuucauucuacua

SEQ ID NO: 2193589 - RNA, 16 nt, Streptococcus pneumoniae R6
uugugauuuuaaauuu

SEQ ID NO: 2193590 - RNA, 20 nt, Streptococcus pneumoniae R6
uugugauuuuaaauuuacuu

SEQ ID NO: 2193591 - RNA, 16 nt, Streptococcus pneumoniae R6
uugugcugacauugaa

SEQ ID NO: 2193592 - RNA, 22 nt, Streptococcus pneumoniae R6
uugugaggaccagguuuuucac

SEQ ID NO: 2193593 - RNA, 14 nt, Streptococcus pneumoniae R6
uugugaauacaaaa

SEQ ID NO: 2193594 - RNA, 11 nt, Streptococcus pneumoniae R6
uugucuucaaa

SEQ ID NO: 2193595 - RNA, 23 nt, Streptococcus pneumoniae R6
uugucuucugcggauaaaaccug

SEQ ID NO: 2193596 - RNA, 19 nt, Streptococcus pneumoniae R6
uugugaaagcucuucuaaa

SEQ ID NO: 2193597 - RNA, 18 nt, Streptococcus pneumoniae R6
uugucuuugauuuacuau

SEQ ID NO: 2193598 - RNA, 22 nt, Streptococcus pneumoniae R6
uugucuagauucgaucugauau

SEQ ID NO: 2193599 - RNA, 16 nt, Streptococcus pneumoniae R6
uugucgucauaccagu

SEQ ID NO: 2193600 - RNA, 20 nt, Streptococcus pneumoniae R6
uugucgucauaccaguuuuu

SEQ ID NO: 2193601 - RNA, 14 nt, Streptococcus pneumoniae R6
uugucuaacuuuuu

SEQ ID NO: 2193602 - RNA, 16 nt, Streptococcus pneumoniae R6
uugucuaagcgaaaca

SEQ ID NO: 2193603 - RNA, 14 nt, Streptococcus pneumoniae R6
uugucuaaaaauag

SEQ ID NO: 2193604 - RNA, 18 nt, Streptococcus pneumoniae R6
uugucuaaaaauuuaaaa

SEQ ID NO: 2193605 - RNA, 12 nt, Streptococcus pneumoniae R6
uugucuaaaauu

SEQ ID NO: 2193606 - RNA, 22 nt, Streptococcus pneumoniae R6
uuguguuccgaagaguucaaua

SEQ ID NO: 2193607 - RNA, 18 nt, Streptococcus pneumoniae R6
uugugugaaauuugugau

SEQ ID NO: 2193608 - RNA, 19 nt, Streptococcus pneumoniae R6
uuguguacucaacagaaga

SEQ ID NO: 2193609 - RNA, 13 nt, Streptococcus pneumoniae R6
uuguguuugacca

SEQ ID NO: 2193610 - RNA, 14 nt, Streptococcus pneumoniae R6
uuguuccuaaaaca

SEQ ID NO: 2193611 - RNA, 21 nt, Streptococcus pneumoniae R6
uuguucagguguuucuggucu

SEQ ID NO: 2193612 - RNA, 23 nt, Streptococcus pneumoniae R6
uuuaaaaauccacuugggaaacc

SEQ ID NO: 2193613 - RNA, 13 nt, Streptococcus pneumoniae R6
uuuaaaaaguuuu

SEQ ID NO: 2193614 - RNA, 21 nt, Streptococcus pneumoniae R6
uuguugaaacggcauaaaauc

SEQ ID NO: 2193615 - RNA, 23 nt, Streptococcus pneumoniae R6
uuguugaaaauauuuuaaacguu

SEQ ID NO: 2193616 - RNA, 19 nt, Streptococcus pneumoniae R6
uuguaaagaguacagucuu

SEQ ID NO: 2193617 - RNA, 21 nt, Streptococcus pneumoniae R6
uuguaaaggaugacaauagcu

SEQ ID NO: 2193618 - RNA, 23 nt, Streptococcus pneumoniae R6
uuguaaagcgaaaggagaaaaaa

SEQ ID NO: 2193619 - RNA, 14 nt, Streptococcus pneumoniae R6
uuguaaaaaaggac

SEQ ID NO: 2193620 - RNA, 18 nt, Streptococcus pneumoniae R6
uuguaaccgauauuuccu

SEQ ID NO: 2193621 - RNA, 19 nt, Streptococcus pneumoniae R6
uuguaaccgauauuuccug

SEQ ID NO: 2193622 - RNA, 15 nt, Streptococcus pneumoniae R6
uuguaagucugcuuu

SEQ ID NO: 2193623 - RNA, 17 nt, Streptococcus pneumoniae R6
uuguaaucuaggaaaac

SEQ ID NO: 2193624 - RNA, 15 nt, Streptococcus pneumoniae R6
uuguaguaaaagaau

SEQ ID NO: 2193625 - RNA, 17 nt, Streptococcus pneumoniae R6
uuguaggcuuucaacug

SEQ ID NO: 2193626 - RNA, 22 nt, Streptococcus pneumoniae R6
uuguagucugcugccaauugcu

SEQ ID NO: 2193627 - RNA, 18 nt, Streptococcus pneumoniae R6
uuguagauggaacugacg

SEQ ID NO: 2193628 - RNA, 16 nt, Streptococcus pneumoniae R6
uuguagauguucuuug

SEQ ID NO: 2193629 - RNA, 14 nt, Streptococcus pneumoniae R6
uuguacuuguucua

SEQ ID NO: 2193630 - RNA, 12 nt, Streptococcus pneumoniae R6
uugucacacaaa

SEQ ID NO: 2193631 - RNA, 17 nt, Streptococcus pneumoniae R6
uugucacacaaaaaaga

SEQ ID NO: 2193632 - RNA, 10 nt, Streptococcus pneumoniae R6
uugucaacug

SEQ ID NO: 2193633 - RNA, 18 nt, Streptococcus pneumoniae R6
uugucaaacaagaccuca

SEQ ID NO: 2193634 - RNA, 15 nt, Streptococcus pneumoniae R6
uugucaaacaucaug

SEQ ID NO: 2193635 - RNA, 23 nt, Streptococcus pneumoniae R6
uugucaaauuacgaugcuuuucu

SEQ ID NO: 2193636 - RNA, 18 nt, Streptococcus pneumoniae R6
uuguauacguuuuuacua

SEQ ID NO: 2193637 - RNA, 19 nt, Streptococcus pneumoniae R6
uuguauagugaauugaaau

SEQ ID NO: 2193638 - RNA, 20 nt, Streptococcus pneumoniae R6
uuguaugaaaaguuuuagcu

SEQ ID NO: 2193639 - RNA, 19 nt, Streptococcus pneumoniae R6
uuguccucaaugaauccga

SEQ ID NO: 2193640 - RNA, 22 nt, Streptococcus pneumoniae R6
uuguccugaaugauuucuucuu

SEQ ID NO: 2193641 - RNA, 15 nt, Streptococcus pneumoniae R6
uugucccuuuuucac

SEQ ID NO: 2193642 - RNA, 20 nt, Streptococcus pneumoniae R6
uugucaucguuuucucguuu

SEQ ID NO: 2193643 - RNA, 24 nt, Streptococcus pneumoniae R6
uugucauccuuacggucaaaguca

SEQ ID NO: 2193644 - RNA, 22 nt, Streptococcus pneumoniae R6
uugucaugucauguuagaaaaa

SEQ ID NO: 2193645 - RNA, 17 nt, Streptococcus pneumoniae R6
uugucccaucauuccuu

SEQ ID NO: 2193646 - RNA, 23 nt, Streptococcus pneumoniae R6
uugucccaucauuccuucaaggg

SEQ ID NO: 2193647 - RNA, 21 nt, Streptococcus pneumoniae R6
uuuaagguugcagauagaacu

SEQ ID NO: 2193648 - RNA, 19 nt, Streptococcus pneumoniae R6
uuuaagacuuguuagcuga

SEQ ID NO: 2193649 - RNA, 11 nt, Streptococcus pneumoniae R6
uuuaacuuuuu

SEQ ID NO: 2193650 - RNA, 20 nt, Streptococcus pneumoniae R6
uuuaacuuuuuugagaaauu

SEQ ID NO: 2193651 - RNA, 19 nt, Streptococcus pneumoniae R6
uuuaaaacucauuaauaaa

SEQ ID NO: 2193652 - RNA, 20 nt, Streptococcus pneumoniae R6
uuuaaaaauuuuuuucuaau

SEQ ID NO: 2193653 - RNA, 21 nt, Streptococcus pneumoniae R6
uuuaaaaauuuuuuucuaauu

SEQ ID NO: 2193654 - RNA, 22 nt, Streptococcus pneumoniae R6
uuuaauaauuuuguuaagacac

SEQ ID NO: 2193655 - RNA, 16 nt, Streptococcus pneumoniae R6
uuuaauauauaaaaaa

SEQ ID NO: 2193656 - RNA, 15 nt, Streptococcus pneumoniae R6
uuuaauauacuugau

SEQ ID NO: 2193657 - RNA, 18 nt, Streptococcus pneumoniae R6
uuuaauacucugugaaaa

SEQ ID NO: 2193658 - RNA, 17 nt, Streptococcus pneumoniae R6
uuuaaucauguuuuuaa

SEQ ID NO: 2193659 - RNA, 23 nt, Streptococcus pneumoniae R6
uuuaauccaaaguaaaauacaaa

SEQ ID NO: 2193660 - RNA, 22 nt, Streptococcus pneumoniae R6
uuuaaucuugacuauauuucuu

SEQ ID NO: 2193661 - RNA, 17 nt, Streptococcus pneumoniae R6
uuuaaugcuaauuuaga

SEQ ID NO: 2193662 - RNA, 22 nt, Streptococcus pneumoniae R6
uuuaaugcuaauuuagaaauag

SEQ ID NO: 2193663 - RNA, 20 nt, Streptococcus pneumoniae R6
uuuagaaagguaaaauauag

SEQ ID NO: 2193664 - RNA, 22 nt, Streptococcus pneumoniae R6
uuuagaaggauaaauuuuauug

SEQ ID NO: 2193665 - RNA, 21 nt, Streptococcus pneumoniae R6
uuuagaaguagagguguacua

SEQ ID NO: 2193666 - RNA, 20 nt, Streptococcus pneumoniae R6
uuuacuuuuuuucuucugaa

SEQ ID NO: 2193667 - RNA, 13 nt, Streptococcus pneumoniae R6
uuuacuuuccuga

SEQ ID NO: 2193668 - RNA, 16 nt, Streptococcus pneumoniae R6
uuuacuaguucucaaa

SEQ ID NO: 2193669 - RNA, 15 nt, Streptococcus pneumoniae R6
uuuacuauaaaauaa

SEQ ID NO: 2193670 - RNA, 23 nt, Streptococcus pneumoniae R6
uuuacuacuuuugucaguaaaaa

SEQ ID NO: 2193671 - RNA, 23 nt, Streptococcus pneumoniae R6
uuuacuaaauacuagucuuucuu

SEQ ID NO: 2193672 - RNA, 21 nt, Streptococcus pneumoniae R6
uuuacuacaaagagagcagau

SEQ ID NO: 2193673 - RNA, 13 nt, Streptococcus pneumoniae R6
uuuacuuccuuuu

SEQ ID NO: 2193674 - RNA, 22 nt, Streptococcus pneumoniae R6
uuuacuucauguuuuccuaauu

SEQ ID NO: 2193675 - RNA, 12 nt, Streptococcus pneumoniae R6
uuuacuucauua

SEQ ID NO: 2193676 - RNA, 15 nt, Streptococcus pneumoniae R6
uuuacuucauuuuug

SEQ ID NO: 2193677 - RNA, 13 nt, Streptococcus pneumoniae R6
uuuacuuaauuua

SEQ ID NO: 2193678 - RNA, 13 nt, Streptococcus pneumoniae R6
uuuacuaaaauaa

SEQ ID NO: 2193679 - RNA, 17 nt, Streptococcus pneumoniae R6
uuuaccugcuacugcau

SEQ ID NO: 2193680 - RNA, 18 nt, Streptococcus pneumoniae R6
uuuacaugcgcaaaauaa

SEQ ID NO: 2193681 - RNA, 18 nt, Streptococcus pneumoniae R6
uuuacauaauuuaaaaua

SEQ ID NO: 2193682 - RNA, 16 nt, Streptococcus pneumoniae R6
uuuacagaaagaacaa

SEQ ID NO: 2193683 - RNA, 19 nt, Streptococcus pneumoniae R6
uuuauugcaauuuaucagu

SEQ ID NO: 2193684 - RNA, 23 nt, Streptococcus pneumoniae R6
uuuauuuuuauaacaacccaauu

SEQ ID NO: 2193685 - RNA, 13 nt, Streptococcus pneumoniae R6
uuuauuuuuaugc

SEQ ID NO: 2193686 - RNA, 15 nt, Streptococcus pneumoniae R6
uuuauuuaaucauuu

SEQ ID NO: 2193687 - RNA, 17 nt, Streptococcus pneumoniae R6
uuuauugguuaaaugca

SEQ ID NO: 2193688 - RNA, 20 nt, Streptococcus pneumoniae R6
uuuauuaagcccuacuguac

SEQ ID NO: 2193689 - RNA, 23 nt, Streptococcus pneumoniae R6
uuuauuaagcccuacuguacuua

SEQ ID NO: 2193690 - RNA, 12 nt, Streptococcus pneumoniae R6
uuuaucuuaauu

SEQ ID NO: 2193691 - RNA, 14 nt, Streptococcus pneumoniae R6
uuuaucucccauac

SEQ ID NO: 2193692 - RNA, 22 nt, Streptococcus pneumoniae R6
uuuauggaaaaaaugaaauuaa

SEQ ID NO: 2193693 - RNA, 16 nt, Streptococcus pneumoniae R6
uuuaugcuucaacucu

SEQ ID NO: 2193694 - RNA, 19 nt, Streptococcus pneumoniae R6
uuuaugcuuggugagaaag

SEQ ID NO: 2193695 - RNA, 13 nt, Streptococcus pneumoniae R6
uuuaucuuuccuu

SEQ ID NO: 2193696 - RNA, 14 nt, Streptococcus pneumoniae R6
uuuaugaaaaaguu

SEQ ID NO: 2193697 - RNA, 15 nt, Streptococcus pneumoniae R6
uuuaugaaaaaguuu

SEQ ID NO: 2193698 - RNA, 22 nt, Streptococcus pneumoniae R6
uuuauccaaucuauuuaugaaa

SEQ ID NO: 2193699 - RNA, 18 nt, Streptococcus pneumoniae R6
uuuauccaaggcauucau

SEQ ID NO: 2193700 - RNA, 17 nt, Streptococcus pneumoniae R6
uuuauccauucacaaca

SEQ ID NO: 2193701 - RNA, 23 nt, Streptococcus pneumoniae R6
uuuauccauucacaacaucuucu

SEQ ID NO: 2193702 - RNA, 22 nt, Streptococcus pneumoniae R6
uuuaucaguaaucucaaaacag

SEQ ID NO: 2193703 - RNA, 13 nt, Streptococcus pneumoniae R6
uuuaucaguauau

SEQ ID NO: 2193704 - RNA, 18 nt, Streptococcus pneumoniae R6
uuuaucaccuccuucucc

SEQ ID NO: 2193705 - RNA, 20 nt, Streptococcus pneumoniae R6
uuuaucaccuccuucuccaa

SEQ ID NO: 2193706 - RNA, 19 nt, Streptococcus pneumoniae R6
uuuaucagccaaaccguuc

SEQ ID NO: 2193707 - RNA, 15 nt, Streptococcus pneumoniae R6
uuuagauaagacuga

SEQ ID NO: 2193708 - RNA, 13 nt, Streptococcus pneumoniae R6
uuuagacauuaua

SEQ ID NO: 2193709 - RNA, 17 nt, Streptococcus pneumoniae R6
uuuagagaaugaaauau

SEQ ID NO: 2193710 - RNA, 21 nt, Streptococcus pneumoniae R6
uuuagauuguccucaauaagc

SEQ ID NO: 2193711 - RNA, 13 nt, Streptococcus pneumoniae R6
uuuauaauuuuaa

SEQ ID NO: 2193712 - RNA, 13 nt, Streptococcus pneumoniae R6
uuuauaauaucac

SEQ ID NO: 2193713 - RNA, 23 nt, Streptococcus pneumoniae R6
uucuugguaguagcaccaagaau

SEQ ID NO: 2193714 - RNA, 15 nt, Streptococcus pneumoniae R6
uucuugguauuguuu

SEQ ID NO: 2193715 - RNA, 23 nt, Streptococcus pneumoniae R6
uucuugggcuggacguucuucaa

SEQ ID NO: 2193716 - RNA, 22 nt, Streptococcus pneumoniae R6
uucuuggagaaacuccuuggcu

SEQ ID NO: 2193717 - RNA, 23 nt, Streptococcus pneumoniae R6
uucuugaaaccaguuccuuuguc

SEQ ID NO: 2193718 - RNA, 20 nt, Streptococcus pneumoniae R6
uucuucugugauauaaucuu

SEQ ID NO: 2193719 - RNA, 11 nt, Streptococcus pneumoniae R6
uucuucuuuuu

SEQ ID NO: 2193720 - RNA, 20 nt, Streptococcus pneumoniae R6
uucuucuuuucauaauuucu

SEQ ID NO: 2193721 - RNA, 20 nt, Streptococcus pneumoniae R6
uugagcuacguucugucaaa

SEQ ID NO: 2193722 - RNA, 23 nt, Streptococcus pneumoniae R6
uugagcuacguucugucaaacca

SEQ ID NO: 2193723 - RNA, 13 nt, Streptococcus pneumoniae R6
uugagcucauccu

SEQ ID NO: 2193724 - RNA, 18 nt, Streptococcus pneumoniae R6
uugagcugacuucgucag

SEQ ID NO: 2193725 - RNA, 22 nt, Streptococcus pneumoniae R6
uugagcugacuucgucaguucu

SEQ ID NO: 2193726 - RNA, 20 nt, Streptococcus pneumoniae R6
uugagcugcugugaugaggg

SEQ ID NO: 2193727 - RNA, 19 nt, Streptococcus pneumoniae R6
uugagccuagugucucaaa

SEQ ID NO: 2193728 - RNA, 21 nt, Streptococcus pneumoniae R6
uugaggaagguuuuaaacaaa

SEQ ID NO: 2193729 - RNA, 21 nt, Streptococcus pneumoniae R6
uugaggaagguuuuaaagaca

SEQ ID NO: 2193730 - RNA, 21 nt, Streptococcus pneumoniae R6
uugaggaaguaccaaggaaga

SEQ ID NO: 2193731 - RNA, 23 nt, Streptococcus pneumoniae R6
uugaguaauuccccaucuucaac

SEQ ID NO: 2193732 - RNA, 20 nt, Streptococcus pneumoniae R6
uugagguuguagaugaaacu

SEQ ID NO: 2193733 - RNA, 17 nt, Streptococcus pneumoniae R6
uugaguaaauaaaacaa

SEQ ID NO: 2193734 - RNA, 22 nt, Streptococcus pneumoniae R6
uugaguauaaacgaauagaaaa

SEQ ID NO: 2193735 - RNA, 17 nt, Streptococcus pneumoniae R6
uugaguucacaaaugag

SEQ ID NO: 2193736 - RNA, 20 nt, Streptococcus pneumoniae R6
uugagucguucucuuauugu

SEQ ID NO: 2193737 - RNA, 19 nt, Streptococcus pneumoniae R6
uugagugcuuuuguacugc

SEQ ID NO: 2193738 - RNA, 17 nt, Streptococcus pneumoniae R6
uugauaauaaagaagag

SEQ ID NO: 2193739 - RNA, 21 nt, Streptococcus pneumoniae R6
uugauaauagcacuuaaaaag

SEQ ID NO: 2193740 - RNA, 19 nt, Streptococcus pneumoniae R6
uugauaauaguaugucuga

SEQ ID NO: 2193741 - RNA, 22 nt, Streptococcus pneumoniae R6
uugauaaugcguuuagcaucuu

SEQ ID NO: 2193742 - RNA, 16 nt, Streptococcus pneumoniae R6
uugauaagauaauaaa

SEQ ID NO: 2193743 - RNA, 21 nt, Streptococcus pneumoniae R6
uugauaagauaauaaauaguu

SEQ ID NO: 2193744 - RNA, 18 nt, Streptococcus pneumoniae R6
uugauggguucuuugcca

SEQ ID NO: 2193745 - RNA, 14 nt, Streptococcus pneumoniae R6
uugauuacauaaau

SEQ ID NO: 2193746 - RNA, 20 nt, Streptococcus pneumoniae R6
uugauuacaauuuaccugcu

SEQ ID NO: 2193747 - RNA, 14 nt, Streptococcus pneumoniae R6
uugauuagcaaaac

SEQ ID NO: 2193748 - RNA, 16 nt, Streptococcus pneumoniae R6
uugauuagcaaaacgu

SEQ ID NO: 2193749 - RNA, 16 nt, Streptococcus pneumoniae R6
uugauuaggauuuuuu

SEQ ID NO: 2193750 - RNA, 17 nt, Streptococcus pneumoniae R6
uugauuauccuuuacuu

SEQ ID NO: 2193751 - RNA, 14 nt, Streptococcus pneumoniae R6
uugauuuaugccau

SEQ ID NO: 2193752 - RNA, 12 nt, Streptococcus pneumoniae R6
uugauuuccagc

SEQ ID NO: 2193753 - RNA, 13 nt, Streptococcus pneumoniae R6
uugauuucuaaag

SEQ ID NO: 2193754 - RNA, 19 nt, Streptococcus pneumoniae R6
uugauuuguucgcaucuua

SEQ ID NO: 2193755 - RNA, 20 nt, Streptococcus pneumoniae R6
uugauuucuggauuuccauu

SEQ ID NO: 2193756 - RNA, 14 nt, Streptococcus pneumoniae R6
uugauuugaaugcc

SEQ ID NO: 2193757 - RNA, 20 nt, Streptococcus pneumoniae R6
uugauuuggacuauucguuu

SEQ ID NO: 2193758 - RNA, 20 nt, Streptococcus pneumoniae R6
uugauauaguuaaaaaagau

SEQ ID NO: 2193759 - RNA, 16 nt, Streptococcus pneumoniae R6
uugauagcauuuggaa

SEQ ID NO: 2193760 - RNA, 21 nt, Streptococcus pneumoniae R6
uugauacuguacguuuuauca

SEQ ID NO: 2193761 - RNA, 14 nt, Streptococcus pneumoniae R6
uugauagaaagcaa

SEQ ID NO: 2193762 - RNA, 18 nt, Streptococcus pneumoniae R6
uugauaggauauugacaa

SEQ ID NO: 2193763 - RNA, 21 nt, Streptococcus pneumoniae R6
uugauagaugacuucuuaauc

SEQ ID NO: 2193764 - RNA, 17 nt, Streptococcus pneumoniae R6
uugauacucuucgaaaa

SEQ ID NO: 2193765 - RNA, 17 nt, Streptococcus pneumoniae R6
uugauggacaacaauga

SEQ ID NO: 2193766 - RNA, 13 nt, Streptococcus pneumoniae R6
uugauggagcugg

SEQ ID NO: 2193767 - RNA, 16 nt, Streptococcus pneumoniae R6
uugauggaguuuucaa

SEQ ID NO: 2193768 - RNA, 17 nt, Streptococcus pneumoniae R6
uugauauauaaaugaaa

SEQ ID NO: 2193769 - RNA, 17 nt, Streptococcus pneumoniae R6
uugaucggaagcuacag

SEQ ID NO: 2193770 - RNA, 17 nt, Streptococcus pneumoniae R6
uugaucuagcucucucu

SEQ ID NO: 2193771 - RNA, 16 nt, Streptococcus pneumoniae R6
uugcauuaaaaaguuu

SEQ ID NO: 2193772 - RNA, 17 nt, Streptococcus pneumoniae R6
uugcauuaaaaaguuuu

SEQ ID NO: 2193773 - RNA, 17 nt, Streptococcus pneumoniae R6
uugccagaaaaagucaa

SEQ ID NO: 2193774 - RNA, 19 nt, Streptococcus pneumoniae R6
uugcagguucgauuccugc

SEQ ID NO: 2193775 - RNA, 15 nt, Streptococcus pneumoniae R6
uugcaguugaaauaa

SEQ ID NO: 2193776 - RNA, 22 nt, Streptococcus pneumoniae R6
uugauuuuccuaaucaauuugu

SEQ ID NO: 2193777 - RNA, 11 nt, Streptococcus pneumoniae R6
uugauuuuaau

SEQ ID NO: 2193778 - RNA, 18 nt, Streptococcus pneumoniae R6
uugauuuuaaagaaauag

SEQ ID NO: 2193779 - RNA, 16 nt, Streptococcus pneumoniae R6
uugcacuuuccucuug

SEQ ID NO: 2193780 - RNA, 18 nt, Streptococcus pneumoniae R6
uugcagauagaacugacg

SEQ ID NO: 2193781 - RNA, 11 nt, Streptococcus pneumoniae R6
uugcaguauau

SEQ ID NO: 2193782 - RNA, 20 nt, Streptococcus pneumoniae R6
uugcaggagaaaaugaaaua

SEQ ID NO: 2193783 - RNA, 17 nt, Streptococcus pneumoniae R6
uugcaggauuuuugcuu

SEQ ID NO: 2193784 - RNA, 22 nt, Streptococcus pneumoniae R6
uugcgaggacagauaagagcaa

SEQ ID NO: 2193785 - RNA, 23 nt, Streptococcus pneumoniae R6
uugccuagggugacaguaaaaaa

SEQ ID NO: 2193786 - RNA, 13 nt, Streptococcus pneumoniae R6
uugcgaagugaua

SEQ ID NO: 2193787 - RNA, 22 nt, Streptococcus pneumoniae R6
uugccucccacuaucuaaaaaa

SEQ ID NO: 2193788 - RNA, 13 nt, Streptococcus pneumoniae R6
uugccuaauuuuu

SEQ ID NO: 2193789 - RNA, 21 nt, Streptococcus pneumoniae R6
uugccuaaacacuucacuaau

SEQ ID NO: 2193790 - RNA, 17 nt, Streptococcus pneumoniae R6
uugccgugcucuaaaau

SEQ ID NO: 2193791 - RNA, 22 nt, Streptococcus pneumoniae R6
uuggaagaaugagugcuguaau

SEQ ID NO: 2193792 - RNA, 14 nt, Streptococcus pneumoniae R6
uuggaauaagguaa

SEQ ID NO: 2193793 - RNA, 18 nt, Streptococcus pneumoniae R6
uuggaacuaaaguuccua

SEQ ID NO: 2193794 - RNA, 20 nt, Streptococcus pneumoniae R6
uuggaacuaaaguuccuaau

SEQ ID NO: 2193795 - RNA, 13 nt, Streptococcus pneumoniae R6
uuggaaaaaauaa

SEQ ID NO: 2193796 - RNA, 19 nt, Streptococcus pneumoniae R6
uuggaaauagcauccacca

SEQ ID NO: 2193797 - RNA, 19 nt, Streptococcus pneumoniae R6
uuggaaaccaagaagucca

SEQ ID NO: 2193798 - RNA, 19 nt, Streptococcus pneumoniae R6
uuggaguugauucaugaca

SEQ ID NO: 2193799 - RNA, 15 nt, Streptococcus pneumoniae R6
uuggagcuuaaaauc

SEQ ID NO: 2193800 - RNA, 16 nt, Streptococcus pneumoniae R6
uuggagggagcaacca

SEQ ID NO: 2193801 - RNA, 20 nt, Streptococcus pneumoniae R6
uuggagaaacuccuuggcua

SEQ ID NO: 2193802 - RNA, 15 nt, Streptococcus pneumoniae R6
uuggacauagccaau

SEQ ID NO: 2193803 - RNA, 18 nt, Streptococcus pneumoniae R6
uuggcagccucuuucuug

SEQ ID NO: 2193804 - RNA, 23 nt, Streptococcus pneumoniae R6
uuggcagauuuaaucugaauguu

SEQ ID NO: 2193805 - RNA, 20 nt, Streptococcus pneumoniae R6
uuggcaauuuuugaaaggau

SEQ ID NO: 2193806 - RNA, 15 nt, Streptococcus pneumoniae R6
uuggauuuucugaag

SEQ ID NO: 2193807 - RNA, 16 nt, Streptococcus pneumoniae R6
uuggauuaauccccau

SEQ ID NO: 2193808 - RNA, 17 nt, Streptococcus pneumoniae R6
uuggcaacgacaggagu

SEQ ID NO: 2193809 - RNA, 15 nt, Streptococcus pneumoniae R6
uuggauaauauccac

SEQ ID NO: 2193810 - RNA, 15 nt, Streptococcus pneumoniae R6
uuggauauaagaagc

SEQ ID NO: 2193811 - RNA, 13 nt, Streptococcus pneumoniae R6
uuggauauucaau

SEQ ID NO: 2193812 - RNA, 16 nt, Streptococcus pneumoniae R6
uugcuugccaugagcu

SEQ ID NO: 2193813 - RNA, 13 nt, Streptococcus pneumoniae R6
uugcuugucaucu

SEQ ID NO: 2193814 - RNA, 14 nt, Streptococcus pneumoniae R6
uugcuugaaaacuc

SEQ ID NO: 2193815 - RNA, 14 nt, Streptococcus pneumoniae R6
uugcuugaccagcu

SEQ ID NO: 2193816 - RNA, 21 nt, Streptococcus pneumoniae R6
uugcuuuccucagcaggagca

SEQ ID NO: 2193817 - RNA, 19 nt, Streptococcus pneumoniae R6
uugcuuugcugacuugccu

SEQ ID NO: 2193818 - RNA, 23 nt, Streptococcus pneumoniae R6
uugcuuuuagagauuuucauaaa

SEQ ID NO: 2193819 - RNA, 13 nt, Streptococcus pneumoniae R6
uugcuguuuauau

SEQ ID NO: 2193820 - RNA, 19 nt, Streptococcus pneumoniae R6
uugcuucauugacagaacc

SEQ ID NO: 2193821 - RNA, 16 nt, Streptococcus pneumoniae R6
uugcuuccaaaaauuc

SEQ ID NO: 2193822 - RNA, 11 nt, Streptococcus pneumoniae R6
uugcuuagaaa

SEQ ID NO: 2193823 - RNA, 15 nt, Streptococcus pneumoniae R6
uugcuuauacucaau

SEQ ID NO: 2193824 - RNA, 22 nt, Streptococcus pneumoniae R6
uugcuacaaggacauugacuuu

SEQ ID NO: 2193825 - RNA, 17 nt, Streptococcus pneumoniae R6
uugcugucaaaaagauc

SEQ ID NO: 2193826 - RNA, 18 nt, Streptococcus pneumoniae R6
uugcuggagcuggggcua

SEQ ID NO: 2193827 - RNA, 19 nt, Streptococcus pneumoniae R6
uugggaaaauggcuccugu

SEQ ID NO: 2193828 - RNA, 20 nt, Streptococcus pneumoniae R6
uuggcuuugagauauuucuu

SEQ ID NO: 2193829 - RNA, 21 nt, Streptococcus pneumoniae R6
uugggacgauuuucaaaaaga

SEQ ID NO: 2193830 - RNA, 18 nt, Streptococcus pneumoniae R6
uuggcuucguguuccaaa

SEQ ID NO: 2193831 - RNA, 21 nt, Streptococcus pneumoniae R6
uugggcaaucguugucaaguu

SEQ ID NO: 2193832 - RNA, 14 nt, Streptococcus pneumoniae R6
uuggcuaaagauaa

SEQ ID NO: 2193833 - RNA, 14 nt, Streptococcus pneumoniae R6
uuggcguaacaaaa

SEQ ID NO: 2193834 - RNA, 22 nt, Streptococcus pneumoniae R6
uuggcuaggcgcuucacuaguu

SEQ ID NO: 2193835 - RNA, 12 nt, Streptococcus pneumoniae R6
uuggcucaucug

SEQ ID NO: 2193836 - RNA, 14 nt, Streptococcus pneumoniae R6
uuggcugauuucuu

SEQ ID NO: 2193837 - RNA, 22 nt, Streptococcus pneumoniae R6
uuggccgcaagcagcuaaaagc

SEQ ID NO: 2193838 - RNA, 23 nt, Streptococcus pneumoniae R6
uuggccaacuaaccaacuucuuu

SEQ ID NO: 2193839 - RNA, 20 nt, Streptococcus pneumoniae R6
uuggcgauaugguaggcuuu

SEQ ID NO: 2193840 - RNA, 19 nt, Streptococcus pneumoniae R6
uuggcgaauauagacaaaa

SEQ ID NO: 2193841 - RNA, 21 nt, Streptococcus pneumoniae R6
uuggcgaauuggauauagucu

SEQ ID NO: 2193842 - RNA, 18 nt, Streptococcus pneumoniae R6
uugggguuuggaaaugau

SEQ ID NO: 2193843 - RNA, 14 nt, Streptococcus pneumoniae R6
uugguaagagaaau

SEQ ID NO: 2193844 - RNA, 22 nt, Streptococcus pneumoniae R6
uugguaagagaaauuucugaaa

SEQ ID NO: 2193845 - RNA, 23 nt, Streptococcus pneumoniae R6
uugguaagagaaauuucugaaac

SEQ ID NO: 2193846 - RNA, 14 nt, Streptococcus pneumoniae R6
uugguaagagucac

SEQ ID NO: 2193847 - RNA, 13 nt, Streptococcus pneumoniae R6
uugguaagaguug

SEQ ID NO: 2193848 - RNA, 14 nt, Streptococcus pneumoniae R6
uugguaauuuucaa

SEQ ID NO: 2193849 - RNA, 16 nt, Streptococcus pneumoniae R6
uugguaauuuucaaga

SEQ ID NO: 2193850 - RNA, 19 nt, Streptococcus pneumoniae R6
uugguaccgcugaaagcaa

SEQ ID NO: 2193851 - RNA, 15 nt, Streptococcus pneumoniae R6
uugguauguguauuc

SEQ ID NO: 2193852 - RNA, 15 nt, Streptococcus pneumoniae R6
uugguaucuuggcua

SEQ ID NO: 2193853 - RNA, 23 nt, Streptococcus pneumoniae R6
uugguaggguucuucgaaaguca

SEQ ID NO: 2193854 - RNA, 12 nt, Streptococcus pneumoniae R6
uugguaggauaa

SEQ ID NO: 2193855 - RNA, 18 nt, Streptococcus pneumoniae R6
uugguuaaaugcauacga

SEQ ID NO: 2193856 - RNA, 18 nt, Streptococcus pneumoniae R6
uugguuauacauagcuaa

SEQ ID NO: 2193857 - RNA, 12 nt, Streptococcus pneumoniae R6
uugguucugcuc

SEQ ID NO: 2193858 - RNA, 15 nt, Streptococcus pneumoniae R6
uugguucuucacuau

SEQ ID NO: 2193859 - RNA, 19 nt, Streptococcus pneumoniae R6
uugguguuugguugaccag

SEQ ID NO: 2193860 - RNA, 14 nt, Streptococcus pneumoniae R6
uugguguaaauaga

SEQ ID NO: 2193861 - RNA, 19 nt, Streptococcus pneumoniae R6
uugguguaaauagaaacca

SEQ ID NO: 2193862 - RNA, 14 nt, Streptococcus pneumoniae R6
uugguggcuuccag

SEQ ID NO: 2193863 - RNA, 15 nt, Streptococcus pneumoniae R6
uuggucauuaaauuu

SEQ ID NO: 2193864 - RNA, 12 nt, Streptococcus pneumoniae R6
uuggucuagcaa

SEQ ID NO: 2193865 - RNA, 20 nt, Streptococcus pneumoniae R6
uuggucuagcaagaguuuuu

SEQ ID NO: 2193866 - RNA, 18 nt, Streptococcus pneumoniae R6
uuggucuuauaagccucu

SEQ ID NO: 2193867 - RNA, 15 nt, Streptococcus pneumoniae R6
uuggugcaaacggau

SEQ ID NO: 2193868 - RNA, 17 nt, Streptococcus pneumoniae R6
uuggugagaaaguuuuu

SEQ ID NO: 2193869 - RNA, 13 nt, Streptococcus pneumoniae R6
aauaauuaaaaug

SEQ ID NO: 2193870 - RNA, 17 nt, Streptococcus pneumoniae R6
aauaauguuaaccacaa

SEQ ID NO: 2193871 - RNA, 20 nt, Streptococcus pneumoniae R6
aauaauguuaaccacaaaaa

SEQ ID NO: 2193872 - RNA, 22 nt, Streptococcus pneumoniae R6
aauaauguuaaccacaaaaagu

SEQ ID NO: 2193873 - RNA, 19 nt, Streptococcus pneumoniae R6
aauaauugacgaagaaacc

SEQ ID NO: 2193874 - RNA, 23 nt, Streptococcus pneumoniae R6
aauaauugacgaagaaaccaagc

SEQ ID NO: 2193875 - RNA, 23 nt, Streptococcus pneumoniae R6
aauaauuaguucagaauuuucuu

SEQ ID NO: 2193876 - RNA, 19 nt, Streptococcus pneumoniae R6
aauaauuauagaaaugagg

SEQ ID NO: 2193877 - RNA, 20 nt, Streptococcus pneumoniae R6
aauaauuauagaaaugaggu

SEQ ID NO: 2193878 - RNA, 16 nt, Streptococcus pneumoniae R6
aauaaucggaagcagc

SEQ ID NO: 2193879 - RNA, 12 nt, Streptococcus pneumoniae R6
aauaauccuaac

SEQ ID NO: 2193880 - RNA, 13 nt, Streptococcus pneumoniae R6
aauaauccuaacu

SEQ ID NO: 2193881 - RNA, 13 nt, Streptococcus pneumoniae R6
aauaaugaagaca

SEQ ID NO: 2193882 - RNA, 19 nt, Streptococcus pneumoniae R6
aauaaugaagacaucauau

SEQ ID NO: 2193883 - RNA, 16 nt, Streptococcus pneumoniae R6
aauaaguucaacaaau

SEQ ID NO: 2193884 - RNA, 13 nt, Streptococcus pneumoniae R6
aauaauaaaacuu

SEQ ID NO: 2193885 - RNA, 20 nt, Streptococcus pneumoniae R6
aauaagguugcauagaccaa

SEQ ID NO: 2193886 - RNA, 20 nt, Streptococcus pneumoniae R6
aauaagguuuagcaaaagca

SEQ ID NO: 2193887 - RNA, 23 nt, Streptococcus pneumoniae R6
aauaagcccgaaaaauuucucug

SEQ ID NO: 2193888 - RNA, 14 nt, Streptococcus pneumoniae R6
aauaaggaaaacau

SEQ ID NO: 2193889 - RNA, 20 nt, Streptococcus pneumoniae R6
aauaauagcuugcaauucuu

SEQ ID NO: 2193890 - RNA, 22 nt, Streptococcus pneumoniae R6
aauaauagcuugcaauucuuua

SEQ ID NO: 2193891 - RNA, 21 nt, Streptococcus pneumoniae R6
aauaauagacuuccugcaaaa

SEQ ID NO: 2193892 - RNA, 14 nt, Streptococcus pneumoniae R6
aauaauagaaaaca

SEQ ID NO: 2193893 - RNA, 16 nt, Streptococcus pneumoniae R6
aauaauacaaaaaaua

SEQ ID NO: 2193894 - RNA, 14 nt, Streptococcus pneumoniae R6
aauaaucaaaacua

SEQ ID NO: 2193895 - RNA, 15 nt, Streptococcus pneumoniae R6
aauaauauaggucag

SEQ ID NO: 2193896 - RNA, 17 nt, Streptococcus pneumoniae R6
aauaauauccgauagca

SEQ ID NO: 2193897 - RNA, 20 nt, Streptococcus pneumoniae R6
aaguugaccaacuagauuuc

SEQ ID NO: 2193898 - RNA, 19 nt, Streptococcus pneumoniae R6
aaguugauacuuauccuuu

SEQ ID NO: 2193899 - RNA, 15 nt, Streptococcus pneumoniae R6
aaguuccggaaacca

SEQ ID NO: 2193900 - RNA, 18 nt, Streptococcus pneumoniae R6
aaguuccucuuuuucccc

SEQ ID NO: 2193901 - RNA, 21 nt, Streptococcus pneumoniae R6
aaguucacuugagcaaacuga

SEQ ID NO: 2193902 - RNA, 12 nt, Streptococcus pneumoniae R6
aaguucaucuuc

SEQ ID NO: 2193903 - RNA, 20 nt, Streptococcus pneumoniae R6
aaguucaucuucaaaaucaa

SEQ ID NO: 2193904 - RNA, 21 nt, Streptococcus pneumoniae R6
aaguucaucuucaaaaucaaa

SEQ ID NO: 2193905 - RNA, 14 nt, Streptococcus pneumoniae R6
aauaaauagauagu

SEQ ID NO: 2193906 - RNA, 16 nt, Streptococcus pneumoniae R6
aauaaauaaaacucuu

SEQ ID NO: 2193907 - RNA, 21 nt, Streptococcus pneumoniae R6
aauaaaucauugauaguaaca

SEQ ID NO: 2193908 - RNA, 15 nt, Streptococcus pneumoniae R6
aauaaauccagcuga

SEQ ID NO: 2193909 - RNA, 20 nt, Streptococcus pneumoniae R6
aauaaauaucaaaaaaagaa

SEQ ID NO: 2193910 - RNA, 16 nt, Streptococcus pneumoniae R6
aauaaaucuaucagaa

SEQ ID NO: 2193911 - RNA, 16 nt, Streptococcus pneumoniae R6
aauaacaaaccaagaa

SEQ ID NO: 2193912 - RNA, 16 nt, Streptococcus pneumoniae R6
aauaacaaagucuggu

SEQ ID NO: 2193913 - RNA, 18 nt, Streptococcus pneumoniae R6
aauaacucucaucuaucu

SEQ ID NO: 2193914 - RNA, 15 nt, Streptococcus pneumoniae R6
aauaacucaauuaag

SEQ ID NO: 2193915 - RNA, 19 nt, Streptococcus pneumoniae R6
aauaacucaauuaagaaau

SEQ ID NO: 2193916 - RNA, 13 nt, Streptococcus pneumoniae R6
aauaacuucaaua

SEQ ID NO: 2193917 - RNA, 17 nt, Streptococcus pneumoniae R6
aauaacuucaauaucuu

SEQ ID NO: 2193918 - RNA, 18 nt, Streptococcus pneumoniae R6
aauaacuucaauaucuuu

SEQ ID NO: 2193919 - RNA, 17 nt, Streptococcus pneumoniae R6
aauaagauaugaacaaa

SEQ ID NO: 2193920 - RNA, 23 nt, Streptococcus pneumoniae R6
aauaagaugcgaacaaaucaauu

SEQ ID NO: 2193921 - RNA, 13 nt, Streptococcus pneumoniae R6
aauaagaugugaa

SEQ ID NO: 2193922 - RNA, 22 nt, Streptococcus pneumoniae R6
aauaagaugugaacaacucuau

SEQ ID NO: 2193923 - RNA, 14 nt, Streptococcus pneumoniae R6
aauaacauuuccuc

SEQ ID NO: 2193924 - RNA, 22 nt, Streptococcus pneumoniae R6
aauaacccaccaagucaucaaa

SEQ ID NO: 2193925 - RNA, 17 nt, Streptococcus pneumoniae R6
aauagcacuuaaaaagu

SEQ ID NO: 2193926 - RNA, 16 nt, Streptococcus pneumoniae R6
aauagcagaaaaauga

SEQ ID NO: 2193927 - RNA, 19 nt, Streptococcus pneumoniae R6
aauagcagagacauuagaa

SEQ ID NO: 2193928 - RNA, 22 nt, Streptococcus pneumoniae R6
aauagcccacugugauuucuaa

SEQ ID NO: 2193929 - RNA, 17 nt, Streptococcus pneumoniae R6
aauagcccauaaagaga

SEQ ID NO: 2193930 - RNA, 17 nt, Streptococcus pneumoniae R6
aauagauuggauaaaau

SEQ ID NO: 2193931 - RNA, 18 nt, Streptococcus pneumoniae R6
aauagauuggauaaaauc

SEQ ID NO: 2193932 - RNA, 19 nt, Streptococcus pneumoniae R6
aauacucuuucaguuucau

SEQ ID NO: 2193933 - RNA, 14 nt, Streptococcus pneumoniae R6
aauacugaaacaac

SEQ ID NO: 2193934 - RNA, 15 nt, Streptococcus pneumoniae R6
aauacugaaacaaca

SEQ ID NO: 2193935 - RNA, 22 nt, Streptococcus pneumoniae R6
aauacugaaacaacaucuuucc

SEQ ID NO: 2193936 - RNA, 17 nt, Streptococcus pneumoniae R6
aauacucugugaaaauc

SEQ ID NO: 2193937 - RNA, 16 nt, Streptococcus pneumoniae R6
aauacugauguaacug

SEQ ID NO: 2193938 - RNA, 12 nt, Streptococcus pneumoniae R6
aauacugcucgg

SEQ ID NO: 2193939 - RNA, 13 nt, Streptococcus pneumoniae R6
aauagaaaucacg

SEQ ID NO: 2193940 - RNA, 22 nt, Streptococcus pneumoniae R6
aauagauaauuuaaaacucauu

SEQ ID NO: 2193941 - RNA, 15 nt, Streptococcus pneumoniae R6
aauagaaaacaaaaa

SEQ ID NO: 2193942 - RNA, 13 nt, Streptococcus pneumoniae R6
aauagaaaaaauc

SEQ ID NO: 2193943 - RNA, 13 nt, Streptococcus pneumoniae R6
aauagaaaccagc

SEQ ID NO: 2193944 - RNA, 13 nt, Streptococcus pneumoniae R6
aauacuuuuuccu

SEQ ID NO: 2193945 - RNA, 14 nt, Streptococcus pneumoniae R6
aauaccuaccagag

SEQ ID NO: 2193946 - RNA, 19 nt, Streptococcus pneumoniae R6
aauacggacauagcagaua

SEQ ID NO: 2193947 - RNA, 13 nt, Streptococcus pneumoniae R6
aauacaaaaacaa

SEQ ID NO: 2193948 - RNA, 16 nt, Streptococcus pneumoniae R6
aauacaaaaaauaguc

SEQ ID NO: 2193949 - RNA, 16 nt, Streptococcus pneumoniae R6
aauacauuuuguaaaa

SEQ ID NO: 2193950 - RNA, 18 nt, Streptococcus pneumoniae R6
aauacauuuuguaaaaaa

SEQ ID NO: 2193951 - RNA, 19 nt, Streptococcus pneumoniae R6
aauacauuuuguaaaaaag

SEQ ID NO: 2193952 - RNA, 23 nt, Streptococcus pneumoniae R6
aauacaaaaucccucuuuuuaca

SEQ ID NO: 2193953 - RNA, 20 nt, Streptococcus pneumoniae R6
aauacaaaaaucuaagauaa

SEQ ID NO: 2193954 - RNA, 22 nt, Streptococcus pneumoniae R6
aauacaaaaaucuaagauaaag

SEQ ID NO: 2193955 - RNA, 14 nt, Streptococcus pneumoniae R6
aauaauuuauaaaa

SEQ ID NO: 2193956 - RNA, 13 nt, Streptococcus pneumoniae R6
aauaauuucuuuu

SEQ ID NO: 2193957 - RNA, 17 nt, Streptococcus pneumoniae R6
aauaauuuugauucaga

SEQ ID NO: 2193958 - RNA, 20 nt, Streptococcus pneumoniae R6
aauaauuuuguuaagacacu

SEQ ID NO: 2193959 - RNA, 19 nt, Streptococcus pneumoniae R6
aauacccccuuaaaaccau

SEQ ID NO: 2193960 - RNA, 17 nt, Streptococcus pneumoniae R6
aauaccaaguucauuuu

SEQ ID NO: 2193961 - RNA, 23 nt, Streptococcus pneumoniae R6
aauaccaaguucauuuuuuaugg

SEQ ID NO: 2193962 - RNA, 14 nt, Streptococcus pneumoniae R6
aauaccaaagaagu

SEQ ID NO: 2193963 - RNA, 16 nt, Streptococcus pneumoniae R6
aauaccaaagaaguca

SEQ ID NO: 2193964 - RNA, 21 nt, Streptococcus pneumoniae R6
aauaccaaagaagucaccaua

SEQ ID NO: 2193965 - RNA, 17 nt, Streptococcus pneumoniae R6
aauauaguaaaaugaaa

SEQ ID NO: 2193966 - RNA, 21 nt, Streptococcus pneumoniae R6
aauauagucuauaauggcuug

SEQ ID NO: 2193967 - RNA, 23 nt, Streptococcus pneumoniae R6
aauauagugaaauuaacaaaaag

SEQ ID NO: 2193968 - RNA, 11 nt, Streptococcus pneumoniae R6
aauauauaaaa

SEQ ID NO: 2193969 - RNA, 13 nt, Streptococcus pneumoniae R6
aauauauaaaauu

SEQ ID NO: 2193970 - RNA, 22 nt, Streptococcus pneumoniae R6
aauaucaucgauuuuuucacca

SEQ ID NO: 2193971 - RNA, 13 nt, Streptococcus pneumoniae R6
aauaucauuucca

SEQ ID NO: 2193972 - RNA, 21 nt, Streptococcus pneumoniae R6
aauaucuggacuuauaugcua

SEQ ID NO: 2193973 - RNA, 22 nt, Streptococcus pneumoniae R6
aauaucugagauaguauuuuaa

SEQ ID NO: 2193974 - RNA, 14 nt, Streptococcus pneumoniae R6
aauaucugauauua

SEQ ID NO: 2193975 - RNA, 14 nt, Streptococcus pneumoniae R6
aauaucugcacucu

SEQ ID NO: 2193976 - RNA, 17 nt, Streptococcus pneumoniae R6
aauauccgauagcauca

SEQ ID NO: 2193977 - RNA, 23 nt, Streptococcus pneumoniae R6
aauaugcucacugaugaaacuaa

SEQ ID NO: 2193978 - RNA, 19 nt, Streptococcus pneumoniae R6
aauaugggcuuacaucaaa

SEQ ID NO: 2193979 - RNA, 22 nt, Streptococcus pneumoniae R6
aauaugggcuuacaucaaaaac

SEQ ID NO: 2193980 - RNA, 16 nt, Streptococcus pneumoniae R6
aauauggauaauugaa

SEQ ID NO: 2193981 - RNA, 14 nt, Streptococcus pneumoniae R6
aauaggccucuuca

SEQ ID NO: 2193982 - RNA, 12 nt, Streptococcus pneumoniae R6
aauagucucuug

SEQ ID NO: 2193983 - RNA, 19 nt, Streptococcus pneumoniae R6
aauagugggaauuuguaaa

SEQ ID NO: 2193984 - RNA, 22 nt, Streptococcus pneumoniae R6
aauagugggaauuuguaaaguu

SEQ ID NO: 2193985 - RNA, 17 nt, Streptococcus pneumoniae R6
aauagcgaugaagagag

SEQ ID NO: 2193986 - RNA, 23 nt, Streptococcus pneumoniae R6
aauaggauuuggcguuaguuacu

SEQ ID NO: 2193987 - RNA, 21 nt, Streptococcus pneumoniae R6
aauagcccuucggauaaaauc

SEQ ID NO: 2193988 - RNA, 17 nt, Streptococcus pneumoniae R6
aauauaauaaacuaauu

SEQ ID NO: 2193989 - RNA, 17 nt, Streptococcus pneumoniae R6
aauagugugaccugcuu

SEQ ID NO: 2193990 - RNA, 21 nt, Streptococcus pneumoniae R6
aauaguuaucguaauuaaagu

SEQ ID NO: 2193991 - RNA, 23 nt, Streptococcus pneumoniae R6
aauaguucagugaacuauuuuau

SEQ ID NO: 2193992 - RNA, 14 nt, Streptococcus pneumoniae R6
aauaguuaggcaua

SEQ ID NO: 2193993 - RNA, 21 nt, Streptococcus pneumoniae R6
aauaguuauagaguguuaucu

SEQ ID NO: 2193994 - RNA, 15 nt, Streptococcus pneumoniae R6
aauauaggccaagau

SEQ ID NO: 2193995 - RNA, 19 nt, Streptococcus pneumoniae R6
aauauagggcuuuuuuugc

SEQ ID NO: 2193996 - RNA, 23 nt, Streptococcus pneumoniae R6
aauauagccuaagacaaccaaac

SEQ ID NO: 2193997 - RNA, 16 nt, Streptococcus pneumoniae R6
aauauagaaguaguuu

SEQ ID NO: 2193998 - RNA, 12 nt, Streptococcus pneumoniae R6
aauauagacaaa

SEQ ID NO: 2193999 - RNA, 14 nt, Streptococcus pneumoniae R6
aauauagaggauau

SEQ ID NO: 2194000 - RNA, 18 nt, Streptococcus pneumoniae R6
aagccuucguaagcuucc

SEQ ID NO: 2194001 - RNA, 20 nt, Streptococcus pneumoniae R6
aagccuucuccaauugcaag

SEQ ID NO: 2194002 - RNA, 22 nt, Streptococcus pneumoniae R6
aagccuuucgaacuuuggaaga

SEQ ID NO: 2194003 - RNA, 14 nt, Streptococcus pneumoniae R6
aagccuuguuucca

SEQ ID NO: 2194004 - RNA, 22 nt, Streptococcus pneumoniae R6
aagccuucuugguuuuugccau

SEQ ID NO: 2194005 - RNA, 16 nt, Streptococcus pneumoniae R6
aagcgaaaggagaaaa

SEQ ID NO: 2194006 - RNA, 22 nt, Streptococcus pneumoniae R6
aagcgcacaagcgcuauuaaaa

SEQ ID NO: 2194007 - RNA, 22 nt, Streptococcus pneumoniae R6
aagcgaucaaccgauuuaagau

SEQ ID NO: 2194008 - RNA, 16 nt, Streptococcus pneumoniae R6
aagccggcuugucuuu

SEQ ID NO: 2194009 - RNA, 19 nt, Streptococcus pneumoniae R6
aagccugagaugauucuca

SEQ ID NO: 2194010 - RNA, 14 nt, Streptococcus pneumoniae R6
aagccuguccuguu

SEQ ID NO: 2194011 - RNA, 16 nt, Streptococcus pneumoniae R6
aagccuccaaucugga

SEQ ID NO: 2194012 - RNA, 23 nt, Streptococcus pneumoniae R6
aagccagucgucaccguuuuugu

SEQ ID NO: 2194013 - RNA, 20 nt, Streptococcus pneumoniae R6
aagccauauuggaugaguuu

SEQ ID NO: 2194014 - RNA, 23 nt, Streptococcus pneumoniae R6
aagccauauuggaugaguuuacu

SEQ ID NO: 2194015 - RNA, 19 nt, Streptococcus pneumoniae R6
aagaagucaccauaaaucu

SEQ ID NO: 2194016 - RNA, 12 nt, Streptococcus pneumoniae R6
aagaaguaaauc

SEQ ID NO: 2194017 - RNA, 22 nt, Streptococcus pneumoniae R6
aagaaguccauagcgucaaaga

SEQ ID NO: 2194018 - RNA, 18 nt, Streptococcus pneumoniae R6
aagaagguauucauaaaa

SEQ ID NO: 2194019 - RNA, 22 nt, Streptococcus pneumoniae R6
aagaagguauucauaaaauacc

SEQ ID NO: 2194020 - RNA, 18 nt, Streptococcus pneumoniae R6
aagaagguguuuuuauga

SEQ ID NO: 2194021 - RNA, 22 nt, Streptococcus pneumoniae R6
aagaaguuggccaacuaaccaa

SEQ ID NO: 2194022 - RNA, 22 nt, Streptococcus pneumoniae R6
aagaaguugguuaguuggccaa

SEQ ID NO: 2194023 - RNA, 19 nt, Streptococcus pneumoniae R6
aagcccuauauuauaagac

SEQ ID NO: 2194024 - RNA, 20 nt, Streptococcus pneumoniae R6
aagcccaguugacuguguuu

SEQ ID NO: 2194025 - RNA, 20 nt, Streptococcus pneumoniae R6
aagccgagcaagaauucaau

SEQ ID NO: 2194026 - RNA, 13 nt, Streptococcus pneumoniae R6
aagcccuuuauga

SEQ ID NO: 2194027 - RNA, 21 nt, Streptococcus pneumoniae R6
aagccgacccaggcaaagagu

SEQ ID NO: 2194028 - RNA, 17 nt, Streptococcus pneumoniae R6
aagcgccugacauucuu

SEQ ID NO: 2194029 - RNA, 12 nt, Streptococcus pneumoniae R6
aagcucagcauu

SEQ ID NO: 2194030 - RNA, 17 nt, Streptococcus pneumoniae R6
aaggaagaagcuguaaa

SEQ ID NO: 2194031 - RNA, 12 nt, Streptococcus pneumoniae R6
aaggacaucuuc

SEQ ID NO: 2194032 - RNA, 14 nt, Streptococcus pneumoniae R6
aaggaacuaacuca

SEQ ID NO: 2194033 - RNA, 20 nt, Streptococcus pneumoniae R6
aaggaaccaguuuuuuucag

SEQ ID NO: 2194034 - RNA, 16 nt, Streptococcus pneumoniae R6
aaggacaccagcacag

SEQ ID NO: 2194035 - RNA, 23 nt, Streptococcus pneumoniae R6
aaggacaccagcacaggcaacca

SEQ ID NO: 2194036 - RNA, 23 nt, Streptococcus pneumoniae R6
aaggagaacuccagauuaucuuc

SEQ ID NO: 2194037 - RNA, 14 nt, Streptococcus pneumoniae R6
aaggacuuagcucu

SEQ ID NO: 2194038 - RNA, 15 nt, Streptococcus pneumoniae R6
aaggacuugaguaau

SEQ ID NO: 2194039 - RNA, 23 nt, Streptococcus pneumoniae R6
aaggaccugaguucauuacucaa

SEQ ID NO: 2194040 - RNA, 15 nt, Streptococcus pneumoniae R6
aagcuucuacagaug

SEQ ID NO: 2194041 - RNA, 16 nt, Streptococcus pneumoniae R6
aagcuugaguggaaaa

SEQ ID NO: 2194042 - RNA, 21 nt, Streptococcus pneumoniae R6
aagcuuggcuuugauucaucu

SEQ ID NO: 2194043 - RNA, 23 nt, Streptococcus pneumoniae R6
aagcuugcgauaaagcuaaagau

SEQ ID NO: 2194044 - RNA, 17 nt, Streptococcus pneumoniae R6
aagcuugcuuccaaaaa

SEQ ID NO: 2194045 - RNA, 22 nt, Streptococcus pneumoniae R6
aaggaaaauugauuuauagaaa

SEQ ID NO: 2194046 - RNA, 15 nt, Streptococcus pneumoniae R6
aaggaaaccuaauca

SEQ ID NO: 2194047 - RNA, 15 nt, Streptococcus pneumoniae R6
aaggaaagucggaag

SEQ ID NO: 2194048 - RNA, 20 nt, Streptococcus pneumoniae R6
aagcugacgcgguuugaaga

SEQ ID NO: 2194049 - RNA, 23 nt, Streptococcus pneumoniae R6
aagcugacgcgguuugaagagau

SEQ ID NO: 2194050 - RNA, 23 nt, Streptococcus pneumoniae R6
aagcugacgggcaaauuucauga

SEQ ID NO: 2194051 - RNA, 23 nt, Streptococcus pneumoniae R6
aagcugacgugguuugaagagau

SEQ ID NO: 2194052 - RNA, 19 nt, Streptococcus pneumoniae R6
aagcugacuucgucaguuc

SEQ ID NO: 2194053 - RNA, 21 nt, Streptococcus pneumoniae R6
aagcugacuucgucaguucua

SEQ ID NO: 2194054 - RNA, 19 nt, Streptococcus pneumoniae R6
aagcugacuucgucaguuu

SEQ ID NO: 2194055 - RNA, 15 nt, Streptococcus pneumoniae R6
aagcugaauucuaau

SEQ ID NO: 2194056 - RNA, 22 nt, Streptococcus pneumoniae R6
aagcugcuuucauagcugcguu

SEQ ID NO: 2194057 - RNA, 14 nt, Streptococcus pneumoniae R6
aagcugaugcgguu

SEQ ID NO: 2194058 - RNA, 17 nt, Streptococcus pneumoniae R6
aagcuucgcagaccaca

SEQ ID NO: 2194059 - RNA, 15 nt, Streptococcus pneumoniae R6
aagcuggcuacagau

SEQ ID NO: 2194060 - RNA, 19 nt, Streptococcus pneumoniae R6
aagcuggcuugagguccca

SEQ ID NO: 2194061 - RNA, 13 nt, Streptococcus pneumoniae R6
aagcuggucuuuu

SEQ ID NO: 2194062 - RNA, 21 nt, Streptococcus pneumoniae R6
aagcuggucuuuuuugagaaa

SEQ ID NO: 2194063 - RNA, 14 nt, Streptococcus pneumoniae R6
aagugauaaugauu

SEQ ID NO: 2194064 - RNA, 15 nt, Streptococcus pneumoniae R6
aagugauaaugauuu

SEQ ID NO: 2194065 - RNA, 19 nt, Streptococcus pneumoniae R6
aagugaguaccagauauac

SEQ ID NO: 2194066 - RNA, 15 nt, Streptococcus pneumoniae R6
aagugauauacuaug

SEQ ID NO: 2194067 - RNA, 20 nt, Streptococcus pneumoniae R6
aagucugggaaaaauuuuca

SEQ ID NO: 2194068 - RNA, 14 nt, Streptococcus pneumoniae R6
aagucugaaucaaa

SEQ ID NO: 2194069 - RNA, 20 nt, Streptococcus pneumoniae R6
aagugacagucgcaaagagg

SEQ ID NO: 2194070 - RNA, 16 nt, Streptococcus pneumoniae R6
aagugacuauuaguuu

SEQ ID NO: 2194071 - RNA, 19 nt, Streptococcus pneumoniae R6
aaguguaacaacuucacga

SEQ ID NO: 2194072 - RNA, 19 nt, Streptococcus pneumoniae R6
aaguguaacuggaccaagu

SEQ ID NO: 2194073 - RNA, 21 nt, Streptococcus pneumoniae R6
aagugguugauaaauuucaaa

SEQ ID NO: 2194074 - RNA, 11 nt, Streptococcus pneumoniae R6
aagugucuccc

SEQ ID NO: 2194075 - RNA, 19 nt, Streptococcus pneumoniae R6
aagugucuggaaugauaac

SEQ ID NO: 2194076 - RNA, 17 nt, Streptococcus pneumoniae R6
aaguucaaucagcuaaa

SEQ ID NO: 2194077 - RNA, 18 nt, Streptococcus pneumoniae R6
aaguucaaucagcuaaaa

SEQ ID NO: 2194078 - RNA, 19 nt, Streptococcus pneumoniae R6
aaguucacucaaaccugau

SEQ ID NO: 2194079 - RNA, 21 nt, Streptococcus pneumoniae R6
aaguuauuucuccuaaagaaa

SEQ ID NO: 2194080 - RNA, 22 nt, Streptococcus pneumoniae R6
aaguucaacaaaucagaaaagu

SEQ ID NO: 2194081 - RNA, 23 nt, Streptococcus pneumoniae R6
aaguucaacaaaucagaaaagua

SEQ ID NO: 2194082 - RNA, 15 nt, Streptococcus pneumoniae R6
aaguuaugaaaaaga

SEQ ID NO: 2194083 - RNA, 19 nt, Streptococcus pneumoniae R6
aaguuauuggaacuaaagu

SEQ ID NO: 2194084 - RNA, 13 nt, Streptococcus pneumoniae R6
aagucggaaggca

SEQ ID NO: 2194085 - RNA, 18 nt, Streptococcus pneumoniae R6
aagucgcucgucaucguc

SEQ ID NO: 2194086 - RNA, 15 nt, Streptococcus pneumoniae R6
aagucuccugugcuc

SEQ ID NO: 2194087 - RNA, 21 nt, Streptococcus pneumoniae R6
aagucucugucccaucauuuc

SEQ ID NO: 2194088 - RNA, 13 nt, Streptococcus pneumoniae R6
aagucauuuucuu

SEQ ID NO: 2194089 - RNA, 22 nt, Streptococcus pneumoniae R6
aaguccaaagaugagaggagaa

SEQ ID NO: 2194090 - RNA, 18 nt, Streptococcus pneumoniae R6
aaguccuuacucaaauaa

SEQ ID NO: 2194091 - RNA, 20 nt, Streptococcus pneumoniae R6
aaguccuuacucaaauaaaa

SEQ ID NO: 2194092 - RNA, 22 nt, Streptococcus pneumoniae R6
aaguccuuguuugagcucuuug

SEQ ID NO: 2194093 - RNA, 14 nt, Streptococcus pneumoniae R6
aagucgaaaauaaa

SEQ ID NO: 2194094 - RNA, 15 nt, Streptococcus pneumoniae R6
aagucaugagaguuu

SEQ ID NO: 2194095 - RNA, 14 nt, Streptococcus pneumoniae R6
aagucauacuuucu

SEQ ID NO: 2194096 - RNA, 18 nt, Streptococcus pneumoniae R6
aagucaucuaucaaaaga

SEQ ID NO: 2194097 - RNA, 15 nt, Streptococcus pneumoniae R6
aagucaggcauaccg

SEQ ID NO: 2194098 - RNA, 15 nt, Streptococcus pneumoniae R6
aagucauaacauucu

SEQ ID NO: 2194099 - RNA, 17 nt, Streptococcus pneumoniae R6
aagucagucacauauau

SEQ ID NO: 2194100 - RNA, 19 nt, Streptococcus pneumoniae R6
aagucaacaucucuuguuu

SEQ ID NO: 2194101 - RNA, 16 nt, Streptococcus pneumoniae R6
aagucaaagccaauca

SEQ ID NO: 2194102 - RNA, 14 nt, Streptococcus pneumoniae R6
aagucaaauaagaa

SEQ ID NO: 2194103 - RNA, 19 nt, Streptococcus pneumoniae R6
aagucaaauaagaaagacc

SEQ ID NO: 2194104 - RNA, 18 nt, Streptococcus pneumoniae R6
aagucaaauuaauuuaua

SEQ ID NO: 2194105 - RNA, 14 nt, Streptococcus pneumoniae R6
aaguauuauaauau

SEQ ID NO: 2194106 - RNA, 14 nt, Streptococcus pneumoniae R6
aaguauucaagagu

SEQ ID NO: 2194107 - RNA, 16 nt, Streptococcus pneumoniae R6
aaguauuguaagaauu

SEQ ID NO: 2194108 - RNA, 22 nt, Streptococcus pneumoniae R6
aaguauuguaagaauuugauua

SEQ ID NO: 2194109 - RNA, 18 nt, Streptococcus pneumoniae R6
aaguaguugacaaaguuu

SEQ ID NO: 2194110 - RNA, 19 nt, Streptococcus pneumoniae R6
aaguauacucuaauugaaa

SEQ ID NO: 2194111 - RNA, 15 nt, Streptococcus pneumoniae R6
aaguaguaaccaccu

SEQ ID NO: 2194112 - RNA, 18 nt, Streptococcus pneumoniae R6
aaguaggccaaacuugaa

SEQ ID NO: 2194113 - RNA, 12 nt, Streptococcus pneumoniae R6
aaguagucauuu

SEQ ID NO: 2194114 - RNA, 22 nt, Streptococcus pneumoniae R6
aaguaggucccaucauagccga

SEQ ID NO: 2194115 - RNA, 14 nt, Streptococcus pneumoniae R6
aaguagcaaaacac

SEQ ID NO: 2194116 - RNA, 14 nt, Streptococcus pneumoniae R6
aaguacgagucaag

SEQ ID NO: 2194117 - RNA, 22 nt, Streptococcus pneumoniae R6
aaguacuuuuaauauacuugau

SEQ ID NO: 2194118 - RNA, 18 nt, Streptococcus pneumoniae R6
aaguagagauaaguggca

SEQ ID NO: 2194119 - RNA, 19 nt, Streptococcus pneumoniae R6
aaguaauuugaguaaaaga

SEQ ID NO: 2194120 - RNA, 14 nt, Streptococcus pneumoniae R6
aaguaccugacgaa

SEQ ID NO: 2194121 - RNA, 12 nt, Streptococcus pneumoniae R6
aaguacauguca

SEQ ID NO: 2194122 - RNA, 13 nt, Streptococcus pneumoniae R6
aaguacagauuug

SEQ ID NO: 2194123 - RNA, 13 nt, Streptococcus pneumoniae R6
aaggucaaacuuu

SEQ ID NO: 2194124 - RNA, 17 nt, Streptococcus pneumoniae R6
aaggucacuuuuuucuu

SEQ ID NO: 2194125 - RNA, 15 nt, Streptococcus pneumoniae R6
aaggucaguugcaag

SEQ ID NO: 2194126 - RNA, 16 nt, Streptococcus pneumoniae R6
aagguauucauaaaau

SEQ ID NO: 2194127 - RNA, 17 nt, Streptococcus pneumoniae R6
aaggucgcauaggcaau

SEQ ID NO: 2194128 - RNA, 14 nt, Streptococcus pneumoniae R6
aaggucaucagcag

SEQ ID NO: 2194129 - RNA, 15 nt, Streptococcus pneumoniae R6
aagguccagaagccu

SEQ ID NO: 2194130 - RNA, 20 nt, Streptococcus pneumoniae R6
aagguccagcguccagcagc

SEQ ID NO: 2194131 - RNA, 13 nt, Streptococcus pneumoniae R6
aaguaaaauacaa

SEQ ID NO: 2194132 - RNA, 19 nt, Streptococcus pneumoniae R6
aaguaaaauacaaaccaaa

SEQ ID NO: 2194133 - RNA, 14 nt, Streptococcus pneumoniae R6
aaguaaaauuaauu

SEQ ID NO: 2194134 - RNA, 16 nt, Streptococcus pneumoniae R6
aaguaaucucugauaa

SEQ ID NO: 2194135 - RNA, 13 nt, Streptococcus pneumoniae R6
aaguaaucugcac

SEQ ID NO: 2194136 - RNA, 22 nt, Streptococcus pneumoniae R6
aaguaaaugugagcuuugguuu

SEQ ID NO: 2194137 - RNA, 22 nt, Streptococcus pneumoniae R6
aaggagagucagggucaaagua

SEQ ID NO: 2194138 - RNA, 16 nt, Streptococcus pneumoniae R6
aaggauugagaagcca

SEQ ID NO: 2194139 - RNA, 23 nt, Streptococcus pneumoniae R6
aaggauugagaagccaaaaucau

SEQ ID NO: 2194140 - RNA, 18 nt, Streptococcus pneumoniae R6
aaggcuauagucaaaggg

SEQ ID NO: 2194141 - RNA, 15 nt, Streptococcus pneumoniae R6
aaggcucauaguuua

SEQ ID NO: 2194142 - RNA, 19 nt, Streptococcus pneumoniae R6
aaggcuauuauuaauguuu

SEQ ID NO: 2194143 - RNA, 15 nt, Streptococcus pneumoniae R6
aaggcuuuuucuucu

SEQ ID NO: 2194144 - RNA, 13 nt, Streptococcus pneumoniae R6
aaggcguucaucc

SEQ ID NO: 2194145 - RNA, 19 nt, Streptococcus pneumoniae R6
aagggagguaaagauagcc

SEQ ID NO: 2194146 - RNA, 18 nt, Streptococcus pneumoniae R6
aagggacuggauuuuaag

SEQ ID NO: 2194147 - RNA, 12 nt, Streptococcus pneumoniae R6
aagggauagcga

SEQ ID NO: 2194148 - RNA, 14 nt, Streptococcus pneumoniae R6
aagggcaguaccug

SEQ ID NO: 2194149 - RNA, 16 nt, Streptococcus pneumoniae R6
aagggcaccaaacuua

SEQ ID NO: 2194150 - RNA, 22 nt, Streptococcus pneumoniae R6
aagggauuuuucuggcucuuug

SEQ ID NO: 2194151 - RNA, 20 nt, Streptococcus pneumoniae R6
aagggcuucaucaaccccca

SEQ ID NO: 2194152 - RNA, 14 nt, Streptococcus pneumoniae R6
aauuggaaaauaaa

SEQ ID NO: 2194153 - RNA, 24 nt, Streptococcus pneumoniae R6
aauugcuuucuucagauuuuauag

SEQ ID NO: 2194154 - RNA, 13 nt, Streptococcus pneumoniae R6
aauuggcacaaaa

SEQ ID NO: 2194155 - RNA, 14 nt, Streptococcus pneumoniae R6
aauugcuaaaacau

SEQ ID NO: 2194156 - RNA, 18 nt, Streptococcus pneumoniae R6
aauugcuaaaacauuuau

SEQ ID NO: 2194157 - RNA, 20 nt, Streptococcus pneumoniae R6
aauugcucuucugaaaucuu

SEQ ID NO: 2194158 - RNA, 22 nt, Streptococcus pneumoniae R6
aauugcugcaccuucaacugca

SEQ ID NO: 2194159 - RNA, 15 nt, Streptococcus pneumoniae R6
aauugcggaauucaa

SEQ ID NO: 2194160 - RNA, 11 nt, Streptococcus pneumoniae R6
aauugauuaag

SEQ ID NO: 2194161 - RNA, 12 nt, Streptococcus pneumoniae R6
aauugauuaagu

SEQ ID NO: 2194162 - RNA, 16 nt, Streptococcus pneumoniae R6
aauugauuaagugauu

SEQ ID NO: 2194163 - RNA, 15 nt, Streptococcus pneumoniae R6
aauugauuuauagaa

SEQ ID NO: 2194164 - RNA, 22 nt, Streptococcus pneumoniae R6
aauugauuugacuuccaaaauu

SEQ ID NO: 2194165 - RNA, 21 nt, Streptococcus pneumoniae R6
aauugauuuguucgcaucuua

SEQ ID NO: 2194166 - RNA, 15 nt, Streptococcus pneumoniae R6
aauugcaagagggcu

SEQ ID NO: 2194167 - RNA, 15 nt, Streptococcus pneumoniae R6
aauugcacuuuccuc

SEQ ID NO: 2194168 - RNA, 23 nt, Streptococcus pneumoniae R6
aauugcccaaagcucaagaguuc

SEQ ID NO: 2194169 - RNA, 18 nt, Streptococcus pneumoniae R6
aauucugcuuuuaaauag

SEQ ID NO: 2194170 - RNA, 18 nt, Streptococcus pneumoniae R6
aauucugucacaacugaa

SEQ ID NO: 2194171 - RNA, 20 nt, Streptococcus pneumoniae R6
aauucugucacaacugaacg

SEQ ID NO: 2194172 - RNA, 12 nt, Streptococcus pneumoniae R6
aauucuguuuga

SEQ ID NO: 2194173 - RNA, 14 nt, Streptococcus pneumoniae R6
aauucugucuuaga

SEQ ID NO: 2194174 - RNA, 22 nt, Streptococcus pneumoniae R6
aauucugucuuagacuuucuca

SEQ ID NO: 2194175 - RNA, 22 nt, Streptococcus pneumoniae R6
aauucuuccuacugauaucuuu

SEQ ID NO: 2194176 - RNA, 11 nt, Streptococcus pneumoniae R6
aauucuuuucc

SEQ ID NO: 2194177 - RNA, 19 nt, Streptococcus pneumoniae R6
aauucuuuucgaaacucuu

SEQ ID NO: 2194178 - RNA, 18 nt, Streptococcus pneumoniae R6
aauucuuugaaaucagaa

SEQ ID NO: 2194179 - RNA, 14 nt, Streptococcus pneumoniae R6
aauucuugaaaauc

SEQ ID NO: 2194180 - RNA, 15 nt, Streptococcus pneumoniae R6
aauucuuuaacaaaa

SEQ ID NO: 2194181 - RNA, 17 nt, Streptococcus pneumoniae R6
aauucuuuagaaaacua

SEQ ID NO: 2194182 - RNA, 14 nt, Streptococcus pneumoniae R6
aauucuucucuuuc

SEQ ID NO: 2194183 - RNA, 19 nt, Streptococcus pneumoniae R6
aauucuucuguuucugcaa

SEQ ID NO: 2194184 - RNA, 21 nt, Streptococcus pneumoniae R6
aauucuucguaagauucuucu

SEQ ID NO: 2194185 - RNA, 14 nt, Streptococcus pneumoniae R6
aauucuucuccuac

SEQ ID NO: 2194186 - RNA, 20 nt, Streptococcus pneumoniae R6
aauucuucuccuacuugcuu

SEQ ID NO: 2194187 - RNA, 20 nt, Streptococcus pneumoniae R6
aauugaauaaagucaacaga

SEQ ID NO: 2194188 - RNA, 19 nt, Streptococcus pneumoniae R6
aauugacgaagaaaccaag

SEQ ID NO: 2194189 - RNA, 14 nt, Streptococcus pneumoniae R6
aauugaauuucaag

SEQ ID NO: 2194190 - RNA, 15 nt, Streptococcus pneumoniae R6
aauugaauugcuuau

SEQ ID NO: 2194191 - RNA, 13 nt, Streptococcus pneumoniae R6
aauugaaacaaga

SEQ ID NO: 2194192 - RNA, 15 nt, Streptococcus pneumoniae R6
aauugaaacaagaac

SEQ ID NO: 2194193 - RNA, 16 nt, Streptococcus pneumoniae R6
aauugauaauagcacu

SEQ ID NO: 2194194 - RNA, 20 nt, Streptococcus pneumoniae R6
aauugauaauaguaugucug

SEQ ID NO: 2194195 - RNA, 22 nt, Streptococcus pneumoniae R6
aauugauaauaguaugucugaa

SEQ ID NO: 2194196 - RNA, 16 nt, Streptococcus pneumoniae R6
aauugaggaaguacca

SEQ ID NO: 2194197 - RNA, 15 nt, Streptococcus pneumoniae R6
aauugacucucaccu

SEQ ID NO: 2194198 - RNA, 17 nt, Streptococcus pneumoniae R6
aauugacuauagcagau

SEQ ID NO: 2194199 - RNA, 18 nt, Streptococcus pneumoniae R6
aauugacuauagcagauu

SEQ ID NO: 2194200 - RNA, 12 nt, Streptococcus pneumoniae R6
aauugagaaaga

SEQ ID NO: 2194201 - RNA, 18 nt, Streptococcus pneumoniae R6
aauuuauagaaaaauuuu

SEQ ID NO: 2194202 - RNA, 13 nt, Streptococcus pneumoniae R6
aauuuauagaaau

SEQ ID NO: 2194203 - RNA, 16 nt, Streptococcus pneumoniae R6
aauuuauagaaauauu

SEQ ID NO: 2194204 - RNA, 16 nt, Streptococcus pneumoniae R6
aauuuagagaaugaaa

SEQ ID NO: 2194205 - RNA, 18 nt, Streptococcus pneumoniae R6
aauuuagagaaugaaaua

SEQ ID NO: 2194206 - RNA, 21 nt, Streptococcus pneumoniae R6
aauuuaaucauguaccuaaga

SEQ ID NO: 2194207 - RNA, 12 nt, Streptococcus pneumoniae R6
aauuuaagagua

SEQ ID NO: 2194208 - RNA, 21 nt, Streptococcus pneumoniae R6
aauuuaauccacuauaauaaa

SEQ ID NO: 2194209 - RNA, 22 nt, Streptococcus pneumoniae R6
aauuuaccaaggaagcugaggg

SEQ ID NO: 2194210 - RNA, 13 nt, Streptococcus pneumoniae R6
aauuuagaaauag

SEQ ID NO: 2194211 - RNA, 14 nt, Streptococcus pneumoniae R6
aauuuaucaguuau

SEQ ID NO: 2194212 - RNA, 13 nt, Streptococcus pneumoniae R6
aauuuaucccaau

SEQ ID NO: 2194213 - RNA, 17 nt, Streptococcus pneumoniae R6
aauuucaaaaucuucug

SEQ ID NO: 2194214 - RNA, 21 nt, Streptococcus pneumoniae R6
aauuucaaaggcuuuuucuuc

SEQ ID NO: 2194215 - RNA, 13 nt, Streptococcus pneumoniae R6
aauuucaaaguag

SEQ ID NO: 2194216 - RNA, 15 nt, Streptococcus pneumoniae R6
aauuucaauguacua

SEQ ID NO: 2194217 - RNA, 20 nt, Streptococcus pneumoniae R6
aauuucacguccgagugcaa

SEQ ID NO: 2194218 - RNA, 18 nt, Streptococcus pneumoniae R6
aauuucacuagaaaauga

SEQ ID NO: 2194219 - RNA, 17 nt, Streptococcus pneumoniae R6
aauuuaaccaaaccaac

SEQ ID NO: 2194220 - RNA, 14 nt, Streptococcus pneumoniae R6
aauuuaaaaauaga

SEQ ID NO: 2194221 - RNA, 18 nt, Streptococcus pneumoniae R6
aauuuaaaaaucuauuuu

SEQ ID NO: 2194222 - RNA, 13 nt, Streptococcus pneumoniae R6
aauuuaaaaagaa

SEQ ID NO: 2194223 - RNA, 20 nt, Streptococcus pneumoniae R6
aauuuaaaaagaaauauaua

SEQ ID NO: 2194224 - RNA, 16 nt, Streptococcus pneumoniae R6
aauuguuuauaaaaua

SEQ ID NO: 2194225 - RNA, 15 nt, Streptococcus pneumoniae R6
aauugugacucuuuu

SEQ ID NO: 2194226 - RNA, 18 nt, Streptococcus pneumoniae R6
aauugucuaaaaauuuaa

SEQ ID NO: 2194227 - RNA, 19 nt, Streptococcus pneumoniae R6
aauugucuaacuuuuuugg

SEQ ID NO: 2194228 - RNA, 21 nt, Streptococcus pneumoniae R6
aauugucuaagcgaaacaacc

SEQ ID NO: 2194229 - RNA, 22 nt, Streptococcus pneumoniae R6
aauuguagcuuuauuaagcccu

SEQ ID NO: 2194230 - RNA, 15 nt, Streptococcus pneumoniae R6
aauuguaggaaagaa

SEQ ID NO: 2194231 - RNA, 18 nt, Streptococcus pneumoniae R6
aauuguagauguucuuug

SEQ ID NO: 2194232 - RNA, 19 nt, Streptococcus pneumoniae R6
aauuguaaagcgaaaggag

SEQ ID NO: 2194233 - RNA, 15 nt, Streptococcus pneumoniae R6
aauugguuuuuuaag

SEQ ID NO: 2194234 - RNA, 15 nt, Streptococcus pneumoniae R6
aauuguaaacuguga

SEQ ID NO: 2194235 - RNA, 17 nt, Streptococcus pneumoniae R6
aauugguuaaaagcuca

SEQ ID NO: 2194236 - RNA, 22 nt, Streptococcus pneumoniae R6
aauucaaaguggguuuuaacua

SEQ ID NO: 2194237 - RNA, 21 nt, Streptococcus pneumoniae R6
aauucaauugcaggagaaaau

SEQ ID NO: 2194238 - RNA, 21 nt, Streptococcus pneumoniae R6
aauucaauuuuauacucaucu

SEQ ID NO: 2194239 - RNA, 21 nt, Streptococcus pneumoniae R6
aauuauuuacagaaagaacaa

SEQ ID NO: 2194240 - RNA, 22 nt, Streptococcus pneumoniae R6
aauuauuuccuugaccaagucc

SEQ ID NO: 2194241 - RNA, 18 nt, Streptococcus pneumoniae R6
aauuauuucaauuaguuu

SEQ ID NO: 2194242 - RNA, 17 nt, Streptococcus pneumoniae R6
aauuauuucuuuuguac

SEQ ID NO: 2194243 - RNA, 12 nt, Streptococcus pneumoniae R6
aauuauauauaa

SEQ ID NO: 2194244 - RNA, 13 nt, Streptococcus pneumoniae R6
aauuaauucggaa

SEQ ID NO: 2194245 - RNA, 19 nt, Streptococcus pneumoniae R6
aauuaauuucuagaaauau

SEQ ID NO: 2194246 - RNA, 16 nt, Streptococcus pneumoniae R6
aauuaauuuauagaaa

SEQ ID NO: 2194247 - RNA, 17 nt, Streptococcus pneumoniae R6
aauuaauuuauagaaaa

SEQ ID NO: 2194248 - RNA, 24 nt, Streptococcus pneumoniae R6
aauuaauuuauagaaauauuuuag

SEQ ID NO: 2194249 - RNA, 21 nt, Streptococcus pneumoniae R6
aauguaauuguuccauaugau

SEQ ID NO: 2194250 - RNA, 18 nt, Streptococcus pneumoniae R6
aauguacuggauaaaguu

SEQ ID NO: 2194251 - RNA, 17 nt, Streptococcus pneumoniae R6
aauguaaggugcaaaaa

SEQ ID NO: 2194252 - RNA, 16 nt, Streptococcus pneumoniae R6
aauuaacaaaaagaaa

SEQ ID NO: 2194253 - RNA, 14 nt, Streptococcus pneumoniae R6
aauuagaguuucau

SEQ ID NO: 2194254 - RNA, 17 nt, Streptococcus pneumoniae R6
aauuagccuucauuacu

SEQ ID NO: 2194255 - RNA, 18 nt, Streptococcus pneumoniae R6
aauuagccuucauuacuu

SEQ ID NO: 2194256 - RNA, 21 nt, Streptococcus pneumoniae R6
aauuagcaagaaauugauaua

SEQ ID NO: 2194257 - RNA, 14 nt, Streptococcus pneumoniae R6
aauuagcaaucacu

SEQ ID NO: 2194258 - RNA, 15 nt, Streptococcus pneumoniae R6
aauuagcaaucacuc

SEQ ID NO: 2194259 - RNA, 19 nt, Streptococcus pneumoniae R6
aauuagcaaucacucuaac

SEQ ID NO: 2194260 - RNA, 19 nt, Streptococcus pneumoniae R6
aauuaggauagauaccuug

SEQ ID NO: 2194261 - RNA, 16 nt, Streptococcus pneumoniae R6
aauuaggcucuuuguc

SEQ ID NO: 2194262 - RNA, 15 nt, Streptococcus pneumoniae R6
aauuagggauacucc

SEQ ID NO: 2194263 - RNA, 14 nt, Streptococcus pneumoniae R6
aauuaggaaaacau

SEQ ID NO: 2194264 - RNA, 12 nt, Streptococcus pneumoniae R6
aauuccuuuaaa

SEQ ID NO: 2194265 - RNA, 15 nt, Streptococcus pneumoniae R6
aauuccuuuaaaaac

SEQ ID NO: 2194266 - RNA, 17 nt, Streptococcus pneumoniae R6
aauuccuuuaaaaacaa

SEQ ID NO: 2194267 - RNA, 18 nt, Streptococcus pneumoniae R6
aauuccuggcauaaguca

SEQ ID NO: 2194268 - RNA, 14 nt, Streptococcus pneumoniae R6
aauuccuucuugac

SEQ ID NO: 2194269 - RNA, 20 nt, Streptococcus pneumoniae R6
aauuccuucuugaccacguu

SEQ ID NO: 2194270 - RNA, 17 nt, Streptococcus pneumoniae R6
aauuccuugaugagcaa

SEQ ID NO: 2194271 - RNA, 16 nt, Streptococcus pneumoniae R6
aauuccucauuuugaa

SEQ ID NO: 2194272 - RNA, 20 nt, Streptococcus pneumoniae R6
aauuccuaagauauuaagaa

SEQ ID NO: 2194273 - RNA, 12 nt, Streptococcus pneumoniae R6
aauuccuaaaau

SEQ ID NO: 2194274 - RNA, 15 nt, Streptococcus pneumoniae R6
aauucuaaaaacaga

SEQ ID NO: 2194275 - RNA, 21 nt, Streptococcus pneumoniae R6
aauucuaaaucuugcccuucu

SEQ ID NO: 2194276 - RNA, 21 nt, Streptococcus pneumoniae R6
aauucucaagcugugaguuca

SEQ ID NO: 2194277 - RNA, 22 nt, Streptococcus pneumoniae R6
aauucucguauauagugacuau

SEQ ID NO: 2194278 - RNA, 17 nt, Streptococcus pneumoniae R6
aauuccaaauuagaaaa

SEQ ID NO: 2194279 - RNA, 21 nt, Streptococcus pneumoniae R6
aauuccaaauuagaaaaagac

SEQ ID NO: 2194280 - RNA, 15 nt, Streptococcus pneumoniae R6
aauuccaaaauccca

SEQ ID NO: 2194281 - RNA, 20 nt, Streptococcus pneumoniae R6
aauuccaggagaguaugauu

SEQ ID NO: 2194282 - RNA, 15 nt, Streptococcus pneumoniae R6
aauucauuuucuuaa

SEQ ID NO: 2194283 - RNA, 14 nt, Streptococcus pneumoniae R6
aauucauuugauuu

SEQ ID NO: 2194284 - RNA, 18 nt, Streptococcus pneumoniae R6
aauucauuaaacucugca

SEQ ID NO: 2194285 - RNA, 23 nt, Streptococcus pneumoniae R6
aauucccuuauccacaucaucaa

SEQ ID NO: 2194286 - RNA, 22 nt, Streptococcus pneumoniae R6
aauucccucugacgagaaauag

SEQ ID NO: 2194287 - RNA, 17 nt, Streptococcus pneumoniae R6
aauucaccuaaccaaau

SEQ ID NO: 2194288 - RNA, 21 nt, Streptococcus pneumoniae R6
aauucaccuaaccaaauaaua

SEQ ID NO: 2194289 - RNA, 19 nt, Streptococcus pneumoniae R6
aauucaccuauuaacaaua

SEQ ID NO: 2194290 - RNA, 18 nt, Streptococcus pneumoniae R6
aauucacuauaguuuaau

SEQ ID NO: 2194291 - RNA, 18 nt, Streptococcus pneumoniae R6
aauucauccgcuaucuua

SEQ ID NO: 2194292 - RNA, 24 nt, Streptococcus pneumoniae R6
aauucauccgcuaucuuauugauu

SEQ ID NO: 2194293 - RNA, 21 nt, Streptococcus pneumoniae R6
aauucaguaugcuauaucuua

SEQ ID NO: 2194294 - RNA, 18 nt, Streptococcus pneumoniae R6
aauucaggugauuuacca

SEQ ID NO: 2194295 - RNA, 21 nt, Streptococcus pneumoniae R6
aaugcuucuuggauaccuuua

SEQ ID NO: 2194296 - RNA, 18 nt, Streptococcus pneumoniae R6
aaugcuuuuugaaagcag

SEQ ID NO: 2194297 - RNA, 13 nt, Streptococcus pneumoniae R6
aaugcuugcaaau

SEQ ID NO: 2194298 - RNA, 15 nt, Streptococcus pneumoniae R6
aaugcuugcaaauca

SEQ ID NO: 2194299 - RNA, 17 nt, Streptococcus pneumoniae R6
aaugcuugcaaaucauu

SEQ ID NO: 2194300 - RNA, 17 nt, Streptococcus pneumoniae R6
aaugcuugcgacaaaaa

SEQ ID NO: 2194301 - RNA, 18 nt, Streptococcus pneumoniae R6
aauggaaguuucaaaauu

SEQ ID NO: 2194302 - RNA, 21 nt, Streptococcus pneumoniae R6
aauggaaguuucaaaauuccc

SEQ ID NO: 2194303 - RNA, 14 nt, Streptococcus pneumoniae R6
aaugguuuagaagu

SEQ ID NO: 2194304 - RNA, 17 nt, Streptococcus pneumoniae R6
aauggaguaaaaaaaga

SEQ ID NO: 2194305 - RNA, 20 nt, Streptococcus pneumoniae R6
aauggcaucugguuuuuccc

SEQ ID NO: 2194306 - RNA, 15 nt, Streptococcus pneumoniae R6
aauggcaugaggaga

SEQ ID NO: 2194307 - RNA, 14 nt, Streptococcus pneumoniae R6
aauggccuguucua

SEQ ID NO: 2194308 - RNA, 14 nt, Streptococcus pneumoniae R6
aaugccaaagguaa

SEQ ID NO: 2194309 - RNA, 12 nt, Streptococcus pneumoniae R6
aaugccaaaauu

SEQ ID NO: 2194310 - RNA, 15 nt, Streptococcus pneumoniae R6
aaugccaaaauucca

SEQ ID NO: 2194311 - RNA, 19 nt, Streptococcus pneumoniae R6
aaugccgauucccaaacuu

SEQ ID NO: 2194312 - RNA, 24 nt, Streptococcus pneumoniae R6
aaugccgauucccaaacuuguacu

SEQ ID NO: 2194313 - RNA, 15 nt, Streptococcus pneumoniae R6
aaugcccuuuuuugu

SEQ ID NO: 2194314 - RNA, 18 nt, Streptococcus pneumoniae R6
aaugccuccaagaaagag

SEQ ID NO: 2194315 - RNA, 19 nt, Streptococcus pneumoniae R6
aaugccuccaagaaagaga

SEQ ID NO: 2194316 - RNA, 20 nt, Streptococcus pneumoniae R6
aaugcgccaccaacugcacc

SEQ ID NO: 2194317 - RNA, 21 nt, Streptococcus pneumoniae R6
aaugaccugcauacguucaaa

SEQ ID NO: 2194318 - RNA, 23 nt, Streptococcus pneumoniae R6
aaugacgaaacgaagaaggaaga

SEQ ID NO: 2194319 - RNA, 14 nt, Streptococcus pneumoniae R6
aaugaauccgaaaa

SEQ ID NO: 2194320 - RNA, 20 nt, Streptococcus pneumoniae R6
aaugacuaagcccaaagaua

SEQ ID NO: 2194321 - RNA, 20 nt, Streptococcus pneumoniae R6
aaugauuuggcaaauuccuu

SEQ ID NO: 2194322 - RNA, 24 nt, Streptococcus pneumoniae R6
aaugauuuggcaaauuccuugaug

SEQ ID NO: 2194323 - RNA, 13 nt, Streptococcus pneumoniae R6
aaugauuucucuu

SEQ ID NO: 2194324 - RNA, 19 nt, Streptococcus pneumoniae R6
aaugauuucuucuuggucu

SEQ ID NO: 2194325 - RNA, 13 nt, Streptococcus pneumoniae R6
aaugauuugaaca

SEQ ID NO: 2194326 - RNA, 12 nt, Streptococcus pneumoniae R6
aaugaggaaggg

SEQ ID NO: 2194327 - RNA, 20 nt, Streptococcus pneumoniae R6
aaugaggaaggggacaaggu

SEQ ID NO: 2194328 - RNA, 18 nt, Streptococcus pneumoniae R6
aaugagccaaggaagucu

SEQ ID NO: 2194329 - RNA, 21 nt, Streptococcus pneumoniae R6
aaugaugagggcgauuuuccc

SEQ ID NO: 2194330 - RNA, 19 nt, Streptococcus pneumoniae R6
aaugaaguuagguuuuguu

SEQ ID NO: 2194331 - RNA, 14 nt, Streptococcus pneumoniae R6
aaugaaauaaaauu

SEQ ID NO: 2194332 - RNA, 13 nt, Streptococcus pneumoniae R6
aaugaaauaagaa

SEQ ID NO: 2194333 - RNA, 16 nt, Streptococcus pneumoniae R6
aaugaaauaagaauag

SEQ ID NO: 2194334 - RNA, 17 nt, Streptococcus pneumoniae R6
aaugaaaaucauagaaa

SEQ ID NO: 2194335 - RNA, 17 nt, Streptococcus pneumoniae R6
aaugaaaguuuauaaac

SEQ ID NO: 2194336 - RNA, 13 nt, Streptococcus pneumoniae R6
aaugaaagagcag

SEQ ID NO: 2194337 - RNA, 16 nt, Streptococcus pneumoniae R6
aaucuuuuacuucuga

SEQ ID NO: 2194338 - RNA, 17 nt, Streptococcus pneumoniae R6
aaucuuuuacuucugaa

SEQ ID NO: 2194339 - RNA, 16 nt, Streptococcus pneumoniae R6
aaucuuuuccaacuca

SEQ ID NO: 2194340 - RNA, 18 nt, Streptococcus pneumoniae R6
aaucuuagucaaaacaau

SEQ ID NO: 2194341 - RNA, 20 nt, Streptococcus pneumoniae R6
aaucuuagucaaaacaauuc

SEQ ID NO: 2194342 - RNA, 20 nt, Streptococcus pneumoniae R6
aaucuuaccaaccucagaau

SEQ ID NO: 2194343 - RNA, 12 nt, Streptococcus pneumoniae R6
aaucuucaaaaa

SEQ ID NO: 2194344 - RNA, 20 nt, Streptococcus pneumoniae R6
aaucuuaucuaagacugcuu

SEQ ID NO: 2194345 - RNA, 13 nt, Streptococcus pneumoniae R6
aaucuuaucucua

SEQ ID NO: 2194346 - RNA, 18 nt, Streptococcus pneumoniae R6
aaucuaucuuuuaauuca

SEQ ID NO: 2194347 - RNA, 19 nt, Streptococcus pneumoniae R6
aaucuauuuaugaaaaagu

SEQ ID NO: 2194348 - RNA, 23 nt, Streptococcus pneumoniae R6
aaucuggugccccaguucuucag

SEQ ID NO: 2194349 - RNA, 16 nt, Streptococcus pneumoniae R6
aaucugucagugacag

SEQ ID NO: 2194350 - RNA, 15 nt, Streptococcus pneumoniae R6
aaucuguaauauaca

SEQ ID NO: 2194351 - RNA, 17 nt, Streptococcus pneumoniae R6
aaucuguuaaaaaauaa

SEQ ID NO: 2194352 - RNA, 21 nt, Streptococcus pneumoniae R6
aaucuguuaaaaaauaaucaa

SEQ ID NO: 2194353 - RNA, 18 nt, Streptococcus pneumoniae R6
aaucuuaaaaauuacaaa

SEQ ID NO: 2194354 - RNA, 23 nt, Streptococcus pneumoniae R6
aaucuuaaaguuauuggaacuaa

SEQ ID NO: 2194355 - RNA, 15 nt, Streptococcus pneumoniae R6
aaucccauauuuuuc

SEQ ID NO: 2194356 - RNA, 20 nt, Streptococcus pneumoniae R6
aauccccaagggaccaaauu

SEQ ID NO: 2194357 - RNA, 18 nt, Streptococcus pneumoniae R6
aaucccaaucauggcugg

SEQ ID NO: 2194358 - RNA, 18 nt, Streptococcus pneumoniae R6
aaucccagauaaagcuga

SEQ ID NO: 2194359 - RNA, 15 nt, Streptococcus pneumoniae R6
aaucccuuuuuaaga

SEQ ID NO: 2194360 - RNA, 21 nt, Streptococcus pneumoniae R6
aaucccuuuuuaagauuuuac

SEQ ID NO: 2194361 - RNA, 22 nt, Streptococcus pneumoniae R6
aaucccuuuuuaagauuuuacc

SEQ ID NO: 2194362 - RNA, 22 nt, Streptococcus pneumoniae R6
aaucccuucaauggaguaaaaa

SEQ ID NO: 2194363 - RNA, 23 nt, Streptococcus pneumoniae R6
aaucccucuuuuuacaauuguaa

SEQ ID NO: 2194364 - RNA, 17 nt, Streptococcus pneumoniae R6
aaucccuagcuuuuucc

SEQ ID NO: 2194365 - RNA, 23 nt, Streptococcus pneumoniae R6
aauccugauuucaaguaaaauca

SEQ ID NO: 2194366 - RNA, 19 nt, Streptococcus pneumoniae R6
aauccugcauugugagcaa

SEQ ID NO: 2194367 - RNA, 16 nt, Streptococcus pneumoniae R6
aauccugccaaugguc

SEQ ID NO: 2194368 - RNA, 17 nt, Streptococcus pneumoniae R6
aauccguuuuuugaagu

SEQ ID NO: 2194369 - RNA, 17 nt, Streptococcus pneumoniae R6
aauccuagauacaguga

SEQ ID NO: 2194370 - RNA, 17 nt, Streptococcus pneumoniae R6
aauccuaguggaaaaga

SEQ ID NO: 2194371 - RNA, 14 nt, Streptococcus pneumoniae R6
aauccuaguucaug

SEQ ID NO: 2194372 - RNA, 16 nt, Streptococcus pneumoniae R6
aauccuaguucaugau

SEQ ID NO: 2194373 - RNA, 13 nt, Streptococcus pneumoniae R6
aauccuaacuuaa

SEQ ID NO: 2194374 - RNA, 13 nt, Streptococcus pneumoniae R6
aauccuaaauccu

SEQ ID NO: 2194375 - RNA, 18 nt, Streptococcus pneumoniae R6
aauccuuguaugacaucu

SEQ ID NO: 2194376 - RNA, 23 nt, Streptococcus pneumoniae R6
aauccuuguaugacaucuuggag

SEQ ID NO: 2194377 - RNA, 23 nt, Streptococcus pneumoniae R6
aauccuuauuuucuacucuuucg

SEQ ID NO: 2194378 - RNA, 21 nt, Streptococcus pneumoniae R6
aauccuguuuguguuucugga

SEQ ID NO: 2194379 - RNA, 16 nt, Streptococcus pneumoniae R6
aaucgcccuucuugua

SEQ ID NO: 2194380 - RNA, 15 nt, Streptococcus pneumoniae R6
aaucguaauuuagaa

SEQ ID NO: 2194381 - RNA, 16 nt, Streptococcus pneumoniae R6
aaucgguaggaugaca

SEQ ID NO: 2194382 - RNA, 23 nt, Streptococcus pneumoniae R6
aaucgguaggaugacaacuggga

SEQ ID NO: 2194383 - RNA, 21 nt, Streptococcus pneumoniae R6
aaucgucucacgguaaaugua

SEQ ID NO: 2194384 - RNA, 13 nt, Streptococcus pneumoniae R6
aaucuaggacaaa

SEQ ID NO: 2194385 - RNA, 15 nt, Streptococcus pneumoniae R6
aaucuaguaaagcua

SEQ ID NO: 2194386 - RNA, 20 nt, Streptococcus pneumoniae R6
aaucuaguaaagcuagauuu

SEQ ID NO: 2194387 - RNA, 17 nt, Streptococcus pneumoniae R6
aaucuagauacauuuuu

SEQ ID NO: 2194388 - RNA, 19 nt, Streptococcus pneumoniae R6
aaucuacuauauuuuugga

SEQ ID NO: 2194389 - RNA, 15 nt, Streptococcus pneumoniae R6
aaucccaagauagaa

SEQ ID NO: 2194390 - RNA, 20 nt, Streptococcus pneumoniae R6
aauccaugaccgaaugaagg

SEQ ID NO: 2194391 - RNA, 20 nt, Streptococcus pneumoniae R6
aauccauggaauaccaauau

SEQ ID NO: 2194392 - RNA, 22 nt, Streptococcus pneumoniae R6
aauccauggaauaccaauauca

SEQ ID NO: 2194393 - RNA, 23 nt, Streptococcus pneumoniae R6
aauccagucccuuuuaagaguua

SEQ ID NO: 2194394 - RNA, 12 nt, Streptococcus pneumoniae R6
aauccaguuaac

SEQ ID NO: 2194395 - RNA, 23 nt, Streptococcus pneumoniae R6
aauccacuauaauaaaaugaaau

SEQ ID NO: 2194396 - RNA, 23 nt, Streptococcus pneumoniae R6
aauccacucagcugucugagugg

SEQ ID NO: 2194397 - RNA, 16 nt, Streptococcus pneumoniae R6
aauccacucccucuag

SEQ ID NO: 2194398 - RNA, 19 nt, Streptococcus pneumoniae R6
aauccacuugggaaaccaa

SEQ ID NO: 2194399 - RNA, 20 nt, Streptococcus pneumoniae R6
aauccacuugggaaaccaaa

SEQ ID NO: 2194400 - RNA, 17 nt, Streptococcus pneumoniae R6
aaucauuuaauaaugaa

SEQ ID NO: 2194401 - RNA, 18 nt, Streptococcus pneumoniae R6
aaucauuuaauaaugaag

SEQ ID NO: 2194402 - RNA, 18 nt, Streptococcus pneumoniae R6
aaucauuugaaucaaaaa

SEQ ID NO: 2194403 - RNA, 19 nt, Streptococcus pneumoniae R6
aaucauuugaaucaaaaau

SEQ ID NO: 2194404 - RNA, 18 nt, Streptococcus pneumoniae R6
aaucauuuccuucguuuu

SEQ ID NO: 2194405 - RNA, 16 nt, Streptococcus pneumoniae R6
aaucauuuggaaaaca

SEQ ID NO: 2194406 - RNA, 16 nt, Streptococcus pneumoniae R6
aaucauuuucuugauu

SEQ ID NO: 2194407 - RNA, 20 nt, Streptococcus pneumoniae R6
aauccaaaggcguuucguuu

SEQ ID NO: 2194408 - RNA, 18 nt, Streptococcus pneumoniae R6
aauccaacaccaauuuua

SEQ ID NO: 2194409 - RNA, 16 nt, Streptococcus pneumoniae R6
aauccaauugaggaag

SEQ ID NO: 2194410 - RNA, 17 nt, Streptococcus pneumoniae R6
aauccaauugaggaagu

SEQ ID NO: 2194411 - RNA, 22 nt, Streptococcus pneumoniae R6
aauccaauugaggaaguaccaa

SEQ ID NO: 2194412 - RNA, 15 nt, Streptococcus pneumoniae R6
aauccacauuuacga

SEQ ID NO: 2194413 - RNA, 23 nt, Streptococcus pneumoniae R6
aauccacggcucaugagauaaua

SEQ ID NO: 2194414 - RNA, 14 nt, Streptococcus pneumoniae R6
aauauguauuuaua

SEQ ID NO: 2194415 - RNA, 15 nt, Streptococcus pneumoniae R6
aauauguauuuauag

SEQ ID NO: 2194416 - RNA, 20 nt, Streptococcus pneumoniae R6
aauauguauuuauaguauua

SEQ ID NO: 2194417 - RNA, 13 nt, Streptococcus pneumoniae R6
aauauguauuuca

SEQ ID NO: 2194418 - RNA, 14 nt, Streptococcus pneumoniae R6
aauaugucuagcca

SEQ ID NO: 2194419 - RNA, 19 nt, Streptococcus pneumoniae R6
aaucaggaaaucuucucga

SEQ ID NO: 2194420 - RNA, 17 nt, Streptococcus pneumoniae R6
aaucagcucucugauuu

SEQ ID NO: 2194421 - RNA, 17 nt, Streptococcus pneumoniae R6
aaucauagagcaaacua

SEQ ID NO: 2194422 - RNA, 23 nt, Streptococcus pneumoniae R6
aaucauagagcaaacuaggaaac

SEQ ID NO: 2194423 - RNA, 18 nt, Streptococcus pneumoniae R6
aaucauagaaaaaagcau

SEQ ID NO: 2194424 - RNA, 22 nt, Streptococcus pneumoniae R6
aaucauacuuggagaaccuaga

SEQ ID NO: 2194425 - RNA, 13 nt, Streptococcus pneumoniae R6
aaucauagauuca

SEQ ID NO: 2194426 - RNA, 20 nt, Streptococcus pneumoniae R6
aaucauagauucaccaguag

SEQ ID NO: 2194427 - RNA, 20 nt, Streptococcus pneumoniae R6
aaucauaauccaacaccaau

SEQ ID NO: 2194428 - RNA, 20 nt, Streptococcus pneumoniae R6
aaucaggauuuuuucaugga

SEQ ID NO: 2194429 - RNA, 20 nt, Streptococcus pneumoniae R6
aaucaguaauuuaguucuca

SEQ ID NO: 2194430 - RNA, 19 nt, Streptococcus pneumoniae R6
aaucagguaggauuucucc

SEQ ID NO: 2194431 - RNA, 21 nt, Streptococcus pneumoniae R6
aaucagguaggauuucuccug

SEQ ID NO: 2194432 - RNA, 20 nt, Streptococcus pneumoniae R6
aaucaggucuuauagaaaca

SEQ ID NO: 2194433 - RNA, 17 nt, Streptococcus pneumoniae R6
aaucaucgcuaucaaug

SEQ ID NO: 2194434 - RNA, 19 nt, Streptococcus pneumoniae R6
aaucauguaccuaagauua

SEQ ID NO: 2194435 - RNA, 12 nt, Streptococcus pneumoniae R6
aaucauuaaaau

SEQ ID NO: 2194436 - RNA, 14 nt, Streptococcus pneumoniae R6
aaucauuaaaauaa

SEQ ID NO: 2194437 - RNA, 13 nt, Streptococcus pneumoniae R6
aaucauugcaaag

SEQ ID NO: 2194438 - RNA, 20 nt, Streptococcus pneumoniae R6
aaucauucugaacuaaaaaa

SEQ ID NO: 2194439 - RNA, 15 nt, Streptococcus pneumoniae R6
aaccuuaaaacagug

SEQ ID NO: 2194440 - RNA, 17 nt, Streptococcus pneumoniae R6
aaccugguacaguuggg

SEQ ID NO: 2194441 - RNA, 13 nt, Streptococcus pneumoniae R6
aaccuucaucaua

SEQ ID NO: 2194442 - RNA, 22 nt, Streptococcus pneumoniae R6
aaccuuccaagagaccuuucau

SEQ ID NO: 2194443 - RNA, 11 nt, Streptococcus pneumoniae R6
aaccuucuucu

SEQ ID NO: 2194444 - RNA, 14 nt, Streptococcus pneumoniae R6
aaccuucuucugug

SEQ ID NO: 2194445 - RNA, 20 nt, Streptococcus pneumoniae R6
aaccuucuucugugauauaa

SEQ ID NO: 2194446 - RNA, 15 nt, Streptococcus pneumoniae R6
aaccuuucucagaua

SEQ ID NO: 2194447 - RNA, 21 nt, Streptococcus pneumoniae R6
aaccuuucucagauaauaauu

SEQ ID NO: 2194448 - RNA, 12 nt, Streptococcus pneumoniae R6
aaccuugcaaaa

SEQ ID NO: 2194449 - RNA, 14 nt, Streptococcus pneumoniae R6
aaccuuggaaauaa

SEQ ID NO: 2194450 - RNA, 21 nt, Streptococcus pneumoniae R6
aacgaacgccuuaaaaaacca

SEQ ID NO: 2194451 - RNA, 20 nt, Streptococcus pneumoniae R6
aacgaauacuuuguuuagac

SEQ ID NO: 2194452 - RNA, 15 nt, Streptococcus pneumoniae R6
aacgaauagaaaaau

SEQ ID NO: 2194453 - RNA, 16 nt, Streptococcus pneumoniae R6
aacgaacuauaaaauc

SEQ ID NO: 2194454 - RNA, 17 nt, Streptococcus pneumoniae R6
aacgaacuauaaaaucu

SEQ ID NO: 2194455 - RNA, 19 nt, Streptococcus pneumoniae R6
aacgacaugcguuaaaagu

SEQ ID NO: 2194456 - RNA, 14 nt, Streptococcus pneumoniae R6
aacgacauagucaa

SEQ ID NO: 2194457 - RNA, 17 nt, Streptococcus pneumoniae R6
aacgacacgguauggaa

SEQ ID NO: 2194458 - RNA, 19 nt, Streptococcus pneumoniae R6
aaccugauaggaugcguuu

SEQ ID NO: 2194459 - RNA, 16 nt, Streptococcus pneumoniae R6
aaccucuugaaguuca

SEQ ID NO: 2194460 - RNA, 21 nt, Streptococcus pneumoniae R6
aaccugcuuaagauuguccuc

SEQ ID NO: 2194461 - RNA, 21 nt, Streptococcus pneumoniae R6
aaccugcuucagauuguccuc

SEQ ID NO: 2194462 - RNA, 14 nt, Streptococcus pneumoniae R6
aaccugcuuuaaga

SEQ ID NO: 2194463 - RNA, 20 nt, Streptococcus pneumoniae R6
aaccucuguauaaauagcua

SEQ ID NO: 2194464 - RNA, 22 nt, Streptococcus pneumoniae R6
aaccucuguauaaauagcuaca

SEQ ID NO: 2194465 - RNA, 16 nt, Streptococcus pneumoniae R6
aaccucgauaccuguu

SEQ ID NO: 2194466 - RNA, 22 nt, Streptococcus pneumoniae R6
aaccuacuguuagaacagucag

SEQ ID NO: 2194467 - RNA, 12 nt, Streptococcus pneumoniae R6
aaccucaaaaac

SEQ ID NO: 2194468 - RNA, 13 nt, Streptococcus pneumoniae R6
aaccucaaaaaca

SEQ ID NO: 2194469 - RNA, 12 nt, Streptococcus pneumoniae R6
aaccucaaaaca

SEQ ID NO: 2194470 - RNA, 15 nt, Streptococcus pneumoniae R6
aaccucaaaacaaug

SEQ ID NO: 2194471 - RNA, 13 nt, Streptococcus pneumoniae R6
aaccucaaaacac

SEQ ID NO: 2194472 - RNA, 15 nt, Streptococcus pneumoniae R6
aaccucaaaacacug

SEQ ID NO: 2194473 - RNA, 21 nt, Streptococcus pneumoniae R6
aaccucaaaacaguguuuuga

SEQ ID NO: 2194474 - RNA, 13 nt, Streptococcus pneumoniae R6
aaccucaaaacca

SEQ ID NO: 2194475 - RNA, 22 nt, Streptococcus pneumoniae R6
aaccucaaagcagugcuuugag

SEQ ID NO: 2194476 - RNA, 22 nt, Streptococcus pneumoniae R6
aaccguguuguaugaaaaguuu

SEQ ID NO: 2194477 - RNA, 23 nt, Streptococcus pneumoniae R6
aaccguaugauucguuugaagcu

SEQ ID NO: 2194478 - RNA, 13 nt, Streptococcus pneumoniae R6
aaccgucaucagc

SEQ ID NO: 2194479 - RNA, 13 nt, Streptococcus pneumoniae R6
aacgcauaaaauc

SEQ ID NO: 2194480 - RNA, 14 nt, Streptococcus pneumoniae R6
aacgcauaauacca

SEQ ID NO: 2194481 - RNA, 15 nt, Streptococcus pneumoniae R6
aacgauguuugaguu

SEQ ID NO: 2194482 - RNA, 21 nt, Streptococcus pneumoniae R6
aacgauguuugcagcaccagc

SEQ ID NO: 2194483 - RNA, 15 nt, Streptococcus pneumoniae R6
aacgauugaaauaac

SEQ ID NO: 2194484 - RNA, 18 nt, Streptococcus pneumoniae R6
aacgauauaguugacgau

SEQ ID NO: 2194485 - RNA, 22 nt, Streptococcus pneumoniae R6
aacgauaaacaagggcaaaaaa

SEQ ID NO: 2194486 - RNA, 22 nt, Streptococcus pneumoniae R6
aacgcauauuaccaagguuguu

SEQ ID NO: 2194487 - RNA, 21 nt, Streptococcus pneumoniae R6
aacgccucccaauuaaaauag

SEQ ID NO: 2194488 - RNA, 15 nt, Streptococcus pneumoniae R6
aacgcgauacaauaa

SEQ ID NO: 2194489 - RNA, 21 nt, Streptococcus pneumoniae R6
aacgcgauacaauaaaggugu

SEQ ID NO: 2194490 - RNA, 15 nt, Streptococcus pneumoniae R6
aacggcauaaaaucu

SEQ ID NO: 2194491 - RNA, 19 nt, Streptococcus pneumoniae R6
aacgguaucuguuucuguu

SEQ ID NO: 2194492 - RNA, 17 nt, Streptococcus pneumoniae R6
aacgggcaagggcugca

SEQ ID NO: 2194493 - RNA, 20 nt, Streptococcus pneumoniae R6
aacguugacuguuucgucuu

SEQ ID NO: 2194494 - RNA, 18 nt, Streptococcus pneumoniae R6
aacguuuaucacucaguu

SEQ ID NO: 2194495 - RNA, 15 nt, Streptococcus pneumoniae R6
aacguuaaagaguug

SEQ ID NO: 2194496 - RNA, 14 nt, Streptococcus pneumoniae R6
aacguggaaacucu

SEQ ID NO: 2194497 - RNA, 19 nt, Streptococcus pneumoniae R6
aacguaguuuuuuuuguaa

SEQ ID NO: 2194498 - RNA, 19 nt, Streptococcus pneumoniae R6
aacgucuucaauaccaaag

SEQ ID NO: 2194499 - RNA, 21 nt, Streptococcus pneumoniae R6
aacuagaauagaaacaaaaua

SEQ ID NO: 2194500 - RNA, 20 nt, Streptococcus pneumoniae R6
aacuacuugauaaaaguuau

SEQ ID NO: 2194501 - RNA, 21 nt, Streptococcus pneumoniae R6
aacuagaauccuaguucauga

SEQ ID NO: 2194502 - RNA, 19 nt, Streptococcus pneumoniae R6
aacuagauuucugaauauc

SEQ ID NO: 2194503 - RNA, 22 nt, Streptococcus pneumoniae R6
aacuagcaagugcuaagauaau

SEQ ID NO: 2194504 - RNA, 19 nt, Streptococcus pneumoniae R6
aacuagcauccaucccauu

SEQ ID NO: 2194505 - RNA, 13 nt, Streptococcus pneumoniae R6
aacuagagaagcc

SEQ ID NO: 2194506 - RNA, 22 nt, Streptococcus pneumoniae R6
aacuagagaguuuuuuucuuaa

SEQ ID NO: 2194507 - RNA, 14 nt, Streptococcus pneumoniae R6
aacuauaagauacu

SEQ ID NO: 2194508 - RNA, 12 nt, Streptococcus pneumoniae R6
aacuaguaaauu

SEQ ID NO: 2194509 - RNA, 21 nt, Streptococcus pneumoniae R6
aacuauaaaaucugaagaaag

SEQ ID NO: 2194510 - RNA, 23 nt, Streptococcus pneumoniae R6
aacuauaaaaucugaagaaagca

SEQ ID NO: 2194511 - RNA, 14 nt, Streptococcus pneumoniae R6
aacuaggaaacuag

SEQ ID NO: 2194512 - RNA, 19 nt, Streptococcus pneumoniae R6
aacuaggaaacuagcugca

SEQ ID NO: 2194513 - RNA, 16 nt, Streptococcus pneumoniae R6
aacuaggaagcuagcc

SEQ ID NO: 2194514 - RNA, 16 nt, Streptococcus pneumoniae R6
aacuaggacaagaaga

SEQ ID NO: 2194515 - RNA, 19 nt, Streptococcus pneumoniae R6
aacuacacccgcauaaaua

SEQ ID NO: 2194516 - RNA, 15 nt, Streptococcus pneumoniae R6
aacuacauaggcuaa

SEQ ID NO: 2194517 - RNA, 16 nt, Streptococcus pneumoniae R6
aacuacaguauagcau

SEQ ID NO: 2194518 - RNA, 20 nt, Streptococcus pneumoniae R6
aacuaaugagccuuaucaua

SEQ ID NO: 2194519 - RNA, 21 nt, Streptococcus pneumoniae R6
aacuaacccuagaaaaccaag

SEQ ID NO: 2194520 - RNA, 16 nt, Streptococcus pneumoniae R6
aacuaagcuucaaaaa

SEQ ID NO: 2194521 - RNA, 22 nt, Streptococcus pneumoniae R6
aacuaaaucuucggauaaauua

SEQ ID NO: 2194522 - RNA, 20 nt, Streptococcus pneumoniae R6
aacuaaauuccaaauuagaa

SEQ ID NO: 2194523 - RNA, 14 nt, Streptococcus pneumoniae R6
aacuaaaguuccua

SEQ ID NO: 2194524 - RNA, 17 nt, Streptococcus pneumoniae R6
aacguuuuucaaaccuu

SEQ ID NO: 2194525 - RNA, 13 nt, Streptococcus pneumoniae R6
aacuaaaaaaucu

SEQ ID NO: 2194526 - RNA, 17 nt, Streptococcus pneumoniae R6
aacucauaauagucucu

SEQ ID NO: 2194527 - RNA, 18 nt, Streptococcus pneumoniae R6
aacucauaauagucucuu

SEQ ID NO: 2194528 - RNA, 13 nt, Streptococcus pneumoniae R6
aacucaggaaaga

SEQ ID NO: 2194529 - RNA, 18 nt, Streptococcus pneumoniae R6
aacucaucaaaggucucu

SEQ ID NO: 2194530 - RNA, 16 nt, Streptococcus pneumoniae R6
aacucauagcagauaa

SEQ ID NO: 2194531 - RNA, 18 nt, Streptococcus pneumoniae R6
aacucauagcagauaagu

SEQ ID NO: 2194532 - RNA, 17 nt, Streptococcus pneumoniae R6
aacuauaguagauugaa

SEQ ID NO: 2194533 - RNA, 21 nt, Streptococcus pneumoniae R6
aacuauuaagccuucuccaau

SEQ ID NO: 2194534 - RNA, 17 nt, Streptococcus pneumoniae R6
aacuauuguagauuaua

SEQ ID NO: 2194535 - RNA, 21 nt, Streptococcus pneumoniae R6
aacuauuguagauuauaugcu

SEQ ID NO: 2194536 - RNA, 14 nt, Streptococcus pneumoniae R6
aacucaaauguaag

SEQ ID NO: 2194537 - RNA, 20 nt, Streptococcus pneumoniae R6
aacucaaguuaugcauuuuc

SEQ ID NO: 2194538 - RNA, 18 nt, Streptococcus pneumoniae R6
aacucaaauuucccauca

SEQ ID NO: 2194539 - RNA, 13 nt, Streptococcus pneumoniae R6
aacucaauuaaga

SEQ ID NO: 2194540 - RNA, 14 nt, Streptococcus pneumoniae R6
aacucaauuaagaa

SEQ ID NO: 2194541 - RNA, 13 nt, Streptococcus pneumoniae R6
aacucuauuuuug

SEQ ID NO: 2194542 - RNA, 16 nt, Streptococcus pneumoniae R6
aacucugcacguguaa

SEQ ID NO: 2194543 - RNA, 19 nt, Streptococcus pneumoniae R6
aacucugcacguguaauga

SEQ ID NO: 2194544 - RNA, 14 nt, Streptococcus pneumoniae R6
aacucucauuaaaa

SEQ ID NO: 2194545 - RNA, 22 nt, Streptococcus pneumoniae R6
aacucuccaauaucaucgauuu

SEQ ID NO: 2194546 - RNA, 14 nt, Streptococcus pneumoniae R6
aacucuugaaauau

SEQ ID NO: 2194547 - RNA, 23 nt, Streptococcus pneumoniae R6
aacucuuguucaaagugguguua

SEQ ID NO: 2194548 - RNA, 23 nt, Streptococcus pneumoniae R6
aacucuucuuuuggcaauaaaaa

SEQ ID NO: 2194549 - RNA, 22 nt, Streptococcus pneumoniae R6
aacucuucaagguuuuauacuc

SEQ ID NO: 2194550 - RNA, 15 nt, Streptococcus pneumoniae R6
aacucuuauacuuuu

SEQ ID NO: 2194551 - RNA, 15 nt, Streptococcus pneumoniae R6
aacucuuaucuaauc

SEQ ID NO: 2194552 - RNA, 16 nt, Streptococcus pneumoniae R6
aacucuggguguuucu

SEQ ID NO: 2194553 - RNA, 13 nt, Streptococcus pneumoniae R6
aacucuuacaaaa

SEQ ID NO: 2194554 - RNA, 22 nt, Streptococcus pneumoniae R6
aacucuuacaaaaaaucaaaaa

SEQ ID NO: 2194555 - RNA, 17 nt, Streptococcus pneumoniae R6
aacucgggcugaauaua

SEQ ID NO: 2194556 - RNA, 22 nt, Streptococcus pneumoniae R6
aacucgggcugaauauauucuc

SEQ ID NO: 2194557 - RNA, 13 nt, Streptococcus pneumoniae R6
aacuccucucagu

SEQ ID NO: 2194558 - RNA, 17 nt, Streptococcus pneumoniae R6
aacuccucucuccuccc

SEQ ID NO: 2194559 - RNA, 15 nt, Streptococcus pneumoniae R6
aacuccuugaaucau

SEQ ID NO: 2194560 - RNA, 20 nt, Streptococcus pneumoniae R6
aacugcugcuuggaaggaag

SEQ ID NO: 2194561 - RNA, 15 nt, Streptococcus pneumoniae R6
aacugcguuuugauu

SEQ ID NO: 2194562 - RNA, 21 nt, Streptococcus pneumoniae R6
aacugcuaaaagauuucuaua

SEQ ID NO: 2194563 - RNA, 16 nt, Streptococcus pneumoniae R6
aacugcguauuccauu

SEQ ID NO: 2194564 - RNA, 20 nt, Streptococcus pneumoniae R6
aacugcguauuccauuggaa

SEQ ID NO: 2194565 - RNA, 16 nt, Streptococcus pneumoniae R6
aacugccugguaaaga

SEQ ID NO: 2194566 - RNA, 21 nt, Streptococcus pneumoniae R6
aacugacgaagucagcucaaa

SEQ ID NO: 2194567 - RNA, 23 nt, Streptococcus pneumoniae R6
aacugacgaagucaguaaccaua

SEQ ID NO: 2194568 - RNA, 16 nt, Streptococcus pneumoniae R6
aacugaacaagacgaa

SEQ ID NO: 2194569 - RNA, 20 nt, Streptococcus pneumoniae R6
aacugaucccuccauuucau

SEQ ID NO: 2194570 - RNA, 23 nt, Streptococcus pneumoniae R6
aacugaucccuccauuucauagc

SEQ ID NO: 2194571 - RNA, 20 nt, Streptococcus pneumoniae R6
aacuguuuuaggaacaauaa

SEQ ID NO: 2194572 - RNA, 23 nt, Streptococcus pneumoniae R6
aacuguuuuaggaacaauaaaac

SEQ ID NO: 2194573 - RNA, 19 nt, Streptococcus pneumoniae R6
aacugucuaguguugucaa

SEQ ID NO: 2194574 - RNA, 14 nt, Streptococcus pneumoniae R6
aacuguggaaaaua

SEQ ID NO: 2194575 - RNA, 14 nt, Streptococcus pneumoniae R6
aacuguaugagaaa

SEQ ID NO: 2194576 - RNA, 16 nt, Streptococcus pneumoniae R6
aacuguacaagaacaa

SEQ ID NO: 2194577 - RNA, 14 nt, Streptococcus pneumoniae R6
aacuguaguggguu

SEQ ID NO: 2194578 - RNA, 20 nt, Streptococcus pneumoniae R6
aacuguaguggguugaagaa

SEQ ID NO: 2194579 - RNA, 22 nt, Streptococcus pneumoniae R6
aacuguaguggguugaagucag

SEQ ID NO: 2194580 - RNA, 18 nt, Streptococcus pneumoniae R6
aacuguaaaguagcaaaa

SEQ ID NO: 2194581 - RNA, 20 nt, Streptococcus pneumoniae R6
aacuguaaaguagcaaaaca

SEQ ID NO: 2194582 - RNA, 21 nt, Streptococcus pneumoniae R6
aacuguaaaguagcaaaacac

SEQ ID NO: 2194583 - RNA, 23 nt, Streptococcus pneumoniae R6
aacugguuaauuaauuuauuuaa

SEQ ID NO: 2194584 - RNA, 17 nt, Streptococcus pneumoniae R6
aacugguuccuuuuuag

SEQ ID NO: 2194585 - RNA, 15 nt, Streptococcus pneumoniae R6
aacuggguugaagau

SEQ ID NO: 2194586 - RNA, 22 nt, Streptococcus pneumoniae R6
aacuggugauaaguaaagcuuu

SEQ ID NO: 2194587 - RNA, 14 nt, Streptococcus pneumoniae R6
aacuggaaagauaa

SEQ ID NO: 2194588 - RNA, 20 nt, Streptococcus pneumoniae R6
aacugcuucacuagucauga

SEQ ID NO: 2194589 - RNA, 12 nt, Streptococcus pneumoniae R6
aacuggcaaaau

SEQ ID NO: 2194590 - RNA, 22 nt, Streptococcus pneumoniae R6
aacuucucauggcgaucauuau

SEQ ID NO: 2194591 - RNA, 22 nt, Streptococcus pneumoniae R6
aacuucuugaccaacuuuaaga

SEQ ID NO: 2194592 - RNA, 22 nt, Streptococcus pneumoniae R6
aacuuccaugacgcacaaacuu

SEQ ID NO: 2194593 - RNA, 23 nt, Streptococcus pneumoniae R6
aacuuccaagcgaugauauccug

SEQ ID NO: 2194594 - RNA, 13 nt, Streptococcus pneumoniae R6
aacuucauuauag

SEQ ID NO: 2194595 - RNA, 19 nt, Streptococcus pneumoniae R6
aacuucacuaguauucauc

SEQ ID NO: 2194596 - RNA, 18 nt, Streptococcus pneumoniae R6
aacuucagauucacuagc

SEQ ID NO: 2194597 - RNA, 13 nt, Streptococcus pneumoniae R6
aacuuaggaagca

SEQ ID NO: 2194598 - RNA, 16 nt, Streptococcus pneumoniae R6
aacuuacgagcacgag

SEQ ID NO: 2194599 - RNA, 19 nt, Streptococcus pneumoniae R6
aacuuacgagcacgaguca

SEQ ID NO: 2194600 - RNA, 23 nt, Streptococcus pneumoniae R6
aacuuacuccggcggagccaaug

SEQ ID NO: 2194601 - RNA, 16 nt, Streptococcus pneumoniae R6
aacuuaugagcuaggu

SEQ ID NO: 2194602 - RNA, 22 nt, Streptococcus pneumoniae R6
aacuuaucuagggcauuaauca

SEQ ID NO: 2194603 - RNA, 21 nt, Streptococcus pneumoniae R6
aacuuauccgaacccuguuuu

SEQ ID NO: 2194604 - RNA, 12 nt, Streptococcus pneumoniae R6
aacuucaacauu

SEQ ID NO: 2194605 - RNA, 15 nt, Streptococcus pneumoniae R6
aacuuuuccaguaau

SEQ ID NO: 2194606 - RNA, 17 nt, Streptococcus pneumoniae R6
aacuuuuuaaguuuuuu

SEQ ID NO: 2194607 - RNA, 16 nt, Streptococcus pneumoniae R6
aacuuuuguauuuuga

SEQ ID NO: 2194608 - RNA, 15 nt, Streptococcus pneumoniae R6
aacuuucauaaugga

SEQ ID NO: 2194609 - RNA, 13 nt, Streptococcus pneumoniae R6
aacuuuaccaaaa

SEQ ID NO: 2194610 - RNA, 24 nt, Streptococcus pneumoniae R6
aacuucuuuuugauuuauccaacu

SEQ ID NO: 2194611 - RNA, 22 nt, Streptococcus pneumoniae R6
aacuucuuuuuuugauauuuau

SEQ ID NO: 2194612 - RNA, 21 nt, Streptococcus pneumoniae R6
aacuugaauccuucguaaaua

SEQ ID NO: 2194613 - RNA, 12 nt, Streptococcus pneumoniae R6
aacuugauacua

SEQ ID NO: 2194614 - RNA, 16 nt, Streptococcus pneumoniae R6
aacuugguuugucauc

SEQ ID NO: 2194615 - RNA, 16 nt, Streptococcus pneumoniae R6
aacuugugauuuagua

SEQ ID NO: 2194616 - RNA, 23 nt, Streptococcus pneumoniae R6
aacuugugauuuaguagcaucau

SEQ ID NO: 2194617 - RNA, 14 nt, Streptococcus pneumoniae R6
aacuuuaagagcuu

SEQ ID NO: 2194618 - RNA, 23 nt, Streptococcus pneumoniae R6
aacuuguuuuuccugauuaaaau

SEQ ID NO: 2194619 - RNA, 11 nt, Streptococcus pneumoniae R6
aagaacagucu

SEQ ID NO: 2194620 - RNA, 14 nt, Streptococcus pneumoniae R6
aagaacagucucug

SEQ ID NO: 2194621 - RNA, 15 nt, Streptococcus pneumoniae R6
aagaacauuuggaag

SEQ ID NO: 2194622 - RNA, 21 nt, Streptococcus pneumoniae R6
aagaacaauuucacaacucuu

SEQ ID NO: 2194623 - RNA, 19 nt, Streptococcus pneumoniae R6
aagaaauuuucuuuuuccu

SEQ ID NO: 2194624 - RNA, 20 nt, Streptococcus pneumoniae R6
aagaaauuggcugcaauaau

SEQ ID NO: 2194625 - RNA, 13 nt, Streptococcus pneumoniae R6
aagaacaaguaaa

SEQ ID NO: 2194626 - RNA, 17 nt, Streptococcus pneumoniae R6
aagaacaaguaaagagu

SEQ ID NO: 2194627 - RNA, 18 nt, Streptococcus pneumoniae R6
aagaacaauccaaauaag

SEQ ID NO: 2194628 - RNA, 20 nt, Streptococcus pneumoniae R6
aagaacaauccaaauaagua

SEQ ID NO: 2194629 - RNA, 15 nt, Streptococcus pneumoniae R6
aagaaauugauauaa

SEQ ID NO: 2194630 - RNA, 12 nt, Streptococcus pneumoniae R6
aagaacucuuuc

SEQ ID NO: 2194631 - RNA, 14 nt, Streptococcus pneumoniae R6
aagaacucuuucca

SEQ ID NO: 2194632 - RNA, 15 nt, Streptococcus pneumoniae R6
aagaacucuuuccaa

SEQ ID NO: 2194633 - RNA, 14 nt, Streptococcus pneumoniae R6
aagaacuccaguga

SEQ ID NO: 2194634 - RNA, 21 nt, Streptococcus pneumoniae R6
aagaacuccagugaaaacagg

SEQ ID NO: 2194635 - RNA, 13 nt, Streptococcus pneumoniae R6
aagaagcuguaaa

SEQ ID NO: 2194636 - RNA, 11 nt, Streptococcus pneumoniae R6
aagaagagggc

SEQ ID NO: 2194637 - RNA, 21 nt, Streptococcus pneumoniae R6
aagaagagggcuucuucaaca

SEQ ID NO: 2194638 - RNA, 15 nt, Streptococcus pneumoniae R6
aagaagcagaaaaau

SEQ ID NO: 2194639 - RNA, 18 nt, Streptococcus pneumoniae R6
aagaagcagaaaaauuuc

SEQ ID NO: 2194640 - RNA, 22 nt, Streptococcus pneumoniae R6
aagaagauuuuuuaguucagaa

SEQ ID NO: 2194641 - RNA, 21 nt, Streptococcus pneumoniae R6
aagaagccugauggaaacauc

SEQ ID NO: 2194642 - RNA, 16 nt, Streptococcus pneumoniae R6
aagaagacuagaccac

SEQ ID NO: 2194643 - RNA, 23 nt, Streptococcus pneumoniae R6
aagaagagcauaggaaguugagc

SEQ ID NO: 2194644 - RNA, 19 nt, Streptococcus pneumoniae R6
aagaacugcuaccaauuca

SEQ ID NO: 2194645 - RNA, 23 nt, Streptococcus pneumoniae R6
aagaacuugguuugucaucguuc

SEQ ID NO: 2194646 - RNA, 19 nt, Streptococcus pneumoniae R6
aagaacuuuuuaaaguauu

SEQ ID NO: 2194647 - RNA, 18 nt, Streptococcus pneumoniae R6
aagaaaagugcaaauaag

SEQ ID NO: 2194648 - RNA, 18 nt, Streptococcus pneumoniae R6
aagaaaacuugauacuau

SEQ ID NO: 2194649 - RNA, 21 nt, Streptococcus pneumoniae R6
aagaaaacgccugcuuuuugc

SEQ ID NO: 2194650 - RNA, 16 nt, Streptococcus pneumoniae R6
aagaaacaacaaugga

SEQ ID NO: 2194651 - RNA, 19 nt, Streptococcus pneumoniae R6
aagaaacaacaauggaaau

SEQ ID NO: 2194652 - RNA, 13 nt, Streptococcus pneumoniae R6
aagaaaaacucuu

SEQ ID NO: 2194653 - RNA, 21 nt, Streptococcus pneumoniae R6
aacuuuuuuauagucuauuuc

SEQ ID NO: 2194654 - RNA, 16 nt, Streptococcus pneumoniae R6
aacuuuuuugagaaau

SEQ ID NO: 2194655 - RNA, 18 nt, Streptococcus pneumoniae R6
aagaaaccgucaucagca

SEQ ID NO: 2194656 - RNA, 14 nt, Streptococcus pneumoniae R6
aagaaagcaauuuu

SEQ ID NO: 2194657 - RNA, 21 nt, Streptococcus pneumoniae R6
aagaaagcauagagaaaaaca

SEQ ID NO: 2194658 - RNA, 23 nt, Streptococcus pneumoniae R6
aagaaaggauauaaaucucagaa

SEQ ID NO: 2194659 - RNA, 14 nt, Streptococcus pneumoniae R6
aagaaagagaauaa

SEQ ID NO: 2194660 - RNA, 16 nt, Streptococcus pneumoniae R6
aagaaagagaauaaca

SEQ ID NO: 2194661 - RNA, 13 nt, Streptococcus pneumoniae R6
aagaaagaggagu

SEQ ID NO: 2194662 - RNA, 18 nt, Streptococcus pneumoniae R6
aagaaagaccauagcaaa

SEQ ID NO: 2194663 - RNA, 24 nt, Streptococcus pneumoniae R6
aagaaagaccauagcaaaggugca

SEQ ID NO: 2194664 - RNA, 15 nt, Streptococcus pneumoniae R6
aagaaauagaaaaca

SEQ ID NO: 2194665 - RNA, 17 nt, Streptococcus pneumoniae R6
aagaaauagaaaacaaa

SEQ ID NO: 2194666 - RNA, 20 nt, Streptococcus pneumoniae R6
aagaaauaguuuagauaaaa

SEQ ID NO: 2194667 - RNA, 23 nt, Streptococcus pneumoniae R6
aagaaauaguuuagauaaaacua

SEQ ID NO: 2194668 - RNA, 23 nt, Streptococcus pneumoniae R6
aagaaaucauuggauacaaggag

SEQ ID NO: 2194669 - RNA, 15 nt, Streptococcus pneumoniae R6
aagaaauuauucuua

SEQ ID NO: 2194670 - RNA, 24 nt, Streptococcus pneumoniae R6
aaauugauuuauagaaauguuuua

SEQ ID NO: 2194671 - RNA, 13 nt, Streptococcus pneumoniae R6
aaauugauuugaa

SEQ ID NO: 2194672 - RNA, 23 nt, Streptococcus pneumoniae R6
aaauugauauaaugguuauaucu

SEQ ID NO: 2194673 - RNA, 21 nt, Streptococcus pneumoniae R6
uuucaaaagcuaauagagcug

SEQ ID NO: 2194674 - RNA, 18 nt, Streptococcus pneumoniae R6
uuucaaaaagcauucuau

SEQ ID NO: 2194675 - RNA, 22 nt, Streptococcus pneumoniae R6
uuucaaaaaaaucguaaaaaag

SEQ ID NO: 2194676 - RNA, 21 nt, Streptococcus pneumoniae R6
uuucaaaaaauugcacuuucc

SEQ ID NO: 2194677 - RNA, 16 nt, Streptococcus pneumoniae R6
aaauugguuugaauuc

SEQ ID NO: 2194678 - RNA, 21 nt, Streptococcus pneumoniae R6
aaauugguuugaauucuccaa

SEQ ID NO: 2194679 - RNA, 14 nt, Streptococcus pneumoniae R6
aaauugguguugga

SEQ ID NO: 2194680 - RNA, 18 nt, Streptococcus pneumoniae R6
aaauuggauauugaguaa

SEQ ID NO: 2194681 - RNA, 21 nt, Streptococcus pneumoniae R6
aaauuggcucaucugcaauaa

SEQ ID NO: 2194682 - RNA, 16 nt, Streptococcus pneumoniae R6
aaauuggcugcaauaa

SEQ ID NO: 2194683 - RNA, 18 nt, Streptococcus pneumoniae R6
aaauuuacuuaaaauugu

SEQ ID NO: 2194684 - RNA, 12 nt, Streptococcus pneumoniae R6
aaauuguuucau

SEQ ID NO: 2194685 - RNA, 21 nt, Streptococcus pneumoniae R6
aaauugugcaguuuucauucu

SEQ ID NO: 2194686 - RNA, 14 nt, Streptococcus pneumoniae R6
aaauuuaaaaauag

SEQ ID NO: 2194687 - RNA, 22 nt, Streptococcus pneumoniae R6
aaauugucuaagcgaaacaacc

SEQ ID NO: 2194688 - RNA, 19 nt, Streptococcus pneumoniae R6
aaauuucgaaaaaugcucu

SEQ ID NO: 2194689 - RNA, 17 nt, Streptococcus pneumoniae R6
aaauuucgauugucauc

SEQ ID NO: 2194690 - RNA, 21 nt, Streptococcus pneumoniae R6
aaauuucgauugucaucaucu

SEQ ID NO: 2194691 - RNA, 15 nt, Streptococcus pneumoniae R6
aaauuucguccuuuc

SEQ ID NO: 2194692 - RNA, 15 nt, Streptococcus pneumoniae R6
aaauuucauuuucua

SEQ ID NO: 2194693 - RNA, 21 nt, Streptococcus pneumoniae R6
aaauuucucugguuccuuauu

SEQ ID NO: 2194694 - RNA, 14 nt, Streptococcus pneumoniae R6
aaauuucuaugaua

SEQ ID NO: 2194695 - RNA, 16 nt, Streptococcus pneumoniae R6
aaauuucuaugauaaa

SEQ ID NO: 2194696 - RNA, 14 nt, Streptococcus pneumoniae R6
aaauuugaaaaucu

SEQ ID NO: 2194697 - RNA, 12 nt, Streptococcus pneumoniae R6
aaauuuauacua

SEQ ID NO: 2194698 - RNA, 13 nt, Streptococcus pneumoniae R6
aaauuuaucaacc

SEQ ID NO: 2194699 - RNA, 17 nt, Streptococcus pneumoniae R6
aaauuucauuucgacug

SEQ ID NO: 2194700 - RNA, 12 nt, Streptococcus pneumoniae R6
aaauuuucuuua

SEQ ID NO: 2194701 - RNA, 14 nt, Streptococcus pneumoniae R6
aaauuuuguccuuu

SEQ ID NO: 2194702 - RNA, 14 nt, Streptococcus pneumoniae R6
aaauuuucaaaauc

SEQ ID NO: 2194703 - RNA, 14 nt, Streptococcus pneumoniae R6
aaauuuuauacaaa

SEQ ID NO: 2194704 - RNA, 15 nt, Streptococcus pneumoniae R6
aaauuuggaaaauag

SEQ ID NO: 2194705 - RNA, 11 nt, Streptococcus pneumoniae R6
aaauuugacca

SEQ ID NO: 2194706 - RNA, 19 nt, Streptococcus pneumoniae R6
aaauuugaccauuucaacc

SEQ ID NO: 2194707 - RNA, 11 nt, Streptococcus pneumoniae R6
aaauuugacua

SEQ ID NO: 2194708 - RNA, 17 nt, Streptococcus pneumoniae R6
aaauuugaucauccaaa

SEQ ID NO: 2194709 - RNA, 18 nt, Streptococcus pneumoniae R6
aacaaccugcacauuggu

SEQ ID NO: 2194710 - RNA, 14 nt, Streptococcus pneumoniae R6
aacaaccgauaaga

SEQ ID NO: 2194711 - RNA, 22 nt, Streptococcus pneumoniae R6
aacaacaucuuuccagaacuuc

SEQ ID NO: 2194712 - RNA, 13 nt, Streptococcus pneumoniae R6
aacaagaacucuc

SEQ ID NO: 2194713 - RNA, 16 nt, Streptococcus pneumoniae R6
aacaacugauucuacu

SEQ ID NO: 2194714 - RNA, 20 nt, Streptococcus pneumoniae R6
aacaagauaggagaccagcu

SEQ ID NO: 2194715 - RNA, 22 nt, Streptococcus pneumoniae R6
aacaagaccgagaguucuuguu

SEQ ID NO: 2194716 - RNA, 17 nt, Streptococcus pneumoniae R6
aacaagccuagucuucu

SEQ ID NO: 2194717 - RNA, 17 nt, Streptococcus pneumoniae R6
aacaagggcaaaaaaga

SEQ ID NO: 2194718 - RNA, 13 nt, Streptococcus pneumoniae R6
aacaaggacagca

SEQ ID NO: 2194719 - RNA, 21 nt, Streptococcus pneumoniae R6
aacaauaaaaucaaacaaaag

SEQ ID NO: 2194720 - RNA, 14 nt, Streptococcus pneumoniae R6
aacaaguucuuuuc

SEQ ID NO: 2194721 - RNA, 16 nt, Streptococcus pneumoniae R6
aacaaguucuuuucug

SEQ ID NO: 2194722 - RNA, 20 nt, Streptococcus pneumoniae R6
aacaaguucuuuucuguuga

SEQ ID NO: 2194723 - RNA, 19 nt, Streptococcus pneumoniae R6
aacaagucuuaaaaucaca

SEQ ID NO: 2194724 - RNA, 20 nt, Streptococcus pneumoniae R6
aacaagucuuaaaaucacaa

SEQ ID NO: 2194725 - RNA, 12 nt, Streptococcus pneumoniae R6
aacaaaaauacg

SEQ ID NO: 2194726 - RNA, 13 nt, Streptococcus pneumoniae R6
aacaaaaauuuga

SEQ ID NO: 2194727 - RNA, 20 nt, Streptococcus pneumoniae R6
aacaaaaaaggucaucagca

SEQ ID NO: 2194728 - RNA, 13 nt, Streptococcus pneumoniae R6
aacaaaaaaugcu

SEQ ID NO: 2194729 - RNA, 16 nt, Streptococcus pneumoniae R6
aaauuuuucugcaaaa

SEQ ID NO: 2194730 - RNA, 19 nt, Streptococcus pneumoniae R6
aaauuuuucugcaaaaaau

SEQ ID NO: 2194731 - RNA, 20 nt, Streptococcus pneumoniae R6
aacaaaauauauaauagauu

SEQ ID NO: 2194732 - RNA, 20 nt, Streptococcus pneumoniae R6
aacaaacaucgugguacaag

SEQ ID NO: 2194733 - RNA, 15 nt, Streptococcus pneumoniae R6
aacaaaauuaucaac

SEQ ID NO: 2194734 - RNA, 19 nt, Streptococcus pneumoniae R6
aacaaauaauauguaaaga

SEQ ID NO: 2194735 - RNA, 17 nt, Streptococcus pneumoniae R6
aacaaaguucaaagcgg

SEQ ID NO: 2194736 - RNA, 21 nt, Streptococcus pneumoniae R6
aacaaagcugaauucuaaugu

SEQ ID NO: 2194737 - RNA, 13 nt, Streptococcus pneumoniae R6
aacaaacuccucu

SEQ ID NO: 2194738 - RNA, 16 nt, Streptococcus pneumoniae R6
aacaaaucagaaaagu

SEQ ID NO: 2194739 - RNA, 17 nt, Streptococcus pneumoniae R6
aacaaauuguuauuaag

SEQ ID NO: 2194740 - RNA, 18 nt, Streptococcus pneumoniae R6
aacaaauuguuauuaaga

SEQ ID NO: 2194741 - RNA, 21 nt, Streptococcus pneumoniae R6
aacaaauugauaagaggauuu

SEQ ID NO: 2194742 - RNA, 18 nt, Streptococcus pneumoniae R6
aacaacaauacuuuccaa

SEQ ID NO: 2194743 - RNA, 17 nt, Streptococcus pneumoniae R6
aacaauguuuuagaagu

SEQ ID NO: 2194744 - RNA, 16 nt, Streptococcus pneumoniae R6
aacaaugguaacaguc

SEQ ID NO: 2194745 - RNA, 22 nt, Streptococcus pneumoniae R6
aacaauuucacaacucuuauac

SEQ ID NO: 2194746 - RNA, 17 nt, Streptococcus pneumoniae R6
aacacaaaaaguccucu

SEQ ID NO: 2194747 - RNA, 12 nt, Streptococcus pneumoniae R6
aacaauagcgaa

SEQ ID NO: 2194748 - RNA, 12 nt, Streptococcus pneumoniae R6
aacaaugaaaaa

SEQ ID NO: 2194749 - RNA, 14 nt, Streptococcus pneumoniae R6
aacaaugaaaaaaa

SEQ ID NO: 2194750 - RNA, 17 nt, Streptococcus pneumoniae R6
aacaaugaaaaaaacaa

SEQ ID NO: 2194751 - RNA, 13 nt, Streptococcus pneumoniae R6
aacaaugaaaauu

SEQ ID NO: 2194752 - RNA, 23 nt, Streptococcus pneumoniae R6
aacaauggaaaugauaauugauu

SEQ ID NO: 2194753 - RNA, 12 nt, Streptococcus pneumoniae R6
aacaccugauag

SEQ ID NO: 2194754 - RNA, 14 nt, Streptococcus pneumoniae R6
aacaccgacagcaa

SEQ ID NO: 2194755 - RNA, 16 nt, Streptococcus pneumoniae R6
aacaccgacuuuacca

SEQ ID NO: 2194756 - RNA, 20 nt, Streptococcus pneumoniae R6
aacaccaucacgauuaucua

SEQ ID NO: 2194757 - RNA, 15 nt, Streptococcus pneumoniae R6
aacacccauaauauc

SEQ ID NO: 2194758 - RNA, 23 nt, Streptococcus pneumoniae R6
aacaccaauuuuacaaauaccau

SEQ ID NO: 2194759 - RNA, 23 nt, Streptococcus pneumoniae R6
aacacuagaggggugauuuuaua

SEQ ID NO: 2194760 - RNA, 12 nt, Streptococcus pneumoniae R6
aacacuccauuu

SEQ ID NO: 2194761 - RNA, 20 nt, Streptococcus pneumoniae R6
aacacuuacgacauccuauu

SEQ ID NO: 2194762 - RNA, 17 nt, Streptococcus pneumoniae R6
aacacgagaaacaauaa

SEQ ID NO: 2194763 - RNA, 17 nt, Streptococcus pneumoniae R6
aacagaggcuggacaaa

SEQ ID NO: 2194764 - RNA, 17 nt, Streptococcus pneumoniae R6
aacacuuguaaagagua

SEQ ID NO: 2194765 - RNA, 18 nt, Streptococcus pneumoniae R6
aacacuuuucaaaaaucu

SEQ ID NO: 2194766 - RNA, 14 nt, Streptococcus pneumoniae R6
aacagacaaaacua

SEQ ID NO: 2194767 - RNA, 23 nt, Streptococcus pneumoniae R6
aacagccaaaaguccaaagauga

SEQ ID NO: 2194768 - RNA, 21 nt, Streptococcus pneumoniae R6
aacagcauuuccaccugcagc

SEQ ID NO: 2194769 - RNA, 20 nt, Streptococcus pneumoniae R6
aacagccgaggguacuccuu

SEQ ID NO: 2194770 - RNA, 19 nt, Streptococcus pneumoniae R6
aacagcgagauugaagcuc

SEQ ID NO: 2194771 - RNA, 17 nt, Streptococcus pneumoniae R6
aacagcugcgauuuuag

SEQ ID NO: 2194772 - RNA, 17 nt, Streptococcus pneumoniae R6
aacagcuccuucaaguu

SEQ ID NO: 2194773 - RNA, 15 nt, Streptococcus pneumoniae R6
aacagcuccauaaca

SEQ ID NO: 2194774 - RNA, 16 nt, Streptococcus pneumoniae R6
aacagcuccauaacaa

SEQ ID NO: 2194775 - RNA, 19 nt, Streptococcus pneumoniae R6
aacagcuccauaacaauag

SEQ ID NO: 2194776 - RNA, 18 nt, Streptococcus pneumoniae R6
aacagcuccugaaauaag

SEQ ID NO: 2194777 - RNA, 18 nt, Streptococcus pneumoniae R6
aacauaaaaaacgaauag

SEQ ID NO: 2194778 - RNA, 13 nt, Streptococcus pneumoniae R6
aacauaaaugaug

SEQ ID NO: 2194779 - RNA, 22 nt, Streptococcus pneumoniae R6
aacaguuacaucaguauuucau

SEQ ID NO: 2194780 - RNA, 15 nt, Streptococcus pneumoniae R6
aacaguuaguugacc

SEQ ID NO: 2194781 - RNA, 22 nt, Streptococcus pneumoniae R6
aacaguguuuugagcaaccugc

SEQ ID NO: 2194782 - RNA, 22 nt, Streptococcus pneumoniae R6
aacaguguuuugaggcugcaga

SEQ ID NO: 2194783 - RNA, 21 nt, Streptococcus pneumoniae R6
aacaguauacuggagaauuga

SEQ ID NO: 2194784 - RNA, 17 nt, Streptococcus pneumoniae R6
aacagucucaccugcuu

SEQ ID NO: 2194785 - RNA, 14 nt, Streptococcus pneumoniae R6
aacaggauuuuguu

SEQ ID NO: 2194786 - RNA, 17 nt, Streptococcus pneumoniae R6
aacaggauuuuguucuu

SEQ ID NO: 2194787 - RNA, 18 nt, Streptococcus pneumoniae R6
aacaggauuuuguucuuu

SEQ ID NO: 2194788 - RNA, 23 nt, Streptococcus pneumoniae R6
aacaggauuuuguucuuuuucaa

SEQ ID NO: 2194789 - RNA, 16 nt, Streptococcus pneumoniae R6
aacaggccaauacaga

SEQ ID NO: 2194790 - RNA, 20 nt, Streptococcus pneumoniae R6
aacauccauaccgccaauca

SEQ ID NO: 2194791 - RNA, 14 nt, Streptococcus pneumoniae R6
aacaucaucugcau

SEQ ID NO: 2194792 - RNA, 20 nt, Streptococcus pneumoniae R6
aacauauuucuagaaauuaa

SEQ ID NO: 2194793 - RNA, 18 nt, Streptococcus pneumoniae R6
aacauauuuucaaaacug

SEQ ID NO: 2194794 - RNA, 13 nt, Streptococcus pneumoniae R6
aacauaauuuuag

SEQ ID NO: 2194795 - RNA, 20 nt, Streptococcus pneumoniae R6
aacauacugugccagccaua

SEQ ID NO: 2194796 - RNA, 15 nt, Streptococcus pneumoniae R6
aacauagauccaagc

SEQ ID NO: 2194797 - RNA, 20 nt, Streptococcus pneumoniae R6
aacauagcagauaggugggg

SEQ ID NO: 2194798 - RNA, 21 nt, Streptococcus pneumoniae R6
aacauucccacaauaaaacgc

SEQ ID NO: 2194799 - RNA, 22 nt, Streptococcus pneumoniae R6
aacauucccacaauaaaacgca

SEQ ID NO: 2194800 - RNA, 14 nt, Streptococcus pneumoniae R6
aacauucuuacaaa

SEQ ID NO: 2194801 - RNA, 12 nt, Streptococcus pneumoniae R6
aacauucuuauc

SEQ ID NO: 2194802 - RNA, 9 nt, Streptococcus pneumoniae R6
aacauucuc

SEQ ID NO: 2194803 - RNA, 13 nt, Streptococcus pneumoniae R6
aacauugugagaa

SEQ ID NO: 2194804 - RNA, 19 nt, Streptococcus pneumoniae R6
aacauugugagaaauuggu

SEQ ID NO: 2194805 - RNA, 20 nt, Streptococcus pneumoniae R6
aacauuuaucuauaaacaaa

SEQ ID NO: 2194806 - RNA, 16 nt, Streptococcus pneumoniae R6
aacauuugauuuugua

SEQ ID NO: 2194807 - RNA, 22 nt, Streptococcus pneumoniae R6
aacauuugauuuuguaaaaaua

SEQ ID NO: 2194808 - RNA, 18 nt, Streptococcus pneumoniae R6
aacauuucuauaaaucaa

SEQ ID NO: 2194809 - RNA, 23 nt, Streptococcus pneumoniae R6
aacauuucuauaaaucaauuuuc

SEQ ID NO: 2194810 - RNA, 17 nt, Streptococcus pneumoniae R6
aacauuuuaauuuugga

SEQ ID NO: 2194811 - RNA, 16 nt, Streptococcus pneumoniae R6
aaccaaaucagauaag

SEQ ID NO: 2194812 - RNA, 18 nt, Streptococcus pneumoniae R6
aaccaaaucagauaagca

SEQ ID NO: 2194813 - RNA, 18 nt, Streptococcus pneumoniae R6
aaccaaaggcauugcgcu

SEQ ID NO: 2194814 - RNA, 13 nt, Streptococcus pneumoniae R6
aaccaaaccaacg

SEQ ID NO: 2194815 - RNA, 21 nt, Streptococcus pneumoniae R6
aaccaaaaaguggaaagagca

SEQ ID NO: 2194816 - RNA, 23 nt, Streptococcus pneumoniae R6
aaccaaaaucauacuuggagaac

SEQ ID NO: 2194817 - RNA, 18 nt, Streptococcus pneumoniae R6
aaccaacauagauaaaga

SEQ ID NO: 2194818 - RNA, 12 nt, Streptococcus pneumoniae R6
aaccacaaaaaa

SEQ ID NO: 2194819 - RNA, 14 nt, Streptococcus pneumoniae R6
aaccacaaaaaagc

SEQ ID NO: 2194820 - RNA, 19 nt, Streptococcus pneumoniae R6
aaccaauuucucaaaaaag

SEQ ID NO: 2194821 - RNA, 20 nt, Streptococcus pneumoniae R6
aaccaauuucucaaaaaagu

SEQ ID NO: 2194822 - RNA, 21 nt, Streptococcus pneumoniae R6
aaccaauuucucaaaaaaguu

SEQ ID NO: 2194823 - RNA, 15 nt, Streptococcus pneumoniae R6
aaccaagucugcaug

SEQ ID NO: 2194824 - RNA, 20 nt, Streptococcus pneumoniae R6
aaccaaguuuguaucuuccu

SEQ ID NO: 2194825 - RNA, 12 nt, Streptococcus pneumoniae R6
aaccaagcuagg

SEQ ID NO: 2194826 - RNA, 18 nt, Streptococcus pneumoniae R6
aaccaacguuuugugaaa

SEQ ID NO: 2194827 - RNA, 16 nt, Streptococcus pneumoniae R6
aaccaacuucuuuuuu

SEQ ID NO: 2194828 - RNA, 14 nt, Streptococcus pneumoniae R6
aaccaacuuuuccu

SEQ ID NO: 2194829 - RNA, 16 nt, Streptococcus pneumoniae R6
aaccaacuuuugaaug

SEQ ID NO: 2194830 - RNA, 16 nt, Streptococcus pneumoniae R6
aacauggcuuccagga

SEQ ID NO: 2194831 - RNA, 13 nt, Streptococcus pneumoniae R6
aacauguuuuuga

SEQ ID NO: 2194832 - RNA, 23 nt, Streptococcus pneumoniae R6
aacaugguuuugagguuguagau

SEQ ID NO: 2194833 - RNA, 13 nt, Streptococcus pneumoniae R6
aacaucgaaagca

SEQ ID NO: 2194834 - RNA, 11 nt, Streptococcus pneumoniae R6
aacauccauuc

SEQ ID NO: 2194835 - RNA, 18 nt, Streptococcus pneumoniae R6
aacaucgucacuaacaaa

SEQ ID NO: 2194836 - RNA, 18 nt, Streptococcus pneumoniae R6
aacaugaaccucuucauu

SEQ ID NO: 2194837 - RNA, 17 nt, Streptococcus pneumoniae R6
aacaucuuuuccauauc

SEQ ID NO: 2194838 - RNA, 13 nt, Streptococcus pneumoniae R6
aacaucucagaau

SEQ ID NO: 2194839 - RNA, 17 nt, Streptococcus pneumoniae R6
aacaucucuaucaggaa

SEQ ID NO: 2194840 - RNA, 18 nt, Streptococcus pneumoniae R6
aacaucuuauuaucaagu

SEQ ID NO: 2194841 - RNA, 17 nt, Streptococcus pneumoniae R6
aacaucuggcucauauc

SEQ ID NO: 2194842 - RNA, 21 nt, Streptococcus pneumoniae R6
aacaucugguuuaauccaugg

SEQ ID NO: 2194843 - RNA, 15 nt, Streptococcus pneumoniae R6
aaccgaaaaucuccu

SEQ ID NO: 2194844 - RNA, 18 nt, Streptococcus pneumoniae R6
aaccgaaaaucuccucua

SEQ ID NO: 2194845 - RNA, 18 nt, Streptococcus pneumoniae R6
aacccuaagugucuggaa

SEQ ID NO: 2194846 - RNA, 22 nt, Streptococcus pneumoniae R6
aacccuucuuuuuauaggcucu

SEQ ID NO: 2194847 - RNA, 14 nt, Streptococcus pneumoniae R6
aacccuugauacua

SEQ ID NO: 2194848 - RNA, 17 nt, Streptococcus pneumoniae R6
aacccuugauacuaugc

SEQ ID NO: 2194849 - RNA, 16 nt, Streptococcus pneumoniae R6
aaccccgauaacagcc

SEQ ID NO: 2194850 - RNA, 18 nt, Streptococcus pneumoniae R6
aacccgcgcaauuaagca

SEQ ID NO: 2194851 - RNA, 19 nt, Streptococcus pneumoniae R6
aaccaggaaaccagcugcg

SEQ ID NO: 2194852 - RNA, 15 nt, Streptococcus pneumoniae R6
aaccagcuguaucga

SEQ ID NO: 2194853 - RNA, 20 nt, Streptococcus pneumoniae R6
aaccagcuaccagaccaagu

SEQ ID NO: 2194854 - RNA, 15 nt, Streptococcus pneumoniae R6
aaccagacauagaga

SEQ ID NO: 2194855 - RNA, 15 nt, Streptococcus pneumoniae R6
aaccagaucuuagaa

SEQ ID NO: 2194856 - RNA, 22 nt, Streptococcus pneumoniae R6
aaccaccagaguggauuugguu

SEQ ID NO: 2194857 - RNA, 12 nt, Streptococcus pneumoniae R6
aaccacaaaaag

SEQ ID NO: 2194858 - RNA, 17 nt, Streptococcus pneumoniae R6
aaccaccgacaacccag

SEQ ID NO: 2194859 - RNA, 16 nt, Streptococcus pneumoniae R6
aaccaccugagcuacg

SEQ ID NO: 2194860 - RNA, 17 nt, Streptococcus pneumoniae R6
aaccacgguaaaauacu

SEQ ID NO: 2194861 - RNA, 18 nt, Streptococcus pneumoniae R6
aaccaguuccuuugucuu

SEQ ID NO: 2194862 - RNA, 17 nt, Streptococcus pneumoniae R6
aaccaguccuggaaaaa

SEQ ID NO: 2194863 - RNA, 15 nt, Streptococcus pneumoniae R6
aaccaggucaucugc

SEQ ID NO: 2194864 - RNA, 19 nt, Streptococcus pneumoniae R6
aacccaccaagucaucaaa

SEQ ID NO: 2194865 - RNA, 12 nt, Streptococcus pneumoniae R6
aacccaccugaa

SEQ ID NO: 2194866 - RNA, 22 nt, Streptococcus pneumoniae R6
aacccacuacaguugacaaaga

SEQ ID NO: 2194867 - RNA, 13 nt, Streptococcus pneumoniae R6
aacccaaacaagc

SEQ ID NO: 2194868 - RNA, 13 nt, Streptococcus pneumoniae R6
aaccauguuuuga

SEQ ID NO: 2194869 - RNA, 22 nt, Streptococcus pneumoniae R6
aaccauguuuugagcugacuuc

SEQ ID NO: 2194870 - RNA, 18 nt, Streptococcus pneumoniae R6
accgccuucuacuuccug

SEQ ID NO: 2194871 - RNA, 16 nt, Streptococcus pneumoniae R6
accguacguaccauuc

SEQ ID NO: 2194872 - RNA, 15 nt, Streptococcus pneumoniae R6
accguauauauguua

SEQ ID NO: 2194873 - RNA, 16 nt, Streptococcus pneumoniae R6
accuaguacaaagaau

SEQ ID NO: 2194874 - RNA, 13 nt, Streptococcus pneumoniae R6
accuaaucauagu

SEQ ID NO: 2194875 - RNA, 22 nt, Streptococcus pneumoniae R6
accuaauuuuuuggcaaccucg

SEQ ID NO: 2194876 - RNA, 12 nt, Streptococcus pneumoniae R6
accuaagauuag

SEQ ID NO: 2194877 - RNA, 16 nt, Streptococcus pneumoniae R6
accuaaaauucccuua

SEQ ID NO: 2194878 - RNA, 17 nt, Streptococcus pneumoniae R6
accuaaaauucccuuau

SEQ ID NO: 2194879 - RNA, 21 nt, Streptococcus pneumoniae R6
accuaaaauucccuuauccac

SEQ ID NO: 2194880 - RNA, 18 nt, Streptococcus pneumoniae R6
accguguuguaugaaaag

SEQ ID NO: 2194881 - RNA, 23 nt, Streptococcus pneumoniae R6
accguguuugacgagugaagaau

SEQ ID NO: 2194882 - RNA, 14 nt, Streptococcus pneumoniae R6
accuauucauauau

SEQ ID NO: 2194883 - RNA, 17 nt, Streptococcus pneumoniae R6
accuauucauauaugcu

SEQ ID NO: 2194884 - RNA, 20 nt, Streptococcus pneumoniae R6
accuauuaacaauaaucuau

SEQ ID NO: 2194885 - RNA, 22 nt, Streptococcus pneumoniae R6
accucaaaaccauguuuugagc

SEQ ID NO: 2194886 - RNA, 15 nt, Streptococcus pneumoniae R6
accucaaaacagugu

SEQ ID NO: 2194887 - RNA, 22 nt, Streptococcus pneumoniae R6
accucaaaacaguguuuugagc

SEQ ID NO: 2194888 - RNA, 21 nt, Streptococcus pneumoniae R6
accucaaaacaguguuuugau

SEQ ID NO: 2194889 - RNA, 23 nt, Streptococcus pneumoniae R6
accucacggagcgagacaaaaca

SEQ ID NO: 2194890 - RNA, 18 nt, Streptococcus pneumoniae R6
accucauaucucuuguau

SEQ ID NO: 2194891 - RNA, 17 nt, Streptococcus pneumoniae R6
accucauuggaaaagau

SEQ ID NO: 2194892 - RNA, 20 nt, Streptococcus pneumoniae R6
accuccaccuugaucuucca

SEQ ID NO: 2194893 - RNA, 16 nt, Streptococcus pneumoniae R6
accuccgccuccagag

SEQ ID NO: 2194894 - RNA, 22 nt, Streptococcus pneumoniae R6
accugaaauauacucauaaagu

SEQ ID NO: 2194895 - RNA, 13 nt, Streptococcus pneumoniae R6
accugaaaccauu

SEQ ID NO: 2194896 - RNA, 22 nt, Streptococcus pneumoniae R6
accugacgaaagacuugauuuu

SEQ ID NO: 2194897 - RNA, 15 nt, Streptococcus pneumoniae R6
accugaucaaagggc

SEQ ID NO: 2194898 - RNA, 21 nt, Streptococcus pneumoniae R6
accugaaucuccucaggaacu

SEQ ID NO: 2194899 - RNA, 23 nt, Streptococcus pneumoniae R6
accucuaucuuaguaguuuguau

SEQ ID NO: 2194900 - RNA, 23 nt, Streptococcus pneumoniae R6
accucugguaugaucuauuccua

SEQ ID NO: 2194901 - RNA, 18 nt, Streptococcus pneumoniae R6
accuuauccaauucuuca

SEQ ID NO: 2194902 - RNA, 19 nt, Streptococcus pneumoniae R6
accuucaauuccuucugga

SEQ ID NO: 2194903 - RNA, 16 nt, Streptococcus pneumoniae R6
accuuacucuacagau

SEQ ID NO: 2194904 - RNA, 17 nt, Streptococcus pneumoniae R6
accuuacucuacagauu

SEQ ID NO: 2194905 - RNA, 21 nt, Streptococcus pneumoniae R6
accuuaaucuuggcaaaacgu

SEQ ID NO: 2194906 - RNA, 23 nt, Streptococcus pneumoniae R6
accuuaaaaugaaauuccucuag

SEQ ID NO: 2194907 - RNA, 15 nt, Streptococcus pneumoniae R6
accuuaaaacagugu

SEQ ID NO: 2194908 - RNA, 16 nt, Streptococcus pneumoniae R6
accuuaaaacaguguu

SEQ ID NO: 2194909 - RNA, 12 nt, Streptococcus pneumoniae R6
accuguuuucac

SEQ ID NO: 2194910 - RNA, 15 nt, Streptococcus pneumoniae R6
accuguaauuugguu

SEQ ID NO: 2194911 - RNA, 19 nt, Streptococcus pneumoniae R6
accuguuugaaucaauucu

SEQ ID NO: 2194912 - RNA, 22 nt, Streptococcus pneumoniae R6
accuguuaagccuauucccuga

SEQ ID NO: 2194913 - RNA, 14 nt, Streptococcus pneumoniae R6
accuguccaacaga

SEQ ID NO: 2194914 - RNA, 21 nt, Streptococcus pneumoniae R6
accugcuaccguugaaaucaa

SEQ ID NO: 2194915 - RNA, 16 nt, Streptococcus pneumoniae R6
accugcuacugcaucc

SEQ ID NO: 2194916 - RNA, 17 nt, Streptococcus pneumoniae R6
accugcacauugguucu

SEQ ID NO: 2194917 - RNA, 15 nt, Streptococcus pneumoniae R6
accugcaguucccac

SEQ ID NO: 2194918 - RNA, 19 nt, Streptococcus pneumoniae R6
accugcagcgauugaaaca

SEQ ID NO: 2194919 - RNA, 21 nt, Streptococcus pneumoniae R6
accugcagcgauugaaacagc

SEQ ID NO: 2194920 - RNA, 17 nt, Streptococcus pneumoniae R6
accuucaggagauaaaa

SEQ ID NO: 2194921 - RNA, 14 nt, Streptococcus pneumoniae R6
accuucuucuguga

SEQ ID NO: 2194922 - RNA, 14 nt, Streptococcus pneumoniae R6
accuugaauuuugu

SEQ ID NO: 2194923 - RNA, 18 nt, Streptococcus pneumoniae R6
accuucuuuguaggcuuc

SEQ ID NO: 2194924 - RNA, 15 nt, Streptococcus pneumoniae R6
accuugcaaaaaaac

SEQ ID NO: 2194925 - RNA, 14 nt, Streptococcus pneumoniae R6
accuugaucuucca

SEQ ID NO: 2194926 - RNA, 21 nt, Streptococcus pneumoniae R6
accuugaucuuccauuucuuu

SEQ ID NO: 2194927 - RNA, 14 nt, Streptococcus pneumoniae R6
accuugaucaauca

SEQ ID NO: 2194928 - RNA, 23 nt, Streptococcus pneumoniae R6
accuugguaguggagaguucacg

SEQ ID NO: 2194929 - RNA, 20 nt, Streptococcus pneumoniae R6
accuuguccgcauagccaaa

SEQ ID NO: 2194930 - RNA, 19 nt, Streptococcus pneumoniae R6
accuuuguauggaaacuca

SEQ ID NO: 2194931 - RNA, 21 nt, Streptococcus pneumoniae R6
accuuuguauggaaacucaaa

SEQ ID NO: 2194932 - RNA, 17 nt, Streptococcus pneumoniae R6
accuuuuccuucauuuc

SEQ ID NO: 2194933 - RNA, 16 nt, Streptococcus pneumoniae R6
accuuuucucaauacu

SEQ ID NO: 2194934 - RNA, 13 nt, Streptococcus pneumoniae R6
accuuugaaaaaa

SEQ ID NO: 2194935 - RNA, 19 nt, Streptococcus pneumoniae R6
accuuugaaaacugaacaa

SEQ ID NO: 2194936 - RNA, 20 nt, Streptococcus pneumoniae R6
accuuugaaaacugaacaag

SEQ ID NO: 2194937 - RNA, 13 nt, Streptococcus pneumoniae R6
accuuucucagau

SEQ ID NO: 2194938 - RNA, 14 nt, Streptococcus pneumoniae R6
accuuucucagaua

SEQ ID NO: 2194939 - RNA, 15 nt, Streptococcus pneumoniae R6
accuuuauuauuaau

SEQ ID NO: 2194940 - RNA, 16 nt, Streptococcus pneumoniae R6
accuuuaaauccugca

SEQ ID NO: 2194941 - RNA, 20 nt, Streptococcus pneumoniae R6
accuuuuugcgcaauuugac

SEQ ID NO: 2194942 - RNA, 21 nt, Streptococcus pneumoniae R6
accuuuuugcgcaauuugacg

SEQ ID NO: 2194943 - RNA, 22 nt, Streptococcus pneumoniae R6
acgaaaaguagggcgauaaaau

SEQ ID NO: 2194944 - RNA, 16 nt, Streptococcus pneumoniae R6
acgaacaaaaagugau

SEQ ID NO: 2194945 - RNA, 12 nt, Streptococcus pneumoniae R6
acgaaaggauua

SEQ ID NO: 2194946 - RNA, 19 nt, Streptococcus pneumoniae R6
acgaaaggauuauaaaagc

SEQ ID NO: 2194947 - RNA, 17 nt, Streptococcus pneumoniae R6
acgaccaguacggccag

SEQ ID NO: 2194948 - RNA, 15 nt, Streptococcus pneumoniae R6
acgaccaaucuuuuc

SEQ ID NO: 2194949 - RNA, 19 nt, Streptococcus pneumoniae R6
acgacauagucaaagaguu

SEQ ID NO: 2194950 - RNA, 23 nt, Streptococcus pneumoniae R6
acgacgauuccguuugagaagaa

SEQ ID NO: 2194951 - RNA, 17 nt, Streptococcus pneumoniae R6
acgagaaacaauaaaau

SEQ ID NO: 2194952 - RNA, 21 nt, Streptococcus pneumoniae R6
acgagaaacaauaaaaucaaa

SEQ ID NO: 2194953 - RNA, 23 nt, Streptococcus pneumoniae R6
acgacuuucugauggauuuauag

SEQ ID NO: 2194954 - RNA, 14 nt, Streptococcus pneumoniae R6
acgacuaauuucaa

SEQ ID NO: 2194955 - RNA, 15 nt, Streptococcus pneumoniae R6
acgacuaauuucaaa

SEQ ID NO: 2194956 - RNA, 18 nt, Streptococcus pneumoniae R6
acgacgggcuaauugaca

SEQ ID NO: 2194957 - RNA, 17 nt, Streptococcus pneumoniae R6
acgaaccacacuuucau

SEQ ID NO: 2194958 - RNA, 19 nt, Streptococcus pneumoniae R6
acgaacgccuuaaaaaacc

SEQ ID NO: 2194959 - RNA, 17 nt, Streptococcus pneumoniae R6
acgaacggguucuucca

SEQ ID NO: 2194960 - RNA, 22 nt, Streptococcus pneumoniae R6
acgaacugcgacguuuucuccu

SEQ ID NO: 2194961 - RNA, 14 nt, Streptococcus pneumoniae R6
acgaaguccuuguu

SEQ ID NO: 2194962 - RNA, 21 nt, Streptococcus pneumoniae R6
acgaagucagcucaaaacaca

SEQ ID NO: 2194963 - RNA, 14 nt, Streptococcus pneumoniae R6
acgaagaaggaaga

SEQ ID NO: 2194964 - RNA, 17 nt, Streptococcus pneumoniae R6
acgaagaaggaagaguc

SEQ ID NO: 2194965 - RNA, 16 nt, Streptococcus pneumoniae R6
acgaauuagguugacc

SEQ ID NO: 2194966 - RNA, 16 nt, Streptococcus pneumoniae R6
acgaaucucuuuccac

SEQ ID NO: 2194967 - RNA, 22 nt, Streptococcus pneumoniae R6
acgaaucaauacagaagaaaaa

SEQ ID NO: 2194968 - RNA, 14 nt, Streptococcus pneumoniae R6
acgaauauccucuu

SEQ ID NO: 2194969 - RNA, 16 nt, Streptococcus pneumoniae R6
acgauguuugcagcac

SEQ ID NO: 2194970 - RNA, 19 nt, Streptococcus pneumoniae R6
acgauguuugcagcaccag

SEQ ID NO: 2194971 - RNA, 22 nt, Streptococcus pneumoniae R6
acgaugaccguugacuuccuua

SEQ ID NO: 2194972 - RNA, 13 nt, Streptococcus pneumoniae R6
acgaugaccaaga

SEQ ID NO: 2194973 - RNA, 13 nt, Streptococcus pneumoniae R6
acgaucugaaaua

SEQ ID NO: 2194974 - RNA, 18 nt, Streptococcus pneumoniae R6
acgauucaucaagagaca

SEQ ID NO: 2194975 - RNA, 15 nt, Streptococcus pneumoniae R6
acgauuccaaacaac

SEQ ID NO: 2194976 - RNA, 24 nt, Streptococcus pneumoniae R6
acgauucccacaagggauagcaca

SEQ ID NO: 2194977 - RNA, 15 nt, Streptococcus pneumoniae R6
acgauuggacucagu

SEQ ID NO: 2194978 - RNA, 13 nt, Streptococcus pneumoniae R6
acgauuuucucuu

SEQ ID NO: 2194979 - RNA, 17 nt, Streptococcus pneumoniae R6
acgauuuucucuuuguu

SEQ ID NO: 2194980 - RNA, 19 nt, Streptococcus pneumoniae R6
acgauuuuuuucaaacaau

SEQ ID NO: 2194981 - RNA, 14 nt, Streptococcus pneumoniae R6
acgauuuuuucuuu

SEQ ID NO: 2194982 - RNA, 13 nt, Streptococcus pneumoniae R6
acgaguuaaaaca

SEQ ID NO: 2194983 - RNA, 15 nt, Streptococcus pneumoniae R6
acgaguuaaaacaaa

SEQ ID NO: 2194984 - RNA, 19 nt, Streptococcus pneumoniae R6
acgaguuaaaacaaagaaa

SEQ ID NO: 2194985 - RNA, 20 nt, Streptococcus pneumoniae R6
acgaguuaaaacaaagaaaa

SEQ ID NO: 2194986 - RNA, 17 nt, Streptococcus pneumoniae R6
acgagucaagucaacuu

SEQ ID NO: 2194987 - RNA, 13 nt, Streptococcus pneumoniae R6
acgauaaauuccc

SEQ ID NO: 2194988 - RNA, 14 nt, Streptococcus pneumoniae R6
acgaucaaucaauu

SEQ ID NO: 2194989 - RNA, 15 nt, Streptococcus pneumoniae R6
acgauacuguaguuu

SEQ ID NO: 2194990 - RNA, 18 nt, Streptococcus pneumoniae R6
acgauagcaccaaaagca

SEQ ID NO: 2194991 - RNA, 15 nt, Streptococcus pneumoniae R6
accaaaggaagcuga

SEQ ID NO: 2194992 - RNA, 14 nt, Streptococcus pneumoniae R6
accaaaaaguggaa

SEQ ID NO: 2194993 - RNA, 17 nt, Streptococcus pneumoniae R6
accaaaaccaaucaauu

SEQ ID NO: 2194994 - RNA, 15 nt, Streptococcus pneumoniae R6
accaaacuuucccuu

SEQ ID NO: 2194995 - RNA, 19 nt, Streptococcus pneumoniae R6
accaaaacgccaucuucca

SEQ ID NO: 2194996 - RNA, 16 nt, Streptococcus pneumoniae R6
accaaacggauuuuuu

SEQ ID NO: 2194997 - RNA, 22 nt, Streptococcus pneumoniae R6
accaaaaaaaauacaguaucca

SEQ ID NO: 2194998 - RNA, 14 nt, Streptococcus pneumoniae R6
accaaaaaaacucc

SEQ ID NO: 2194999 - RNA, 20 nt, Streptococcus pneumoniae R6
acauuuaagccuuuuugaau

SEQ ID NO: 2195000 - RNA, 14 nt, Streptococcus pneumoniae R6
acauguguuaccau

SEQ ID NO: 2195001 - RNA, 22 nt, Streptococcus pneumoniae R6
acaugguuuugagguuguagau

SEQ ID NO: 2195002 - RNA, 15 nt, Streptococcus pneumoniae R6
accaauucaguaacu

SEQ ID NO: 2195003 - RNA, 13 nt, Streptococcus pneumoniae R6
accaaucauuugg

SEQ ID NO: 2195004 - RNA, 24 nt, Streptococcus pneumoniae R6
accaaucccaugucaauucucacu

SEQ ID NO: 2195005 - RNA, 14 nt, Streptococcus pneumoniae R6
accaauauuagucg

SEQ ID NO: 2195006 - RNA, 24 nt, Streptococcus pneumoniae R6
accaauauuagucggaaucuuuaa

SEQ ID NO: 2195007 - RNA, 14 nt, Streptococcus pneumoniae R6
accaaucaaaucaa

SEQ ID NO: 2195008 - RNA, 15 nt, Streptococcus pneumoniae R6
accaaucaaucgucc

SEQ ID NO: 2195009 - RNA, 14 nt, Streptococcus pneumoniae R6
accaauuuuacaaa

SEQ ID NO: 2195010 - RNA, 14 nt, Streptococcus pneumoniae R6
accacaugacauua

SEQ ID NO: 2195011 - RNA, 19 nt, Streptococcus pneumoniae R6
accacaugacauuauuuuc

SEQ ID NO: 2195012 - RNA, 17 nt, Streptococcus pneumoniae R6
accacaaacaaggugaa

SEQ ID NO: 2195013 - RNA, 17 nt, Streptococcus pneumoniae R6
accaagcuaucagagau

SEQ ID NO: 2195014 - RNA, 15 nt, Streptococcus pneumoniae R6
accaacuucuuuuuu

SEQ ID NO: 2195015 - RNA, 21 nt, Streptococcus pneumoniae R6
accaacuucuuuuuuugauau

SEQ ID NO: 2195016 - RNA, 17 nt, Streptococcus pneumoniae R6
accaaggauugucugaa

SEQ ID NO: 2195017 - RNA, 13 nt, Streptococcus pneumoniae R6
accaacuuuuccu

SEQ ID NO: 2195018 - RNA, 14 nt, Streptococcus pneumoniae R6
accaagucugcaug

SEQ ID NO: 2195019 - RNA, 16 nt, Streptococcus pneumoniae R6
accaaguauuggcaaa

SEQ ID NO: 2195020 - RNA, 17 nt, Streptococcus pneumoniae R6
accaacauagauaaaga

SEQ ID NO: 2195021 - RNA, 15 nt, Streptococcus pneumoniae R6
accaaccucagaauc

SEQ ID NO: 2195022 - RNA, 14 nt, Streptococcus pneumoniae R6
accagaaauaaaag

SEQ ID NO: 2195023 - RNA, 18 nt, Streptococcus pneumoniae R6
accagaauagcugucaaa

SEQ ID NO: 2195024 - RNA, 14 nt, Streptococcus pneumoniae R6
accagacauagaga

SEQ ID NO: 2195025 - RNA, 14 nt, Streptococcus pneumoniae R6
accagccaagacac

SEQ ID NO: 2195026 - RNA, 20 nt, Streptococcus pneumoniae R6
accagcaguaucaaucauga

SEQ ID NO: 2195027 - RNA, 12 nt, Streptococcus pneumoniae R6
accagagcgacu

SEQ ID NO: 2195028 - RNA, 22 nt, Streptococcus pneumoniae R6
accagaugagacgagcaguucc

SEQ ID NO: 2195029 - RNA, 13 nt, Streptococcus pneumoniae R6
accagauauacca

SEQ ID NO: 2195030 - RNA, 12 nt, Streptococcus pneumoniae R6
accaccgaccuc

SEQ ID NO: 2195031 - RNA, 17 nt, Streptococcus pneumoniae R6
accacgaaguccuuguu

SEQ ID NO: 2195032 - RNA, 15 nt, Streptococcus pneumoniae R6
accaguuucuucuuu

SEQ ID NO: 2195033 - RNA, 23 nt, Streptococcus pneumoniae R6
accaguuguggcgacuuccuugc

SEQ ID NO: 2195034 - RNA, 19 nt, Streptococcus pneumoniae R6
accaguuccuuugucuuua

SEQ ID NO: 2195035 - RNA, 16 nt, Streptococcus pneumoniae R6
accaguccuugaaaaa

SEQ ID NO: 2195036 - RNA, 21 nt, Streptococcus pneumoniae R6
accagucgagacauaccauuu

SEQ ID NO: 2195037 - RNA, 18 nt, Streptococcus pneumoniae R6
accauaaaucuugauguc

SEQ ID NO: 2195038 - RNA, 17 nt, Streptococcus pneumoniae R6
accauaguguuucucug

SEQ ID NO: 2195039 - RNA, 14 nt, Streptococcus pneumoniae R6
acccaccaagucau

SEQ ID NO: 2195040 - RNA, 16 nt, Streptococcus pneumoniae R6
acccaccaagucauca

SEQ ID NO: 2195041 - RNA, 19 nt, Streptococcus pneumoniae R6
accauuagauuucaggugu

SEQ ID NO: 2195042 - RNA, 15 nt, Streptococcus pneumoniae R6
accauucaauucugg

SEQ ID NO: 2195043 - RNA, 16 nt, Streptococcus pneumoniae R6
accaucauuuuuagau

SEQ ID NO: 2195044 - RNA, 17 nt, Streptococcus pneumoniae R6
accaucaucagcauaau

SEQ ID NO: 2195045 - RNA, 15 nt, Streptococcus pneumoniae R6
accccauccgcccca

SEQ ID NO: 2195046 - RNA, 15 nt, Streptococcus pneumoniae R6
accccaacuuacauu

SEQ ID NO: 2195047 - RNA, 12 nt, Streptococcus pneumoniae R6
accccaaauucc

SEQ ID NO: 2195048 - RNA, 13 nt, Streptococcus pneumoniae R6
accccaaauuccu

SEQ ID NO: 2195049 - RNA, 23 nt, Streptococcus pneumoniae R6
acagcugucgcaccugacuccau

SEQ ID NO: 2195050 - RNA, 18 nt, Streptococcus pneumoniae R6
acagcuugagauuucacg

SEQ ID NO: 2195051 - RNA, 19 nt, Streptococcus pneumoniae R6
acagcuuguugcuuuucuu

SEQ ID NO: 2195052 - RNA, 20 nt, Streptococcus pneumoniae R6
acagcuuguugcuuuucuuc

SEQ ID NO: 2195053 - RNA, 19 nt, Streptococcus pneumoniae R6
acagcugcgauaaggaagu

SEQ ID NO: 2195054 - RNA, 15 nt, Streptococcus pneumoniae R6
acagcugcgauuuua

SEQ ID NO: 2195055 - RNA, 22 nt, Streptococcus pneumoniae R6
acaggacguccgugaggacagu

SEQ ID NO: 2195056 - RNA, 20 nt, Streptococcus pneumoniae R6
acaggauguguaaaaaagua

SEQ ID NO: 2195057 - RNA, 22 nt, Streptococcus pneumoniae R6
acaggauuaccuuugaaaaaau

SEQ ID NO: 2195058 - RNA, 13 nt, Streptococcus pneumoniae R6
acaggauuuuguu

SEQ ID NO: 2195059 - RNA, 19 nt, Streptococcus pneumoniae R6
acaggcaaccaaaaucaua

SEQ ID NO: 2195060 - RNA, 12 nt, Streptococcus pneumoniae R6
acagccaucaga

SEQ ID NO: 2195061 - RNA, 13 nt, Streptococcus pneumoniae R6
acagccauggugu

SEQ ID NO: 2195062 - RNA, 14 nt, Streptococcus pneumoniae R6
acagccuugacucc

SEQ ID NO: 2195063 - RNA, 21 nt, Streptococcus pneumoniae R6
acagcgcuggucacgaccaga

SEQ ID NO: 2195064 - RNA, 15 nt, Streptococcus pneumoniae R6
acagcgccuguugcu

SEQ ID NO: 2195065 - RNA, 13 nt, Streptococcus pneumoniae R6
acagagcuugaag

SEQ ID NO: 2195066 - RNA, 21 nt, Streptococcus pneumoniae R6
acagaguacuaaauauaagau

SEQ ID NO: 2195067 - RNA, 17 nt, Streptococcus pneumoniae R6
acagagguggaaaagca

SEQ ID NO: 2195068 - RNA, 17 nt, Streptococcus pneumoniae R6
acagauuugaaaacuga

SEQ ID NO: 2195069 - RNA, 20 nt, Streptococcus pneumoniae R6
acagauuugaaaacugauga

SEQ ID NO: 2195070 - RNA, 22 nt, Streptococcus pneumoniae R6
acagauucaucacgaucaaagu

SEQ ID NO: 2195071 - RNA, 18 nt, Streptococcus pneumoniae R6
aauuucaggagaaaaugg

SEQ ID NO: 2195072 - RNA, 18 nt, Streptococcus pneumoniae R6
aauuucagaagaaaaaaa

SEQ ID NO: 2195073 - RNA, 21 nt, Streptococcus pneumoniae R6
aauuucagaagaaaaaaagua

SEQ ID NO: 2195074 - RNA, 14 nt, Streptococcus pneumoniae R6
acagacaaaacuaa

SEQ ID NO: 2195075 - RNA, 14 nt, Streptococcus pneumoniae R6
acagacaaaacugg

SEQ ID NO: 2195076 - RNA, 15 nt, Streptococcus pneumoniae R6
acacuuuuauuaugg

SEQ ID NO: 2195077 - RNA, 13 nt, Streptococcus pneumoniae R6
acagagaagaaau

SEQ ID NO: 2195078 - RNA, 14 nt, Streptococcus pneumoniae R6
acagagaagaaauu

SEQ ID NO: 2195079 - RNA, 13 nt, Streptococcus pneumoniae R6
acacuucuacuau

SEQ ID NO: 2195080 - RNA, 13 nt, Streptococcus pneumoniae R6
acacuucuacuuc

SEQ ID NO: 2195081 - RNA, 20 nt, Streptococcus pneumoniae R6
acacuuaggcuauccagaua

SEQ ID NO: 2195082 - RNA, 12 nt, Streptococcus pneumoniae R6
acacuguuuuaa

SEQ ID NO: 2195083 - RNA, 14 nt, Streptococcus pneumoniae R6
acacuguuuuaagg

SEQ ID NO: 2195084 - RNA, 13 nt, Streptococcus pneumoniae R6
acacuuucauuga

SEQ ID NO: 2195085 - RNA, 14 nt, Streptococcus pneumoniae R6
acauaauuuaaaau

SEQ ID NO: 2195086 - RNA, 21 nt, Streptococcus pneumoniae R6
acauaauuuuaguagaaaaug

SEQ ID NO: 2195087 - RNA, 17 nt, Streptococcus pneumoniae R6
acauauucccacaauaa

SEQ ID NO: 2195088 - RNA, 16 nt, Streptococcus pneumoniae R6
acauauugauauuuau

SEQ ID NO: 2195089 - RNA, 17 nt, Streptococcus pneumoniae R6
acauauugauauuuaua

SEQ ID NO: 2195090 - RNA, 19 nt, Streptococcus pneumoniae R6
acaucaaaaacagccgaaa

SEQ ID NO: 2195091 - RNA, 14 nt, Streptococcus pneumoniae R6
acauccaccagcua

SEQ ID NO: 2195092 - RNA, 20 nt, Streptococcus pneumoniae R6
acaugcaaguagaacgcuga

SEQ ID NO: 2195093 - RNA, 20 nt, Streptococcus pneumoniae R6
acauggaaauuauaaaacca

SEQ ID NO: 2195094 - RNA, 18 nt, Streptococcus pneumoniae R6
acaugagaauacaaaaau

SEQ ID NO: 2195095 - RNA, 18 nt, Streptococcus pneumoniae R6
acaugacaaauucuccac

SEQ ID NO: 2195096 - RNA, 21 nt, Streptococcus pneumoniae R6
acaugacaaauucuccacaga

SEQ ID NO: 2195097 - RNA, 21 nt, Streptococcus pneumoniae R6
acaucuggcucauaucuggca

SEQ ID NO: 2195098 - RNA, 18 nt, Streptococcus pneumoniae R6
acaucucuuguaacccaa

SEQ ID NO: 2195099 - RNA, 22 nt, Streptococcus pneumoniae R6
acaucucuuguuuaagagcaca

SEQ ID NO: 2195100 - RNA, 15 nt, Streptococcus pneumoniae R6
acaucuguuuuaaac

SEQ ID NO: 2195101 - RNA, 18 nt, Streptococcus pneumoniae R6
acaucuggguuaaaaauu

SEQ ID NO: 2195102 - RNA, 19 nt, Streptococcus pneumoniae R6
acaucugucgcaaggaugc

SEQ ID NO: 2195103 - RNA, 23 nt, Streptococcus pneumoniae R6
acaucugucgcaaggaugccagc

SEQ ID NO: 2195104 - RNA, 15 nt, Streptococcus pneumoniae R6
acaucuuauuaucaa

SEQ ID NO: 2195105 - RNA, 17 nt, Streptococcus pneumoniae R6
acaucuuauuaucaagu

SEQ ID NO: 2195106 - RNA, 14 nt, Streptococcus pneumoniae R6
acaucuuauuucaa

SEQ ID NO: 2195107 - RNA, 13 nt, Streptococcus pneumoniae R6
acaucuaccuauu

SEQ ID NO: 2195108 - RNA, 14 nt, Streptococcus pneumoniae R6
acaucuaaauaaua

SEQ ID NO: 2195109 - RNA, 16 nt, Streptococcus pneumoniae R6
acauaaucaagaugaa

SEQ ID NO: 2195110 - RNA, 23 nt, Streptococcus pneumoniae R6
acaguugcaucuuaguuaaaaua

SEQ ID NO: 2195111 - RNA, 13 nt, Streptococcus pneumoniae R6
acaguugacaaag

SEQ ID NO: 2195112 - RNA, 14 nt, Streptococcus pneumoniae R6
acaguugacaaaga

SEQ ID NO: 2195113 - RNA, 23 nt, Streptococcus pneumoniae R6
acaguugacaaagagccauaaaa

SEQ ID NO: 2195114 - RNA, 19 nt, Streptococcus pneumoniae R6
acaguguuuuaagcugacu

SEQ ID NO: 2195115 - RNA, 17 nt, Streptococcus pneumoniae R6
acaguguuuugagcagc

SEQ ID NO: 2195116 - RNA, 19 nt, Streptococcus pneumoniae R6
acaguguuuugagcugacu

SEQ ID NO: 2195117 - RNA, 18 nt, Streptococcus pneumoniae R6
acaguguuuugaggcugc

SEQ ID NO: 2195118 - RNA, 22 nt, Streptococcus pneumoniae R6
acagugggcuauuccauauuca

SEQ ID NO: 2195119 - RNA, 16 nt, Streptococcus pneumoniae R6
acagugauuaaaacug

SEQ ID NO: 2195120 - RNA, 19 nt, Streptococcus pneumoniae R6
acagugaaggcuuuaaaug

SEQ ID NO: 2195121 - RNA, 21 nt, Streptococcus pneumoniae R6
acagucgcaaagaggaagagg

SEQ ID NO: 2195122 - RNA, 14 nt, Streptococcus pneumoniae R6
acagucugaaaaag

SEQ ID NO: 2195123 - RNA, 15 nt, Streptococcus pneumoniae R6
acagucugaaaaaga

SEQ ID NO: 2195124 - RNA, 17 nt, Streptococcus pneumoniae R6
acagucugaaaaagagg

SEQ ID NO: 2195125 - RNA, 14 nt, Streptococcus pneumoniae R6
acagucugaaaaau

SEQ ID NO: 2195126 - RNA, 20 nt, Streptococcus pneumoniae R6
acaguccucccuuguuuuua

SEQ ID NO: 2195127 - RNA, 21 nt, Streptococcus pneumoniae R6
acaguccucccuuguuuuuau

SEQ ID NO: 2195128 - RNA, 16 nt, Streptococcus pneumoniae R6
acaguccuuguuucca

SEQ ID NO: 2195129 - RNA, 17 nt, Streptococcus pneumoniae R6
acaguccuuguuuccau

SEQ ID NO: 2195130 - RNA, 22 nt, Streptococcus pneumoniae R6
acaguacacaggaauacuaaaa

SEQ ID NO: 2195131 - RNA, 20 nt, Streptococcus pneumoniae R6
acaguauuuauaaacuuuau

SEQ ID NO: 2195132 - RNA, 23 nt, Streptococcus pneumoniae R6
acagguguuauuagcugauuaug

SEQ ID NO: 2195133 - RNA, 20 nt, Streptococcus pneumoniae R6
acaguaacguucuuuucaag

SEQ ID NO: 2195134 - RNA, 15 nt, Streptococcus pneumoniae R6
acaguaacccauacc

SEQ ID NO: 2195135 - RNA, 12 nt, Streptococcus pneumoniae R6
acaguaaaaaau

SEQ ID NO: 2195136 - RNA, 14 nt, Streptococcus pneumoniae R6
acaguaaaaaauca

SEQ ID NO: 2195137 - RNA, 18 nt, Streptococcus pneumoniae R6
acaguaaaaaaucauuuu

SEQ ID NO: 2195138 - RNA, 16 nt, Streptococcus pneumoniae R6
acaggucaauggcaaa

SEQ ID NO: 2195139 - RNA, 21 nt, Streptococcus pneumoniae R6
agaagauuggucaaucuuauc

SEQ ID NO: 2195140 - RNA, 18 nt, Streptococcus pneumoniae R6
agaagauuucagaaauau

SEQ ID NO: 2195141 - RNA, 13 nt, Streptococcus pneumoniae R6
agaagccaaaauc

SEQ ID NO: 2195142 - RNA, 15 nt, Streptococcus pneumoniae R6
agaagcaagugacaa

SEQ ID NO: 2195143 - RNA, 13 nt, Streptococcus pneumoniae R6
agaagcagaaaaa

SEQ ID NO: 2195144 - RNA, 17 nt, Streptococcus pneumoniae R6
agaagcagaaaaauuuc

SEQ ID NO: 2195145 - RNA, 18 nt, Streptococcus pneumoniae R6
agaagcagaaaaauuuca

SEQ ID NO: 2195146 - RNA, 22 nt, Streptococcus pneumoniae R6
agaacuuuaguuugaguugcgu

SEQ ID NO: 2195147 - RNA, 13 nt, Streptococcus pneumoniae R6
agaacuuuuuaaa

SEQ ID NO: 2195148 - RNA, 14 nt, Streptococcus pneumoniae R6
agaacuuuuuaaag

SEQ ID NO: 2195149 - RNA, 20 nt, Streptococcus pneumoniae R6
agaaguagauacgcucagca

SEQ ID NO: 2195150 - RNA, 14 nt, Streptococcus pneumoniae R6
agaagucaccauaa

SEQ ID NO: 2195151 - RNA, 19 nt, Streptococcus pneumoniae R6
agaagucaccauaaaucuu

SEQ ID NO: 2195152 - RNA, 18 nt, Streptococcus pneumoniae R6
agaagguuuuugaaaguc

SEQ ID NO: 2195153 - RNA, 15 nt, Streptococcus pneumoniae R6
agaaguccauaaugu

SEQ ID NO: 2195154 - RNA, 18 nt, Streptococcus pneumoniae R6
agaagcuguaaaucuagg

SEQ ID NO: 2195155 - RNA, 19 nt, Streptococcus pneumoniae R6
agaagcuuuaccauccuga

SEQ ID NO: 2195156 - RNA, 19 nt, Streptococcus pneumoniae R6
agaagguauucauaaaaua

SEQ ID NO: 2195157 - RNA, 21 nt, Streptococcus pneumoniae R6
agaagguauucauaaaauacc

SEQ ID NO: 2195158 - RNA, 16 nt, Streptococcus pneumoniae R6
agaaggucaagagaaa

SEQ ID NO: 2195159 - RNA, 20 nt, Streptococcus pneumoniae R6
agaaggucaagagaaaacca

SEQ ID NO: 2195160 - RNA, 18 nt, Streptococcus pneumoniae R6
agaagguguugauuuccu

SEQ ID NO: 2195161 - RNA, 22 nt, Streptococcus pneumoniae R6
agaaugcuugcgacaaaaagag

SEQ ID NO: 2195162 - RNA, 18 nt, Streptococcus pneumoniae R6
agaaugcuuuuugaaagc

SEQ ID NO: 2195163 - RNA, 14 nt, Streptococcus pneumoniae R6
agaauguccauaac

SEQ ID NO: 2195164 - RNA, 17 nt, Streptococcus pneumoniae R6
agaaugggcucccacuu

SEQ ID NO: 2195165 - RNA, 18 nt, Streptococcus pneumoniae R6
agaauggguuaaaauuuu

SEQ ID NO: 2195166 - RNA, 20 nt, Streptococcus pneumoniae R6
agaauggcggcauucaagag

SEQ ID NO: 2195167 - RNA, 13 nt, Streptococcus pneumoniae R6
agaauacucuuua

SEQ ID NO: 2195168 - RNA, 15 nt, Streptococcus pneumoniae R6
agaauauuuacuuca

SEQ ID NO: 2195169 - RNA, 22 nt, Streptococcus pneumoniae R6
agaauauuuacuucauuuuugc

SEQ ID NO: 2195170 - RNA, 23 nt, Streptococcus pneumoniae R6
agaaucaacaugagaauacaaaa

SEQ ID NO: 2195171 - RNA, 16 nt, Streptococcus pneumoniae R6
agaauccuaguucaug

SEQ ID NO: 2195172 - RNA, 23 nt, Streptococcus pneumoniae R6
agacgguuuaccaauuuuuccuu

SEQ ID NO: 2195173 - RNA, 18 nt, Streptococcus pneumoniae R6
agacgaugaauaugucua

SEQ ID NO: 2195174 - RNA, 22 nt, Streptococcus pneumoniae R6
agacgauuaaauaguucuucca

SEQ ID NO: 2195175 - RNA, 13 nt, Streptococcus pneumoniae R6
agaccaugaggaa

SEQ ID NO: 2195176 - RNA, 16 nt, Streptococcus pneumoniae R6
agacaaggauaaaaag

SEQ ID NO: 2195177 - RNA, 17 nt, Streptococcus pneumoniae R6
agacaaggauaaaaagu

SEQ ID NO: 2195178 - RNA, 20 nt, Streptococcus pneumoniae R6
agacaacuccuugaaucauc

SEQ ID NO: 2195179 - RNA, 20 nt, Streptococcus pneumoniae R6
agaauugcuuuaaucugcuu

SEQ ID NO: 2195180 - RNA, 19 nt, Streptococcus pneumoniae R6
agaauuggcacaaaagcga

SEQ ID NO: 2195181 - RNA, 14 nt, Streptococcus pneumoniae R6
agaauugaaagucu

SEQ ID NO: 2195182 - RNA, 20 nt, Streptococcus pneumoniae R6
agaauugaaagucuuggaaa

SEQ ID NO: 2195183 - RNA, 14 nt, Streptococcus pneumoniae R6
agaauuuaacucuu

SEQ ID NO: 2195184 - RNA, 20 nt, Streptococcus pneumoniae R6
agaauuuaacucuuuuuugg

SEQ ID NO: 2195185 - RNA, 18 nt, Streptococcus pneumoniae R6
agaauuggcuaaagaguu

SEQ ID NO: 2195186 - RNA, 12 nt, Streptococcus pneumoniae R6
agacauaucuuu

SEQ ID NO: 2195187 - RNA, 23 nt, Streptococcus pneumoniae R6
agacaucagaugacaaaacguuc

SEQ ID NO: 2195188 - RNA, 15 nt, Streptococcus pneumoniae R6
agaccaccucaucuu

SEQ ID NO: 2195189 - RNA, 16 nt, Streptococcus pneumoniae R6
agaccaccuuccuugg

SEQ ID NO: 2195190 - RNA, 17 nt, Streptococcus pneumoniae R6
agacauaccauuuucca

SEQ ID NO: 2195191 - RNA, 18 nt, Streptococcus pneumoniae R6
agacauaaucaagaugaa

SEQ ID NO: 2195192 - RNA, 14 nt, Streptococcus pneumoniae R6
agacauauccauuc

SEQ ID NO: 2195193 - RNA, 16 nt, Streptococcus pneumoniae R6
agacauauccauuccu

SEQ ID NO: 2195194 - RNA, 14 nt, Streptococcus pneumoniae R6
agacauagucaagc

SEQ ID NO: 2195195 - RNA, 19 nt, Streptococcus pneumoniae R6
agacacuuacggaucuagc

SEQ ID NO: 2195196 - RNA, 21 nt, Streptococcus pneumoniae R6
agacacuugacuagcaaugua

SEQ ID NO: 2195197 - RNA, 17 nt, Streptococcus pneumoniae R6
agacacuugccuaaaca

SEQ ID NO: 2195198 - RNA, 18 nt, Streptococcus pneumoniae R6
agacagagacaaaggagc

SEQ ID NO: 2195199 - RNA, 15 nt, Streptococcus pneumoniae R6
agaacacuuccaaua

SEQ ID NO: 2195200 - RNA, 23 nt, Streptococcus pneumoniae R6
agaacagucucuguauaggucug

SEQ ID NO: 2195201 - RNA, 18 nt, Streptococcus pneumoniae R6
agaaccaagaucuugucu

SEQ ID NO: 2195202 - RNA, 18 nt, Streptococcus pneumoniae R6
agaaccacgguaaaauac

SEQ ID NO: 2195203 - RNA, 21 nt, Streptococcus pneumoniae R6
agaaccaggaaaccagcugcg

SEQ ID NO: 2195204 - RNA, 20 nt, Streptococcus pneumoniae R6
agaaccaaaccaaacagucu

SEQ ID NO: 2195205 - RNA, 14 nt, Streptococcus pneumoniae R6
agaacauuuggaag

SEQ ID NO: 2195206 - RNA, 13 nt, Streptococcus pneumoniae R6
agaacaucuacaa

SEQ ID NO: 2195207 - RNA, 18 nt, Streptococcus pneumoniae R6
agaacaucuacaauugaa

SEQ ID NO: 2195208 - RNA, 20 nt, Streptococcus pneumoniae R6
agaacaucuacaauugaaac

SEQ ID NO: 2195209 - RNA, 20 nt, Streptococcus pneumoniae R6
agaacaaacuaggaagcuag

SEQ ID NO: 2195210 - RNA, 14 nt, Streptococcus pneumoniae R6
agaaauuuucuuuu

SEQ ID NO: 2195211 - RNA, 16 nt, Streptococcus pneumoniae R6
agaaauuuugaaauaa

SEQ ID NO: 2195212 - RNA, 15 nt, Streptococcus pneumoniae R6
agaaauuuuuacuuu

SEQ ID NO: 2195213 - RNA, 20 nt, Streptococcus pneumoniae R6
agaaauuuuuacuuuauuuu

SEQ ID NO: 2195214 - RNA, 21 nt, Streptococcus pneumoniae R6
agaacaaguaaagagucaaga

SEQ ID NO: 2195215 - RNA, 14 nt, Streptococcus pneumoniae R6
agaacaauccaaau

SEQ ID NO: 2195216 - RNA, 16 nt, Streptococcus pneumoniae R6
agaacaauccaaauaa

SEQ ID NO: 2195217 - RNA, 19 nt, Streptococcus pneumoniae R6
agaaauuuaugcuauauau

SEQ ID NO: 2195218 - RNA, 13 nt, Streptococcus pneumoniae R6
agaaauuucaaca

SEQ ID NO: 2195219 - RNA, 16 nt, Streptococcus pneumoniae R6
agaaauuucaacaaaa

SEQ ID NO: 2195220 - RNA, 18 nt, Streptococcus pneumoniae R6
agaaauuucugaaacuaa

SEQ ID NO: 2195221 - RNA, 19 nt, Streptococcus pneumoniae R6
agaaaguagaguccaaaga

SEQ ID NO: 2195222 - RNA, 13 nt, Streptococcus pneumoniae R6
agaaccugcaguu

SEQ ID NO: 2195223 - RNA, 22 nt, Streptococcus pneumoniae R6
agaaccucuguauaaauagcua

SEQ ID NO: 2195224 - RNA, 19 nt, Streptococcus pneumoniae R6
agaaccugguuccuuuuua

SEQ ID NO: 2195225 - RNA, 18 nt, Streptococcus pneumoniae R6
agaaccccgauaacagcc

SEQ ID NO: 2195226 - RNA, 22 nt, Streptococcus pneumoniae R6
agaaccgauacgaugaccaaga

SEQ ID NO: 2195227 - RNA, 17 nt, Streptococcus pneumoniae R6
agaacgauaaacaaggg

SEQ ID NO: 2195228 - RNA, 23 nt, Streptococcus pneumoniae R6
agaacgauaaacaagggcaaaaa

SEQ ID NO: 2195229 - RNA, 15 nt, Streptococcus pneumoniae R6
agaaccuuugagaaa

SEQ ID NO: 2195230 - RNA, 14 nt, Streptococcus pneumoniae R6
agaacuaguaaauu

SEQ ID NO: 2195231 - RNA, 14 nt, Streptococcus pneumoniae R6
agaacuaaauuacu

SEQ ID NO: 2195232 - RNA, 15 nt, Streptococcus pneumoniae R6
agaacgguaucuguu

SEQ ID NO: 2195233 - RNA, 17 nt, Streptococcus pneumoniae R6
agaacugacgaagucag

SEQ ID NO: 2195234 - RNA, 20 nt, Streptococcus pneumoniae R6
agaacugacgaagucagcuc

SEQ ID NO: 2195235 - RNA, 21 nt, Streptococcus pneumoniae R6
agaacuccagauuaucuuccu

SEQ ID NO: 2195236 - RNA, 16 nt, Streptococcus pneumoniae R6
agaacuccagugaaaa

SEQ ID NO: 2195237 - RNA, 22 nt, Streptococcus pneumoniae R6
agaacucccuguuccaaagaag

SEQ ID NO: 2195238 - RNA, 23 nt, Streptococcus pneumoniae R6
agaacucccuguuccaaagaagu

SEQ ID NO: 2195239 - RNA, 23 nt, Streptococcus pneumoniae R6
acuuccugcaaaacuagaauccu

SEQ ID NO: 2195240 - RNA, 16 nt, Streptococcus pneumoniae R6
acuuccugcaaaucua

SEQ ID NO: 2195241 - RNA, 14 nt, Streptococcus pneumoniae R6
acuuccuuuucuac

SEQ ID NO: 2195242 - RNA, 14 nt, Streptococcus pneumoniae R6
acuuccuuuucuua

SEQ ID NO: 2195243 - RNA, 20 nt, Streptococcus pneumoniae R6
acuucgauguuacagacaaa

SEQ ID NO: 2195244 - RNA, 12 nt, Streptococcus pneumoniae R6
acuuuugaaaaa

SEQ ID NO: 2195245 - RNA, 20 nt, Streptococcus pneumoniae R6
acuuuuggggggcaguucau

SEQ ID NO: 2195246 - RNA, 18 nt, Streptococcus pneumoniae R6
acuuuuuauuacaucuau

SEQ ID NO: 2195247 - RNA, 20 nt, Streptococcus pneumoniae R6
acuuuuguuucccuaauaau

SEQ ID NO: 2195248 - RNA, 19 nt, Streptococcus pneumoniae R6
acuuuuguccuauucuugu

SEQ ID NO: 2195249 - RNA, 23 nt, Streptococcus pneumoniae R6
acuuuuuaaguuuuuugauuucu

SEQ ID NO: 2195250 - RNA, 13 nt, Streptococcus pneumoniae R6
acuuuuucaguuu

SEQ ID NO: 2195251 - RNA, 19 nt, Streptococcus pneumoniae R6
acuuuuucaguuuuagauu

SEQ ID NO: 2195252 - RNA, 18 nt, Streptococcus pneumoniae R6
acuuuuucauaaauagau

SEQ ID NO: 2195253 - RNA, 14 nt, Streptococcus pneumoniae R6
acuuuuucuaacau

SEQ ID NO: 2195254 - RNA, 16 nt, Streptococcus pneumoniae R6
acuuuuuccaaaucuu

SEQ ID NO: 2195255 - RNA, 18 nt, Streptococcus pneumoniae R6
agaaaaagucaauaauau

SEQ ID NO: 2195256 - RNA, 14 nt, Streptococcus pneumoniae R6
agaaaaagccucca

SEQ ID NO: 2195257 - RNA, 15 nt, Streptococcus pneumoniae R6
agaaaaagccuccag

SEQ ID NO: 2195258 - RNA, 21 nt, Streptococcus pneumoniae R6
agaaaaagucugaaucaaaaa

SEQ ID NO: 2195259 - RNA, 15 nt, Streptococcus pneumoniae R6
agaaaaaguucaauu

SEQ ID NO: 2195260 - RNA, 17 nt, Streptococcus pneumoniae R6
agaaaaaguucucuuuc

SEQ ID NO: 2195261 - RNA, 20 nt, Streptococcus pneumoniae R6
agaaaaaguguuugauaucu

SEQ ID NO: 2195262 - RNA, 16 nt, Streptococcus pneumoniae R6
acuuuuuuaccuguac

SEQ ID NO: 2195263 - RNA, 20 nt, Streptococcus pneumoniae R6
acuuuuuuaugauuaacuau

SEQ ID NO: 2195264 - RNA, 16 nt, Streptococcus pneumoniae R6
agaaacuagaaguggu

SEQ ID NO: 2195265 - RNA, 13 nt, Streptococcus pneumoniae R6
agaaacucuucua

SEQ ID NO: 2195266 - RNA, 16 nt, Streptococcus pneumoniae R6
agaaagcgaagaucua

SEQ ID NO: 2195267 - RNA, 19 nt, Streptococcus pneumoniae R6
agaaagcgaagaucuagaa

SEQ ID NO: 2195268 - RNA, 23 nt, Streptococcus pneumoniae R6
agaaaggagcacaguagauuccu

SEQ ID NO: 2195269 - RNA, 14 nt, Streptococcus pneumoniae R6
agaaaggacaaauu

SEQ ID NO: 2195270 - RNA, 16 nt, Streptococcus pneumoniae R6
agaaaggacaaauuuu

SEQ ID NO: 2195271 - RNA, 21 nt, Streptococcus pneumoniae R6
agaaaggacaaauuuuguccu

SEQ ID NO: 2195272 - RNA, 23 nt, Streptococcus pneumoniae R6
agaaaggaccugaguucauuacu

SEQ ID NO: 2195273 - RNA, 18 nt, Streptococcus pneumoniae R6
agaaaggacgaaauuugu

SEQ ID NO: 2195274 - RNA, 22 nt, Streptococcus pneumoniae R6
agaaaggacgaaauuuguccuu

SEQ ID NO: 2195275 - RNA, 16 nt, Streptococcus pneumoniae R6
agaaagguaacuccuu

SEQ ID NO: 2195276 - RNA, 13 nt, Streptococcus pneumoniae R6
agaaagguuuuaa

SEQ ID NO: 2195277 - RNA, 15 nt, Streptococcus pneumoniae R6
agaaagguuuuaaag

SEQ ID NO: 2195278 - RNA, 17 nt, Streptococcus pneumoniae R6
agaaagguuuuaaagac

SEQ ID NO: 2195279 - RNA, 13 nt, Streptococcus pneumoniae R6
agaaaaugaaaua

SEQ ID NO: 2195280 - RNA, 18 nt, Streptococcus pneumoniae R6
agaaaaugaaauacauau

SEQ ID NO: 2195281 - RNA, 21 nt, Streptococcus pneumoniae R6
agaaaaucucuucaaaccaug

SEQ ID NO: 2195282 - RNA, 13 nt, Streptococcus pneumoniae R6
agaaaaucaagua

SEQ ID NO: 2195283 - RNA, 13 nt, Streptococcus pneumoniae R6
agaaaaauuucau

SEQ ID NO: 2195284 - RNA, 18 nt, Streptococcus pneumoniae R6
agaaacgacggucaugcg

SEQ ID NO: 2195285 - RNA, 22 nt, Streptococcus pneumoniae R6
agaaacgccuuguagaugaaaa

SEQ ID NO: 2195286 - RNA, 15 nt, Streptococcus pneumoniae R6
agaaacguuguuaaa

SEQ ID NO: 2195287 - RNA, 18 nt, Streptococcus pneumoniae R6
agaaacguuguuaaauca

SEQ ID NO: 2195288 - RNA, 21 nt, Streptococcus pneumoniae R6
agaaacguccaaggcugaaau

SEQ ID NO: 2195289 - RNA, 14 nt, Streptococcus pneumoniae R6
agacuaacuucuua

SEQ ID NO: 2195290 - RNA, 19 nt, Streptococcus pneumoniae R6
agacuaccgcuccuaaucu

SEQ ID NO: 2195291 - RNA, 16 nt, Streptococcus pneumoniae R6
agacuagcacaaugcu

SEQ ID NO: 2195292 - RNA, 19 nt, Streptococcus pneumoniae R6
agacuauauugauuauuac

SEQ ID NO: 2195293 - RNA, 22 nt, Streptococcus pneumoniae R6
agacuauauugauuauuacaac

SEQ ID NO: 2195294 - RNA, 23 nt, Streptococcus pneumoniae R6
agacuauauugauuauuacaaca

SEQ ID NO: 2195295 - RNA, 12 nt, Streptococcus pneumoniae R6
agacuaucugcu

SEQ ID NO: 2195296 - RNA, 13 nt, Streptococcus pneumoniae R6
agagagaaaggag

SEQ ID NO: 2195297 - RNA, 13 nt, Streptococcus pneumoniae R6
agagagauaaaua

SEQ ID NO: 2195298 - RNA, 20 nt, Streptococcus pneumoniae R6
agagagcuccaaagaagaua

SEQ ID NO: 2195299 - RNA, 14 nt, Streptococcus pneumoniae R6
agagagcuccaaau

SEQ ID NO: 2195300 - RNA, 18 nt, Streptococcus pneumoniae R6
agagagcuccaaauggca

SEQ ID NO: 2195301 - RNA, 24 nt, Streptococcus pneumoniae R6
agagagcuccaaauggcaugagga

SEQ ID NO: 2195302 - RNA, 21 nt, Streptococcus pneumoniae R6
agagagguagaggcgccugcu

SEQ ID NO: 2195303 - RNA, 18 nt, Streptococcus pneumoniae R6
agagauagaaggucaaga

SEQ ID NO: 2195304 - RNA, 19 nt, Streptococcus pneumoniae R6
agagauugauaucuggauu

SEQ ID NO: 2195305 - RNA, 19 nt, Streptococcus pneumoniae R6
agagaucuagauuuggaaa

SEQ ID NO: 2195306 - RNA, 16 nt, Streptococcus pneumoniae R6
agagauuuucaaagag

SEQ ID NO: 2195307 - RNA, 15 nt, Streptococcus pneumoniae R6
agagauuuucgaaga

SEQ ID NO: 2195308 - RNA, 15 nt, Streptococcus pneumoniae R6
agagcaacaaauaug

SEQ ID NO: 2195309 - RNA, 20 nt, Streptococcus pneumoniae R6
agagcaaacuaggaaaccag

SEQ ID NO: 2195310 - RNA, 17 nt, Streptococcus pneumoniae R6
agagauugcgauacugu

SEQ ID NO: 2195311 - RNA, 17 nt, Streptococcus pneumoniae R6
agaguauaagucuuuga

SEQ ID NO: 2195312 - RNA, 19 nt, Streptococcus pneumoniae R6
agaguagucugggugcuga

SEQ ID NO: 2195313 - RNA, 16 nt, Streptococcus pneumoniae R6
agaguauaaaaucaaa

SEQ ID NO: 2195314 - RNA, 16 nt, Streptococcus pneumoniae R6
agagucacaaagguca

SEQ ID NO: 2195315 - RNA, 21 nt, Streptococcus pneumoniae R6
agagguauuuaccgucuuuag

SEQ ID NO: 2195316 - RNA, 17 nt, Streptococcus pneumoniae R6
agagguccaaccagaug

SEQ ID NO: 2195317 - RNA, 17 nt, Streptococcus pneumoniae R6
agagucccuuagaaaaa

SEQ ID NO: 2195318 - RNA, 18 nt, Streptococcus pneumoniae R6
agagucccuuagaaaaac

SEQ ID NO: 2195319 - RNA, 21 nt, Streptococcus pneumoniae R6
agaguccaaagaccaugagga

SEQ ID NO: 2195320 - RNA, 22 nt, Streptococcus pneumoniae R6
agaguauuaaacaaaaagaaaa

SEQ ID NO: 2195321 - RNA, 21 nt, Streptococcus pneumoniae R6
agagucagcucuuuuuugaua

SEQ ID NO: 2195322 - RNA, 18 nt, Streptococcus pneumoniae R6
agagucuggaacaaaaua

SEQ ID NO: 2195323 - RNA, 22 nt, Streptococcus pneumoniae R6
agagggcgguacccacaaagau

SEQ ID NO: 2195324 - RNA, 21 nt, Streptococcus pneumoniae R6
agaggguggaaagacugguga

SEQ ID NO: 2195325 - RNA, 17 nt, Streptococcus pneumoniae R6
agagcuuugacauccuu

SEQ ID NO: 2195326 - RNA, 22 nt, Streptococcus pneumoniae R6
agagcuuugcuuuccucagcag

SEQ ID NO: 2195327 - RNA, 22 nt, Streptococcus pneumoniae R6
agagcugaggaaauuucgguga

SEQ ID NO: 2195328 - RNA, 17 nt, Streptococcus pneumoniae R6
agagcugauagagauua

SEQ ID NO: 2195329 - RNA, 23 nt, Streptococcus pneumoniae R6
agagccuaguugcuaguguaugg

SEQ ID NO: 2195330 - RNA, 22 nt, Streptococcus pneumoniae R6
agagccuugaguggauuuuuaa

SEQ ID NO: 2195331 - RNA, 17 nt, Streptococcus pneumoniae R6
agauacugaaucaaaaa

SEQ ID NO: 2195332 - RNA, 14 nt, Streptococcus pneumoniae R6
agauacuugauuuu

SEQ ID NO: 2195333 - RNA, 22 nt, Streptococcus pneumoniae R6
agauagagaaagaaaaacugcu

SEQ ID NO: 2195334 - RNA, 13 nt, Streptococcus pneumoniae R6
agauagaacugac

SEQ ID NO: 2195335 - RNA, 23 nt, Streptococcus pneumoniae R6
agauagaacugacgaagucagcu

SEQ ID NO: 2195336 - RNA, 19 nt, Streptococcus pneumoniae R6
agauagaaggucaagagaa

SEQ ID NO: 2195337 - RNA, 16 nt, Streptococcus pneumoniae R6
agauaggcgcaaaucc

SEQ ID NO: 2195338 - RNA, 23 nt, Streptococcus pneumoniae R6
agauaggauggcuccagaaauaa

SEQ ID NO: 2195339 - RNA, 14 nt, Streptococcus pneumoniae R6
agauaggauugccc

SEQ ID NO: 2195340 - RNA, 14 nt, Streptococcus pneumoniae R6
agauagcugcagcu

SEQ ID NO: 2195341 - RNA, 17 nt, Streptococcus pneumoniae R6
agauagcugcagcugag

SEQ ID NO: 2195342 - RNA, 17 nt, Streptococcus pneumoniae R6
agauagagagcuccaaa

SEQ ID NO: 2195343 - RNA, 14 nt, Streptococcus pneumoniae R6
agauaaaaaacaac

SEQ ID NO: 2195344 - RNA, 20 nt, Streptococcus pneumoniae R6
agaguuuuuuaucuuuggga

SEQ ID NO: 2195345 - RNA, 12 nt, Streptococcus pneumoniae R6
agaguuucaauu

SEQ ID NO: 2195346 - RNA, 19 nt, Streptococcus pneumoniae R6
agaguuucaauuguagaug

SEQ ID NO: 2195347 - RNA, 22 nt, Streptococcus pneumoniae R6
agaguugggguuuggaaaugau

SEQ ID NO: 2195348 - RNA, 20 nt, Streptococcus pneumoniae R6
agaguuucgcccaaccacuu

SEQ ID NO: 2195349 - RNA, 22 nt, Streptococcus pneumoniae R6
agaguugaaaaguccucguagc

SEQ ID NO: 2195350 - RNA, 23 nt, Streptococcus pneumoniae R6
agaguucuccggcuuucacaaau

SEQ ID NO: 2195351 - RNA, 17 nt, Streptococcus pneumoniae R6
agaguugccuaaaacuc

SEQ ID NO: 2195352 - RNA, 15 nt, Streptococcus pneumoniae R6
agauaccuuuuccuu

SEQ ID NO: 2195353 - RNA, 22 nt, Streptococcus pneumoniae R6
agauaccuuuuccuucauuucc

SEQ ID NO: 2195354 - RNA, 13 nt, Streptococcus pneumoniae R6
agauacagacugc

SEQ ID NO: 2195355 - RNA, 21 nt, Streptococcus pneumoniae R6
agauacagugaaggcuuuaaa

SEQ ID NO: 2195356 - RNA, 16 nt, Streptococcus pneumoniae R6
agaucaaguucaagau

SEQ ID NO: 2195357 - RNA, 18 nt, Streptococcus pneumoniae R6
agaucaaguucaagauga

SEQ ID NO: 2195358 - RNA, 22 nt, Streptococcus pneumoniae R6
agaucagaguagucuuuuuguu

SEQ ID NO: 2195359 - RNA, 20 nt, Streptococcus pneumoniae R6
agauauuauuucaaagaaca

SEQ ID NO: 2195360 - RNA, 14 nt, Streptococcus pneumoniae R6
agauauuucuucuu

SEQ ID NO: 2195361 - RNA, 18 nt, Streptococcus pneumoniae R6
agauauagccuguaaaaa

SEQ ID NO: 2195362 - RNA, 15 nt, Streptococcus pneumoniae R6
agauauauugacuuu

SEQ ID NO: 2195363 - RNA, 15 nt, Streptococcus pneumoniae R6
agauaguagaccuca

SEQ ID NO: 2195364 - RNA, 15 nt, Streptococcus pneumoniae R6
agauaguaucaaaug

SEQ ID NO: 2195365 - RNA, 17 nt, Streptococcus pneumoniae R6
agauaguaucaaaugac

SEQ ID NO: 2195366 - RNA, 15 nt, Streptococcus pneumoniae R6
agauaguauuuuaaa

SEQ ID NO: 2195367 - RNA, 16 nt, Streptococcus pneumoniae R6
agauagggaagguaug

SEQ ID NO: 2195368 - RNA, 13 nt, Streptococcus pneumoniae R6
agauagguggggc

SEQ ID NO: 2195369 - RNA, 17 nt, Streptococcus pneumoniae R6
agauagggcuaggcuaa

SEQ ID NO: 2195370 - RNA, 14 nt, Streptococcus pneumoniae R6
agauaggucacagc

SEQ ID NO: 2195371 - RNA, 13 nt, Streptococcus pneumoniae R6
agaugauuuuucu

SEQ ID NO: 2195372 - RNA, 21 nt, Streptococcus pneumoniae R6
agaugcaaaagucaggccugc

SEQ ID NO: 2195373 - RNA, 14 nt, Streptococcus pneumoniae R6
agaugauuugcuca

SEQ ID NO: 2195374 - RNA, 12 nt, Streptococcus pneumoniae R6
agaugauuccug

SEQ ID NO: 2195375 - RNA, 15 nt, Streptococcus pneumoniae R6
agaugauuacucaaa

SEQ ID NO: 2195376 - RNA, 16 nt, Streptococcus pneumoniae R6
agaugauuacucaaaa

SEQ ID NO: 2195377 - RNA, 15 nt, Streptococcus pneumoniae R6
agaugaguuugcuuu

SEQ ID NO: 2195378 - RNA, 18 nt, Streptococcus pneumoniae R6
agaugaguguaaaaagaa

SEQ ID NO: 2195379 - RNA, 23 nt, Streptococcus pneumoniae R6
agaugaguguaaaaagaaagucc

SEQ ID NO: 2195380 - RNA, 19 nt, Streptococcus pneumoniae R6
agaugacuucuuaaucaau

SEQ ID NO: 2195381 - RNA, 21 nt, Streptococcus pneumoniae R6
agaugagaaagauuuucaaag

SEQ ID NO: 2195382 - RNA, 19 nt, Streptococcus pneumoniae R6
agaugagacuugcaagaaa

SEQ ID NO: 2195383 - RNA, 20 nt, Streptococcus pneumoniae R6
agaugagacuugcaagaaag

SEQ ID NO: 2195384 - RNA, 21 nt, Streptococcus pneumoniae R6
agaugagacuugcaagaaagu

SEQ ID NO: 2195385 - RNA, 23 nt, Streptococcus pneumoniae R6
agaugagacuugcaagaaaguag

SEQ ID NO: 2195386 - RNA, 14 nt, Streptococcus pneumoniae R6
agaugagaggagaa

SEQ ID NO: 2195387 - RNA, 12 nt, Streptococcus pneumoniae R6
agaugaaacuga

SEQ ID NO: 2195388 - RNA, 21 nt, Streptococcus pneumoniae R6
agaugaagcaaucaauguacu

SEQ ID NO: 2195389 - RNA, 19 nt, Streptococcus pneumoniae R6
agaugacaaaacguuccca

SEQ ID NO: 2195390 - RNA, 21 nt, Streptococcus pneumoniae R6
agaugacaaaguacuugagaa

SEQ ID NO: 2195391 - RNA, 18 nt, Streptococcus pneumoniae R6
agaugacaacauggcuuc

SEQ ID NO: 2195392 - RNA, 16 nt, Streptococcus pneumoniae R6
agaugacaucuaaaua

SEQ ID NO: 2195393 - RNA, 15 nt, Streptococcus pneumoniae R6
agaucugcuugcucu

SEQ ID NO: 2195394 - RNA, 13 nt, Streptococcus pneumoniae R6
agaucuucuucua

SEQ ID NO: 2195395 - RNA, 16 nt, Streptococcus pneumoniae R6
agaucugguuaaaauu

SEQ ID NO: 2195396 - RNA, 17 nt, Streptococcus pneumoniae R6
agaucuaucauuauacu

SEQ ID NO: 2195397 - RNA, 13 nt, Streptococcus pneumoniae R6
agaucuauccauu

SEQ ID NO: 2195398 - RNA, 20 nt, Streptococcus pneumoniae R6
agaucaucaaccucacuuaa

SEQ ID NO: 2195399 - RNA, 22 nt, Streptococcus pneumoniae R6
agaugcuugcauuuuuugaguu

SEQ ID NO: 2195400 - RNA, 14 nt, Streptococcus pneumoniae R6
agaugcuugaauuc

SEQ ID NO: 2195401 - RNA, 18 nt, Streptococcus pneumoniae R6
agauggaagcugacguag

SEQ ID NO: 2195402 - RNA, 18 nt, Streptococcus pneumoniae R6
agauggaguguucuaaaa

SEQ ID NO: 2195403 - RNA, 19 nt, Streptococcus pneumoniae R6
agauggaguuccuccauug

SEQ ID NO: 2195404 - RNA, 19 nt, Streptococcus pneumoniae R6
agauggacuagaaugcuuu

SEQ ID NO: 2195405 - RNA, 15 nt, Streptococcus pneumoniae R6
agauggauuuuccuu

SEQ ID NO: 2195406 - RNA, 14 nt, Streptococcus pneumoniae R6
agaugggacuaaag

SEQ ID NO: 2195407 - RNA, 15 nt, Streptococcus pneumoniae R6
agaugggacuaaaga

SEQ ID NO: 2195408 - RNA, 23 nt, Streptococcus pneumoniae R6
agaugggacuaaagauugagaaa

SEQ ID NO: 2195409 - RNA, 16 nt, Streptococcus pneumoniae R6
agauguuagaaaaagu

SEQ ID NO: 2195410 - RNA, 13 nt, Streptococcus pneumoniae R6
agauguucaaaga

SEQ ID NO: 2195411 - RNA, 20 nt, Streptococcus pneumoniae R6
agaugucggauugcccaaaa

SEQ ID NO: 2195412 - RNA, 22 nt, Streptococcus pneumoniae R6
agauguauaauggauugaaaua

SEQ ID NO: 2195413 - RNA, 20 nt, Streptococcus pneumoniae R6
agaugguauccaaaacaacc

SEQ ID NO: 2195414 - RNA, 18 nt, Streptococcus pneumoniae R6
agauuaaaaaauaacucu

SEQ ID NO: 2195415 - RNA, 19 nt, Streptococcus pneumoniae R6
agauuaaaaaauaacucug

SEQ ID NO: 2195416 - RNA, 16 nt, Streptococcus pneumoniae R6
agauuacugauaaaac

SEQ ID NO: 2195417 - RNA, 22 nt, Streptococcus pneumoniae R6
agauucuauuuuuuauaauauc

SEQ ID NO: 2195418 - RNA, 16 nt, Streptococcus pneumoniae R6
agauucugacaaucca

SEQ ID NO: 2195419 - RNA, 15 nt, Streptococcus pneumoniae R6
agauugaaacuagaa

SEQ ID NO: 2195420 - RNA, 15 nt, Streptococcus pneumoniae R6
agauucuuauaaaua

SEQ ID NO: 2195421 - RNA, 20 nt, Streptococcus pneumoniae R6
agauucugugguaaugcuuu

SEQ ID NO: 2195422 - RNA, 17 nt, Streptococcus pneumoniae R6
agauuggaaaccaagaa

SEQ ID NO: 2195423 - RNA, 18 nt, Streptococcus pneumoniae R6
agauugcuuuccaauaau

SEQ ID NO: 2195424 - RNA, 20 nt, Streptococcus pneumoniae R6
agauugcccaucauuccuga

SEQ ID NO: 2195425 - RNA, 20 nt, Streptococcus pneumoniae R6
agauugaugcaaaucucauu

SEQ ID NO: 2195426 - RNA, 16 nt, Streptococcus pneumoniae R6
agauuaugaugcaaaa

SEQ ID NO: 2195427 - RNA, 16 nt, Streptococcus pneumoniae R6
agauuauguaagauag

SEQ ID NO: 2195428 - RNA, 21 nt, Streptococcus pneumoniae R6
agauuauugcagccaauuucu

SEQ ID NO: 2195429 - RNA, 19 nt, Streptococcus pneumoniae R6
agauuaggaauuagaguuu

SEQ ID NO: 2195430 - RNA, 15 nt, Streptococcus pneumoniae R6
agauuaucgacagga

SEQ ID NO: 2195431 - RNA, 13 nt, Streptococcus pneumoniae R6
agauuaucuuccu

SEQ ID NO: 2195432 - RNA, 12 nt, Streptococcus pneumoniae R6
agauucauucug

SEQ ID NO: 2195433 - RNA, 22 nt, Streptococcus pneumoniae R6
agauuccacguuucuaauaauu

SEQ ID NO: 2195434 - RNA, 15 nt, Streptococcus pneumoniae R6
agauucaucagggca

SEQ ID NO: 2195435 - RNA, 21 nt, Streptococcus pneumoniae R6
agauuauugguggcuuccagu

SEQ ID NO: 2195436 - RNA, 17 nt, Streptococcus pneumoniae R6
agauucaauauacuaua

SEQ ID NO: 2195437 - RNA, 23 nt, Streptococcus pneumoniae R6
agauucacuagccccagcuagga

SEQ ID NO: 2195438 - RNA, 13 nt, Streptococcus pneumoniae R6
agauucagucuac

SEQ ID NO: 2195439 - RNA, 13 nt, Streptococcus pneumoniae R6
agauucagcuaaa

SEQ ID NO: 2195440 - RNA, 14 nt, Streptococcus pneumoniae R6
agauucagcuaaaa

SEQ ID NO: 2195441 - RNA, 14 nt, Streptococcus pneumoniae R6
acuccucucuccuc

SEQ ID NO: 2195442 - RNA, 19 nt, Streptococcus pneumoniae R6
acuccucucuccuccccuu

SEQ ID NO: 2195443 - RNA, 16 nt, Streptococcus pneumoniae R6
acuccuuacuuuuuau

SEQ ID NO: 2195444 - RNA, 12 nt, Streptococcus pneumoniae R6
acuccuuuucua

SEQ ID NO: 2195445 - RNA, 12 nt, Streptococcus pneumoniae R6
acuccuuuuuug

SEQ ID NO: 2195446 - RNA, 16 nt, Streptococcus pneumoniae R6
acucgaacuagagaag

SEQ ID NO: 2195447 - RNA, 15 nt, Streptococcus pneumoniae R6
acucaaugaaaauca

SEQ ID NO: 2195448 - RNA, 16 nt, Streptococcus pneumoniae R6
acucaaugaaaaucaa

SEQ ID NO: 2195449 - RNA, 18 nt, Streptococcus pneumoniae R6
acucaacauuauccauga

SEQ ID NO: 2195450 - RNA, 14 nt, Streptococcus pneumoniae R6
acucaacagaagaa

SEQ ID NO: 2195451 - RNA, 24 nt, Streptococcus pneumoniae R6
acucaacagaagaauccugccaau

SEQ ID NO: 2195452 - RNA, 13 nt, Streptococcus pneumoniae R6
acucuguuuucac

SEQ ID NO: 2195453 - RNA, 18 nt, Streptococcus pneumoniae R6
acucuuacaaaaaaucaa

SEQ ID NO: 2195454 - RNA, 15 nt, Streptococcus pneumoniae R6
acucuuagaaaaucu

SEQ ID NO: 2195455 - RNA, 20 nt, Streptococcus pneumoniae R6
acucuggcaauuuaucuccu

SEQ ID NO: 2195456 - RNA, 15 nt, Streptococcus pneumoniae R6
acucucuuuuuugau

SEQ ID NO: 2195457 - RNA, 17 nt, Streptococcus pneumoniae R6
acucucggucuuguuuu

SEQ ID NO: 2195458 - RNA, 15 nt, Streptococcus pneumoniae R6
acucucguaaacaaa

SEQ ID NO: 2195459 - RNA, 23 nt, Streptococcus pneumoniae R6
acucucuaauucccuuaaagugg

SEQ ID NO: 2195460 - RNA, 16 nt, Streptococcus pneumoniae R6
acucugccuuccuugu

SEQ ID NO: 2195461 - RNA, 23 nt, Streptococcus pneumoniae R6
acucuaucaggaaagucaaauua

SEQ ID NO: 2195462 - RNA, 23 nt, Streptococcus pneumoniae R6
acucuaguuuuuauaauguauug

SEQ ID NO: 2195463 - RNA, 12 nt, Streptococcus pneumoniae R6
acucuacagauu

SEQ ID NO: 2195464 - RNA, 18 nt, Streptococcus pneumoniae R6
acucuaacuucugcuaau

SEQ ID NO: 2195465 - RNA, 15 nt, Streptococcus pneumoniae R6
acucggccuucuuuu

SEQ ID NO: 2195466 - RNA, 21 nt, Streptococcus pneumoniae R6
acugauuucaaggcauuuuuu

SEQ ID NO: 2195467 - RNA, 23 nt, Streptococcus pneumoniae R6
acugauuuacaaauauucaccac

SEQ ID NO: 2195468 - RNA, 19 nt, Streptococcus pneumoniae R6
acugauuggugucaaaaag

SEQ ID NO: 2195469 - RNA, 22 nt, Streptococcus pneumoniae R6
acugauuggugucaaaaaggaa

SEQ ID NO: 2195470 - RNA, 14 nt, Streptococcus pneumoniae R6
acugaucccuccau

SEQ ID NO: 2195471 - RNA, 21 nt, Streptococcus pneumoniae R6
acugauucuacuuuuucaaag

SEQ ID NO: 2195472 - RNA, 23 nt, Streptococcus pneumoniae R6
acugagagcuacacguggguuga

SEQ ID NO: 2195473 - RNA, 19 nt, Streptococcus pneumoniae R6
acugacuucgucaguucua

SEQ ID NO: 2195474 - RNA, 23 nt, Streptococcus pneumoniae R6
acugacuucgucaguucuaucua

SEQ ID NO: 2195475 - RNA, 23 nt, Streptococcus pneumoniae R6
acugacuucgucaguuucaucua

SEQ ID NO: 2195476 - RNA, 18 nt, Streptococcus pneumoniae R6
acucuuuuuuggucuuau

SEQ ID NO: 2195477 - RNA, 17 nt, Streptococcus pneumoniae R6
acugaaacaacaucuuu

SEQ ID NO: 2195478 - RNA, 22 nt, Streptococcus pneumoniae R6
acugaucaaaaaauuucauuuc

SEQ ID NO: 2195479 - RNA, 20 nt, Streptococcus pneumoniae R6
acugaguauuuuauaguaau

SEQ ID NO: 2195480 - RNA, 21 nt, Streptococcus pneumoniae R6
acugaguuuuucccagccuuc

SEQ ID NO: 2195481 - RNA, 12 nt, Streptococcus pneumoniae R6
acugcaucuuug

SEQ ID NO: 2195482 - RNA, 16 nt, Streptococcus pneumoniae R6
acugccaagauagaga

SEQ ID NO: 2195483 - RNA, 19 nt, Streptococcus pneumoniae R6
acugcagcaacgucuucaa

SEQ ID NO: 2195484 - RNA, 20 nt, Streptococcus pneumoniae R6
acugcagucuucauguggcu

SEQ ID NO: 2195485 - RNA, 17 nt, Streptococcus pneumoniae R6
acugcgaagaaaucauu

SEQ ID NO: 2195486 - RNA, 19 nt, Streptococcus pneumoniae R6
acugcgaagagggcaagga

SEQ ID NO: 2195487 - RNA, 19 nt, Streptococcus pneumoniae R6
acugccuuuauuuuuuuau

SEQ ID NO: 2195488 - RNA, 15 nt, Streptococcus pneumoniae R6
acugcuaaaagauuu

SEQ ID NO: 2195489 - RNA, 13 nt, Streptococcus pneumoniae R6
acugcuagaaaug

SEQ ID NO: 2195490 - RNA, 14 nt, Streptococcus pneumoniae R6
acugcgguugcgua

SEQ ID NO: 2195491 - RNA, 16 nt, Streptococcus pneumoniae R6
acugcugccacuggga

SEQ ID NO: 2195492 - RNA, 15 nt, Streptococcus pneumoniae R6
acugcucgguaaaac

SEQ ID NO: 2195493 - RNA, 18 nt, Streptococcus pneumoniae R6
acugcugggucaaacggc

SEQ ID NO: 2195494 - RNA, 20 nt, Streptococcus pneumoniae R6
acugcuuugagaucuuuuuc

SEQ ID NO: 2195495 - RNA, 19 nt, Streptococcus pneumoniae R6
acugcuuagaaccgaaaau

SEQ ID NO: 2195496 - RNA, 17 nt, Streptococcus pneumoniae R6
acugcuucacuagucau

SEQ ID NO: 2195497 - RNA, 15 nt, Streptococcus pneumoniae R6
acuggaaacuuuuuu

SEQ ID NO: 2195498 - RNA, 18 nt, Streptococcus pneumoniae R6
acuggaaacuuuuuuaua

SEQ ID NO: 2195499 - RNA, 14 nt, Streptococcus pneumoniae R6
acuggaacaucuac

SEQ ID NO: 2195500 - RNA, 15 nt, Streptococcus pneumoniae R6
acuggaccagaacca

SEQ ID NO: 2195501 - RNA, 23 nt, Streptococcus pneumoniae R6
acuggaccagaaccaugaccgag

SEQ ID NO: 2195502 - RNA, 22 nt, Streptococcus pneumoniae R6
acuggauaaaguuaugaaaaag

SEQ ID NO: 2195503 - RNA, 11 nt, Streptococcus pneumoniae R6
acuggcaaaau

SEQ ID NO: 2195504 - RNA, 14 nt, Streptococcus pneumoniae R6
acuggcaaaggcau

SEQ ID NO: 2195505 - RNA, 12 nt, Streptococcus pneumoniae R6
acuggauuuuaa

SEQ ID NO: 2195506 - RNA, 20 nt, Streptococcus pneumoniae R6
acuggauguguauagagcaa

SEQ ID NO: 2195507 - RNA, 22 nt, Streptococcus pneumoniae R6
acuggcauaagcaaucauaccu

SEQ ID NO: 2195508 - RNA, 12 nt, Streptococcus pneumoniae R6
acuggcaucccc

SEQ ID NO: 2195509 - RNA, 21 nt, Streptococcus pneumoniae R6
acuggcgauuuuaggauacug

SEQ ID NO: 2195510 - RNA, 16 nt, Streptococcus pneumoniae R6
acuggccucugcacua

SEQ ID NO: 2195511 - RNA, 20 nt, Streptococcus pneumoniae R6
acuggcugccauugguguuu

SEQ ID NO: 2195512 - RNA, 18 nt, Streptococcus pneumoniae R6
acuggucacauugaaaau

SEQ ID NO: 2195513 - RNA, 19 nt, Streptococcus pneumoniae R6
acuggucacauugaaaaug

SEQ ID NO: 2195514 - RNA, 17 nt, Streptococcus pneumoniae R6
acuggguguuugccauc

SEQ ID NO: 2195515 - RNA, 18 nt, Streptococcus pneumoniae R6
acuggugagauaaaacgu

SEQ ID NO: 2195516 - RNA, 11 nt, Streptococcus pneumoniae R6
acuuagccaag

SEQ ID NO: 2195517 - RNA, 17 nt, Streptococcus pneumoniae R6
acuuaaauagaaaaaca

SEQ ID NO: 2195518 - RNA, 23 nt, Streptococcus pneumoniae R6
acuguuuugagauuacugauaaa

SEQ ID NO: 2195519 - RNA, 20 nt, Streptococcus pneumoniae R6
acuguaaaguagcaaaacac

SEQ ID NO: 2195520 - RNA, 15 nt, Streptococcus pneumoniae R6
acugguuuuccugua

SEQ ID NO: 2195521 - RNA, 15 nt, Streptococcus pneumoniae R6
acugucguuccuuuu

SEQ ID NO: 2195522 - RNA, 18 nt, Streptococcus pneumoniae R6
acugucucaggucuagca

SEQ ID NO: 2195523 - RNA, 22 nt, Streptococcus pneumoniae R6
acugucuuauccaaacuagaua

SEQ ID NO: 2195524 - RNA, 14 nt, Streptococcus pneumoniae R6
acugucuugccaac

SEQ ID NO: 2195525 - RNA, 16 nt, Streptococcus pneumoniae R6
acuguucuaaauucag

SEQ ID NO: 2195526 - RNA, 13 nt, Streptococcus pneumoniae R6
acuguuccuucua

SEQ ID NO: 2195527 - RNA, 22 nt, Streptococcus pneumoniae R6
acuguuauagauucaauauauu

SEQ ID NO: 2195528 - RNA, 24 nt, Streptococcus pneumoniae R6
acuucccgauggguuaagugcauu

SEQ ID NO: 2195529 - RNA, 17 nt, Streptococcus pneumoniae R6
acuucccagccuaccug

SEQ ID NO: 2195530 - RNA, 21 nt, Streptococcus pneumoniae R6
acuucacuaauucaccuaacc

SEQ ID NO: 2195531 - RNA, 17 nt, Streptococcus pneumoniae R6
acuucacguucuuccaa

SEQ ID NO: 2195532 - RNA, 14 nt, Streptococcus pneumoniae R6
acuucagauucacu

SEQ ID NO: 2195533 - RNA, 14 nt, Streptococcus pneumoniae R6
acuucaggaaaaaa

SEQ ID NO: 2195534 - RNA, 17 nt, Streptococcus pneumoniae R6
acuuaucagcuagcuua

SEQ ID NO: 2195535 - RNA, 20 nt, Streptococcus pneumoniae R6
acuuaucuagggcauuaauc

SEQ ID NO: 2195536 - RNA, 16 nt, Streptococcus pneumoniae R6
acuuauacucuucaaa

SEQ ID NO: 2195537 - RNA, 15 nt, Streptococcus pneumoniae R6
acuuauaauuaaaag

SEQ ID NO: 2195538 - RNA, 17 nt, Streptococcus pneumoniae R6
acuuauaaaaaacacaa

SEQ ID NO: 2195539 - RNA, 14 nt, Streptococcus pneumoniae R6
acuucaaucauauc

SEQ ID NO: 2195540 - RNA, 14 nt, Streptococcus pneumoniae R6
acuuaugaagaaau

SEQ ID NO: 2195541 - RNA, 18 nt, Streptococcus pneumoniae R6
acuuaugagcuagguuca

SEQ ID NO: 2195542 - RNA, 15 nt, Streptococcus pneumoniae R6
acuucaauuucuaau

SEQ ID NO: 2195543 - RNA, 23 nt, Streptococcus pneumoniae R6
acuucaauuucuaaugucucugc

SEQ ID NO: 2195544 - RNA, 17 nt, Streptococcus pneumoniae R6
acguccgucaagaagag

SEQ ID NO: 2195545 - RNA, 17 nt, Streptococcus pneumoniae R6
acguccgugaggacagu

SEQ ID NO: 2195546 - RNA, 12 nt, Streptococcus pneumoniae R6
acguccuuggaa

SEQ ID NO: 2195547 - RNA, 16 nt, Streptococcus pneumoniae R6
acgugcucaaaacacu

SEQ ID NO: 2195548 - RNA, 18 nt, Streptococcus pneumoniae R6
acgucguaaccagagaca

SEQ ID NO: 2195549 - RNA, 17 nt, Streptococcus pneumoniae R6
acguuuuaaaaaagagc

SEQ ID NO: 2195550 - RNA, 17 nt, Streptococcus pneumoniae R6
acguuuuucuucuuuuu

SEQ ID NO: 2195551 - RNA, 14 nt, Streptococcus pneumoniae R6
acguuuuuacuuug

SEQ ID NO: 2195552 - RNA, 18 nt, Streptococcus pneumoniae R6
acguuuuuacuacuuuug

SEQ ID NO: 2195553 - RNA, 11 nt, Streptococcus pneumoniae R6
acguuuuuaaa

SEQ ID NO: 2195554 - RNA, 17 nt, Streptococcus pneumoniae R6
acuaaaaacucuucuuu

SEQ ID NO: 2195555 - RNA, 22 nt, Streptococcus pneumoniae R6
acuaaaacguuguuuucacgau

SEQ ID NO: 2195556 - RNA, 23 nt, Streptococcus pneumoniae R6
acuaaaacguuguuuucacgauu

SEQ ID NO: 2195557 - RNA, 13 nt, Streptococcus pneumoniae R6
acuaaaauaacug

SEQ ID NO: 2195558 - RNA, 11 nt, Streptococcus pneumoniae R6
acuaaacaagg

SEQ ID NO: 2195559 - RNA, 14 nt, Streptococcus pneumoniae R6
acguuucuaauaau

SEQ ID NO: 2195560 - RNA, 17 nt, Streptococcus pneumoniae R6
acguuuccuucuacugu

SEQ ID NO: 2195561 - RNA, 15 nt, Streptococcus pneumoniae R6
acguuagcaaagacu

SEQ ID NO: 2195562 - RNA, 16 nt, Streptococcus pneumoniae R6
acguuagcaaagacuu

SEQ ID NO: 2195563 - RNA, 19 nt, Streptococcus pneumoniae R6
acguuagcaaagacuucaa

SEQ ID NO: 2195564 - RNA, 22 nt, Streptococcus pneumoniae R6
acguucaaaggcaucaucugaa

SEQ ID NO: 2195565 - RNA, 14 nt, Streptococcus pneumoniae R6
acguugcuuauacu

SEQ ID NO: 2195566 - RNA, 14 nt, Streptococcus pneumoniae R6
acuacuugauaaaa

SEQ ID NO: 2195567 - RNA, 11 nt, Streptococcus pneumoniae R6
acuacuuugac

SEQ ID NO: 2195568 - RNA, 19 nt, Streptococcus pneumoniae R6
acuagugccauaguuaagg

SEQ ID NO: 2195569 - RNA, 14 nt, Streptococcus pneumoniae R6
acuagaaaaugagg

SEQ ID NO: 2195570 - RNA, 13 nt, Streptococcus pneumoniae R6
acuagacagugaa

SEQ ID NO: 2195571 - RNA, 18 nt, Streptococcus pneumoniae R6
acuagaauccuaguucau

SEQ ID NO: 2195572 - RNA, 11 nt, Streptococcus pneumoniae R6
acuagaaugcu

SEQ ID NO: 2195573 - RNA, 20 nt, Streptococcus pneumoniae R6
acuagaaugcuuugugaaga

SEQ ID NO: 2195574 - RNA, 20 nt, Streptococcus pneumoniae R6
acuagaaugcuuuuugaaag

SEQ ID NO: 2195575 - RNA, 23 nt, Streptococcus pneumoniae R6
acuagaaugcuuuuugaaagcag

SEQ ID NO: 2195576 - RNA, 20 nt, Streptococcus pneumoniae R6
acuaauuuagagaaugaaau

SEQ ID NO: 2195577 - RNA, 20 nt, Streptococcus pneumoniae R6
acuacaguugacaaagagcc

SEQ ID NO: 2195578 - RNA, 23 nt, Streptococcus pneumoniae R6
acuacaguugacaaagagccaua

SEQ ID NO: 2195579 - RNA, 13 nt, Streptococcus pneumoniae R6
acuaauuaauuaa

SEQ ID NO: 2195580 - RNA, 21 nt, Streptococcus pneumoniae R6
acuacauuuuuugaaauaaga

SEQ ID NO: 2195581 - RNA, 14 nt, Streptococcus pneumoniae R6
acuaaauauaagau

SEQ ID NO: 2195582 - RNA, 15 nt, Streptococcus pneumoniae R6
acuaauguaaaaaag

SEQ ID NO: 2195583 - RNA, 16 nt, Streptococcus pneumoniae R6
acuaaugcccuuuuuu

SEQ ID NO: 2195584 - RNA, 14 nt, Streptococcus pneumoniae R6
acuaaagcuuuuuu

SEQ ID NO: 2195585 - RNA, 18 nt, Streptococcus pneumoniae R6
acuaaauacuagucuuuc

SEQ ID NO: 2195586 - RNA, 20 nt, Streptococcus pneumoniae R6
acuauauuucuauacuuuuu

SEQ ID NO: 2195587 - RNA, 18 nt, Streptococcus pneumoniae R6
acuaucaaaaucaaugac

SEQ ID NO: 2195588 - RNA, 21 nt, Streptococcus pneumoniae R6
acuaucaaaaucaaugacaau

SEQ ID NO: 2195589 - RNA, 16 nt, Streptococcus pneumoniae R6
acuauaacagagaaga

SEQ ID NO: 2195590 - RNA, 14 nt, Streptococcus pneumoniae R6
acuauaauaaaaug

SEQ ID NO: 2195591 - RNA, 16 nt, Streptococcus pneumoniae R6
acuauaauaaaaugaa

SEQ ID NO: 2195592 - RNA, 14 nt, Streptococcus pneumoniae R6
acuauaaaacauuc

SEQ ID NO: 2195593 - RNA, 14 nt, Streptococcus pneumoniae R6
acuauaaaagagga

SEQ ID NO: 2195594 - RNA, 16 nt, Streptococcus pneumoniae R6
acuauaaaagaggagg

SEQ ID NO: 2195595 - RNA, 15 nt, Streptococcus pneumoniae R6
acuauaaaaucugaa

SEQ ID NO: 2195596 - RNA, 15 nt, Streptococcus pneumoniae R6
acuauaaaaaaguga

SEQ ID NO: 2195597 - RNA, 17 nt, Streptococcus pneumoniae R6
acuauaaaaaagugaac

SEQ ID NO: 2195598 - RNA, 19 nt, Streptococcus pneumoniae R6
acuaguuuucuaaagaauu

SEQ ID NO: 2195599 - RNA, 17 nt, Streptococcus pneumoniae R6
acuauuaaccuugucuu

SEQ ID NO: 2195600 - RNA, 17 nt, Streptococcus pneumoniae R6
acuauguacgaaaagca

SEQ ID NO: 2195601 - RNA, 15 nt, Streptococcus pneumoniae R6
acuaugggaagauuu

SEQ ID NO: 2195602 - RNA, 16 nt, Streptococcus pneumoniae R6
acuaucccuuuaccau

SEQ ID NO: 2195603 - RNA, 23 nt, Streptococcus pneumoniae R6
acuauccagagcauucuuuuguu

SEQ ID NO: 2195604 - RNA, 15 nt, Streptococcus pneumoniae R6
acuaucccuaaaggg

SEQ ID NO: 2195605 - RNA, 12 nt, Streptococcus pneumoniae R6
acuauucuuuuu

SEQ ID NO: 2195606 - RNA, 22 nt, Streptococcus pneumoniae R6
acuauugaguucacaaaugaga

SEQ ID NO: 2195607 - RNA, 16 nt, Streptococcus pneumoniae R6
acuauugaugaacugc

SEQ ID NO: 2195608 - RNA, 20 nt, Streptococcus pneumoniae R6
acuauugaugaacugcuuga

SEQ ID NO: 2195609 - RNA, 15 nt, Streptococcus pneumoniae R6
acuauugaugaagua

SEQ ID NO: 2195610 - RNA, 22 nt, Streptococcus pneumoniae R6
acuauuagcaucuuaucagaaa

SEQ ID NO: 2195611 - RNA, 17 nt, Streptococcus pneumoniae R6
acuauucuaguuucaau

SEQ ID NO: 2195612 - RNA, 12 nt, Streptococcus pneumoniae R6
acuauuugagua

SEQ ID NO: 2195613 - RNA, 13 nt, Streptococcus pneumoniae R6
acuauuucuuauu

SEQ ID NO: 2195614 - RNA, 18 nt, Streptococcus pneumoniae R6
acuauuuuauuuuuuaag

SEQ ID NO: 2195615 - RNA, 19 nt, Streptococcus pneumoniae R6
acuauuguuauuuuucuuu

SEQ ID NO: 2195616 - RNA, 12 nt, Streptococcus pneumoniae R6
acuauuucagau

SEQ ID NO: 2195617 - RNA, 14 nt, Streptococcus pneumoniae R6
acuauuuauuuaau

SEQ ID NO: 2195618 - RNA, 15 nt, Streptococcus pneumoniae R6
acucaaaucaaaaua

SEQ ID NO: 2195619 - RNA, 16 nt, Streptococcus pneumoniae R6
acucaaaucaaaauau

SEQ ID NO: 2195620 - RNA, 18 nt, Streptococcus pneumoniae R6
acucaaauuuaccaaugc

SEQ ID NO: 2195621 - RNA, 18 nt, Streptococcus pneumoniae R6
acucaaauguaaguuggg

SEQ ID NO: 2195622 - RNA, 15 nt, Streptococcus pneumoniae R6
acuauuuuugucauc

SEQ ID NO: 2195623 - RNA, 21 nt, Streptococcus pneumoniae R6
acucaaaagcuuguuuaaaau

SEQ ID NO: 2195624 - RNA, 20 nt, Streptococcus pneumoniae R6
acgcuggcuggaucagcuuu

SEQ ID NO: 2195625 - RNA, 18 nt, Streptococcus pneumoniae R6
acggcaagacgaagcuga

SEQ ID NO: 2195626 - RNA, 20 nt, Streptococcus pneumoniae R6
acggcaagacgaagcugaca

SEQ ID NO: 2195627 - RNA, 12 nt, Streptococcus pneumoniae R6
acggaucugaag

SEQ ID NO: 2195628 - RNA, 17 nt, Streptococcus pneumoniae R6
acggcggaaaggcuagg

SEQ ID NO: 2195629 - RNA, 21 nt, Streptococcus pneumoniae R6
acgggcuuggcguuuugaguu

SEQ ID NO: 2195630 - RNA, 16 nt, Streptococcus pneumoniae R6
acggugaacuucuuca

SEQ ID NO: 2195631 - RNA, 19 nt, Streptococcus pneumoniae R6
acguaacuuguaacuagcu

SEQ ID NO: 2195632 - RNA, 20 nt, Streptococcus pneumoniae R6
acgguuuaccaauuuuuccu

SEQ ID NO: 2195633 - RNA, 12 nt, Streptococcus pneumoniae R6
acggugguguga

SEQ ID NO: 2195634 - RNA, 21 nt, Streptococcus pneumoniae R6
acgguguuuugagcagucugc

SEQ ID NO: 2195635 - RNA, 17 nt, Streptococcus pneumoniae R6
acgguguuuugagcuga

SEQ ID NO: 2195636 - RNA, 19 nt, Streptococcus pneumoniae R6
acgguguuuugagcugacu

SEQ ID NO: 2195637 - RNA, 18 nt, Streptococcus pneumoniae R6
aggucauaaaccucgaua

SEQ ID NO: 2195638 - RNA, 17 nt, Streptococcus pneumoniae R6
aggucaucagcagagaa

SEQ ID NO: 2195639 - RNA, 22 nt, Streptococcus pneumoniae R6
aggucuuuuugugaauacaaaa

SEQ ID NO: 2195640 - RNA, 17 nt, Streptococcus pneumoniae R6
aggugaacuugaccuaa

SEQ ID NO: 2195641 - RNA, 21 nt, Streptococcus pneumoniae R6
aggucugacaggcuauugaag

SEQ ID NO: 2195642 - RNA, 18 nt, Streptococcus pneumoniae R6
aggugcagagagauaaau

SEQ ID NO: 2195643 - RNA, 16 nt, Streptococcus pneumoniae R6
aggugagauuggauuu

SEQ ID NO: 2195644 - RNA, 16 nt, Streptococcus pneumoniae R6
aggugaauuagugaag

SEQ ID NO: 2195645 - RNA, 23 nt, Streptococcus pneumoniae R6
aggugagggcugagaaggcuggu

SEQ ID NO: 2195646 - RNA, 17 nt, Streptococcus pneumoniae R6
aggugauaaaguccauc

SEQ ID NO: 2195647 - RNA, 17 nt, Streptococcus pneumoniae R6
aggugauaucugguugc

SEQ ID NO: 2195648 - RNA, 19 nt, Streptococcus pneumoniae R6
agguguacuauucuaguuu

SEQ ID NO: 2195649 - RNA, 21 nt, Streptococcus pneumoniae R6
agguguacuguuauagauuca

SEQ ID NO: 2195650 - RNA, 14 nt, Streptococcus pneumoniae R6
agguggggcaaaaa

SEQ ID NO: 2195651 - RNA, 15 nt, Streptococcus pneumoniae R6
agguacuugauuuau

SEQ ID NO: 2195652 - RNA, 21 nt, Streptococcus pneumoniae R6
agguacuaagaccccaacgug

SEQ ID NO: 2195653 - RNA, 14 nt, Streptococcus pneumoniae R6
agguaggagugaaa

SEQ ID NO: 2195654 - RNA, 16 nt, Streptococcus pneumoniae R6
agguaauccagaaaug

SEQ ID NO: 2195655 - RNA, 15 nt, Streptococcus pneumoniae R6
aggucaaaauuccua

SEQ ID NO: 2195656 - RNA, 20 nt, Streptococcus pneumoniae R6
aggucaaaauuccuaaaaua

SEQ ID NO: 2195657 - RNA, 19 nt, Streptococcus pneumoniae R6
aggucaaacuuuuucucuc

SEQ ID NO: 2195658 - RNA, 14 nt, Streptococcus pneumoniae R6
aggucaagagaaaa

SEQ ID NO: 2195659 - RNA, 20 nt, Streptococcus pneumoniae R6
aggucacgaggaggagaaaa

SEQ ID NO: 2195660 - RNA, 22 nt, Streptococcus pneumoniae R6
aggucacgaggaggagaaaaag

SEQ ID NO: 2195661 - RNA, 19 nt, Streptococcus pneumoniae R6
agguauggccgauaacagc

SEQ ID NO: 2195662 - RNA, 23 nt, Streptococcus pneumoniae R6
agguauggccgauaacagccaaa

SEQ ID NO: 2195663 - RNA, 19 nt, Streptococcus pneumoniae R6
agguaugguuacugacuuc

SEQ ID NO: 2195664 - RNA, 22 nt, Streptococcus pneumoniae R6
agguaucuguagaguuuugguu

SEQ ID NO: 2195665 - RNA, 22 nt, Streptococcus pneumoniae R6
agguauugaaaaaacuugauac

SEQ ID NO: 2195666 - RNA, 14 nt, Streptococcus pneumoniae R6
agguauaaaccacg

SEQ ID NO: 2195667 - RNA, 18 nt, Streptococcus pneumoniae R6
aggguugguuaaaaguug

SEQ ID NO: 2195668 - RNA, 15 nt, Streptococcus pneumoniae R6
agguaaaaccaauau

SEQ ID NO: 2195669 - RNA, 18 nt, Streptococcus pneumoniae R6
agguaaaauauagaauug

SEQ ID NO: 2195670 - RNA, 18 nt, Streptococcus pneumoniae R6
agguaaagauagccauga

SEQ ID NO: 2195671 - RNA, 22 nt, Streptococcus pneumoniae R6
aggguccaaaccaacauagaua

SEQ ID NO: 2195672 - RNA, 20 nt, Streptococcus pneumoniae R6
agggucuuuaaugucuagua

SEQ ID NO: 2195673 - RNA, 12 nt, Streptococcus pneumoniae R6
agggucuuuguu

SEQ ID NO: 2195674 - RNA, 18 nt, Streptococcus pneumoniae R6
agggugacuucauuauua

SEQ ID NO: 2195675 - RNA, 18 nt, Streptococcus pneumoniae R6
agggugacaguaaaaaau

SEQ ID NO: 2195676 - RNA, 24 nt, Streptococcus pneumoniae R6
aggguguuuucaaucaagacagau

SEQ ID NO: 2195677 - RNA, 14 nt, Streptococcus pneumoniae R6
agguuucacagaau

SEQ ID NO: 2195678 - RNA, 18 nt, Streptococcus pneumoniae R6
agguuuccugcaugaagg

SEQ ID NO: 2195679 - RNA, 22 nt, Streptococcus pneumoniae R6
agguuuccuuuaaccugaugaa

SEQ ID NO: 2195680 - RNA, 19 nt, Streptococcus pneumoniae R6
agguuguggauagaacuga

SEQ ID NO: 2195681 - RNA, 19 nt, Streptococcus pneumoniae R6
agguuguggaugaaacuga

SEQ ID NO: 2195682 - RNA, 15 nt, Streptococcus pneumoniae R6
agguugguugcuucc

SEQ ID NO: 2195683 - RNA, 18 nt, Streptococcus pneumoniae R6
agguuguagauagaacug

SEQ ID NO: 2195684 - RNA, 19 nt, Streptococcus pneumoniae R6
agguuguagauagaacuga

SEQ ID NO: 2195685 - RNA, 14 nt, Streptococcus pneumoniae R6
agguuguagaugaa

SEQ ID NO: 2195686 - RNA, 21 nt, Streptococcus pneumoniae R6
aguaaaaaaaacauauauuca

SEQ ID NO: 2195687 - RNA, 19 nt, Streptococcus pneumoniae R6
agguuuuucuguacugccc

SEQ ID NO: 2195688 - RNA, 23 nt, Streptococcus pneumoniae R6
agguuuuaucugagaugaggcgc

SEQ ID NO: 2195689 - RNA, 13 nt, Streptococcus pneumoniae R6
agguuuuaaacaa

SEQ ID NO: 2195690 - RNA, 14 nt, Streptococcus pneumoniae R6
aguaaaaauugcuu

SEQ ID NO: 2195691 - RNA, 13 nt, Streptococcus pneumoniae R6
aguaaaaaaagag

SEQ ID NO: 2195692 - RNA, 16 nt, Streptococcus pneumoniae R6
aguaaaaaaagaguug

SEQ ID NO: 2195693 - RNA, 17 nt, Streptococcus pneumoniae R6
aguaaaaacguuuuuca

SEQ ID NO: 2195694 - RNA, 21 nt, Streptococcus pneumoniae R6
aguaaaaucaggauuuuuuca

SEQ ID NO: 2195695 - RNA, 13 nt, Streptococcus pneumoniae R6
aguaaaaugaaac

SEQ ID NO: 2195696 - RNA, 13 nt, Streptococcus pneumoniae R6
aguaaaaugaaau

SEQ ID NO: 2195697 - RNA, 17 nt, Streptococcus pneumoniae R6
aguaaaaugaaauaaga

SEQ ID NO: 2195698 - RNA, 22 nt, Streptococcus pneumoniae R6
aguaaacaaaggauuuugugaa

SEQ ID NO: 2195699 - RNA, 22 nt, Streptococcus pneumoniae R6
aguaaacacacuauguggcuug

SEQ ID NO: 2195700 - RNA, 15 nt, Streptococcus pneumoniae R6
aguaaaccuucccac

SEQ ID NO: 2195701 - RNA, 19 nt, Streptococcus pneumoniae R6
aguaaagacuagacuugcc

SEQ ID NO: 2195702 - RNA, 14 nt, Streptococcus pneumoniae R6
aguaaauaaaacaa

SEQ ID NO: 2195703 - RNA, 15 nt, Streptococcus pneumoniae R6
aguaaauaaaacaaa

SEQ ID NO: 2195704 - RNA, 18 nt, Streptococcus pneumoniae R6
aguaaauaaaacaaaaaa

SEQ ID NO: 2195705 - RNA, 16 nt, Streptococcus pneumoniae R6
aguaaagggcuuuaaa

SEQ ID NO: 2195706 - RNA, 14 nt, Streptococcus pneumoniae R6
aguaaaggacuuua

SEQ ID NO: 2195707 - RNA, 16 nt, Streptococcus pneumoniae R6
aguaaaggacuuuaaa

SEQ ID NO: 2195708 - RNA, 20 nt, Streptococcus pneumoniae R6
aguaaagcuagauuuaaaac

SEQ ID NO: 2195709 - RNA, 13 nt, Streptococcus pneumoniae R6
agguguucaaaaa

SEQ ID NO: 2195710 - RNA, 15 nt, Streptococcus pneumoniae R6
agguucaaaaaaugc

SEQ ID NO: 2195711 - RNA, 22 nt, Streptococcus pneumoniae R6
agguucaauccccaagggacca

SEQ ID NO: 2195712 - RNA, 19 nt, Streptococcus pneumoniae R6
agguuaucguaacggcuuu

SEQ ID NO: 2195713 - RNA, 16 nt, Streptococcus pneumoniae R6
agguucauuucuucua

SEQ ID NO: 2195714 - RNA, 21 nt, Streptococcus pneumoniae R6
agguucuuuuauccuguucuu

SEQ ID NO: 2195715 - RNA, 22 nt, Streptococcus pneumoniae R6
agguucuucaaucaaagcuccc

SEQ ID NO: 2195716 - RNA, 14 nt, Streptococcus pneumoniae R6
agguuccuucugca

SEQ ID NO: 2195717 - RNA, 16 nt, Streptococcus pneumoniae R6
agguugaccauuucaa

SEQ ID NO: 2195718 - RNA, 20 nt, Streptococcus pneumoniae R6
agguugaugaguaaguuuuu

SEQ ID NO: 2195719 - RNA, 14 nt, Streptococcus pneumoniae R6
agguugcagauaaa

SEQ ID NO: 2195720 - RNA, 15 nt, Streptococcus pneumoniae R6
agguugcagaugaaa

SEQ ID NO: 2195721 - RNA, 18 nt, Streptococcus pneumoniae R6
agguugcucaaaacacug

SEQ ID NO: 2195722 - RNA, 21 nt, Streptococcus pneumoniae R6
agguugcucaaaacacuguuu

SEQ ID NO: 2195723 - RNA, 15 nt, Streptococcus pneumoniae R6
agguugcucaaagua

SEQ ID NO: 2195724 - RNA, 19 nt, Streptococcus pneumoniae R6
agguugcucaaaguacugc

SEQ ID NO: 2195725 - RNA, 20 nt, Streptococcus pneumoniae R6
aguaaucacugcagcaaagg

SEQ ID NO: 2195726 - RNA, 22 nt, Streptococcus pneumoniae R6
aguaaucacugcagcaaaggua

SEQ ID NO: 2195727 - RNA, 23 nt, Streptococcus pneumoniae R6
aguaaugacuuguguuuuuccuu

SEQ ID NO: 2195728 - RNA, 17 nt, Streptococcus pneumoniae R6
aguaaucucaaaacagu

SEQ ID NO: 2195729 - RNA, 20 nt, Streptococcus pneumoniae R6
aguaauuuugugauaaaaug

SEQ ID NO: 2195730 - RNA, 16 nt, Streptococcus pneumoniae R6
aguaauuucccauuug

SEQ ID NO: 2195731 - RNA, 20 nt, Streptococcus pneumoniae R6
aguaauuucccauuuguaaa

SEQ ID NO: 2195732 - RNA, 21 nt, Streptococcus pneumoniae R6
aguaaugggcgcauuuuccuu

SEQ ID NO: 2195733 - RNA, 19 nt, Streptococcus pneumoniae R6
aguaaugguugauuugguu

SEQ ID NO: 2195734 - RNA, 20 nt, Streptococcus pneumoniae R6
aguacaaagaauaaaauagu

SEQ ID NO: 2195735 - RNA, 14 nt, Streptococcus pneumoniae R6
aguacaaaagcacu

SEQ ID NO: 2195736 - RNA, 17 nt, Streptococcus pneumoniae R6
aguacaauaccuuuccu

SEQ ID NO: 2195737 - RNA, 16 nt, Streptococcus pneumoniae R6
aguacacaacugcuuc

SEQ ID NO: 2195738 - RNA, 20 nt, Streptococcus pneumoniae R6
aguacacaucuacuucuaaa

SEQ ID NO: 2195739 - RNA, 15 nt, Streptococcus pneumoniae R6
aguacacuucugcuu

SEQ ID NO: 2195740 - RNA, 14 nt, Streptococcus pneumoniae R6
aguacagaacuggc

SEQ ID NO: 2195741 - RNA, 20 nt, Streptococcus pneumoniae R6
aguacaccuuuacuucuaaa

SEQ ID NO: 2195742 - RNA, 19 nt, Streptococcus pneumoniae R6
aguacauugaaauuaaaau

SEQ ID NO: 2195743 - RNA, 18 nt, Streptococcus pneumoniae R6
aguacauugauugcuuca

SEQ ID NO: 2195744 - RNA, 14 nt, Streptococcus pneumoniae R6
aguacaugcaaagu

SEQ ID NO: 2195745 - RNA, 12 nt, Streptococcus pneumoniae R6
aguacaugucag

SEQ ID NO: 2195746 - RNA, 15 nt, Streptococcus pneumoniae R6
aguaccaaggaagaa

SEQ ID NO: 2195747 - RNA, 16 nt, Streptococcus pneumoniae R6
aguaccagauauacca

SEQ ID NO: 2195748 - RNA, 23 nt, Streptococcus pneumoniae R6
aguaauaucuccagauagagcua

SEQ ID NO: 2195749 - RNA, 19 nt, Streptococcus pneumoniae R6
aguaauauaggagauucug

SEQ ID NO: 2195750 - RNA, 14 nt, Streptococcus pneumoniae R6
aguaaguagcaucu

SEQ ID NO: 2195751 - RNA, 22 nt, Streptococcus pneumoniae R6
aguaaguuuaauguccaugcuu

SEQ ID NO: 2195752 - RNA, 12 nt, Streptococcus pneumoniae R6
aguaagugggug

SEQ ID NO: 2195753 - RNA, 16 nt, Streptococcus pneumoniae R6
aguaagauacagacug

SEQ ID NO: 2195754 - RNA, 23 nt, Streptococcus pneumoniae R6
aguaacuuuaccaaaaccuucuu

SEQ ID NO: 2195755 - RNA, 18 nt, Streptococcus pneumoniae R6
aguaacuucugucuauuu

SEQ ID NO: 2195756 - RNA, 22 nt, Streptococcus pneumoniae R6
aguaacuucugucuauuugcuu

SEQ ID NO: 2195757 - RNA, 17 nt, Streptococcus pneumoniae R6
aguaagaauguugcuuu

SEQ ID NO: 2195758 - RNA, 20 nt, Streptococcus pneumoniae R6
aguaacguucuuuucaagaa

SEQ ID NO: 2195759 - RNA, 13 nt, Streptococcus pneumoniae R6
aguaacuauuuuu

SEQ ID NO: 2195760 - RNA, 16 nt, Streptococcus pneumoniae R6
aguaacuauuuuugau

SEQ ID NO: 2195761 - RNA, 18 nt, Streptococcus pneumoniae R6
aguaacggcuuccugugc

SEQ ID NO: 2195762 - RNA, 16 nt, Streptococcus pneumoniae R6
aguaacgagucaaaaa

SEQ ID NO: 2195763 - RNA, 11 nt, Streptococcus pneumoniae R6
aguaacaucaa

SEQ ID NO: 2195764 - RNA, 21 nt, Streptococcus pneumoniae R6
aguaacaucaauaaccaucau

SEQ ID NO: 2195765 - RNA, 15 nt, Streptococcus pneumoniae R6
aguaaccaguugugg

SEQ ID NO: 2195766 - RNA, 15 nt, Streptococcus pneumoniae R6
aguaaauuagggaua

SEQ ID NO: 2195767 - RNA, 22 nt, Streptococcus pneumoniae R6
aguaaauauuucuaugauaaaa

SEQ ID NO: 2195768 - RNA, 20 nt, Streptococcus pneumoniae R6
aguaaauaucauuuccaaca

SEQ ID NO: 2195769 - RNA, 11 nt, Streptococcus pneumoniae R6
aguaaaucuuc

SEQ ID NO: 2195770 - RNA, 13 nt, Streptococcus pneumoniae R6
aguaaaucuuccc

SEQ ID NO: 2195771 - RNA, 14 nt, Streptococcus pneumoniae R6
aguaaaucuuccca

SEQ ID NO: 2195772 - RNA, 20 nt, Streptococcus pneumoniae R6
aguaaaucuucccacaauaa

SEQ ID NO: 2195773 - RNA, 18 nt, Streptococcus pneumoniae R6
aguaaauugucuaaaaau

SEQ ID NO: 2195774 - RNA, 21 nt, Streptococcus pneumoniae R6
aguaaaugugagcuuugguuu

SEQ ID NO: 2195775 - RNA, 16 nt, Streptococcus pneumoniae R6
aggccucuucaaagaa

SEQ ID NO: 2195776 - RNA, 17 nt, Streptococcus pneumoniae R6
aggccucuucaaagaag

SEQ ID NO: 2195777 - RNA, 19 nt, Streptococcus pneumoniae R6
aggccuauuuaccauggac

SEQ ID NO: 2195778 - RNA, 21 nt, Streptococcus pneumoniae R6
aggccuaaggcuguuucaaau

SEQ ID NO: 2195779 - RNA, 18 nt, Streptococcus pneumoniae R6
aggcuauuauuaauguuu

SEQ ID NO: 2195780 - RNA, 16 nt, Streptococcus pneumoniae R6
aggcuauugaagaaga

SEQ ID NO: 2195781 - RNA, 14 nt, Streptococcus pneumoniae R6
aggcuaaugagucu

SEQ ID NO: 2195782 - RNA, 17 nt, Streptococcus pneumoniae R6
aggcuaauugcaaauuu

SEQ ID NO: 2195783 - RNA, 14 nt, Streptococcus pneumoniae R6
aggcugacaauaaa

SEQ ID NO: 2195784 - RNA, 20 nt, Streptococcus pneumoniae R6
aggcugacaauaaagauaag

SEQ ID NO: 2195785 - RNA, 22 nt, Streptococcus pneumoniae R6
aggcugacgcgaucuggcaggc

SEQ ID NO: 2195786 - RNA, 18 nt, Streptococcus pneumoniae R6
aggcucgagaaaggacaa

SEQ ID NO: 2195787 - RNA, 22 nt, Streptococcus pneumoniae R6
aggcucgagaaaggacaaauuu

SEQ ID NO: 2195788 - RNA, 20 nt, Streptococcus pneumoniae R6
agggcauuaaucauucccug

SEQ ID NO: 2195789 - RNA, 21 nt, Streptococcus pneumoniae R6
aggggucaugacuagugaagc

SEQ ID NO: 2195790 - RNA, 21 nt, Streptococcus pneumoniae R6
aggguagcgugucaagaguug

SEQ ID NO: 2195791 - RNA, 13 nt, Streptococcus pneumoniae R6
agggcuucaucaa

SEQ ID NO: 2195792 - RNA, 16 nt, Streptococcus pneumoniae R6
agggcuuuuuuugcuu

SEQ ID NO: 2195793 - RNA, 13 nt, Streptococcus pneumoniae R6
agggcuucuuuga

SEQ ID NO: 2195794 - RNA, 18 nt, Streptococcus pneumoniae R6
aggggaggauagaccugu

SEQ ID NO: 2195795 - RNA, 22 nt, Streptococcus pneumoniae R6
aggggcaacucuucaagguuuu

SEQ ID NO: 2195796 - RNA, 18 nt, Streptococcus pneumoniae R6
agggcguuaccuccaccu

SEQ ID NO: 2195797 - RNA, 22 nt, Streptococcus pneumoniae R6
agggcguugacgauuuucucuu

SEQ ID NO: 2195798 - RNA, 21 nt, Streptococcus pneumoniae R6
agggcugcguugaggacaggu

SEQ ID NO: 2195799 - RNA, 14 nt, Streptococcus pneumoniae R6
agggcugaaggaau

SEQ ID NO: 2195800 - RNA, 17 nt, Streptococcus pneumoniae R6
aggcuuaauauuaccac

SEQ ID NO: 2195801 - RNA, 15 nt, Streptococcus pneumoniae R6
aggcuuuaccaaaaa

SEQ ID NO: 2195802 - RNA, 18 nt, Streptococcus pneumoniae R6
aggcuuuaccaaaaaugu

SEQ ID NO: 2195803 - RNA, 21 nt, Streptococcus pneumoniae R6
aggcuuuaaaugcugguuuuu

SEQ ID NO: 2195804 - RNA, 19 nt, Streptococcus pneumoniae R6
aggcuuggauuuaaaaacg

SEQ ID NO: 2195805 - RNA, 14 nt, Streptococcus pneumoniae R6
aggcuugugugcca

SEQ ID NO: 2195806 - RNA, 23 nt, Streptococcus pneumoniae R6
aggcuugcucugucacuugaccu

SEQ ID NO: 2195807 - RNA, 21 nt, Streptococcus pneumoniae R6
aggcuucuugaccagcgauag

SEQ ID NO: 2195808 - RNA, 20 nt, Streptococcus pneumoniae R6
aggcuuuaguaucaagugua

SEQ ID NO: 2195809 - RNA, 21 nt, Streptococcus pneumoniae R6
aggcuuuaucaagcaaaucaa

SEQ ID NO: 2195810 - RNA, 13 nt, Streptococcus pneumoniae R6
aggcuuucucccu

SEQ ID NO: 2195811 - RNA, 21 nt, Streptococcus pneumoniae R6
aggcuuucucccuuuugcucg

SEQ ID NO: 2195812 - RNA, 22 nt, Streptococcus pneumoniae R6
aggcuggacaaaaacucaauuu

SEQ ID NO: 2195813 - RNA, 15 nt, Streptococcus pneumoniae R6
aggcugcucaaaaca

SEQ ID NO: 2195814 - RNA, 18 nt, Streptococcus pneumoniae R6
aggcugcucaaaacacug

SEQ ID NO: 2195815 - RNA, 16 nt, Streptococcus pneumoniae R6
aggcugguugaaaacc

SEQ ID NO: 2195816 - RNA, 14 nt, Streptococcus pneumoniae R6
aggcuggucgagaa

SEQ ID NO: 2195817 - RNA, 17 nt, Streptococcus pneumoniae R6
aggcugucggcaugcug

SEQ ID NO: 2195818 - RNA, 18 nt, Streptococcus pneumoniae R6
agggcaaagaaaaggaaa

SEQ ID NO: 2195819 - RNA, 13 nt, Streptococcus pneumoniae R6
agggcaaauaaaa

SEQ ID NO: 2195820 - RNA, 17 nt, Streptococcus pneumoniae R6
agggcaaauaaaaagcu

SEQ ID NO: 2195821 - RNA, 14 nt, Streptococcus pneumoniae R6
agggcaaaaaagaa

SEQ ID NO: 2195822 - RNA, 15 nt, Streptococcus pneumoniae R6
agggcaaaaaagaaa

SEQ ID NO: 2195823 - RNA, 16 nt, Streptococcus pneumoniae R6
agggaguuuagaagag

SEQ ID NO: 2195824 - RNA, 22 nt, Streptococcus pneumoniae R6
agggagguaaagauagccauga

SEQ ID NO: 2195825 - RNA, 23 nt, Streptococcus pneumoniae R6
agggaaacaccaccgauagagug

SEQ ID NO: 2195826 - RNA, 14 nt, Streptococcus pneumoniae R6
agggaaacaaaagu

SEQ ID NO: 2195827 - RNA, 19 nt, Streptococcus pneumoniae R6
aggcuuuguggucuugcuu

SEQ ID NO: 2195828 - RNA, 21 nt, Streptococcus pneumoniae R6
aggcuuuuucucaucuauuuu

SEQ ID NO: 2195829 - RNA, 23 nt, Streptococcus pneumoniae R6
agcuaugaauaugaguucuucaa

SEQ ID NO: 2195830 - RNA, 22 nt, Streptococcus pneumoniae R6
agcuauguagccacucuggcaa

SEQ ID NO: 2195831 - RNA, 18 nt, Streptococcus pneumoniae R6
agcuauuaaagauuuuuu

SEQ ID NO: 2195832 - RNA, 13 nt, Streptococcus pneumoniae R6
agcuaauuuugcc

SEQ ID NO: 2195833 - RNA, 14 nt, Streptococcus pneumoniae R6
agcuaauuuugcca

SEQ ID NO: 2195834 - RNA, 15 nt, Streptococcus pneumoniae R6
agcuaauuuugccag

SEQ ID NO: 2195835 - RNA, 12 nt, Streptococcus pneumoniae R6
agcuauuucuug

SEQ ID NO: 2195836 - RNA, 19 nt, Streptococcus pneumoniae R6
agcucaaaacacuguuuua

SEQ ID NO: 2195837 - RNA, 13 nt, Streptococcus pneumoniae R6
agcuaagcucgag

SEQ ID NO: 2195838 - RNA, 20 nt, Streptococcus pneumoniae R6
agcuaagcucgauaaaggac

SEQ ID NO: 2195839 - RNA, 15 nt, Streptococcus pneumoniae R6
agcuaacuuuuccuu

SEQ ID NO: 2195840 - RNA, 15 nt, Streptococcus pneumoniae R6
agcuaagaaaguaag

SEQ ID NO: 2195841 - RNA, 14 nt, Streptococcus pneumoniae R6
agcuaauagagcug

SEQ ID NO: 2195842 - RNA, 15 nt, Streptococcus pneumoniae R6
agcuaaauccuuuuu

SEQ ID NO: 2195843 - RNA, 23 nt, Streptococcus pneumoniae R6
agcuaaaucuaaucauucugaac

SEQ ID NO: 2195844 - RNA, 15 nt, Streptococcus pneumoniae R6
agcggucaaucgcuu

SEQ ID NO: 2195845 - RNA, 22 nt, Streptococcus pneumoniae R6
agcgggauuuaaaauaagagga

SEQ ID NO: 2195846 - RNA, 22 nt, Streptococcus pneumoniae R6
agcggcuagcgucuaacaauua

SEQ ID NO: 2195847 - RNA, 17 nt, Streptococcus pneumoniae R6
agcucaucuaauguuuu

SEQ ID NO: 2195848 - RNA, 18 nt, Streptococcus pneumoniae R6
agcucaucuaauguuuuu

SEQ ID NO: 2195849 - RNA, 16 nt, Streptococcus pneumoniae R6
agcucaagaccuugau

SEQ ID NO: 2195850 - RNA, 18 nt, Streptococcus pneumoniae R6
agcucuuuugggacagaa

SEQ ID NO: 2195851 - RNA, 16 nt, Streptococcus pneumoniae R6
agcucuuuuuggaauu

SEQ ID NO: 2195852 - RNA, 20 nt, Streptococcus pneumoniae R6
agcucuuuuuggaauuuuuu

SEQ ID NO: 2195853 - RNA, 21 nt, Streptococcus pneumoniae R6
agcucuuuuuggaauuuuuug

SEQ ID NO: 2195854 - RNA, 18 nt, Streptococcus pneumoniae R6
agcucuuuuuugauaucu

SEQ ID NO: 2195855 - RNA, 15 nt, Streptococcus pneumoniae R6
agcucuuugacagaa

SEQ ID NO: 2195856 - RNA, 21 nt, Streptococcus pneumoniae R6
agcugcaggcugcucaaaaca

SEQ ID NO: 2195857 - RNA, 19 nt, Streptococcus pneumoniae R6
agcugccuaguuugaucuu

SEQ ID NO: 2195858 - RNA, 22 nt, Streptococcus pneumoniae R6
agcugccccaccugcuacagag

SEQ ID NO: 2195859 - RNA, 14 nt, Streptococcus pneumoniae R6
agcuguuucaacac

SEQ ID NO: 2195860 - RNA, 14 nt, Streptococcus pneumoniae R6
agcuguuuggccaa

SEQ ID NO: 2195861 - RNA, 17 nt, Streptococcus pneumoniae R6
agcuguaucaauugcug

SEQ ID NO: 2195862 - RNA, 18 nt, Streptococcus pneumoniae R6
agcugucaagaaauuaca

SEQ ID NO: 2195863 - RNA, 20 nt, Streptococcus pneumoniae R6
agcugucaagaaauuacagu

SEQ ID NO: 2195864 - RNA, 23 nt, Streptococcus pneumoniae R6
agcuguaaaucuaggacaaagcg

SEQ ID NO: 2195865 - RNA, 18 nt, Streptococcus pneumoniae R6
agcugcgauaaggaaguu

SEQ ID NO: 2195866 - RNA, 14 nt, Streptococcus pneumoniae R6
agcugcgauuuuag

SEQ ID NO: 2195867 - RNA, 14 nt, Streptococcus pneumoniae R6
agcuggcuccuucu

SEQ ID NO: 2195868 - RNA, 16 nt, Streptococcus pneumoniae R6
agcuggcuccuucuuu

SEQ ID NO: 2195869 - RNA, 14 nt, Streptococcus pneumoniae R6
agcuggcucaucug

SEQ ID NO: 2195870 - RNA, 15 nt, Streptococcus pneumoniae R6
agcuuagcuuuucuu

SEQ ID NO: 2195871 - RNA, 19 nt, Streptococcus pneumoniae R6
agcuuauauacccaaaaca

SEQ ID NO: 2195872 - RNA, 21 nt, Streptococcus pneumoniae R6
agcuuauauacccaaaacaca

SEQ ID NO: 2195873 - RNA, 17 nt, Streptococcus pneumoniae R6
agcuucauuuaucuucu

SEQ ID NO: 2195874 - RNA, 15 nt, Streptococcus pneumoniae R6
agcuucaaaucccau

SEQ ID NO: 2195875 - RNA, 20 nt, Streptococcus pneumoniae R6
agcuucaauggacuauagua

SEQ ID NO: 2195876 - RNA, 19 nt, Streptococcus pneumoniae R6
agcuuccgcaagagcaucu

SEQ ID NO: 2195877 - RNA, 23 nt, Streptococcus pneumoniae R6
agcuuccgguaaaguugaaauga

SEQ ID NO: 2195878 - RNA, 16 nt, Streptococcus pneumoniae R6
agcuugaauucuuccu

SEQ ID NO: 2195879 - RNA, 17 nt, Streptococcus pneumoniae R6
agcuugaagcuauccug

SEQ ID NO: 2195880 - RNA, 18 nt, Streptococcus pneumoniae R6
agcuucuuuuuauauaua

SEQ ID NO: 2195881 - RNA, 21 nt, Streptococcus pneumoniae R6
agcuugaaacaaauaaaucau

SEQ ID NO: 2195882 - RNA, 23 nt, Streptococcus pneumoniae R6
agcuucuuggaauucuggauuuu

SEQ ID NO: 2195883 - RNA, 19 nt, Streptococcus pneumoniae R6
agcuucuucguccucuguc

SEQ ID NO: 2195884 - RNA, 20 nt, Streptococcus pneumoniae R6
agcuuuaauagaaagugaca

SEQ ID NO: 2195885 - RNA, 11 nt, Streptococcus pneumoniae R6
agcuuucagag

SEQ ID NO: 2195886 - RNA, 14 nt, Streptococcus pneumoniae R6
agcuuucagcagcu

SEQ ID NO: 2195887 - RNA, 18 nt, Streptococcus pneumoniae R6
agcuuugaaaauuccauu

SEQ ID NO: 2195888 - RNA, 12 nt, Streptococcus pneumoniae R6
agcuuuucuuca

SEQ ID NO: 2195889 - RNA, 15 nt, Streptococcus pneumoniae R6
agcuuuucuucaacc

SEQ ID NO: 2195890 - RNA, 19 nt, Streptococcus pneumoniae R6
agcuuuuauaaauuuucca

SEQ ID NO: 2195891 - RNA, 23 nt, Streptococcus pneumoniae R6
agcuuuucaauacggucaaucaa

SEQ ID NO: 2195892 - RNA, 20 nt, Streptococcus pneumoniae R6
agcuuggcuuugauucaucu

SEQ ID NO: 2195893 - RNA, 14 nt, Streptococcus pneumoniae R6
agcuugcuuccaaa

SEQ ID NO: 2195894 - RNA, 24 nt, Streptococcus pneumoniae R6
agcuugcuuccaaaaauucuuacu

SEQ ID NO: 2195895 - RNA, 18 nt, Streptococcus pneumoniae R6
agcuugcucaaaguacag

SEQ ID NO: 2195896 - RNA, 16 nt, Streptococcus pneumoniae R6
agcuugcuccauucuu

SEQ ID NO: 2195897 - RNA, 16 nt, Streptococcus pneumoniae R6
agcuuguucuucugcu

SEQ ID NO: 2195898 - RNA, 13 nt, Streptococcus pneumoniae R6
agcuugcaaugag

SEQ ID NO: 2195899 - RNA, 15 nt, Streptococcus pneumoniae R6
agcuugcaauucuuu

SEQ ID NO: 2195900 - RNA, 22 nt, Streptococcus pneumoniae R6
agcuugcaauucuuuagcagau

SEQ ID NO: 2195901 - RNA, 16 nt, Streptococcus pneumoniae R6
agcuugcgaaauggcu

SEQ ID NO: 2195902 - RNA, 16 nt, Streptococcus pneumoniae R6
aggagaaucaacauga

SEQ ID NO: 2195903 - RNA, 21 nt, Streptococcus pneumoniae R6
aggagaaucaacaugagaaua

SEQ ID NO: 2195904 - RNA, 16 nt, Streptococcus pneumoniae R6
aggacuuugcuuacag

SEQ ID NO: 2195905 - RNA, 15 nt, Streptococcus pneumoniae R6
aggagaaaaugaaau

SEQ ID NO: 2195906 - RNA, 17 nt, Streptococcus pneumoniae R6
aggagaaagaagagggc

SEQ ID NO: 2195907 - RNA, 13 nt, Streptococcus pneumoniae R6
aggagaaaaagaa

SEQ ID NO: 2195908 - RNA, 13 nt, Streptococcus pneumoniae R6
aggagaaccagga

SEQ ID NO: 2195909 - RNA, 16 nt, Streptococcus pneumoniae R6
aggagaaccaggaaac

SEQ ID NO: 2195910 - RNA, 13 nt, Streptococcus pneumoniae R6
aggacuaaaucca

SEQ ID NO: 2195911 - RNA, 22 nt, Streptococcus pneumoniae R6
aggacguuuugugauaaucaua

SEQ ID NO: 2195912 - RNA, 19 nt, Streptococcus pneumoniae R6
aggacugagccaauuaaau

SEQ ID NO: 2195913 - RNA, 19 nt, Streptococcus pneumoniae R6
aggagauucuuauaaauau

SEQ ID NO: 2195914 - RNA, 17 nt, Streptococcus pneumoniae R6
aggagaugaauugugua

SEQ ID NO: 2195915 - RNA, 11 nt, Streptococcus pneumoniae R6
aggagauaaaa

SEQ ID NO: 2195916 - RNA, 19 nt, Streptococcus pneumoniae R6
aggagcacaguagauuccu

SEQ ID NO: 2195917 - RNA, 22 nt, Streptococcus pneumoniae R6
aggagcacuugaugaaaaaaag

SEQ ID NO: 2195918 - RNA, 13 nt, Streptococcus pneumoniae R6
aggagccaagaua

SEQ ID NO: 2195919 - RNA, 22 nt, Streptococcus pneumoniae R6
aggagaguaugauuacuuauuu

SEQ ID NO: 2195920 - RNA, 17 nt, Streptococcus pneumoniae R6
aggagaauuuuugagau

SEQ ID NO: 2195921 - RNA, 19 nt, Streptococcus pneumoniae R6
aggacaaaucgaucaggac

SEQ ID NO: 2195922 - RNA, 14 nt, Streptococcus pneumoniae R6
aggacauaaauaug

SEQ ID NO: 2195923 - RNA, 14 nt, Streptococcus pneumoniae R6
aggacauaaaucga

SEQ ID NO: 2195924 - RNA, 11 nt, Streptococcus pneumoniae R6
aggacauagaa

SEQ ID NO: 2195925 - RNA, 17 nt, Streptococcus pneumoniae R6
aggacagucaaaucgau

SEQ ID NO: 2195926 - RNA, 15 nt, Streptococcus pneumoniae R6
aggacaucauaaauc

SEQ ID NO: 2195927 - RNA, 14 nt, Streptococcus pneumoniae R6
aggacaucauaacu

SEQ ID NO: 2195928 - RNA, 14 nt, Streptococcus pneumoniae R6
aggacauugacuuu

SEQ ID NO: 2195929 - RNA, 15 nt, Streptococcus pneumoniae R6
aggaccagguuuuuc

SEQ ID NO: 2195930 - RNA, 17 nt, Streptococcus pneumoniae R6
aggaccagguuuuucac

SEQ ID NO: 2195931 - RNA, 14 nt, Streptococcus pneumoniae R6
aggacgaacgcugg

SEQ ID NO: 2195932 - RNA, 16 nt, Streptococcus pneumoniae R6
aggauaauagcaagga

SEQ ID NO: 2195933 - RNA, 18 nt, Streptococcus pneumoniae R6
aggauagaaguagagagu

SEQ ID NO: 2195934 - RNA, 14 nt, Streptococcus pneumoniae R6
aggauacugucuca

SEQ ID NO: 2195935 - RNA, 14 nt, Streptococcus pneumoniae R6
aggauagcgaggau

SEQ ID NO: 2195936 - RNA, 14 nt, Streptococcus pneumoniae R6
aggauagauaccuu

SEQ ID NO: 2195937 - RNA, 13 nt, Streptococcus pneumoniae R6
aggauaugaggag

SEQ ID NO: 2195938 - RNA, 15 nt, Streptococcus pneumoniae R6
aggauaugaggagaa

SEQ ID NO: 2195939 - RNA, 19 nt, Streptococcus pneumoniae R6
aggauaugaggagaaagaa

SEQ ID NO: 2195940 - RNA, 20 nt, Streptococcus pneumoniae R6
aggauauuucuccaaagccu

SEQ ID NO: 2195941 - RNA, 20 nt, Streptococcus pneumoniae R6
aggagcuaacggaauuaaua

SEQ ID NO: 2195942 - RNA, 21 nt, Streptococcus pneumoniae R6
aggaggcaaagaaaaaagcug

SEQ ID NO: 2195943 - RNA, 20 nt, Streptococcus pneumoniae R6
aggagcuggaucuugaggaa

SEQ ID NO: 2195944 - RNA, 14 nt, Streptococcus pneumoniae R6
aggaggagaaaaag

SEQ ID NO: 2195945 - RNA, 16 nt, Streptococcus pneumoniae R6
aggauaaaaaguccau

SEQ ID NO: 2195946 - RNA, 19 nt, Streptococcus pneumoniae R6
aggauaaaaaagaaggagc

SEQ ID NO: 2195947 - RNA, 15 nt, Streptococcus pneumoniae R6
aggaguccucuguau

SEQ ID NO: 2195948 - RNA, 21 nt, Streptococcus pneumoniae R6
aggaguuaaccucgagaaagg

SEQ ID NO: 2195949 - RNA, 18 nt, Streptococcus pneumoniae R6
aggaacacguaaauuaua

SEQ ID NO: 2195950 - RNA, 23 nt, Streptococcus pneumoniae R6
aggaacacguaaauuauacucuu

SEQ ID NO: 2195951 - RNA, 14 nt, Streptococcus pneumoniae R6
aggaaccaaaugau

SEQ ID NO: 2195952 - RNA, 20 nt, Streptococcus pneumoniae R6
aggaaaucccuacaaggaag

SEQ ID NO: 2195953 - RNA, 18 nt, Streptococcus pneumoniae R6
aggaaaucccucggcuuu

SEQ ID NO: 2195954 - RNA, 19 nt, Streptococcus pneumoniae R6
aggaaaucccucggcuuuu

SEQ ID NO: 2195955 - RNA, 18 nt, Streptococcus pneumoniae R6
aggaaccccaacuuacau

SEQ ID NO: 2195956 - RNA, 15 nt, Streptococcus pneumoniae R6
aggaacuauccguga

SEQ ID NO: 2195957 - RNA, 14 nt, Streptococcus pneumoniae R6
aggaagaaagagga

SEQ ID NO: 2195958 - RNA, 15 nt, Streptococcus pneumoniae R6
aggaagaaagaggag

SEQ ID NO: 2195959 - RNA, 13 nt, Streptococcus pneumoniae R6
agcuuuuuccuca

SEQ ID NO: 2195960 - RNA, 14 nt, Streptococcus pneumoniae R6
agcuuuuuccucau

SEQ ID NO: 2195961 - RNA, 21 nt, Streptococcus pneumoniae R6
agcuuuugugauaaaggccuu

SEQ ID NO: 2195962 - RNA, 18 nt, Streptococcus pneumoniae R6
aggaaaaugauuuuuuac

SEQ ID NO: 2195963 - RNA, 18 nt, Streptococcus pneumoniae R6
aggaaagucaaauuaauu

SEQ ID NO: 2195964 - RNA, 21 nt, Streptococcus pneumoniae R6
aggaaagucggaaggcaugaa

SEQ ID NO: 2195965 - RNA, 15 nt, Streptococcus pneumoniae R6
aggaaaguucuuccc

SEQ ID NO: 2195966 - RNA, 22 nt, Streptococcus pneumoniae R6
aggaaauaagucagcucacaaa

SEQ ID NO: 2195967 - RNA, 21 nt, Streptococcus pneumoniae R6
aggaaaaucuucccacaauaa

SEQ ID NO: 2195968 - RNA, 17 nt, Streptococcus pneumoniae R6
aggaaacucuuacaaaa

SEQ ID NO: 2195969 - RNA, 16 nt, Streptococcus pneumoniae R6
aggaauaucaaaguuu

SEQ ID NO: 2195970 - RNA, 23 nt, Streptococcus pneumoniae R6
aggaauauugaguucuucacgaa

SEQ ID NO: 2195971 - RNA, 23 nt, Streptococcus pneumoniae R6
aggaaucuugcugguuugugaag

SEQ ID NO: 2195972 - RNA, 17 nt, Streptococcus pneumoniae R6
aggaauucaagcaaaac

SEQ ID NO: 2195973 - RNA, 19 nt, Streptococcus pneumoniae R6
aggaauucaagcaaaacaa

SEQ ID NO: 2195974 - RNA, 18 nt, Streptococcus pneumoniae R6
aggacaaaauucguccuu

SEQ ID NO: 2195975 - RNA, 14 nt, Streptococcus pneumoniae R6
aggaauuuuagaag

SEQ ID NO: 2195976 - RNA, 18 nt, Streptococcus pneumoniae R6
aggacaaguuaaauaaua

SEQ ID NO: 2195977 - RNA, 13 nt, Streptococcus pneumoniae R6
aggacaaauuucg

SEQ ID NO: 2195978 - RNA, 13 nt, Streptococcus pneumoniae R6
aggaauacuaaaa

SEQ ID NO: 2195979 - RNA, 15 nt, Streptococcus pneumoniae R6
aggaauacuaaaaua

SEQ ID NO: 2195980 - RNA, 16 nt, Streptococcus pneumoniae R6
aggaauacuaaaauau

SEQ ID NO: 2195981 - RNA, 20 nt, Streptococcus pneumoniae R6
aggaauacuaaaauauuucu

SEQ ID NO: 2195982 - RNA, 19 nt, Streptococcus pneumoniae R6
aggaauaaauccagcugag

SEQ ID NO: 2195983 - RNA, 20 nt, Streptococcus pneumoniae R6
aggaauaaauccagcugaga

SEQ ID NO: 2195984 - RNA, 20 nt, Streptococcus pneumoniae R6
aggaaguaccaaggaagaag

SEQ ID NO: 2195985 - RNA, 15 nt, Streptococcus pneumoniae R6
aggaagguuuuaaag

SEQ ID NO: 2195986 - RNA, 23 nt, Streptococcus pneumoniae R6
aggaagguaacucccauaguuaa

SEQ ID NO: 2195987 - RNA, 17 nt, Streptococcus pneumoniae R6
aggaagguuauuuggau

SEQ ID NO: 2195988 - RNA, 20 nt, Streptococcus pneumoniae R6
aggaaggggacaagguguuu

SEQ ID NO: 2195989 - RNA, 19 nt, Streptococcus pneumoniae R6
aggaagccuucuuuuccac

SEQ ID NO: 2195990 - RNA, 22 nt, Streptococcus pneumoniae R6
aggaaggaaauagcuguuucaa

SEQ ID NO: 2195991 - RNA, 19 nt, Streptococcus pneumoniae R6
aggaagcuagucucagcuu

SEQ ID NO: 2195992 - RNA, 19 nt, Streptococcus pneumoniae R6
aggcccaauuaaaaucaaa

SEQ ID NO: 2195993 - RNA, 14 nt, Streptococcus pneumoniae R6
aggccacaaaugcu

SEQ ID NO: 2195994 - RNA, 16 nt, Streptococcus pneumoniae R6
aggccaaacuugaaau

SEQ ID NO: 2195995 - RNA, 19 nt, Streptococcus pneumoniae R6
aggccaaacuugaaaugau

SEQ ID NO: 2195996 - RNA, 11 nt, Streptococcus pneumoniae R6
aggccaagaua

SEQ ID NO: 2195997 - RNA, 13 nt, Streptococcus pneumoniae R6
aggccaauacaga

SEQ ID NO: 2195998 - RNA, 16 nt, Streptococcus pneumoniae R6
aggcaggacaaaagau

SEQ ID NO: 2195999 - RNA, 15 nt, Streptococcus pneumoniae R6
aggcagcuuguucuu

SEQ ID NO: 2196000 - RNA, 21 nt, Streptococcus pneumoniae R6
aggcagcuuguucuucugcug

SEQ ID NO: 2196001 - RNA, 18 nt, Streptococcus pneumoniae R6
aggcagcuuaagugcguu

SEQ ID NO: 2196002 - RNA, 22 nt, Streptococcus pneumoniae R6
aggcauaguaccaguuaccauu

SEQ ID NO: 2196003 - RNA, 14 nt, Streptococcus pneumoniae R6
aggcauaauacugu

SEQ ID NO: 2196004 - RNA, 23 nt, Streptococcus pneumoniae R6
aggcaucacgaaaauauuuggaa

SEQ ID NO: 2196005 - RNA, 17 nt, Streptococcus pneumoniae R6
aggcaucaucugaaauc

SEQ ID NO: 2196006 - RNA, 16 nt, Streptococcus pneumoniae R6
aggaugacaauagcua

SEQ ID NO: 2196007 - RNA, 20 nt, Streptococcus pneumoniae R6
aggaugacaauagcuaauag

SEQ ID NO: 2196008 - RNA, 22 nt, Streptococcus pneumoniae R6
aggaugacaauagcuaauagaa

SEQ ID NO: 2196009 - RNA, 21 nt, Streptococcus pneumoniae R6
aggauggcuccagaaauaaua

SEQ ID NO: 2196010 - RNA, 23 nt, Streptococcus pneumoniae R6
aggauuuaggacuaaauacaaaa

SEQ ID NO: 2196011 - RNA, 21 nt, Streptococcus pneumoniae R6
aggauugucugaacugccccc

SEQ ID NO: 2196012 - RNA, 14 nt, Streptococcus pneumoniae R6
aggauuuccuagua

SEQ ID NO: 2196013 - RNA, 13 nt, Streptococcus pneumoniae R6
aggcaaagaaaaa

SEQ ID NO: 2196014 - RNA, 21 nt, Streptococcus pneumoniae R6
aggauuaccuuugaaaaaaug

SEQ ID NO: 2196015 - RNA, 14 nt, Streptococcus pneumoniae R6
aggauugauaaaau

SEQ ID NO: 2196016 - RNA, 19 nt, Streptococcus pneumoniae R6
aggauugacaaaauuuggu

SEQ ID NO: 2196017 - RNA, 18 nt, Streptococcus pneumoniae R6
aggcagauucucuaucuc

SEQ ID NO: 2196018 - RNA, 23 nt, Streptococcus pneumoniae R6
aggcacuuuuguccuauucuugu

SEQ ID NO: 2196019 - RNA, 16 nt, Streptococcus pneumoniae R6
aggcaaccaaaaucau

SEQ ID NO: 2196020 - RNA, 18 nt, Streptococcus pneumoniae R6
aggcaauggccuguucua

SEQ ID NO: 2196021 - RNA, 15 nt, Streptococcus pneumoniae R6
aggcaauuaaaaggc

SEQ ID NO: 2196022 - RNA, 16 nt, Streptococcus pneumoniae R6
aggcaauuaaaaggcu

SEQ ID NO: 2196023 - RNA, 17 nt, Streptococcus pneumoniae R6
auaagcuugugaaagcu

SEQ ID NO: 2196024 - RNA, 17 nt, Streptococcus pneumoniae R6
auaaggaagucuguuau

SEQ ID NO: 2196025 - RNA, 23 nt, Streptococcus pneumoniae R6
auaaggaagucuguuauuucuug

SEQ ID NO: 2196026 - RNA, 19 nt, Streptococcus pneumoniae R6
auaagcggcuagcgucuaa

SEQ ID NO: 2196027 - RNA, 19 nt, Streptococcus pneumoniae R6
auaagcuacauagagauug

SEQ ID NO: 2196028 - RNA, 22 nt, Streptococcus pneumoniae R6
auaagcccgaaaaauuucucug

SEQ ID NO: 2196029 - RNA, 21 nt, Streptococcus pneumoniae R6
auaagccgaagccaaucaaac

SEQ ID NO: 2196030 - RNA, 18 nt, Streptococcus pneumoniae R6
auaagcccaaaucaucag

SEQ ID NO: 2196031 - RNA, 15 nt, Streptococcus pneumoniae R6
auaagcgauugagaa

SEQ ID NO: 2196032 - RNA, 22 nt, Streptococcus pneumoniae R6
auaagcaccuacaacauagacu

SEQ ID NO: 2196033 - RNA, 13 nt, Streptococcus pneumoniae R6
auaagagcaacaa

SEQ ID NO: 2196034 - RNA, 17 nt, Streptococcus pneumoniae R6
auaagagcaacaaauau

SEQ ID NO: 2196035 - RNA, 18 nt, Streptococcus pneumoniae R6
auaagagcaacaaauaug

SEQ ID NO: 2196036 - RNA, 20 nt, Streptococcus pneumoniae R6
auaagagcaacaaauauggu

SEQ ID NO: 2196037 - RNA, 15 nt, Streptococcus pneumoniae R6
auaagaauaucaaga

SEQ ID NO: 2196038 - RNA, 16 nt, Streptococcus pneumoniae R6
auaagaauaucaagau

SEQ ID NO: 2196039 - RNA, 17 nt, Streptococcus pneumoniae R6
auaagaggauuuuaaag

SEQ ID NO: 2196040 - RNA, 16 nt, Streptococcus pneumoniae R6
auaagaggucugaaac

SEQ ID NO: 2196041 - RNA, 18 nt, Streptococcus pneumoniae R6
auaagaggucugaaacua

SEQ ID NO: 2196042 - RNA, 19 nt, Streptococcus pneumoniae R6
auaagauaaggcaucuuaa

SEQ ID NO: 2196043 - RNA, 17 nt, Streptococcus pneumoniae R6
auaagauaauaaauagu

SEQ ID NO: 2196044 - RNA, 16 nt, Streptococcus pneumoniae R6
auaagagaagagagca

SEQ ID NO: 2196045 - RNA, 17 nt, Streptococcus pneumoniae R6
auaagagaauuaagaua

SEQ ID NO: 2196046 - RNA, 16 nt, Streptococcus pneumoniae R6
auaagauaucacucau

SEQ ID NO: 2196047 - RNA, 20 nt, Streptococcus pneumoniae R6
auaagauuaauuucagaaau

SEQ ID NO: 2196048 - RNA, 24 nt, Streptococcus pneumoniae R6
auaagcaauucaauuuuauacuca

SEQ ID NO: 2196049 - RNA, 19 nt, Streptococcus pneumoniae R6
auaaggacugcgauugggg

SEQ ID NO: 2196050 - RNA, 14 nt, Streptococcus pneumoniae R6
auaagcuuugaaaa

SEQ ID NO: 2196051 - RNA, 19 nt, Streptococcus pneumoniae R6
auaagcuuugaaaauucca

SEQ ID NO: 2196052 - RNA, 21 nt, Streptococcus pneumoniae R6
auaaggcaucuuaacauucuc

SEQ ID NO: 2196053 - RNA, 19 nt, Streptococcus pneumoniae R6
auaaguccgaaaaauuucu

SEQ ID NO: 2196054 - RNA, 14 nt, Streptococcus pneumoniae R6
auaagucagcucac

SEQ ID NO: 2196055 - RNA, 19 nt, Streptococcus pneumoniae R6
auaaguuccaucugggucg

SEQ ID NO: 2196056 - RNA, 14 nt, Streptococcus pneumoniae R6
auaagucuuugauu

SEQ ID NO: 2196057 - RNA, 11 nt, Streptococcus pneumoniae R6
auaaguggcaa

SEQ ID NO: 2196058 - RNA, 20 nt, Streptococcus pneumoniae R6
auaauaaaagugucuuaaca

SEQ ID NO: 2196059 - RNA, 18 nt, Streptococcus pneumoniae R6
auaaguuguaguacugaa

SEQ ID NO: 2196060 - RNA, 21 nt, Streptococcus pneumoniae R6
auaaguuguaguacugaacaa

SEQ ID NO: 2196061 - RNA, 22 nt, Streptococcus pneumoniae R6
auaaguuuuguuugucaguuau

SEQ ID NO: 2196062 - RNA, 12 nt, Streptococcus pneumoniae R6
auaauaaaacuu

SEQ ID NO: 2196063 - RNA, 17 nt, Streptococcus pneumoniae R6
auaaucguuuaaaacac

SEQ ID NO: 2196064 - RNA, 17 nt, Streptococcus pneumoniae R6
auaaucuuggucaacau

SEQ ID NO: 2196065 - RNA, 13 nt, Streptococcus pneumoniae R6
auaaucuugacaa

SEQ ID NO: 2196066 - RNA, 19 nt, Streptococcus pneumoniae R6
auaaucuuaucucuaucuc

SEQ ID NO: 2196067 - RNA, 15 nt, Streptococcus pneumoniae R6
auaaucauaaagccu

SEQ ID NO: 2196068 - RNA, 17 nt, Streptococcus pneumoniae R6
auaaucgccauacaucu

SEQ ID NO: 2196069 - RNA, 21 nt, Streptococcus pneumoniae R6
auaaucgcaagguagagacag

SEQ ID NO: 2196070 - RNA, 17 nt, Streptococcus pneumoniae R6
auaaugaagacaucaua

SEQ ID NO: 2196071 - RNA, 22 nt, Streptococcus pneumoniae R6
auaaugaagacaucauauaaau

SEQ ID NO: 2196072 - RNA, 17 nt, Streptococcus pneumoniae R6
auaauggauugaaauaa

SEQ ID NO: 2196073 - RNA, 16 nt, Streptococcus pneumoniae R6
auaauuaaaucauaaa

SEQ ID NO: 2196074 - RNA, 19 nt, Streptococcus pneumoniae R6
auaauuaaaucauaaacac

SEQ ID NO: 2196075 - RNA, 23 nt, Streptococcus pneumoniae R6
auaauaauugacgaagaaaccaa

SEQ ID NO: 2196076 - RNA, 15 nt, Streptococcus pneumoniae R6
auaauaauuuauaaa

SEQ ID NO: 2196077 - RNA, 14 nt, Streptococcus pneumoniae R6
auaauacaaaaaau

SEQ ID NO: 2196078 - RNA, 15 nt, Streptococcus pneumoniae R6
auaauaggagcuuuu

SEQ ID NO: 2196079 - RNA, 17 nt, Streptococcus pneumoniae R6
auaauagcacuuaaaaa

SEQ ID NO: 2196080 - RNA, 22 nt, Streptococcus pneumoniae R6
auaauagcgauagauguuuuca

SEQ ID NO: 2196081 - RNA, 19 nt, Streptococcus pneumoniae R6
auaauagcgaugaagagag

SEQ ID NO: 2196082 - RNA, 21 nt, Streptococcus pneumoniae R6
auaauagcgaugaagagagag

SEQ ID NO: 2196083 - RNA, 17 nt, Streptococcus pneumoniae R6
auaauagauugaaacua

SEQ ID NO: 2196084 - RNA, 15 nt, Streptococcus pneumoniae R6
auaauagucucuugc

SEQ ID NO: 2196085 - RNA, 17 nt, Streptococcus pneumoniae R6
auaauagucucuugcga

SEQ ID NO: 2196086 - RNA, 23 nt, Streptococcus pneumoniae R6
auaauaguaagaguugaaaauag

SEQ ID NO: 2196087 - RNA, 19 nt, Streptococcus pneumoniae R6
auaauagaaaacagacaaa

SEQ ID NO: 2196088 - RNA, 21 nt, Streptococcus pneumoniae R6
auaauagaaaacagacaaaac

SEQ ID NO: 2196089 - RNA, 18 nt, Streptococcus pneumoniae R6
auaauagaaauuuugaaa

SEQ ID NO: 2196090 - RNA, 21 nt, Streptococcus pneumoniae R6
auaauacucaaugaaaaucaa

SEQ ID NO: 2196091 - RNA, 22 nt, Streptococcus pneumoniae R6
auaauacgaccaaucuuuucca

SEQ ID NO: 2196092 - RNA, 20 nt, Streptococcus pneumoniae R6
auaauagugauuggagauac

SEQ ID NO: 2196093 - RNA, 20 nt, Streptococcus pneumoniae R6
auaauauuacuucuaaaaca

SEQ ID NO: 2196094 - RNA, 15 nt, Streptococcus pneumoniae R6
auaauauguauuuau

SEQ ID NO: 2196095 - RNA, 17 nt, Streptococcus pneumoniae R6
auaauauguauuuauag

SEQ ID NO: 2196096 - RNA, 17 nt, Streptococcus pneumoniae R6
auaauaucagauauucu

SEQ ID NO: 2196097 - RNA, 20 nt, Streptococcus pneumoniae R6
auaauaucagauauucuaaa

SEQ ID NO: 2196098 - RNA, 23 nt, Streptococcus pneumoniae R6
auaauaucagauauucuaaaacc

SEQ ID NO: 2196099 - RNA, 18 nt, Streptococcus pneumoniae R6
auaaucaauauagaagua

SEQ ID NO: 2196100 - RNA, 20 nt, Streptococcus pneumoniae R6
auaaucaauauagucuauaa

SEQ ID NO: 2196101 - RNA, 22 nt, Streptococcus pneumoniae R6
auaaucaaaauauguuuucuuu

SEQ ID NO: 2196102 - RNA, 16 nt, Streptococcus pneumoniae R6
auaaagguaaaaccaa

SEQ ID NO: 2196103 - RNA, 22 nt, Streptococcus pneumoniae R6
auaaagcuugaccugauaguuu

SEQ ID NO: 2196104 - RNA, 19 nt, Streptococcus pneumoniae R6
auaaagccuuucgaacuuu

SEQ ID NO: 2196105 - RNA, 14 nt, Streptococcus pneumoniae R6
auaaauaauuauag

SEQ ID NO: 2196106 - RNA, 21 nt, Streptococcus pneumoniae R6
auaaauaauuauagaaaugag

SEQ ID NO: 2196107 - RNA, 11 nt, Streptococcus pneumoniae R6
auaaauacaac

SEQ ID NO: 2196108 - RNA, 13 nt, Streptococcus pneumoniae R6
auaaauacaacag

SEQ ID NO: 2196109 - RNA, 21 nt, Streptococcus pneumoniae R6
auaaaucgcuuuuguaaaucu

SEQ ID NO: 2196110 - RNA, 16 nt, Streptococcus pneumoniae R6
auaaaucuucuaaauu

SEQ ID NO: 2196111 - RNA, 18 nt, Streptococcus pneumoniae R6
auaaacuauccagagcau

SEQ ID NO: 2196112 - RNA, 21 nt, Streptococcus pneumoniae R6
auaaagagucuggaacaaaau

SEQ ID NO: 2196113 - RNA, 18 nt, Streptococcus pneumoniae R6
auaaaaauaacuucagau

SEQ ID NO: 2196114 - RNA, 14 nt, Streptococcus pneumoniae R6
auaaaaagaaaugu

SEQ ID NO: 2196115 - RNA, 11 nt, Streptococcus pneumoniae R6
auaaaaagacc

SEQ ID NO: 2196116 - RNA, 21 nt, Streptococcus pneumoniae R6
auaaaaagaccggauugcucc

SEQ ID NO: 2196117 - RNA, 17 nt, Streptococcus pneumoniae R6
auaaaaagcauaguauc

SEQ ID NO: 2196118 - RNA, 17 nt, Streptococcus pneumoniae R6
auaaaccacgaggguaa

SEQ ID NO: 2196119 - RNA, 16 nt, Streptococcus pneumoniae R6
auaaaugacaggcugc

SEQ ID NO: 2196120 - RNA, 14 nt, Streptococcus pneumoniae R6
auaaaugacaugcu

SEQ ID NO: 2196121 - RNA, 22 nt, Streptococcus pneumoniae R6
auaaaugucgaaccaagagcac

SEQ ID NO: 2196122 - RNA, 16 nt, Streptococcus pneumoniae R6
auaaauguuuuagcaa

SEQ ID NO: 2196123 - RNA, 17 nt, Streptococcus pneumoniae R6
auaaauguuuuagcaau

SEQ ID NO: 2196124 - RNA, 16 nt, Streptococcus pneumoniae R6
auaaauuaauugucua

SEQ ID NO: 2196125 - RNA, 16 nt, Streptococcus pneumoniae R6
auaaauuuuccagcua

SEQ ID NO: 2196126 - RNA, 22 nt, Streptococcus pneumoniae R6
auaacacccugcaugagcuguu

SEQ ID NO: 2196127 - RNA, 19 nt, Streptococcus pneumoniae R6
auaacagcauuuccaccug

SEQ ID NO: 2196128 - RNA, 15 nt, Streptococcus pneumoniae R6
auaacagagaagaaa

SEQ ID NO: 2196129 - RNA, 16 nt, Streptococcus pneumoniae R6
auaacagagaagaaau

SEQ ID NO: 2196130 - RNA, 17 nt, Streptococcus pneumoniae R6
auaacagagaagaaauu

SEQ ID NO: 2196131 - RNA, 19 nt, Streptococcus pneumoniae R6
auaacagagaagaaauucc

SEQ ID NO: 2196132 - RNA, 17 nt, Streptococcus pneumoniae R6
auaacacgagaaacaau

SEQ ID NO: 2196133 - RNA, 19 nt, Streptococcus pneumoniae R6
auaacauugacaucuguga

SEQ ID NO: 2196134 - RNA, 20 nt, Streptococcus pneumoniae R6
auaacauuuccucgaagcaa

SEQ ID NO: 2196135 - RNA, 22 nt, Streptococcus pneumoniae R6
auaaccaaaacgccaucuucca

SEQ ID NO: 2196136 - RNA, 16 nt, Streptococcus pneumoniae R6
auaacugcuaaaagau

SEQ ID NO: 2196137 - RNA, 23 nt, Streptococcus pneumoniae R6
auaacuucacuaguauucaucuu

SEQ ID NO: 2196138 - RNA, 17 nt, Streptococcus pneumoniae R6
auaacuucaauaucuuu

SEQ ID NO: 2196139 - RNA, 19 nt, Streptococcus pneumoniae R6
auaacuucaauaucuuuaa

SEQ ID NO: 2196140 - RNA, 16 nt, Streptococcus pneumoniae R6
auaacucgaucaacaa

SEQ ID NO: 2196141 - RNA, 18 nt, Streptococcus pneumoniae R6
auaagaaaccgucaucag

SEQ ID NO: 2196142 - RNA, 22 nt, Streptococcus pneumoniae R6
auaagaaccaauauguaggcua

SEQ ID NO: 2196143 - RNA, 12 nt, Streptococcus pneumoniae R6
auaacuuuucug

SEQ ID NO: 2196144 - RNA, 14 nt, Streptococcus pneumoniae R6
auaacuuuauccag

SEQ ID NO: 2196145 - RNA, 21 nt, Streptococcus pneumoniae R6
auaacuuguuuacguuuuaaa

SEQ ID NO: 2196146 - RNA, 16 nt, Streptococcus pneumoniae R6
auaacuaguuaauacu

SEQ ID NO: 2196147 - RNA, 15 nt, Streptococcus pneumoniae R6
auaacucauaauagu

SEQ ID NO: 2196148 - RNA, 18 nt, Streptococcus pneumoniae R6
agucuucaauacgaacac

SEQ ID NO: 2196149 - RNA, 16 nt, Streptococcus pneumoniae R6
agucuucggaauagcu

SEQ ID NO: 2196150 - RNA, 24 nt, Streptococcus pneumoniae R6
agucuucggaauagcucaaaaguu

SEQ ID NO: 2196151 - RNA, 18 nt, Streptococcus pneumoniae R6
agucuuccgaauagcuca

SEQ ID NO: 2196152 - RNA, 23 nt, Streptococcus pneumoniae R6
agucugggaaaaauuuucaaaau

SEQ ID NO: 2196153 - RNA, 15 nt, Streptococcus pneumoniae R6
agucugggugcugaa

SEQ ID NO: 2196154 - RNA, 23 nt, Streptococcus pneumoniae R6
agucugguucccagcauggucag

SEQ ID NO: 2196155 - RNA, 21 nt, Streptococcus pneumoniae R6
agucugacgcuggaaauaaga

SEQ ID NO: 2196156 - RNA, 15 nt, Streptococcus pneumoniae R6
agucugcuuuauagu

SEQ ID NO: 2196157 - RNA, 17 nt, Streptococcus pneumoniae R6
agucugcuuuauagugg

SEQ ID NO: 2196158 - RNA, 20 nt, Streptococcus pneumoniae R6
agugacagaaaugaguaaga

SEQ ID NO: 2196159 - RNA, 14 nt, Streptococcus pneumoniae R6
agugaauugaaaua

SEQ ID NO: 2196160 - RNA, 16 nt, Streptococcus pneumoniae R6
agugaauugaaauaag

SEQ ID NO: 2196161 - RNA, 22 nt, Streptococcus pneumoniae R6
agucuugacaaagaaaaaacaa

SEQ ID NO: 2196162 - RNA, 22 nt, Streptococcus pneumoniae R6
agucuuguuugagaauugcuuu

SEQ ID NO: 2196163 - RNA, 13 nt, Streptococcus pneumoniae R6
agucuuggaaaau

SEQ ID NO: 2196164 - RNA, 14 nt, Streptococcus pneumoniae R6
agucuugcucuuca

SEQ ID NO: 2196165 - RNA, 20 nt, Streptococcus pneumoniae R6
agucuuucuucguuuuuacu

SEQ ID NO: 2196166 - RNA, 22 nt, Streptococcus pneumoniae R6
agucuuucuucguuuuuacuac

SEQ ID NO: 2196167 - RNA, 19 nt, Streptococcus pneumoniae R6
agucuuuucggauggcuag

SEQ ID NO: 2196168 - RNA, 22 nt, Streptococcus pneumoniae R6
aguaccguucauauccguucca

SEQ ID NO: 2196169 - RNA, 16 nt, Streptococcus pneumoniae R6
aguaccgacuucugag

SEQ ID NO: 2196170 - RNA, 18 nt, Streptococcus pneumoniae R6
aguaccgccaaaccuucu

SEQ ID NO: 2196171 - RNA, 18 nt, Streptococcus pneumoniae R6
aguaccgaauguggauac

SEQ ID NO: 2196172 - RNA, 21 nt, Streptococcus pneumoniae R6
aguacccucggcuguuuuuuc

SEQ ID NO: 2196173 - RNA, 14 nt, Streptococcus pneumoniae R6
aguccuuguuucca

SEQ ID NO: 2196174 - RNA, 18 nt, Streptococcus pneumoniae R6
aguccuuguaugacaucu

SEQ ID NO: 2196175 - RNA, 13 nt, Streptococcus pneumoniae R6
aguccguuuucac

SEQ ID NO: 2196176 - RNA, 22 nt, Streptococcus pneumoniae R6
aguccguuuucaccaaaacuau

SEQ ID NO: 2196177 - RNA, 19 nt, Streptococcus pneumoniae R6
agucuagcaauucuugguu

SEQ ID NO: 2196178 - RNA, 14 nt, Streptococcus pneumoniae R6
agucugaaaaagag

SEQ ID NO: 2196179 - RNA, 18 nt, Streptococcus pneumoniae R6
agucugaaaaauaggaug

SEQ ID NO: 2196180 - RNA, 16 nt, Streptococcus pneumoniae R6
agucguuucaagauaa

SEQ ID NO: 2196181 - RNA, 20 nt, Streptococcus pneumoniae R6
agucguuucaagauaaggaa

SEQ ID NO: 2196182 - RNA, 19 nt, Streptococcus pneumoniae R6
agucguucggcuucaucug

SEQ ID NO: 2196183 - RNA, 22 nt, Streptococcus pneumoniae R6
agucgcagguugcucaaaguac

SEQ ID NO: 2196184 - RNA, 14 nt, Streptococcus pneumoniae R6
aguggauuuuucuu

SEQ ID NO: 2196185 - RNA, 22 nt, Streptococcus pneumoniae R6
aguggauuuuucuucuuuucuu

SEQ ID NO: 2196186 - RNA, 18 nt, Streptococcus pneumoniae R6
agugcucacagaguagaa

SEQ ID NO: 2196187 - RNA, 20 nt, Streptococcus pneumoniae R6
agugcauacgaaaaguagga

SEQ ID NO: 2196188 - RNA, 15 nt, Streptococcus pneumoniae R6
agugacuucagaguc

SEQ ID NO: 2196189 - RNA, 17 nt, Streptococcus pneumoniae R6
agugagaagcccaguac

SEQ ID NO: 2196190 - RNA, 13 nt, Streptococcus pneumoniae R6
aguguauggagcu

SEQ ID NO: 2196191 - RNA, 15 nt, Streptococcus pneumoniae R6
aguguauuguacuuu

SEQ ID NO: 2196192 - RNA, 18 nt, Streptococcus pneumoniae R6
aguguauaagguucauua

SEQ ID NO: 2196193 - RNA, 16 nt, Streptococcus pneumoniae R6
aguguauaugaagauu

SEQ ID NO: 2196194 - RNA, 22 nt, Streptococcus pneumoniae R6
aguguauaugaagauucuguau

SEQ ID NO: 2196195 - RNA, 15 nt, Streptococcus pneumoniae R6
aguguacuagucuaa

SEQ ID NO: 2196196 - RNA, 12 nt, Streptococcus pneumoniae R6
aguguagcagau

SEQ ID NO: 2196197 - RNA, 15 nt, Streptococcus pneumoniae R6
aguguacauacuuua

SEQ ID NO: 2196198 - RNA, 20 nt, Streptococcus pneumoniae R6
agugugacccaagauaggau

SEQ ID NO: 2196199 - RNA, 20 nt, Streptococcus pneumoniae R6
agugugaccugcuuucugca

SEQ ID NO: 2196200 - RNA, 15 nt, Streptococcus pneumoniae R6
agugucuggaaugau

SEQ ID NO: 2196201 - RNA, 16 nt, Streptococcus pneumoniae R6
agugucuggaaugaua

SEQ ID NO: 2196202 - RNA, 22 nt, Streptococcus pneumoniae R6
agugguuuuuaggcaauaaaau

SEQ ID NO: 2196203 - RNA, 13 nt, Streptococcus pneumoniae R6
aguguaaaaagaa

SEQ ID NO: 2196204 - RNA, 15 nt, Streptococcus pneumoniae R6
aguguaaaaagaaag

SEQ ID NO: 2196205 - RNA, 13 nt, Streptococcus pneumoniae R6
agugggaacuaga

SEQ ID NO: 2196206 - RNA, 21 nt, Streptococcus pneumoniae R6
agugggcuauuccauauucaa

SEQ ID NO: 2196207 - RNA, 21 nt, Streptococcus pneumoniae R6
agugggcucauguaaaucauu

SEQ ID NO: 2196208 - RNA, 16 nt, Streptococcus pneumoniae R6
agugggccagauuuau

SEQ ID NO: 2196209 - RNA, 16 nt, Streptococcus pneumoniae R6
aguggguugaaaaaaa

SEQ ID NO: 2196210 - RNA, 17 nt, Streptococcus pneumoniae R6
aguggguugaaaaaaag

SEQ ID NO: 2196211 - RNA, 14 nt, Streptococcus pneumoniae R6
aguggguugaaguc

SEQ ID NO: 2196212 - RNA, 14 nt, Streptococcus pneumoniae R6
aguggguugaaguu

SEQ ID NO: 2196213 - RNA, 19 nt, Streptococcus pneumoniae R6
aguucaagugcuuuuguga

SEQ ID NO: 2196214 - RNA, 14 nt, Streptococcus pneumoniae R6
aguucaauagcucu

SEQ ID NO: 2196215 - RNA, 15 nt, Streptococcus pneumoniae R6
aguucaaucagcuaa

SEQ ID NO: 2196216 - RNA, 16 nt, Streptococcus pneumoniae R6
aguucaaucagcuaaa

SEQ ID NO: 2196217 - RNA, 14 nt, Streptococcus pneumoniae R6
aguucacaaaugag

SEQ ID NO: 2196218 - RNA, 17 nt, Streptococcus pneumoniae R6
aguuccucuuucaaaag

SEQ ID NO: 2196219 - RNA, 22 nt, Streptococcus pneumoniae R6
aguuccauccacaaccuuaaaa

SEQ ID NO: 2196220 - RNA, 17 nt, Streptococcus pneumoniae R6
aguuccaucuacaaccu

SEQ ID NO: 2196221 - RNA, 20 nt, Streptococcus pneumoniae R6
aguuccaucuacaaccuuaa

SEQ ID NO: 2196222 - RNA, 22 nt, Streptococcus pneumoniae R6
aguuccaucuacaaccuuaaaa

SEQ ID NO: 2196223 - RNA, 18 nt, Streptococcus pneumoniae R6
aguuccagugauuuggaa

SEQ ID NO: 2196224 - RNA, 13 nt, Streptococcus pneumoniae R6
aguuccagcaaac

SEQ ID NO: 2196225 - RNA, 19 nt, Streptococcus pneumoniae R6
aguuccagcaaacauagau

SEQ ID NO: 2196226 - RNA, 16 nt, Streptococcus pneumoniae R6
aguuccacgauauugu

SEQ ID NO: 2196227 - RNA, 16 nt, Streptococcus pneumoniae R6
aguuccacccauggca

SEQ ID NO: 2196228 - RNA, 16 nt, Streptococcus pneumoniae R6
aguucauuuuuuaugg

SEQ ID NO: 2196229 - RNA, 23 nt, Streptococcus pneumoniae R6
aguucauuuucuuuacuucugag

SEQ ID NO: 2196230 - RNA, 19 nt, Streptococcus pneumoniae R6
aguucuggaugccauugga

SEQ ID NO: 2196231 - RNA, 20 nt, Streptococcus pneumoniae R6
aguucuucauacauuucgau

SEQ ID NO: 2196232 - RNA, 20 nt, Streptococcus pneumoniae R6
aguucuggucuacauccuca

SEQ ID NO: 2196233 - RNA, 16 nt, Streptococcus pneumoniae R6
aguucuguacugcaca

SEQ ID NO: 2196234 - RNA, 17 nt, Streptococcus pneumoniae R6
aguucuaaaacuccuau

SEQ ID NO: 2196235 - RNA, 15 nt, Streptococcus pneumoniae R6
aguuccuuugucuuu

SEQ ID NO: 2196236 - RNA, 22 nt, Streptococcus pneumoniae R6
aguucgaaaggcuuuauucuua

SEQ ID NO: 2196237 - RNA, 15 nt, Streptococcus pneumoniae R6
aguucgaagauaucu

SEQ ID NO: 2196238 - RNA, 19 nt, Streptococcus pneumoniae R6
agugugagcaauuccuucg

SEQ ID NO: 2196239 - RNA, 19 nt, Streptococcus pneumoniae R6
aguguggacaugaguccug

SEQ ID NO: 2196240 - RNA, 16 nt, Streptococcus pneumoniae R6
agugugggacuccuac

SEQ ID NO: 2196241 - RNA, 13 nt, Streptococcus pneumoniae R6
aguguucugucuu

SEQ ID NO: 2196242 - RNA, 15 nt, Streptococcus pneumoniae R6
aguguugaaaacccu

SEQ ID NO: 2196243 - RNA, 18 nt, Streptococcus pneumoniae R6
aguguugacaagugaaag

SEQ ID NO: 2196244 - RNA, 19 nt, Streptococcus pneumoniae R6
aguguuugauaucuaucaa

SEQ ID NO: 2196245 - RNA, 15 nt, Streptococcus pneumoniae R6
aguguugucaaguuc

SEQ ID NO: 2196246 - RNA, 15 nt, Streptococcus pneumoniae R6
aguguucuaaaauaa

SEQ ID NO: 2196247 - RNA, 15 nt, Streptococcus pneumoniae R6
aguuagacaauuaau

SEQ ID NO: 2196248 - RNA, 16 nt, Streptococcus pneumoniae R6
aguuagacagaaaaaa

SEQ ID NO: 2196249 - RNA, 17 nt, Streptococcus pneumoniae R6
aguuagauaacuuuucu

SEQ ID NO: 2196250 - RNA, 12 nt, Streptococcus pneumoniae R6
aguuagauuuuu

SEQ ID NO: 2196251 - RNA, 18 nt, Streptococcus pneumoniae R6
aguuagccacaacuagga

SEQ ID NO: 2196252 - RNA, 14 nt, Streptococcus pneumoniae R6
aguuaaaacaaaga

SEQ ID NO: 2196253 - RNA, 15 nt, Streptococcus pneumoniae R6
aguuaaaacaaagaa

SEQ ID NO: 2196254 - RNA, 13 nt, Streptococcus pneumoniae R6
aguuaaaauaagu

SEQ ID NO: 2196255 - RNA, 13 nt, Streptococcus pneumoniae R6
aguguuuucacuu

SEQ ID NO: 2196256 - RNA, 21 nt, Streptococcus pneumoniae R6
aguguuuugaucugacuucgu

SEQ ID NO: 2196257 - RNA, 16 nt, Streptococcus pneumoniae R6
aguuaaaaaaagggcu

SEQ ID NO: 2196258 - RNA, 15 nt, Streptococcus pneumoniae R6
aguguuuugagcagc

SEQ ID NO: 2196259 - RNA, 23 nt, Streptococcus pneumoniae R6
aguguuuugagcuaauuuugcca

SEQ ID NO: 2196260 - RNA, 16 nt, Streptococcus pneumoniae R6
aguguuuugagcugac

SEQ ID NO: 2196261 - RNA, 21 nt, Streptococcus pneumoniae R6
aguuaaacucuccaauaucau

SEQ ID NO: 2196262 - RNA, 22 nt, Streptococcus pneumoniae R6
aguuguuuugucgcuuuucauu

SEQ ID NO: 2196263 - RNA, 23 nt, Streptococcus pneumoniae R6
aguuuaaacucagguuucucuac

SEQ ID NO: 2196264 - RNA, 20 nt, Streptococcus pneumoniae R6
aguuuaagagcgaugccaug

SEQ ID NO: 2196265 - RNA, 21 nt, Streptococcus pneumoniae R6
aguuuaaucaaaauaaagcaa

SEQ ID NO: 2196266 - RNA, 20 nt, Streptococcus pneumoniae R6
aguuguuaguucuugaaaug

SEQ ID NO: 2196267 - RNA, 15 nt, Streptococcus pneumoniae R6
aguuguuauuuagga

SEQ ID NO: 2196268 - RNA, 16 nt, Streptococcus pneumoniae R6
aguuguuauuuaggac

SEQ ID NO: 2196269 - RNA, 23 nt, Streptococcus pneumoniae R6
aguuguguucauuguuagcaaag

SEQ ID NO: 2196270 - RNA, 18 nt, Streptococcus pneumoniae R6
aguugcuugauuacauga

SEQ ID NO: 2196271 - RNA, 16 nt, Streptococcus pneumoniae R6
aguugcuugucaucuu

SEQ ID NO: 2196272 - RNA, 18 nt, Streptococcus pneumoniae R6
aguuggacaaaaugauug

SEQ ID NO: 2196273 - RNA, 17 nt, Streptococcus pneumoniae R6
aguugcagguucgauuc

SEQ ID NO: 2196274 - RNA, 16 nt, Streptococcus pneumoniae R6
aguugcagggcuauuu

SEQ ID NO: 2196275 - RNA, 17 nt, Streptococcus pneumoniae R6
aguucuuuuugcugguu

SEQ ID NO: 2196276 - RNA, 11 nt, Streptococcus pneumoniae R6
aguucuucccc

SEQ ID NO: 2196277 - RNA, 12 nt, Streptococcus pneumoniae R6
aguucuucccac

SEQ ID NO: 2196278 - RNA, 17 nt, Streptococcus pneumoniae R6
aguucuuccaauuucuu

SEQ ID NO: 2196279 - RNA, 13 nt, Streptococcus pneumoniae R6
aguugacaaagag

SEQ ID NO: 2196280 - RNA, 14 nt, Streptococcus pneumoniae R6
aguugacaaagagc

SEQ ID NO: 2196281 - RNA, 23 nt, Streptococcus pneumoniae R6
aguugacaaagagccauaaaaau

SEQ ID NO: 2196282 - RNA, 20 nt, Streptococcus pneumoniae R6
aguuuugguugaugaagaac

SEQ ID NO: 2196283 - RNA, 15 nt, Streptococcus pneumoniae R6
aguuuuuaauuuuuc

SEQ ID NO: 2196284 - RNA, 14 nt, Streptococcus pneumoniae R6
aguuuuuagaagcu

SEQ ID NO: 2196285 - RNA, 20 nt, Streptococcus pneumoniae R6
aguuuuuagaagcuucuugg

SEQ ID NO: 2196286 - RNA, 21 nt, Streptococcus pneumoniae R6
aguuuuuagaagcuucuugga

SEQ ID NO: 2196287 - RNA, 19 nt, Streptococcus pneumoniae R6
aguuuuaaucucaaaagaa

SEQ ID NO: 2196288 - RNA, 19 nt, Streptococcus pneumoniae R6
aguuuguguuucuuuuugg

SEQ ID NO: 2196289 - RNA, 13 nt, Streptococcus pneumoniae R6
aguuuugagaauc

SEQ ID NO: 2196290 - RNA, 17 nt, Streptococcus pneumoniae R6
aguuuugauuauuuuuu

SEQ ID NO: 2196291 - RNA, 18 nt, Streptococcus pneumoniae R6
aguuuaauguccaugcuu

SEQ ID NO: 2196292 - RNA, 14 nt, Streptococcus pneumoniae R6
aguuuacgacacau

SEQ ID NO: 2196293 - RNA, 16 nt, Streptococcus pneumoniae R6
aguuucgaaaaccaaa

SEQ ID NO: 2196294 - RNA, 23 nt, Streptococcus pneumoniae R6
aguuucgaaaagaauuaggaaaa

SEQ ID NO: 2196295 - RNA, 15 nt, Streptococcus pneumoniae R6
aguuucuauuucauu

SEQ ID NO: 2196296 - RNA, 17 nt, Streptococcus pneumoniae R6
aguuucuauuucauuuu

SEQ ID NO: 2196297 - RNA, 20 nt, Streptococcus pneumoniae R6
aguuucggcaccaauacagc

SEQ ID NO: 2196298 - RNA, 21 nt, Streptococcus pneumoniae R6
aguuucggcaccaauacagcu

SEQ ID NO: 2196299 - RNA, 17 nt, Streptococcus pneumoniae R6
aguuugucuuucauuuc

SEQ ID NO: 2196300 - RNA, 16 nt, Streptococcus pneumoniae R6
aguuugcaaauuauuu

SEQ ID NO: 2196301 - RNA, 17 nt, Streptococcus pneumoniae R6
aguuugcaaauuauuua

SEQ ID NO: 2196302 - RNA, 16 nt, Streptococcus pneumoniae R6
aguuugaucuuugcuu

SEQ ID NO: 2196303 - RNA, 11 nt, Streptococcus pneumoniae R6
aguuucuucuu

SEQ ID NO: 2196304 - RNA, 14 nt, Streptococcus pneumoniae R6
aguuucuuuauucg

SEQ ID NO: 2196305 - RNA, 15 nt, Streptococcus pneumoniae R6
aucacgcuuuucuug

SEQ ID NO: 2196306 - RNA, 17 nt, Streptococcus pneumoniae R6
aucacggcauuucugca

SEQ ID NO: 2196307 - RNA, 13 nt, Streptococcus pneumoniae R6
aucacgauuaucu

SEQ ID NO: 2196308 - RNA, 16 nt, Streptococcus pneumoniae R6
aucacgacuaauuuca

SEQ ID NO: 2196309 - RNA, 15 nt, Streptococcus pneumoniae R6
aucacgacuuucuga

SEQ ID NO: 2196310 - RNA, 17 nt, Streptococcus pneumoniae R6
aucacugcagcaaaggu

SEQ ID NO: 2196311 - RNA, 19 nt, Streptococcus pneumoniae R6
aucacugcagcaaagguac

SEQ ID NO: 2196312 - RNA, 16 nt, Streptococcus pneumoniae R6
aucacucaucugcuua

SEQ ID NO: 2196313 - RNA, 23 nt, Streptococcus pneumoniae R6
aucacuaguaauaauuucaaaau

SEQ ID NO: 2196314 - RNA, 20 nt, Streptococcus pneumoniae R6
aucacuagcuuggucaguaa

SEQ ID NO: 2196315 - RNA, 22 nt, Streptococcus pneumoniae R6
aucacguccaauuuugucucug

SEQ ID NO: 2196316 - RNA, 13 nt, Streptococcus pneumoniae R6
aucaccagcaugg

SEQ ID NO: 2196317 - RNA, 18 nt, Streptococcus pneumoniae R6
aucaccaagcauuuucau

SEQ ID NO: 2196318 - RNA, 19 nt, Streptococcus pneumoniae R6
aucaccaagcauuuucaua

SEQ ID NO: 2196319 - RNA, 14 nt, Streptococcus pneumoniae R6
aucacauucaaugu

SEQ ID NO: 2196320 - RNA, 18 nt, Streptococcus pneumoniae R6
aucacaguuuacaauuag

SEQ ID NO: 2196321 - RNA, 18 nt, Streptococcus pneumoniae R6
aucacagugggcuauucc

SEQ ID NO: 2196322 - RNA, 13 nt, Streptococcus pneumoniae R6
aucaccugcaaua

SEQ ID NO: 2196323 - RNA, 15 nt, Streptococcus pneumoniae R6
aucagcauaaucugc

SEQ ID NO: 2196324 - RNA, 13 nt, Streptococcus pneumoniae R6
aucagauggguca

SEQ ID NO: 2196325 - RNA, 19 nt, Streptococcus pneumoniae R6
aucagaugggucaagauuu

SEQ ID NO: 2196326 - RNA, 17 nt, Streptococcus pneumoniae R6
aucagauaaacaauggu

SEQ ID NO: 2196327 - RNA, 16 nt, Streptococcus pneumoniae R6
aucagaguagucuuuu

SEQ ID NO: 2196328 - RNA, 17 nt, Streptococcus pneumoniae R6
aucagaaaaaaggcauc

SEQ ID NO: 2196329 - RNA, 22 nt, Streptococcus pneumoniae R6
aucagaaaaacgcauaaaauca

SEQ ID NO: 2196330 - RNA, 13 nt, Streptococcus pneumoniae R6
aucagaaaauaaa

SEQ ID NO: 2196331 - RNA, 17 nt, Streptococcus pneumoniae R6
aucacuucgucugcgac

SEQ ID NO: 2196332 - RNA, 15 nt, Streptococcus pneumoniae R6
aucacuguuuuuuau

SEQ ID NO: 2196333 - RNA, 21 nt, Streptococcus pneumoniae R6
aucaagcguuuuucuucugua

SEQ ID NO: 2196334 - RNA, 18 nt, Streptococcus pneumoniae R6
aucaagcuggcuacagau

SEQ ID NO: 2196335 - RNA, 21 nt, Streptococcus pneumoniae R6
aucaagcuggcuacagaugcu

SEQ ID NO: 2196336 - RNA, 14 nt, Streptococcus pneumoniae R6
aucaagcuuucacu

SEQ ID NO: 2196337 - RNA, 21 nt, Streptococcus pneumoniae R6
aucaaggauuuuuugaacugc

SEQ ID NO: 2196338 - RNA, 16 nt, Streptococcus pneumoniae R6
aucaagugaguuagga

SEQ ID NO: 2196339 - RNA, 16 nt, Streptococcus pneumoniae R6
aucaagguuuuucaaa

SEQ ID NO: 2196340 - RNA, 13 nt, Streptococcus pneumoniae R6
aucaaguaacuuu

SEQ ID NO: 2196341 - RNA, 23 nt, Streptococcus pneumoniae R6
aucaacgcuacgacguuuaucaa

SEQ ID NO: 2196342 - RNA, 19 nt, Streptococcus pneumoniae R6
aucaagaugagacuugcaa

SEQ ID NO: 2196343 - RNA, 17 nt, Streptococcus pneumoniae R6
aucaaccacuuaacaac

SEQ ID NO: 2196344 - RNA, 22 nt, Streptococcus pneumoniae R6
aucaaccgugcagucuuuuugc

SEQ ID NO: 2196345 - RNA, 19 nt, Streptococcus pneumoniae R6
aucaaacgagaaucuguau

SEQ ID NO: 2196346 - RNA, 19 nt, Streptococcus pneumoniae R6
aucaauuauaauaaaauga

SEQ ID NO: 2196347 - RNA, 17 nt, Streptococcus pneumoniae R6
aucaauuaucauuucca

SEQ ID NO: 2196348 - RNA, 18 nt, Streptococcus pneumoniae R6
aucaaugauuuauuuguu

SEQ ID NO: 2196349 - RNA, 19 nt, Streptococcus pneumoniae R6
aucaaucuucaaaaucuca

SEQ ID NO: 2196350 - RNA, 15 nt, Streptococcus pneumoniae R6
aucaaugacaaucuc

SEQ ID NO: 2196351 - RNA, 19 nt, Streptococcus pneumoniae R6
aucaaguuuaccauucaau

SEQ ID NO: 2196352 - RNA, 14 nt, Streptococcus pneumoniae R6
aucaaguuuucaca

SEQ ID NO: 2196353 - RNA, 16 nt, Streptococcus pneumoniae R6
aucaauagugagacaa

SEQ ID NO: 2196354 - RNA, 19 nt, Streptococcus pneumoniae R6
aucacacuagcaauuuuuu

SEQ ID NO: 2196355 - RNA, 22 nt, Streptococcus pneumoniae R6
aucaauuguucacgcauaagca

SEQ ID NO: 2196356 - RNA, 17 nt, Streptococcus pneumoniae R6
aucaauuuguaucacca

SEQ ID NO: 2196357 - RNA, 20 nt, Streptococcus pneumoniae R6
aucaauuuuccuuuccuaau

SEQ ID NO: 2196358 - RNA, 13 nt, Streptococcus pneumoniae R6
aucaauuuuuaac

SEQ ID NO: 2196359 - RNA, 11 nt, Streptococcus pneumoniae R6
aucaauuuuuc

SEQ ID NO: 2196360 - RNA, 12 nt, Streptococcus pneumoniae R6
aucaauuuuucg

SEQ ID NO: 2196361 - RNA, 22 nt, Streptococcus pneumoniae R6
auauucaaaauacaaaaguuga

SEQ ID NO: 2196362 - RNA, 17 nt, Streptococcus pneumoniae R6
auaugaggagaaagaag

SEQ ID NO: 2196363 - RNA, 15 nt, Streptococcus pneumoniae R6
auauuaugcguuuua

SEQ ID NO: 2196364 - RNA, 15 nt, Streptococcus pneumoniae R6
auaugaugcguuuua

SEQ ID NO: 2196365 - RNA, 15 nt, Streptococcus pneumoniae R6
auauugauauuuaua

SEQ ID NO: 2196366 - RNA, 21 nt, Streptococcus pneumoniae R6
auauucuuggcaaaguuuuug

SEQ ID NO: 2196367 - RNA, 23 nt, Streptococcus pneumoniae R6
auauucucaauuucuauuuuaaa

SEQ ID NO: 2196368 - RNA, 22 nt, Streptococcus pneumoniae R6
auauucucuagaaaucucuuuu

SEQ ID NO: 2196369 - RNA, 18 nt, Streptococcus pneumoniae R6
auauucagagcgauaaaa

SEQ ID NO: 2196370 - RNA, 20 nt, Streptococcus pneumoniae R6
auauucuaacuuauuuuaac

SEQ ID NO: 2196371 - RNA, 18 nt, Streptococcus pneumoniae R6
auauuuuuuacuuuugca

SEQ ID NO: 2196372 - RNA, 22 nt, Streptococcus pneumoniae R6
auauuuuuucguaguugguuac

SEQ ID NO: 2196373 - RNA, 16 nt, Streptococcus pneumoniae R6
aucaaaaaaucucacu

SEQ ID NO: 2196374 - RNA, 13 nt, Streptococcus pneumoniae R6
aucaaaaauagaa

SEQ ID NO: 2196375 - RNA, 16 nt, Streptococcus pneumoniae R6
aucaaaaauagaaaua

SEQ ID NO: 2196376 - RNA, 22 nt, Streptococcus pneumoniae R6
aucaaaaauugguguaaauaga

SEQ ID NO: 2196377 - RNA, 19 nt, Streptococcus pneumoniae R6
aucaaaaaaagaaguuggu

SEQ ID NO: 2196378 - RNA, 16 nt, Streptococcus pneumoniae R6
auauuuucugggaaga

SEQ ID NO: 2196379 - RNA, 20 nt, Streptococcus pneumoniae R6
auauuuucuuuauuagcaua

SEQ ID NO: 2196380 - RNA, 12 nt, Streptococcus pneumoniae R6
auauuguuuuaa

SEQ ID NO: 2196381 - RNA, 13 nt, Streptococcus pneumoniae R6
auauuguuuuaau

SEQ ID NO: 2196382 - RNA, 14 nt, Streptococcus pneumoniae R6
auauuguuuuaaua

SEQ ID NO: 2196383 - RNA, 19 nt, Streptococcus pneumoniae R6
auauugccgauaucaccaa

SEQ ID NO: 2196384 - RNA, 16 nt, Streptococcus pneumoniae R6
auauuuucaaaaaaau

SEQ ID NO: 2196385 - RNA, 14 nt, Streptococcus pneumoniae R6
auauuuuagcaguc

SEQ ID NO: 2196386 - RNA, 14 nt, Streptococcus pneumoniae R6
auauuuuagaagca

SEQ ID NO: 2196387 - RNA, 17 nt, Streptococcus pneumoniae R6
auauuuuagaagcagag

SEQ ID NO: 2196388 - RNA, 23 nt, Streptococcus pneumoniae R6
auauuuggaauguugcugaaaug

SEQ ID NO: 2196389 - RNA, 16 nt, Streptococcus pneumoniae R6
auauuuggagcaagug

SEQ ID NO: 2196390 - RNA, 15 nt, Streptococcus pneumoniae R6
auacugacuuccugu

SEQ ID NO: 2196391 - RNA, 13 nt, Streptococcus pneumoniae R6
auacugauaaaaa

SEQ ID NO: 2196392 - RNA, 15 nt, Streptococcus pneumoniae R6
auacugaaacaacau

SEQ ID NO: 2196393 - RNA, 15 nt, Streptococcus pneumoniae R6
auacugaauuuagaa

SEQ ID NO: 2196394 - RNA, 17 nt, Streptococcus pneumoniae R6
auacugcccugaaaucc

SEQ ID NO: 2196395 - RNA, 17 nt, Streptococcus pneumoniae R6
auacugcucgguaaaac

SEQ ID NO: 2196396 - RNA, 15 nt, Streptococcus pneumoniae R6
auacugccaagauag

SEQ ID NO: 2196397 - RNA, 21 nt, Streptococcus pneumoniae R6
auacuguauuuuuuuugguuu

SEQ ID NO: 2196398 - RNA, 22 nt, Streptococcus pneumoniae R6
auacuguauuuuuuuugguuuu

SEQ ID NO: 2196399 - RNA, 20 nt, Streptococcus pneumoniae R6
auacuguacguuuuaucaua

SEQ ID NO: 2196400 - RNA, 21 nt, Streptococcus pneumoniae R6
auacugggcacggugauuuuu

SEQ ID NO: 2196401 - RNA, 15 nt, Streptococcus pneumoniae R6
auacuguuaauaaaa

SEQ ID NO: 2196402 - RNA, 15 nt, Streptococcus pneumoniae R6
auacuaucaauaaaa

SEQ ID NO: 2196403 - RNA, 13 nt, Streptococcus pneumoniae R6
auacuaugaagga

SEQ ID NO: 2196404 - RNA, 18 nt, Streptococcus pneumoniae R6
auacuaugcguuuugcuu

SEQ ID NO: 2196405 - RNA, 19 nt, Streptococcus pneumoniae R6
auacuaugcuuuuuucuau

SEQ ID NO: 2196406 - RNA, 21 nt, Streptococcus pneumoniae R6
auacuauggcaucuaguaaau

SEQ ID NO: 2196407 - RNA, 13 nt, Streptococcus pneumoniae R6
auacucuuuacuu

SEQ ID NO: 2196408 - RNA, 13 nt, Streptococcus pneumoniae R6
auacuccauaaaa

SEQ ID NO: 2196409 - RNA, 21 nt, Streptococcus pneumoniae R6
auacucaaucccauauuuuuc

SEQ ID NO: 2196410 - RNA, 14 nt, Streptococcus pneumoniae R6
auacucaaugaaaa

SEQ ID NO: 2196411 - RNA, 18 nt, Streptococcus pneumoniae R6
auacucaaugaaaaucaa

SEQ ID NO: 2196412 - RNA, 21 nt, Streptococcus pneumoniae R6
auacucaaugaaaaucaaagu

SEQ ID NO: 2196413 - RNA, 16 nt, Streptococcus pneumoniae R6
auacucauaaagucuu

SEQ ID NO: 2196414 - RNA, 18 nt, Streptococcus pneumoniae R6
auacucauaaagucuuua

SEQ ID NO: 2196415 - RNA, 21 nt, Streptococcus pneumoniae R6
auacucauaaagucuuuaaca

SEQ ID NO: 2196416 - RNA, 15 nt, Streptococcus pneumoniae R6
auacgaugaccaaga

SEQ ID NO: 2196417 - RNA, 17 nt, Streptococcus pneumoniae R6
auacgaugaccaagaug

SEQ ID NO: 2196418 - RNA, 16 nt, Streptococcus pneumoniae R6
auaccuucuuuaucau

SEQ ID NO: 2196419 - RNA, 13 nt, Streptococcus pneumoniae R6
auacggcauugag

SEQ ID NO: 2196420 - RNA, 20 nt, Streptococcus pneumoniae R6
auaccugcucgccccauuuc

SEQ ID NO: 2196421 - RNA, 13 nt, Streptococcus pneumoniae R6
auaccugggaaga

SEQ ID NO: 2196422 - RNA, 22 nt, Streptococcus pneumoniae R6
auaccuguuaagccuauucccu

SEQ ID NO: 2196423 - RNA, 23 nt, Streptococcus pneumoniae R6
auaccugaaaccauuagauuuca

SEQ ID NO: 2196424 - RNA, 17 nt, Streptococcus pneumoniae R6
auagcacuuaaaaaguu

SEQ ID NO: 2196425 - RNA, 14 nt, Streptococcus pneumoniae R6
auagaugaugguuu

SEQ ID NO: 2196426 - RNA, 21 nt, Streptococcus pneumoniae R6
auagauguuaagcuccaauuu

SEQ ID NO: 2196427 - RNA, 23 nt, Streptococcus pneumoniae R6
auagauucaacgaacuauaaaau

SEQ ID NO: 2196428 - RNA, 16 nt, Streptococcus pneumoniae R6
auagagggauuuuuug

SEQ ID NO: 2196429 - RNA, 16 nt, Streptococcus pneumoniae R6
auagaggucagugacu

SEQ ID NO: 2196430 - RNA, 19 nt, Streptococcus pneumoniae R6
auagaguucuugguuuuuu

SEQ ID NO: 2196431 - RNA, 13 nt, Streptococcus pneumoniae R6
auagauccuucaa

SEQ ID NO: 2196432 - RNA, 19 nt, Streptococcus pneumoniae R6
auagauaaaggccaagucc

SEQ ID NO: 2196433 - RNA, 22 nt, Streptococcus pneumoniae R6
auagaugacaaaguacuugaga

SEQ ID NO: 2196434 - RNA, 15 nt, Streptococcus pneumoniae R6
auagaucuuuacuug

SEQ ID NO: 2196435 - RNA, 22 nt, Streptococcus pneumoniae R6
auagagaccaacuccucucucc

SEQ ID NO: 2196436 - RNA, 18 nt, Streptococcus pneumoniae R6
auagacuguuaccacuuc

SEQ ID NO: 2196437 - RNA, 18 nt, Streptococcus pneumoniae R6
auagagagcuccaaagaa

SEQ ID NO: 2196438 - RNA, 16 nt, Streptococcus pneumoniae R6
auagagauagaagguc

SEQ ID NO: 2196439 - RNA, 24 nt, Streptococcus pneumoniae R6
auagagauuauagugguguuucaa

SEQ ID NO: 2196440 - RNA, 17 nt, Streptococcus pneumoniae R6
auagagccuucuuccau

SEQ ID NO: 2196441 - RNA, 19 nt, Streptococcus pneumoniae R6
auacuugauuuuugccaua

SEQ ID NO: 2196442 - RNA, 21 nt, Streptococcus pneumoniae R6
auacuugauuuuugccauaua

SEQ ID NO: 2196443 - RNA, 24 nt, Streptococcus pneumoniae R6
auacuugauuuuugccauauagca

SEQ ID NO: 2196444 - RNA, 15 nt, Streptococcus pneumoniae R6
auacuugcaaacuuu

SEQ ID NO: 2196445 - RNA, 13 nt, Streptococcus pneumoniae R6
auacuuggagaac

SEQ ID NO: 2196446 - RNA, 22 nt, Streptococcus pneumoniae R6
auacuuggugcuauuuguugua

SEQ ID NO: 2196447 - RNA, 14 nt, Streptococcus pneumoniae R6
auacuugaucccac

SEQ ID NO: 2196448 - RNA, 17 nt, Streptococcus pneumoniae R6
auacuuuuaauauuucc

SEQ ID NO: 2196449 - RNA, 18 nt, Streptococcus pneumoniae R6
auacuuuuaauauuuccc

SEQ ID NO: 2196450 - RNA, 21 nt, Streptococcus pneumoniae R6
auacuuugcaacuggagacuu

SEQ ID NO: 2196451 - RNA, 19 nt, Streptococcus pneumoniae R6
auacuuuggcuucguguuc

SEQ ID NO: 2196452 - RNA, 12 nt, Streptococcus pneumoniae R6
auacuuucucug

SEQ ID NO: 2196453 - RNA, 17 nt, Streptococcus pneumoniae R6
auacuuucucugacuuu

SEQ ID NO: 2196454 - RNA, 21 nt, Streptococcus pneumoniae R6
auacuuucucugacuuuucca

SEQ ID NO: 2196455 - RNA, 17 nt, Streptococcus pneumoniae R6
auagcagcgguuccauu

SEQ ID NO: 2196456 - RNA, 19 nt, Streptococcus pneumoniae R6
auagcagauagguggggca

SEQ ID NO: 2196457 - RNA, 13 nt, Streptococcus pneumoniae R6
auagccagacugg

SEQ ID NO: 2196458 - RNA, 22 nt, Streptococcus pneumoniae R6
auagcaguaguuggcuugucuu

SEQ ID NO: 2196459 - RNA, 22 nt, Streptococcus pneumoniae R6
auagccaacucauacuuucuau

SEQ ID NO: 2196460 - RNA, 14 nt, Streptococcus pneumoniae R6
auagccaccaugcu

SEQ ID NO: 2196461 - RNA, 18 nt, Streptococcus pneumoniae R6
auagccauaaaacauuuc

SEQ ID NO: 2196462 - RNA, 21 nt, Streptococcus pneumoniae R6
auagcuaaaccuuauuuuuua

SEQ ID NO: 2196463 - RNA, 23 nt, Streptococcus pneumoniae R6
auagcuaaacuaucgcuggcugc

SEQ ID NO: 2196464 - RNA, 17 nt, Streptococcus pneumoniae R6
auagcgugcccaaaaau

SEQ ID NO: 2196465 - RNA, 22 nt, Streptococcus pneumoniae R6
auagcggcuuguccguuuucau

SEQ ID NO: 2196466 - RNA, 20 nt, Streptococcus pneumoniae R6
auagcuuuugcagcaccagu

SEQ ID NO: 2196467 - RNA, 21 nt, Streptococcus pneumoniae R6
auagcuuuugugauaaaggcc

SEQ ID NO: 2196468 - RNA, 20 nt, Streptococcus pneumoniae R6
auagcuuaaaaucuugucaa

SEQ ID NO: 2196469 - RNA, 19 nt, Streptococcus pneumoniae R6
auagcugucaaaucauccg

SEQ ID NO: 2196470 - RNA, 14 nt, Streptococcus pneumoniae R6
auagcucaaaagcu

SEQ ID NO: 2196471 - RNA, 23 nt, Streptococcus pneumoniae R6
auagcucaaaaguuuaucuagaa

SEQ ID NO: 2196472 - RNA, 22 nt, Streptococcus pneumoniae R6
auagcucgggggauuaauuuuc

SEQ ID NO: 2196473 - RNA, 21 nt, Streptococcus pneumoniae R6
auagcuccuccaaguccaaga

SEQ ID NO: 2196474 - RNA, 14 nt, Streptococcus pneumoniae R6
auagcugcagcuga

SEQ ID NO: 2196475 - RNA, 12 nt, Streptococcus pneumoniae R6
auaucuuccuca

SEQ ID NO: 2196476 - RNA, 15 nt, Streptococcus pneumoniae R6
auaucuucugcuugc

SEQ ID NO: 2196477 - RNA, 13 nt, Streptococcus pneumoniae R6
auaucuuauuuca

SEQ ID NO: 2196478 - RNA, 20 nt, Streptococcus pneumoniae R6
auaucuuauuucaauccauu

SEQ ID NO: 2196479 - RNA, 20 nt, Streptococcus pneumoniae R6
auaucuuauuucaguuuacu

SEQ ID NO: 2196480 - RNA, 17 nt, Streptococcus pneumoniae R6
auaucuuauuuuucuau

SEQ ID NO: 2196481 - RNA, 15 nt, Streptococcus pneumoniae R6
auaucugucuuacca

SEQ ID NO: 2196482 - RNA, 17 nt, Streptococcus pneumoniae R6
auaucugguugccaagu

SEQ ID NO: 2196483 - RNA, 23 nt, Streptococcus pneumoniae R6
auaucugguugccaaguccauuu

SEQ ID NO: 2196484 - RNA, 16 nt, Streptococcus pneumoniae R6
auaucuauccuaucuu

SEQ ID NO: 2196485 - RNA, 15 nt, Streptococcus pneumoniae R6
auaucuggauuuuca

SEQ ID NO: 2196486 - RNA, 21 nt, Streptococcus pneumoniae R6
auaucugguacucacuuacau

SEQ ID NO: 2196487 - RNA, 19 nt, Streptococcus pneumoniae R6
auaucuggacuuauaugcu

SEQ ID NO: 2196488 - RNA, 23 nt, Streptococcus pneumoniae R6
auaucuuuagggaaauuauuuau

SEQ ID NO: 2196489 - RNA, 13 nt, Streptococcus pneumoniae R6
auaucuuugauuu

SEQ ID NO: 2196490 - RNA, 17 nt, Streptococcus pneumoniae R6
auauccaaaaccauuca

SEQ ID NO: 2196491 - RNA, 17 nt, Streptococcus pneumoniae R6
auauccaaguuuuguug

SEQ ID NO: 2196492 - RNA, 16 nt, Streptococcus pneumoniae R6
auaucgauauaauggc

SEQ ID NO: 2196493 - RNA, 19 nt, Streptococcus pneumoniae R6
auaucgaugcccucuucuu

SEQ ID NO: 2196494 - RNA, 15 nt, Streptococcus pneumoniae R6
auaucguuauuagca

SEQ ID NO: 2196495 - RNA, 22 nt, Streptococcus pneumoniae R6
auaucuaauugauuuaaauuca

SEQ ID NO: 2196496 - RNA, 14 nt, Streptococcus pneumoniae R6
auaucuaauaauuu

SEQ ID NO: 2196497 - RNA, 18 nt, Streptococcus pneumoniae R6
auaucuaauaauuuuuca

SEQ ID NO: 2196498 - RNA, 20 nt, Streptococcus pneumoniae R6
auaucaagguuuuugaaaaa

SEQ ID NO: 2196499 - RNA, 14 nt, Streptococcus pneumoniae R6
auaucaaguuuuca

SEQ ID NO: 2196500 - RNA, 17 nt, Streptococcus pneumoniae R6
auaucaaucucugcaau

SEQ ID NO: 2196501 - RNA, 19 nt, Streptococcus pneumoniae R6
auaucaaaaccaaacucac

SEQ ID NO: 2196502 - RNA, 18 nt, Streptococcus pneumoniae R6
auaucaaaaccaguccuu

SEQ ID NO: 2196503 - RNA, 13 nt, Streptococcus pneumoniae R6
auaucaccaucaa

SEQ ID NO: 2196504 - RNA, 17 nt, Streptococcus pneumoniae R6
auaucaccaucaaggac

SEQ ID NO: 2196505 - RNA, 21 nt, Streptococcus pneumoniae R6
auaucaccaaacucgaucuga

SEQ ID NO: 2196506 - RNA, 19 nt, Streptococcus pneumoniae R6
auaucacuuuauaguuuuc

SEQ ID NO: 2196507 - RNA, 18 nt, Streptococcus pneumoniae R6
auaucacggcauuucugc

SEQ ID NO: 2196508 - RNA, 22 nt, Streptococcus pneumoniae R6
auaucacggcauuucugcauaa

SEQ ID NO: 2196509 - RNA, 20 nt, Streptococcus pneumoniae R6
auaucagccagagcaccaac

SEQ ID NO: 2196510 - RNA, 14 nt, Streptococcus pneumoniae R6
auaucauuaaguaa

SEQ ID NO: 2196511 - RNA, 21 nt, Streptococcus pneumoniae R6
auaucagcuaggauagcuuga

SEQ ID NO: 2196512 - RNA, 15 nt, Streptococcus pneumoniae R6
auaucagacauauca

SEQ ID NO: 2196513 - RNA, 15 nt, Streptococcus pneumoniae R6
auauauuuauuauaa

SEQ ID NO: 2196514 - RNA, 13 nt, Streptococcus pneumoniae R6
auauauuauauau

SEQ ID NO: 2196515 - RNA, 15 nt, Streptococcus pneumoniae R6
auauauucuccagcu

SEQ ID NO: 2196516 - RNA, 18 nt, Streptococcus pneumoniae R6
auauauugacuuuugaaa

SEQ ID NO: 2196517 - RNA, 13 nt, Streptococcus pneumoniae R6
auauagaauuuua

SEQ ID NO: 2196518 - RNA, 14 nt, Streptococcus pneumoniae R6
auauagaauuuuag

SEQ ID NO: 2196519 - RNA, 18 nt, Streptococcus pneumoniae R6
auauagacaaaaucauca

SEQ ID NO: 2196520 - RNA, 16 nt, Streptococcus pneumoniae R6
auauagaccaacuauu

SEQ ID NO: 2196521 - RNA, 22 nt, Streptococcus pneumoniae R6
auauacuugauauaguuaaaaa

SEQ ID NO: 2196522 - RNA, 14 nt, Streptococcus pneumoniae R6
auaguaccaguuac

SEQ ID NO: 2196523 - RNA, 20 nt, Streptococcus pneumoniae R6
auaguaauuccacacagaaa

SEQ ID NO: 2196524 - RNA, 16 nt, Streptococcus pneumoniae R6
auaguagauugaaaua

SEQ ID NO: 2196525 - RNA, 18 nt, Streptococcus pneumoniae R6
auaguagccaaaauccuu

SEQ ID NO: 2196526 - RNA, 23 nt, Streptococcus pneumoniae R6
auaguagccaaaauccuugacca

SEQ ID NO: 2196527 - RNA, 14 nt, Streptococcus pneumoniae R6
auaguaaacuucuu

SEQ ID NO: 2196528 - RNA, 23 nt, Streptococcus pneumoniae R6
auaguaacgagucaaaaaaggag

SEQ ID NO: 2196529 - RNA, 15 nt, Streptococcus pneumoniae R6
auaguacaauaccuu

SEQ ID NO: 2196530 - RNA, 16 nt, Streptococcus pneumoniae R6
auaguacacaucuacu

SEQ ID NO: 2196531 - RNA, 21 nt, Streptococcus pneumoniae R6
auaguacacaucuacuucuaa

SEQ ID NO: 2196532 - RNA, 16 nt, Streptococcus pneumoniae R6
auaguacaccuuuacu

SEQ ID NO: 2196533 - RNA, 17 nt, Streptococcus pneumoniae R6
auaguacaccuuuacuu

SEQ ID NO: 2196534 - RNA, 14 nt, Streptococcus pneumoniae R6
auaguacacuucua

SEQ ID NO: 2196535 - RNA, 19 nt, Streptococcus pneumoniae R6
auaguacacuucugcuucu

SEQ ID NO: 2196536 - RNA, 13 nt, Streptococcus pneumoniae R6
auagguugcaaag

SEQ ID NO: 2196537 - RNA, 22 nt, Streptococcus pneumoniae R6
auagguuguugaaaauauuuua

SEQ ID NO: 2196538 - RNA, 13 nt, Streptococcus pneumoniae R6
auagguuuugcua

SEQ ID NO: 2196539 - RNA, 15 nt, Streptococcus pneumoniae R6
auaguaaaaugaaac

SEQ ID NO: 2196540 - RNA, 21 nt, Streptococcus pneumoniae R6
auagguggauaaaagucuuca

SEQ ID NO: 2196541 - RNA, 18 nt, Streptococcus pneumoniae R6
auaggugguuggaaguag

SEQ ID NO: 2196542 - RNA, 20 nt, Streptococcus pneumoniae R6
auagguggggcaaaaacaca

SEQ ID NO: 2196543 - RNA, 15 nt, Streptococcus pneumoniae R6
auaggugggugggua

SEQ ID NO: 2196544 - RNA, 16 nt, Streptococcus pneumoniae R6
auaggauuuauuuuuc

SEQ ID NO: 2196545 - RNA, 23 nt, Streptococcus pneumoniae R6
auaggauuuauuuuucuuuuuca

SEQ ID NO: 2196546 - RNA, 15 nt, Streptococcus pneumoniae R6
auaggacguuuucag

SEQ ID NO: 2196547 - RNA, 24 nt, Streptococcus pneumoniae R6
auaggacguuuucagauuuuuagu

SEQ ID NO: 2196548 - RNA, 19 nt, Streptococcus pneumoniae R6
auagggcuuuuuuugcuua

SEQ ID NO: 2196549 - RNA, 12 nt, Streptococcus pneumoniae R6
auaggggaauau

SEQ ID NO: 2196550 - RNA, 21 nt, Streptococcus pneumoniae R6
auaggcggacaccucuuucuu

SEQ ID NO: 2196551 - RNA, 21 nt, Streptococcus pneumoniae R6
auaggccuuguggaagaaguu

SEQ ID NO: 2196552 - RNA, 14 nt, Streptococcus pneumoniae R6
auagugguguuuca

SEQ ID NO: 2196553 - RNA, 23 nt, Streptococcus pneumoniae R6
auaguagguugcaguugaaauaa

SEQ ID NO: 2196554 - RNA, 16 nt, Streptococcus pneumoniae R6
auagugaauugaaaua

SEQ ID NO: 2196555 - RNA, 15 nt, Streptococcus pneumoniae R6
auagugacuuuaugu

SEQ ID NO: 2196556 - RNA, 21 nt, Streptococcus pneumoniae R6
auagugauuggagauacuuuu

SEQ ID NO: 2196557 - RNA, 13 nt, Streptococcus pneumoniae R6
auaguuuuucccg

SEQ ID NO: 2196558 - RNA, 23 nt, Streptococcus pneumoniae R6
auaguuuucacuauugaugaacu

SEQ ID NO: 2196559 - RNA, 17 nt, Streptococcus pneumoniae R6
auaguuugcaaauuauu

SEQ ID NO: 2196560 - RNA, 19 nt, Streptococcus pneumoniae R6
auaguuucauaacuacagu

SEQ ID NO: 2196561 - RNA, 20 nt, Streptococcus pneumoniae R6
auaguuucauaacuacagua

SEQ ID NO: 2196562 - RNA, 22 nt, Streptococcus pneumoniae R6
auaguuuaaguaguaaccaccu

SEQ ID NO: 2196563 - RNA, 15 nt, Streptococcus pneumoniae R6
auaguugcauuaaaa

SEQ ID NO: 2196564 - RNA, 17 nt, Streptococcus pneumoniae R6
auauaauggcuucauua

SEQ ID NO: 2196565 - RNA, 20 nt, Streptococcus pneumoniae R6
auauaagauuuaacuuuuuu

SEQ ID NO: 2196566 - RNA, 14 nt, Streptococcus pneumoniae R6
auauaaaaagaccg

SEQ ID NO: 2196567 - RNA, 21 nt, Streptococcus pneumoniae R6
auuauccuuuacuuguuuuag

SEQ ID NO: 2196568 - RNA, 22 nt, Streptococcus pneumoniae R6
auuaucggagauggguucccua

SEQ ID NO: 2196569 - RNA, 16 nt, Streptococcus pneumoniae R6
auuauccauaauaaua

SEQ ID NO: 2196570 - RNA, 12 nt, Streptococcus pneumoniae R6
auuauccauauu

SEQ ID NO: 2196571 - RNA, 22 nt, Streptococcus pneumoniae R6
auuauccccuacucgauuuuaa

SEQ ID NO: 2196572 - RNA, 14 nt, Streptococcus pneumoniae R6
auuaucuaacaaua

SEQ ID NO: 2196573 - RNA, 17 nt, Streptococcus pneumoniae R6
auuaucguguugaaauu

SEQ ID NO: 2196574 - RNA, 14 nt, Streptococcus pneumoniae R6
auuaucuuuccauu

SEQ ID NO: 2196575 - RNA, 16 nt, Streptococcus pneumoniae R6
auuaugaaaaccaaga

SEQ ID NO: 2196576 - RNA, 12 nt, Streptococcus pneumoniae R6
auuaugauuuaa

SEQ ID NO: 2196577 - RNA, 20 nt, Streptococcus pneumoniae R6
auuaugaaauuuaaaaagaa

SEQ ID NO: 2196578 - RNA, 17 nt, Streptococcus pneumoniae R6
auuaugagcuauuagau

SEQ ID NO: 2196579 - RNA, 12 nt, Streptococcus pneumoniae R6
auuauuuaaagc

SEQ ID NO: 2196580 - RNA, 14 nt, Streptococcus pneumoniae R6
auuauuuaaagcaa

SEQ ID NO: 2196581 - RNA, 13 nt, Streptococcus pneumoniae R6
auuauuuauuuac

SEQ ID NO: 2196582 - RNA, 13 nt, Streptococcus pneumoniae R6
auuauguuuuaaa

SEQ ID NO: 2196583 - RNA, 14 nt, Streptococcus pneumoniae R6
auuauguuuuaaau

SEQ ID NO: 2196584 - RNA, 17 nt, Streptococcus pneumoniae R6
auuauuagggaaacaaa

SEQ ID NO: 2196585 - RNA, 20 nt, Streptococcus pneumoniae R6
auuauuagggaaacaaaagu

SEQ ID NO: 2196586 - RNA, 13 nt, Streptococcus pneumoniae R6
auuauuaugaaaa

SEQ ID NO: 2196587 - RNA, 17 nt, Streptococcus pneumoniae R6
auuauuaugaaaaccaa

SEQ ID NO: 2196588 - RNA, 13 nt, Streptococcus pneumoniae R6
auuauuaccuuga

SEQ ID NO: 2196589 - RNA, 14 nt, Streptococcus pneumoniae R6
auuaugcguuuuau

SEQ ID NO: 2196590 - RNA, 17 nt, Streptococcus pneumoniae R6
auuaugcuaaagaaauu

SEQ ID NO: 2196591 - RNA, 22 nt, Streptococcus pneumoniae R6
auuauguaaauaaauaucaaaa

SEQ ID NO: 2196592 - RNA, 14 nt, Streptococcus pneumoniae R6
auuaugguauacga

SEQ ID NO: 2196593 - RNA, 17 nt, Streptococcus pneumoniae R6
auucaaacucaaauuua

SEQ ID NO: 2196594 - RNA, 18 nt, Streptococcus pneumoniae R6
auuauuugccuaugaaau

SEQ ID NO: 2196595 - RNA, 23 nt, Streptococcus pneumoniae R6
auuauuugguuaggugaauuagu

SEQ ID NO: 2196596 - RNA, 13 nt, Streptococcus pneumoniae R6
auuauuuccuuga

SEQ ID NO: 2196597 - RNA, 16 nt, Streptococcus pneumoniae R6
auuauuuccuugacca

SEQ ID NO: 2196598 - RNA, 15 nt, Streptococcus pneumoniae R6
auucaauauauuaug

SEQ ID NO: 2196599 - RNA, 14 nt, Streptococcus pneumoniae R6
auucaauccaucuc

SEQ ID NO: 2196600 - RNA, 16 nt, Streptococcus pneumoniae R6
auucaauccaucucca

SEQ ID NO: 2196601 - RNA, 17 nt, Streptococcus pneumoniae R6
auucaaaguggguuuua

SEQ ID NO: 2196602 - RNA, 14 nt, Streptococcus pneumoniae R6
auucaacagcuuuu

SEQ ID NO: 2196603 - RNA, 19 nt, Streptococcus pneumoniae R6
auucaacauuuaucuauaa

SEQ ID NO: 2196604 - RNA, 19 nt, Streptococcus pneumoniae R6
auucaacgaacuauaaaau

SEQ ID NO: 2196605 - RNA, 18 nt, Streptococcus pneumoniae R6
auucaccuauuaacaaua

SEQ ID NO: 2196606 - RNA, 16 nt, Streptococcus pneumoniae R6
auucaccaauuuuacc

SEQ ID NO: 2196607 - RNA, 16 nt, Streptococcus pneumoniae R6
auucaccaacuacagu

SEQ ID NO: 2196608 - RNA, 22 nt, Streptococcus pneumoniae R6
auucacauggagggucaaaaca

SEQ ID NO: 2196609 - RNA, 16 nt, Streptococcus pneumoniae R6
auucaauucuuuaaca

SEQ ID NO: 2196610 - RNA, 20 nt, Streptococcus pneumoniae R6
auucaauguuuacucaguau

SEQ ID NO: 2196611 - RNA, 18 nt, Streptococcus pneumoniae R6
auucaauugcaggagaaa

SEQ ID NO: 2196612 - RNA, 21 nt, Streptococcus pneumoniae R6
auucaauuuuauacucaucug

SEQ ID NO: 2196613 - RNA, 12 nt, Streptococcus pneumoniae R6
auucagauuuua

SEQ ID NO: 2196614 - RNA, 13 nt, Streptococcus pneumoniae R6
auucagauuuuau

SEQ ID NO: 2196615 - RNA, 16 nt, Streptococcus pneumoniae R6
auucacugagaucuuc

SEQ ID NO: 2196616 - RNA, 21 nt, Streptococcus pneumoniae R6
auuacaaacacgcauaguauc

SEQ ID NO: 2196617 - RNA, 14 nt, Streptococcus pneumoniae R6
auuacaucuaucuc

SEQ ID NO: 2196618 - RNA, 13 nt, Streptococcus pneumoniae R6
auuacauccacca

SEQ ID NO: 2196619 - RNA, 21 nt, Streptococcus pneumoniae R6
auuacaguuauuuuaguaaaa

SEQ ID NO: 2196620 - RNA, 20 nt, Streptococcus pneumoniae R6
auuacaggcaggacaaaaga

SEQ ID NO: 2196621 - RNA, 23 nt, Streptococcus pneumoniae R6
auuacaggcaggacaaaagauaa

SEQ ID NO: 2196622 - RNA, 18 nt, Streptococcus pneumoniae R6
auuaauuugaauuuucua

SEQ ID NO: 2196623 - RNA, 14 nt, Streptococcus pneumoniae R6
auuaauuugacuuu

SEQ ID NO: 2196624 - RNA, 19 nt, Streptococcus pneumoniae R6
auuaauuugacuuuucuaa

SEQ ID NO: 2196625 - RNA, 12 nt, Streptococcus pneumoniae R6
auuaauuucuag

SEQ ID NO: 2196626 - RNA, 17 nt, Streptococcus pneumoniae R6
auuaauuucauuacuaa

SEQ ID NO: 2196627 - RNA, 18 nt, Streptococcus pneumoniae R6
auuaauuuauagaaaaau

SEQ ID NO: 2196628 - RNA, 20 nt, Streptococcus pneumoniae R6
auuaauucggaaagccaaau

SEQ ID NO: 2196629 - RNA, 16 nt, Streptococcus pneumoniae R6
auuacgaugcuuuucu

SEQ ID NO: 2196630 - RNA, 18 nt, Streptococcus pneumoniae R6
auuacucaaguccuuuug

SEQ ID NO: 2196631 - RNA, 18 nt, Streptococcus pneumoniae R6
auuacuaucaaaaucaau

SEQ ID NO: 2196632 - RNA, 17 nt, Streptococcus pneumoniae R6
auuaccaaguuaaacaa

SEQ ID NO: 2196633 - RNA, 19 nt, Streptococcus pneumoniae R6
auuaccaccacguauaauu

SEQ ID NO: 2196634 - RNA, 21 nt, Streptococcus pneumoniae R6
auuaccucuuuuuauucuuuu

SEQ ID NO: 2196635 - RNA, 17 nt, Streptococcus pneumoniae R6
auuaccuuugaaaaaau

SEQ ID NO: 2196636 - RNA, 18 nt, Streptococcus pneumoniae R6
auuaccuuugaaaaaaug

SEQ ID NO: 2196637 - RNA, 15 nt, Streptococcus pneumoniae R6
auuacgacguuuuag

SEQ ID NO: 2196638 - RNA, 12 nt, Streptococcus pneumoniae R6
auuagcucaaaa

SEQ ID NO: 2196639 - RNA, 16 nt, Streptococcus pneumoniae R6
auuagcucaaaacacu

SEQ ID NO: 2196640 - RNA, 22 nt, Streptococcus pneumoniae R6
auuagcaucuuaucagaaaaua

SEQ ID NO: 2196641 - RNA, 13 nt, Streptococcus pneumoniae R6
auuagauaagagu

SEQ ID NO: 2196642 - RNA, 19 nt, Streptococcus pneumoniae R6
auuagauaguuuugcaaga

SEQ ID NO: 2196643 - RNA, 20 nt, Streptococcus pneumoniae R6
auuagagguuugcuuagaaa

SEQ ID NO: 2196644 - RNA, 18 nt, Streptococcus pneumoniae R6
auuagaccugccaugcug

SEQ ID NO: 2196645 - RNA, 19 nt, Streptococcus pneumoniae R6
auuagaauucagcuuuguu

SEQ ID NO: 2196646 - RNA, 22 nt, Streptococcus pneumoniae R6
auuagaggcgagacauuuuucg

SEQ ID NO: 2196647 - RNA, 17 nt, Streptococcus pneumoniae R6
auuagaaauugaaguaa

SEQ ID NO: 2196648 - RNA, 15 nt, Streptococcus pneumoniae R6
auuagaaaaagacuu

SEQ ID NO: 2196649 - RNA, 21 nt, Streptococcus pneumoniae R6
auuagaaaaagacuugaaaua

SEQ ID NO: 2196650 - RNA, 17 nt, Streptococcus pneumoniae R6
auuacuguuguugagac

SEQ ID NO: 2196651 - RNA, 15 nt, Streptococcus pneumoniae R6
auuacuucuaaaaca

SEQ ID NO: 2196652 - RNA, 22 nt, Streptococcus pneumoniae R6
auuauagugguguuucaagucu

SEQ ID NO: 2196653 - RNA, 14 nt, Streptococcus pneumoniae R6
auuauauaaaccaa

SEQ ID NO: 2196654 - RNA, 13 nt, Streptococcus pneumoniae R6
auuauauuuaggg

SEQ ID NO: 2196655 - RNA, 17 nt, Streptococcus pneumoniae R6
auuauauuuauagaauu

SEQ ID NO: 2196656 - RNA, 22 nt, Streptococcus pneumoniae R6
auuauaugcaauuucuuuauau

SEQ ID NO: 2196657 - RNA, 23 nt, Streptococcus pneumoniae R6
auuauacguuuuuugauuuuaau

SEQ ID NO: 2196658 - RNA, 23 nt, Streptococcus pneumoniae R6
auuauacuauaaaacaauagcuu

SEQ ID NO: 2196659 - RNA, 16 nt, Streptococcus pneumoniae R6
auuauagcauucuucu

SEQ ID NO: 2196660 - RNA, 17 nt, Streptococcus pneumoniae R6
auuauagcggauguuau

SEQ ID NO: 2196661 - RNA, 20 nt, Streptococcus pneumoniae R6
auuauaggacguuuucagau

SEQ ID NO: 2196662 - RNA, 20 nt, Streptococcus pneumoniae R6
auuauaaauuucgaaaaaug

SEQ ID NO: 2196663 - RNA, 15 nt, Streptococcus pneumoniae R6
auuauaauaaaauga

SEQ ID NO: 2196664 - RNA, 21 nt, Streptococcus pneumoniae R6
auuauaaucguuuaaaacacc

SEQ ID NO: 2196665 - RNA, 16 nt, Streptococcus pneumoniae R6
auuaguaaucuggucu

SEQ ID NO: 2196666 - RNA, 17 nt, Streptococcus pneumoniae R6
auuaguaaucuggucuu

SEQ ID NO: 2196667 - RNA, 17 nt, Streptococcus pneumoniae R6
auuaggggggcuauucu

SEQ ID NO: 2196668 - RNA, 20 nt, Streptococcus pneumoniae R6
auuagggucuuuaaugucua

SEQ ID NO: 2196669 - RNA, 19 nt, Streptococcus pneumoniae R6
auuagggaaacaaaagucu

SEQ ID NO: 2196670 - RNA, 16 nt, Streptococcus pneumoniae R6
auuaggaaagaauguu

SEQ ID NO: 2196671 - RNA, 15 nt, Streptococcus pneumoniae R6
auuaggcucuuuguc

SEQ ID NO: 2196672 - RNA, 20 nt, Streptococcus pneumoniae R6
auuaggcucuuugucaacug

SEQ ID NO: 2196673 - RNA, 21 nt, Streptococcus pneumoniae R6
auuaggcucuuugucaacugu

SEQ ID NO: 2196674 - RNA, 15 nt, Streptococcus pneumoniae R6
auuagggcaaauaaa

SEQ ID NO: 2196675 - RNA, 17 nt, Streptococcus pneumoniae R6
auuagggcaaauaaaaa

SEQ ID NO: 2196676 - RNA, 14 nt, Streptococcus pneumoniae R6
auuauaaauuauuu

SEQ ID NO: 2196677 - RNA, 20 nt, Streptococcus pneumoniae R6
auuauaaaagcucauuuccu

SEQ ID NO: 2196678 - RNA, 20 nt, Streptococcus pneumoniae R6
auuagucggaaucuuuaaga

SEQ ID NO: 2196679 - RNA, 17 nt, Streptococcus pneumoniae R6
auuagugaaguguuuag

SEQ ID NO: 2196680 - RNA, 14 nt, Streptococcus pneumoniae R6
auuagucaagugca

SEQ ID NO: 2196681 - RNA, 16 nt, Streptococcus pneumoniae R6
auguucaguuucuauu

SEQ ID NO: 2196682 - RNA, 23 nt, Streptococcus pneumoniae R6
auguucaguuucuauuucauuuu

SEQ ID NO: 2196683 - RNA, 13 nt, Streptococcus pneumoniae R6
auguucaagacau

SEQ ID NO: 2196684 - RNA, 19 nt, Streptococcus pneumoniae R6
auguuccaaguccguuuuc

SEQ ID NO: 2196685 - RNA, 16 nt, Streptococcus pneumoniae R6
auguuuaaaaucugga

SEQ ID NO: 2196686 - RNA, 19 nt, Streptococcus pneumoniae R6
auguugucaauuuccauuu

SEQ ID NO: 2196687 - RNA, 16 nt, Streptococcus pneumoniae R6
auguugguaagagaaa

SEQ ID NO: 2196688 - RNA, 21 nt, Streptococcus pneumoniae R6
auguuugcuucauuuuuuccu

SEQ ID NO: 2196689 - RNA, 17 nt, Streptococcus pneumoniae R6
auguuuuagaaaucaca

SEQ ID NO: 2196690 - RNA, 16 nt, Streptococcus pneumoniae R6
auguuuucucauagcc

SEQ ID NO: 2196691 - RNA, 22 nt, Streptococcus pneumoniae R6
auguuuucucauagccauaaaa

SEQ ID NO: 2196692 - RNA, 14 nt, Streptococcus pneumoniae R6
auguuucuuuaaau

SEQ ID NO: 2196693 - RNA, 15 nt, Streptococcus pneumoniae R6
auguuucuuuaaauc

SEQ ID NO: 2196694 - RNA, 13 nt, Streptococcus pneumoniae R6
auuaaagaccaaa

SEQ ID NO: 2196695 - RNA, 15 nt, Streptococcus pneumoniae R6
auuaaagaccaaaga

SEQ ID NO: 2196696 - RNA, 20 nt, Streptococcus pneumoniae R6
auuaaaguuuaacccacuua

SEQ ID NO: 2196697 - RNA, 15 nt, Streptococcus pneumoniae R6
auuaaagccuucgua

SEQ ID NO: 2196698 - RNA, 21 nt, Streptococcus pneumoniae R6
auuaaaucauaaacacccaua

SEQ ID NO: 2196699 - RNA, 16 nt, Streptococcus pneumoniae R6
auuaaaucauccauau

SEQ ID NO: 2196700 - RNA, 13 nt, Streptococcus pneumoniae R6
auguuuuugaggu

SEQ ID NO: 2196701 - RNA, 19 nt, Streptococcus pneumoniae R6
auuaaaaagaguagaaauu

SEQ ID NO: 2196702 - RNA, 12 nt, Streptococcus pneumoniae R6
auuaaaauguuc

SEQ ID NO: 2196703 - RNA, 12 nt, Streptococcus pneumoniae R6
auuaaaaucaua

SEQ ID NO: 2196704 - RNA, 18 nt, Streptococcus pneumoniae R6
auuaaaaggcucauaaau

SEQ ID NO: 2196705 - RNA, 14 nt, Streptococcus pneumoniae R6
auuaaaacugccuu

SEQ ID NO: 2196706 - RNA, 14 nt, Streptococcus pneumoniae R6
auuaauaauuuuca

SEQ ID NO: 2196707 - RNA, 16 nt, Streptococcus pneumoniae R6
auuaauaauuuucaca

SEQ ID NO: 2196708 - RNA, 11 nt, Streptococcus pneumoniae R6
auuaagccucu

SEQ ID NO: 2196709 - RNA, 16 nt, Streptococcus pneumoniae R6
auuaagguuuuaccuu

SEQ ID NO: 2196710 - RNA, 19 nt, Streptococcus pneumoniae R6
auuaagguuuuaccuucaa

SEQ ID NO: 2196711 - RNA, 18 nt, Streptococcus pneumoniae R6
auuaagugauuuaaaugu

SEQ ID NO: 2196712 - RNA, 19 nt, Streptococcus pneumoniae R6
auuaagugauuuaaauguu

SEQ ID NO: 2196713 - RNA, 14 nt, Streptococcus pneumoniae R6
auuaaucaaaugag

SEQ ID NO: 2196714 - RNA, 21 nt, Streptococcus pneumoniae R6
auuaaucaccguccccaaaaa

SEQ ID NO: 2196715 - RNA, 23 nt, Streptococcus pneumoniae R6
auuaaucagaauggguuaaaauu

SEQ ID NO: 2196716 - RNA, 19 nt, Streptococcus pneumoniae R6
auuaaucauucccugggga

SEQ ID NO: 2196717 - RNA, 17 nt, Streptococcus pneumoniae R6
auuaauggcagugcuuu

SEQ ID NO: 2196718 - RNA, 20 nt, Streptococcus pneumoniae R6
auuaaauugcgauuuugcca

SEQ ID NO: 2196719 - RNA, 12 nt, Streptococcus pneumoniae R6
auuaacaauaau

SEQ ID NO: 2196720 - RNA, 23 nt, Streptococcus pneumoniae R6
auuaacuucaggauuuuuacagu

SEQ ID NO: 2196721 - RNA, 17 nt, Streptococcus pneumoniae R6
auuaacgauugaaauaa

SEQ ID NO: 2196722 - RNA, 15 nt, Streptococcus pneumoniae R6
auggucuucaugcug

SEQ ID NO: 2196723 - RNA, 18 nt, Streptococcus pneumoniae R6
augguaguuuaccccaaa

SEQ ID NO: 2196724 - RNA, 20 nt, Streptococcus pneumoniae R6
augguccgggcugacaacca

SEQ ID NO: 2196725 - RNA, 12 nt, Streptococcus pneumoniae R6
augguaauguuc

SEQ ID NO: 2196726 - RNA, 22 nt, Streptococcus pneumoniae R6
augguaaugccgugauuuccaa

SEQ ID NO: 2196727 - RNA, 14 nt, Streptococcus pneumoniae R6
augggcaaggagau

SEQ ID NO: 2196728 - RNA, 20 nt, Streptococcus pneumoniae R6
augggauuuucauauaauaa

SEQ ID NO: 2196729 - RNA, 19 nt, Streptococcus pneumoniae R6
auggguucgcccugucuuu

SEQ ID NO: 2196730 - RNA, 18 nt, Streptococcus pneumoniae R6
auggguugaaguaacucu

SEQ ID NO: 2196731 - RNA, 16 nt, Streptococcus pneumoniae R6
augggcuuacaucaaa

SEQ ID NO: 2196732 - RNA, 16 nt, Streptococcus pneumoniae R6
auggcuaacuucauua

SEQ ID NO: 2196733 - RNA, 20 nt, Streptococcus pneumoniae R6
auggcuccguagauagcugc

SEQ ID NO: 2196734 - RNA, 17 nt, Streptococcus pneumoniae R6
auggccaccuucaacaa

SEQ ID NO: 2196735 - RNA, 13 nt, Streptococcus pneumoniae R6
auggcauuagcug

SEQ ID NO: 2196736 - RNA, 15 nt, Streptococcus pneumoniae R6
augcgcaaaauaauu

SEQ ID NO: 2196737 - RNA, 16 nt, Streptococcus pneumoniae R6
augccuuuuucaauca

SEQ ID NO: 2196738 - RNA, 19 nt, Streptococcus pneumoniae R6
augccuuuuucaaucaaug

SEQ ID NO: 2196739 - RNA, 18 nt, Streptococcus pneumoniae R6
auguagucaaucaaaaug

SEQ ID NO: 2196740 - RNA, 19 nt, Streptococcus pneumoniae R6
auguauaauggauugaaau

SEQ ID NO: 2196741 - RNA, 22 nt, Streptococcus pneumoniae R6
auguaugaugagggaaugacuc

SEQ ID NO: 2196742 - RNA, 18 nt, Streptococcus pneumoniae R6
auguauauuacagauuuc

SEQ ID NO: 2196743 - RNA, 14 nt, Streptococcus pneumoniae R6
auguccuaaaacgu

SEQ ID NO: 2196744 - RNA, 16 nt, Streptococcus pneumoniae R6
augucauguuagaaaa

SEQ ID NO: 2196745 - RNA, 14 nt, Streptococcus pneumoniae R6
auguaaucaaaagg

SEQ ID NO: 2196746 - RNA, 15 nt, Streptococcus pneumoniae R6
auguaguaaucauua

SEQ ID NO: 2196747 - RNA, 21 nt, Streptococcus pneumoniae R6
auguagggugacgaauuuuuu

SEQ ID NO: 2196748 - RNA, 19 nt, Streptococcus pneumoniae R6
augguuuuuagcgccuuaa

SEQ ID NO: 2196749 - RNA, 13 nt, Streptococcus pneumoniae R6
augguuuugaggu

SEQ ID NO: 2196750 - RNA, 17 nt, Streptococcus pneumoniae R6
augguuugaugacuuca

SEQ ID NO: 2196751 - RNA, 12 nt, Streptococcus pneumoniae R6
auguaagaguuc

SEQ ID NO: 2196752 - RNA, 15 nt, Streptococcus pneumoniae R6
augucuuggauuuuu

SEQ ID NO: 2196753 - RNA, 22 nt, Streptococcus pneumoniae R6
augugacgggcguuugacaagu

SEQ ID NO: 2196754 - RNA, 19 nt, Streptococcus pneumoniae R6
auguucaaagcgauaaaaa

SEQ ID NO: 2196755 - RNA, 13 nt, Streptococcus pneumoniae R6
auguuaagugcuu

SEQ ID NO: 2196756 - RNA, 14 nt, Streptococcus pneumoniae R6
auguuaaccacaaa

SEQ ID NO: 2196757 - RNA, 17 nt, Streptococcus pneumoniae R6
auguuaaccacaaaaag

SEQ ID NO: 2196758 - RNA, 19 nt, Streptococcus pneumoniae R6
auguuaaccacaaaaagug

SEQ ID NO: 2196759 - RNA, 21 nt, Streptococcus pneumoniae R6
aucuccaguuuggaccauaaa

SEQ ID NO: 2196760 - RNA, 19 nt, Streptococcus pneumoniae R6
aucuccguuuuuaaucaua

SEQ ID NO: 2196761 - RNA, 23 nt, Streptococcus pneumoniae R6
aucuccguuuuuaaucauacaca

SEQ ID NO: 2196762 - RNA, 22 nt, Streptococcus pneumoniae R6
aucuccucaggaacuucaacau

SEQ ID NO: 2196763 - RNA, 18 nt, Streptococcus pneumoniae R6
aucuccucuaccugccuu

SEQ ID NO: 2196764 - RNA, 21 nt, Streptococcus pneumoniae R6
aucucacguaacauauuuuca

SEQ ID NO: 2196765 - RNA, 22 nt, Streptococcus pneumoniae R6
aucucacguaacauauuuucaa

SEQ ID NO: 2196766 - RNA, 17 nt, Streptococcus pneumoniae R6
aucuccagauagagcua

SEQ ID NO: 2196767 - RNA, 21 nt, Streptococcus pneumoniae R6
aucuccaccaccgauauauug

SEQ ID NO: 2196768 - RNA, 19 nt, Streptococcus pneumoniae R6
aucuccaacugcaaagaua

SEQ ID NO: 2196769 - RNA, 21 nt, Streptococcus pneumoniae R6
aucuccaacugcaaagauacc

SEQ ID NO: 2196770 - RNA, 13 nt, Streptococcus pneumoniae R6
aucuccaacugcu

SEQ ID NO: 2196771 - RNA, 13 nt, Streptococcus pneumoniae R6
aucucaaaagaaa

SEQ ID NO: 2196772 - RNA, 16 nt, Streptococcus pneumoniae R6
aucucaaaagaaagca

SEQ ID NO: 2196773 - RNA, 18 nt, Streptococcus pneumoniae R6
aucucaaaagaaagcaua

SEQ ID NO: 2196774 - RNA, 18 nt, Streptococcus pneumoniae R6
aucuauuuuuaauagaca

SEQ ID NO: 2196775 - RNA, 15 nt, Streptococcus pneumoniae R6
aucuauuuuuacuca

SEQ ID NO: 2196776 - RNA, 17 nt, Streptococcus pneumoniae R6
aucuauuuuuacucaag

SEQ ID NO: 2196777 - RNA, 20 nt, Streptococcus pneumoniae R6
aucuagcgcaaagcuaaauc

SEQ ID NO: 2196778 - RNA, 15 nt, Streptococcus pneumoniae R6
aucuaggucaacagg

SEQ ID NO: 2196779 - RNA, 12 nt, Streptococcus pneumoniae R6
aucuaguaaagc

SEQ ID NO: 2196780 - RNA, 20 nt, Streptococcus pneumoniae R6
aucuaguaaaucgauuuuua

SEQ ID NO: 2196781 - RNA, 22 nt, Streptococcus pneumoniae R6
aucuaguaaaucgauuuuuaug

SEQ ID NO: 2196782 - RNA, 14 nt, Streptococcus pneumoniae R6
aucuagucaucaga

SEQ ID NO: 2196783 - RNA, 16 nt, Streptococcus pneumoniae R6
aucuagucgaagcuuc

SEQ ID NO: 2196784 - RNA, 15 nt, Streptococcus pneumoniae R6
aucuauaaacaaagg

SEQ ID NO: 2196785 - RNA, 16 nt, Streptococcus pneumoniae R6
aucuauaaacaaagga

SEQ ID NO: 2196786 - RNA, 14 nt, Streptococcus pneumoniae R6
aucuauaacaguac

SEQ ID NO: 2196787 - RNA, 16 nt, Streptococcus pneumoniae R6
aucuacuuuuuucuaa

SEQ ID NO: 2196788 - RNA, 22 nt, Streptococcus pneumoniae R6
aucuacuuuuuucuaaagcaau

SEQ ID NO: 2196789 - RNA, 17 nt, Streptococcus pneumoniae R6
aucuacuucuuuaacua

SEQ ID NO: 2196790 - RNA, 14 nt, Streptococcus pneumoniae R6
aucuacuauagaaa

SEQ ID NO: 2196791 - RNA, 17 nt, Streptococcus pneumoniae R6
aucuacgcuuuaaaaau

SEQ ID NO: 2196792 - RNA, 13 nt, Streptococcus pneumoniae R6
aucucuccuuauc

SEQ ID NO: 2196793 - RNA, 15 nt, Streptococcus pneumoniae R6
aucucuccuuaucaa

SEQ ID NO: 2196794 - RNA, 21 nt, Streptococcus pneumoniae R6
aucucuaacaaugcuuuagaa

SEQ ID NO: 2196795 - RNA, 20 nt, Streptococcus pneumoniae R6
aucucuacauucccaaacaa

SEQ ID NO: 2196796 - RNA, 12 nt, Streptococcus pneumoniae R6
aucucguucuug

SEQ ID NO: 2196797 - RNA, 17 nt, Streptococcus pneumoniae R6
aucucguucuugaaacc

SEQ ID NO: 2196798 - RNA, 21 nt, Streptococcus pneumoniae R6
aucucgugcauuucaucccca

SEQ ID NO: 2196799 - RNA, 22 nt, Streptococcus pneumoniae R6
aucucgugcauuucauccccau

SEQ ID NO: 2196800 - RNA, 15 nt, Streptococcus pneumoniae R6
aucucggaaagauau

SEQ ID NO: 2196801 - RNA, 19 nt, Streptococcus pneumoniae R6
aucucgcuguuuauuuuuu

SEQ ID NO: 2196802 - RNA, 18 nt, Streptococcus pneumoniae R6
aucucggucaucaucacu

SEQ ID NO: 2196803 - RNA, 17 nt, Streptococcus pneumoniae R6
aucugaaaaauuaacaa

SEQ ID NO: 2196804 - RNA, 15 nt, Streptococcus pneumoniae R6
aucucugcaaaccac

SEQ ID NO: 2196805 - RNA, 13 nt, Streptococcus pneumoniae R6
aucucucuauaau

SEQ ID NO: 2196806 - RNA, 14 nt, Streptococcus pneumoniae R6
aucucucuauaaua

SEQ ID NO: 2196807 - RNA, 20 nt, Streptococcus pneumoniae R6
aucucuuagaucuagauuaa

SEQ ID NO: 2196808 - RNA, 14 nt, Streptococcus pneumoniae R6
aucucuuaaaaaag

SEQ ID NO: 2196809 - RNA, 22 nt, Streptococcus pneumoniae R6
aucucuggguacucuuuuuuca

SEQ ID NO: 2196810 - RNA, 18 nt, Streptococcus pneumoniae R6
aucucuguuaagaaauaa

SEQ ID NO: 2196811 - RNA, 12 nt, Streptococcus pneumoniae R6
aucugcaaccuc

SEQ ID NO: 2196812 - RNA, 15 nt, Streptococcus pneumoniae R6
aucugcaaccucaaa

SEQ ID NO: 2196813 - RNA, 16 nt, Streptococcus pneumoniae R6
aucugcaaccucaaaa

SEQ ID NO: 2196814 - RNA, 19 nt, Streptococcus pneumoniae R6
aucugcaaccuuaaaacag

SEQ ID NO: 2196815 - RNA, 22 nt, Streptococcus pneumoniae R6
aucugaugcugacaagucaucc

SEQ ID NO: 2196816 - RNA, 23 nt, Streptococcus pneumoniae R6
aucugaaccugauuggccgcaag

SEQ ID NO: 2196817 - RNA, 12 nt, Streptococcus pneumoniae R6
aucugaagaaag

SEQ ID NO: 2196818 - RNA, 14 nt, Streptococcus pneumoniae R6
aucugaagaaagca

SEQ ID NO: 2196819 - RNA, 20 nt, Streptococcus pneumoniae R6
aucugaaaucccuuguucca

SEQ ID NO: 2196820 - RNA, 16 nt, Streptococcus pneumoniae R6
aucugaaaguuuaucu

SEQ ID NO: 2196821 - RNA, 19 nt, Streptococcus pneumoniae R6
aucugaaucaaaauuauuu

SEQ ID NO: 2196822 - RNA, 17 nt, Streptococcus pneumoniae R6
aucugaaugacaaaucc

SEQ ID NO: 2196823 - RNA, 20 nt, Streptococcus pneumoniae R6
aucugacuagcaucuugugu

SEQ ID NO: 2196824 - RNA, 17 nt, Streptococcus pneumoniae R6
aucugauaaacucccac

SEQ ID NO: 2196825 - RNA, 18 nt, Streptococcus pneumoniae R6
aucugagguguaaguccu

SEQ ID NO: 2196826 - RNA, 19 nt, Streptococcus pneumoniae R6
aucugagguguaaguccuc

SEQ ID NO: 2196827 - RNA, 20 nt, Streptococcus pneumoniae R6
aucugagguguaaguccucg

SEQ ID NO: 2196828 - RNA, 11 nt, Streptococcus pneumoniae R6
aucugcaugac

SEQ ID NO: 2196829 - RNA, 18 nt, Streptococcus pneumoniae R6
aucugcagccucaaaaca

SEQ ID NO: 2196830 - RNA, 19 nt, Streptococcus pneumoniae R6
aucugcagccucaaaacac

SEQ ID NO: 2196831 - RNA, 14 nt, Streptococcus pneumoniae R6
aucugccauaucau

SEQ ID NO: 2196832 - RNA, 13 nt, Streptococcus pneumoniae R6
aucugcccaaaga

SEQ ID NO: 2196833 - RNA, 14 nt, Streptococcus pneumoniae R6
aucugcccaaagac

SEQ ID NO: 2196834 - RNA, 19 nt, Streptococcus pneumoniae R6
aucugccuuuuuauccaaa

SEQ ID NO: 2196835 - RNA, 17 nt, Streptococcus pneumoniae R6
aucguugcaccugaacg

SEQ ID NO: 2196836 - RNA, 15 nt, Streptococcus pneumoniae R6
aucuacaaccucaaa

SEQ ID NO: 2196837 - RNA, 19 nt, Streptococcus pneumoniae R6
aucuacaaccucaaaaaca

SEQ ID NO: 2196838 - RNA, 14 nt, Streptococcus pneumoniae R6
aucuacaaccuuaa

SEQ ID NO: 2196839 - RNA, 15 nt, Streptococcus pneumoniae R6
aucuacaaccuuaaa

SEQ ID NO: 2196840 - RNA, 18 nt, Streptococcus pneumoniae R6
aucuacaaccuuaaaaca

SEQ ID NO: 2196841 - RNA, 20 nt, Streptococcus pneumoniae R6
aucuacacccacgucacaaa

SEQ ID NO: 2196842 - RNA, 20 nt, Streptococcus pneumoniae R6
aucguguugaaauuguucac

SEQ ID NO: 2196843 - RNA, 22 nt, Streptococcus pneumoniae R6
aucgguaagaaagcaacuaaaa

SEQ ID NO: 2196844 - RNA, 19 nt, Streptococcus pneumoniae R6
auccuuuguuuacuaaaca

SEQ ID NO: 2196845 - RNA, 21 nt, Streptococcus pneumoniae R6
auccuuuuaaucgauuauuuu

SEQ ID NO: 2196846 - RNA, 22 nt, Streptococcus pneumoniae R6
auccuuuuaaucgauuauuuuu

SEQ ID NO: 2196847 - RNA, 21 nt, Streptococcus pneumoniae R6
auccuuuuccaagaccuuaaa

SEQ ID NO: 2196848 - RNA, 14 nt, Streptococcus pneumoniae R6
auccuuuuuucuuu

SEQ ID NO: 2196849 - RNA, 21 nt, Streptococcus pneumoniae R6
auccuuuuuuugaaguuuuca

SEQ ID NO: 2196850 - RNA, 11 nt, Streptococcus pneumoniae R6
aucgaaaaaua

SEQ ID NO: 2196851 - RNA, 17 nt, Streptococcus pneumoniae R6
aucgaaagcaaauuuaa

SEQ ID NO: 2196852 - RNA, 21 nt, Streptococcus pneumoniae R6
aucagcuaagccuuuuucuuc

SEQ ID NO: 2196853 - RNA, 17 nt, Streptococcus pneumoniae R6
aucagcguuuuuucuuu

SEQ ID NO: 2196854 - RNA, 16 nt, Streptococcus pneumoniae R6
aucagcucucugauuu

SEQ ID NO: 2196855 - RNA, 16 nt, Streptococcus pneumoniae R6
aucagcuuuuucaggu

SEQ ID NO: 2196856 - RNA, 15 nt, Streptococcus pneumoniae R6
aucgcaagguagaga

SEQ ID NO: 2196857 - RNA, 21 nt, Streptococcus pneumoniae R6
aucgcaaucuacuugucuaga

SEQ ID NO: 2196858 - RNA, 19 nt, Streptococcus pneumoniae R6
aucgauuuguccuguucuu

SEQ ID NO: 2196859 - RNA, 20 nt, Streptococcus pneumoniae R6
aucgauauaauuuuccuuaa

SEQ ID NO: 2196860 - RNA, 19 nt, Streptococcus pneumoniae R6
aucgaguuauuaacaaaag

SEQ ID NO: 2196861 - RNA, 19 nt, Streptococcus pneumoniae R6
aucgaguaggggauaaucu

SEQ ID NO: 2196862 - RNA, 15 nt, Streptococcus pneumoniae R6
aucgagcagauuucu

SEQ ID NO: 2196863 - RNA, 13 nt, Streptococcus pneumoniae R6
aucgcauaaaacg

SEQ ID NO: 2196864 - RNA, 16 nt, Streptococcus pneumoniae R6
aucuuuaaaaguugua

SEQ ID NO: 2196865 - RNA, 17 nt, Streptococcus pneumoniae R6
aucuuuaaaaguuguau

SEQ ID NO: 2196866 - RNA, 14 nt, Streptococcus pneumoniae R6
aucuugagcaaguc

SEQ ID NO: 2196867 - RNA, 17 nt, Streptococcus pneumoniae R6
aucuugaauauuuuucu

SEQ ID NO: 2196868 - RNA, 16 nt, Streptococcus pneumoniae R6
aucuugacuauauuuc

SEQ ID NO: 2196869 - RNA, 21 nt, Streptococcus pneumoniae R6
aucuugaacugcauuuuuuca

SEQ ID NO: 2196870 - RNA, 13 nt, Streptococcus pneumoniae R6
aucuugaaguuga

SEQ ID NO: 2196871 - RNA, 11 nt, Streptococcus pneumoniae R6
aucuuuaaggc

SEQ ID NO: 2196872 - RNA, 15 nt, Streptococcus pneumoniae R6
aucugcuaaaacaaa

SEQ ID NO: 2196873 - RNA, 18 nt, Streptococcus pneumoniae R6
aucugcuaaaacaaaauu

SEQ ID NO: 2196874 - RNA, 19 nt, Streptococcus pneumoniae R6
aucugcuaaaacaaaauuc

SEQ ID NO: 2196875 - RNA, 20 nt, Streptococcus pneumoniae R6
aucugcuaacugcuggauag

SEQ ID NO: 2196876 - RNA, 19 nt, Streptococcus pneumoniae R6
aucuggcuuucuguaaucu

SEQ ID NO: 2196877 - RNA, 22 nt, Streptococcus pneumoniae R6
aucugggauugguaccgcugaa

SEQ ID NO: 2196878 - RNA, 17 nt, Streptococcus pneumoniae R6
aucuucuggcacagaaa

SEQ ID NO: 2196879 - RNA, 19 nt, Streptococcus pneumoniae R6
aucuucuggcacagaaaca

SEQ ID NO: 2196880 - RNA, 14 nt, Streptococcus pneumoniae R6
aucuucuuucuccu

SEQ ID NO: 2196881 - RNA, 13 nt, Streptococcus pneumoniae R6
aucuucuuacaua

SEQ ID NO: 2196882 - RNA, 16 nt, Streptococcus pneumoniae R6
aucuucuguaccaaua

SEQ ID NO: 2196883 - RNA, 16 nt, Streptococcus pneumoniae R6
aucuucuguguuugaa

SEQ ID NO: 2196884 - RNA, 23 nt, Streptococcus pneumoniae R6
augaaacaaaaacaggacaaauc

SEQ ID NO: 2196885 - RNA, 22 nt, Streptococcus pneumoniae R6
augaaacccuugauuuuuuccu

SEQ ID NO: 2196886 - RNA, 23 nt, Streptococcus pneumoniae R6
augaaaccccaagaaacaacaau

SEQ ID NO: 2196887 - RNA, 23 nt, Streptococcus pneumoniae R6
augaaacuauguacgaaaagcac

SEQ ID NO: 2196888 - RNA, 16 nt, Streptococcus pneumoniae R6
aucuuuuauuugagua

SEQ ID NO: 2196889 - RNA, 15 nt, Streptococcus pneumoniae R6
aucuuuuauuuuuau

SEQ ID NO: 2196890 - RNA, 18 nt, Streptococcus pneumoniae R6
aucuuuugauagaugacu

SEQ ID NO: 2196891 - RNA, 20 nt, Streptococcus pneumoniae R6
aucuuuuacuucugaaguua

SEQ ID NO: 2196892 - RNA, 16 nt, Streptococcus pneumoniae R6
augaagauugauaaag

SEQ ID NO: 2196893 - RNA, 20 nt, Streptococcus pneumoniae R6
augaagauugauaaaggcag

SEQ ID NO: 2196894 - RNA, 14 nt, Streptococcus pneumoniae R6
augaaauaaaauuu

SEQ ID NO: 2196895 - RNA, 18 nt, Streptococcus pneumoniae R6
augaaauaagaacaggac

SEQ ID NO: 2196896 - RNA, 22 nt, Streptococcus pneumoniae R6
augaaauaauaacaggacaaau

SEQ ID NO: 2196897 - RNA, 13 nt, Streptococcus pneumoniae R6
augaaauaauacu

SEQ ID NO: 2196898 - RNA, 17 nt, Streptococcus pneumoniae R6
augaaauaauacucaau

SEQ ID NO: 2196899 - RNA, 17 nt, Streptococcus pneumoniae R6
augaaauacugauguaa

SEQ ID NO: 2196900 - RNA, 15 nt, Streptococcus pneumoniae R6
augaaauauuuuuua

SEQ ID NO: 2196901 - RNA, 22 nt, Streptococcus pneumoniae R6
augaaauauuuuuuacuuuugc

SEQ ID NO: 2196902 - RNA, 15 nt, Streptococcus pneumoniae R6
augagaaauuuuugg

SEQ ID NO: 2196903 - RNA, 13 nt, Streptococcus pneumoniae R6
augacuugcaauc

SEQ ID NO: 2196904 - RNA, 19 nt, Streptococcus pneumoniae R6
augacuuuccacaauuuuc

SEQ ID NO: 2196905 - RNA, 20 nt, Streptococcus pneumoniae R6
augacuuuccacaauuuuca

SEQ ID NO: 2196906 - RNA, 22 nt, Streptococcus pneumoniae R6
augacuuucuaauuauuucaau

SEQ ID NO: 2196907 - RNA, 15 nt, Streptococcus pneumoniae R6
augacgaaacgaaga

SEQ ID NO: 2196908 - RNA, 22 nt, Streptococcus pneumoniae R6
augagguuucgcauuugagcga

SEQ ID NO: 2196909 - RNA, 21 nt, Streptococcus pneumoniae R6
augaggguccgaaccacaaca

SEQ ID NO: 2196910 - RNA, 15 nt, Streptococcus pneumoniae R6
augagauuauugguc

SEQ ID NO: 2196911 - RNA, 19 nt, Streptococcus pneumoniae R6
augagauuuuggaagagua

SEQ ID NO: 2196912 - RNA, 17 nt, Streptococcus pneumoniae R6
augagacuugcaagaaa

SEQ ID NO: 2196913 - RNA, 19 nt, Streptococcus pneumoniae R6
augagagauucauucugcu

SEQ ID NO: 2196914 - RNA, 23 nt, Streptococcus pneumoniae R6
augagaaguuuuauuaggaagaa

SEQ ID NO: 2196915 - RNA, 16 nt, Streptococcus pneumoniae R6
augagaauacaaaaau

SEQ ID NO: 2196916 - RNA, 12 nt, Streptococcus pneumoniae R6
augagaauaucg

SEQ ID NO: 2196917 - RNA, 14 nt, Streptococcus pneumoniae R6
augagauaauacaa

SEQ ID NO: 2196918 - RNA, 15 nt, Streptococcus pneumoniae R6
augagauaauacaau

SEQ ID NO: 2196919 - RNA, 16 nt, Streptococcus pneumoniae R6
augagaggcaacagaa

SEQ ID NO: 2196920 - RNA, 17 nt, Streptococcus pneumoniae R6
augagaggcaacagaaa

SEQ ID NO: 2196921 - RNA, 17 nt, Streptococcus pneumoniae R6
augaauaacuucaauau

SEQ ID NO: 2196922 - RNA, 17 nt, Streptococcus pneumoniae R6
augaaguggggcaccau

SEQ ID NO: 2196923 - RNA, 22 nt, Streptococcus pneumoniae R6
augaaguggggcaccauuuuca

SEQ ID NO: 2196924 - RNA, 19 nt, Streptococcus pneumoniae R6
augaaguuagguuuuguuu

SEQ ID NO: 2196925 - RNA, 16 nt, Streptococcus pneumoniae R6
augaaguaaaugugag

SEQ ID NO: 2196926 - RNA, 22 nt, Streptococcus pneumoniae R6
augaauauauuccauuccucug

SEQ ID NO: 2196927 - RNA, 18 nt, Streptococcus pneumoniae R6
augaaucguaauuuagaa

SEQ ID NO: 2196928 - RNA, 17 nt, Streptococcus pneumoniae R6
augacauuauuuucuua

SEQ ID NO: 2196929 - RNA, 22 nt, Streptococcus pneumoniae R6
augaauuugaaacaaugaaaau

SEQ ID NO: 2196930 - RNA, 22 nt, Streptococcus pneumoniae R6
augacaucuuggaguugauuca

SEQ ID NO: 2196931 - RNA, 17 nt, Streptococcus pneumoniae R6
augacaucuaaauaaua

SEQ ID NO: 2196932 - RNA, 13 nt, Streptococcus pneumoniae R6
augacaucuucca

SEQ ID NO: 2196933 - RNA, 23 nt, Streptococcus pneumoniae R6
augaauuucuacaaauguuuuag

SEQ ID NO: 2196934 - RNA, 16 nt, Streptococcus pneumoniae R6
augaauugauuuaaca

SEQ ID NO: 2196935 - RNA, 15 nt, Streptococcus pneumoniae R6
augaauugccugaua

SEQ ID NO: 2196936 - RNA, 18 nt, Streptococcus pneumoniae R6
augaaucugaaucaaaau

SEQ ID NO: 2196937 - RNA, 18 nt, Streptococcus pneumoniae R6
augauuuaauuagaaaaa

SEQ ID NO: 2196938 - RNA, 17 nt, Streptococcus pneumoniae R6
augauuucaauuuuaaa

SEQ ID NO: 2196939 - RNA, 18 nt, Streptococcus pneumoniae R6
augcaaagaccaccucau

SEQ ID NO: 2196940 - RNA, 17 nt, Streptococcus pneumoniae R6
augcaaagccaauauua

SEQ ID NO: 2196941 - RNA, 20 nt, Streptococcus pneumoniae R6
augcaacuuguuuuuccuga

SEQ ID NO: 2196942 - RNA, 18 nt, Streptococcus pneumoniae R6
augcaagguuucacagaa

SEQ ID NO: 2196943 - RNA, 14 nt, Streptococcus pneumoniae R6
augauggaagacug

SEQ ID NO: 2196944 - RNA, 19 nt, Streptococcus pneumoniae R6
augaugagcuggaagaauu

SEQ ID NO: 2196945 - RNA, 19 nt, Streptococcus pneumoniae R6
augaugacaccugaaacau

SEQ ID NO: 2196946 - RNA, 18 nt, Streptococcus pneumoniae R6
augaguggagccccuuga

SEQ ID NO: 2196947 - RNA, 17 nt, Streptococcus pneumoniae R6
augaguguaaaaagaaa

SEQ ID NO: 2196948 - RNA, 14 nt, Streptococcus pneumoniae R6
augaguuaccuaaa

SEQ ID NO: 2196949 - RNA, 19 nt, Streptococcus pneumoniae R6
augaguguuugcaaagaug

SEQ ID NO: 2196950 - RNA, 13 nt, Streptococcus pneumoniae R6
augauaagaaucg

SEQ ID NO: 2196951 - RNA, 12 nt, Streptococcus pneumoniae R6
augcaauuuuuu

SEQ ID NO: 2196952 - RNA, 17 nt, Streptococcus pneumoniae R6
augcacagacauaugaa

SEQ ID NO: 2196953 - RNA, 20 nt, Streptococcus pneumoniae R6
augcacauauacacuuaaau

SEQ ID NO: 2196954 - RNA, 22 nt, Streptococcus pneumoniae R6
augcaauuucuuuauauaaaaa

SEQ ID NO: 2196955 - RNA, 23 nt, Streptococcus pneumoniae R6
augcaauuucuuuauauaaaaag

SEQ ID NO: 2196956 - RNA, 22 nt, Streptococcus pneumoniae R6
augccaaucgacccuggauuga

SEQ ID NO: 2196957 - RNA, 15 nt, Streptococcus pneumoniae R6
augcccuugauaaua

SEQ ID NO: 2196958 - RNA, 22 nt, Streptococcus pneumoniae R6
augcccuugauaauaaagaaga

SEQ ID NO: 2196959 - RNA, 19 nt, Streptococcus pneumoniae R6
augccuuaucuuuuuucau

SEQ ID NO: 2196960 - RNA, 15 nt, Streptococcus pneumoniae R6
augccuguuccaaca

SEQ ID NO: 2196961 - RNA, 19 nt, Streptococcus pneumoniae R6
augccuguuccaacauugu

SEQ ID NO: 2196962 - RNA, 21 nt, Streptococcus pneumoniae R6
augccugucguaccuaaaaag

SEQ ID NO: 2196963 - RNA, 19 nt, Streptococcus pneumoniae R6
augccgugauuuccaaucu

SEQ ID NO: 2196964 - RNA, 13 nt, Streptococcus pneumoniae R6
auucuaggcuauc

SEQ ID NO: 2196965 - RNA, 14 nt, Streptococcus pneumoniae R6
auucuaguuucaau

SEQ ID NO: 2196966 - RNA, 15 nt, Streptococcus pneumoniae R6
auucaguaacguuag

SEQ ID NO: 2196967 - RNA, 20 nt, Streptococcus pneumoniae R6
auucaguaacguuagcaaag

SEQ ID NO: 2196968 - RNA, 12 nt, Streptococcus pneumoniae R6
auucuauuuuuu

SEQ ID NO: 2196969 - RNA, 13 nt, Streptococcus pneumoniae R6
auucuauuuuuua

SEQ ID NO: 2196970 - RNA, 14 nt, Streptococcus pneumoniae R6
auucuauuuuuuau

SEQ ID NO: 2196971 - RNA, 19 nt, Streptococcus pneumoniae R6
auucuauuuuuuauaauau

SEQ ID NO: 2196972 - RNA, 21 nt, Streptococcus pneumoniae R6
auucuauuuuuuauaauauca

SEQ ID NO: 2196973 - RNA, 16 nt, Streptococcus pneumoniae R6
auucuauuccaucucc

SEQ ID NO: 2196974 - RNA, 16 nt, Streptococcus pneumoniae R6
auucagagcgauaaaa

SEQ ID NO: 2196975 - RNA, 16 nt, Streptococcus pneumoniae R6
auucagccaaggcucc

SEQ ID NO: 2196976 - RNA, 17 nt, Streptococcus pneumoniae R6
auucaggugauuuacca

SEQ ID NO: 2196977 - RNA, 21 nt, Streptococcus pneumoniae R6
auucugcuagacuaacuucuu

SEQ ID NO: 2196978 - RNA, 15 nt, Streptococcus pneumoniae R6
auucugcuuuuaaau

SEQ ID NO: 2196979 - RNA, 17 nt, Streptococcus pneumoniae R6
auucucgugaaauuuua

SEQ ID NO: 2196980 - RNA, 13 nt, Streptococcus pneumoniae R6
auucuggauuuuu

SEQ ID NO: 2196981 - RNA, 20 nt, Streptococcus pneumoniae R6
auucugggauuacaagaccg

SEQ ID NO: 2196982 - RNA, 20 nt, Streptococcus pneumoniae R6
auucuuaaaauugguuuaaa

SEQ ID NO: 2196983 - RNA, 18 nt, Streptococcus pneumoniae R6
auucuuaaagccacuaua

SEQ ID NO: 2196984 - RNA, 22 nt, Streptococcus pneumoniae R6
auugaaguuagaguaguacaca

SEQ ID NO: 2196985 - RNA, 15 nt, Streptococcus pneumoniae R6
auugacuauauuucu

SEQ ID NO: 2196986 - RNA, 17 nt, Streptococcus pneumoniae R6
auugacgcccuuaguaa

SEQ ID NO: 2196987 - RNA, 17 nt, Streptococcus pneumoniae R6
auugacucuaacuguau

SEQ ID NO: 2196988 - RNA, 20 nt, Streptococcus pneumoniae R6
auugacucucaccuguugcu

SEQ ID NO: 2196989 - RNA, 12 nt, Streptococcus pneumoniae R6
auugacugccca

SEQ ID NO: 2196990 - RNA, 20 nt, Streptococcus pneumoniae R6
auugagacgacuacuuccua

SEQ ID NO: 2196991 - RNA, 16 nt, Streptococcus pneumoniae R6
auugagagcgacuuuu

SEQ ID NO: 2196992 - RNA, 13 nt, Streptococcus pneumoniae R6
auugagaagccaa

SEQ ID NO: 2196993 - RNA, 16 nt, Streptococcus pneumoniae R6
auugagaagccaaaau

SEQ ID NO: 2196994 - RNA, 13 nt, Streptococcus pneumoniae R6
auugaaauagaau

SEQ ID NO: 2196995 - RNA, 12 nt, Streptococcus pneumoniae R6
auugaaaugaaa

SEQ ID NO: 2196996 - RNA, 19 nt, Streptococcus pneumoniae R6
auugaaaacgguaacaaaa

SEQ ID NO: 2196997 - RNA, 22 nt, Streptococcus pneumoniae R6
auugaaaauucacaaaauccuu

SEQ ID NO: 2196998 - RNA, 17 nt, Streptococcus pneumoniae R6
auugaaacagcuaaaga

SEQ ID NO: 2196999 - RNA, 22 nt, Streptococcus pneumoniae R6
auugaaaggaaaaugauuuuuu

SEQ ID NO: 2197000 - RNA, 18 nt, Streptococcus pneumoniae R6
auugaaauaacccaccaa

SEQ ID NO: 2197001 - RNA, 21 nt, Streptococcus pneumoniae R6
auucuuuuuugguuucuugau

SEQ ID NO: 2197002 - RNA, 14 nt, Streptococcus pneumoniae R6
auugaaaaaacuug

SEQ ID NO: 2197003 - RNA, 11 nt, Streptococcus pneumoniae R6
auucuuuuucu

SEQ ID NO: 2197004 - RNA, 12 nt, Streptococcus pneumoniae R6
auucuuauuuca

SEQ ID NO: 2197005 - RNA, 16 nt, Streptococcus pneumoniae R6
auucuuauuucaaaaa

SEQ ID NO: 2197006 - RNA, 17 nt, Streptococcus pneumoniae R6
auucuuauuucaaaaaa

SEQ ID NO: 2197007 - RNA, 14 nt, Streptococcus pneumoniae R6
auucuuauuucauu

SEQ ID NO: 2197008 - RNA, 14 nt, Streptococcus pneumoniae R6
auucuuauauuaaa

SEQ ID NO: 2197009 - RNA, 15 nt, Streptococcus pneumoniae R6
auucuuauauuaaaa

SEQ ID NO: 2197010 - RNA, 13 nt, Streptococcus pneumoniae R6
auucuuagaaauc

SEQ ID NO: 2197011 - RNA, 19 nt, Streptococcus pneumoniae R6
auucuucaggauugauaaa

SEQ ID NO: 2197012 - RNA, 14 nt, Streptococcus pneumoniae R6
auugcccaaaauga

SEQ ID NO: 2197013 - RNA, 19 nt, Streptococcus pneumoniae R6
auugcccaaaaugaggguc

SEQ ID NO: 2197014 - RNA, 18 nt, Streptococcus pneumoniae R6
auugccgacucaaguaca

SEQ ID NO: 2197015 - RNA, 18 nt, Streptococcus pneumoniae R6
auugaggacaauagcgag

SEQ ID NO: 2197016 - RNA, 17 nt, Streptococcus pneumoniae R6
auugagcgcaggaagaa

SEQ ID NO: 2197017 - RNA, 14 nt, Streptococcus pneumoniae R6
auugaguucacaaa

SEQ ID NO: 2197018 - RNA, 23 nt, Streptococcus pneumoniae R6
auugaguauaaacgaauagaaaa

SEQ ID NO: 2197019 - RNA, 14 nt, Streptococcus pneumoniae R6
auugaguauaaaug

SEQ ID NO: 2197020 - RNA, 15 nt, Streptococcus pneumoniae R6
auugaguauaaaugg

SEQ ID NO: 2197021 - RNA, 16 nt, Streptococcus pneumoniae R6
auugaguauaaaugga

SEQ ID NO: 2197022 - RNA, 21 nt, Streptococcus pneumoniae R6
auugaguauaaauggacaauc

SEQ ID NO: 2197023 - RNA, 10 nt, Streptococcus pneumoniae R6
auugaguauu

SEQ ID NO: 2197024 - RNA, 19 nt, Streptococcus pneumoniae R6
auugaguuuuaaucucaaa

SEQ ID NO: 2197025 - RNA, 16 nt, Streptococcus pneumoniae R6
auugauuugacuucca

SEQ ID NO: 2197026 - RNA, 13 nt, Streptococcus pneumoniae R6
auugauuuccuga

SEQ ID NO: 2197027 - RNA, 15 nt, Streptococcus pneumoniae R6
auugcaaagcaaucu

SEQ ID NO: 2197028 - RNA, 14 nt, Streptococcus pneumoniae R6
auugcaauuuauca

SEQ ID NO: 2197029 - RNA, 21 nt, Streptococcus pneumoniae R6
auugcaagcccuuauuuccau

SEQ ID NO: 2197030 - RNA, 15 nt, Streptococcus pneumoniae R6
auuggauuuucugaa

SEQ ID NO: 2197031 - RNA, 17 nt, Streptococcus pneumoniae R6
auuggauuuucugaagu

SEQ ID NO: 2197032 - RNA, 18 nt, Streptococcus pneumoniae R6
auuggauuuucugaaguu

SEQ ID NO: 2197033 - RNA, 13 nt, Streptococcus pneumoniae R6
auuggcaagagcu

SEQ ID NO: 2197034 - RNA, 16 nt, Streptococcus pneumoniae R6
auuggcucaucugcaa

SEQ ID NO: 2197035 - RNA, 23 nt, Streptococcus pneumoniae R6
auugcuuuccaauaauucaccua

SEQ ID NO: 2197036 - RNA, 16 nt, Streptococcus pneumoniae R6
auugcuugagcaaucc

SEQ ID NO: 2197037 - RNA, 13 nt, Streptococcus pneumoniae R6
auugcuucauaaa

SEQ ID NO: 2197038 - RNA, 23 nt, Streptococcus pneumoniae R6
auuggaggcaaacuucuaaggaa

SEQ ID NO: 2197039 - RNA, 15 nt, Streptococcus pneumoniae R6
auuggauaguuuuuc

SEQ ID NO: 2197040 - RNA, 16 nt, Streptococcus pneumoniae R6
auugcgauuuugccaa

SEQ ID NO: 2197041 - RNA, 23 nt, Streptococcus pneumoniae R6
auugcgauuuugccaaguuucuu

SEQ ID NO: 2197042 - RNA, 17 nt, Streptococcus pneumoniae R6
auugcuccgaucuuuca

SEQ ID NO: 2197043 - RNA, 19 nt, Streptococcus pneumoniae R6
auugcuagcaaugguuuag

SEQ ID NO: 2197044 - RNA, 16 nt, Streptococcus pneumoniae R6
auugcucaacuucuuu

SEQ ID NO: 2197045 - RNA, 17 nt, Streptococcus pneumoniae R6
auuucagaaucccaaag

SEQ ID NO: 2197046 - RNA, 12 nt, Streptococcus pneumoniae R6
auuucaucccca

SEQ ID NO: 2197047 - RNA, 18 nt, Streptococcus pneumoniae R6
auuucaucgauuucuucu

SEQ ID NO: 2197048 - RNA, 17 nt, Streptococcus pneumoniae R6
auuucaaccuuguggaa

SEQ ID NO: 2197049 - RNA, 18 nt, Streptococcus pneumoniae R6
auuucaaccuuguggaau

SEQ ID NO: 2197050 - RNA, 20 nt, Streptococcus pneumoniae R6
auuucaaccuuguggaauug

SEQ ID NO: 2197051 - RNA, 13 nt, Streptococcus pneumoniae R6
auuucaaaucaua

SEQ ID NO: 2197052 - RNA, 15 nt, Streptococcus pneumoniae R6
auuucaaaucauaaa

SEQ ID NO: 2197053 - RNA, 22 nt, Streptococcus pneumoniae R6
auuucaaaggcuuuuucuucuu

SEQ ID NO: 2197054 - RNA, 18 nt, Streptococcus pneumoniae R6
auuucaauagaaaucacg

SEQ ID NO: 2197055 - RNA, 22 nt, Streptococcus pneumoniae R6
auuucaauagcuccuugugcac

SEQ ID NO: 2197056 - RNA, 16 nt, Streptococcus pneumoniae R6
auuucaauccauuaua

SEQ ID NO: 2197057 - RNA, 14 nt, Streptococcus pneumoniae R6
auuuauuaauuuca

SEQ ID NO: 2197058 - RNA, 16 nt, Streptococcus pneumoniae R6
auuuauuauaaaauuu

SEQ ID NO: 2197059 - RNA, 15 nt, Streptococcus pneumoniae R6
auuucaaaaaaugua

SEQ ID NO: 2197060 - RNA, 12 nt, Streptococcus pneumoniae R6
auuuauuuacuu

SEQ ID NO: 2197061 - RNA, 16 nt, Streptococcus pneumoniae R6
auuuauagaauuuuuu

SEQ ID NO: 2197062 - RNA, 16 nt, Streptococcus pneumoniae R6
auuuauaguaaaauga

SEQ ID NO: 2197063 - RNA, 20 nt, Streptococcus pneumoniae R6
auuuauaguaaaaugaaaua

SEQ ID NO: 2197064 - RNA, 20 nt, Streptococcus pneumoniae R6
auuuauaguauuaguaauuu

SEQ ID NO: 2197065 - RNA, 18 nt, Streptococcus pneumoniae R6
auuuauccauucacaaca

SEQ ID NO: 2197066 - RNA, 17 nt, Streptococcus pneumoniae R6
auuuauccgaaggauuu

SEQ ID NO: 2197067 - RNA, 21 nt, Streptococcus pneumoniae R6
auuuaucccaauggauauaag

SEQ ID NO: 2197068 - RNA, 12 nt, Streptococcus pneumoniae R6
auuuauagaaaa

SEQ ID NO: 2197069 - RNA, 17 nt, Streptococcus pneumoniae R6
auuuauagaaauauuuu

SEQ ID NO: 2197070 - RNA, 14 nt, Streptococcus pneumoniae R6
auuuauagaaaugu

SEQ ID NO: 2197071 - RNA, 16 nt, Streptococcus pneumoniae R6
auuuauagaaauuaau

SEQ ID NO: 2197072 - RNA, 21 nt, Streptococcus pneumoniae R6
auuuauacuaauacauuuugu

SEQ ID NO: 2197073 - RNA, 22 nt, Streptococcus pneumoniae R6
auuuauaauauaaacuuuuuca

SEQ ID NO: 2197074 - RNA, 15 nt, Streptococcus pneumoniae R6
auuuaguucuguauu

SEQ ID NO: 2197075 - RNA, 21 nt, Streptococcus pneumoniae R6
auuuagucuaacuuuugaggu

SEQ ID NO: 2197076 - RNA, 20 nt, Streptococcus pneumoniae R6
auuuagauucaguugcauaa

SEQ ID NO: 2197077 - RNA, 19 nt, Streptococcus pneumoniae R6
auuuagaggccaugacguc

SEQ ID NO: 2197078 - RNA, 17 nt, Streptococcus pneumoniae R6
auuuagagaaugaaaua

SEQ ID NO: 2197079 - RNA, 14 nt, Streptococcus pneumoniae R6
auuuagaacaccau

SEQ ID NO: 2197080 - RNA, 18 nt, Streptococcus pneumoniae R6
auuuaaucugaauguuuc

SEQ ID NO: 2197081 - RNA, 22 nt, Streptococcus pneumoniae R6
auuuaaucauguuuuuaagcua

SEQ ID NO: 2197082 - RNA, 17 nt, Streptococcus pneumoniae R6
auuuaaucauuuaauaa

SEQ ID NO: 2197083 - RNA, 14 nt, Streptococcus pneumoniae R6
auuuaauauauuua

SEQ ID NO: 2197084 - RNA, 17 nt, Streptococcus pneumoniae R6
auugugggaagauuuac

SEQ ID NO: 2197085 - RNA, 16 nt, Streptococcus pneumoniae R6
auugugggaauguuug

SEQ ID NO: 2197086 - RNA, 22 nt, Streptococcus pneumoniae R6
auugucaugucauguuagaaaa

SEQ ID NO: 2197087 - RNA, 16 nt, Streptococcus pneumoniae R6
auugucagagucuuga

SEQ ID NO: 2197088 - RNA, 17 nt, Streptococcus pneumoniae R6
auugucucuaaaaauaa

SEQ ID NO: 2197089 - RNA, 19 nt, Streptococcus pneumoniae R6
auugucucuaaaaauaaaa

SEQ ID NO: 2197090 - RNA, 21 nt, Streptococcus pneumoniae R6
auugucucuaaaaauaaaaaa

SEQ ID NO: 2197091 - RNA, 17 nt, Streptococcus pneumoniae R6
auugucuuacguucauc

SEQ ID NO: 2197092 - RNA, 20 nt, Streptococcus pneumoniae R6
auugucuuacguucauccau

SEQ ID NO: 2197093 - RNA, 23 nt, Streptococcus pneumoniae R6
auugucuaaaaauuuaaaagaua

SEQ ID NO: 2197094 - RNA, 18 nt, Streptococcus pneumoniae R6
auugucuaacuuuuuugg

SEQ ID NO: 2197095 - RNA, 19 nt, Streptococcus pneumoniae R6
auugucuaagcgaaacaac

SEQ ID NO: 2197096 - RNA, 20 nt, Streptococcus pneumoniae R6
auugucuacauugauuucca

SEQ ID NO: 2197097 - RNA, 22 nt, Streptococcus pneumoniae R6
auuguaaaaagagggauucuua

SEQ ID NO: 2197098 - RNA, 13 nt, Streptococcus pneumoniae R6
auugguuuaaaua

SEQ ID NO: 2197099 - RNA, 17 nt, Streptococcus pneumoniae R6
auuguauuuaugugcuu

SEQ ID NO: 2197100 - RNA, 20 nt, Streptococcus pneumoniae R6
auugucaaacaagaccucaa

SEQ ID NO: 2197101 - RNA, 18 nt, Streptococcus pneumoniae R6
auuguauagugaacugaa

SEQ ID NO: 2197102 - RNA, 18 nt, Streptococcus pneumoniae R6
auuguauagugaauugaa

SEQ ID NO: 2197103 - RNA, 20 nt, Streptococcus pneumoniae R6
auuguauccugaaaagccac

SEQ ID NO: 2197104 - RNA, 20 nt, Streptococcus pneumoniae R6
auuguaucugucguuagcac

SEQ ID NO: 2197105 - RNA, 18 nt, Streptococcus pneumoniae R6
auuguauacguuuuuacu

SEQ ID NO: 2197106 - RNA, 13 nt, Streptococcus pneumoniae R6
auuguagauguuc

SEQ ID NO: 2197107 - RNA, 15 nt, Streptococcus pneumoniae R6
auuguaggaaagaag

SEQ ID NO: 2197108 - RNA, 15 nt, Streptococcus pneumoniae R6
auuguuuauaaaaua

SEQ ID NO: 2197109 - RNA, 20 nt, Streptococcus pneumoniae R6
auuguuuaauucuugaaaau

SEQ ID NO: 2197110 - RNA, 16 nt, Streptococcus pneumoniae R6
auuguuguaauaauca

SEQ ID NO: 2197111 - RNA, 17 nt, Streptococcus pneumoniae R6
auuguugucccuuuuuc

SEQ ID NO: 2197112 - RNA, 21 nt, Streptococcus pneumoniae R6
auuguugucccuuuuucacua

SEQ ID NO: 2197113 - RNA, 20 nt, Streptococcus pneumoniae R6
auuguugcauuaaaaaguuu

SEQ ID NO: 2197114 - RNA, 15 nt, Streptococcus pneumoniae R6
auuguucuaguuuuu

SEQ ID NO: 2197115 - RNA, 12 nt, Streptococcus pneumoniae R6
auuguuaaaguu

SEQ ID NO: 2197116 - RNA, 16 nt, Streptococcus pneumoniae R6
auuguuaauggucuuc

SEQ ID NO: 2197117 - RNA, 13 nt, Streptococcus pneumoniae R6
auuguuaaacaau

SEQ ID NO: 2197118 - RNA, 13 nt, Streptococcus pneumoniae R6
auuguuaaaaauc

SEQ ID NO: 2197119 - RNA, 20 nt, Streptococcus pneumoniae R6
auuguuauuaagauuacaga

SEQ ID NO: 2197120 - RNA, 19 nt, Streptococcus pneumoniae R6
auuguucagaggcacuuga

SEQ ID NO: 2197121 - RNA, 15 nt, Streptococcus pneumoniae R6
auuguuauuuuucuu

SEQ ID NO: 2197122 - RNA, 16 nt, Streptococcus pneumoniae R6
auuguuccuaaaacag

SEQ ID NO: 2197123 - RNA, 16 nt, Streptococcus pneumoniae R6
auuuaaacuaguuuuc

SEQ ID NO: 2197124 - RNA, 18 nt, Streptococcus pneumoniae R6
auuguuucguacuauuuc

SEQ ID NO: 2197125 - RNA, 17 nt, Streptococcus pneumoniae R6
auuuaaauguuuucuca

SEQ ID NO: 2197126 - RNA, 12 nt, Streptococcus pneumoniae R6
auuuaacauuaa

SEQ ID NO: 2197127 - RNA, 15 nt, Streptococcus pneumoniae R6
auuuaaccaaaccaa

SEQ ID NO: 2197128 - RNA, 13 nt, Streptococcus pneumoniae R6
auuuuaucuuuga

SEQ ID NO: 2197129 - RNA, 17 nt, Streptococcus pneumoniae R6
auuuuaucuuugaaaua

SEQ ID NO: 2197130 - RNA, 23 nt, Streptococcus pneumoniae R6
auuuuaucuuugaaauaaucaaa

SEQ ID NO: 2197131 - RNA, 21 nt, Streptococcus pneumoniae R6
auuuucaauccguuuguguga

SEQ ID NO: 2197132 - RNA, 11 nt, Streptococcus pneumoniae R6
auuuucaaucc

SEQ ID NO: 2197133 - RNA, 17 nt, Streptococcus pneumoniae R6
auuuucagauaaccauc

SEQ ID NO: 2197134 - RNA, 20 nt, Streptococcus pneumoniae R6
auuuucagauaaccaucuca

SEQ ID NO: 2197135 - RNA, 15 nt, Streptococcus pneumoniae R6
auuuucagaaagaag

SEQ ID NO: 2197136 - RNA, 19 nt, Streptococcus pneumoniae R6
auuuucauaaacaagagca

SEQ ID NO: 2197137 - RNA, 21 nt, Streptococcus pneumoniae R6
auuuucauagaggaaggggcg

SEQ ID NO: 2197138 - RNA, 14 nt, Streptococcus pneumoniae R6
auuuucauauaaua

SEQ ID NO: 2197139 - RNA, 18 nt, Streptococcus pneumoniae R6
auuuucagcccagagcuu

SEQ ID NO: 2197140 - RNA, 19 nt, Streptococcus pneumoniae R6
auuuucagccucuauacuu

SEQ ID NO: 2197141 - RNA, 21 nt, Streptococcus pneumoniae R6
auuuucagccucuauacuuac

SEQ ID NO: 2197142 - RNA, 18 nt, Streptococcus pneumoniae R6
auuuuaauauauaaaaaa

SEQ ID NO: 2197143 - RNA, 14 nt, Streptococcus pneumoniae R6
auuuuacuauaaaa

SEQ ID NO: 2197144 - RNA, 17 nt, Streptococcus pneumoniae R6
auuuuacuauaaaauaa

SEQ ID NO: 2197145 - RNA, 15 nt, Streptococcus pneumoniae R6
auuuuagaagguuuu

SEQ ID NO: 2197146 - RNA, 20 nt, Streptococcus pneumoniae R6
auuuuagaagguuuuugaaa

SEQ ID NO: 2197147 - RNA, 16 nt, Streptococcus pneumoniae R6
auuuuacuucuucccc

SEQ ID NO: 2197148 - RNA, 17 nt, Streptococcus pneumoniae R6
auuuuaaaggucaauuc

SEQ ID NO: 2197149 - RNA, 14 nt, Streptococcus pneumoniae R6
auuuuaaauuuuuc

SEQ ID NO: 2197150 - RNA, 20 nt, Streptococcus pneumoniae R6
auuuuaaauuuuucugcaaa

SEQ ID NO: 2197151 - RNA, 15 nt, Streptococcus pneumoniae R6
auuuuguucuuuuuc

SEQ ID NO: 2197152 - RNA, 16 nt, Streptococcus pneumoniae R6
auuuuguucuuuuuca

SEQ ID NO: 2197153 - RNA, 23 nt, Streptococcus pneumoniae R6
auuuuguucuuuuucaaaagcua

SEQ ID NO: 2197154 - RNA, 14 nt, Streptococcus pneumoniae R6
auuuuguuucuuaa

SEQ ID NO: 2197155 - RNA, 15 nt, Streptococcus pneumoniae R6
auuuugugaaaaacu

SEQ ID NO: 2197156 - RNA, 21 nt, Streptococcus pneumoniae R6
auuuugaggauaaaaaagaag

SEQ ID NO: 2197157 - RNA, 16 nt, Streptococcus pneumoniae R6
auuuucuuaaaagcuu

SEQ ID NO: 2197158 - RNA, 16 nt, Streptococcus pneumoniae R6
auuuucuguggauacu

SEQ ID NO: 2197159 - RNA, 21 nt, Streptococcus pneumoniae R6
auuuucuuagcaauucuaaaa

SEQ ID NO: 2197160 - RNA, 14 nt, Streptococcus pneumoniae R6
auuuucuuaucacg

SEQ ID NO: 2197161 - RNA, 20 nt, Streptococcus pneumoniae R6
auuuucugggaagacuguca

SEQ ID NO: 2197162 - RNA, 23 nt, Streptococcus pneumoniae R6
auuuucucuuuguucuuuagaaa

SEQ ID NO: 2197163 - RNA, 14 nt, Streptococcus pneumoniae R6
auuuucgauuuaau

SEQ ID NO: 2197164 - RNA, 11 nt, Streptococcus pneumoniae R6
auuuuccuugg

SEQ ID NO: 2197165 - RNA, 23 nt, Streptococcus pneumoniae R6
auuuucgaagaguauaaaaucaa

SEQ ID NO: 2197166 - RNA, 16 nt, Streptococcus pneumoniae R6
auuuuccuaaacagaa

SEQ ID NO: 2197167 - RNA, 13 nt, Streptococcus pneumoniae R6
auuuucaucauca

SEQ ID NO: 2197168 - RNA, 15 nt, Streptococcus pneumoniae R6
auuuucaucaucaca

SEQ ID NO: 2197169 - RNA, 19 nt, Streptococcus pneumoniae R6
auuuucauugagcuuuaaa

SEQ ID NO: 2197170 - RNA, 15 nt, Streptococcus pneumoniae R6
auuuucauugaguau

SEQ ID NO: 2197171 - RNA, 17 nt, Streptococcus pneumoniae R6
auuuucauugaguauaa

SEQ ID NO: 2197172 - RNA, 18 nt, Streptococcus pneumoniae R6
auuuucauugaguauaag

SEQ ID NO: 2197173 - RNA, 21 nt, Streptococcus pneumoniae R6
auuuucauugaguauaagcaa

SEQ ID NO: 2197174 - RNA, 20 nt, Streptococcus pneumoniae R6
auuuucauugaguaugaaau

SEQ ID NO: 2197175 - RNA, 22 nt, Streptococcus pneumoniae R6
auuuucauugaguaugaaauaa

SEQ ID NO: 2197176 - RNA, 15 nt, Streptococcus pneumoniae R6
auuucaugacagauu

SEQ ID NO: 2197177 - RNA, 22 nt, Streptococcus pneumoniae R6
auuucaugacagauucaucacg

SEQ ID NO: 2197178 - RNA, 19 nt, Streptococcus pneumoniae R6
auuucuaaaaauguuuuaa

SEQ ID NO: 2197179 - RNA, 13 nt, Streptococcus pneumoniae R6
auuucuaaaacau

SEQ ID NO: 2197180 - RNA, 14 nt, Streptococcus pneumoniae R6
auuucuaaaacauu

SEQ ID NO: 2197181 - RNA, 17 nt, Streptococcus pneumoniae R6
auuucuaaaacauuguu

SEQ ID NO: 2197182 - RNA, 16 nt, Streptococcus pneumoniae R6
auuucuauugaaauga

SEQ ID NO: 2197183 - RNA, 16 nt, Streptococcus pneumoniae R6
auuucuauuuuaaaaa

SEQ ID NO: 2197184 - RNA, 19 nt, Streptococcus pneumoniae R6
auuucuaacaauguuuuag

SEQ ID NO: 2197185 - RNA, 18 nt, Streptococcus pneumoniae R6
auuucuaacauauuucua

SEQ ID NO: 2197186 - RNA, 20 nt, Streptococcus pneumoniae R6
auuucuaacgagugggacau

SEQ ID NO: 2197187 - RNA, 21 nt, Streptococcus pneumoniae R6
auuucucagggucuuuguucu

SEQ ID NO: 2197188 - RNA, 24 nt, Streptococcus pneumoniae R6
auuucucagggucuuuguucugaa

SEQ ID NO: 2197189 - RNA, 18 nt, Streptococcus pneumoniae R6
auuucuccuguuucaaag

SEQ ID NO: 2197190 - RNA, 19 nt, Streptococcus pneumoniae R6
auuucuccuguuucaaagu

SEQ ID NO: 2197191 - RNA, 15 nt, Streptococcus pneumoniae R6
auuucuucuggauga

SEQ ID NO: 2197192 - RNA, 12 nt, Streptococcus pneumoniae R6
auuucuucuugg

SEQ ID NO: 2197193 - RNA, 22 nt, Streptococcus pneumoniae R6
auuucuugacauacaacuuaaa

SEQ ID NO: 2197194 - RNA, 13 nt, Streptococcus pneumoniae R6
auuugaaacuaaa

SEQ ID NO: 2197195 - RNA, 13 nt, Streptococcus pneumoniae R6
auuugaacaaagu

SEQ ID NO: 2197196 - RNA, 17 nt, Streptococcus pneumoniae R6
auuugaacaaauuaauu

SEQ ID NO: 2197197 - RNA, 19 nt, Streptococcus pneumoniae R6
auuugaaaaaaauuuuauu

SEQ ID NO: 2197198 - RNA, 11 nt, Streptococcus pneumoniae R6
auuugaaacaa

SEQ ID NO: 2197199 - RNA, 14 nt, Streptococcus pneumoniae R6
auuugaaaaauaua

SEQ ID NO: 2197200 - RNA, 21 nt, Streptococcus pneumoniae R6
auuugaaaaauauacaaaaaa

SEQ ID NO: 2197201 - RNA, 15 nt, Streptococcus pneumoniae R6
auuugaacauuacua

SEQ ID NO: 2197202 - RNA, 14 nt, Streptococcus pneumoniae R6
auuugagugagcac

SEQ ID NO: 2197203 - RNA, 20 nt, Streptococcus pneumoniae R6
auuuguaucaccaagcauuu

SEQ ID NO: 2197204 - RNA, 19 nt, Streptococcus pneumoniae R6
auuuuaaaaugccaaagaa

SEQ ID NO: 2197205 - RNA, 22 nt, Streptococcus pneumoniae R6
auuuuaaaaugccaaagaaaga

SEQ ID NO: 2197206 - RNA, 19 nt, Streptococcus pneumoniae R6
auuuguucguauccuauuu

SEQ ID NO: 2197207 - RNA, 21 nt, Streptococcus pneumoniae R6
auuuguucguauccuauuuca

SEQ ID NO: 2197208 - RNA, 22 nt, Streptococcus pneumoniae R6
auuuuaaagaaauagaaaacaa

SEQ ID NO: 2197209 - RNA, 20 nt, Streptococcus pneumoniae R6
auuuuaaagacuuuuuucca

SEQ ID NO: 2197210 - RNA, 17 nt, Streptococcus pneumoniae R6
auuuguuccgauuuuau

SEQ ID NO: 2197211 - RNA, 21 nt, Streptococcus pneumoniae R6
auuuguuccgauuuuauuuca

SEQ ID NO: 2197212 - RNA, 19 nt, Streptococcus pneumoniae R6
auuuggcaccgaauuuuuc

SEQ ID NO: 2197213 - RNA, 20 nt, Streptococcus pneumoniae R6
auuuggcaccgaauuuuuca

SEQ ID NO: 2197214 - RNA, 17 nt, Streptococcus pneumoniae R6
auuugcucaauaaccac

SEQ ID NO: 2197215 - RNA, 18 nt, Streptococcus pneumoniae R6
auuuggcgaugauuuuag

SEQ ID NO: 2197216 - RNA, 19 nt, Streptococcus pneumoniae R6
auuuggcuuuuuuguauuc

SEQ ID NO: 2197217 - RNA, 16 nt, Streptococcus pneumoniae R6
auuugauauauaaaug

SEQ ID NO: 2197218 - RNA, 19 nt, Streptococcus pneumoniae R6
auuugauauauaaaugaaa

SEQ ID NO: 2197219 - RNA, 16 nt, Streptococcus pneumoniae R6
auuugauauagaguuc

SEQ ID NO: 2197220 - RNA, 21 nt, Streptococcus pneumoniae R6
auuugauuaggagauucuuau

SEQ ID NO: 2197221 - RNA, 22 nt, Streptococcus pneumoniae R6
auuugauuaggagauucuuaua

SEQ ID NO: 2197222 - RNA, 19 nt, Streptococcus pneumoniae R6
auuugcgacacuagcauaa

SEQ ID NO: 2197223 - RNA, 17 nt, Streptococcus pneumoniae R6
auuugccuaugaaauga

SEQ ID NO: 2197224 - RNA, 14 nt, Streptococcus pneumoniae R6
caaaaccaaacauc

SEQ ID NO: 2197225 - RNA, 14 nt, Streptococcus pneumoniae R6
caaaacaguguuuu

SEQ ID NO: 2197226 - RNA, 22 nt, Streptococcus pneumoniae R6
caaaacaguguuuuaagcugac

SEQ ID NO: 2197227 - RNA, 21 nt, Streptococcus pneumoniae R6
caaaacaguguuuugagcagc

SEQ ID NO: 2197228 - RNA, 20 nt, Streptococcus pneumoniae R6
caaaacaguguuuugagcua

SEQ ID NO: 2197229 - RNA, 11 nt, Streptococcus pneumoniae R6
caaaacacugu

SEQ ID NO: 2197230 - RNA, 15 nt, Streptococcus pneumoniae R6
caaaacacuguuuua

SEQ ID NO: 2197231 - RNA, 13 nt, Streptococcus pneumoniae R6
caaaacaaauugu

SEQ ID NO: 2197232 - RNA, 14 nt, Streptococcus pneumoniae R6
caaaacacaaaaag

SEQ ID NO: 2197233 - RNA, 14 nt, Streptococcus pneumoniae R6
caaaacacuaccaa

SEQ ID NO: 2197234 - RNA, 13 nt, Streptococcus pneumoniae R6
caaaaauuugauc

SEQ ID NO: 2197235 - RNA, 16 nt, Streptococcus pneumoniae R6
caaaaccaguccuuga

SEQ ID NO: 2197236 - RNA, 16 nt, Streptococcus pneumoniae R6
caaaaccauucaaaau

SEQ ID NO: 2197237 - RNA, 19 nt, Streptococcus pneumoniae R6
caaaaccauucaaaauacu

SEQ ID NO: 2197238 - RNA, 17 nt, Streptococcus pneumoniae R6
caaaacgccaucuucca

SEQ ID NO: 2197239 - RNA, 20 nt, Streptococcus pneumoniae R6
caaaaccugguacaguuggg

SEQ ID NO: 2197240 - RNA, 13 nt, Streptococcus pneumoniae R6
caaaacuuucaua

SEQ ID NO: 2197241 - RNA, 16 nt, Streptococcus pneumoniae R6
caaaacuguaaaguag

SEQ ID NO: 2197242 - RNA, 19 nt, Streptococcus pneumoniae R6
caaaacugguccagagaua

SEQ ID NO: 2197243 - RNA, 14 nt, Streptococcus pneumoniae R6
caaaacuauaaaug

SEQ ID NO: 2197244 - RNA, 15 nt, Streptococcus pneumoniae R6
caaaacguucccaac

SEQ ID NO: 2197245 - RNA, 19 nt, Streptococcus pneumoniae R6
caaaacuaacccuagaaaa

SEQ ID NO: 2197246 - RNA, 17 nt, Streptococcus pneumoniae R6
caaaacguaguuuuuuu

SEQ ID NO: 2197247 - RNA, 17 nt, Streptococcus pneumoniae R6
caaaagauguucaaaga

SEQ ID NO: 2197248 - RNA, 14 nt, Streptococcus pneumoniae R6
caaaagcacucaau

SEQ ID NO: 2197249 - RNA, 14 nt, Streptococcus pneumoniae R6
caaaagagaaagac

SEQ ID NO: 2197250 - RNA, 13 nt, Streptococcus pneumoniae R6
caaaagagcuacu

SEQ ID NO: 2197251 - RNA, 13 nt, Streptococcus pneumoniae R6
caaaagauaagau

SEQ ID NO: 2197252 - RNA, 17 nt, Streptococcus pneumoniae R6
caaaagauagaugauuu

SEQ ID NO: 2197253 - RNA, 18 nt, Streptococcus pneumoniae R6
caaaagaagauuggucaa

SEQ ID NO: 2197254 - RNA, 22 nt, Streptococcus pneumoniae R6
caaaaaauaugauggaagacug

SEQ ID NO: 2197255 - RNA, 16 nt, Streptococcus pneumoniae R6
caaaaaauauuuauag

SEQ ID NO: 2197256 - RNA, 14 nt, Streptococcus pneumoniae R6
caaaaacaaagaga

SEQ ID NO: 2197257 - RNA, 23 nt, Streptococcus pneumoniae R6
caaaaaauugcacuuuccucuug

SEQ ID NO: 2197258 - RNA, 19 nt, Streptococcus pneumoniae R6
caaaaacacaauuuuagga

SEQ ID NO: 2197259 - RNA, 23 nt, Streptococcus pneumoniae R6
caaaaagaaaaaacgcuacuccu

SEQ ID NO: 2197260 - RNA, 12 nt, Streptococcus pneumoniae R6
caaaaacucaau

SEQ ID NO: 2197261 - RNA, 17 nt, Streptococcus pneumoniae R6
caaaaagcauucuauuc

SEQ ID NO: 2197262 - RNA, 18 nt, Streptococcus pneumoniae R6
caaaaacgauaaaagcua

SEQ ID NO: 2197263 - RNA, 12 nt, Streptococcus pneumoniae R6
caaaaaugugaa

SEQ ID NO: 2197264 - RNA, 15 nt, Streptococcus pneumoniae R6
caaaaaucauuauau

SEQ ID NO: 2197265 - RNA, 20 nt, Streptococcus pneumoniae R6
caaaaauagaaauaaaaauc

SEQ ID NO: 2197266 - RNA, 19 nt, Streptococcus pneumoniae R6
caaaaagucguuaaaagca

SEQ ID NO: 2197267 - RNA, 19 nt, Streptococcus pneumoniae R6
caaaaagugaacaaagcug

SEQ ID NO: 2197268 - RNA, 15 nt, Streptococcus pneumoniae R6
caaaaagugcaugag

SEQ ID NO: 2197269 - RNA, 15 nt, Streptococcus pneumoniae R6
caaaaaguggaaaga

SEQ ID NO: 2197270 - RNA, 19 nt, Streptococcus pneumoniae R6
caaaaaguggaaagagcag

SEQ ID NO: 2197271 - RNA, 22 nt, Streptococcus pneumoniae R6
caaaaagggggcaaaacuuuca

SEQ ID NO: 2197272 - RNA, 14 nt, Streptococcus pneumoniae R6
caaaaaaacuccaa

SEQ ID NO: 2197273 - RNA, 21 nt, Streptococcus pneumoniae R6
caaaaaaagcuguuaaaaacu

SEQ ID NO: 2197274 - RNA, 16 nt, Streptococcus pneumoniae R6
caaaaaaauucuucac

SEQ ID NO: 2197275 - RNA, 20 nt, Streptococcus pneumoniae R6
caaaaaaggucaucagcaga

SEQ ID NO: 2197276 - RNA, 23 nt, Streptococcus pneumoniae R6
caaaaaaggucaucagcagagaa

SEQ ID NO: 2197277 - RNA, 23 nt, Streptococcus pneumoniae R6
caaaaaaggaguaacuaugaauc

SEQ ID NO: 2197278 - RNA, 16 nt, Streptococcus pneumoniae R6
caaaaaagaaaccaau

SEQ ID NO: 2197279 - RNA, 21 nt, Streptococcus pneumoniae R6
auuuuuuucuaauuaaaucau

SEQ ID NO: 2197280 - RNA, 20 nt, Streptococcus pneumoniae R6
caaaaaaaauacaguaucca

SEQ ID NO: 2197281 - RNA, 13 nt, Streptococcus pneumoniae R6
auuuuuuuuaaaa

SEQ ID NO: 2197282 - RNA, 14 nt, Streptococcus pneumoniae R6
auuuuuuuuaaaaa

SEQ ID NO: 2197283 - RNA, 11 nt, Streptococcus pneumoniae R6
auuuuuucuug

SEQ ID NO: 2197284 - RNA, 23 nt, Streptococcus pneumoniae R6
auuuuuucugaagacaaaucauu

SEQ ID NO: 2197285 - RNA, 16 nt, Streptococcus pneumoniae R6
auuuuuuaugguuuga

SEQ ID NO: 2197286 - RNA, 20 nt, Streptococcus pneumoniae R6
auuuuuucaaucgcagcauc

SEQ ID NO: 2197287 - RNA, 19 nt, Streptococcus pneumoniae R6
auuuuuucaccaaaaccaa

SEQ ID NO: 2197288 - RNA, 15 nt, Streptococcus pneumoniae R6
auuuuuuccaauucu

SEQ ID NO: 2197289 - RNA, 15 nt, Streptococcus pneumoniae R6
auuuuuugcaucaac

SEQ ID NO: 2197290 - RNA, 22 nt, Streptococcus pneumoniae R6
auuuuuugcaucaacuauucuu

SEQ ID NO: 2197291 - RNA, 12 nt, Streptococcus pneumoniae R6
auuuuuuuacuu

SEQ ID NO: 2197292 - RNA, 13 nt, Streptococcus pneumoniae R6
auuuuuuuacuua

SEQ ID NO: 2197293 - RNA, 22 nt, Streptococcus pneumoniae R6
auuuuuuuauccauuuuucaaa

SEQ ID NO: 2197294 - RNA, 21 nt, Streptococcus pneumoniae R6
auuuuuuucauagaaaucaau

SEQ ID NO: 2197295 - RNA, 16 nt, Streptococcus pneumoniae R6
auuuuuccuucaucaa

SEQ ID NO: 2197296 - RNA, 20 nt, Streptococcus pneumoniae R6
auuuuucgacugugauuuuu

SEQ ID NO: 2197297 - RNA, 14 nt, Streptococcus pneumoniae R6
auuuuucuaaauuu

SEQ ID NO: 2197298 - RNA, 22 nt, Streptococcus pneumoniae R6
auuuuucguauaccauaauaaa

SEQ ID NO: 2197299 - RNA, 15 nt, Streptococcus pneumoniae R6
auuuuucugagucug

SEQ ID NO: 2197300 - RNA, 15 nt, Streptococcus pneumoniae R6
auuuuuaaauuuuau

SEQ ID NO: 2197301 - RNA, 20 nt, Streptococcus pneumoniae R6
auuuuuaaauuuuaucaauc

SEQ ID NO: 2197302 - RNA, 11 nt, Streptococcus pneumoniae R6
auuuuugauuc

SEQ ID NO: 2197303 - RNA, 12 nt, Streptococcus pneumoniae R6
auuuuugcuucu

SEQ ID NO: 2197304 - RNA, 20 nt, Streptococcus pneumoniae R6
auuuuuggaaaaaauaaaaa

SEQ ID NO: 2197305 - RNA, 21 nt, Streptococcus pneumoniae R6
auuuuuggaaaaaauaaaaaa

SEQ ID NO: 2197306 - RNA, 20 nt, Streptococcus pneumoniae R6
auuuuuggagugauagaaaa

SEQ ID NO: 2197307 - RNA, 19 nt, Streptococcus pneumoniae R6
auuuuuggaguuugauuuc

SEQ ID NO: 2197308 - RNA, 17 nt, Streptococcus pneumoniae R6
auuuuucuguuuucuua

SEQ ID NO: 2197309 - RNA, 17 nt, Streptococcus pneumoniae R6
auuuuucuguuuucuuc

SEQ ID NO: 2197310 - RNA, 12 nt, Streptococcus pneumoniae R6
auuuuucuuugu

SEQ ID NO: 2197311 - RNA, 16 nt, Streptococcus pneumoniae R6
auuuuucuuuuuucgu

SEQ ID NO: 2197312 - RNA, 14 nt, Streptococcus pneumoniae R6
auuuuugaaaggau

SEQ ID NO: 2197313 - RNA, 16 nt, Streptococcus pneumoniae R6
auuuuugagcagaaca

SEQ ID NO: 2197314 - RNA, 14 nt, Streptococcus pneumoniae R6
auuuuuuagcuucu

SEQ ID NO: 2197315 - RNA, 18 nt, Streptococcus pneumoniae R6
auuuuuuaguucagaaug

SEQ ID NO: 2197316 - RNA, 14 nt, Streptococcus pneumoniae R6
auuuuuuaacagau

SEQ ID NO: 2197317 - RNA, 20 nt, Streptococcus pneumoniae R6
auuuuuuaacagauuuuucu

SEQ ID NO: 2197318 - RNA, 19 nt, Streptococcus pneumoniae R6
auuuuuguguuuuuucuug

SEQ ID NO: 2197319 - RNA, 17 nt, Streptococcus pneumoniae R6
caaucguugcaccugaa

SEQ ID NO: 2197320 - RNA, 13 nt, Streptococcus pneumoniae R6
caaucuaucuuuu

SEQ ID NO: 2197321 - RNA, 16 nt, Streptococcus pneumoniae R6
caaucuacuauagaaa

SEQ ID NO: 2197322 - RNA, 15 nt, Streptococcus pneumoniae R6
caaucuacuuguuca

SEQ ID NO: 2197323 - RNA, 18 nt, Streptococcus pneumoniae R6
caaucucaaggcacgauu

SEQ ID NO: 2197324 - RNA, 18 nt, Streptococcus pneumoniae R6
caaucucugcaauuucua

SEQ ID NO: 2197325 - RNA, 13 nt, Streptococcus pneumoniae R6
caaucgcuuuuuu

SEQ ID NO: 2197326 - RNA, 18 nt, Streptococcus pneumoniae R6
caaucgcuuaauuucuau

SEQ ID NO: 2197327 - RNA, 22 nt, Streptococcus pneumoniae R6
caaucgcuauuaucguuuuccu

SEQ ID NO: 2197328 - RNA, 14 nt, Streptococcus pneumoniae R6
caaucguaaacuga

SEQ ID NO: 2197329 - RNA, 16 nt, Streptococcus pneumoniae R6
caaucgccaauucuuu

SEQ ID NO: 2197330 - RNA, 15 nt, Streptococcus pneumoniae R6
caaucgauuuguucu

SEQ ID NO: 2197331 - RNA, 13 nt, Streptococcus pneumoniae R6
caauccuuuucug

SEQ ID NO: 2197332 - RNA, 16 nt, Streptococcus pneumoniae R6
caauccuuuucugagg

SEQ ID NO: 2197333 - RNA, 17 nt, Streptococcus pneumoniae R6
caauccugaagaauggg

SEQ ID NO: 2197334 - RNA, 19 nt, Streptococcus pneumoniae R6
caaucauaucaucaaucaa

SEQ ID NO: 2197335 - RNA, 15 nt, Streptococcus pneumoniae R6
caaucauaucaucaa

SEQ ID NO: 2197336 - RNA, 19 nt, Streptococcus pneumoniae R6
caaucaguuuuuucacaaa

SEQ ID NO: 2197337 - RNA, 16 nt, Streptococcus pneumoniae R6
caauauuuuugagccu

SEQ ID NO: 2197338 - RNA, 12 nt, Streptococcus pneumoniae R6
caaucaaaaaau

SEQ ID NO: 2197339 - RNA, 21 nt, Streptococcus pneumoniae R6
caaucaaaaaaucucacuauu

SEQ ID NO: 2197340 - RNA, 22 nt, Streptococcus pneumoniae R6
caaucaaacgagaaucuguauu

SEQ ID NO: 2197341 - RNA, 13 nt, Streptococcus pneumoniae R6
caaucaaacuacu

SEQ ID NO: 2197342 - RNA, 11 nt, Streptococcus pneumoniae R6
caaucaaauca

SEQ ID NO: 2197343 - RNA, 16 nt, Streptococcus pneumoniae R6
caaucaaaucaauaac

SEQ ID NO: 2197344 - RNA, 19 nt, Streptococcus pneumoniae R6
caauauuuuagaagcagag

SEQ ID NO: 2197345 - RNA, 20 nt, Streptococcus pneumoniae R6
caauauuacguccuguugcu

SEQ ID NO: 2197346 - RNA, 14 nt, Streptococcus pneumoniae R6
caaucauugcaaag

SEQ ID NO: 2197347 - RNA, 21 nt, Streptococcus pneumoniae R6
caaucauugcaaaggagagga

SEQ ID NO: 2197348 - RNA, 20 nt, Streptococcus pneumoniae R6
caaucauuucaaagccuucc

SEQ ID NO: 2197349 - RNA, 13 nt, Streptococcus pneumoniae R6
caauccaucucca

SEQ ID NO: 2197350 - RNA, 19 nt, Streptococcus pneumoniae R6
caaucccuagcuuuuuccu

SEQ ID NO: 2197351 - RNA, 15 nt, Streptococcus pneumoniae R6
caauccuaaauccuc

SEQ ID NO: 2197352 - RNA, 20 nt, Streptococcus pneumoniae R6
caauccuaugauacccaaaa

SEQ ID NO: 2197353 - RNA, 21 nt, Streptococcus pneumoniae R6
caaugaugagggcgauuuucc

SEQ ID NO: 2197354 - RNA, 17 nt, Streptococcus pneumoniae R6
caaugaucaagaugaga

SEQ ID NO: 2197355 - RNA, 13 nt, Streptococcus pneumoniae R6
caaugauaaaagu

SEQ ID NO: 2197356 - RNA, 15 nt, Streptococcus pneumoniae R6
caaugauaaaagucu

SEQ ID NO: 2197357 - RNA, 19 nt, Streptococcus pneumoniae R6
caaugacucccauaaaaau

SEQ ID NO: 2197358 - RNA, 20 nt, Streptococcus pneumoniae R6
caaugacucccauaaaaaua

SEQ ID NO: 2197359 - RNA, 22 nt, Streptococcus pneumoniae R6
caaugacucccauaaaaauaau

SEQ ID NO: 2197360 - RNA, 18 nt, Streptococcus pneumoniae R6
caaugaauccgaaaaauu

SEQ ID NO: 2197361 - RNA, 14 nt, Streptococcus pneumoniae R6
caaugaaaaucaaa

SEQ ID NO: 2197362 - RNA, 20 nt, Streptococcus pneumoniae R6
caaugaaaaucaaagagcaa

SEQ ID NO: 2197363 - RNA, 19 nt, Streptococcus pneumoniae R6
caaugaaaaucaaagugca

SEQ ID NO: 2197364 - RNA, 12 nt, Streptococcus pneumoniae R6
caaucuuuuuag

SEQ ID NO: 2197365 - RNA, 20 nt, Streptococcus pneumoniae R6
caaucuuaccaaccucagaa

SEQ ID NO: 2197366 - RNA, 13 nt, Streptococcus pneumoniae R6
caaucuucuccag

SEQ ID NO: 2197367 - RNA, 14 nt, Streptococcus pneumoniae R6
caauggaaaugaua

SEQ ID NO: 2197368 - RNA, 15 nt, Streptococcus pneumoniae R6
caauggaaaugauaa

SEQ ID NO: 2197369 - RNA, 16 nt, Streptococcus pneumoniae R6
caauggaguaaaaaaa

SEQ ID NO: 2197370 - RNA, 22 nt, Streptococcus pneumoniae R6
caauggaguaaaaaaagaguug

SEQ ID NO: 2197371 - RNA, 20 nt, Streptococcus pneumoniae R6
caaugcccuugauaauaaag

SEQ ID NO: 2197372 - RNA, 21 nt, Streptococcus pneumoniae R6
caaugcccuugauaauaaaga

SEQ ID NO: 2197373 - RNA, 14 nt, Streptococcus pneumoniae R6
caauggcaaaaaau

SEQ ID NO: 2197374 - RNA, 18 nt, Streptococcus pneumoniae R6
caaugguuccaauaguca

SEQ ID NO: 2197375 - RNA, 19 nt, Streptococcus pneumoniae R6
caauguaccugcaaauuua

SEQ ID NO: 2197376 - RNA, 20 nt, Streptococcus pneumoniae R6
caauguacuggauaaaguua

SEQ ID NO: 2197377 - RNA, 22 nt, Streptococcus pneumoniae R6
caauguagccaucauccaccuu

SEQ ID NO: 2197378 - RNA, 20 nt, Streptococcus pneumoniae R6
caauggggcuuuauuugaua

SEQ ID NO: 2197379 - RNA, 16 nt, Streptococcus pneumoniae R6
caaugguaacagucuu

SEQ ID NO: 2197380 - RNA, 16 nt, Streptococcus pneumoniae R6
caauggucaagaguug

SEQ ID NO: 2197381 - RNA, 14 nt, Streptococcus pneumoniae R6
caaugguuuuuagc

SEQ ID NO: 2197382 - RNA, 13 nt, Streptococcus pneumoniae R6
caauaaaaucaaa

SEQ ID NO: 2197383 - RNA, 16 nt, Streptococcus pneumoniae R6
caauaaaaucaaacaa

SEQ ID NO: 2197384 - RNA, 18 nt, Streptococcus pneumoniae R6
caauaaaaucaaacaaaa

SEQ ID NO: 2197385 - RNA, 21 nt, Streptococcus pneumoniae R6
caauaaaaucaaacaaaagcg

SEQ ID NO: 2197386 - RNA, 18 nt, Streptococcus pneumoniae R6
caauaaaacgcaucauau

SEQ ID NO: 2197387 - RNA, 13 nt, Streptococcus pneumoniae R6
caauaaaaagcau

SEQ ID NO: 2197388 - RNA, 17 nt, Streptococcus pneumoniae R6
caaguuuguaucuuccu

SEQ ID NO: 2197389 - RNA, 16 nt, Streptococcus pneumoniae R6
caaguuuuagaugaga

SEQ ID NO: 2197390 - RNA, 21 nt, Streptococcus pneumoniae R6
caaguuuuugaauaaugaaaa

SEQ ID NO: 2197391 - RNA, 18 nt, Streptococcus pneumoniae R6
caaguccaagaaccaaca

SEQ ID NO: 2197392 - RNA, 18 nt, Streptococcus pneumoniae R6
caagucauccaugauaau

SEQ ID NO: 2197393 - RNA, 22 nt, Streptococcus pneumoniae R6
caagucaucaaaaauagaaaua

SEQ ID NO: 2197394 - RNA, 14 nt, Streptococcus pneumoniae R6
caaguauuguaaga

SEQ ID NO: 2197395 - RNA, 14 nt, Streptococcus pneumoniae R6
caaguauuggcaaa

SEQ ID NO: 2197396 - RNA, 20 nt, Streptococcus pneumoniae R6
caaguagaacgcugaaggag

SEQ ID NO: 2197397 - RNA, 15 nt, Streptococcus pneumoniae R6
caagguucauggcau

SEQ ID NO: 2197398 - RNA, 16 nt, Streptococcus pneumoniae R6
caagguucauuucuuc

SEQ ID NO: 2197399 - RNA, 20 nt, Streptococcus pneumoniae R6
caauaacacgagaaacaaua

SEQ ID NO: 2197400 - RNA, 22 nt, Streptococcus pneumoniae R6
caauaacacgagaaacaauaaa

SEQ ID NO: 2197401 - RNA, 16 nt, Streptococcus pneumoniae R6
caauaauagcuugcaa

SEQ ID NO: 2197402 - RNA, 22 nt, Streptococcus pneumoniae R6
caauaauagcuugcaauucuuu

SEQ ID NO: 2197403 - RNA, 20 nt, Streptococcus pneumoniae R6
caauaaguccgaaaaauuuc

SEQ ID NO: 2197404 - RNA, 21 nt, Streptococcus pneumoniae R6
caauaaguccgaaaaauuucu

SEQ ID NO: 2197405 - RNA, 16 nt, Streptococcus pneumoniae R6
caauaaagguguucaa

SEQ ID NO: 2197406 - RNA, 19 nt, Streptococcus pneumoniae R6
caauaaagguguucaaucc

SEQ ID NO: 2197407 - RNA, 22 nt, Streptococcus pneumoniae R6
caauaucuuuaaagcuuuuugu

SEQ ID NO: 2197408 - RNA, 14 nt, Streptococcus pneumoniae R6
caauagucauucca

SEQ ID NO: 2197409 - RNA, 17 nt, Streptococcus pneumoniae R6
caauaggauuguacuca

SEQ ID NO: 2197410 - RNA, 18 nt, Streptococcus pneumoniae R6
caauaggcggacaccucu

SEQ ID NO: 2197411 - RNA, 20 nt, Streptococcus pneumoniae R6
caauaggcggacaccucuuu

SEQ ID NO: 2197412 - RNA, 18 nt, Streptococcus pneumoniae R6
caauagcuucauccuauc

SEQ ID NO: 2197413 - RNA, 20 nt, Streptococcus pneumoniae R6
caauaauugguacauuuuga

SEQ ID NO: 2197414 - RNA, 21 nt, Streptococcus pneumoniae R6
caauaauugguacauuuugau

SEQ ID NO: 2197415 - RNA, 16 nt, Streptococcus pneumoniae R6
caauacagauaaaaau

SEQ ID NO: 2197416 - RNA, 17 nt, Streptococcus pneumoniae R6
caauacagauaaaaauc

SEQ ID NO: 2197417 - RNA, 22 nt, Streptococcus pneumoniae R6
caauaauuucuuuuuguguuaa

SEQ ID NO: 2197418 - RNA, 12 nt, Streptococcus pneumoniae R6
caauacuuuuuc

SEQ ID NO: 2197419 - RNA, 12 nt, Streptococcus pneumoniae R6
caauagccgcaa

SEQ ID NO: 2197420 - RNA, 21 nt, Streptococcus pneumoniae R6
caauacuuggugcuauuuguu

SEQ ID NO: 2197421 - RNA, 23 nt, Streptococcus pneumoniae R6
caauagcgauucccaagucugac

SEQ ID NO: 2197422 - RNA, 18 nt, Streptococcus pneumoniae R6
caagcauaacagcauuuc

SEQ ID NO: 2197423 - RNA, 20 nt, Streptococcus pneumoniae R6
caagcauuuuuuugauaaga

SEQ ID NO: 2197424 - RNA, 12 nt, Streptococcus pneumoniae R6
caagcauuuuca

SEQ ID NO: 2197425 - RNA, 13 nt, Streptococcus pneumoniae R6
caagcauuuucau

SEQ ID NO: 2197426 - RNA, 19 nt, Streptococcus pneumoniae R6
caagguaguagucagugau

SEQ ID NO: 2197427 - RNA, 14 nt, Streptococcus pneumoniae R6
caagguagagacag

SEQ ID NO: 2197428 - RNA, 21 nt, Streptococcus pneumoniae R6
caaggucgcauaggcaauuuc

SEQ ID NO: 2197429 - RNA, 17 nt, Streptococcus pneumoniae R6
caaggucugacaggcua

SEQ ID NO: 2197430 - RNA, 18 nt, Streptococcus pneumoniae R6
caaggucugacaggcuau

SEQ ID NO: 2197431 - RNA, 18 nt, Streptococcus pneumoniae R6
caaggugaacuugaccua

SEQ ID NO: 2197432 - RNA, 18 nt, Streptococcus pneumoniae R6
caaggugacgagacagau

SEQ ID NO: 2197433 - RNA, 14 nt, Streptococcus pneumoniae R6
caaggaagaagcug

SEQ ID NO: 2197434 - RNA, 21 nt, Streptococcus pneumoniae R6
caaggaagccuucuuuuccac

SEQ ID NO: 2197435 - RNA, 21 nt, Streptococcus pneumoniae R6
caaggacggcuuuuaguaaaa

SEQ ID NO: 2197436 - RNA, 14 nt, Streptococcus pneumoniae R6
caaaguuccgaaau

SEQ ID NO: 2197437 - RNA, 16 nt, Streptococcus pneumoniae R6
caaaguccuuacucaa

SEQ ID NO: 2197438 - RNA, 18 nt, Streptococcus pneumoniae R6
caaagucaucaaaauccg

SEQ ID NO: 2197439 - RNA, 18 nt, Streptococcus pneumoniae R6
caaaguaauuugaguaaa

SEQ ID NO: 2197440 - RNA, 21 nt, Streptococcus pneumoniae R6
caaaguacagauuugaaaacu

SEQ ID NO: 2197441 - RNA, 15 nt, Streptococcus pneumoniae R6
caaaguacuugagaa

SEQ ID NO: 2197442 - RNA, 23 nt, Streptococcus pneumoniae R6
caaaguagugaaugauucugaaa

SEQ ID NO: 2197443 - RNA, 17 nt, Streptococcus pneumoniae R6
caaaguauuaaaauaag

SEQ ID NO: 2197444 - RNA, 13 nt, Streptococcus pneumoniae R6
caaaguaaaauac

SEQ ID NO: 2197445 - RNA, 20 nt, Streptococcus pneumoniae R6
caaagccuucuugguuuuug

SEQ ID NO: 2197446 - RNA, 11 nt, Streptococcus pneumoniae R6
caaaguuugaa

SEQ ID NO: 2197447 - RNA, 18 nt, Streptococcus pneumoniae R6
caaauaaaaagcuuuaag

SEQ ID NO: 2197448 - RNA, 23 nt, Streptococcus pneumoniae R6
caaauaaaaagcuuuaagacaga

SEQ ID NO: 2197449 - RNA, 15 nt, Streptococcus pneumoniae R6
caaaguuuuugguaa

SEQ ID NO: 2197450 - RNA, 17 nt, Streptococcus pneumoniae R6
caaauaaacggacaaaa

SEQ ID NO: 2197451 - RNA, 19 nt, Streptococcus pneumoniae R6
caaauaaacggacaaaacu

SEQ ID NO: 2197452 - RNA, 18 nt, Streptococcus pneumoniae R6
caaauagcaguaacuucu

SEQ ID NO: 2197453 - RNA, 23 nt, Streptococcus pneumoniae R6
caaacuuuuuaaguuuuuugauu

SEQ ID NO: 2197454 - RNA, 12 nt, Streptococcus pneumoniae R6
caaacuuuuuag

SEQ ID NO: 2197455 - RNA, 21 nt, Streptococcus pneumoniae R6
caaacuuuuucucucugaaua

SEQ ID NO: 2197456 - RNA, 17 nt, Streptococcus pneumoniae R6
caaagaaaaaagcugua

SEQ ID NO: 2197457 - RNA, 21 nt, Streptococcus pneumoniae R6
caaagaaggcuuuaccaaaaa

SEQ ID NO: 2197458 - RNA, 23 nt, Streptococcus pneumoniae R6
caaagaacaucuacaauugaaac

SEQ ID NO: 2197459 - RNA, 14 nt, Streptococcus pneumoniae R6
caaagaacaugaaa

SEQ ID NO: 2197460 - RNA, 15 nt, Streptococcus pneumoniae R6
caaagaacaugaaag

SEQ ID NO: 2197461 - RNA, 17 nt, Streptococcus pneumoniae R6
caaagaacaugaaagau

SEQ ID NO: 2197462 - RNA, 16 nt, Streptococcus pneumoniae R6
caaagaaccugcaguu

SEQ ID NO: 2197463 - RNA, 13 nt, Streptococcus pneumoniae R6
caaagaauaaaau

SEQ ID NO: 2197464 - RNA, 17 nt, Streptococcus pneumoniae R6
caaaagccgauaccuau

SEQ ID NO: 2197465 - RNA, 14 nt, Streptococcus pneumoniae R6
caaaagcuuguuua

SEQ ID NO: 2197466 - RNA, 15 nt, Streptococcus pneumoniae R6
caaaagcuaauagag

SEQ ID NO: 2197467 - RNA, 22 nt, Streptococcus pneumoniae R6
caaaagcguguaggaaaccaau

SEQ ID NO: 2197468 - RNA, 19 nt, Streptococcus pneumoniae R6
caaaaggcaucuugucaaa

SEQ ID NO: 2197469 - RNA, 22 nt, Streptococcus pneumoniae R6
caaaaggcaucuugucaaagag

SEQ ID NO: 2197470 - RNA, 23 nt, Streptococcus pneumoniae R6
caaagauuuuauccaaucuauuu

SEQ ID NO: 2197471 - RNA, 19 nt, Streptococcus pneumoniae R6
caaagcacggagaacaaua

SEQ ID NO: 2197472 - RNA, 19 nt, Streptococcus pneumoniae R6
caaagacaagggaugaaac

SEQ ID NO: 2197473 - RNA, 18 nt, Streptococcus pneumoniae R6
caaagacagguuucacau

SEQ ID NO: 2197474 - RNA, 17 nt, Streptococcus pneumoniae R6
caaagcaucaaucaaac

SEQ ID NO: 2197475 - RNA, 18 nt, Streptococcus pneumoniae R6
caaagccaaucaaaaaau

SEQ ID NO: 2197476 - RNA, 19 nt, Streptococcus pneumoniae R6
caaaucgauuaggaaagga

SEQ ID NO: 2197477 - RNA, 23 nt, Streptococcus pneumoniae R6
caaaucgauuaggaaaggaaaau

SEQ ID NO: 2197478 - RNA, 17 nt, Streptococcus pneumoniae R6
caaaucgauuucuaaca

SEQ ID NO: 2197479 - RNA, 14 nt, Streptococcus pneumoniae R6
caaaucgaucagga

SEQ ID NO: 2197480 - RNA, 18 nt, Streptococcus pneumoniae R6
caaaucaucauaaaaaua

SEQ ID NO: 2197481 - RNA, 14 nt, Streptococcus pneumoniae R6
caaaucaucagcca

SEQ ID NO: 2197482 - RNA, 18 nt, Streptococcus pneumoniae R6
caaaugaauuucuacaaa

SEQ ID NO: 2197483 - RNA, 15 nt, Streptococcus pneumoniae R6
caaauauaccaacua

SEQ ID NO: 2197484 - RNA, 20 nt, Streptococcus pneumoniae R6
caaauauaccaacuacuaaa

SEQ ID NO: 2197485 - RNA, 22 nt, Streptococcus pneumoniae R6
caaaucaacuggcauccccagc

SEQ ID NO: 2197486 - RNA, 14 nt, Streptococcus pneumoniae R6
caaaucaauuuuua

SEQ ID NO: 2197487 - RNA, 22 nt, Streptococcus pneumoniae R6
caaaucagguaggauuucuccu

SEQ ID NO: 2197488 - RNA, 16 nt, Streptococcus pneumoniae R6
caaauuagaaaaagac

SEQ ID NO: 2197489 - RNA, 21 nt, Streptococcus pneumoniae R6
caaauuagaaaaagacuugaa

SEQ ID NO: 2197490 - RNA, 22 nt, Streptococcus pneumoniae R6
caaauuauuggucgcuucaagu

SEQ ID NO: 2197491 - RNA, 18 nt, Streptococcus pneumoniae R6
caaauuaauuauacuaua

SEQ ID NO: 2197492 - RNA, 19 nt, Streptococcus pneumoniae R6
caaauuaauucggaaagcc

SEQ ID NO: 2197493 - RNA, 13 nt, Streptococcus pneumoniae R6
caaauuaauuuau

SEQ ID NO: 2197494 - RNA, 15 nt, Streptococcus pneumoniae R6
caaauuaauuuauag

SEQ ID NO: 2197495 - RNA, 19 nt, Streptococcus pneumoniae R6
caaauuaauuucuagaaau

SEQ ID NO: 2197496 - RNA, 18 nt, Streptococcus pneumoniae R6
caaaugacuaaccuuguc

SEQ ID NO: 2197497 - RNA, 22 nt, Streptococcus pneumoniae R6
caaaugacuaagcccaaagaua

SEQ ID NO: 2197498 - RNA, 16 nt, Streptococcus pneumoniae R6
caaaugacuuucuaau

SEQ ID NO: 2197499 - RNA, 18 nt, Streptococcus pneumoniae R6
caaaugagauuugcauca

SEQ ID NO: 2197500 - RNA, 21 nt, Streptococcus pneumoniae R6
caaaucucauuugaugagaaa

SEQ ID NO: 2197501 - RNA, 12 nt, Streptococcus pneumoniae R6
caacacuuaagu

SEQ ID NO: 2197502 - RNA, 12 nt, Streptococcus pneumoniae R6
caacagaagaau

SEQ ID NO: 2197503 - RNA, 15 nt, Streptococcus pneumoniae R6
caacagagaaaauuc

SEQ ID NO: 2197504 - RNA, 13 nt, Streptococcus pneumoniae R6
caacagcuuuuuu

SEQ ID NO: 2197505 - RNA, 18 nt, Streptococcus pneumoniae R6
caacaggauuuuguucuu

SEQ ID NO: 2197506 - RNA, 21 nt, Streptococcus pneumoniae R6
caaauugugcaguuuucauuc

SEQ ID NO: 2197507 - RNA, 14 nt, Streptococcus pneumoniae R6
caaauuuauaaauc

SEQ ID NO: 2197508 - RNA, 15 nt, Streptococcus pneumoniae R6
caaauuucauauuuu

SEQ ID NO: 2197509 - RNA, 13 nt, Streptococcus pneumoniae R6
caaauuucaugac

SEQ ID NO: 2197510 - RNA, 18 nt, Streptococcus pneumoniae R6
caaauuucaugacagauu

SEQ ID NO: 2197511 - RNA, 16 nt, Streptococcus pneumoniae R6
caaauuuauucagacu

SEQ ID NO: 2197512 - RNA, 18 nt, Streptococcus pneumoniae R6
caaauuugacuaaaaacu

SEQ ID NO: 2197513 - RNA, 15 nt, Streptococcus pneumoniae R6
caacaauacuuucca

SEQ ID NO: 2197514 - RNA, 20 nt, Streptococcus pneumoniae R6
caacaaugagaaauuuuugg

SEQ ID NO: 2197515 - RNA, 23 nt, Streptococcus pneumoniae R6
caacugaucccuccauuucauag

SEQ ID NO: 2197516 - RNA, 15 nt, Streptococcus pneumoniae R6
caacugaugagagau

SEQ ID NO: 2197517 - RNA, 15 nt, Streptococcus pneumoniae R6
caacugauucuacuu

SEQ ID NO: 2197518 - RNA, 20 nt, Streptococcus pneumoniae R6
caacugcaaguccagaaccg

SEQ ID NO: 2197519 - RNA, 16 nt, Streptococcus pneumoniae R6
caacuacuaaaccaau

SEQ ID NO: 2197520 - RNA, 16 nt, Streptococcus pneumoniae R6
caacucuuauacuuuu

SEQ ID NO: 2197521 - RNA, 11 nt, Streptococcus pneumoniae R6
caacuaaccaa

SEQ ID NO: 2197522 - RNA, 22 nt, Streptococcus pneumoniae R6
caacuaaccaacuucuuuuuuu

SEQ ID NO: 2197523 - RNA, 15 nt, Streptococcus pneumoniae R6
caacuggcaucccca

SEQ ID NO: 2197524 - RNA, 16 nt, Streptococcus pneumoniae R6
caacuggcauccccag

SEQ ID NO: 2197525 - RNA, 19 nt, Streptococcus pneumoniae R6
caacugccugguaaagacu

SEQ ID NO: 2197526 - RNA, 13 nt, Streptococcus pneumoniae R6
caacuguuuuuuc

SEQ ID NO: 2197527 - RNA, 19 nt, Streptococcus pneumoniae R6
caacuguuuuuucaacagc

SEQ ID NO: 2197528 - RNA, 13 nt, Streptococcus pneumoniae R6
caacuuaaaaaga

SEQ ID NO: 2197529 - RNA, 19 nt, Streptococcus pneumoniae R6
caacuguaguggguugaaa

SEQ ID NO: 2197530 - RNA, 23 nt, Streptococcus pneumoniae R6
caacuguaguggguugaaaaaaa

SEQ ID NO: 2197531 - RNA, 21 nt, Streptococcus pneumoniae R6
caacuguaguggguugaaguc

SEQ ID NO: 2197532 - RNA, 18 nt, Streptococcus pneumoniae R6
caacugucuuauccaaac

SEQ ID NO: 2197533 - RNA, 17 nt, Streptococcus pneumoniae R6
caaccuacggcuagcuu

SEQ ID NO: 2197534 - RNA, 13 nt, Streptococcus pneumoniae R6
caaccguuuggca

SEQ ID NO: 2197535 - RNA, 19 nt, Streptococcus pneumoniae R6
caaccgugcagucuuuuug

SEQ ID NO: 2197536 - RNA, 14 nt, Streptococcus pneumoniae R6
caaccucaaaaaca

SEQ ID NO: 2197537 - RNA, 19 nt, Streptococcus pneumoniae R6
caaccucaaaaacauguuu

SEQ ID NO: 2197538 - RNA, 18 nt, Streptococcus pneumoniae R6
caaccucaaaacaauguu

SEQ ID NO: 2197539 - RNA, 14 nt, Streptococcus pneumoniae R6
caaccucaaagcag

SEQ ID NO: 2197540 - RNA, 12 nt, Streptococcus pneumoniae R6
caaccucaaggc

SEQ ID NO: 2197541 - RNA, 15 nt, Streptococcus pneumoniae R6
caaccgcaaaagcuu

SEQ ID NO: 2197542 - RNA, 16 nt, Streptococcus pneumoniae R6
caacccaguaaagugu

SEQ ID NO: 2197543 - RNA, 17 nt, Streptococcus pneumoniae R6
caacccucucuucaaau

SEQ ID NO: 2197544 - RNA, 15 nt, Streptococcus pneumoniae R6
caacauucuccagua

SEQ ID NO: 2197545 - RNA, 23 nt, Streptococcus pneumoniae R6
caacauuguuuguacuuguucua

SEQ ID NO: 2197546 - RNA, 20 nt, Streptococcus pneumoniae R6
caacaugagaauacaaaaau

SEQ ID NO: 2197547 - RNA, 13 nt, Streptococcus pneumoniae R6
caacaugguauug

SEQ ID NO: 2197548 - RNA, 21 nt, Streptococcus pneumoniae R6
caacaucuucuguaccaauac

SEQ ID NO: 2197549 - RNA, 14 nt, Streptococcus pneumoniae R6
caacaucuuuccag

SEQ ID NO: 2197550 - RNA, 22 nt, Streptococcus pneumoniae R6
caacaucuuuccagaacuucaa

SEQ ID NO: 2197551 - RNA, 23 nt, Streptococcus pneumoniae R6
caacaucucuuguuuaagagcac

SEQ ID NO: 2197552 - RNA, 14 nt, Streptococcus pneumoniae R6
caaccaagucugca

SEQ ID NO: 2197553 - RNA, 21 nt, Streptococcus pneumoniae R6
cagcgauagcuccaucuccaa

SEQ ID NO: 2197554 - RNA, 20 nt, Streptococcus pneumoniae R6
cagcgauugaaacagcugcg

SEQ ID NO: 2197555 - RNA, 15 nt, Streptococcus pneumoniae R6
cagccuuggucacua

SEQ ID NO: 2197556 - RNA, 16 nt, Streptococcus pneumoniae R6
cagccuucauaaaagu

SEQ ID NO: 2197557 - RNA, 16 nt, Streptococcus pneumoniae R6
cagccgacuauacucc

SEQ ID NO: 2197558 - RNA, 19 nt, Streptococcus pneumoniae R6
cagcacguuuuucuucuuu

SEQ ID NO: 2197559 - RNA, 14 nt, Streptococcus pneumoniae R6
cagcacuaaaacgu

SEQ ID NO: 2197560 - RNA, 12 nt, Streptococcus pneumoniae R6
cagcagagaaag

SEQ ID NO: 2197561 - RNA, 16 nt, Streptococcus pneumoniae R6
cagcagagaaagaaaa

SEQ ID NO: 2197562 - RNA, 20 nt, Streptococcus pneumoniae R6
cagcacuuggcauucaaaac

SEQ ID NO: 2197563 - RNA, 19 nt, Streptococcus pneumoniae R6
cagcaguuaugauauauuu

SEQ ID NO: 2197564 - RNA, 21 nt, Streptococcus pneumoniae R6
cagcaggagaaaguuugguuu

SEQ ID NO: 2197565 - RNA, 17 nt, Streptococcus pneumoniae R6
cagcauuuccuagccaa

SEQ ID NO: 2197566 - RNA, 22 nt, Streptococcus pneumoniae R6
cagcauggcacggucauuuucu

SEQ ID NO: 2197567 - RNA, 16 nt, Streptococcus pneumoniae R6
cagcauggcccgcuuc

SEQ ID NO: 2197568 - RNA, 22 nt, Streptococcus pneumoniae R6
cagcauggcccgcuucgcuucc

SEQ ID NO: 2197569 - RNA, 16 nt, Streptococcus pneumoniae R6
cagccaaggcucccau

SEQ ID NO: 2197570 - RNA, 21 nt, Streptococcus pneumoniae R6
cagcauuuucuuuuugaaguu

SEQ ID NO: 2197571 - RNA, 15 nt, Streptococcus pneumoniae R6
cagccaaaaguccaa

SEQ ID NO: 2197572 - RNA, 20 nt, Streptococcus pneumoniae R6
cagcauauuucccauuuuuu

SEQ ID NO: 2197573 - RNA, 19 nt, Streptococcus pneumoniae R6
cagccauaagcuacauaga

SEQ ID NO: 2197574 - RNA, 18 nt, Streptococcus pneumoniae R6
cagccacggcacguucca

SEQ ID NO: 2197575 - RNA, 18 nt, Streptococcus pneumoniae R6
cagccacuguacguccaa

SEQ ID NO: 2197576 - RNA, 15 nt, Streptococcus pneumoniae R6
cagccaucagagagg

SEQ ID NO: 2197577 - RNA, 18 nt, Streptococcus pneumoniae R6
cagccaucagagaggucc

SEQ ID NO: 2197578 - RNA, 18 nt, Streptococcus pneumoniae R6
cagaugaaagcugaugcg

SEQ ID NO: 2197579 - RNA, 19 nt, Streptococcus pneumoniae R6
cagaugaugagcuggaaga

SEQ ID NO: 2197580 - RNA, 13 nt, Streptococcus pneumoniae R6
cagaugcuugcau

SEQ ID NO: 2197581 - RNA, 20 nt, Streptococcus pneumoniae R6
cagaugcuugcauuuuuuga

SEQ ID NO: 2197582 - RNA, 22 nt, Streptococcus pneumoniae R6
cagauggacugaccaccuguac

SEQ ID NO: 2197583 - RNA, 15 nt, Streptococcus pneumoniae R6
cagaucuuagaagca

SEQ ID NO: 2197584 - RNA, 12 nt, Streptococcus pneumoniae R6
cagauucagucu

SEQ ID NO: 2197585 - RNA, 14 nt, Streptococcus pneumoniae R6
cagauuaguaauuc

SEQ ID NO: 2197586 - RNA, 13 nt, Streptococcus pneumoniae R6
cagauucaucacg

SEQ ID NO: 2197587 - RNA, 15 nt, Streptococcus pneumoniae R6
cagauucacuagccc

SEQ ID NO: 2197588 - RNA, 13 nt, Streptococcus pneumoniae R6
cagauucugacaa

SEQ ID NO: 2197589 - RNA, 12 nt, Streptococcus pneumoniae R6
cagauuuuucug

SEQ ID NO: 2197590 - RNA, 12 nt, Streptococcus pneumoniae R6
cagauuuuaaag

SEQ ID NO: 2197591 - RNA, 20 nt, Streptococcus pneumoniae R6
cagauuugaaaacugaugaa

SEQ ID NO: 2197592 - RNA, 15 nt, Streptococcus pneumoniae R6
cagauuuccauuaaa

SEQ ID NO: 2197593 - RNA, 22 nt, Streptococcus pneumoniae R6
cagauuucaaaccugagaagga

SEQ ID NO: 2197594 - RNA, 23 nt, Streptococcus pneumoniae R6
cagauugucgguagaacgauaaa

SEQ ID NO: 2197595 - RNA, 11 nt, Streptococcus pneumoniae R6
cagcaaucaaa

SEQ ID NO: 2197596 - RNA, 15 nt, Streptococcus pneumoniae R6
cagagcgauaaaaau

SEQ ID NO: 2197597 - RNA, 19 nt, Streptococcus pneumoniae R6
cagagcgauaaaaauccuu

SEQ ID NO: 2197598 - RNA, 18 nt, Streptococcus pneumoniae R6
cagaggcuggacaaaaac

SEQ ID NO: 2197599 - RNA, 13 nt, Streptococcus pneumoniae R6
cagaguaagaaag

SEQ ID NO: 2197600 - RNA, 16 nt, Streptococcus pneumoniae R6
cagaguagucuuuuug

SEQ ID NO: 2197601 - RNA, 20 nt, Streptococcus pneumoniae R6
cagauaagagcaacaaauau

SEQ ID NO: 2197602 - RNA, 24 nt, Streptococcus pneumoniae R6
cagauaagcaccuaguacaaagaa

SEQ ID NO: 2197603 - RNA, 15 nt, Streptococcus pneumoniae R6
cagauaauucucuaa

SEQ ID NO: 2197604 - RNA, 23 nt, Streptococcus pneumoniae R6
cagauagggcuaggcuaacacuu

SEQ ID NO: 2197605 - RNA, 18 nt, Streptococcus pneumoniae R6
cagacgaguuaaaacaaa

SEQ ID NO: 2197606 - RNA, 14 nt, Streptococcus pneumoniae R6
cagagcaaugauag

SEQ ID NO: 2197607 - RNA, 17 nt, Streptococcus pneumoniae R6
cagagagauaaauauug

SEQ ID NO: 2197608 - RNA, 19 nt, Streptococcus pneumoniae R6
cagacuuuuuuauacuuuu

SEQ ID NO: 2197609 - RNA, 16 nt, Streptococcus pneumoniae R6
cagagaaaauucuaaa

SEQ ID NO: 2197610 - RNA, 14 nt, Streptococcus pneumoniae R6
cagagaagaaauuc

SEQ ID NO: 2197611 - RNA, 14 nt, Streptococcus pneumoniae R6
cagagaagaggcug

SEQ ID NO: 2197612 - RNA, 13 nt, Streptococcus pneumoniae R6
cagagacaaagga

SEQ ID NO: 2197613 - RNA, 14 nt, Streptococcus pneumoniae R6
cagacuucuuuuuu

SEQ ID NO: 2197614 - RNA, 19 nt, Streptococcus pneumoniae R6
cagacuuggaacaguccuu

SEQ ID NO: 2197615 - RNA, 19 nt, Streptococcus pneumoniae R6
cagacuggugucguugaau

SEQ ID NO: 2197616 - RNA, 21 nt, Streptococcus pneumoniae R6
cagacuggugucguugaauga

SEQ ID NO: 2197617 - RNA, 15 nt, Streptococcus pneumoniae R6
cagacuguuuuucuu

SEQ ID NO: 2197618 - RNA, 22 nt, Streptococcus pneumoniae R6
cagacugcaaggcaagacugac

SEQ ID NO: 2197619 - RNA, 17 nt, Streptococcus pneumoniae R6
cagaacuuccacuucca

SEQ ID NO: 2197620 - RNA, 20 nt, Streptococcus pneumoniae R6
cagaacuuccacuuccagaa

SEQ ID NO: 2197621 - RNA, 23 nt, Streptococcus pneumoniae R6
cagaacuggcguuuuauuuuuua

SEQ ID NO: 2197622 - RNA, 21 nt, Streptococcus pneumoniae R6
cagaacgucgcuguaaaaucu

SEQ ID NO: 2197623 - RNA, 23 nt, Streptococcus pneumoniae R6
cagaacucccuguuccaaagaag

SEQ ID NO: 2197624 - RNA, 20 nt, Streptococcus pneumoniae R6
cagaacuaagggaaccugaa

SEQ ID NO: 2197625 - RNA, 23 nt, Streptococcus pneumoniae R6
cagaaccaaaccaaacagucuca

SEQ ID NO: 2197626 - RNA, 21 nt, Streptococcus pneumoniae R6
cagaacauuacccauagauuu

SEQ ID NO: 2197627 - RNA, 17 nt, Streptococcus pneumoniae R6
cagaaccuuaaaaugaa

SEQ ID NO: 2197628 - RNA, 19 nt, Streptococcus pneumoniae R6
cagaaccuuaaaaugaaau

SEQ ID NO: 2197629 - RNA, 21 nt, Streptococcus pneumoniae R6
cagaaccuuaaaaugaaauuc

SEQ ID NO: 2197630 - RNA, 14 nt, Streptococcus pneumoniae R6
cagaaccuuggaaa

SEQ ID NO: 2197631 - RNA, 14 nt, Streptococcus pneumoniae R6
cagaagccuucauc

SEQ ID NO: 2197632 - RNA, 14 nt, Streptococcus pneumoniae R6
cagaagcuuuacca

SEQ ID NO: 2197633 - RNA, 14 nt, Streptococcus pneumoniae R6
cagaaggcuuucua

SEQ ID NO: 2197634 - RNA, 14 nt, Streptococcus pneumoniae R6
cagaaaauaaaauu

SEQ ID NO: 2197635 - RNA, 16 nt, Streptococcus pneumoniae R6
cagaaaauaaaauucc

SEQ ID NO: 2197636 - RNA, 19 nt, Streptococcus pneumoniae R6
cagaaaauaaaauuccuuu

SEQ ID NO: 2197637 - RNA, 17 nt, Streptococcus pneumoniae R6
cagaaaaucauugcuau

SEQ ID NO: 2197638 - RNA, 22 nt, Streptococcus pneumoniae R6
cagaaacgaaccuuggcuugcu

SEQ ID NO: 2197639 - RNA, 16 nt, Streptococcus pneumoniae R6
cagaaaugaguaagaa

SEQ ID NO: 2197640 - RNA, 16 nt, Streptococcus pneumoniae R6
cagaaaucuaguuggu

SEQ ID NO: 2197641 - RNA, 16 nt, Streptococcus pneumoniae R6
cagaaauggaaguuuc

SEQ ID NO: 2197642 - RNA, 17 nt, Streptococcus pneumoniae R6
cagaaauaucgaugccc

SEQ ID NO: 2197643 - RNA, 13 nt, Streptococcus pneumoniae R6
cagaacacuucca

SEQ ID NO: 2197644 - RNA, 23 nt, Streptococcus pneumoniae R6
cagaaauugaucuagcucucucu

SEQ ID NO: 2197645 - RNA, 18 nt, Streptococcus pneumoniae R6
cagaacaaugacucccau

SEQ ID NO: 2197646 - RNA, 19 nt, Streptococcus pneumoniae R6
cagaacaaugacucccaua

SEQ ID NO: 2197647 - RNA, 12 nt, Streptococcus pneumoniae R6
cagacaaaacua

SEQ ID NO: 2197648 - RNA, 16 nt, Streptococcus pneumoniae R6
cagacaaaacuaaccc

SEQ ID NO: 2197649 - RNA, 17 nt, Streptococcus pneumoniae R6
cagacaaaacuaacccu

SEQ ID NO: 2197650 - RNA, 17 nt, Streptococcus pneumoniae R6
cagaauggguuaaaauu

SEQ ID NO: 2197651 - RNA, 16 nt, Streptococcus pneumoniae R6
cagaauuggcuaaaga

SEQ ID NO: 2197652 - RNA, 20 nt, Streptococcus pneumoniae R6
cagaauaauuaaaucauaaa

SEQ ID NO: 2197653 - RNA, 21 nt, Streptococcus pneumoniae R6
cagaaucauucacuacuuuga

SEQ ID NO: 2197654 - RNA, 20 nt, Streptococcus pneumoniae R6
cagaaucccagauaaagcug

SEQ ID NO: 2197655 - RNA, 18 nt, Streptococcus pneumoniae R6
cagaauccuuauuuucua

SEQ ID NO: 2197656 - RNA, 18 nt, Streptococcus pneumoniae R6
cagaaucuuuuaauuggu

SEQ ID NO: 2197657 - RNA, 18 nt, Streptococcus pneumoniae R6
cagaccaguuucuucuuu

SEQ ID NO: 2197658 - RNA, 19 nt, Streptococcus pneumoniae R6
cagaccaguuucuucuuuc

SEQ ID NO: 2197659 - RNA, 17 nt, Streptococcus pneumoniae R6
cagacagcugaguggau

SEQ ID NO: 2197660 - RNA, 22 nt, Streptococcus pneumoniae R6
cagacauaacacccugcaugag

SEQ ID NO: 2197661 - RNA, 15 nt, Streptococcus pneumoniae R6
cagacauauccauuc

SEQ ID NO: 2197662 - RNA, 20 nt, Streptococcus pneumoniae R6
cagacauauccauuccuccc

SEQ ID NO: 2197663 - RNA, 23 nt, Streptococcus pneumoniae R6
cagacauaugaaaucuuuuugau

SEQ ID NO: 2197664 - RNA, 18 nt, Streptococcus pneumoniae R6
cacugccauuaauuccug

SEQ ID NO: 2197665 - RNA, 17 nt, Streptococcus pneumoniae R6
caauguugucaauuucc

SEQ ID NO: 2197666 - RNA, 20 nt, Streptococcus pneumoniae R6
caauguugucaauuuccauu

SEQ ID NO: 2197667 - RNA, 21 nt, Streptococcus pneumoniae R6
caauguuuuugggaaggaaua

SEQ ID NO: 2197668 - RNA, 22 nt, Streptococcus pneumoniae R6
caaugugcagggcgcuacaaca

SEQ ID NO: 2197669 - RNA, 15 nt, Streptococcus pneumoniae R6
caauguucaagacau

SEQ ID NO: 2197670 - RNA, 18 nt, Streptococcus pneumoniae R6
caauguucucauauuuuc

SEQ ID NO: 2197671 - RNA, 19 nt, Streptococcus pneumoniae R6
caauguucucauauuuucu

SEQ ID NO: 2197672 - RNA, 20 nt, Streptococcus pneumoniae R6
cacuguuuugagcugacuuc

SEQ ID NO: 2197673 - RNA, 16 nt, Streptococcus pneumoniae R6
cacuguuuuuuauccc

SEQ ID NO: 2197674 - RNA, 16 nt, Streptococcus pneumoniae R6
cacuuaauucuucaua

SEQ ID NO: 2197675 - RNA, 16 nt, Streptococcus pneumoniae R6
cacuuacggaucuagc

SEQ ID NO: 2197676 - RNA, 11 nt, Streptococcus pneumoniae R6
cacugguguga

SEQ ID NO: 2197677 - RNA, 18 nt, Streptococcus pneumoniae R6
cacugugcuuugugucau

SEQ ID NO: 2197678 - RNA, 19 nt, Streptococcus pneumoniae R6
cacuucauguuucauauca

SEQ ID NO: 2197679 - RNA, 19 nt, Streptococcus pneumoniae R6
cacuuaguugaauuaucau

SEQ ID NO: 2197680 - RNA, 15 nt, Streptococcus pneumoniae R6
cacuuacgacauccu

SEQ ID NO: 2197681 - RNA, 16 nt, Streptococcus pneumoniae R6
cacuucacgaaugaca

SEQ ID NO: 2197682 - RNA, 14 nt, Streptococcus pneumoniae R6
cacuuauuuuauag

SEQ ID NO: 2197683 - RNA, 13 nt, Streptococcus pneumoniae R6
cacuucugcuucu

SEQ ID NO: 2197684 - RNA, 19 nt, Streptococcus pneumoniae R6
cacuucugcuucuaaaaca

SEQ ID NO: 2197685 - RNA, 16 nt, Streptococcus pneumoniae R6
cagaaaaaucccuugu

SEQ ID NO: 2197686 - RNA, 17 nt, Streptococcus pneumoniae R6
cagaaaaaucccuuguu

SEQ ID NO: 2197687 - RNA, 13 nt, Streptococcus pneumoniae R6
cagaaaaaucugu

SEQ ID NO: 2197688 - RNA, 22 nt, Streptococcus pneumoniae R6
cagaaaaaucuguuaaaaaaua

SEQ ID NO: 2197689 - RNA, 18 nt, Streptococcus pneumoniae R6
cagaaaaaugacaauaaa

SEQ ID NO: 2197690 - RNA, 20 nt, Streptococcus pneumoniae R6
cagaaaaaugacaauaaaau

SEQ ID NO: 2197691 - RNA, 20 nt, Streptococcus pneumoniae R6
cagaaaaaccuuguuuuuuc

SEQ ID NO: 2197692 - RNA, 19 nt, Streptococcus pneumoniae R6
cagaaaaacgcauaaaauc

SEQ ID NO: 2197693 - RNA, 13 nt, Streptococcus pneumoniae R6
cacuugggaaacc

SEQ ID NO: 2197694 - RNA, 14 nt, Streptococcus pneumoniae R6
cacuugggaaacca

SEQ ID NO: 2197695 - RNA, 19 nt, Streptococcus pneumoniae R6
cacuugcuuuugauggguu

SEQ ID NO: 2197696 - RNA, 21 nt, Streptococcus pneumoniae R6
cacuuggcauucaaaacgcca

SEQ ID NO: 2197697 - RNA, 14 nt, Streptococcus pneumoniae R6
cacuugguaggaua

SEQ ID NO: 2197698 - RNA, 21 nt, Streptococcus pneumoniae R6
cacuugguguugagaaagcac

SEQ ID NO: 2197699 - RNA, 22 nt, Streptococcus pneumoniae R6
cacuugguguugagaaagcacu

SEQ ID NO: 2197700 - RNA, 15 nt, Streptococcus pneumoniae R6
cacuuguauccuccu

SEQ ID NO: 2197701 - RNA, 15 nt, Streptococcus pneumoniae R6
cacuugaugaaaaaa

SEQ ID NO: 2197702 - RNA, 16 nt, Streptococcus pneumoniae R6
cacuuuauuuuuucug

SEQ ID NO: 2197703 - RNA, 22 nt, Streptococcus pneumoniae R6
cacuuuauuuuuucuguaaaau

SEQ ID NO: 2197704 - RNA, 18 nt, Streptococcus pneumoniae R6
cagcugucuuuucaaagu

SEQ ID NO: 2197705 - RNA, 19 nt, Streptococcus pneumoniae R6
cagcugucuuuucaaaguu

SEQ ID NO: 2197706 - RNA, 16 nt, Streptococcus pneumoniae R6
cagcuuaucucguacu

SEQ ID NO: 2197707 - RNA, 14 nt, Streptococcus pneumoniae R6
cagcuucuuuuuau

SEQ ID NO: 2197708 - RNA, 19 nt, Streptococcus pneumoniae R6
cagcuuccaucugcagccu

SEQ ID NO: 2197709 - RNA, 14 nt, Streptococcus pneumoniae R6
cagcuauuaagaaa

SEQ ID NO: 2197710 - RNA, 21 nt, Streptococcus pneumoniae R6
cagcuagcuagaguuucaauu

SEQ ID NO: 2197711 - RNA, 20 nt, Streptococcus pneumoniae R6
cagcuagucgugaaagagca

SEQ ID NO: 2197712 - RNA, 18 nt, Streptococcus pneumoniae R6
cagcuagucuagucugga

SEQ ID NO: 2197713 - RNA, 16 nt, Streptococcus pneumoniae R6
cagcuacgacaccuga

SEQ ID NO: 2197714 - RNA, 19 nt, Streptococcus pneumoniae R6
cagcuacgacaccugacaa

SEQ ID NO: 2197715 - RNA, 17 nt, Streptococcus pneumoniae R6
cagcuccgauguauuug

SEQ ID NO: 2197716 - RNA, 20 nt, Streptococcus pneumoniae R6
cagcucaaaacacuguuuua

SEQ ID NO: 2197717 - RNA, 20 nt, Streptococcus pneumoniae R6
caggaauauccaauauggca

SEQ ID NO: 2197718 - RNA, 20 nt, Streptococcus pneumoniae R6
caggaauauugaguucuuca

SEQ ID NO: 2197719 - RNA, 20 nt, Streptococcus pneumoniae R6
caggaauguccuuagcaugg

SEQ ID NO: 2197720 - RNA, 14 nt, Streptococcus pneumoniae R6
caggaaguuuuuuc

SEQ ID NO: 2197721 - RNA, 16 nt, Streptococcus pneumoniae R6
caggaauacuaaaaua

SEQ ID NO: 2197722 - RNA, 15 nt, Streptococcus pneumoniae R6
caggacaaaagauaa

SEQ ID NO: 2197723 - RNA, 15 nt, Streptococcus pneumoniae R6
caggacgaacgcugg

SEQ ID NO: 2197724 - RNA, 18 nt, Streptococcus pneumoniae R6
cagcuugcccuuugucca

SEQ ID NO: 2197725 - RNA, 17 nt, Streptococcus pneumoniae R6
caggaaggaaauagcug

SEQ ID NO: 2197726 - RNA, 15 nt, Streptococcus pneumoniae R6
caggagauaaaagcg

SEQ ID NO: 2197727 - RNA, 22 nt, Streptococcus pneumoniae R6
caggagauaaaagcgccugaca

SEQ ID NO: 2197728 - RNA, 21 nt, Streptococcus pneumoniae R6
caggacuuggauaagagaaga

SEQ ID NO: 2197729 - RNA, 14 nt, Streptococcus pneumoniae R6
caggauugauaaaa

SEQ ID NO: 2197730 - RNA, 18 nt, Streptococcus pneumoniae R6
caggauuaccuuugaaaa

SEQ ID NO: 2197731 - RNA, 20 nt, Streptococcus pneumoniae R6
caggauuaccuuugaaaaaa

SEQ ID NO: 2197732 - RNA, 21 nt, Streptococcus pneumoniae R6
caggauuaccuuugaaaaaau

SEQ ID NO: 2197733 - RNA, 17 nt, Streptococcus pneumoniae R6
caggauguguaaaaaag

SEQ ID NO: 2197734 - RNA, 19 nt, Streptococcus pneumoniae R6
caggauguagggugacgaa

SEQ ID NO: 2197735 - RNA, 21 nt, Streptococcus pneumoniae R6
cagggccuuuugcauaaugag

SEQ ID NO: 2197736 - RNA, 16 nt, Streptococcus pneumoniae R6
cagggcuucuaacaua

SEQ ID NO: 2197737 - RNA, 16 nt, Streptococcus pneumoniae R6
cagucagugguucacu

SEQ ID NO: 2197738 - RNA, 17 nt, Streptococcus pneumoniae R6
cagucuccuagucuaca

SEQ ID NO: 2197739 - RNA, 23 nt, Streptococcus pneumoniae R6
cagucuccuagucuacaaauuca

SEQ ID NO: 2197740 - RNA, 23 nt, Streptococcus pneumoniae R6
cagucguuccuuuugugacaauu

SEQ ID NO: 2197741 - RNA, 23 nt, Streptococcus pneumoniae R6
cagucuagaagcaagacaaaaac

SEQ ID NO: 2197742 - RNA, 21 nt, Streptococcus pneumoniae R6
cagucugaaaaagaggaugaa

SEQ ID NO: 2197743 - RNA, 20 nt, Streptococcus pneumoniae R6
cagucugaaaaauaggauga

SEQ ID NO: 2197744 - RNA, 15 nt, Streptococcus pneumoniae R6
cagucugaccaccau

SEQ ID NO: 2197745 - RNA, 13 nt, Streptococcus pneumoniae R6
cagucuuaucugc

SEQ ID NO: 2197746 - RNA, 17 nt, Streptococcus pneumoniae R6
cagugaaggcuuuaaau

SEQ ID NO: 2197747 - RNA, 15 nt, Streptococcus pneumoniae R6
cagugaacuauuuua

SEQ ID NO: 2197748 - RNA, 15 nt, Streptococcus pneumoniae R6
cagugaauuuaccaa

SEQ ID NO: 2197749 - RNA, 22 nt, Streptococcus pneumoniae R6
cagugaauuuaccaaggaagcu

SEQ ID NO: 2197750 - RNA, 16 nt, Streptococcus pneumoniae R6
caguguacauacuuua

SEQ ID NO: 2197751 - RNA, 17 nt, Streptococcus pneumoniae R6
caguguacauacuuuau

SEQ ID NO: 2197752 - RNA, 18 nt, Streptococcus pneumoniae R6
cagucaagaguucuucua

SEQ ID NO: 2197753 - RNA, 13 nt, Streptococcus pneumoniae R6
cagucaauaccag

SEQ ID NO: 2197754 - RNA, 16 nt, Streptococcus pneumoniae R6
caguauauugaaauga

SEQ ID NO: 2197755 - RNA, 17 nt, Streptococcus pneumoniae R6
caguauauugaaaugaa

SEQ ID NO: 2197756 - RNA, 20 nt, Streptococcus pneumoniae R6
caguaguuggcuugucuuuu

SEQ ID NO: 2197757 - RNA, 18 nt, Streptococcus pneumoniae R6
caguagacuugaccgcag

SEQ ID NO: 2197758 - RNA, 13 nt, Streptococcus pneumoniae R6
caguagaugauuu

SEQ ID NO: 2197759 - RNA, 14 nt, Streptococcus pneumoniae R6
caguagaucacuga

SEQ ID NO: 2197760 - RNA, 15 nt, Streptococcus pneumoniae R6
caguacuuucaacuc

SEQ ID NO: 2197761 - RNA, 19 nt, Streptococcus pneumoniae R6
caguacuuucaacuccuua

SEQ ID NO: 2197762 - RNA, 12 nt, Streptococcus pneumoniae R6
caguaacuucug

SEQ ID NO: 2197763 - RNA, 19 nt, Streptococcus pneumoniae R6
caguaacuucugucuauuu

SEQ ID NO: 2197764 - RNA, 17 nt, Streptococcus pneumoniae R6
caguaacuuuaccaaaa

SEQ ID NO: 2197765 - RNA, 14 nt, Streptococcus pneumoniae R6
caggugugaaaacu

SEQ ID NO: 2197766 - RNA, 23 nt, Streptococcus pneumoniae R6
caguaaaauagauaaauacucug

SEQ ID NO: 2197767 - RNA, 14 nt, Streptococcus pneumoniae R6
caguaaaaacuguu

SEQ ID NO: 2197768 - RNA, 19 nt, Streptococcus pneumoniae R6
caguaaaaaaaacauauau

SEQ ID NO: 2197769 - RNA, 23 nt, Streptococcus pneumoniae R6
cagguugcucaaaguacugccuu

SEQ ID NO: 2197770 - RNA, 15 nt, Streptococcus pneumoniae R6
cagguuuuucaccag

SEQ ID NO: 2197771 - RNA, 22 nt, Streptococcus pneumoniae R6
cagguuuuucaccagauagaau

SEQ ID NO: 2197772 - RNA, 20 nt, Streptococcus pneumoniae R6
cauaaaucgaucauauuuau

SEQ ID NO: 2197773 - RNA, 17 nt, Streptococcus pneumoniae R6
cauaaaucuugaugucu

SEQ ID NO: 2197774 - RNA, 18 nt, Streptococcus pneumoniae R6
caguuuauaacuugaagu

SEQ ID NO: 2197775 - RNA, 16 nt, Streptococcus pneumoniae R6
cauaaaaaaauccucc

SEQ ID NO: 2197776 - RNA, 13 nt, Streptococcus pneumoniae R6
cauaaaaauaaua

SEQ ID NO: 2197777 - RNA, 15 nt, Streptococcus pneumoniae R6
cauaaaaagaccgga

SEQ ID NO: 2197778 - RNA, 18 nt, Streptococcus pneumoniae R6
cauaaacacccauaauau

SEQ ID NO: 2197779 - RNA, 22 nt, Streptococcus pneumoniae R6
cauaaauagauuggauaaaauc

SEQ ID NO: 2197780 - RNA, 23 nt, Streptococcus pneumoniae R6
cauaaauagauuggauaaaaucu

SEQ ID NO: 2197781 - RNA, 20 nt, Streptococcus pneumoniae R6
cauaaauacuaucaauaaaa

SEQ ID NO: 2197782 - RNA, 16 nt, Streptococcus pneumoniae R6
cauaaagagaaggagg

SEQ ID NO: 2197783 - RNA, 17 nt, Streptococcus pneumoniae R6
cauaaacuugcaggaaa

SEQ ID NO: 2197784 - RNA, 13 nt, Streptococcus pneumoniae R6
caguugcaagaag

SEQ ID NO: 2197785 - RNA, 20 nt, Streptococcus pneumoniae R6
caguugcaucuuaguuaaaa

SEQ ID NO: 2197786 - RNA, 17 nt, Streptococcus pneumoniae R6
caguugauggagcuggu

SEQ ID NO: 2197787 - RNA, 22 nt, Streptococcus pneumoniae R6
caguguuuuaagcugacuucgu

SEQ ID NO: 2197788 - RNA, 15 nt, Streptococcus pneumoniae R6
caguguuuugagcac

SEQ ID NO: 2197789 - RNA, 16 nt, Streptococcus pneumoniae R6
caguguuuugagcagc

SEQ ID NO: 2197790 - RNA, 20 nt, Streptococcus pneumoniae R6
caguguuuugagcugacuuc

SEQ ID NO: 2197791 - RNA, 20 nt, Streptococcus pneumoniae R6
caguguuuugaucugacuuc

SEQ ID NO: 2197792 - RNA, 14 nt, Streptococcus pneumoniae R6
caguucuauccaca

SEQ ID NO: 2197793 - RNA, 17 nt, Streptococcus pneumoniae R6
caguucuauccacaacc

SEQ ID NO: 2197794 - RNA, 17 nt, Streptococcus pneumoniae R6
caguucuaucuacaacc

SEQ ID NO: 2197795 - RNA, 22 nt, Streptococcus pneumoniae R6
caguucuaucugcaaccuuaaa

SEQ ID NO: 2197796 - RNA, 14 nt, Streptococcus pneumoniae R6
caguugacaaagag

SEQ ID NO: 2197797 - RNA, 22 nt, Streptococcus pneumoniae R6
caguugacaaagagccaaaaaa

SEQ ID NO: 2197798 - RNA, 19 nt, Streptococcus pneumoniae R6
caguugacaaagagccgga

SEQ ID NO: 2197799 - RNA, 14 nt, Streptococcus pneumoniae R6
cauaaugagcugua

SEQ ID NO: 2197800 - RNA, 22 nt, Streptococcus pneumoniae R6
cauaaugagcuguacuauuguc

SEQ ID NO: 2197801 - RNA, 14 nt, Streptococcus pneumoniae R6
cauaaucuguuuaa

SEQ ID NO: 2197802 - RNA, 19 nt, Streptococcus pneumoniae R6
cauaacugcugcuuggaag

SEQ ID NO: 2197803 - RNA, 19 nt, Streptococcus pneumoniae R6
cauaaccuaggucaaccaa

SEQ ID NO: 2197804 - RNA, 18 nt, Streptococcus pneumoniae R6
cauaacgaguaaaagaua

SEQ ID NO: 2197805 - RNA, 20 nt, Streptococcus pneumoniae R6
cauaacgauaauccuugucg

SEQ ID NO: 2197806 - RNA, 13 nt, Streptococcus pneumoniae R6
cauacauacgaua

SEQ ID NO: 2197807 - RNA, 19 nt, Streptococcus pneumoniae R6
cauacacuggauguguaua

SEQ ID NO: 2197808 - RNA, 16 nt, Streptococcus pneumoniae R6
cauacagagaaaguca

SEQ ID NO: 2197809 - RNA, 15 nt, Streptococcus pneumoniae R6
cauacccaugcuuuu

SEQ ID NO: 2197810 - RNA, 19 nt, Streptococcus pneumoniae R6
cauacccaugcuuuucuau

SEQ ID NO: 2197811 - RNA, 16 nt, Streptococcus pneumoniae R6
cauacauuucgauaaa

SEQ ID NO: 2197812 - RNA, 20 nt, Streptococcus pneumoniae R6
cauacauuucgauaaaggga

SEQ ID NO: 2197813 - RNA, 14 nt, Streptococcus pneumoniae R6
cauacgagccgcaa

SEQ ID NO: 2197814 - RNA, 15 nt, Streptococcus pneumoniae R6
cauacgauaaaaauc

SEQ ID NO: 2197815 - RNA, 19 nt, Streptococcus pneumoniae R6
cauacggcgguucaacuaa

SEQ ID NO: 2197816 - RNA, 23 nt, Streptococcus pneumoniae R6
cauacggcgguucaacuaacuuu

SEQ ID NO: 2197817 - RNA, 23 nt, Streptococcus pneumoniae R6
cauaccuacgauaucugaagaua

SEQ ID NO: 2197818 - RNA, 22 nt, Streptococcus pneumoniae R6
cauacucgugaagaaaucaucc

SEQ ID NO: 2197819 - RNA, 17 nt, Streptococcus pneumoniae R6
cauacuaauagcaccaa

SEQ ID NO: 2197820 - RNA, 16 nt, Streptococcus pneumoniae R6
cauacgucggcuagca

SEQ ID NO: 2197821 - RNA, 17 nt, Streptococcus pneumoniae R6
cauacuuggagaaccua

SEQ ID NO: 2197822 - RNA, 22 nt, Streptococcus pneumoniae R6
cauacugggcacggugauuuuu

SEQ ID NO: 2197823 - RNA, 11 nt, Streptococcus pneumoniae R6
cauacugcccu

SEQ ID NO: 2197824 - RNA, 14 nt, Streptococcus pneumoniae R6
cauacugcccugaa

SEQ ID NO: 2197825 - RNA, 19 nt, Streptococcus pneumoniae R6
cauacugccaagauagaga

SEQ ID NO: 2197826 - RNA, 20 nt, Streptococcus pneumoniae R6
caugcuuuacuaguucucaa

SEQ ID NO: 2197827 - RNA, 21 nt, Streptococcus pneumoniae R6
caugcuuuacuaguucucaaa

SEQ ID NO: 2197828 - RNA, 15 nt, Streptococcus pneumoniae R6
cauggaaagcaucuc

SEQ ID NO: 2197829 - RNA, 15 nt, Streptococcus pneumoniae R6
cauggaaccaaaguu

SEQ ID NO: 2197830 - RNA, 14 nt, Streptococcus pneumoniae R6
cauggacuguuuca

SEQ ID NO: 2197831 - RNA, 14 nt, Streptococcus pneumoniae R6
cauggacuuuuuug

SEQ ID NO: 2197832 - RNA, 15 nt, Streptococcus pneumoniae R6
cauggacuuuuuugc

SEQ ID NO: 2197833 - RNA, 18 nt, Streptococcus pneumoniae R6
cauggacuuuuuugcgaa

SEQ ID NO: 2197834 - RNA, 22 nt, Streptococcus pneumoniae R6
caugcuugauucaaagucauaa

SEQ ID NO: 2197835 - RNA, 15 nt, Streptococcus pneumoniae R6
caugcguuaaaaguu

SEQ ID NO: 2197836 - RNA, 19 nt, Streptococcus pneumoniae R6
cauggucaaaguagucauu

SEQ ID NO: 2197837 - RNA, 21 nt, Streptococcus pneumoniae R6
cauggcacggucauuuucuuc

SEQ ID NO: 2197838 - RNA, 19 nt, Streptococcus pneumoniae R6
cauggcaacguuaaagagu

SEQ ID NO: 2197839 - RNA, 20 nt, Streptococcus pneumoniae R6
cauggauuuuauugucuuua

SEQ ID NO: 2197840 - RNA, 20 nt, Streptococcus pneumoniae R6
cauggauuuuucuuauuuuc

SEQ ID NO: 2197841 - RNA, 15 nt, Streptococcus pneumoniae R6
caugcgcaaaauaau

SEQ ID NO: 2197842 - RNA, 21 nt, Streptococcus pneumoniae R6
caugcgcucgcuuuucaccug

SEQ ID NO: 2197843 - RNA, 18 nt, Streptococcus pneumoniae R6
caugccuuuuucaaucaa

SEQ ID NO: 2197844 - RNA, 22 nt, Streptococcus pneumoniae R6
caugcgauagaugaucgagcag

SEQ ID NO: 2197845 - RNA, 13 nt, Streptococcus pneumoniae R6
caucuuucauguu

SEQ ID NO: 2197846 - RNA, 14 nt, Streptococcus pneumoniae R6
caucuuuugauaga

SEQ ID NO: 2197847 - RNA, 17 nt, Streptococcus pneumoniae R6
caucuuuugauagauga

SEQ ID NO: 2197848 - RNA, 20 nt, Streptococcus pneumoniae R6
caucuuuugauagaugacuu

SEQ ID NO: 2197849 - RNA, 23 nt, Streptococcus pneumoniae R6
caugaaaccaccgacaacccagu

SEQ ID NO: 2197850 - RNA, 21 nt, Streptococcus pneumoniae R6
caugaaaggauuucucuauuc

SEQ ID NO: 2197851 - RNA, 23 nt, Streptococcus pneumoniae R6
caugaaagaugaagcaaucaaug

SEQ ID NO: 2197852 - RNA, 16 nt, Streptococcus pneumoniae R6
cauguuucggaucaua

SEQ ID NO: 2197853 - RNA, 17 nt, Streptococcus pneumoniae R6
cauguuuuucaauagcc

SEQ ID NO: 2197854 - RNA, 20 nt, Streptococcus pneumoniae R6
cauguuuuucaauagccuga

SEQ ID NO: 2197855 - RNA, 17 nt, Streptococcus pneumoniae R6
cauguuuuucuccuauu

SEQ ID NO: 2197856 - RNA, 23 nt, Streptococcus pneumoniae R6
cauguuuuucuccuauuuucuuc

SEQ ID NO: 2197857 - RNA, 14 nt, Streptococcus pneumoniae R6
cauguuuuuaagcu

SEQ ID NO: 2197858 - RNA, 21 nt, Streptococcus pneumoniae R6
cauuaaagacaauguucuuuu

SEQ ID NO: 2197859 - RNA, 19 nt, Streptococcus pneumoniae R6
cauuaaagaccaaagaaaa

SEQ ID NO: 2197860 - RNA, 18 nt, Streptococcus pneumoniae R6
caugugcaguuuuggaau

SEQ ID NO: 2197861 - RNA, 15 nt, Streptococcus pneumoniae R6
caugucguuuccuuc

SEQ ID NO: 2197862 - RNA, 16 nt, Streptococcus pneumoniae R6
caugguucgggauaaa

SEQ ID NO: 2197863 - RNA, 14 nt, Streptococcus pneumoniae R6
cauuacuuaaccca

SEQ ID NO: 2197864 - RNA, 22 nt, Streptococcus pneumoniae R6
cauuacaauguagccaucaucc

SEQ ID NO: 2197865 - RNA, 22 nt, Streptococcus pneumoniae R6
cauuaaucagauaaacaauggu

SEQ ID NO: 2197866 - RNA, 14 nt, Streptococcus pneumoniae R6
cauuaagucaacau

SEQ ID NO: 2197867 - RNA, 19 nt, Streptococcus pneumoniae R6
cauuaaauuuuuuucucaa

SEQ ID NO: 2197868 - RNA, 23 nt, Streptococcus pneumoniae R6
cauuaacgacauagucaaagagu

SEQ ID NO: 2197869 - RNA, 19 nt, Streptococcus pneumoniae R6
cauuaacgaucaaucaauu

SEQ ID NO: 2197870 - RNA, 16 nt, Streptococcus pneumoniae R6
cauuuuucaaaucaaa

SEQ ID NO: 2197871 - RNA, 14 nt, Streptococcus pneumoniae R6
cauuuuucugcuau

SEQ ID NO: 2197872 - RNA, 14 nt, Streptococcus pneumoniae R6
cauuuugaccuguu

SEQ ID NO: 2197873 - RNA, 23 nt, Streptococcus pneumoniae R6
cauuuuguuuuugagucaagaua

SEQ ID NO: 2197874 - RNA, 17 nt, Streptococcus pneumoniae R6
cauuuuggauauaagaa

SEQ ID NO: 2197875 - RNA, 13 nt, Streptococcus pneumoniae R6
cauuuuguaaaaa

SEQ ID NO: 2197876 - RNA, 14 nt, Streptococcus pneumoniae R6
cauuuuguaaaaaa

SEQ ID NO: 2197877 - RNA, 17 nt, Streptococcus pneumoniae R6
cauuuucuugauuuguu

SEQ ID NO: 2197878 - RNA, 18 nt, Streptococcus pneumoniae R6
cauuuucuuuacuucuga

SEQ ID NO: 2197879 - RNA, 15 nt, Streptococcus pneumoniae R6
cauuuucuacuaaaa

SEQ ID NO: 2197880 - RNA, 20 nt, Streptococcus pneumoniae R6
cauuuuacaucuguuuuaaa

SEQ ID NO: 2197881 - RNA, 15 nt, Streptococcus pneumoniae R6
cauuuucaaagaaga

SEQ ID NO: 2197882 - RNA, 13 nt, Streptococcus pneumoniae R6
cauuuuauuauua

SEQ ID NO: 2197883 - RNA, 16 nt, Streptococcus pneumoniae R6
cauuuuauucauaucc

SEQ ID NO: 2197884 - RNA, 17 nt, Streptococcus pneumoniae R6
cauuuuauucauauccc

SEQ ID NO: 2197885 - RNA, 14 nt, Streptococcus pneumoniae R6
cauuuuaauauaua

SEQ ID NO: 2197886 - RNA, 16 nt, Streptococcus pneumoniae R6
cauuuuaauauauaaa

SEQ ID NO: 2197887 - RNA, 19 nt, Streptococcus pneumoniae R6
cauuuuaauauauaaaaaa

SEQ ID NO: 2197888 - RNA, 20 nt, Streptococcus pneumoniae R6
cauuuuaauauauaaaaaau

SEQ ID NO: 2197889 - RNA, 15 nt, Streptococcus pneumoniae R6
cauuuuacuauaaaa

SEQ ID NO: 2197890 - RNA, 13 nt, Streptococcus pneumoniae R6
cauuuuacuauau

SEQ ID NO: 2197891 - RNA, 13 nt, Streptococcus pneumoniae R6
cauuuguaaacug

SEQ ID NO: 2197892 - RNA, 20 nt, Streptococcus pneumoniae R6
cauuuggcuauaaaaaacuc

SEQ ID NO: 2197893 - RNA, 19 nt, Streptococcus pneumoniae R6
cauuuggcccuaccugcuc

SEQ ID NO: 2197894 - RNA, 14 nt, Streptococcus pneumoniae R6
cauuugcuucauca

SEQ ID NO: 2197895 - RNA, 21 nt, Streptococcus pneumoniae R6
cauuugcgcgcuugaaugaua

SEQ ID NO: 2197896 - RNA, 20 nt, Streptococcus pneumoniae R6
cauuugcagacgaaauacaa

SEQ ID NO: 2197897 - RNA, 23 nt, Streptococcus pneumoniae R6
cauuuguuuaguguauaugaaga

SEQ ID NO: 2197898 - RNA, 17 nt, Streptococcus pneumoniae R6
cauuuguaugagaggca

SEQ ID NO: 2197899 - RNA, 19 nt, Streptococcus pneumoniae R6
cauuuguaaaucuucagau

SEQ ID NO: 2197900 - RNA, 20 nt, Streptococcus pneumoniae R6
cauuuggguaggucuuuuug

SEQ ID NO: 2197901 - RNA, 14 nt, Streptococcus pneumoniae R6
cauuuaauauauuu

SEQ ID NO: 2197902 - RNA, 21 nt, Streptococcus pneumoniae R6
cauuucuguguuucauagauu

SEQ ID NO: 2197903 - RNA, 22 nt, Streptococcus pneumoniae R6
cauuucuguguuucauagauuu

SEQ ID NO: 2197904 - RNA, 18 nt, Streptococcus pneumoniae R6
cauuucuucaacaaaccu

SEQ ID NO: 2197905 - RNA, 20 nt, Streptococcus pneumoniae R6
cauuugacgaacaaaaagug

SEQ ID NO: 2197906 - RNA, 12 nt, Streptococcus pneumoniae R6
cauuugaugaga

SEQ ID NO: 2197907 - RNA, 17 nt, Streptococcus pneumoniae R6
cauuugagcgaaaucaa

SEQ ID NO: 2197908 - RNA, 14 nt, Streptococcus pneumoniae R6
cauuugauuuuccu

SEQ ID NO: 2197909 - RNA, 18 nt, Streptococcus pneumoniae R6
cauuugauuuuguaaaaa

SEQ ID NO: 2197910 - RNA, 19 nt, Streptococcus pneumoniae R6
cauuucuuugucuccaaca

SEQ ID NO: 2197911 - RNA, 20 nt, Streptococcus pneumoniae R6
cauuucuucaguauaaacug

SEQ ID NO: 2197912 - RNA, 23 nt, Streptococcus pneumoniae R6
cauugagguccaaguuugcaaag

SEQ ID NO: 2197913 - RNA, 22 nt, Streptococcus pneumoniae R6
cauugaguauaagauacaaauu

SEQ ID NO: 2197914 - RNA, 22 nt, Streptococcus pneumoniae R6
cauugaguauuauuucauuuuc

SEQ ID NO: 2197915 - RNA, 20 nt, Streptococcus pneumoniae R6
cauugacuugcuguuuucuu

SEQ ID NO: 2197916 - RNA, 21 nt, Streptococcus pneumoniae R6
cauucugcuagacuaacuucu

SEQ ID NO: 2197917 - RNA, 19 nt, Streptococcus pneumoniae R6
cauucuuauuuggcaauuc

SEQ ID NO: 2197918 - RNA, 20 nt, Streptococcus pneumoniae R6
cauucuuagaaaucgauuug

SEQ ID NO: 2197919 - RNA, 19 nt, Streptococcus pneumoniae R6
cauuauccaacagagaaaa

SEQ ID NO: 2197920 - RNA, 21 nt, Streptococcus pneumoniae R6
cauuauccaacagagaaaauu

SEQ ID NO: 2197921 - RNA, 16 nt, Streptococcus pneumoniae R6
cauuaucuaauaccaa

SEQ ID NO: 2197922 - RNA, 13 nt, Streptococcus pneumoniae R6
cauuaucuagacc

SEQ ID NO: 2197923 - RNA, 18 nt, Streptococcus pneumoniae R6
cauucuaguccaucuccg

SEQ ID NO: 2197924 - RNA, 16 nt, Streptococcus pneumoniae R6
cauucuaggcuaucga

SEQ ID NO: 2197925 - RNA, 16 nt, Streptococcus pneumoniae R6
cauucuaaaacgcauc

SEQ ID NO: 2197926 - RNA, 17 nt, Streptococcus pneumoniae R6
cauucguuccuuuaaaa

SEQ ID NO: 2197927 - RNA, 16 nt, Streptococcus pneumoniae R6
cauucugaacuaaaaa

SEQ ID NO: 2197928 - RNA, 20 nt, Streptococcus pneumoniae R6
cauucugcauguaucacagu

SEQ ID NO: 2197929 - RNA, 21 nt, Streptococcus pneumoniae R6
cauucucgugaaauuuuagaa

SEQ ID NO: 2197930 - RNA, 22 nt, Streptococcus pneumoniae R6
cauuguuagaaaucaauuugac

SEQ ID NO: 2197931 - RNA, 16 nt, Streptococcus pneumoniae R6
cauuguucuuguuuug

SEQ ID NO: 2197932 - RNA, 21 nt, Streptococcus pneumoniae R6
cauuguucuuguuuugacauu

SEQ ID NO: 2197933 - RNA, 14 nt, Streptococcus pneumoniae R6
cauuuaaaauuaaa

SEQ ID NO: 2197934 - RNA, 21 nt, Streptococcus pneumoniae R6
cauuguuucguuucuucgucc

SEQ ID NO: 2197935 - RNA, 12 nt, Streptococcus pneumoniae R6
cauuggacaggg

SEQ ID NO: 2197936 - RNA, 14 nt, Streptococcus pneumoniae R6
cauugauauaaaga

SEQ ID NO: 2197937 - RNA, 20 nt, Streptococcus pneumoniae R6
cauaugggacuuuuuuucua

SEQ ID NO: 2197938 - RNA, 19 nt, Streptococcus pneumoniae R6
cauaucuuuauaggcuugg

SEQ ID NO: 2197939 - RNA, 17 nt, Streptococcus pneumoniae R6
cauaucuccauuacuug

SEQ ID NO: 2197940 - RNA, 12 nt, Streptococcus pneumoniae R6
cauaucuuauuu

SEQ ID NO: 2197941 - RNA, 18 nt, Streptococcus pneumoniae R6
cauaucuggcauuccugc

SEQ ID NO: 2197942 - RNA, 13 nt, Streptococcus pneumoniae R6
cauacuuucucug

SEQ ID NO: 2197943 - RNA, 20 nt, Streptococcus pneumoniae R6
cauagaaaaugguuccaaaa

SEQ ID NO: 2197944 - RNA, 17 nt, Streptococcus pneumoniae R6
cauacuuucuaucuuca

SEQ ID NO: 2197945 - RNA, 18 nt, Streptococcus pneumoniae R6
cauauaaaucuccagacc

SEQ ID NO: 2197946 - RNA, 12 nt, Streptococcus pneumoniae R6
cauauaaauaca

SEQ ID NO: 2197947 - RNA, 13 nt, Streptococcus pneumoniae R6
cauauaaauacaa

SEQ ID NO: 2197948 - RNA, 16 nt, Streptococcus pneumoniae R6
cauauaaggaccaaau

SEQ ID NO: 2197949 - RNA, 18 nt, Streptococcus pneumoniae R6
cauauauucaacgaaaau

SEQ ID NO: 2197950 - RNA, 17 nt, Streptococcus pneumoniae R6
cauauacacuuaaauuc

SEQ ID NO: 2197951 - RNA, 23 nt, Streptococcus pneumoniae R6
cauauacagucccuuuugaggga

SEQ ID NO: 2197952 - RNA, 20 nt, Streptococcus pneumoniae R6
cauaucaagguuuuucaaaa

SEQ ID NO: 2197953 - RNA, 13 nt, Streptococcus pneumoniae R6
cauauuuggcaua

SEQ ID NO: 2197954 - RNA, 18 nt, Streptococcus pneumoniae R6
cauauuagggcaaauaaa

SEQ ID NO: 2197955 - RNA, 18 nt, Streptococcus pneumoniae R6
caucaaaaacaucucaga

SEQ ID NO: 2197956 - RNA, 22 nt, Streptococcus pneumoniae R6
caucaaaaaccgcucagcugag

SEQ ID NO: 2197957 - RNA, 21 nt, Streptococcus pneumoniae R6
caucaacuagagcccaauauu

SEQ ID NO: 2197958 - RNA, 18 nt, Streptococcus pneumoniae R6
caucaacuauucuuuuuc

SEQ ID NO: 2197959 - RNA, 13 nt, Streptococcus pneumoniae R6
caucaagcuuuca

SEQ ID NO: 2197960 - RNA, 15 nt, Streptococcus pneumoniae R6
caucauauaaauaau

SEQ ID NO: 2197961 - RNA, 15 nt, Streptococcus pneumoniae R6
caucaucuagaugaa

SEQ ID NO: 2197962 - RNA, 19 nt, Streptococcus pneumoniae R6
caucaucguggucuucauc

SEQ ID NO: 2197963 - RNA, 21 nt, Streptococcus pneumoniae R6
caucaucguggucuucaucgc

SEQ ID NO: 2197964 - RNA, 22 nt, Streptococcus pneumoniae R6
caucauccaccuugcaaaaaaa

SEQ ID NO: 2197965 - RNA, 14 nt, Streptococcus pneumoniae R6
caucaugaaaccac

SEQ ID NO: 2197966 - RNA, 18 nt, Streptococcus pneumoniae R6
caucaucuugcuaaaaaa

SEQ ID NO: 2197967 - RNA, 23 nt, Streptococcus pneumoniae R6
caucaucuugcuaaaaaaaggga

SEQ ID NO: 2197968 - RNA, 20 nt, Streptococcus pneumoniae R6
caucauuccugauaaaagau

SEQ ID NO: 2197969 - RNA, 13 nt, Streptococcus pneumoniae R6
caucauuccuuca

SEQ ID NO: 2197970 - RNA, 18 nt, Streptococcus pneumoniae R6
caucauuuuauucauauc

SEQ ID NO: 2197971 - RNA, 19 nt, Streptococcus pneumoniae R6
cauccaccuugcaaaaaaa

SEQ ID NO: 2197972 - RNA, 23 nt, Streptococcus pneumoniae R6
cauccacgagaaagaucauuaac

SEQ ID NO: 2197973 - RNA, 17 nt, Streptococcus pneumoniae R6
caucagguuucaagucu

SEQ ID NO: 2197974 - RNA, 19 nt, Streptococcus pneumoniae R6
caucagguuucaagucugu

SEQ ID NO: 2197975 - RNA, 18 nt, Streptococcus pneumoniae R6
caucagucaaucuacuug

SEQ ID NO: 2197976 - RNA, 15 nt, Streptococcus pneumoniae R6
caucauaaaucaauu

SEQ ID NO: 2197977 - RNA, 13 nt, Streptococcus pneumoniae R6
caucauaaaaaua

SEQ ID NO: 2197978 - RNA, 20 nt, Streptococcus pneumoniae R6
caucagggaguuguuuuuua

SEQ ID NO: 2197979 - RNA, 21 nt, Streptococcus pneumoniae R6
caucagggaguuguuuuuuau

SEQ ID NO: 2197980 - RNA, 19 nt, Streptococcus pneumoniae R6
caucuaucaaaagauguua

SEQ ID NO: 2197981 - RNA, 15 nt, Streptococcus pneumoniae R6
caucuauaaucaaua

SEQ ID NO: 2197982 - RNA, 13 nt, Streptococcus pneumoniae R6
caucugcaauaac

SEQ ID NO: 2197983 - RNA, 20 nt, Streptococcus pneumoniae R6
caucugcagccucaaaacac

SEQ ID NO: 2197984 - RNA, 22 nt, Streptococcus pneumoniae R6
caucugcagccucaaaacacug

SEQ ID NO: 2197985 - RNA, 14 nt, Streptococcus pneumoniae R6
caucucgacuggca

SEQ ID NO: 2197986 - RNA, 19 nt, Streptococcus pneumoniae R6
caucuccugucaauuccaa

SEQ ID NO: 2197987 - RNA, 15 nt, Streptococcus pneumoniae R6
caucuguuuuaaacg

SEQ ID NO: 2197988 - RNA, 23 nt, Streptococcus pneumoniae R6
caucuguuuuaaacguucaaucc

SEQ ID NO: 2197989 - RNA, 16 nt, Streptococcus pneumoniae R6
caucuuaguuaaaaua

SEQ ID NO: 2197990 - RNA, 22 nt, Streptococcus pneumoniae R6
caucuuauagcgacuauaaaaa

SEQ ID NO: 2197991 - RNA, 21 nt, Streptococcus pneumoniae R6
caucuuauuucaaucugcuau

SEQ ID NO: 2197992 - RNA, 16 nt, Streptococcus pneumoniae R6
caucuucaaaaucaaa

SEQ ID NO: 2197993 - RNA, 12 nt, Streptococcus pneumoniae R6
caucuuccaaag

SEQ ID NO: 2197994 - RNA, 20 nt, Streptococcus pneumoniae R6
caucuguccccucacaucuu

SEQ ID NO: 2197995 - RNA, 20 nt, Streptococcus pneumoniae R6
caucuguaccgaccuugucu

SEQ ID NO: 2197996 - RNA, 19 nt, Streptococcus pneumoniae R6
caucuggaguagcaucccc

SEQ ID NO: 2197997 - RNA, 21 nt, Streptococcus pneumoniae R6
caucuggaguagcauccccag

SEQ ID NO: 2197998 - RNA, 22 nt, Streptococcus pneumoniae R6
caucuggaguagcauccccagu

SEQ ID NO: 2197999 - RNA, 16 nt, Streptococcus pneumoniae R6
caucuugucuucaaag

SEQ ID NO: 2198000 - RNA, 17 nt, Streptococcus pneumoniae R6
caucuugucuucaaagg

SEQ ID NO: 2198001 - RNA, 16 nt, Streptococcus pneumoniae R6
caucuuguguuuuuug

SEQ ID NO: 2198002 - RNA, 13 nt, Streptococcus pneumoniae R6
caucuuggucagg

SEQ ID NO: 2198003 - RNA, 20 nt, Streptococcus pneumoniae R6
caucuucuguaccaauacua

SEQ ID NO: 2198004 - RNA, 14 nt, Streptococcus pneumoniae R6
caucuucuucuggu

SEQ ID NO: 2198005 - RNA, 20 nt, Streptococcus pneumoniae R6
cauccugaauagugaagaua

SEQ ID NO: 2198006 - RNA, 18 nt, Streptococcus pneumoniae R6
cauccuuuucuguacuua

SEQ ID NO: 2198007 - RNA, 20 nt, Streptococcus pneumoniae R6
cauccuuuucuguacuuagc

SEQ ID NO: 2198008 - RNA, 22 nt, Streptococcus pneumoniae R6
caucgaaguuguguuugaccac

SEQ ID NO: 2198009 - RNA, 19 nt, Streptococcus pneumoniae R6
cauccacuggauaauuucu

SEQ ID NO: 2198010 - RNA, 22 nt, Streptococcus pneumoniae R6
cauccacuggauaauuucuuua

SEQ ID NO: 2198011 - RNA, 18 nt, Streptococcus pneumoniae R6
cauccguuuuucuccucu

SEQ ID NO: 2198012 - RNA, 15 nt, Streptococcus pneumoniae R6
caucgacuacuaaaa

SEQ ID NO: 2198013 - RNA, 22 nt, Streptococcus pneumoniae R6
ccguuuuuugaaguuuucaaag

SEQ ID NO: 2198014 - RNA, 16 nt, Streptococcus pneumoniae R6
ccuaaaacuagugaag

SEQ ID NO: 2198015 - RNA, 22 nt, Streptococcus pneumoniae R6
ccguugaguuuuuuauuuuccc

SEQ ID NO: 2198016 - RNA, 20 nt, Streptococcus pneumoniae R6
ccuaaaucaacuguuuuuga

SEQ ID NO: 2198017 - RNA, 15 nt, Streptococcus pneumoniae R6
ccuaaggcuguuuca

SEQ ID NO: 2198018 - RNA, 22 nt, Streptococcus pneumoniae R6
ccuaaggcuguuucaaaugaaa

SEQ ID NO: 2198019 - RNA, 21 nt, Streptococcus pneumoniae R6
ccuaauuuuucaauaucuuua

SEQ ID NO: 2198020 - RNA, 17 nt, Streptococcus pneumoniae R6
ccuaguuugaucuuugc

SEQ ID NO: 2198021 - RNA, 13 nt, Streptococcus pneumoniae R6
ccuaguuugcucu

SEQ ID NO: 2198022 - RNA, 14 nt, Streptococcus pneumoniae R6
ccuaguuugcucuu

SEQ ID NO: 2198023 - RNA, 22 nt, Streptococcus pneumoniae R6
ccuagucagaauagauaacacc

SEQ ID NO: 2198024 - RNA, 18 nt, Streptococcus pneumoniae R6
ccuagucuacaaauucaa

SEQ ID NO: 2198025 - RNA, 19 nt, Streptococcus pneumoniae R6
ccuaugauuaaucaaauga

SEQ ID NO: 2198026 - RNA, 16 nt, Streptococcus pneumoniae R6
ccuaugauacccaaaa

SEQ ID NO: 2198027 - RNA, 21 nt, Streptococcus pneumoniae R6
ccuaucugcuauguugcaaau

SEQ ID NO: 2198028 - RNA, 18 nt, Streptococcus pneumoniae R6
ccuaucgauauaauuuuc

SEQ ID NO: 2198029 - RNA, 14 nt, Streptococcus pneumoniae R6
ccuauagaaaucug

SEQ ID NO: 2198030 - RNA, 16 nt, Streptococcus pneumoniae R6
ccuaucaacuagauca

SEQ ID NO: 2198031 - RNA, 17 nt, Streptococcus pneumoniae R6
ccuaucaacuagaucaa

SEQ ID NO: 2198032 - RNA, 17 nt, Streptococcus pneumoniae R6
ccuaucaagguuuuuga

SEQ ID NO: 2198033 - RNA, 16 nt, Streptococcus pneumoniae R6
ccuagauuacaaaaaa

SEQ ID NO: 2198034 - RNA, 22 nt, Streptococcus pneumoniae R6
ccuagauuacaaaaaaaacuac

SEQ ID NO: 2198035 - RNA, 14 nt, Streptococcus pneumoniae R6
ccuagcuuuuuccu

SEQ ID NO: 2198036 - RNA, 16 nt, Streptococcus pneumoniae R6
ccuagccuauuuuuua

SEQ ID NO: 2198037 - RNA, 19 nt, Streptococcus pneumoniae R6
ccuacuugcuucccauuua

SEQ ID NO: 2198038 - RNA, 16 nt, Streptococcus pneumoniae R6
ccuauuuauuacuuca

SEQ ID NO: 2198039 - RNA, 20 nt, Streptococcus pneumoniae R6
ccuauuuauuacuucaauuu

SEQ ID NO: 2198040 - RNA, 13 nt, Streptococcus pneumoniae R6
ccuauuuucuucu

SEQ ID NO: 2198041 - RNA, 14 nt, Streptococcus pneumoniae R6
ccucaaaauucugu

SEQ ID NO: 2198042 - RNA, 12 nt, Streptococcus pneumoniae R6
ccucaaaaacag

SEQ ID NO: 2198043 - RNA, 15 nt, Streptococcus pneumoniae R6
ccucaaaaacauguu

SEQ ID NO: 2198044 - RNA, 16 nt, Streptococcus pneumoniae R6
ccucaaaacaauguuu

SEQ ID NO: 2198045 - RNA, 16 nt, Streptococcus pneumoniae R6
ccucaaaacaguguuu

SEQ ID NO: 2198046 - RNA, 23 nt, Streptococcus pneumoniae R6
ccucaauaugcucacugaugaaa

SEQ ID NO: 2198047 - RNA, 19 nt, Streptococcus pneumoniae R6
ccucaauaucuucugcuug

SEQ ID NO: 2198048 - RNA, 12 nt, Streptococcus pneumoniae R6
ccucaauaagcc

SEQ ID NO: 2198049 - RNA, 18 nt, Streptococcus pneumoniae R6
ccucagaguaagaaagca

SEQ ID NO: 2198050 - RNA, 23 nt, Streptococcus pneumoniae R6
ccucagaguaagaaagcagcuua

SEQ ID NO: 2198051 - RNA, 17 nt, Streptococcus pneumoniae R6
ccguauauauguuacug

SEQ ID NO: 2198052 - RNA, 20 nt, Streptococcus pneumoniae R6
ccugcaaaacuagaauccua

SEQ ID NO: 2198053 - RNA, 14 nt, Streptococcus pneumoniae R6
ccugauuaaaauca

SEQ ID NO: 2198054 - RNA, 22 nt, Streptococcus pneumoniae R6
ccugaucgauuuguccuguucu

SEQ ID NO: 2198055 - RNA, 18 nt, Streptococcus pneumoniae R6
ccugacaauuuaaccaaa

SEQ ID NO: 2198056 - RNA, 23 nt, Streptococcus pneumoniae R6
ccugacaauuuaaccaaaccaac

SEQ ID NO: 2198057 - RNA, 18 nt, Streptococcus pneumoniae R6
ccugauacuaugcuuuuu

SEQ ID NO: 2198058 - RNA, 15 nt, Streptococcus pneumoniae R6
ccugauagaguuguu

SEQ ID NO: 2198059 - RNA, 23 nt, Streptococcus pneumoniae R6
ccugauaggaugccuuuuuauga

SEQ ID NO: 2198060 - RNA, 19 nt, Streptococcus pneumoniae R6
ccugauaguuuaguuauug

SEQ ID NO: 2198061 - RNA, 23 nt, Streptococcus pneumoniae R6
ccugauauuaugcguuuuuuuga

SEQ ID NO: 2198062 - RNA, 17 nt, Streptococcus pneumoniae R6
ccugauaagauuuuugg

SEQ ID NO: 2198063 - RNA, 14 nt, Streptococcus pneumoniae R6
ccugauaaaagaua

SEQ ID NO: 2198064 - RNA, 17 nt, Streptococcus pneumoniae R6
ccugauaacgaagagcu

SEQ ID NO: 2198065 - RNA, 15 nt, Streptococcus pneumoniae R6
ccugagccaucuuga

SEQ ID NO: 2198066 - RNA, 22 nt, Streptococcus pneumoniae R6
ccucagcaaaggacuaugauca

SEQ ID NO: 2198067 - RNA, 17 nt, Streptococcus pneumoniae R6
ccucauauucaagaauc

SEQ ID NO: 2198068 - RNA, 23 nt, Streptococcus pneumoniae R6
ccucauauucaagaaucgucacg

SEQ ID NO: 2198069 - RNA, 21 nt, Streptococcus pneumoniae R6
ccucgagcaguuccaucaauc

SEQ ID NO: 2198070 - RNA, 18 nt, Streptococcus pneumoniae R6
ccucuaccugccuuccaa

SEQ ID NO: 2198071 - RNA, 18 nt, Streptococcus pneumoniae R6
ccucuacaauaacacccu

SEQ ID NO: 2198072 - RNA, 22 nt, Streptococcus pneumoniae R6
ccucuacauacccaugcuuuuc

SEQ ID NO: 2198073 - RNA, 17 nt, Streptococcus pneumoniae R6
ccucuucaauuuguuuu

SEQ ID NO: 2198074 - RNA, 21 nt, Streptococcus pneumoniae R6
ccucugguaugaucuauuccu

SEQ ID NO: 2198075 - RNA, 16 nt, Streptococcus pneumoniae R6
ccucggauuuuauccg

SEQ ID NO: 2198076 - RNA, 16 nt, Streptococcus pneumoniae R6
ccucuaaauacaaaaa

SEQ ID NO: 2198077 - RNA, 20 nt, Streptococcus pneumoniae R6
ccugucuuuagcuugcaaug

SEQ ID NO: 2198078 - RNA, 23 nt, Streptococcus pneumoniae R6
ccugucuuuagcuugcaaugagc

SEQ ID NO: 2198079 - RNA, 13 nt, Streptococcus pneumoniae R6
ccuguucuuauuu

SEQ ID NO: 2198080 - RNA, 22 nt, Streptococcus pneumoniae R6
ccuguucuauagcagccuccgu

SEQ ID NO: 2198081 - RNA, 23 nt, Streptococcus pneumoniae R6
ccuguucuauagcagccuccgua

SEQ ID NO: 2198082 - RNA, 17 nt, Streptococcus pneumoniae R6
ccuguuccucaaaagga

SEQ ID NO: 2198083 - RNA, 17 nt, Streptococcus pneumoniae R6
ccuuaacccaaccacgu

SEQ ID NO: 2198084 - RNA, 20 nt, Streptococcus pneumoniae R6
ccuuaaaaccauguuuuuca

SEQ ID NO: 2198085 - RNA, 14 nt, Streptococcus pneumoniae R6
ccuuaacaucuuug

SEQ ID NO: 2198086 - RNA, 15 nt, Streptococcus pneumoniae R6
ccuuaacaucuuuga

SEQ ID NO: 2198087 - RNA, 12 nt, Streptococcus pneumoniae R6
ccuguuguauuu

SEQ ID NO: 2198088 - RNA, 19 nt, Streptococcus pneumoniae R6
ccuguuguauuuauaugcc

SEQ ID NO: 2198089 - RNA, 14 nt, Streptococcus pneumoniae R6
ccuguuuggucaga

SEQ ID NO: 2198090 - RNA, 17 nt, Streptococcus pneumoniae R6
ccuguuugaaucaauuc

SEQ ID NO: 2198091 - RNA, 22 nt, Streptococcus pneumoniae R6
ccuguuugaaucaauucuucac

SEQ ID NO: 2198092 - RNA, 12 nt, Streptococcus pneumoniae R6
ccuguuucaaag

SEQ ID NO: 2198093 - RNA, 18 nt, Streptococcus pneumoniae R6
ccuucaaucuuuugcaag

SEQ ID NO: 2198094 - RNA, 13 nt, Streptococcus pneumoniae R6
ccuucaaauccug

SEQ ID NO: 2198095 - RNA, 14 nt, Streptococcus pneumoniae R6
ccuucaaauccugc

SEQ ID NO: 2198096 - RNA, 15 nt, Streptococcus pneumoniae R6
ccuucaaauccugca

SEQ ID NO: 2198097 - RNA, 23 nt, Streptococcus pneumoniae R6
ccuucaacggcaccuucuacagc

SEQ ID NO: 2198098 - RNA, 22 nt, Streptococcus pneumoniae R6
ccuucagcuuuggcaacugcuu

SEQ ID NO: 2198099 - RNA, 13 nt, Streptococcus pneumoniae R6
ccuucagcccaac

SEQ ID NO: 2198100 - RNA, 12 nt, Streptococcus pneumoniae R6
ccuuauuuccau

SEQ ID NO: 2198101 - RNA, 12 nt, Streptococcus pneumoniae R6
ccuuauuuuuua

SEQ ID NO: 2198102 - RNA, 16 nt, Streptococcus pneumoniae R6
ccuuauugcucuugac

SEQ ID NO: 2198103 - RNA, 18 nt, Streptococcus pneumoniae R6
ccuuauauggaugauuua

SEQ ID NO: 2198104 - RNA, 16 nt, Streptococcus pneumoniae R6
ccuuauccaauucuuc

SEQ ID NO: 2198105 - RNA, 18 nt, Streptococcus pneumoniae R6
ccuuauccaauucuucag

SEQ ID NO: 2198106 - RNA, 19 nt, Streptococcus pneumoniae R6
ccuuaccguauauauguua

SEQ ID NO: 2198107 - RNA, 17 nt, Streptococcus pneumoniae R6
ccuuacuagcaaauuua

SEQ ID NO: 2198108 - RNA, 23 nt, Streptococcus pneumoniae R6
ccuuaggaaugaauuuacguuga

SEQ ID NO: 2198109 - RNA, 17 nt, Streptococcus pneumoniae R6
ccuuagucgcuacaggc

SEQ ID NO: 2198110 - RNA, 19 nt, Streptococcus pneumoniae R6
ccuuagucucaaaaucaaa

SEQ ID NO: 2198111 - RNA, 17 nt, Streptococcus pneumoniae R6
ccuuagcagacuucuuu

SEQ ID NO: 2198112 - RNA, 18 nt, Streptococcus pneumoniae R6
ccuuagcagacuucuuuu

SEQ ID NO: 2198113 - RNA, 13 nt, Streptococcus pneumoniae R6
ccugcuuuuucaa

SEQ ID NO: 2198114 - RNA, 18 nt, Streptococcus pneumoniae R6
ccugcuuuuucaagcauu

SEQ ID NO: 2198115 - RNA, 19 nt, Streptococcus pneumoniae R6
ccugcucgccccauuucuu

SEQ ID NO: 2198116 - RNA, 12 nt, Streptococcus pneumoniae R6
ccugcugcuaag

SEQ ID NO: 2198117 - RNA, 21 nt, Streptococcus pneumoniae R6
ccugcuccuccgagagcugau

SEQ ID NO: 2198118 - RNA, 21 nt, Streptococcus pneumoniae R6
ccuggaaucagaacacuucca

SEQ ID NO: 2198119 - RNA, 20 nt, Streptococcus pneumoniae R6
ccuggucuuauuucauuuca

SEQ ID NO: 2198120 - RNA, 14 nt, Streptococcus pneumoniae R6
ccugggaagaugaa

SEQ ID NO: 2198121 - RNA, 15 nt, Streptococcus pneumoniae R6
ccugggaaauuccag

SEQ ID NO: 2198122 - RNA, 21 nt, Streptococcus pneumoniae R6
cccuuuugcucggcauuguga

SEQ ID NO: 2198123 - RNA, 11 nt, Streptococcus pneumoniae R6
cccuuuaccau

SEQ ID NO: 2198124 - RNA, 13 nt, Streptococcus pneumoniae R6
cccuuuagaacuu

SEQ ID NO: 2198125 - RNA, 20 nt, Streptococcus pneumoniae R6
cccuuuagaacuugcuccaa

SEQ ID NO: 2198126 - RNA, 19 nt, Streptococcus pneumoniae R6
cccuuguuucuaaaacauu

SEQ ID NO: 2198127 - RNA, 23 nt, Streptococcus pneumoniae R6
cccuuguuucuaaaacauuguga

SEQ ID NO: 2198128 - RNA, 13 nt, Streptococcus pneumoniae R6
cccuuguucucca

SEQ ID NO: 2198129 - RNA, 18 nt, Streptococcus pneumoniae R6
cccuuggagggagcaacc

SEQ ID NO: 2198130 - RNA, 23 nt, Streptococcus pneumoniae R6
ccgauaauauauagguuuugcua

SEQ ID NO: 2198131 - RNA, 23 nt, Streptococcus pneumoniae R6
ccgauggaaauauaggccaagau

SEQ ID NO: 2198132 - RNA, 19 nt, Streptococcus pneumoniae R6
ccgauggacuuuaucaccu

SEQ ID NO: 2198133 - RNA, 21 nt, Streptococcus pneumoniae R6
ccgauggacuuuaucaccucc

SEQ ID NO: 2198134 - RNA, 13 nt, Streptococcus pneumoniae R6
ccgccagaacuuc

SEQ ID NO: 2198135 - RNA, 23 nt, Streptococcus pneumoniae R6
ccgccagaacuuccacuuccaga

SEQ ID NO: 2198136 - RNA, 20 nt, Streptococcus pneumoniae R6
ccgccaccuccgccuccaga

SEQ ID NO: 2198137 - RNA, 16 nt, Streptococcus pneumoniae R6
ccgccauacuuucucu

SEQ ID NO: 2198138 - RNA, 15 nt, Streptococcus pneumoniae R6
ccggauugcuccgau

SEQ ID NO: 2198139 - RNA, 23 nt, Streptococcus pneumoniae R6
cauuuuuuccugaagucgaguuu

SEQ ID NO: 2198140 - RNA, 17 nt, Streptococcus pneumoniae R6
cauuuuuugcaucaacu

SEQ ID NO: 2198141 - RNA, 20 nt, Streptococcus pneumoniae R6
cauuuuuuguuaguuuaaaa

SEQ ID NO: 2198142 - RNA, 23 nt, Streptococcus pneumoniae R6
ccaaaaaaaauacaguauccaca

SEQ ID NO: 2198143 - RNA, 15 nt, Streptococcus pneumoniae R6
ccaaaaaaacuccaa

SEQ ID NO: 2198144 - RNA, 17 nt, Streptococcus pneumoniae R6
ccacgaagcugacgggc

SEQ ID NO: 2198145 - RNA, 13 nt, Streptococcus pneumoniae R6
ccacgaaguccuu

SEQ ID NO: 2198146 - RNA, 18 nt, Streptococcus pneumoniae R6
ccacucaguauuacaucc

SEQ ID NO: 2198147 - RNA, 12 nt, Streptococcus pneumoniae R6
ccacucaacauu

SEQ ID NO: 2198148 - RNA, 17 nt, Streptococcus pneumoniae R6
ccacucagacagcugag

SEQ ID NO: 2198149 - RNA, 15 nt, Streptococcus pneumoniae R6
ccacuauaauaaaau

SEQ ID NO: 2198150 - RNA, 19 nt, Streptococcus pneumoniae R6
ccacuauaauaaaaugaaa

SEQ ID NO: 2198151 - RNA, 16 nt, Streptococcus pneumoniae R6
ccacugaguuuuuccc

SEQ ID NO: 2198152 - RNA, 17 nt, Streptococcus pneumoniae R6
ccacugaguuuuuccca

SEQ ID NO: 2198153 - RNA, 17 nt, Streptococcus pneumoniae R6
ccacugaaucguuggca

SEQ ID NO: 2198154 - RNA, 13 nt, Streptococcus pneumoniae R6
ccacguuuuucca

SEQ ID NO: 2198155 - RNA, 13 nt, Streptococcus pneumoniae R6
ccacuaaaaauau

SEQ ID NO: 2198156 - RNA, 21 nt, Streptococcus pneumoniae R6
ccacuaaaaauaugcuauuga

SEQ ID NO: 2198157 - RNA, 15 nt, Streptococcus pneumoniae R6
ccacuacaguugaca

SEQ ID NO: 2198158 - RNA, 14 nt, Streptococcus pneumoniae R6
ccacgucacaaaga

SEQ ID NO: 2198159 - RNA, 16 nt, Streptococcus pneumoniae R6
ccacgucagcuuuauc

SEQ ID NO: 2198160 - RNA, 16 nt, Streptococcus pneumoniae R6
ccacgcuccacuuccc

SEQ ID NO: 2198161 - RNA, 17 nt, Streptococcus pneumoniae R6
ccacgcuccacuucccc

SEQ ID NO: 2198162 - RNA, 18 nt, Streptococcus pneumoniae R6
ccacgcuccacuucccca

SEQ ID NO: 2198163 - RNA, 13 nt, Streptococcus pneumoniae R6
ccacuuccagaag

SEQ ID NO: 2198164 - RNA, 15 nt, Streptococcus pneumoniae R6
ccacuuccuaccuau

SEQ ID NO: 2198165 - RNA, 13 nt, Streptococcus pneumoniae R6
ccacuuaucauua

SEQ ID NO: 2198166 - RNA, 16 nt, Streptococcus pneumoniae R6
ccagccugccugaucu

SEQ ID NO: 2198167 - RNA, 18 nt, Streptococcus pneumoniae R6
ccagccuucauuuuacau

SEQ ID NO: 2198168 - RNA, 18 nt, Streptococcus pneumoniae R6
ccagcgauagcuccaucu

SEQ ID NO: 2198169 - RNA, 16 nt, Streptococcus pneumoniae R6
ccagcaguaucaauca

SEQ ID NO: 2198170 - RNA, 14 nt, Streptococcus pneumoniae R6
ccagauaaagcuga

SEQ ID NO: 2198171 - RNA, 13 nt, Streptococcus pneumoniae R6
ccagauauaccaa

SEQ ID NO: 2198172 - RNA, 22 nt, Streptococcus pneumoniae R6
ccagauagagcuaacuuuuccu

SEQ ID NO: 2198173 - RNA, 12 nt, Streptococcus pneumoniae R6
ccagauuaggaa

SEQ ID NO: 2198174 - RNA, 13 nt, Streptococcus pneumoniae R6
ccagauuaggaac

SEQ ID NO: 2198175 - RNA, 16 nt, Streptococcus pneumoniae R6
ccagauuaucuuccuu

SEQ ID NO: 2198176 - RNA, 21 nt, Streptococcus pneumoniae R6
ccauaccagucuccuagucua

SEQ ID NO: 2198177 - RNA, 22 nt, Streptococcus pneumoniae R6
ccauacauugauugcaagcccu

SEQ ID NO: 2198178 - RNA, 18 nt, Streptococcus pneumoniae R6
ccauaccacgaagcugac

SEQ ID NO: 2198179 - RNA, 17 nt, Streptococcus pneumoniae R6
ccaucaauacccccuua

SEQ ID NO: 2198180 - RNA, 24 nt, Streptococcus pneumoniae R6
ccaucaaggacggcuuuuaguaaa

SEQ ID NO: 2198181 - RNA, 16 nt, Streptococcus pneumoniae R6
ccaucuuuagcuccac

SEQ ID NO: 2198182 - RNA, 17 nt, Streptococcus pneumoniae R6
ccaucuuuaggaucaug

SEQ ID NO: 2198183 - RNA, 13 nt, Streptococcus pneumoniae R6
ccaucuucucacg

SEQ ID NO: 2198184 - RNA, 18 nt, Streptococcus pneumoniae R6
ccagugagaagaagggcu

SEQ ID NO: 2198185 - RNA, 16 nt, Streptococcus pneumoniae R6
ccauaaacgcaagcaa

SEQ ID NO: 2198186 - RNA, 20 nt, Streptococcus pneumoniae R6
ccauaaacgcaagcaacaaa

SEQ ID NO: 2198187 - RNA, 15 nt, Streptococcus pneumoniae R6
ccagucaucugauug

SEQ ID NO: 2198188 - RNA, 16 nt, Streptococcus pneumoniae R6
ccaguauagaccaaga

SEQ ID NO: 2198189 - RNA, 20 nt, Streptococcus pneumoniae R6
ccaguauuuuuaguucuacu

SEQ ID NO: 2198190 - RNA, 12 nt, Streptococcus pneumoniae R6
ccaguauucuuu

SEQ ID NO: 2198191 - RNA, 20 nt, Streptococcus pneumoniae R6
ccaguauucuuuuuaaauaa

SEQ ID NO: 2198192 - RNA, 22 nt, Streptococcus pneumoniae R6
ccaguauucuuuuuaaauaaau

SEQ ID NO: 2198193 - RNA, 23 nt, Streptococcus pneumoniae R6
ccagugaaaacaggaguucuuuu

SEQ ID NO: 2198194 - RNA, 19 nt, Streptococcus pneumoniae R6
ccagucccuuuuaagaguu

SEQ ID NO: 2198195 - RNA, 18 nt, Streptococcus pneumoniae R6
ccagcuauuaagaaaaau

SEQ ID NO: 2198196 - RNA, 19 nt, Streptococcus pneumoniae R6
ccagcguccagcagcuaag

SEQ ID NO: 2198197 - RNA, 20 nt, Streptococcus pneumoniae R6
ccaggcucuuucaguuuauu

SEQ ID NO: 2198198 - RNA, 22 nt, Streptococcus pneumoniae R6
ccccacgaaggacaucuucuac

SEQ ID NO: 2198199 - RNA, 19 nt, Streptococcus pneumoniae R6
cccauuugcuucaucauuu

SEQ ID NO: 2198200 - RNA, 18 nt, Streptococcus pneumoniae R6
cccauggaacuaagauuu

SEQ ID NO: 2198201 - RNA, 14 nt, Streptococcus pneumoniae R6
ccccuucuugauuu

SEQ ID NO: 2198202 - RNA, 18 nt, Streptococcus pneumoniae R6
ccccuucuugauuucguu

SEQ ID NO: 2198203 - RNA, 21 nt, Streptococcus pneumoniae R6
cccacggauuaagaguccgcu

SEQ ID NO: 2198204 - RNA, 14 nt, Streptococcus pneumoniae R6
cccaccugcuuaau

SEQ ID NO: 2198205 - RNA, 13 nt, Streptococcus pneumoniae R6
cccaccucauucc

SEQ ID NO: 2198206 - RNA, 12 nt, Streptococcus pneumoniae R6
cccaaaaaaguu

SEQ ID NO: 2198207 - RNA, 19 nt, Streptococcus pneumoniae R6
ccauuuuuugcaucaacua

SEQ ID NO: 2198208 - RNA, 16 nt, Streptococcus pneumoniae R6
ccauuuuuuaaaaagg

SEQ ID NO: 2198209 - RNA, 23 nt, Streptococcus pneumoniae R6
cccaaacaagccuuuaucugccc

SEQ ID NO: 2198210 - RNA, 14 nt, Streptococcus pneumoniae R6
ccauuucuuuucug

SEQ ID NO: 2198211 - RNA, 20 nt, Streptococcus pneumoniae R6
ccauuuggcccuaccugcuc

SEQ ID NO: 2198212 - RNA, 20 nt, Streptococcus pneumoniae R6
ccauuuucagcccagagcuu

SEQ ID NO: 2198213 - RNA, 14 nt, Streptococcus pneumoniae R6
ccauuuguucccaa

SEQ ID NO: 2198214 - RNA, 20 nt, Streptococcus pneumoniae R6
ccauuuuaaaggucaauucc

SEQ ID NO: 2198215 - RNA, 21 nt, Streptococcus pneumoniae R6
ccauuuuaaaggucaauuccu

SEQ ID NO: 2198216 - RNA, 21 nt, Streptococcus pneumoniae R6
ccaucuuuugacagucuucau

SEQ ID NO: 2198217 - RNA, 22 nt, Streptococcus pneumoniae R6
ccaucuuuugacagucuucaug

SEQ ID NO: 2198218 - RNA, 19 nt, Streptococcus pneumoniae R6
ccauuuauggaaaaaauga

SEQ ID NO: 2198219 - RNA, 13 nt, Streptococcus pneumoniae R6
cccacuaaaaaua

SEQ ID NO: 2198220 - RNA, 17 nt, Streptococcus pneumoniae R6
cccuacuguacuuacau

SEQ ID NO: 2198221 - RNA, 18 nt, Streptococcus pneumoniae R6
cccuauauuauaagacuu

SEQ ID NO: 2198222 - RNA, 23 nt, Streptococcus pneumoniae R6
cccuaucgauauaauuuuccuua

SEQ ID NO: 2198223 - RNA, 22 nt, Streptococcus pneumoniae R6
cccucaaccugaaucuccucag

SEQ ID NO: 2198224 - RNA, 14 nt, Streptococcus pneumoniae R6
cccucacaucuuca

SEQ ID NO: 2198225 - RNA, 13 nt, Streptococcus pneumoniae R6
cccuaccucauau

SEQ ID NO: 2198226 - RNA, 21 nt, Streptococcus pneumoniae R6
cccuacucgauuuuaaaucac

SEQ ID NO: 2198227 - RNA, 20 nt, Streptococcus pneumoniae R6
cgguuugaagagauuuuuga

SEQ ID NO: 2198228 - RNA, 14 nt, Streptococcus pneumoniae R6
cgguuaauuuaaag

SEQ ID NO: 2198229 - RNA, 15 nt, Streptococcus pneumoniae R6
cgguuaauuuaaaga

SEQ ID NO: 2198230 - RNA, 14 nt, Streptococcus pneumoniae R6
cguagaucaucugc

SEQ ID NO: 2198231 - RNA, 15 nt, Streptococcus pneumoniae R6
cguagcugagggcua

SEQ ID NO: 2198232 - RNA, 22 nt, Streptococcus pneumoniae R6
cguaucuuugauacaaagcucu

SEQ ID NO: 2198233 - RNA, 19 nt, Streptococcus pneumoniae R6
cguauucagucaucucugg

SEQ ID NO: 2198234 - RNA, 17 nt, Streptococcus pneumoniae R6
cgucaucgucucuucgu

SEQ ID NO: 2198235 - RNA, 20 nt, Streptococcus pneumoniae R6
cgucaguucuaucugcaacc

SEQ ID NO: 2198236 - RNA, 21 nt, Streptococcus pneumoniae R6
cgucaagaacuuuaguuugag

SEQ ID NO: 2198237 - RNA, 15 nt, Streptococcus pneumoniae R6
cgucaagaagagcuu

SEQ ID NO: 2198238 - RNA, 15 nt, Streptococcus pneumoniae R6
cgggcaauuggaacg

SEQ ID NO: 2198239 - RNA, 13 nt, Streptococcus pneumoniae R6
cggcuuucaguuu

SEQ ID NO: 2198240 - RNA, 21 nt, Streptococcus pneumoniae R6
cggcuucaucuggauuuucag

SEQ ID NO: 2198241 - RNA, 12 nt, Streptococcus pneumoniae R6
cggccuucuuuu

SEQ ID NO: 2198242 - RNA, 13 nt, Streptococcus pneumoniae R6
cgcugaguaaaga

SEQ ID NO: 2198243 - RNA, 11 nt, Streptococcus pneumoniae R6
cgcuggcauuu

SEQ ID NO: 2198244 - RNA, 16 nt, Streptococcus pneumoniae R6
cgcuggcauuucccau

SEQ ID NO: 2198245 - RNA, 20 nt, Streptococcus pneumoniae R6
cgcuggcauuucccauugca

SEQ ID NO: 2198246 - RNA, 17 nt, Streptococcus pneumoniae R6
cgcuuaaaggcucuaaa

SEQ ID NO: 2198247 - RNA, 12 nt, Streptococcus pneumoniae R6
cgcuaagagggu

SEQ ID NO: 2198248 - RNA, 12 nt, Streptococcus pneumoniae R6
cgcuauuuaaac

SEQ ID NO: 2198249 - RNA, 22 nt, Streptococcus pneumoniae R6
cgcuaucucuaggaauaucaaa

SEQ ID NO: 2198250 - RNA, 17 nt, Streptococcus pneumoniae R6
cgcggcaaauagcccau

SEQ ID NO: 2198251 - RNA, 12 nt, Streptococcus pneumoniae R6
cggcauaaaauc

SEQ ID NO: 2198252 - RNA, 14 nt, Streptococcus pneumoniae R6
cggcagacagagaa

SEQ ID NO: 2198253 - RNA, 16 nt, Streptococcus pneumoniae R6
cggaaagccaaaucaa

SEQ ID NO: 2198254 - RNA, 13 nt, Streptococcus pneumoniae R6
cggaaaggcuagg

SEQ ID NO: 2198255 - RNA, 12 nt, Streptococcus pneumoniae R6
cggauaaaagag

SEQ ID NO: 2198256 - RNA, 13 nt, Streptococcus pneumoniae R6
cggauaaaauccg

SEQ ID NO: 2198257 - RNA, 19 nt, Streptococcus pneumoniae R6
cggauaaaaccuguuugaa

SEQ ID NO: 2198258 - RNA, 14 nt, Streptococcus pneumoniae R6
cggagcuuggaaug

SEQ ID NO: 2198259 - RNA, 14 nt, Streptococcus pneumoniae R6
cggccguugauuua

SEQ ID NO: 2198260 - RNA, 19 nt, Streptococcus pneumoniae R6
cgauuaaaaguaagagaaa

SEQ ID NO: 2198261 - RNA, 16 nt, Streptococcus pneumoniae R6
cgauuaaauaguucuu

SEQ ID NO: 2198262 - RNA, 19 nt, Streptococcus pneumoniae R6
cgauuaaauaguucuucca

SEQ ID NO: 2198263 - RNA, 21 nt, Streptococcus pneumoniae R6
cgcaacacacuguuuugaggu

SEQ ID NO: 2198264 - RNA, 22 nt, Streptococcus pneumoniae R6
cgcaagguuguuagauuaugua

SEQ ID NO: 2198265 - RNA, 13 nt, Streptococcus pneumoniae R6
cgcaaguuuuucc

SEQ ID NO: 2198266 - RNA, 18 nt, Streptococcus pneumoniae R6
cgcacugucguuccuuuu

SEQ ID NO: 2198267 - RNA, 20 nt, Streptococcus pneumoniae R6
cgaugauauugcaguauauc

SEQ ID NO: 2198268 - RNA, 23 nt, Streptococcus pneumoniae R6
cgaugauuacaggcaggacaaaa

SEQ ID NO: 2198269 - RNA, 22 nt, Streptococcus pneumoniae R6
cgaugaugauuggaaugacgaa

SEQ ID NO: 2198270 - RNA, 22 nt, Streptococcus pneumoniae R6
cgaugccaugagcgucuuucuu

SEQ ID NO: 2198271 - RNA, 15 nt, Streptococcus pneumoniae R6
cgaugaagagagagu

SEQ ID NO: 2198272 - RNA, 16 nt, Streptococcus pneumoniae R6
cgaucuggcaggcuga

SEQ ID NO: 2198273 - RNA, 13 nt, Streptococcus pneumoniae R6
cgaucucaucuuc

SEQ ID NO: 2198274 - RNA, 16 nt, Streptococcus pneumoniae R6
ccuucauuaagucaua

SEQ ID NO: 2198275 - RNA, 19 nt, Streptococcus pneumoniae R6
ccuucaucucucuauaaua

SEQ ID NO: 2198276 - RNA, 17 nt, Streptococcus pneumoniae R6
ccuucaugaaauuauuu

SEQ ID NO: 2198277 - RNA, 11 nt, Streptococcus pneumoniae R6
ccuucaucagu

SEQ ID NO: 2198278 - RNA, 15 nt, Streptococcus pneumoniae R6
ccuucauaaaggaac

SEQ ID NO: 2198279 - RNA, 18 nt, Streptococcus pneumoniae R6
ccuucauacgagccgcaa

SEQ ID NO: 2198280 - RNA, 23 nt, Streptococcus pneumoniae R6
ccuucauacgagccgcaagguga

SEQ ID NO: 2198281 - RNA, 23 nt, Streptococcus pneumoniae R6
cgauaaauugcuggagaaucauc

SEQ ID NO: 2198282 - RNA, 13 nt, Streptococcus pneumoniae R6
cgauaaaaauccu

SEQ ID NO: 2198283 - RNA, 17 nt, Streptococcus pneumoniae R6
cgauaaaaauccuuuuu

SEQ ID NO: 2198284 - RNA, 13 nt, Streptococcus pneumoniae R6
cgauauagugaaa

SEQ ID NO: 2198285 - RNA, 16 nt, Streptococcus pneumoniae R6
cgauaccuucagccac

SEQ ID NO: 2198286 - RNA, 18 nt, Streptococcus pneumoniae R6
cgcauaagcaauuuuuua

SEQ ID NO: 2198287 - RNA, 12 nt, Streptococcus pneumoniae R6
cgcgaccuggau

SEQ ID NO: 2198288 - RNA, 14 nt, Streptococcus pneumoniae R6
cgcgaaacggcagc

SEQ ID NO: 2198289 - RNA, 15 nt, Streptococcus pneumoniae R6
cgcgaaacggcagcu

SEQ ID NO: 2198290 - RNA, 22 nt, Streptococcus pneumoniae R6
cgccuguaugggcaucaacagc

SEQ ID NO: 2198291 - RNA, 23 nt, Streptococcus pneumoniae R6
cgccuggagcuucaucaguucca

SEQ ID NO: 2198292 - RNA, 18 nt, Streptococcus pneumoniae R6
cgccuggauagguugcaa

SEQ ID NO: 2198293 - RNA, 13 nt, Streptococcus pneumoniae R6
cuugaaguucauu

SEQ ID NO: 2198294 - RNA, 17 nt, Streptococcus pneumoniae R6
cuugaaguucauuuucu

SEQ ID NO: 2198295 - RNA, 18 nt, Streptococcus pneumoniae R6
cuugaaguucauuuucuu

SEQ ID NO: 2198296 - RNA, 15 nt, Streptococcus pneumoniae R6
cuugaauauuuuucu

SEQ ID NO: 2198297 - RNA, 23 nt, Streptococcus pneumoniae R6
cuugaauuuacguccuuggaaga

SEQ ID NO: 2198298 - RNA, 13 nt, Streptococcus pneumoniae R6
cuugaaucuggcu

SEQ ID NO: 2198299 - RNA, 19 nt, Streptococcus pneumoniae R6
cuugaaugauaaaacauac

SEQ ID NO: 2198300 - RNA, 14 nt, Streptococcus pneumoniae R6
cuugaauuuuguga

SEQ ID NO: 2198301 - RNA, 14 nt, Streptococcus pneumoniae R6
cuugacaaagagcc

SEQ ID NO: 2198302 - RNA, 22 nt, Streptococcus pneumoniae R6
cuugacaaagagccacucuuua

SEQ ID NO: 2198303 - RNA, 14 nt, Streptococcus pneumoniae R6
cuugaauucccuua

SEQ ID NO: 2198304 - RNA, 20 nt, Streptococcus pneumoniae R6
cuugaccaacuuuaagagcu

SEQ ID NO: 2198305 - RNA, 23 nt, Streptococcus pneumoniae R6
cuugaccaaguccucaauuugaa

SEQ ID NO: 2198306 - RNA, 15 nt, Streptococcus pneumoniae R6
cuugaccaaucaauc

SEQ ID NO: 2198307 - RNA, 17 nt, Streptococcus pneumoniae R6
cuugaccaaucaaucgu

SEQ ID NO: 2198308 - RNA, 17 nt, Streptococcus pneumoniae R6
cuugaccuaaaucacuu

SEQ ID NO: 2198309 - RNA, 22 nt, Streptococcus pneumoniae R6
cuugaccagcuacuguacuucc

SEQ ID NO: 2198310 - RNA, 18 nt, Streptococcus pneumoniae R6
cuucuuuuuguauuucuu

SEQ ID NO: 2198311 - RNA, 15 nt, Streptococcus pneumoniae R6
cuugaacgacaugcg

SEQ ID NO: 2198312 - RNA, 19 nt, Streptococcus pneumoniae R6
cuugaaggggcaacucuuc

SEQ ID NO: 2198313 - RNA, 22 nt, Streptococcus pneumoniae R6
cuugaaggggcaacucuucaag

SEQ ID NO: 2198314 - RNA, 21 nt, Streptococcus pneumoniae R6
cuucuuuuuaauuauuuucaa

SEQ ID NO: 2198315 - RNA, 13 nt, Streptococcus pneumoniae R6
cuucuuuuacuuc

SEQ ID NO: 2198316 - RNA, 21 nt, Streptococcus pneumoniae R6
cuucuuuguuaagaauaucca

SEQ ID NO: 2198317 - RNA, 17 nt, Streptococcus pneumoniae R6
cuucuccaucuuaggaa

SEQ ID NO: 2198318 - RNA, 21 nt, Streptococcus pneumoniae R6
cuucuuucucaaacauuguga

SEQ ID NO: 2198319 - RNA, 22 nt, Streptococcus pneumoniae R6
cuucuuucucaaacauugugag

SEQ ID NO: 2198320 - RNA, 21 nt, Streptococcus pneumoniae R6
cuugauuuagaaccaagaucu

SEQ ID NO: 2198321 - RNA, 17 nt, Streptococcus pneumoniae R6
cuugaugaaaaaaaguu

SEQ ID NO: 2198322 - RNA, 14 nt, Streptococcus pneumoniae R6
cuugauuucguuua

SEQ ID NO: 2198323 - RNA, 20 nt, Streptococcus pneumoniae R6
cuugauuuguucucuuugca

SEQ ID NO: 2198324 - RNA, 19 nt, Streptococcus pneumoniae R6
cuugauuuucuuuaaaaaa

SEQ ID NO: 2198325 - RNA, 14 nt, Streptococcus pneumoniae R6
cuugauuuuuuccu

SEQ ID NO: 2198326 - RNA, 18 nt, Streptococcus pneumoniae R6
cuugauuuuuuuuaaaaa

SEQ ID NO: 2198327 - RNA, 15 nt, Streptococcus pneumoniae R6
cuugcaaaaaaacuu

SEQ ID NO: 2198328 - RNA, 23 nt, Streptococcus pneumoniae R6
cuugagacgaugaauaugucuag

SEQ ID NO: 2198329 - RNA, 17 nt, Streptococcus pneumoniae R6
cuugauauaguuaaaaa

SEQ ID NO: 2198330 - RNA, 20 nt, Streptococcus pneumoniae R6
cuugauauucuuaucaaauc

SEQ ID NO: 2198331 - RNA, 15 nt, Streptococcus pneumoniae R6
cuugacuagcaaugu

SEQ ID NO: 2198332 - RNA, 19 nt, Streptococcus pneumoniae R6
cuugacuauauuucuuaau

SEQ ID NO: 2198333 - RNA, 13 nt, Streptococcus pneumoniae R6
cuugagaagagcu

SEQ ID NO: 2198334 - RNA, 15 nt, Streptococcus pneumoniae R6
cuugagaagagcuuc

SEQ ID NO: 2198335 - RNA, 9 nt, Streptococcus pneumoniae R6
cuugcaauc

SEQ ID NO: 2198336 - RNA, 16 nt, Streptococcus pneumoniae R6
cuugcauagacuucaa

SEQ ID NO: 2198337 - RNA, 21 nt, Streptococcus pneumoniae R6
cuugcauagacuucaacagca

SEQ ID NO: 2198338 - RNA, 21 nt, Streptococcus pneumoniae R6
cuugcaucaaaucacguacaa

SEQ ID NO: 2198339 - RNA, 21 nt, Streptococcus pneumoniae R6
cuugcauuugggcaaucgcca

SEQ ID NO: 2198340 - RNA, 21 nt, Streptococcus pneumoniae R6
cuugcauuuuaauuucaaugu

SEQ ID NO: 2198341 - RNA, 10 nt, Streptococcus pneumoniae R6
cuugcccuuc

SEQ ID NO: 2198342 - RNA, 16 nt, Streptococcus pneumoniae R6
cuugcccuucuagagu

SEQ ID NO: 2198343 - RNA, 19 nt, Streptococcus pneumoniae R6
cuugcccuuggcuaguuca

SEQ ID NO: 2198344 - RNA, 19 nt, Streptococcus pneumoniae R6
cuugguaguugagcuggcu

SEQ ID NO: 2198345 - RNA, 20 nt, Streptococcus pneumoniae R6
cuugguaguugagcuggcuc

SEQ ID NO: 2198346 - RNA, 14 nt, Streptococcus pneumoniae R6
cuugggaaugauga

SEQ ID NO: 2198347 - RNA, 20 nt, Streptococcus pneumoniae R6
cuuggcuaauuucaagaagu

SEQ ID NO: 2198348 - RNA, 15 nt, Streptococcus pneumoniae R6
cuuggcuaguucagc

SEQ ID NO: 2198349 - RNA, 13 nt, Streptococcus pneumoniae R6
cuuggucaacaua

SEQ ID NO: 2198350 - RNA, 13 nt, Streptococcus pneumoniae R6
cuuggugagaaag

SEQ ID NO: 2198351 - RNA, 14 nt, Streptococcus pneumoniae R6
cuuggugagaaagu

SEQ ID NO: 2198352 - RNA, 16 nt, Streptococcus pneumoniae R6
cuugguguugagaaag

SEQ ID NO: 2198353 - RNA, 17 nt, Streptococcus pneumoniae R6
cuuguaugacaucuugg

SEQ ID NO: 2198354 - RNA, 15 nt, Streptococcus pneumoniae R6
cuugucaaagaguug

SEQ ID NO: 2198355 - RNA, 23 nt, Streptococcus pneumoniae R6
cuuguauccaaucucuugaacau

SEQ ID NO: 2198356 - RNA, 17 nt, Streptococcus pneumoniae R6
cuuguaguucucaauca

SEQ ID NO: 2198357 - RNA, 17 nt, Streptococcus pneumoniae R6
cuugguuugucaucguu

SEQ ID NO: 2198358 - RNA, 12 nt, Streptococcus pneumoniae R6
cuuguagaugaa

SEQ ID NO: 2198359 - RNA, 21 nt, Streptococcus pneumoniae R6
cuuguagaugaaaaauaaucg

SEQ ID NO: 2198360 - RNA, 15 nt, Streptococcus pneumoniae R6
cuuggauuauauaug

SEQ ID NO: 2198361 - RNA, 12 nt, Streptococcus pneumoniae R6
cuuggcaaaauc

SEQ ID NO: 2198362 - RNA, 13 nt, Streptococcus pneumoniae R6
cuugcuugccaug

SEQ ID NO: 2198363 - RNA, 14 nt, Streptococcus pneumoniae R6
cuuggauaccuuua

SEQ ID NO: 2198364 - RNA, 17 nt, Streptococcus pneumoniae R6
cuuggauauucaauucu

SEQ ID NO: 2198365 - RNA, 21 nt, Streptococcus pneumoniae R6
cuugcuuagucggauggaaau

SEQ ID NO: 2198366 - RNA, 15 nt, Streptococcus pneumoniae R6
cuuggccaauucuaa

SEQ ID NO: 2198367 - RNA, 16 nt, Streptococcus pneumoniae R6
cuuggccacuucccaa

SEQ ID NO: 2198368 - RNA, 15 nt, Streptococcus pneumoniae R6
cuugcgaugaugagg

SEQ ID NO: 2198369 - RNA, 22 nt, Streptococcus pneumoniae R6
cuugcgauaaagcuaaagauga

SEQ ID NO: 2198370 - RNA, 15 nt, Streptococcus pneumoniae R6
cuuucaauucuucac

SEQ ID NO: 2198371 - RNA, 20 nt, Streptococcus pneumoniae R6
cuuucaagcgaacaucucca

SEQ ID NO: 2198372 - RNA, 21 nt, Streptococcus pneumoniae R6
cuuucaagcgaacaucuccaa

SEQ ID NO: 2198373 - RNA, 21 nt, Streptococcus pneumoniae R6
cuuucaacucagcauuuucuu

SEQ ID NO: 2198374 - RNA, 11 nt, Streptococcus pneumoniae R6
cuuucaacugc

SEQ ID NO: 2198375 - RNA, 14 nt, Streptococcus pneumoniae R6
cuuucaauauguuu

SEQ ID NO: 2198376 - RNA, 19 nt, Streptococcus pneumoniae R6
cuuucaauagcauauuuuu

SEQ ID NO: 2198377 - RNA, 22 nt, Streptococcus pneumoniae R6
cuuuauuuuuucuguaaaauca

SEQ ID NO: 2198378 - RNA, 15 nt, Streptococcus pneumoniae R6
cuuuauuuucucauc

SEQ ID NO: 2198379 - RNA, 16 nt, Streptococcus pneumoniae R6
cuuuauuuucucauca

SEQ ID NO: 2198380 - RNA, 15 nt, Streptococcus pneumoniae R6
cuuucaaaccagcac

SEQ ID NO: 2198381 - RNA, 19 nt, Streptococcus pneumoniae R6
cuuucaaaccagcaccaga

SEQ ID NO: 2198382 - RNA, 18 nt, Streptococcus pneumoniae R6
cuuuagggaaauuauuua

SEQ ID NO: 2198383 - RNA, 19 nt, Streptococcus pneumoniae R6
cuuuagggaaauuauuuau

SEQ ID NO: 2198384 - RNA, 20 nt, Streptococcus pneumoniae R6
cuuuagucccagcuucuuuu

SEQ ID NO: 2198385 - RNA, 18 nt, Streptococcus pneumoniae R6
cuuuauuggcugccacac

SEQ ID NO: 2198386 - RNA, 12 nt, Streptococcus pneumoniae R6
cuuuagaacuug

SEQ ID NO: 2198387 - RNA, 21 nt, Streptococcus pneumoniae R6
cuuuagaacuugcuccaaagg

SEQ ID NO: 2198388 - RNA, 13 nt, Streptococcus pneumoniae R6
cuuuacuuguuuu

SEQ ID NO: 2198389 - RNA, 15 nt, Streptococcus pneumoniae R6
cuuuacuuguuuuag

SEQ ID NO: 2198390 - RNA, 16 nt, Streptococcus pneumoniae R6
cuuuagaaacuaugau

SEQ ID NO: 2198391 - RNA, 12 nt, Streptococcus pneumoniae R6
cuuuagaaaggu

SEQ ID NO: 2198392 - RNA, 18 nt, Streptococcus pneumoniae R6
cuuuagaaagguuuuaaa

SEQ ID NO: 2198393 - RNA, 20 nt, Streptococcus pneumoniae R6
cuuuagaaagguuuuaaaga

SEQ ID NO: 2198394 - RNA, 18 nt, Streptococcus pneumoniae R6
cuuuagauuguccucaau

SEQ ID NO: 2198395 - RNA, 16 nt, Streptococcus pneumoniae R6
cuuuagauacaccauc

SEQ ID NO: 2198396 - RNA, 14 nt, Streptococcus pneumoniae R6
cuuuagcagaugcu

SEQ ID NO: 2198397 - RNA, 19 nt, Streptococcus pneumoniae R6
cuuuacaugcgcaaaauaa

SEQ ID NO: 2198398 - RNA, 20 nt, Streptococcus pneumoniae R6
cuuuacaugcgcaaaauaau

SEQ ID NO: 2198399 - RNA, 23 nt, Streptococcus pneumoniae R6
cuuuaacuugaacuucuugacca

SEQ ID NO: 2198400 - RNA, 16 nt, Streptococcus pneumoniae R6
cuuuaaggcacuagcu

SEQ ID NO: 2198401 - RNA, 16 nt, Streptococcus pneumoniae R6
cuuuaagguacuugau

SEQ ID NO: 2198402 - RNA, 17 nt, Streptococcus pneumoniae R6
cuuuaagagcuucuuuu

SEQ ID NO: 2198403 - RNA, 22 nt, Streptococcus pneumoniae R6
cuugucgucauaccaguuuuug

SEQ ID NO: 2198404 - RNA, 14 nt, Streptococcus pneumoniae R6
cuugucguugaaaa

SEQ ID NO: 2198405 - RNA, 14 nt, Streptococcus pneumoniae R6
cuugucuaaaaaua

SEQ ID NO: 2198406 - RNA, 16 nt, Streptococcus pneumoniae R6
cuugucgauauaagaa

SEQ ID NO: 2198407 - RNA, 15 nt, Streptococcus pneumoniae R6
cuuugcauccacauc

SEQ ID NO: 2198408 - RNA, 22 nt, Streptococcus pneumoniae R6
cuuugauuuuaaugcuaauuua

SEQ ID NO: 2198409 - RNA, 15 nt, Streptococcus pneumoniae R6
cuuugcaacuggaga

SEQ ID NO: 2198410 - RNA, 16 nt, Streptococcus pneumoniae R6
cuuugauuuucauuga

SEQ ID NO: 2198411 - RNA, 22 nt, Streptococcus pneumoniae R6
cuuugauuuucauugagcuuua

SEQ ID NO: 2198412 - RNA, 17 nt, Streptococcus pneumoniae R6
cuuugauucaucuccaa

SEQ ID NO: 2198413 - RNA, 17 nt, Streptococcus pneumoniae R6
cuuugauggaguuuuca

SEQ ID NO: 2198414 - RNA, 18 nt, Streptococcus pneumoniae R6
cuuugccaguucuucaug

SEQ ID NO: 2198415 - RNA, 19 nt, Streptococcus pneumoniae R6
cuuuggaaauagcauccac

SEQ ID NO: 2198416 - RNA, 16 nt, Streptococcus pneumoniae R6
cuuugacauccuuuuc

SEQ ID NO: 2198417 - RNA, 20 nt, Streptococcus pneumoniae R6
cuuugacauccuuuucugua

SEQ ID NO: 2198418 - RNA, 14 nt, Streptococcus pneumoniae R6
cuuugagcaaccua

SEQ ID NO: 2198419 - RNA, 23 nt, Streptococcus pneumoniae R6
cuuugagauauuucuucuuuuca

SEQ ID NO: 2198420 - RNA, 17 nt, Streptococcus pneumoniae R6
cuuugagaucuuuuucg

SEQ ID NO: 2198421 - RNA, 21 nt, Streptococcus pneumoniae R6
cuuugagggcugcaaaauuuu

SEQ ID NO: 2198422 - RNA, 17 nt, Streptococcus pneumoniae R6
cuuugagguuguagaua

SEQ ID NO: 2198423 - RNA, 19 nt, Streptococcus pneumoniae R6
cuuucuaaaauaguggaaa

SEQ ID NO: 2198424 - RNA, 16 nt, Streptococcus pneumoniae R6
cuuucuaaugaguugu

SEQ ID NO: 2198425 - RNA, 21 nt, Streptococcus pneumoniae R6
cuuucugauagauuuauuuuu

SEQ ID NO: 2198426 - RNA, 13 nt, Streptococcus pneumoniae R6
cuuucugauggau

SEQ ID NO: 2198427 - RNA, 17 nt, Streptococcus pneumoniae R6
cuuucugcauccaccuu

SEQ ID NO: 2198428 - RNA, 17 nt, Streptococcus pneumoniae R6
cuuagacgguuuaccaa

SEQ ID NO: 2198429 - RNA, 14 nt, Streptococcus pneumoniae R6
cuuagcucugugca

SEQ ID NO: 2198430 - RNA, 17 nt, Streptococcus pneumoniae R6
cuuagcuuuucuucaac

SEQ ID NO: 2198431 - RNA, 18 nt, Streptococcus pneumoniae R6
cuuagucggauggaaaua

SEQ ID NO: 2198432 - RNA, 12 nt, Streptococcus pneumoniae R6
cuuagucucaaa

SEQ ID NO: 2198433 - RNA, 13 nt, Streptococcus pneumoniae R6
cuuaguuaaaaua

SEQ ID NO: 2198434 - RNA, 15 nt, Streptococcus pneumoniae R6
cuuaguuaaaauaag

SEQ ID NO: 2198435 - RNA, 16 nt, Streptococcus pneumoniae R6
cuuaguacgugacuca

SEQ ID NO: 2198436 - RNA, 21 nt, Streptococcus pneumoniae R6
cuuaguacgugacucagcuuc

SEQ ID NO: 2198437 - RNA, 16 nt, Streptococcus pneumoniae R6
cuuaggguuagauuau

SEQ ID NO: 2198438 - RNA, 15 nt, Streptococcus pneumoniae R6
cuuaccaaggcuuug

SEQ ID NO: 2198439 - RNA, 19 nt, Streptococcus pneumoniae R6
cuuaccaaggcuuugaggg

SEQ ID NO: 2198440 - RNA, 12 nt, Streptococcus pneumoniae R6
cuuaccaagucc

SEQ ID NO: 2198441 - RNA, 11 nt, Streptococcus pneumoniae R6
cuuaccacaaa

SEQ ID NO: 2198442 - RNA, 18 nt, Streptococcus pneumoniae R6
cuuagaaaaucucuucaa

SEQ ID NO: 2198443 - RNA, 22 nt, Streptococcus pneumoniae R6
cuuagaaccgaaaaucuccucu

SEQ ID NO: 2198444 - RNA, 19 nt, Streptococcus pneumoniae R6
cuuacuguccuucuuuuac

SEQ ID NO: 2198445 - RNA, 12 nt, Streptococcus pneumoniae R6
cuuaaucuguuu

SEQ ID NO: 2198446 - RNA, 16 nt, Streptococcus pneumoniae R6
cuuaaucuuuaaaagu

SEQ ID NO: 2198447 - RNA, 17 nt, Streptococcus pneumoniae R6
cuuaaucuuuaaaaguu

SEQ ID NO: 2198448 - RNA, 20 nt, Streptococcus pneumoniae R6
cuuacauuugaguuucucuu

SEQ ID NO: 2198449 - RNA, 13 nt, Streptococcus pneumoniae R6
cuuacauaauaac

SEQ ID NO: 2198450 - RNA, 20 nt, Streptococcus pneumoniae R6
cuuacauaauaaccuuccac

SEQ ID NO: 2198451 - RNA, 18 nt, Streptococcus pneumoniae R6
cuuaagugcguugauaau

SEQ ID NO: 2198452 - RNA, 20 nt, Streptococcus pneumoniae R6
cuguucgcaagauagaaccc

SEQ ID NO: 2198453 - RNA, 13 nt, Streptococcus pneumoniae R6
cuuaaauccacgu

SEQ ID NO: 2198454 - RNA, 14 nt, Streptococcus pneumoniae R6
cuguuccaccaccu

SEQ ID NO: 2198455 - RNA, 22 nt, Streptococcus pneumoniae R6
cuuaacaaaauuauuaaaauca

SEQ ID NO: 2198456 - RNA, 19 nt, Streptococcus pneumoniae R6
cuuaaauuuuauacaaauu

SEQ ID NO: 2198457 - RNA, 22 nt, Streptococcus pneumoniae R6
cuuaaccucuugaaguucauuu

SEQ ID NO: 2198458 - RNA, 15 nt, Streptococcus pneumoniae R6
cuuauaaacuguaaa

SEQ ID NO: 2198459 - RNA, 20 nt, Streptococcus pneumoniae R6
cuuaugacgaaugauaauca

SEQ ID NO: 2198460 - RNA, 14 nt, Streptococcus pneumoniae R6
cuuauaagccucuu

SEQ ID NO: 2198461 - RNA, 21 nt, Streptococcus pneumoniae R6
cuuaucuugauauucuuauca

SEQ ID NO: 2198462 - RNA, 19 nt, Streptococcus pneumoniae R6
cuuauugaugauguuuaaa

SEQ ID NO: 2198463 - RNA, 20 nt, Streptococcus pneumoniae R6
cuuauugaugauguuuaaaa

SEQ ID NO: 2198464 - RNA, 18 nt, Streptococcus pneumoniae R6
cuucaaaaucucagcuag

SEQ ID NO: 2198465 - RNA, 16 nt, Streptococcus pneumoniae R6
cuucaaaggucaaauc

SEQ ID NO: 2198466 - RNA, 22 nt, Streptococcus pneumoniae R6
cuucaaacuacgucagcuucca

SEQ ID NO: 2198467 - RNA, 20 nt, Streptococcus pneumoniae R6
cuucaaaccacgucagcguc

SEQ ID NO: 2198468 - RNA, 13 nt, Streptococcus pneumoniae R6
cuucaaaccaugu

SEQ ID NO: 2198469 - RNA, 21 nt, Streptococcus pneumoniae R6
cuucaaaccgcgucagcuuua

SEQ ID NO: 2198470 - RNA, 16 nt, Streptococcus pneumoniae R6
cuucaaauccugcauu

SEQ ID NO: 2198471 - RNA, 12 nt, Streptococcus pneumoniae R6
cuucaaauuuuu

SEQ ID NO: 2198472 - RNA, 19 nt, Streptococcus pneumoniae R6
cuucaaauuuuucauaauu

SEQ ID NO: 2198473 - RNA, 14 nt, Streptococcus pneumoniae R6
cuucaacaaaccuu

SEQ ID NO: 2198474 - RNA, 18 nt, Streptococcus pneumoniae R6
cuuauuugaacuugaauc

SEQ ID NO: 2198475 - RNA, 16 nt, Streptococcus pneumoniae R6
cuuauuucaguuuacu

SEQ ID NO: 2198476 - RNA, 13 nt, Streptococcus pneumoniae R6
cuuauuucauuug

SEQ ID NO: 2198477 - RNA, 23 nt, Streptococcus pneumoniae R6
cuuauuucauuuggcuauaaaaa

SEQ ID NO: 2198478 - RNA, 13 nt, Streptococcus pneumoniae R6
cuuauuucauuuu

SEQ ID NO: 2198479 - RNA, 10 nt, Streptococcus pneumoniae R6
cuuauuuccu

SEQ ID NO: 2198480 - RNA, 20 nt, Streptococcus pneumoniae R6
cuuauuguuguaauaaucaa

SEQ ID NO: 2198481 - RNA, 14 nt, Streptococcus pneumoniae R6
cuucacuauugaug

SEQ ID NO: 2198482 - RNA, 17 nt, Streptococcus pneumoniae R6
cuucaauaauuucuuuu

SEQ ID NO: 2198483 - RNA, 18 nt, Streptococcus pneumoniae R6
cuucaauaccaaagaagu

SEQ ID NO: 2198484 - RNA, 18 nt, Streptococcus pneumoniae R6
cuucaauacgaacaccga

SEQ ID NO: 2198485 - RNA, 21 nt, Streptococcus pneumoniae R6
cuucaaucucgcuguuuauuu

SEQ ID NO: 2198486 - RNA, 14 nt, Streptococcus pneumoniae R6
cuucaaucucugcu

SEQ ID NO: 2198487 - RNA, 18 nt, Streptococcus pneumoniae R6
cuucaauggaguaaaaaa

SEQ ID NO: 2198488 - RNA, 19 nt, Streptococcus pneumoniae R6
cuucaauggaguaaaaaaa

SEQ ID NO: 2198489 - RNA, 21 nt, Streptococcus pneumoniae R6
cuucaaguuuagcguuggaau

SEQ ID NO: 2198490 - RNA, 21 nt, Streptococcus pneumoniae R6
cuucaagggcagacauaucca

SEQ ID NO: 2198491 - RNA, 12 nt, Streptococcus pneumoniae R6
cuucaagagcuu

SEQ ID NO: 2198492 - RNA, 15 nt, Streptococcus pneumoniae R6
cuucaagaacuuuaa

SEQ ID NO: 2198493 - RNA, 15 nt, Streptococcus pneumoniae R6
cuucaacuucuauca

SEQ ID NO: 2198494 - RNA, 16 nt, Streptococcus pneumoniae R6
cuucaacuucuaucac

SEQ ID NO: 2198495 - RNA, 12 nt, Streptococcus pneumoniae R6
cuucaacucuau

SEQ ID NO: 2198496 - RNA, 16 nt, Streptococcus pneumoniae R6
cuucaacucuauuuuu

SEQ ID NO: 2198497 - RNA, 22 nt, Streptococcus pneumoniae R6
cuucaacccacuacaguugaca

SEQ ID NO: 2198498 - RNA, 17 nt, Streptococcus pneumoniae R6
cuucaacggcaccuucu

SEQ ID NO: 2198499 - RNA, 21 nt, Streptococcus pneumoniae R6
cuucaacggcaccuucuacag

SEQ ID NO: 2198500 - RNA, 23 nt, Streptococcus pneumoniae R6
cuucgaaaaucucugcaaaccac

SEQ ID NO: 2198501 - RNA, 18 nt, Streptococcus pneumoniae R6
cuucgcuuccaaucucac

SEQ ID NO: 2198502 - RNA, 19 nt, Streptococcus pneumoniae R6
cuucggaauagcucaaaag

SEQ ID NO: 2198503 - RNA, 14 nt, Streptococcus pneumoniae R6
cuucggauaaaauc

SEQ ID NO: 2198504 - RNA, 13 nt, Streptococcus pneumoniae R6
cuucuaucuucuu

SEQ ID NO: 2198505 - RNA, 22 nt, Streptococcus pneumoniae R6
cuucuagcuucauaucaaucuc

SEQ ID NO: 2198506 - RNA, 19 nt, Streptococcus pneumoniae R6
cuucuacuccgugaaguga

SEQ ID NO: 2198507 - RNA, 12 nt, Streptococcus pneumoniae R6
cuucuacuucua

SEQ ID NO: 2198508 - RNA, 13 nt, Streptococcus pneumoniae R6
cuucuaaaacauu

SEQ ID NO: 2198509 - RNA, 19 nt, Streptococcus pneumoniae R6
cuucuaaaacauucuuaca

SEQ ID NO: 2198510 - RNA, 14 nt, Streptococcus pneumoniae R6
cuucuaaaacauug

SEQ ID NO: 2198511 - RNA, 16 nt, Streptococcus pneumoniae R6
cuucuaaaacauuguu

SEQ ID NO: 2198512 - RNA, 19 nt, Streptococcus pneumoniae R6
cuucuaaaacauuguuaga

SEQ ID NO: 2198513 - RNA, 22 nt, Streptococcus pneumoniae R6
cuucuaaaacauuguuagaaau

SEQ ID NO: 2198514 - RNA, 15 nt, Streptococcus pneumoniae R6
cuucuaaggaaaaag

SEQ ID NO: 2198515 - RNA, 14 nt, Streptococcus pneumoniae R6
cuucuaacagcaug

SEQ ID NO: 2198516 - RNA, 14 nt, Streptococcus pneumoniae R6
cuucuaacauauca

SEQ ID NO: 2198517 - RNA, 15 nt, Streptococcus pneumoniae R6
cuucuaaauuaacua

SEQ ID NO: 2198518 - RNA, 20 nt, Streptococcus pneumoniae R6
cuucuacagcaccuuuugcg

SEQ ID NO: 2198519 - RNA, 15 nt, Streptococcus pneumoniae R6
cuucguuuucacaau

SEQ ID NO: 2198520 - RNA, 21 nt, Streptococcus pneumoniae R6
cuucuaaaaaggcguucaucc

SEQ ID NO: 2198521 - RNA, 20 nt, Streptococcus pneumoniae R6
cuucguuuuuacuacaaaga

SEQ ID NO: 2198522 - RNA, 19 nt, Streptococcus pneumoniae R6
cuucgugaaagacaaaggu

SEQ ID NO: 2198523 - RNA, 22 nt, Streptococcus pneumoniae R6
cuucgucuggauugaccaagcu

SEQ ID NO: 2198524 - RNA, 17 nt, Streptococcus pneumoniae R6
cuucgucguaaccuucu

SEQ ID NO: 2198525 - RNA, 13 nt, Streptococcus pneumoniae R6
cuucgucaauaau

SEQ ID NO: 2198526 - RNA, 23 nt, Streptococcus pneumoniae R6
cuucgucaauaauagcuugcaau

SEQ ID NO: 2198527 - RNA, 16 nt, Streptococcus pneumoniae R6
cuucgucagucuuauc

SEQ ID NO: 2198528 - RNA, 16 nt, Streptococcus pneumoniae R6
cuucgucaguucuauc

SEQ ID NO: 2198529 - RNA, 18 nt, Streptococcus pneumoniae R6
cuucgucaguucuaucca

SEQ ID NO: 2198530 - RNA, 22 nt, Streptococcus pneumoniae R6
cuucgucaguucuauccacaac

SEQ ID NO: 2198531 - RNA, 18 nt, Streptococcus pneumoniae R6
cuucgucaguucuaucua

SEQ ID NO: 2198532 - RNA, 15 nt, Streptococcus pneumoniae R6
cuucgucaguuucau

SEQ ID NO: 2198533 - RNA, 16 nt, Streptococcus pneumoniae R6
cuucgucaguuucauc

SEQ ID NO: 2198534 - RNA, 19 nt, Streptococcus pneumoniae R6
cuucgucaguuucauccac

SEQ ID NO: 2198535 - RNA, 20 nt, Streptococcus pneumoniae R6
cuucgucaguuucauccaca

SEQ ID NO: 2198536 - RNA, 21 nt, Streptococcus pneumoniae R6
cuucgucaguuucaucuacaa

SEQ ID NO: 2198537 - RNA, 16 nt, Streptococcus pneumoniae R6
cuucgguuaggaugua

SEQ ID NO: 2198538 - RNA, 19 nt, Streptococcus pneumoniae R6
cuucguaagauucuucugg

SEQ ID NO: 2198539 - RNA, 17 nt, Streptococcus pneumoniae R6
cuuccuuaacaucuuug

SEQ ID NO: 2198540 - RNA, 23 nt, Streptococcus pneumoniae R6
cuuccuguaagaacuuuuuaaag

SEQ ID NO: 2198541 - RNA, 22 nt, Streptococcus pneumoniae R6
cuuccuugccuucaaucuuuug

SEQ ID NO: 2198542 - RNA, 19 nt, Streptococcus pneumoniae R6
cuuccuaauuugcacuuug

SEQ ID NO: 2198543 - RNA, 23 nt, Streptococcus pneumoniae R6
cuuccuagaauaugaacauuuuc

SEQ ID NO: 2198544 - RNA, 16 nt, Streptococcus pneumoniae R6
cuucccauuuaggcua

SEQ ID NO: 2198545 - RNA, 17 nt, Streptococcus pneumoniae R6
cuuccaggaauguccuu

SEQ ID NO: 2198546 - RNA, 18 nt, Streptococcus pneumoniae R6
cuuccaauuuuugcguug

SEQ ID NO: 2198547 - RNA, 13 nt, Streptococcus pneumoniae R6
cuuccaagaccug

SEQ ID NO: 2198548 - RNA, 14 nt, Streptococcus pneumoniae R6
cuuccaagagaccu

SEQ ID NO: 2198549 - RNA, 17 nt, Streptococcus pneumoniae R6
cuuccaagagaccuuuc

SEQ ID NO: 2198550 - RNA, 22 nt, Streptococcus pneumoniae R6
cuuccaaagguugcuugauagu

SEQ ID NO: 2198551 - RNA, 17 nt, Streptococcus pneumoniae R6
cuucaucuugucuucaa

SEQ ID NO: 2198552 - RNA, 14 nt, Streptococcus pneumoniae R6
cuucagaaauuuuc

SEQ ID NO: 2198553 - RNA, 14 nt, Streptococcus pneumoniae R6
cuucaucuccuguc

SEQ ID NO: 2198554 - RNA, 17 nt, Streptococcus pneumoniae R6
cuucaucuccugucaau

SEQ ID NO: 2198555 - RNA, 20 nt, Streptococcus pneumoniae R6
cuucaucuccugucaauucc

SEQ ID NO: 2198556 - RNA, 21 nt, Streptococcus pneumoniae R6
cugccauugguguuugguuga

SEQ ID NO: 2198557 - RNA, 13 nt, Streptococcus pneumoniae R6
cugcccaaagaca

SEQ ID NO: 2198558 - RNA, 16 nt, Streptococcus pneumoniae R6
cugccagauuccugaa

SEQ ID NO: 2198559 - RNA, 15 nt, Streptococcus pneumoniae R6
cugccacaccaccug

SEQ ID NO: 2198560 - RNA, 18 nt, Streptococcus pneumoniae R6
cugccacaccaccugcca

SEQ ID NO: 2198561 - RNA, 22 nt, Streptococcus pneumoniae R6
cugcaucagaugggucaagauu

SEQ ID NO: 2198562 - RNA, 23 nt, Streptococcus pneumoniae R6
cugcaucaagaacaauuucacaa

SEQ ID NO: 2198563 - RNA, 21 nt, Streptococcus pneumoniae R6
cugcagcugcggcuuuuucuu

SEQ ID NO: 2198564 - RNA, 16 nt, Streptococcus pneumoniae R6
cugcagcuaguuuccu

SEQ ID NO: 2198565 - RNA, 21 nt, Streptococcus pneumoniae R6
cugcagccucaaaacacuguu

SEQ ID NO: 2198566 - RNA, 21 nt, Streptococcus pneumoniae R6
cugcaugcgugccuugaccaa

SEQ ID NO: 2198567 - RNA, 15 nt, Streptococcus pneumoniae R6
cugcaugaaggucuu

SEQ ID NO: 2198568 - RNA, 20 nt, Streptococcus pneumoniae R6
cugcaugaaggucuuuuguc

SEQ ID NO: 2198569 - RNA, 14 nt, Streptococcus pneumoniae R6
cugcaucguucaau

SEQ ID NO: 2198570 - RNA, 21 nt, Streptococcus pneumoniae R6
cugccaacuuacgagcacgag

SEQ ID NO: 2198571 - RNA, 16 nt, Streptococcus pneumoniae R6
cugcauuucuuuuauc

SEQ ID NO: 2198572 - RNA, 10 nt, Streptococcus pneumoniae R6
cugcaccaga

SEQ ID NO: 2198573 - RNA, 20 nt, Streptococcus pneumoniae R6
cugcacauugguucuuuuua

SEQ ID NO: 2198574 - RNA, 22 nt, Streptococcus pneumoniae R6
cugcacauugguucuuuuuacu

SEQ ID NO: 2198575 - RNA, 18 nt, Streptococcus pneumoniae R6
cugcaaccucaaaacagu

SEQ ID NO: 2198576 - RNA, 19 nt, Streptococcus pneumoniae R6
cugcaaccucaaaacagug

SEQ ID NO: 2198577 - RNA, 21 nt, Streptococcus pneumoniae R6
cugcaaccucaaaacaguguu

SEQ ID NO: 2198578 - RNA, 18 nt, Streptococcus pneumoniae R6
cugcaaccucuacaauaa

SEQ ID NO: 2198579 - RNA, 19 nt, Streptococcus pneumoniae R6
cugcaaccucuacaauaac

SEQ ID NO: 2198580 - RNA, 13 nt, Streptococcus pneumoniae R6
cugcaaccuuaaa

SEQ ID NO: 2198581 - RNA, 17 nt, Streptococcus pneumoniae R6
cugcaaccuuaaaacag

SEQ ID NO: 2198582 - RNA, 18 nt, Streptococcus pneumoniae R6
cugcaaccuuaaaacagu

SEQ ID NO: 2198583 - RNA, 23 nt, Streptococcus pneumoniae R6
cugcaccugauuucuccgcuucc

SEQ ID NO: 2198584 - RNA, 12 nt, Streptococcus pneumoniae R6
cugauuuugugc

SEQ ID NO: 2198585 - RNA, 13 nt, Streptococcus pneumoniae R6
cugauuuuuucau

SEQ ID NO: 2198586 - RNA, 15 nt, Streptococcus pneumoniae R6
cugauuuuuucauuc

SEQ ID NO: 2198587 - RNA, 15 nt, Streptococcus pneumoniae R6
cugauuuuuucuauu

SEQ ID NO: 2198588 - RNA, 13 nt, Streptococcus pneumoniae R6
cugauuuugaaaa

SEQ ID NO: 2198589 - RNA, 15 nt, Streptococcus pneumoniae R6
cugauuuugaaaauu

SEQ ID NO: 2198590 - RNA, 20 nt, Streptococcus pneumoniae R6
cugauuuugaaaauuuuucc

SEQ ID NO: 2198591 - RNA, 21 nt, Streptococcus pneumoniae R6
cugauuuuaugcguuuuucug

SEQ ID NO: 2198592 - RNA, 23 nt, Streptococcus pneumoniae R6
cugauuuuaugcguuuuucugau

SEQ ID NO: 2198593 - RNA, 17 nt, Streptococcus pneumoniae R6
cugauuccuuuuuucua

SEQ ID NO: 2198594 - RNA, 18 nt, Streptococcus pneumoniae R6
cugauucuacuuuuucaa

SEQ ID NO: 2198595 - RNA, 16 nt, Streptococcus pneumoniae R6
cugauuauguuuuaaa

SEQ ID NO: 2198596 - RNA, 19 nt, Streptococcus pneumoniae R6
cugauuauguuuuaaauaa

SEQ ID NO: 2198597 - RNA, 14 nt, Streptococcus pneumoniae R6
cugauguaacuguu

SEQ ID NO: 2198598 - RNA, 19 nt, Streptococcus pneumoniae R6
cugaugccaucuucguaac

SEQ ID NO: 2198599 - RNA, 21 nt, Streptococcus pneumoniae R6
cugaugaagggcuuuucuauc

SEQ ID NO: 2198600 - RNA, 23 nt, Streptococcus pneumoniae R6
cugaugaagggcuuuucuaucac

SEQ ID NO: 2198601 - RNA, 16 nt, Streptococcus pneumoniae R6
cugaugaagucaaguc

SEQ ID NO: 2198602 - RNA, 19 nt, Streptococcus pneumoniae R6
cugaugaaccuucaucaaa

SEQ ID NO: 2198603 - RNA, 20 nt, Streptococcus pneumoniae R6
cugaugaacggagauaguac

SEQ ID NO: 2198604 - RNA, 17 nt, Streptococcus pneumoniae R6
cugaugcaacaaguugu

SEQ ID NO: 2198605 - RNA, 16 nt, Streptococcus pneumoniae R6
cugaugagagaucuag

SEQ ID NO: 2198606 - RNA, 17 nt, Streptococcus pneumoniae R6
cugaugagagaucuaga

SEQ ID NO: 2198607 - RNA, 18 nt, Streptococcus pneumoniae R6
cugaugagagaucuagau

SEQ ID NO: 2198608 - RNA, 22 nt, Streptococcus pneumoniae R6
cugcgacaaaauugauaauagu

SEQ ID NO: 2198609 - RNA, 18 nt, Streptococcus pneumoniae R6
cugccgccauacuuucuc

SEQ ID NO: 2198610 - RNA, 21 nt, Streptococcus pneumoniae R6
cugcucucaagaacaguuaug

SEQ ID NO: 2198611 - RNA, 15 nt, Streptococcus pneumoniae R6
cugcgucugucuuga

SEQ ID NO: 2198612 - RNA, 23 nt, Streptococcus pneumoniae R6
cugcuccauaggcagcuuguucu

SEQ ID NO: 2198613 - RNA, 16 nt, Streptococcus pneumoniae R6
cugcuccuccgagagc

SEQ ID NO: 2198614 - RNA, 13 nt, Streptococcus pneumoniae R6
cugcuccuccgcc

SEQ ID NO: 2198615 - RNA, 22 nt, Streptococcus pneumoniae R6
cugcugccacugggauuacaua

SEQ ID NO: 2198616 - RNA, 16 nt, Streptococcus pneumoniae R6
cugcugccaauugcuc

SEQ ID NO: 2198617 - RNA, 15 nt, Streptococcus pneumoniae R6
cuggauuuucagccu

SEQ ID NO: 2198618 - RNA, 18 nt, Streptococcus pneumoniae R6
cuggauuuucagccucua

SEQ ID NO: 2198619 - RNA, 15 nt, Streptococcus pneumoniae R6
cuggauugccaacaa

SEQ ID NO: 2198620 - RNA, 19 nt, Streptococcus pneumoniae R6
cuggauugccaacaaacau

SEQ ID NO: 2198621 - RNA, 20 nt, Streptococcus pneumoniae R6
cuggaucuagauaguaccau

SEQ ID NO: 2198622 - RNA, 16 nt, Streptococcus pneumoniae R6
cuggaugauucuuuuc

SEQ ID NO: 2198623 - RNA, 21 nt, Streptococcus pneumoniae R6
cugcuucagauuguccucaau

SEQ ID NO: 2198624 - RNA, 15 nt, Streptococcus pneumoniae R6
cugcuuccauuucca

SEQ ID NO: 2198625 - RNA, 16 nt, Streptococcus pneumoniae R6
cugcuuccauuuccac

SEQ ID NO: 2198626 - RNA, 21 nt, Streptococcus pneumoniae R6
cugcuuccauuuccacagccu

SEQ ID NO: 2198627 - RNA, 15 nt, Streptococcus pneumoniae R6
cugcuucgauaacaa

SEQ ID NO: 2198628 - RNA, 23 nt, Streptococcus pneumoniae R6
cuggauagguugcaaagaguuuu

SEQ ID NO: 2198629 - RNA, 15 nt, Streptococcus pneumoniae R6
cuggauauccuuuuc

SEQ ID NO: 2198630 - RNA, 15 nt, Streptococcus pneumoniae R6
cuggaucagcuuuuu

SEQ ID NO: 2198631 - RNA, 18 nt, Streptococcus pneumoniae R6
cuggaucagcuuuuucag

SEQ ID NO: 2198632 - RNA, 23 nt, Streptococcus pneumoniae R6
cuggcagauagagacauaaucaa

SEQ ID NO: 2198633 - RNA, 15 nt, Streptococcus pneumoniae R6
cuggcagauagaugg

SEQ ID NO: 2198634 - RNA, 21 nt, Streptococcus pneumoniae R6
cugggcaccugucuugaccaa

SEQ ID NO: 2198635 - RNA, 20 nt, Streptococcus pneumoniae R6
cuggcuacagaugcugcauu

SEQ ID NO: 2198636 - RNA, 14 nt, Streptococcus pneumoniae R6
cuggcuauuuuuau

SEQ ID NO: 2198637 - RNA, 22 nt, Streptococcus pneumoniae R6
cuggcuaauaauuccagauugu

SEQ ID NO: 2198638 - RNA, 18 nt, Streptococcus pneumoniae R6
cuggcuugaggucccaug

SEQ ID NO: 2198639 - RNA, 13 nt, Streptococcus pneumoniae R6
cuggcucuuuguc

SEQ ID NO: 2198640 - RNA, 19 nt, Streptococcus pneumoniae R6
cuggugucguugaaugaaa

SEQ ID NO: 2198641 - RNA, 14 nt, Streptococcus pneumoniae R6
cugguaaaagagca

SEQ ID NO: 2198642 - RNA, 19 nt, Streptococcus pneumoniae R6
cugguaaaagagcaagaac

SEQ ID NO: 2198643 - RNA, 13 nt, Streptococcus pneumoniae R6
cugguaaagacuc

SEQ ID NO: 2198644 - RNA, 15 nt, Streptococcus pneumoniae R6
cuggugugauuuucc

SEQ ID NO: 2198645 - RNA, 16 nt, Streptococcus pneumoniae R6
cuggugugauuuuccu

SEQ ID NO: 2198646 - RNA, 17 nt, Streptococcus pneumoniae R6
cuggugugauuuuccug

SEQ ID NO: 2198647 - RNA, 20 nt, Streptococcus pneumoniae R6
cugguuaauuaauuuauuua

SEQ ID NO: 2198648 - RNA, 19 nt, Streptococcus pneumoniae R6
cuguauaggucuggcuauu

SEQ ID NO: 2198649 - RNA, 15 nt, Streptococcus pneumoniae R6
cuguaucgaaacauu

SEQ ID NO: 2198650 - RNA, 21 nt, Streptococcus pneumoniae R6
cuguaucgaaacauucaaauc

SEQ ID NO: 2198651 - RNA, 15 nt, Streptococcus pneumoniae R6
cuguaucgaccucua

SEQ ID NO: 2198652 - RNA, 14 nt, Streptococcus pneumoniae R6
cuguauacuuuuuc

SEQ ID NO: 2198653 - RNA, 17 nt, Streptococcus pneumoniae R6
cugucauuuuuuccaau

SEQ ID NO: 2198654 - RNA, 20 nt, Streptococcus pneumoniae R6
cuguacuagggcauuuugac

SEQ ID NO: 2198655 - RNA, 14 nt, Streptococcus pneumoniae R6
cuguacgguaauca

SEQ ID NO: 2198656 - RNA, 21 nt, Streptococcus pneumoniae R6
cuguaauaugaacaaaaccug

SEQ ID NO: 2198657 - RNA, 22 nt, Streptococcus pneumoniae R6
cuguaauaugaacaaaaccugg

SEQ ID NO: 2198658 - RNA, 19 nt, Streptococcus pneumoniae R6
cuguaagucauuuucuuuu

SEQ ID NO: 2198659 - RNA, 20 nt, Streptococcus pneumoniae R6
cuguaagaacuuuuuaaagu

SEQ ID NO: 2198660 - RNA, 19 nt, Streptococcus pneumoniae R6
cuguagaguuuugguugau

SEQ ID NO: 2198661 - RNA, 15 nt, Streptococcus pneumoniae R6
cuguacuuagccaag

SEQ ID NO: 2198662 - RNA, 21 nt, Streptococcus pneumoniae R6
cugugauaaugguugggaagg

SEQ ID NO: 2198663 - RNA, 17 nt, Streptococcus pneumoniae R6
cugugaccggcuuccua

SEQ ID NO: 2198664 - RNA, 17 nt, Streptococcus pneumoniae R6
cugucuugcugucucca

SEQ ID NO: 2198665 - RNA, 10 nt, Streptococcus pneumoniae R6
cugugaaaau

SEQ ID NO: 2198666 - RNA, 19 nt, Streptococcus pneumoniae R6
cugucuuagacuuucucac

SEQ ID NO: 2198667 - RNA, 21 nt, Streptococcus pneumoniae R6
cuguccuuaucgauuuguccu

SEQ ID NO: 2198668 - RNA, 14 nt, Streptococcus pneumoniae R6
cuguccuucuuuua

SEQ ID NO: 2198669 - RNA, 15 nt, Streptococcus pneumoniae R6
cuguccuaggucuag

SEQ ID NO: 2198670 - RNA, 14 nt, Streptococcus pneumoniae R6
cugugccagccaua

SEQ ID NO: 2198671 - RNA, 17 nt, Streptococcus pneumoniae R6
cugugcaauacagaacu

SEQ ID NO: 2198672 - RNA, 14 nt, Streptococcus pneumoniae R6
cugugauuuucuua

SEQ ID NO: 2198673 - RNA, 19 nt, Streptococcus pneumoniae R6
cugugauuuucuuaucacg

SEQ ID NO: 2198674 - RNA, 21 nt, Streptococcus pneumoniae R6
cugugauuucuaaaacauugu

SEQ ID NO: 2198675 - RNA, 13 nt, Streptococcus pneumoniae R6
cuguuaauaacuc

SEQ ID NO: 2198676 - RNA, 14 nt, Streptococcus pneumoniae R6
cuguuaauaacucu

SEQ ID NO: 2198677 - RNA, 20 nt, Streptococcus pneumoniae R6
cuguuaauaacucucaucua

SEQ ID NO: 2198678 - RNA, 20 nt, Streptococcus pneumoniae R6
cuguuaccacaggagcugga

SEQ ID NO: 2198679 - RNA, 19 nt, Streptococcus pneumoniae R6
cugugugugggcuuuuuuc

SEQ ID NO: 2198680 - RNA, 12 nt, Streptococcus pneumoniae R6
cuguuaaaaaau

SEQ ID NO: 2198681 - RNA, 15 nt, Streptococcus pneumoniae R6
cuguuaaaaacucag

SEQ ID NO: 2198682 - RNA, 15 nt, Streptococcus pneumoniae R6
cuguuccaaagaagu

SEQ ID NO: 2198683 - RNA, 18 nt, Streptococcus pneumoniae R6
cuguguagcacuuuucca

SEQ ID NO: 2198684 - RNA, 11 nt, Streptococcus pneumoniae R6
cuguggaauau

SEQ ID NO: 2198685 - RNA, 18 nt, Streptococcus pneumoniae R6
cuccgugaagugaaagga

SEQ ID NO: 2198686 - RNA, 13 nt, Streptococcus pneumoniae R6
cuccguaccaaca

SEQ ID NO: 2198687 - RNA, 15 nt, Streptococcus pneumoniae R6
cuccgcuuuuaucaa

SEQ ID NO: 2198688 - RNA, 16 nt, Streptococcus pneumoniae R6
cuccugaauuagcaau

SEQ ID NO: 2198689 - RNA, 17 nt, Streptococcus pneumoniae R6
cuccgauaauuauuuuu

SEQ ID NO: 2198690 - RNA, 15 nt, Streptococcus pneumoniae R6
cuccgccuccagaga

SEQ ID NO: 2198691 - RNA, 18 nt, Streptococcus pneumoniae R6
cuccgauguauuugaggu

SEQ ID NO: 2198692 - RNA, 16 nt, Streptococcus pneumoniae R6
cuccaccauaguguuu

SEQ ID NO: 2198693 - RNA, 22 nt, Streptococcus pneumoniae R6
cuccccuuuagaacuugcucca

SEQ ID NO: 2198694 - RNA, 20 nt, Streptococcus pneumoniae R6
cuccuuaaauuuuauacaaa

SEQ ID NO: 2198695 - RNA, 13 nt, Streptococcus pneumoniae R6
cuccuuaauagug

SEQ ID NO: 2198696 - RNA, 16 nt, Streptococcus pneumoniae R6
cuccuuagcucagcug

SEQ ID NO: 2198697 - RNA, 13 nt, Streptococcus pneumoniae R6
cuccugugcucca

SEQ ID NO: 2198698 - RNA, 12 nt, Streptococcus pneumoniae R6
cuccuucaaguu

SEQ ID NO: 2198699 - RNA, 15 nt, Streptococcus pneumoniae R6
cuccuuaucaaaauc

SEQ ID NO: 2198700 - RNA, 19 nt, Streptococcus pneumoniae R6
cuccuugccgauugauuua

SEQ ID NO: 2198701 - RNA, 17 nt, Streptococcus pneumoniae R6
cuccuuuaacauuugag

SEQ ID NO: 2198702 - RNA, 11 nt, Streptococcus pneumoniae R6
cuccuucuuuu

SEQ ID NO: 2198703 - RNA, 16 nt, Streptococcus pneumoniae R6
cuccuucuccaauccu

SEQ ID NO: 2198704 - RNA, 16 nt, Streptococcus pneumoniae R6
cuccuucuccaguccu

SEQ ID NO: 2198705 - RNA, 11 nt, Streptococcus pneumoniae R6
cuccuuuagug

SEQ ID NO: 2198706 - RNA, 13 nt, Streptococcus pneumoniae R6
cucgaucugaaug

SEQ ID NO: 2198707 - RNA, 20 nt, Streptococcus pneumoniae R6
cucgagcaguuccaucaauc

SEQ ID NO: 2198708 - RNA, 19 nt, Streptococcus pneumoniae R6
cucgagcuuagcuuuucuu

SEQ ID NO: 2198709 - RNA, 12 nt, Streptococcus pneumoniae R6
cucuaaccaccu

SEQ ID NO: 2198710 - RNA, 12 nt, Streptococcus pneumoniae R6
cucuaacuucug

SEQ ID NO: 2198711 - RNA, 13 nt, Streptococcus pneumoniae R6
cucuaacuguauu

SEQ ID NO: 2198712 - RNA, 16 nt, Streptococcus pneumoniae R6
cucuagccggauuuau

SEQ ID NO: 2198713 - RNA, 16 nt, Streptococcus pneumoniae R6
cucuaggaauaucaaa

SEQ ID NO: 2198714 - RNA, 20 nt, Streptococcus pneumoniae R6
cucguagcggauuuucaaaa

SEQ ID NO: 2198715 - RNA, 19 nt, Streptococcus pneumoniae R6
cucgcgacaacagcuugga

SEQ ID NO: 2198716 - RNA, 14 nt, Streptococcus pneumoniae R6
cucggccuucuuuu

SEQ ID NO: 2198717 - RNA, 14 nt, Streptococcus pneumoniae R6
cucugccuuccuug

SEQ ID NO: 2198718 - RNA, 15 nt, Streptococcus pneumoniae R6
cucugccuuccuugu

SEQ ID NO: 2198719 - RNA, 17 nt, Streptococcus pneumoniae R6
cucugcugcgucugucu

SEQ ID NO: 2198720 - RNA, 23 nt, Streptococcus pneumoniae R6
cucugagauacuccaaaacaucu

SEQ ID NO: 2198721 - RNA, 21 nt, Streptococcus pneumoniae R6
cucugaggaaucaaucuucaa

SEQ ID NO: 2198722 - RNA, 16 nt, Streptococcus pneumoniae R6
cucugacgagaaauag

SEQ ID NO: 2198723 - RNA, 18 nt, Streptococcus pneumoniae R6
cucugaauggccuccuuc

SEQ ID NO: 2198724 - RNA, 22 nt, Streptococcus pneumoniae R6
cucucuuuuuugauguucaaag

SEQ ID NO: 2198725 - RNA, 19 nt, Streptococcus pneumoniae R6
cucugaaaacaaguucuuu

SEQ ID NO: 2198726 - RNA, 20 nt, Streptococcus pneumoniae R6
cucugaaaacaaguucuuuu

SEQ ID NO: 2198727 - RNA, 13 nt, Streptococcus pneumoniae R6
cucuccuuaucaa

SEQ ID NO: 2198728 - RNA, 14 nt, Streptococcus pneumoniae R6
cucuccuccauaaa

SEQ ID NO: 2198729 - RNA, 14 nt, Streptococcus pneumoniae R6
cucuccuccccuuu

SEQ ID NO: 2198730 - RNA, 15 nt, Streptococcus pneumoniae R6
cucucggucuuguuu

SEQ ID NO: 2198731 - RNA, 14 nt, Streptococcus pneumoniae R6
cucucuucaaauuu

SEQ ID NO: 2198732 - RNA, 18 nt, Streptococcus pneumoniae R6
cucucugcggauaucuga

SEQ ID NO: 2198733 - RNA, 20 nt, Streptococcus pneumoniae R6
cucucuauaauaacuccgaa

SEQ ID NO: 2198734 - RNA, 12 nt, Streptococcus pneumoniae R6
cucucuaauucc

SEQ ID NO: 2198735 - RNA, 20 nt, Streptococcus pneumoniae R6
cucucuaauucccuuaaagu

SEQ ID NO: 2198736 - RNA, 20 nt, Streptococcus pneumoniae R6
cucucagaaccuggucauga

SEQ ID NO: 2198737 - RNA, 15 nt, Streptococcus pneumoniae R6
cucuauacuuacuaa

SEQ ID NO: 2198738 - RNA, 16 nt, Streptococcus pneumoniae R6
cucuauacacauccag

SEQ ID NO: 2198739 - RNA, 16 nt, Streptococcus pneumoniae R6
cucuaguuuuuauaau

SEQ ID NO: 2198740 - RNA, 17 nt, Streptococcus pneumoniae R6
cucucauucaucaccac

SEQ ID NO: 2198741 - RNA, 20 nt, Streptococcus pneumoniae R6
cucuccaaccgucaaucugu

SEQ ID NO: 2198742 - RNA, 12 nt, Streptococcus pneumoniae R6
cugacauucuuu

SEQ ID NO: 2198743 - RNA, 13 nt, Streptococcus pneumoniae R6
cugacauucuuua

SEQ ID NO: 2198744 - RNA, 12 nt, Streptococcus pneumoniae R6
cugacauugaag

SEQ ID NO: 2198745 - RNA, 15 nt, Streptococcus pneumoniae R6
cugacagcauuggag

SEQ ID NO: 2198746 - RNA, 24 nt, Streptococcus pneumoniae R6
cugaauguuucccuugcuagucau

SEQ ID NO: 2198747 - RNA, 14 nt, Streptococcus pneumoniae R6
cugaaugcuuucca

SEQ ID NO: 2198748 - RNA, 15 nt, Streptococcus pneumoniae R6
cugaaugcuuuccaa

SEQ ID NO: 2198749 - RNA, 19 nt, Streptococcus pneumoniae R6
cugaaugucguauucgucu

SEQ ID NO: 2198750 - RNA, 20 nt, Streptococcus pneumoniae R6
cugaauggccuccuucauua

SEQ ID NO: 2198751 - RNA, 20 nt, Streptococcus pneumoniae R6
cugaaucugccucaagaagu

SEQ ID NO: 2198752 - RNA, 16 nt, Streptococcus pneumoniae R6
cugaaucguuggcaaa

SEQ ID NO: 2198753 - RNA, 23 nt, Streptococcus pneumoniae R6
cugaaucauaggcauaguaccag

SEQ ID NO: 2198754 - RNA, 17 nt, Streptococcus pneumoniae R6
cugaauauccuuauaua

SEQ ID NO: 2198755 - RNA, 22 nt, Streptococcus pneumoniae R6
cugaaggaaugccaaagacaaa

SEQ ID NO: 2198756 - RNA, 18 nt, Streptococcus pneumoniae R6
cugaagucgaguuuuuuc

SEQ ID NO: 2198757 - RNA, 14 nt, Streptococcus pneumoniae R6
cugacuaucuuguu

SEQ ID NO: 2198758 - RNA, 15 nt, Streptococcus pneumoniae R6
cugacuagcaucuug

SEQ ID NO: 2198759 - RNA, 21 nt, Streptococcus pneumoniae R6
cugacgugguugaugagauuu

SEQ ID NO: 2198760 - RNA, 23 nt, Streptococcus pneumoniae R6
cugacgugguuugcagagauuuu

SEQ ID NO: 2198761 - RNA, 23 nt, Streptococcus pneumoniae R6
cugacguaguuugaagagauuuu

SEQ ID NO: 2198762 - RNA, 14 nt, Streptococcus pneumoniae R6
cugacgaagucagc

SEQ ID NO: 2198763 - RNA, 18 nt, Streptococcus pneumoniae R6
cugacgaagucagcucaa

SEQ ID NO: 2198764 - RNA, 14 nt, Streptococcus pneumoniae R6
cugacgaagucagu

SEQ ID NO: 2198765 - RNA, 18 nt, Streptococcus pneumoniae R6
cugacgcgaucuggcagg

SEQ ID NO: 2198766 - RNA, 21 nt, Streptococcus pneumoniae R6
cugacuucgucaguuccaucu

SEQ ID NO: 2198767 - RNA, 18 nt, Streptococcus pneumoniae R6
cugacuucgucaguucua

SEQ ID NO: 2198768 - RNA, 20 nt, Streptococcus pneumoniae R6
cugacuucgucaguucuauc

SEQ ID NO: 2198769 - RNA, 21 nt, Streptococcus pneumoniae R6
cugacuucgucaguucuaucu

SEQ ID NO: 2198770 - RNA, 19 nt, Streptococcus pneumoniae R6
cugacuucgucaguuucau

SEQ ID NO: 2198771 - RNA, 21 nt, Streptococcus pneumoniae R6
cugagaagacaucuucucagg

SEQ ID NO: 2198772 - RNA, 22 nt, Streptococcus pneumoniae R6
cugagaagacaucuucucaggc

SEQ ID NO: 2198773 - RNA, 13 nt, Streptococcus pneumoniae R6
cugacuuuuccac

SEQ ID NO: 2198774 - RNA, 21 nt, Streptococcus pneumoniae R6
cugagacucauuuaaaauuaa

SEQ ID NO: 2198775 - RNA, 13 nt, Streptococcus pneumoniae R6
cugagauacucca

SEQ ID NO: 2198776 - RNA, 16 nt, Streptococcus pneumoniae R6
cugagaugaggcgcuc

SEQ ID NO: 2198777 - RNA, 18 nt, Streptococcus pneumoniae R6
cugagauggauuuuccuu

SEQ ID NO: 2198778 - RNA, 19 nt, Streptococcus pneumoniae R6
cugagauggauuuuccuuu

SEQ ID NO: 2198779 - RNA, 15 nt, Streptococcus pneumoniae R6
cugagaucuucuucu

SEQ ID NO: 2198780 - RNA, 16 nt, Streptococcus pneumoniae R6
cugagaucuucuucua

SEQ ID NO: 2198781 - RNA, 19 nt, Streptococcus pneumoniae R6
cugagaucuucuucuagaa

SEQ ID NO: 2198782 - RNA, 18 nt, Streptococcus pneumoniae R6
cucuuauuguauaguaga

SEQ ID NO: 2198783 - RNA, 22 nt, Streptococcus pneumoniae R6
cucuuauuguauaguagauuga

SEQ ID NO: 2198784 - RNA, 21 nt, Streptococcus pneumoniae R6
cucuucaaaccacgucagcgu

SEQ ID NO: 2198785 - RNA, 20 nt, Streptococcus pneumoniae R6
cucuucaaaaaucucuucaa

SEQ ID NO: 2198786 - RNA, 19 nt, Streptococcus pneumoniae R6
cucuuaucuguccucgcaa

SEQ ID NO: 2198787 - RNA, 20 nt, Streptococcus pneumoniae R6
cucuuacaagucguucggcu

SEQ ID NO: 2198788 - RNA, 14 nt, Streptococcus pneumoniae R6
cucuuagaccaagu

SEQ ID NO: 2198789 - RNA, 19 nt, Streptococcus pneumoniae R6
cucuuaauaucagccagag

SEQ ID NO: 2198790 - RNA, 23 nt, Streptococcus pneumoniae R6
cucuuaauccgugggucacaggu

SEQ ID NO: 2198791 - RNA, 17 nt, Streptococcus pneumoniae R6
cucugucacaaagaguu

SEQ ID NO: 2198792 - RNA, 13 nt, Streptococcus pneumoniae R6
cucugugcaauac

SEQ ID NO: 2198793 - RNA, 14 nt, Streptococcus pneumoniae R6
cucugugcaauaca

SEQ ID NO: 2198794 - RNA, 18 nt, Streptococcus pneumoniae R6
cucuguuaccacaggagc

SEQ ID NO: 2198795 - RNA, 11 nt, Streptococcus pneumoniae R6
cucuucaaucu

SEQ ID NO: 2198796 - RNA, 23 nt, Streptococcus pneumoniae R6
cucuucagcaaaacgcugcucaa

SEQ ID NO: 2198797 - RNA, 22 nt, Streptococcus pneumoniae R6
cucuucgaaaaucucuucaauc

SEQ ID NO: 2198798 - RNA, 20 nt, Streptococcus pneumoniae R6
cucuuuacaugcgcaaaaua

SEQ ID NO: 2198799 - RNA, 23 nt, Streptococcus pneumoniae R6
cucuuuacaugcgcaaaauaauu

SEQ ID NO: 2198800 - RNA, 14 nt, Streptococcus pneumoniae R6
cucuuuauuccaug

SEQ ID NO: 2198801 - RNA, 22 nt, Streptococcus pneumoniae R6
cucuuuagucccagcuucuuuu

SEQ ID NO: 2198802 - RNA, 15 nt, Streptococcus pneumoniae R6
cucuuucaguuucau

SEQ ID NO: 2198803 - RNA, 13 nt, Streptococcus pneumoniae R6
cucuuucaaaagg

SEQ ID NO: 2198804 - RNA, 10 nt, Streptococcus pneumoniae R6
cucuuguccu

SEQ ID NO: 2198805 - RNA, 14 nt, Streptococcus pneumoniae R6
cucuugucuuacuu

SEQ ID NO: 2198806 - RNA, 12 nt, Streptococcus pneumoniae R6
cucuugaaaaug

SEQ ID NO: 2198807 - RNA, 12 nt, Streptococcus pneumoniae R6
cucuugaacaua

SEQ ID NO: 2198808 - RNA, 19 nt, Streptococcus pneumoniae R6
cucuugaagacuuuuuaaa

SEQ ID NO: 2198809 - RNA, 20 nt, Streptococcus pneumoniae R6
cucuugaagacuuuuuaaag

SEQ ID NO: 2198810 - RNA, 21 nt, Streptococcus pneumoniae R6
cucuucugguuugugcucaau

SEQ ID NO: 2198811 - RNA, 19 nt, Streptococcus pneumoniae R6
cucuucugaugcaacaagu

SEQ ID NO: 2198812 - RNA, 22 nt, Streptococcus pneumoniae R6
cucuucugaugcaacaaguugu

SEQ ID NO: 2198813 - RNA, 16 nt, Streptococcus pneumoniae R6
cucuucugaaaucuua

SEQ ID NO: 2198814 - RNA, 14 nt, Streptococcus pneumoniae R6
cugaacaaugaaaa

SEQ ID NO: 2198815 - RNA, 15 nt, Streptococcus pneumoniae R6
cugaacaaugaaaaa

SEQ ID NO: 2198816 - RNA, 19 nt, Streptococcus pneumoniae R6
cugaacaagacgaaccaau

SEQ ID NO: 2198817 - RNA, 16 nt, Streptococcus pneumoniae R6
cugaaaucuuagauac

SEQ ID NO: 2198818 - RNA, 12 nt, Streptococcus pneumoniae R6
cugaacaaauua

SEQ ID NO: 2198819 - RNA, 22 nt, Streptococcus pneumoniae R6
cugaaccaagguugcagcgaga

SEQ ID NO: 2198820 - RNA, 20 nt, Streptococcus pneumoniae R6
cugaacccuugucuacauuc

SEQ ID NO: 2198821 - RNA, 18 nt, Streptococcus pneumoniae R6
cugaagcauauuccacau

SEQ ID NO: 2198822 - RNA, 18 nt, Streptococcus pneumoniae R6
cugaacucaacuuccuua

SEQ ID NO: 2198823 - RNA, 16 nt, Streptococcus pneumoniae R6
cugaacgcuagcuacu

SEQ ID NO: 2198824 - RNA, 18 nt, Streptococcus pneumoniae R6
cugaacggugaacuucuu

SEQ ID NO: 2198825 - RNA, 20 nt, Streptococcus pneumoniae R6
cugaacggugaacuucuuca

SEQ ID NO: 2198826 - RNA, 11 nt, Streptococcus pneumoniae R6
cugaaagugaa

SEQ ID NO: 2198827 - RNA, 14 nt, Streptococcus pneumoniae R6
cugaaagugaaaaa

SEQ ID NO: 2198828 - RNA, 15 nt, Streptococcus pneumoniae R6
cugaaagugaaaaag

SEQ ID NO: 2198829 - RNA, 19 nt, Streptococcus pneumoniae R6
cugaaacaacaucuuucca

SEQ ID NO: 2198830 - RNA, 15 nt, Streptococcus pneumoniae R6
cugaaaaucaucugc

SEQ ID NO: 2198831 - RNA, 12 nt, Streptococcus pneumoniae R6
cugaaaaucauc

SEQ ID NO: 2198832 - RNA, 13 nt, Streptococcus pneumoniae R6
cugaaaaauuaac

SEQ ID NO: 2198833 - RNA, 20 nt, Streptococcus pneumoniae R6
cugaaaacaaguucuuuucu

SEQ ID NO: 2198834 - RNA, 12 nt, Streptococcus pneumoniae R6
cucuuugauuuu

SEQ ID NO: 2198835 - RNA, 21 nt, Streptococcus pneumoniae R6
cucuuugauuuucauugagua

SEQ ID NO: 2198836 - RNA, 15 nt, Streptococcus pneumoniae R6
cucuuucuuucucac

SEQ ID NO: 2198837 - RNA, 24 nt, Streptococcus pneumoniae R6
cugaaaagacguauucagucaucu

SEQ ID NO: 2198838 - RNA, 19 nt, Streptococcus pneumoniae R6
cucuuuuuggaauuuuuug

SEQ ID NO: 2198839 - RNA, 12 nt, Streptococcus pneumoniae R6
cucuuuuuucuc

SEQ ID NO: 2198840 - RNA, 22 nt, Streptococcus pneumoniae R6
cucuuuuuugauaucuuccuca

SEQ ID NO: 2198841 - RNA, 22 nt, Streptococcus pneumoniae R6
cugaaaaaauaaauaaaacucu

SEQ ID NO: 2198842 - RNA, 15 nt, Streptococcus pneumoniae R6
cuacuccaagcaagc

SEQ ID NO: 2198843 - RNA, 17 nt, Streptococcus pneumoniae R6
cuacucaugugucuugc

SEQ ID NO: 2198844 - RNA, 14 nt, Streptococcus pneumoniae R6
cuacuguaggcuug

SEQ ID NO: 2198845 - RNA, 17 nt, Streptococcus pneumoniae R6
cuacuguauacuuuuuc

SEQ ID NO: 2198846 - RNA, 20 nt, Streptococcus pneumoniae R6
cuacucgaacuagagaagcc

SEQ ID NO: 2198847 - RNA, 22 nt, Streptococcus pneumoniae R6
cuacucgaacuagagaagccaa

SEQ ID NO: 2198848 - RNA, 17 nt, Streptococcus pneumoniae R6
cuacucuuucgaagucu

SEQ ID NO: 2198849 - RNA, 20 nt, Streptococcus pneumoniae R6
cuacucuuucgaagucugau

SEQ ID NO: 2198850 - RNA, 12 nt, Streptococcus pneumoniae R6
cuacucuaacuu

SEQ ID NO: 2198851 - RNA, 22 nt, Streptococcus pneumoniae R6
cuacuuugauuuuaaagaaaua

SEQ ID NO: 2198852 - RNA, 18 nt, Streptococcus pneumoniae R6
cuacuugcuuugcugacu

SEQ ID NO: 2198853 - RNA, 19 nt, Streptococcus pneumoniae R6
cuacuugcuuugcugacuu

SEQ ID NO: 2198854 - RNA, 12 nt, Streptococcus pneumoniae R6
cuacuuccuaag

SEQ ID NO: 2198855 - RNA, 23 nt, Streptococcus pneumoniae R6
cuacuuccuaagcuuucagcagc

SEQ ID NO: 2198856 - RNA, 15 nt, Streptococcus pneumoniae R6
cuagaauagaaacaa

SEQ ID NO: 2198857 - RNA, 21 nt, Streptococcus pneumoniae R6
cuagaauagaaacaaaauaua

SEQ ID NO: 2198858 - RNA, 23 nt, Streptococcus pneumoniae R6
cuagaauaguacaccuuuacuuc

SEQ ID NO: 2198859 - RNA, 19 nt, Streptococcus pneumoniae R6
cuagaaaaagcuucauuua

SEQ ID NO: 2198860 - RNA, 22 nt, Streptococcus pneumoniae R6
cuagaaugcuuuuugaaagcag

SEQ ID NO: 2198861 - RNA, 13 nt, Streptococcus pneumoniae R6
cuagacuaacuuc

SEQ ID NO: 2198862 - RNA, 15 nt, Streptococcus pneumoniae R6
cuagacuaacuucuu

SEQ ID NO: 2198863 - RNA, 17 nt, Streptococcus pneumoniae R6
cuagacuaacuucuuau

SEQ ID NO: 2198864 - RNA, 20 nt, Streptococcus pneumoniae R6
cuagacgcuuguccugaaug

SEQ ID NO: 2198865 - RNA, 15 nt, Streptococcus pneumoniae R6
cuagaaugucuucca

SEQ ID NO: 2198866 - RNA, 15 nt, Streptococcus pneumoniae R6
cuagacaauuuucau

SEQ ID NO: 2198867 - RNA, 20 nt, Streptococcus pneumoniae R6
cuaguaaauaucauuuccaa

SEQ ID NO: 2198868 - RNA, 15 nt, Streptococcus pneumoniae R6
cuaguaaaucgauuu

SEQ ID NO: 2198869 - RNA, 16 nt, Streptococcus pneumoniae R6
cuaguaaaucgauuuu

SEQ ID NO: 2198870 - RNA, 23 nt, Streptococcus pneumoniae R6
cuaguaauuuugugauaaaaugu

SEQ ID NO: 2198871 - RNA, 20 nt, Streptococcus pneumoniae R6
cuaguaaucgguaggaugac

SEQ ID NO: 2198872 - RNA, 15 nt, Streptococcus pneumoniae R6
cuaguaagaugaguu

SEQ ID NO: 2198873 - RNA, 17 nt, Streptococcus pneumoniae R6
cuaguacaaagaauaaa

SEQ ID NO: 2198874 - RNA, 22 nt, Streptococcus pneumoniae R6
cuagguaaaaauuauuuaaagc

SEQ ID NO: 2198875 - RNA, 18 nt, Streptococcus pneumoniae R6
cuaggucuagacuauaac

SEQ ID NO: 2198876 - RNA, 22 nt, Streptococcus pneumoniae R6
cuaggugagauuggauuuucug

SEQ ID NO: 2198877 - RNA, 19 nt, Streptococcus pneumoniae R6
cuagggugacaguaaaaaa

SEQ ID NO: 2198878 - RNA, 21 nt, Streptococcus pneumoniae R6
cuagggugacaguaaaaaauc

SEQ ID NO: 2198879 - RNA, 17 nt, Streptococcus pneumoniae R6
cuagucgaagcuuccaa

SEQ ID NO: 2198880 - RNA, 14 nt, Streptococcus pneumoniae R6
cuagucuacaaauu

SEQ ID NO: 2198881 - RNA, 15 nt, Streptococcus pneumoniae R6
cuagugaauuugguu

SEQ ID NO: 2198882 - RNA, 15 nt, Streptococcus pneumoniae R6
cuagugaaaaauuga

SEQ ID NO: 2198883 - RNA, 20 nt, Streptococcus pneumoniae R6
cuagugaaauugaacuuuuu

SEQ ID NO: 2198884 - RNA, 12 nt, Streptococcus pneumoniae R6
cuagucuuucuu

SEQ ID NO: 2198885 - RNA, 14 nt, Streptococcus pneumoniae R6
cuaguacauugaaa

SEQ ID NO: 2198886 - RNA, 13 nt, Streptococcus pneumoniae R6
cuagauuuggaaa

SEQ ID NO: 2198887 - RNA, 17 nt, Streptococcus pneumoniae R6
cuagauucuauuuuuua

SEQ ID NO: 2198888 - RNA, 20 nt, Streptococcus pneumoniae R6
cuagacucuuauuucucaac

SEQ ID NO: 2198889 - RNA, 22 nt, Streptococcus pneumoniae R6
cuagaugaauuacaugaaacug

SEQ ID NO: 2198890 - RNA, 22 nt, Streptococcus pneumoniae R6
cuagauauuuccaauugcggaa

SEQ ID NO: 2198891 - RNA, 13 nt, Streptococcus pneumoniae R6
cuagauauuuuga

SEQ ID NO: 2198892 - RNA, 20 nt, Streptococcus pneumoniae R6
cuagagaguuuuuuucuuaa

SEQ ID NO: 2198893 - RNA, 12 nt, Streptococcus pneumoniae R6
cuagagaagcca

SEQ ID NO: 2198894 - RNA, 17 nt, Streptococcus pneumoniae R6
cuagagacuacggaguu

SEQ ID NO: 2198895 - RNA, 23 nt, Streptococcus pneumoniae R6
cuagcuuggucaguaagauacag

SEQ ID NO: 2198896 - RNA, 16 nt, Streptococcus pneumoniae R6
cuagcuggugagaaga

SEQ ID NO: 2198897 - RNA, 19 nt, Streptococcus pneumoniae R6
cuaggaaacuagcugcagg

SEQ ID NO: 2198898 - RNA, 15 nt, Streptococcus pneumoniae R6
cuaggcugacaauaa

SEQ ID NO: 2198899 - RNA, 18 nt, Streptococcus pneumoniae R6
cuagcucccuuaguucaa

SEQ ID NO: 2198900 - RNA, 12 nt, Streptococcus pneumoniae R6
cuagcaacagau

SEQ ID NO: 2198901 - RNA, 17 nt, Streptococcus pneumoniae R6
cuagcuagaguuucaau

SEQ ID NO: 2198902 - RNA, 20 nt, Streptococcus pneumoniae R6
cuagcuaucuccucauauuu

SEQ ID NO: 2198903 - RNA, 15 nt, Streptococcus pneumoniae R6
cuagcuucucauuga

SEQ ID NO: 2198904 - RNA, 15 nt, Streptococcus pneumoniae R6
cuagcuuaggaaaga

SEQ ID NO: 2198905 - RNA, 15 nt, Streptococcus pneumoniae R6
cuaucuaaaaaaaug

SEQ ID NO: 2198906 - RNA, 19 nt, Streptococcus pneumoniae R6
cuaucuaaaauagaaggag

SEQ ID NO: 2198907 - RNA, 20 nt, Streptococcus pneumoniae R6
cuaucuaaaauagaaggagu

SEQ ID NO: 2198908 - RNA, 20 nt, Streptococcus pneumoniae R6
cuaugauuagguuuccuuua

SEQ ID NO: 2198909 - RNA, 14 nt, Streptococcus pneumoniae R6
cuaucuacaaccuc

SEQ ID NO: 2198910 - RNA, 13 nt, Streptococcus pneumoniae R6
cuaucucaacaaa

SEQ ID NO: 2198911 - RNA, 11 nt, Streptococcus pneumoniae R6
cuaugauuuuc

SEQ ID NO: 2198912 - RNA, 13 nt, Streptococcus pneumoniae R6
cuaugauuuucac

SEQ ID NO: 2198913 - RNA, 18 nt, Streptococcus pneumoniae R6
cuaugcaaguucuucucu

SEQ ID NO: 2198914 - RNA, 22 nt, Streptococcus pneumoniae R6
cuauucuaguuucaauuugaua

SEQ ID NO: 2198915 - RNA, 16 nt, Streptococcus pneumoniae R6
cuauucugacuaggaa

SEQ ID NO: 2198916 - RNA, 19 nt, Streptococcus pneumoniae R6
cuauucuucgaccuacauu

SEQ ID NO: 2198917 - RNA, 15 nt, Streptococcus pneumoniae R6
cuauucuuguuucag

SEQ ID NO: 2198918 - RNA, 18 nt, Streptococcus pneumoniae R6
cuauuccauauucaauua

SEQ ID NO: 2198919 - RNA, 12 nt, Streptococcus pneumoniae R6
cuauguugcaaa

SEQ ID NO: 2198920 - RNA, 15 nt, Streptococcus pneumoniae R6
cuauuaucguuuucc

SEQ ID NO: 2198921 - RNA, 22 nt, Streptococcus pneumoniae R6
cuauuauagagagggucuccca

SEQ ID NO: 2198922 - RNA, 16 nt, Streptococcus pneumoniae R6
cuauccaguuauucuu

SEQ ID NO: 2198923 - RNA, 14 nt, Streptococcus pneumoniae R6
cuauccacaaccuc

SEQ ID NO: 2198924 - RNA, 23 nt, Streptococcus pneumoniae R6
cuauccacaaccucaaaacagug

SEQ ID NO: 2198925 - RNA, 16 nt, Streptococcus pneumoniae R6
cuaucauauccagcuu

SEQ ID NO: 2198926 - RNA, 18 nt, Streptococcus pneumoniae R6
cuaucaauuauaauaaaa

SEQ ID NO: 2198927 - RNA, 11 nt, Streptococcus pneumoniae R6
cuaucaaacag

SEQ ID NO: 2198928 - RNA, 16 nt, Streptococcus pneumoniae R6
cuaucaggaaagucaa

SEQ ID NO: 2198929 - RNA, 12 nt, Streptococcus pneumoniae R6
cuaucacuccaa

SEQ ID NO: 2198930 - RNA, 21 nt, Streptococcus pneumoniae R6
cuaucacggcggaaaggcuag

SEQ ID NO: 2198931 - RNA, 18 nt, Streptococcus pneumoniae R6
cuaguucccuaucuuggu

SEQ ID NO: 2198932 - RNA, 21 nt, Streptococcus pneumoniae R6
cuaguuggucaacuuuuguau

SEQ ID NO: 2198933 - RNA, 14 nt, Streptococcus pneumoniae R6
cuaguuguuuuucg

SEQ ID NO: 2198934 - RNA, 17 nt, Streptococcus pneumoniae R6
cuaguuucaaucuacua

SEQ ID NO: 2198935 - RNA, 13 nt, Streptococcus pneumoniae R6
cuaguuugcucuu

SEQ ID NO: 2198936 - RNA, 13 nt, Streptococcus pneumoniae R6
cuaguuugcuuuu

SEQ ID NO: 2198937 - RNA, 14 nt, Streptococcus pneumoniae R6
cuauaaaaaacucu

SEQ ID NO: 2198938 - RNA, 11 nt, Streptococcus pneumoniae R6
cuaguuuuuug

SEQ ID NO: 2198939 - RNA, 19 nt, Streptococcus pneumoniae R6
cuaguuuugguuuuucuuc

SEQ ID NO: 2198940 - RNA, 20 nt, Streptococcus pneumoniae R6
cuaguuuugguuuuucuuca

SEQ ID NO: 2198941 - RNA, 22 nt, Streptococcus pneumoniae R6
cuaguuuugguuuuucuucagc

SEQ ID NO: 2198942 - RNA, 14 nt, Streptococcus pneumoniae R6
cuaguuuuuaggau

SEQ ID NO: 2198943 - RNA, 15 nt, Streptococcus pneumoniae R6
cuaguuuuuaggauu

SEQ ID NO: 2198944 - RNA, 13 nt, Streptococcus pneumoniae R6
cuaguuuuuauaa

SEQ ID NO: 2198945 - RNA, 20 nt, Streptococcus pneumoniae R6
cuauagauaaggucaucuua

SEQ ID NO: 2198946 - RNA, 18 nt, Streptococcus pneumoniae R6
cuauauuucuauacuuuu

SEQ ID NO: 2198947 - RNA, 12 nt, Streptococcus pneumoniae R6
cuauauuuauau

SEQ ID NO: 2198948 - RNA, 15 nt, Streptococcus pneumoniae R6
cuauauucucucuua

SEQ ID NO: 2198949 - RNA, 15 nt, Streptococcus pneumoniae R6
cuauauucuuugaga

SEQ ID NO: 2198950 - RNA, 23 nt, Streptococcus pneumoniae R6
cuauauuagaggcgagacauuuu

SEQ ID NO: 2198951 - RNA, 18 nt, Streptococcus pneumoniae R6
cuauaguagguugcaguu

SEQ ID NO: 2198952 - RNA, 22 nt, Streptococcus pneumoniae R6
cuauaguagguugcaguugaaa

SEQ ID NO: 2198953 - RNA, 22 nt, Streptococcus pneumoniae R6
cuauagucaaagggaaaucuga

SEQ ID NO: 2198954 - RNA, 16 nt, Streptococcus pneumoniae R6
cuauagucaauugaaa

SEQ ID NO: 2198955 - RNA, 20 nt, Streptococcus pneumoniae R6
cuauagccaucucuacuccu

SEQ ID NO: 2198956 - RNA, 14 nt, Streptococcus pneumoniae R6
cuauagcagccucc

SEQ ID NO: 2198957 - RNA, 14 nt, Streptococcus pneumoniae R6
cucaaaacacaguu

SEQ ID NO: 2198958 - RNA, 21 nt, Streptococcus pneumoniae R6
cucaaaacacaguuuugaggu

SEQ ID NO: 2198959 - RNA, 12 nt, Streptococcus pneumoniae R6
cucaaaacacug

SEQ ID NO: 2198960 - RNA, 15 nt, Streptococcus pneumoniae R6
cucaaaacacuguuu

SEQ ID NO: 2198961 - RNA, 20 nt, Streptococcus pneumoniae R6
cucaaaacacuguuuugagc

SEQ ID NO: 2198962 - RNA, 21 nt, Streptococcus pneumoniae R6
cucaaaacacuguuuugaggu

SEQ ID NO: 2198963 - RNA, 17 nt, Streptococcus pneumoniae R6
cucaaaacaguguuuug

SEQ ID NO: 2198964 - RNA, 23 nt, Streptococcus pneumoniae R6
cucaaaacaguguuuugagcuga

SEQ ID NO: 2198965 - RNA, 17 nt, Streptococcus pneumoniae R6
cucaaaaccauguuuug

SEQ ID NO: 2198966 - RNA, 17 nt, Streptococcus pneumoniae R6
cucaaaacgguguuuug

SEQ ID NO: 2198967 - RNA, 15 nt, Streptococcus pneumoniae R6
cucaaaaguuagaaa

SEQ ID NO: 2198968 - RNA, 19 nt, Streptococcus pneumoniae R6
cucaaaaguuagaaauaaa

SEQ ID NO: 2198969 - RNA, 22 nt, Streptococcus pneumoniae R6
cucaaaauaaccaaguucuaaa

SEQ ID NO: 2198970 - RNA, 20 nt, Streptococcus pneumoniae R6
cuauugaugaaguaaaugug

SEQ ID NO: 2198971 - RNA, 14 nt, Streptococcus pneumoniae R6
cuauugcuuuuaga

SEQ ID NO: 2198972 - RNA, 15 nt, Streptococcus pneumoniae R6
cucaacagaagaauc

SEQ ID NO: 2198973 - RNA, 17 nt, Streptococcus pneumoniae R6
cucaacaagcuguaguc

SEQ ID NO: 2198974 - RNA, 17 nt, Streptococcus pneumoniae R6
cucaacgcuagaagcau

SEQ ID NO: 2198975 - RNA, 16 nt, Streptococcus pneumoniae R6
cucaauaucuucugcu

SEQ ID NO: 2198976 - RNA, 21 nt, Streptococcus pneumoniae R6
cucaauauuaugcguuuuuuc

SEQ ID NO: 2198977 - RNA, 20 nt, Streptococcus pneumoniae R6
cucaaucaagauagcuguga

SEQ ID NO: 2198978 - RNA, 16 nt, Streptococcus pneumoniae R6
cucaaucaauccaaag

SEQ ID NO: 2198979 - RNA, 20 nt, Streptococcus pneumoniae R6
cucaaucaauccaaagaaau

SEQ ID NO: 2198980 - RNA, 23 nt, Streptococcus pneumoniae R6
cucaauacugaaacaacaucuuu

SEQ ID NO: 2198981 - RNA, 16 nt, Streptococcus pneumoniae R6
cucaccgaccaauucu

SEQ ID NO: 2198982 - RNA, 15 nt, Streptococcus pneumoniae R6
cuccaaguccaagaa

SEQ ID NO: 2198983 - RNA, 17 nt, Streptococcus pneumoniae R6
cuccaaguccaagaacc

SEQ ID NO: 2198984 - RNA, 20 nt, Streptococcus pneumoniae R6
cuccaaaggagaagauuuca

SEQ ID NO: 2198985 - RNA, 20 nt, Streptococcus pneumoniae R6
cucauugauuuucaucauca

SEQ ID NO: 2198986 - RNA, 16 nt, Streptococcus pneumoniae R6
cuccaaaccauuuuug

SEQ ID NO: 2198987 - RNA, 14 nt, Streptococcus pneumoniae R6
cucaucaucugaau

SEQ ID NO: 2198988 - RNA, 15 nt, Streptococcus pneumoniae R6
cucaucaucugaaug

SEQ ID NO: 2198989 - RNA, 14 nt, Streptococcus pneumoniae R6
cucauaucugucuu

SEQ ID NO: 2198990 - RNA, 16 nt, Streptococcus pneumoniae R6
cucauauucuuuuaca

SEQ ID NO: 2198991 - RNA, 18 nt, Streptococcus pneumoniae R6
cucauauucuuuuacacu

SEQ ID NO: 2198992 - RNA, 17 nt, Streptococcus pneumoniae R6
cucaugacagccucaau

SEQ ID NO: 2198993 - RNA, 14 nt, Streptococcus pneumoniae R6
cucaugaaaggauu

SEQ ID NO: 2198994 - RNA, 14 nt, Streptococcus pneumoniae R6
cucauaaaagguau

SEQ ID NO: 2198995 - RNA, 16 nt, Streptococcus pneumoniae R6
cucauaguuuaucuca

SEQ ID NO: 2198996 - RNA, 22 nt, Streptococcus pneumoniae R6
cuacauauguaagaagauuuuu

SEQ ID NO: 2198997 - RNA, 14 nt, Streptococcus pneumoniae R6
cuacaguugacaaa

SEQ ID NO: 2198998 - RNA, 16 nt, Streptococcus pneumoniae R6
cuacaguugacaaaga

SEQ ID NO: 2198999 - RNA, 17 nt, Streptococcus pneumoniae R6
cuacaguuggagcaucu

SEQ ID NO: 2199000 - RNA, 22 nt, Streptococcus pneumoniae R6
cuacacuugacaaagagccacu

SEQ ID NO: 2199001 - RNA, 14 nt, Streptococcus pneumoniae R6
cuacacuugauuua

SEQ ID NO: 2199002 - RNA, 18 nt, Streptococcus pneumoniae R6
cuacacguggguugaggc

SEQ ID NO: 2199003 - RNA, 20 nt, Streptococcus pneumoniae R6
cuacagaagguguugauuuc

SEQ ID NO: 2199004 - RNA, 19 nt, Streptococcus pneumoniae R6
cuacauuuuuugaaauaag

SEQ ID NO: 2199005 - RNA, 13 nt, Streptococcus pneumoniae R6
cuacaucuucucc

SEQ ID NO: 2199006 - RNA, 20 nt, Streptococcus pneumoniae R6
cuacaugcuguuagaagacu

SEQ ID NO: 2199007 - RNA, 20 nt, Streptococcus pneumoniae R6
cuacauucccaaacaaaaaa

SEQ ID NO: 2199008 - RNA, 13 nt, Streptococcus pneumoniae R6
cuaauuuagaaau

SEQ ID NO: 2199009 - RNA, 20 nt, Streptococcus pneumoniae R6
cuaauuuagaaauagauucu

SEQ ID NO: 2199010 - RNA, 12 nt, Streptococcus pneumoniae R6
cuaauuguaaag

SEQ ID NO: 2199011 - RNA, 23 nt, Streptococcus pneumoniae R6
cuaauuuucuaccgaucucaucu

SEQ ID NO: 2199012 - RNA, 17 nt, Streptococcus pneumoniae R6
cuacaaauguuuuagca

SEQ ID NO: 2199013 - RNA, 20 nt, Streptococcus pneumoniae R6
cuacaaugaucaagaugaga

SEQ ID NO: 2199014 - RNA, 18 nt, Streptococcus pneumoniae R6
cuacaauucgcuauuuuu

SEQ ID NO: 2199015 - RNA, 21 nt, Streptococcus pneumoniae R6
cuacaauagcuuguuccaauu

SEQ ID NO: 2199016 - RNA, 21 nt, Streptococcus pneumoniae R6
cuacaauaauugguacauuuu

SEQ ID NO: 2199017 - RNA, 16 nt, Streptococcus pneumoniae R6
cuacaagaacagucuc

SEQ ID NO: 2199018 - RNA, 18 nt, Streptococcus pneumoniae R6
cuacaacgucuuuugccu

SEQ ID NO: 2199019 - RNA, 18 nt, Streptococcus pneumoniae R6
cuacaaccuuaaaacagu

SEQ ID NO: 2199020 - RNA, 17 nt, Streptococcus pneumoniae R6
cuacaaccucaaaaaca

SEQ ID NO: 2199021 - RNA, 14 nt, Streptococcus pneumoniae R6
cuacacaaaauagg

SEQ ID NO: 2199022 - RNA, 17 nt, Streptococcus pneumoniae R6
cuacaccauaaauauuu

SEQ ID NO: 2199023 - RNA, 20 nt, Streptococcus pneumoniae R6
cuacacagcuugguaaugcu

SEQ ID NO: 2199024 - RNA, 20 nt, Streptococcus pneumoniae R6
cuaaugucucugcuauuucu

SEQ ID NO: 2199025 - RNA, 21 nt, Streptococcus pneumoniae R6
cuaaugucucugcuauuucua

SEQ ID NO: 2199026 - RNA, 13 nt, Streptococcus pneumoniae R6
cuaauguaaaaaa

SEQ ID NO: 2199027 - RNA, 16 nt, Streptococcus pneumoniae R6
cuaauucccauaaaaa

SEQ ID NO: 2199028 - RNA, 21 nt, Streptococcus pneumoniae R6
cuaauucuuugacaagguuuc

SEQ ID NO: 2199029 - RNA, 13 nt, Streptococcus pneumoniae R6
cuaauucuuuucg

SEQ ID NO: 2199030 - RNA, 17 nt, Streptococcus pneumoniae R6
cuaauuauguacacauu

SEQ ID NO: 2199031 - RNA, 17 nt, Streptococcus pneumoniae R6
cuaauguacagaagacu

SEQ ID NO: 2199032 - RNA, 14 nt, Streptococcus pneumoniae R6
cuaaucuuugccac

SEQ ID NO: 2199033 - RNA, 18 nt, Streptococcus pneumoniae R6
cuaauccacucagacagc

SEQ ID NO: 2199034 - RNA, 13 nt, Streptococcus pneumoniae R6
cuaaucauaguga

SEQ ID NO: 2199035 - RNA, 15 nt, Streptococcus pneumoniae R6
cuaacugaagcuguu

SEQ ID NO: 2199036 - RNA, 16 nt, Streptococcus pneumoniae R6
cuaacuggaaagauaa

SEQ ID NO: 2199037 - RNA, 14 nt, Streptococcus pneumoniae R6
cuaacugcuucacu

SEQ ID NO: 2199038 - RNA, 20 nt, Streptococcus pneumoniae R6
cuaacugcuucacuagucau

SEQ ID NO: 2199039 - RNA, 18 nt, Streptococcus pneumoniae R6
cuaagauauuauuucaaa

SEQ ID NO: 2199040 - RNA, 14 nt, Streptococcus pneumoniae R6
cuaaauccuuuuuu

SEQ ID NO: 2199041 - RNA, 21 nt, Streptococcus pneumoniae R6
cuaaaucuagauacauuuuuu

SEQ ID NO: 2199042 - RNA, 12 nt, Streptococcus pneumoniae R6
cuaauaauucca

SEQ ID NO: 2199043 - RNA, 13 nt, Streptococcus pneumoniae R6
cuaauaauuuuaa

SEQ ID NO: 2199044 - RNA, 17 nt, Streptococcus pneumoniae R6
cuaauaauacaaaaaau

SEQ ID NO: 2199045 - RNA, 18 nt, Streptococcus pneumoniae R6
cuaauaauacaaaaaaua

SEQ ID NO: 2199046 - RNA, 23 nt, Streptococcus pneumoniae R6
cuaaggaggcaaagaaaaaagcu

SEQ ID NO: 2199047 - RNA, 14 nt, Streptococcus pneumoniae R6
cuaaggaaaaaggc

SEQ ID NO: 2199048 - RNA, 16 nt, Streptococcus pneumoniae R6
cuaagaugauuuuucu

SEQ ID NO: 2199049 - RNA, 19 nt, Streptococcus pneumoniae R6
cuaagauuuguuuuucaaa

SEQ ID NO: 2199050 - RNA, 20 nt, Streptococcus pneumoniae R6
cuaaggcuguuucaaaugaa

SEQ ID NO: 2199051 - RNA, 20 nt, Streptococcus pneumoniae R6
cuaagguauauucaaaauac

SEQ ID NO: 2199052 - RNA, 24 nt, Streptococcus pneumoniae R6
cuaaggucaaacuuuuucucucug

SEQ ID NO: 2199053 - RNA, 13 nt, Streptococcus pneumoniae R6
cguuuaucaauaa

SEQ ID NO: 2199054 - RNA, 11 nt, Streptococcus pneumoniae R6
cguugucuucu

SEQ ID NO: 2199055 - RNA, 13 nt, Streptococcus pneumoniae R6
cguugucaaguuu

SEQ ID NO: 2199056 - RNA, 18 nt, Streptococcus pneumoniae R6
cguuuuuaucauuuugaa

SEQ ID NO: 2199057 - RNA, 19 nt, Streptococcus pneumoniae R6
cguuuuucagauuuuaaag

SEQ ID NO: 2199058 - RNA, 13 nt, Streptococcus pneumoniae R6
cguuuucuacaau

SEQ ID NO: 2199059 - RNA, 16 nt, Streptococcus pneumoniae R6
cguuuuaucugcaauu

SEQ ID NO: 2199060 - RNA, 21 nt, Streptococcus pneumoniae R6
cguuuucaaagcuacuuuuuu

SEQ ID NO: 2199061 - RNA, 10 nt, Streptococcus pneumoniae R6
cguuuuauag

SEQ ID NO: 2199062 - RNA, 18 nt, Streptococcus pneumoniae R6
cuaaacuauuucuuauuu

SEQ ID NO: 2199063 - RNA, 19 nt, Streptococcus pneumoniae R6
cuaaacuauuucuuauuuc

SEQ ID NO: 2199064 - RNA, 16 nt, Streptococcus pneumoniae R6
cuaaacuguacaagaa

SEQ ID NO: 2199065 - RNA, 16 nt, Streptococcus pneumoniae R6
cuaaauacaaaaacaa

SEQ ID NO: 2199066 - RNA, 20 nt, Streptococcus pneumoniae R6
cuaaagggauccucauauuc

SEQ ID NO: 2199067 - RNA, 21 nt, Streptococcus pneumoniae R6
cuaaaauuguguuuuugcccc

SEQ ID NO: 2199068 - RNA, 17 nt, Streptococcus pneumoniae R6
cuaaaauugacuuucuu

SEQ ID NO: 2199069 - RNA, 23 nt, Streptococcus pneumoniae R6
cuaaacaauguucucauauuuuc

SEQ ID NO: 2199070 - RNA, 17 nt, Streptococcus pneumoniae R6
cuaaacaaacuccucuc

SEQ ID NO: 2199071 - RNA, 14 nt, Streptococcus pneumoniae R6
cuaaaauucccuua

SEQ ID NO: 2199072 - RNA, 20 nt, Streptococcus pneumoniae R6
cuaaacaagggauuuuucug

SEQ ID NO: 2199073 - RNA, 18 nt, Streptococcus pneumoniae R6
cuaaacgugauaaaguuu

SEQ ID NO: 2199074 - RNA, 18 nt, Streptococcus pneumoniae R6
cuaaaauaguggaaagag

SEQ ID NO: 2199075 - RNA, 10 nt, Streptococcus pneumoniae R6
cuaaaauaac

SEQ ID NO: 2199076 - RNA, 15 nt, Streptococcus pneumoniae R6
cguuuuucugauuuu

SEQ ID NO: 2199077 - RNA, 20 nt, Streptococcus pneumoniae R6
cguuuuucugauuuugaaaa

SEQ ID NO: 2199078 - RNA, 20 nt, Streptococcus pneumoniae R6
cuaaaauguuuuucgucucg

SEQ ID NO: 2199079 - RNA, 13 nt, Streptococcus pneumoniae R6
cuaaaauguaguu

SEQ ID NO: 2199080 - RNA, 18 nt, Streptococcus pneumoniae R6
cguugacgauuuuuucuu

SEQ ID NO: 2199081 - RNA, 19 nt, Streptococcus pneumoniae R6
cguugauaaucuuaucucu

SEQ ID NO: 2199082 - RNA, 13 nt, Streptococcus pneumoniae R6
cguugacaaucuu

SEQ ID NO: 2199083 - RNA, 22 nt, Streptococcus pneumoniae R6
cguuccugucuuauuucauuug

SEQ ID NO: 2199084 - RNA, 15 nt, Streptococcus pneumoniae R6
cguucggcuucaucu

SEQ ID NO: 2199085 - RNA, 17 nt, Streptococcus pneumoniae R6
cguucggcuucaucugg

SEQ ID NO: 2199086 - RNA, 13 nt, Streptococcus pneumoniae R6
cguucauccacuc

SEQ ID NO: 2199087 - RNA, 16 nt, Streptococcus pneumoniae R6
cguucauccauaucuu

SEQ ID NO: 2199088 - RNA, 24 nt, Streptococcus pneumoniae R6
cguuccaaccgaacguacgagaua

SEQ ID NO: 2199089 - RNA, 19 nt, Streptococcus pneumoniae R6
cguuccaaguggcauugcu

SEQ ID NO: 2199090 - RNA, 12 nt, Streptococcus pneumoniae R6
cguucaggacag

SEQ ID NO: 2199091 - RNA, 13 nt, Streptococcus pneumoniae R6
cgucauuuaaaga

SEQ ID NO: 2199092 - RNA, 17 nt, Streptococcus pneumoniae R6
aaaaaacaaaguauuaa

SEQ ID NO: 2199093 - RNA, 15 nt, Streptococcus pneumoniae R6
aaaaaaauuuuuaaa

SEQ ID NO: 2199094 - RNA, 17 nt, Streptococcus pneumoniae R6
aaaaaaauuuuauuuaa

SEQ ID NO: 2199095 - RNA, 12 nt, Streptococcus pneumoniae R6
aaaaaaaaaagu

SEQ ID NO: 2199096 - RNA, 14 nt, Streptococcus pneumoniae R6
aaaaaaacuuaaaa

SEQ ID NO: 2199097 - RNA, 11 nt, Streptococcus pneumoniae R6
aaaaaaagcua

SEQ ID NO: 2199098 - RNA, 20 nt, Streptococcus pneumoniae R6
aaaaaaagggggaacguuuu

SEQ ID NO: 2199099 - RNA, 12 nt, Streptococcus pneumoniae R6
aaaaaaaugaua

SEQ ID NO: 2199100 - RNA, 12 nt, Streptococcus pneumoniae R6
aaaaaacaauaa

SEQ ID NO: 2199101 - RNA, 13 nt, Streptococcus pneumoniae R6
aaaaaacaauaaa

SEQ ID NO: 2199102 - RNA, 13 nt, Streptococcus pneumoniae R6
aaaaaaaugaaaa

SEQ ID NO: 2199103 - RNA, 23 nt, Streptococcus pneumoniae R6
aaaaaaauuuggaaaauaguuuu

SEQ ID NO: 2199104 - RNA, 16 nt, Streptococcus pneumoniae R6
aaaaaacaaaggauuu

SEQ ID NO: 2199105 - RNA, 23 nt, Streptococcus pneumoniae R6
aaaaaaccaauucccaaacaucu

SEQ ID NO: 2199106 - RNA, 18 nt, Streptococcus pneumoniae R6
aaaaaaggaguaacuaug

SEQ ID NO: 2199107 - RNA, 21 nt, Streptococcus pneumoniae R6
aaaaaauacaguauccacauu

SEQ ID NO: 2199108 - RNA, 15 nt, Streptococcus pneumoniae R6
aaaaaauaaucaaaa

SEQ ID NO: 2199109 - RNA, 20 nt, Streptococcus pneumoniae R6
aaaaaauaaucaaaacuaua

SEQ ID NO: 2199110 - RNA, 23 nt, Streptococcus pneumoniae R6
aaaaaagugguaucauauaaaua

SEQ ID NO: 2199111 - RNA, 16 nt, Streptococcus pneumoniae R6
aaaaacauaauuuuag

SEQ ID NO: 2199112 - RNA, 13 nt, Streptococcus pneumoniae R6
aaaaaaugauaau

SEQ ID NO: 2199113 - RNA, 23 nt, Streptococcus pneumoniae R6
aaaaaaugauaauagauauaauu

SEQ ID NO: 2199114 - RNA, 20 nt, Streptococcus pneumoniae R6
aaaaaaucaagggaaaauga

SEQ ID NO: 2199115 - RNA, 13 nt, Streptococcus pneumoniae R6
aaaaaauaucuuu

SEQ ID NO: 2199116 - RNA, 23 nt, Streptococcus pneumoniae R6
aaaaaagggggaacguuuuuaaa

SEQ ID NO: 2199117 - RNA, 12 nt, Streptococcus pneumoniae R6
aaaaaauaaaaa

SEQ ID NO: 2199118 - RNA, 17 nt, Streptococcus pneumoniae R6
aaaaaauaaaaaaauuu

SEQ ID NO: 2199119 - RNA, 17 nt, Streptococcus pneumoniae R6
aaaaaaguauacucuaa

SEQ ID NO: 2199120 - RNA, 20 nt, Streptococcus pneumoniae R6
aaaaaaugaaauuaaauaug

SEQ ID NO: 2199121 - RNA, 12 nt, Streptococcus pneumoniae R6
aaaaaaugaaau

SEQ ID NO: 2199122 - RNA, 16 nt, Streptococcus pneumoniae R6
aaaaaaugucauaauu

SEQ ID NO: 2199123 - RNA, 15 nt, Streptococcus pneumoniae R6
aaaaaauuuuuaaag

SEQ ID NO: 2199124 - RNA, 14 nt, Streptococcus pneumoniae R6
aaaaacaaagagau

SEQ ID NO: 2199125 - RNA, 11 nt, Streptococcus pneumoniae R6
aaaaacaaagg

SEQ ID NO: 2199126 - RNA, 17 nt, Streptococcus pneumoniae R6
aaaaacaaaguauuaaa

SEQ ID NO: 2199127 - RNA, 22 nt, Streptococcus pneumoniae R6
aaaaacagaggcuggacaaaaa

SEQ ID NO: 2199128 - RNA, 18 nt, Streptococcus pneumoniae R6
aaaaugccaaagaaagau

SEQ ID NO: 2199129 - RNA, 18 nt, Streptococcus pneumoniae R6
aaaaugcaccaaaacagg

SEQ ID NO: 2199130 - RNA, 14 nt, Streptococcus pneumoniae R6
aaaaugccuuaucu

SEQ ID NO: 2199131 - RNA, 18 nt, Streptococcus pneumoniae R6
aaaauuagcucaaaacac

SEQ ID NO: 2199132 - RNA, 22 nt, Streptococcus pneumoniae R6
aaaauuauagucuuuucacuuu

SEQ ID NO: 2199133 - RNA, 14 nt, Streptococcus pneumoniae R6
aaaauuauuaaaau

SEQ ID NO: 2199134 - RNA, 16 nt, Streptococcus pneumoniae R6
aaaaucguaaaaaagu

SEQ ID NO: 2199135 - RNA, 23 nt, Streptococcus pneumoniae R6
aaaauccugcaaggcauaaacuu

SEQ ID NO: 2199136 - RNA, 20 nt, Streptococcus pneumoniae R6
aaaauccuaguggaaaagau

SEQ ID NO: 2199137 - RNA, 14 nt, Streptococcus pneumoniae R6
aaaauccuugacca

SEQ ID NO: 2199138 - RNA, 13 nt, Streptococcus pneumoniae R6
aaaauccuuuguu

SEQ ID NO: 2199139 - RNA, 12 nt, Streptococcus pneumoniae R6
aaaaugauuuuu

SEQ ID NO: 2199140 - RNA, 16 nt, Streptococcus pneumoniae R6
aaaaugauuuuuuacu

SEQ ID NO: 2199141 - RNA, 12 nt, Streptococcus pneumoniae R6
aaaaucuccucu

SEQ ID NO: 2199142 - RNA, 12 nt, Streptococcus pneumoniae R6
aaaauuucucug

SEQ ID NO: 2199143 - RNA, 22 nt, Streptococcus pneumoniae R6
aaaauuucucagggucuuuguu

SEQ ID NO: 2199144 - RNA, 21 nt, Streptococcus pneumoniae R6
aaaauuuuaucuuugaaauaa

SEQ ID NO: 2199145 - RNA, 23 nt, Streptococcus pneumoniae R6
aaaauuuuaucuuugaaauaauc

SEQ ID NO: 2199146 - RNA, 19 nt, Streptococcus pneumoniae R6
aaaauucaaauuaauuucu

SEQ ID NO: 2199147 - RNA, 19 nt, Streptococcus pneumoniae R6
aaaauucuaaaggcuuaau

SEQ ID NO: 2199148 - RNA, 13 nt, Streptococcus pneumoniae R6
aaaauuuaaaaau

SEQ ID NO: 2199149 - RNA, 14 nt, Streptococcus pneumoniae R6
aaaauuuaaaaaua

SEQ ID NO: 2199150 - RNA, 18 nt, Streptococcus pneumoniae R6
aaaauuuaaaagauacua

SEQ ID NO: 2199151 - RNA, 15 nt, Streptococcus pneumoniae R6
aaaauuccuuuaaaa

SEQ ID NO: 2199152 - RNA, 17 nt, Streptococcus pneumoniae R6
aaaauuccuuuaaaaac

SEQ ID NO: 2199153 - RNA, 20 nt, Streptococcus pneumoniae R6
aaaauuccuuuaaaaacaau

SEQ ID NO: 2199154 - RNA, 13 nt, Streptococcus pneumoniae R6
aaacaaaauauau

SEQ ID NO: 2199155 - RNA, 19 nt, Streptococcus pneumoniae R6
aaaauuuuucuaaccaauc

SEQ ID NO: 2199156 - RNA, 15 nt, Streptococcus pneumoniae R6
aaaauuuuuuucuaa

SEQ ID NO: 2199157 - RNA, 13 nt, Streptococcus pneumoniae R6
aaacaaaaaaccc

SEQ ID NO: 2199158 - RNA, 13 nt, Streptococcus pneumoniae R6
aaacaaccgauaa

SEQ ID NO: 2199159 - RNA, 16 nt, Streptococcus pneumoniae R6
aaacaaaguauuaaaa

SEQ ID NO: 2199160 - RNA, 17 nt, Streptococcus pneumoniae R6
aaacaaaguauuaaaau

SEQ ID NO: 2199161 - RNA, 14 nt, Streptococcus pneumoniae R6
aaacaaagaaaaag

SEQ ID NO: 2199162 - RNA, 13 nt, Streptococcus pneumoniae R6
aaaaucaaagagu

SEQ ID NO: 2199163 - RNA, 14 nt, Streptococcus pneumoniae R6
aaaauauagaauug

SEQ ID NO: 2199164 - RNA, 14 nt, Streptococcus pneumoniae R6
aaaauauacaaaaa

SEQ ID NO: 2199165 - RNA, 21 nt, Streptococcus pneumoniae R6
aaaauauacaaaaaaggaacc

SEQ ID NO: 2199166 - RNA, 18 nt, Streptococcus pneumoniae R6
aaaaucaagguuuuugaa

SEQ ID NO: 2199167 - RNA, 23 nt, Streptococcus pneumoniae R6
aaaaucaaguaggcucauccccu

SEQ ID NO: 2199168 - RNA, 17 nt, Streptococcus pneumoniae R6
aaaaucacaucugcuag

SEQ ID NO: 2199169 - RNA, 15 nt, Streptococcus pneumoniae R6
aaaaucacguggagu

SEQ ID NO: 2199170 - RNA, 14 nt, Streptococcus pneumoniae R6
aaaaucccccaagc

SEQ ID NO: 2199171 - RNA, 18 nt, Streptococcus pneumoniae R6
aaaauccucugaguauuu

SEQ ID NO: 2199172 - RNA, 17 nt, Streptococcus pneumoniae R6
aaaauccguuuuuuaaa

SEQ ID NO: 2199173 - RNA, 19 nt, Streptococcus pneumoniae R6
aaaauccguuuuuugaagu

SEQ ID NO: 2199174 - RNA, 20 nt, Streptococcus pneumoniae R6
aaaauccguuuuuugaaguu

SEQ ID NO: 2199175 - RNA, 17 nt, Streptococcus pneumoniae R6
aaaauccuaagauuacu

SEQ ID NO: 2199176 - RNA, 14 nt, Streptococcus pneumoniae R6
aaaauagaaaaaau

SEQ ID NO: 2199177 - RNA, 13 nt, Streptococcus pneumoniae R6
aaaauagaaaaaa

SEQ ID NO: 2199178 - RNA, 20 nt, Streptococcus pneumoniae R6
aaaauacugauaaaaacaug

SEQ ID NO: 2199179 - RNA, 19 nt, Streptococcus pneumoniae R6
aaaauacucaucaugaaua

SEQ ID NO: 2199180 - RNA, 19 nt, Streptococcus pneumoniae R6
aaaauaguggcugaaacug

SEQ ID NO: 2199181 - RNA, 22 nt, Streptococcus pneumoniae R6
aaaauagggaaauccuagauac

SEQ ID NO: 2199182 - RNA, 20 nt, Streptococcus pneumoniae R6
aaaauaggcagaacaagagu

SEQ ID NO: 2199183 - RNA, 13 nt, Streptococcus pneumoniae R6
aaaauagaaauaa

SEQ ID NO: 2199184 - RNA, 16 nt, Streptococcus pneumoniae R6
aaaauagauaaauacu

SEQ ID NO: 2199185 - RNA, 23 nt, Streptococcus pneumoniae R6
aaaauaaaauuccuuuaaaaaca

SEQ ID NO: 2199186 - RNA, 12 nt, Streptococcus pneumoniae R6
aaaauaaguucu

SEQ ID NO: 2199187 - RNA, 14 nt, Streptococcus pneumoniae R6
aaaauaauuaaaau

SEQ ID NO: 2199188 - RNA, 13 nt, Streptococcus pneumoniae R6
aaaauaaaaaaga

SEQ ID NO: 2199189 - RNA, 15 nt, Streptococcus pneumoniae R6
aaaauaaaaaagaga

SEQ ID NO: 2199190 - RNA, 21 nt, Streptococcus pneumoniae R6
aaaauaaaaaagagaguuaca

SEQ ID NO: 2199191 - RNA, 14 nt, Streptococcus pneumoniae R6
aaaaguucucuuuc

SEQ ID NO: 2199192 - RNA, 17 nt, Streptococcus pneumoniae R6
aaaaguucucuuucuaa

SEQ ID NO: 2199193 - RNA, 19 nt, Streptococcus pneumoniae R6
aaaaguucucuuucuaaaa

SEQ ID NO: 2199194 - RNA, 22 nt, Streptococcus pneumoniae R6
aaaaguucucuuucuaaaauag

SEQ ID NO: 2199195 - RNA, 22 nt, Streptococcus pneumoniae R6
aaaaguuagacaauuaauuuau

SEQ ID NO: 2199196 - RNA, 19 nt, Streptococcus pneumoniae R6
aaaaguuagacagaaaaaa

SEQ ID NO: 2199197 - RNA, 20 nt, Streptococcus pneumoniae R6
aaaaguuagacagaaaaaau

SEQ ID NO: 2199198 - RNA, 15 nt, Streptococcus pneumoniae R6
aaaaguuagaaauaa

SEQ ID NO: 2199199 - RNA, 17 nt, Streptococcus pneumoniae R6
aaaaguuagaaauaaaa

SEQ ID NO: 2199200 - RNA, 17 nt, Streptococcus pneumoniae R6
aaaagugucagauagga

SEQ ID NO: 2199201 - RNA, 16 nt, Streptococcus pneumoniae R6
aaaagugguaucauau

SEQ ID NO: 2199202 - RNA, 18 nt, Streptococcus pneumoniae R6
aaaaguagagucuguucu

SEQ ID NO: 2199203 - RNA, 15 nt, Streptococcus pneumoniae R6
aaaaguauacucuaa

SEQ ID NO: 2199204 - RNA, 14 nt, Streptococcus pneumoniae R6
aaaaguaaaaaggg

SEQ ID NO: 2199205 - RNA, 15 nt, Streptococcus pneumoniae R6
aaaaguaaaaagggu

SEQ ID NO: 2199206 - RNA, 22 nt, Streptococcus pneumoniae R6
aaaaguagcuucacugcgugga

SEQ ID NO: 2199207 - RNA, 20 nt, Streptococcus pneumoniae R6
aaaagccuccaaucuggagg

SEQ ID NO: 2199208 - RNA, 20 nt, Streptococcus pneumoniae R6
aaaagcagaggcaaugacaa

SEQ ID NO: 2199209 - RNA, 23 nt, Streptococcus pneumoniae R6
aaaacucuccugggaaauuccag

SEQ ID NO: 2199210 - RNA, 18 nt, Streptococcus pneumoniae R6
aaaacugaacaaauuaau

SEQ ID NO: 2199211 - RNA, 14 nt, Streptococcus pneumoniae R6
aaaacuuaaaaauc

SEQ ID NO: 2199212 - RNA, 14 nt, Streptococcus pneumoniae R6
aaaacugguccaga

SEQ ID NO: 2199213 - RNA, 19 nt, Streptococcus pneumoniae R6
aaaacugguccagagauag

SEQ ID NO: 2199214 - RNA, 14 nt, Streptococcus pneumoniae R6
aaaacugaugaagu

SEQ ID NO: 2199215 - RNA, 17 nt, Streptococcus pneumoniae R6
aaaacugaugaagucaa

SEQ ID NO: 2199216 - RNA, 16 nt, Streptococcus pneumoniae R6
aaaacuugugauuuag

SEQ ID NO: 2199217 - RNA, 22 nt, Streptococcus pneumoniae R6
aaaacuugugauuuaguagcau

SEQ ID NO: 2199218 - RNA, 17 nt, Streptococcus pneumoniae R6
aaaacuuuuuaaaaaau

SEQ ID NO: 2199219 - RNA, 17 nt, Streptococcus pneumoniae R6
aaaacgguugagcaugu

SEQ ID NO: 2199220 - RNA, 21 nt, Streptococcus pneumoniae R6
aaaaccaauucccaaacaucu

SEQ ID NO: 2199221 - RNA, 13 nt, Streptococcus pneumoniae R6
aaaaccaaacauc

SEQ ID NO: 2199222 - RNA, 13 nt, Streptococcus pneumoniae R6
aaaacguucccaa

SEQ ID NO: 2199223 - RNA, 19 nt, Streptococcus pneumoniae R6
aaaacguucccaacgugag

SEQ ID NO: 2199224 - RNA, 16 nt, Streptococcus pneumoniae R6
aaaacuaaaguguaau

SEQ ID NO: 2199225 - RNA, 23 nt, Streptococcus pneumoniae R6
aaaacuaaaguguaaugcuauug

SEQ ID NO: 2199226 - RNA, 22 nt, Streptococcus pneumoniae R6
aaaacguuguuuucacgauuca

SEQ ID NO: 2199227 - RNA, 17 nt, Streptococcus pneumoniae R6
aaaacguugguaaaagc

SEQ ID NO: 2199228 - RNA, 14 nt, Streptococcus pneumoniae R6
aaaacguuuuucaa

SEQ ID NO: 2199229 - RNA, 20 nt, Streptococcus pneumoniae R6
aaaacguuuuucaaaccuuc

SEQ ID NO: 2199230 - RNA, 20 nt, Streptococcus pneumoniae R6
aaaacuagaauagaaacaaa

SEQ ID NO: 2199231 - RNA, 19 nt, Streptococcus pneumoniae R6
aaaacuagcaaugccaaag

SEQ ID NO: 2199232 - RNA, 14 nt, Streptococcus pneumoniae R6
aaaacuaguuuaaa

SEQ ID NO: 2199233 - RNA, 15 nt, Streptococcus pneumoniae R6
aaaacuaguuuaaaa

SEQ ID NO: 2199234 - RNA, 21 nt, Streptococcus pneumoniae R6
aaaacuaguuuaaaucauaau

SEQ ID NO: 2199235 - RNA, 17 nt, Streptococcus pneumoniae R6
aaaacuauaaaugauga

SEQ ID NO: 2199236 - RNA, 16 nt, Streptococcus pneumoniae R6
aaaacuaauuuagaga

SEQ ID NO: 2199237 - RNA, 14 nt, Streptococcus pneumoniae R6
aaaagcacucaaua

SEQ ID NO: 2199238 - RNA, 17 nt, Streptococcus pneumoniae R6
aaaagcacucaauauua

SEQ ID NO: 2199239 - RNA, 14 nt, Streptococcus pneumoniae R6
aaaagauuucuaua

SEQ ID NO: 2199240 - RNA, 19 nt, Streptococcus pneumoniae R6
aaaagauuugaaacuaaau

SEQ ID NO: 2199241 - RNA, 14 nt, Streptococcus pneumoniae R6
aaaagcaaauagca

SEQ ID NO: 2199242 - RNA, 14 nt, Streptococcus pneumoniae R6
aaaagcaagagcug

SEQ ID NO: 2199243 - RNA, 21 nt, Streptococcus pneumoniae R6
aaaagaguuucgaaaagaauu

SEQ ID NO: 2199244 - RNA, 21 nt, Streptococcus pneumoniae R6
aaaagaggagguaaaucccaa

SEQ ID NO: 2199245 - RNA, 19 nt, Streptococcus pneumoniae R6
aaaagauagagaaagaaaa

SEQ ID NO: 2199246 - RNA, 14 nt, Streptococcus pneumoniae R6
aaaagauagcuaug

SEQ ID NO: 2199247 - RNA, 18 nt, Streptococcus pneumoniae R6
aaaagauagcuaugaaua

SEQ ID NO: 2199248 - RNA, 15 nt, Streptococcus pneumoniae R6
aaaagauaaucaucu

SEQ ID NO: 2199249 - RNA, 22 nt, Streptococcus pneumoniae R6
aaaagaucaguucauuuuuccu

SEQ ID NO: 2199250 - RNA, 19 nt, Streptococcus pneumoniae R6
aaaagauguucaaagauuu

SEQ ID NO: 2199251 - RNA, 15 nt, Streptococcus pneumoniae R6
aaaagaaguaaaucu

SEQ ID NO: 2199252 - RNA, 19 nt, Streptococcus pneumoniae R6
aaaagaaguaaaucuuccc

SEQ ID NO: 2199253 - RNA, 17 nt, Streptococcus pneumoniae R6
aaaagacguauucaguc

SEQ ID NO: 2199254 - RNA, 11 nt, Streptococcus pneumoniae R6
aaaagagaaag

SEQ ID NO: 2199255 - RNA, 19 nt, Streptococcus pneumoniae R6
aaaagagaaagacuugacc

SEQ ID NO: 2199256 - RNA, 14 nt, Streptococcus pneumoniae R6
aaaagagcaagaac

SEQ ID NO: 2199257 - RNA, 21 nt, Streptococcus pneumoniae R6
aaaagagccucauaaaaggua

SEQ ID NO: 2199258 - RNA, 20 nt, Streptococcus pneumoniae R6
aaaagagaguuacaaacucu

SEQ ID NO: 2199259 - RNA, 23 nt, Streptococcus pneumoniae R6
aaaacaucuaccuauucauauau

SEQ ID NO: 2199260 - RNA, 17 nt, Streptococcus pneumoniae R6
aaaacaucucagaauaa

SEQ ID NO: 2199261 - RNA, 13 nt, Streptococcus pneumoniae R6
aaaacagaaaaau

SEQ ID NO: 2199262 - RNA, 17 nt, Streptococcus pneumoniae R6
aaaacagaaaaaucugu

SEQ ID NO: 2199263 - RNA, 21 nt, Streptococcus pneumoniae R6
aaaacagaggcuggacaaaaa

SEQ ID NO: 2199264 - RNA, 21 nt, Streptococcus pneumoniae R6
aaaacauuuccgauuucagaa

SEQ ID NO: 2199265 - RNA, 13 nt, Streptococcus pneumoniae R6
aaaaccaaaaagu

SEQ ID NO: 2199266 - RNA, 16 nt, Streptococcus pneumoniae R6
aaaacauuguuaaaaa

SEQ ID NO: 2199267 - RNA, 23 nt, Streptococcus pneumoniae R6
aaaacauuguuaaaaauugauuu

SEQ ID NO: 2199268 - RNA, 22 nt, Streptococcus pneumoniae R6
aaaacauuuauagaaauuaauu

SEQ ID NO: 2199269 - RNA, 23 nt, Streptococcus pneumoniae R6
aaaacauucuuaucaauugauuu

SEQ ID NO: 2199270 - RNA, 22 nt, Streptococcus pneumoniae R6
aaaacaugaaguaaauauuucu

SEQ ID NO: 2199271 - RNA, 15 nt, Streptococcus pneumoniae R6
aaaacagacaaaacu

SEQ ID NO: 2199272 - RNA, 12 nt, Streptococcus pneumoniae R6
aaaacacuguuu

SEQ ID NO: 2199273 - RNA, 22 nt, Streptococcus pneumoniae R6
aaaacacuguuuuaagguugug

SEQ ID NO: 2199274 - RNA, 21 nt, Streptococcus pneumoniae R6
aaaacacuguuuugagguugu

SEQ ID NO: 2199275 - RNA, 16 nt, Streptococcus pneumoniae R6
aaaacaccuucugcuu

SEQ ID NO: 2199276 - RNA, 22 nt, Streptococcus pneumoniae R6
aaaacaccuucugcuucuaaau

SEQ ID NO: 2199277 - RNA, 18 nt, Streptococcus pneumoniae R6
aaaacaauaucagcugcc

SEQ ID NO: 2199278 - RNA, 20 nt, Streptococcus pneumoniae R6
aaaacaccccaugauaugaa

SEQ ID NO: 2199279 - RNA, 16 nt, Streptococcus pneumoniae R6
aaaacacaaaaggagg

SEQ ID NO: 2199280 - RNA, 22 nt, Streptococcus pneumoniae R6
aaaacaauguuuugaucugacu

SEQ ID NO: 2199281 - RNA, 16 nt, Streptococcus pneumoniae R6
aaaacaauugcccaaa

SEQ ID NO: 2199282 - RNA, 16 nt, Streptococcus pneumoniae R6
aaaaauuucuccgguu

SEQ ID NO: 2199283 - RNA, 15 nt, Streptococcus pneumoniae R6
aaaaauuagaaaaag

SEQ ID NO: 2199284 - RNA, 17 nt, Streptococcus pneumoniae R6
aaaaauuucauuucgac

SEQ ID NO: 2199285 - RNA, 17 nt, Streptococcus pneumoniae R6
aaaacaaguucuuuucu

SEQ ID NO: 2199286 - RNA, 22 nt, Streptococcus pneumoniae R6
aaaaauuuuauuuaagcaaaaa

SEQ ID NO: 2199287 - RNA, 23 nt, Streptococcus pneumoniae R6
aaaaauuuuauuuaagcaaaaaa

SEQ ID NO: 2199288 - RNA, 19 nt, Streptococcus pneumoniae R6
aaaaauuuucaaaaucaga

SEQ ID NO: 2199289 - RNA, 12 nt, Streptococcus pneumoniae R6
aaaaauuuggaa

SEQ ID NO: 2199290 - RNA, 13 nt, Streptococcus pneumoniae R6
aaaaauccuuuuu

SEQ ID NO: 2199291 - RNA, 21 nt, Streptococcus pneumoniae R6
aaaaauccuguacggauuggu

SEQ ID NO: 2199292 - RNA, 19 nt, Streptococcus pneumoniae R6
aaaaauccgaagaaggcca

SEQ ID NO: 2199293 - RNA, 14 nt, Streptococcus pneumoniae R6
aaaaauauaguaua

SEQ ID NO: 2199294 - RNA, 16 nt, Streptococcus pneumoniae R6
aaaaauauacaaaaaa

SEQ ID NO: 2199295 - RNA, 22 nt, Streptococcus pneumoniae R6
aaaaauccacuugggaaaccaa

SEQ ID NO: 2199296 - RNA, 20 nt, Streptococcus pneumoniae R6
aaaaauccaugauccuucau

SEQ ID NO: 2199297 - RNA, 21 nt, Streptococcus pneumoniae R6
aaaaauagauuuuuaaauucu

SEQ ID NO: 2199298 - RNA, 20 nt, Streptococcus pneumoniae R6
aaaaauacaguauccacauu

SEQ ID NO: 2199299 - RNA, 11 nt, Streptococcus pneumoniae R6
aaaaauaaaaa

SEQ ID NO: 2199300 - RNA, 13 nt, Streptococcus pneumoniae R6
aaaaauaaaaaaa

SEQ ID NO: 2199301 - RNA, 14 nt, Streptococcus pneumoniae R6
aaaaauaaaaaaga

SEQ ID NO: 2199302 - RNA, 23 nt, Streptococcus pneumoniae R6
aaaaauaaaaaagagaguuacaa

SEQ ID NO: 2199303 - RNA, 12 nt, Streptococcus pneumoniae R6
aaaaauaaaucu

SEQ ID NO: 2199304 - RNA, 16 nt, Streptococcus pneumoniae R6
aaaaauaaacagcgag

SEQ ID NO: 2199305 - RNA, 13 nt, Streptococcus pneumoniae R6
aaaaauaaucaaa

SEQ ID NO: 2199306 - RNA, 14 nt, Streptococcus pneumoniae R6
aaaaauaaucaaaa

SEQ ID NO: 2199307 - RNA, 18 nt, Streptococcus pneumoniae R6
aaaaauaaucaaaacuau

SEQ ID NO: 2199308 - RNA, 17 nt, Streptococcus pneumoniae R6
aaacgauuuuuuucaaa

SEQ ID NO: 2199309 - RNA, 18 nt, Streptococcus pneumoniae R6
aaacgcaagcaacaaaaa

SEQ ID NO: 2199310 - RNA, 19 nt, Streptococcus pneumoniae R6
aaacgcaagcaacaaaaac

SEQ ID NO: 2199311 - RNA, 18 nt, Streptococcus pneumoniae R6
aaacgcauaguaucaagu

SEQ ID NO: 2199312 - RNA, 16 nt, Streptococcus pneumoniae R6
aaacgauuaucuaaca

SEQ ID NO: 2199313 - RNA, 14 nt, Streptococcus pneumoniae R6
aaacgauaaauucc

SEQ ID NO: 2199314 - RNA, 19 nt, Streptococcus pneumoniae R6
aaacgagucaagaagaggg

SEQ ID NO: 2199315 - RNA, 18 nt, Streptococcus pneumoniae R6
aaacgacuagauaaaaga

SEQ ID NO: 2199316 - RNA, 20 nt, Streptococcus pneumoniae R6
aaacgacuagauaaaagaau

SEQ ID NO: 2199317 - RNA, 14 nt, Streptococcus pneumoniae R6
aaaccuuauuuuuu

SEQ ID NO: 2199318 - RNA, 16 nt, Streptococcus pneumoniae R6
aaaccuuguuuuaaaa

SEQ ID NO: 2199319 - RNA, 17 nt, Streptococcus pneumoniae R6
aaaccuugcaaaacagg

SEQ ID NO: 2199320 - RNA, 13 nt, Streptococcus pneumoniae R6
aaaccuuguucuu

SEQ ID NO: 2199321 - RNA, 19 nt, Streptococcus pneumoniae R6
aaacgaaaggauuauaaaa

SEQ ID NO: 2199322 - RNA, 20 nt, Streptococcus pneumoniae R6
aaacgaacgccuuaaaaaac

SEQ ID NO: 2199323 - RNA, 17 nt, Streptococcus pneumoniae R6
aaacgaauacuuuguuu

SEQ ID NO: 2199324 - RNA, 13 nt, Streptococcus pneumoniae R6
aaacaagaacaag

SEQ ID NO: 2199325 - RNA, 16 nt, Streptococcus pneumoniae R6
aaacaagagcaaggaa

SEQ ID NO: 2199326 - RNA, 15 nt, Streptococcus pneumoniae R6
aaacaagauaggaga

SEQ ID NO: 2199327 - RNA, 15 nt, Streptococcus pneumoniae R6
aaacaacgucagcuu

SEQ ID NO: 2199328 - RNA, 17 nt, Streptococcus pneumoniae R6
aaacaacgucagcuuug

SEQ ID NO: 2199329 - RNA, 15 nt, Streptococcus pneumoniae R6
aaacaacuuauaaaa

SEQ ID NO: 2199330 - RNA, 16 nt, Streptococcus pneumoniae R6
aaacaacuuauaaaaa

SEQ ID NO: 2199331 - RNA, 17 nt, Streptococcus pneumoniae R6
aaacaagccuuuaucug

SEQ ID NO: 2199332 - RNA, 23 nt, Streptococcus pneumoniae R6
aaacguuuuuacuuuggcaaaga

SEQ ID NO: 2199333 - RNA, 21 nt, Streptococcus pneumoniae R6
aaacgugcuauaucaaaacca

SEQ ID NO: 2199334 - RNA, 23 nt, Streptococcus pneumoniae R6
aaacgugcuauaucaaaaccagu

SEQ ID NO: 2199335 - RNA, 19 nt, Streptococcus pneumoniae R6
aaacguccaaggcugaaau

SEQ ID NO: 2199336 - RNA, 19 nt, Streptococcus pneumoniae R6
aaacguccagccuugucuu

SEQ ID NO: 2199337 - RNA, 20 nt, Streptococcus pneumoniae R6
aaacguccagccuugucuug

SEQ ID NO: 2199338 - RNA, 17 nt, Streptococcus pneumoniae R6
aaacgcgauacaauaaa

SEQ ID NO: 2199339 - RNA, 18 nt, Streptococcus pneumoniae R6
aaacgcgauacaauaaag

SEQ ID NO: 2199340 - RNA, 19 nt, Streptococcus pneumoniae R6
aaacgcugcucaaaaucgu

SEQ ID NO: 2199341 - RNA, 21 nt, Streptococcus pneumoniae R6
aaacggauuuugugguugaaa

SEQ ID NO: 2199342 - RNA, 16 nt, Streptococcus pneumoniae R6
aaacggcauaaaaucu

SEQ ID NO: 2199343 - RNA, 16 nt, Streptococcus pneumoniae R6
aaacucaaauuuacca

SEQ ID NO: 2199344 - RNA, 17 nt, Streptococcus pneumoniae R6
aaacucaauuuaauacu

SEQ ID NO: 2199345 - RNA, 15 nt, Streptococcus pneumoniae R6
aaacuaguuuaaaag

SEQ ID NO: 2199346 - RNA, 22 nt, Streptococcus pneumoniae R6
aaacuagcauccaucccauuua

SEQ ID NO: 2199347 - RNA, 20 nt, Streptococcus pneumoniae R6
aaacuagcugcgggcugcuc

SEQ ID NO: 2199348 - RNA, 13 nt, Streptococcus pneumoniae R6
aaacuagaagugg

SEQ ID NO: 2199349 - RNA, 22 nt, Streptococcus pneumoniae R6
aaacuagaauagaaacaaaaua

SEQ ID NO: 2199350 - RNA, 16 nt, Streptococcus pneumoniae R6
aaacuagaauaggaca

SEQ ID NO: 2199351 - RNA, 16 nt, Streptococcus pneumoniae R6
aaacuagcaaugccaa

SEQ ID NO: 2199352 - RNA, 19 nt, Streptococcus pneumoniae R6
aaacuagucgcagguugcu

SEQ ID NO: 2199353 - RNA, 15 nt, Streptococcus pneumoniae R6
aaacuacgucagcuu

SEQ ID NO: 2199354 - RNA, 20 nt, Streptococcus pneumoniae R6
aaacuacguuuugcuaauca

SEQ ID NO: 2199355 - RNA, 13 nt, Streptococcus pneumoniae R6
aaacuagaaagcu

SEQ ID NO: 2199356 - RNA, 20 nt, Streptococcus pneumoniae R6
aaacuaagcuucaaaaaagu

SEQ ID NO: 2199357 - RNA, 20 nt, Streptococcus pneumoniae R6
aaacuacacccgcauaaaua

SEQ ID NO: 2199358 - RNA, 20 nt, Streptococcus pneumoniae R6
aaacuaaugagccuuaucau

SEQ ID NO: 2199359 - RNA, 18 nt, Streptococcus pneumoniae R6
aaacuaauguaaaaaagu

SEQ ID NO: 2199360 - RNA, 15 nt, Streptococcus pneumoniae R6
aaacucaguuaaaau

SEQ ID NO: 2199361 - RNA, 15 nt, Streptococcus pneumoniae R6
aaacucagguuucuc

SEQ ID NO: 2199362 - RNA, 22 nt, Streptococcus pneumoniae R6
aaacucagguuucucuacaguu

SEQ ID NO: 2199363 - RNA, 18 nt, Streptococcus pneumoniae R6
aaacuauugacuuuucuu

SEQ ID NO: 2199364 - RNA, 15 nt, Streptococcus pneumoniae R6
aaacucgaucugaau

SEQ ID NO: 2199365 - RNA, 18 nt, Streptococcus pneumoniae R6
aaacucgaucugaauguc

SEQ ID NO: 2199366 - RNA, 14 nt, Streptococcus pneumoniae R6
aaacucuuacaaaa

SEQ ID NO: 2199367 - RNA, 20 nt, Streptococcus pneumoniae R6
aaacucuuaucuaaucacgu

SEQ ID NO: 2199368 - RNA, 16 nt, Streptococcus pneumoniae R6
aaacugaacaaauuaa

SEQ ID NO: 2199369 - RNA, 14 nt, Streptococcus pneumoniae R6
aaacugacaacuug

SEQ ID NO: 2199370 - RNA, 19 nt, Streptococcus pneumoniae R6
aaacugaugaagucaaguc

SEQ ID NO: 2199371 - RNA, 14 nt, Streptococcus pneumoniae R6
aaacuggagcauuu

SEQ ID NO: 2199372 - RNA, 16 nt, Streptococcus pneumoniae R6
aaacuggagcauuucg

SEQ ID NO: 2199373 - RNA, 17 nt, Streptococcus pneumoniae R6
aaacugcgaagaaauca

SEQ ID NO: 2199374 - RNA, 18 nt, Streptococcus pneumoniae R6
aaacugcgaagaaaucau

SEQ ID NO: 2199375 - RNA, 17 nt, Streptococcus pneumoniae R6
aaacugcguuuugauua

SEQ ID NO: 2199376 - RNA, 15 nt, Streptococcus pneumoniae R6
aaacuguaugagaaa

SEQ ID NO: 2199377 - RNA, 20 nt, Streptococcus pneumoniae R6
aaacuguaaacgaauacuuu

SEQ ID NO: 2199378 - RNA, 19 nt, Streptococcus pneumoniae R6
aaacuguaaaguagcaaaa

SEQ ID NO: 2199379 - RNA, 18 nt, Streptococcus pneumoniae R6
aaacuguacaagaacaaa

SEQ ID NO: 2199380 - RNA, 15 nt, Streptococcus pneumoniae R6
aaacuggcaaaauua

SEQ ID NO: 2199381 - RNA, 22 nt, Streptococcus pneumoniae R6
aaacugguuccuuuuuagguac

SEQ ID NO: 2199382 - RNA, 17 nt, Streptococcus pneumoniae R6
aaacugguagaaagucu

SEQ ID NO: 2199383 - RNA, 12 nt, Streptococcus pneumoniae R6
aaacuuaaaaau

SEQ ID NO: 2199384 - RNA, 16 nt, Streptococcus pneumoniae R6
aaacuuaaauuuuugu

SEQ ID NO: 2199385 - RNA, 19 nt, Streptococcus pneumoniae R6
aaacugugauggauacuua

SEQ ID NO: 2199386 - RNA, 12 nt, Streptococcus pneumoniae R6
aaacuuaggaag

SEQ ID NO: 2199387 - RNA, 15 nt, Streptococcus pneumoniae R6
aaacuuaggaagcag

SEQ ID NO: 2199388 - RNA, 16 nt, Streptococcus pneumoniae R6
aaacuuaguaaacagu

SEQ ID NO: 2199389 - RNA, 16 nt, Streptococcus pneumoniae R6
aaacuuacuacacagc

SEQ ID NO: 2199390 - RNA, 18 nt, Streptococcus pneumoniae R6
aaacuucacgguuuguau

SEQ ID NO: 2199391 - RNA, 19 nt, Streptococcus pneumoniae R6
aaacuucacgguuuguauu

SEQ ID NO: 2199392 - RNA, 13 nt, Streptococcus pneumoniae R6
aaacuugaaauga

SEQ ID NO: 2199393 - RNA, 18 nt, Streptococcus pneumoniae R6
aaacuugcucagaggaga

SEQ ID NO: 2199394 - RNA, 22 nt, Streptococcus pneumoniae R6
aaacuuguaggcuucuugacca

SEQ ID NO: 2199395 - RNA, 17 nt, Streptococcus pneumoniae R6
aaacuugguaauuugaa

SEQ ID NO: 2199396 - RNA, 18 nt, Streptococcus pneumoniae R6
aaacuuuauauccuuguu

SEQ ID NO: 2199397 - RNA, 17 nt, Streptococcus pneumoniae R6
aaagagcugcauuugua

SEQ ID NO: 2199398 - RNA, 16 nt, Streptococcus pneumoniae R6
aaagagccgaaaaaau

SEQ ID NO: 2199399 - RNA, 18 nt, Streptococcus pneumoniae R6
aaagagccgaaaaaauag

SEQ ID NO: 2199400 - RNA, 23 nt, Streptococcus pneumoniae R6
aaagagcacugcuagcaucaucg

SEQ ID NO: 2199401 - RNA, 14 nt, Streptococcus pneumoniae R6
aaagagccauaaaa

SEQ ID NO: 2199402 - RNA, 15 nt, Streptococcus pneumoniae R6
aaagagccauaaaaa

SEQ ID NO: 2199403 - RNA, 19 nt, Streptococcus pneumoniae R6
aaagagccauaaaaauaac

SEQ ID NO: 2199404 - RNA, 19 nt, Streptococcus pneumoniae R6
aaagaguuuuuuaucuuug

SEQ ID NO: 2199405 - RNA, 20 nt, Streptococcus pneumoniae R6
aaagauaacugcuagaaaug

SEQ ID NO: 2199406 - RNA, 22 nt, Streptococcus pneumoniae R6
aaagacuggugagauaaaacgu

SEQ ID NO: 2199407 - RNA, 13 nt, Streptococcus pneumoniae R6
aaagacuuagucu

SEQ ID NO: 2199408 - RNA, 15 nt, Streptococcus pneumoniae R6
aaagacuuuuuucca

SEQ ID NO: 2199409 - RNA, 18 nt, Streptococcus pneumoniae R6
aaagacuuuuuucuauag

SEQ ID NO: 2199410 - RNA, 13 nt, Streptococcus pneumoniae R6
aaagacuugaaau

SEQ ID NO: 2199411 - RNA, 23 nt, Streptococcus pneumoniae R6
aaagacuugaccggagaaagaau

SEQ ID NO: 2199412 - RNA, 15 nt, Streptococcus pneumoniae R6
aaagaccguuugaaa

SEQ ID NO: 2199413 - RNA, 18 nt, Streptococcus pneumoniae R6
aaagaccguuugaaaaag

SEQ ID NO: 2199414 - RNA, 19 nt, Streptococcus pneumoniae R6
aaagaccuacccaaaugga

SEQ ID NO: 2199415 - RNA, 22 nt, Streptococcus pneumoniae R6
aaagaccuuugaaaacugaaca

SEQ ID NO: 2199416 - RNA, 16 nt, Streptococcus pneumoniae R6
aaacuuugagccuagu

SEQ ID NO: 2199417 - RNA, 19 nt, Streptococcus pneumoniae R6
aaagaaguaaaucuuccca

SEQ ID NO: 2199418 - RNA, 23 nt, Streptococcus pneumoniae R6
aaagaaggaauucaagcaaaaca

SEQ ID NO: 2199419 - RNA, 19 nt, Streptococcus pneumoniae R6
aaagaaggauugagaagcc

SEQ ID NO: 2199420 - RNA, 23 nt, Streptococcus pneumoniae R6
aaagaaggauugagaagccaaaa

SEQ ID NO: 2199421 - RNA, 20 nt, Streptococcus pneumoniae R6
aaagaagguauucauaaaau

SEQ ID NO: 2199422 - RNA, 22 nt, Streptococcus pneumoniae R6
aaagcacugccauuaauuccug

SEQ ID NO: 2199423 - RNA, 22 nt, Streptococcus pneumoniae R6
aaagcagaugaguguaaaaaga

SEQ ID NO: 2199424 - RNA, 23 nt, Streptococcus pneumoniae R6
aaagcagaugaguguaaaaagaa

SEQ ID NO: 2199425 - RNA, 15 nt, Streptococcus pneumoniae R6
aaagcagaugcaaaa

SEQ ID NO: 2199426 - RNA, 18 nt, Streptococcus pneumoniae R6
aaagauuuuuuaaaaagu

SEQ ID NO: 2199427 - RNA, 20 nt, Streptococcus pneumoniae R6
aaagauuucuauaaauucau

SEQ ID NO: 2199428 - RNA, 16 nt, Streptococcus pneumoniae R6
aaagauuugcuggaua

SEQ ID NO: 2199429 - RNA, 13 nt, Streptococcus pneumoniae R6
aaagauaucgguu

SEQ ID NO: 2199430 - RNA, 21 nt, Streptococcus pneumoniae R6
aaagauagagaaagaaaaacu

SEQ ID NO: 2199431 - RNA, 22 nt, Streptococcus pneumoniae R6
aaagauaccgucgacugcaguc

SEQ ID NO: 2199432 - RNA, 22 nt, Streptococcus pneumoniae R6
aaagcuggcuugaggucccaug

SEQ ID NO: 2199433 - RNA, 19 nt, Streptococcus pneumoniae R6
aaagcugugcuuugagcaa

SEQ ID NO: 2199434 - RNA, 21 nt, Streptococcus pneumoniae R6
aaaggaagagagcuccaaaug

SEQ ID NO: 2199435 - RNA, 14 nt, Streptococcus pneumoniae R6
aaaggacaaauuuu

SEQ ID NO: 2199436 - RNA, 22 nt, Streptococcus pneumoniae R6
aaaggacaaauuuuguccuuuc

SEQ ID NO: 2199437 - RNA, 23 nt, Streptococcus pneumoniae R6
aaaggaauuuuauuuucugauaa

SEQ ID NO: 2199438 - RNA, 20 nt, Streptococcus pneumoniae R6
aaaggcaacgaagcuagaaa

SEQ ID NO: 2199439 - RNA, 20 nt, Streptococcus pneumoniae R6
aaagcguguaggaaaccaau

SEQ ID NO: 2199440 - RNA, 22 nt, Streptococcus pneumoniae R6
aaagcguguaggaaaccaaucu

SEQ ID NO: 2199441 - RNA, 23 nt, Streptococcus pneumoniae R6
aaagcguuuauauaguagccaaa

SEQ ID NO: 2199442 - RNA, 20 nt, Streptococcus pneumoniae R6
aaagcuacuauaaaagagga

SEQ ID NO: 2199443 - RNA, 17 nt, Streptococcus pneumoniae R6
aaagcuaagaaaguaag

SEQ ID NO: 2199444 - RNA, 13 nt, Streptococcus pneumoniae R6
aaagcuaagcucg

SEQ ID NO: 2199445 - RNA, 15 nt, Streptococcus pneumoniae R6
aaagcuaaagaugau

SEQ ID NO: 2199446 - RNA, 12 nt, Streptococcus pneumoniae R6
aaagcuaaaucc

SEQ ID NO: 2199447 - RNA, 13 nt, Streptococcus pneumoniae R6
aaagcuaaauccu

SEQ ID NO: 2199448 - RNA, 18 nt, Streptococcus pneumoniae R6
aaagcuaaauccuuuuuu

SEQ ID NO: 2199449 - RNA, 14 nt, Streptococcus pneumoniae R6
aaagcccuauauua

SEQ ID NO: 2199450 - RNA, 21 nt, Streptococcus pneumoniae R6
aaagccgacccaggcaaagag

SEQ ID NO: 2199451 - RNA, 17 nt, Streptococcus pneumoniae R6
aaagccgagcaagaauu

SEQ ID NO: 2199452 - RNA, 14 nt, Streptococcus pneumoniae R6
aaagguuuuugaug

SEQ ID NO: 2199453 - RNA, 23 nt, Streptococcus pneumoniae R6
aaagguucuuuuauccuguucuu

SEQ ID NO: 2199454 - RNA, 16 nt, Streptococcus pneumoniae R6
aaagguguucaaucca

SEQ ID NO: 2199455 - RNA, 21 nt, Streptococcus pneumoniae R6
aaagggauaaguugauacuua

SEQ ID NO: 2199456 - RNA, 22 nt, Streptococcus pneumoniae R6
aaagggacaaaacuuuuuaaaa

SEQ ID NO: 2199457 - RNA, 19 nt, Streptococcus pneumoniae R6
aaaggcaucuugucaaaga

SEQ ID NO: 2199458 - RNA, 20 nt, Streptococcus pneumoniae R6
aaaggcaucuugucaaagag

SEQ ID NO: 2199459 - RNA, 22 nt, Streptococcus pneumoniae R6
aaagggaaaucugaaaaauuaa

SEQ ID NO: 2199460 - RNA, 15 nt, Streptococcus pneumoniae R6
aaaguauuauaauau

SEQ ID NO: 2199461 - RNA, 17 nt, Streptococcus pneumoniae R6
aaaguauuauaauauaa

SEQ ID NO: 2199462 - RNA, 12 nt, Streptococcus pneumoniae R6
aaaguauuaaaa

SEQ ID NO: 2199463 - RNA, 15 nt, Streptococcus pneumoniae R6
aaaguauuaaaauaa

SEQ ID NO: 2199464 - RNA, 13 nt, Streptococcus pneumoniae R6
aaagucaacagag

SEQ ID NO: 2199465 - RNA, 14 nt, Streptococcus pneumoniae R6
aaaguauuaaucac

SEQ ID NO: 2199466 - RNA, 16 nt, Streptococcus pneumoniae R6
aaagucaucaaaaucc

SEQ ID NO: 2199467 - RNA, 22 nt, Streptococcus pneumoniae R6
aaaguaaaaauuucuaugauaa

SEQ ID NO: 2199468 - RNA, 16 nt, Streptococcus pneumoniae R6
aaaguaaugccaggcc

SEQ ID NO: 2199469 - RNA, 13 nt, Streptococcus pneumoniae R6
aaaguacgaaggg

SEQ ID NO: 2199470 - RNA, 14 nt, Streptococcus pneumoniae R6
aaaguacugccuug

SEQ ID NO: 2199471 - RNA, 15 nt, Streptococcus pneumoniae R6
aaaucagaaaaaacg

SEQ ID NO: 2199472 - RNA, 14 nt, Streptococcus pneumoniae R6
aaaucagaaaaacg

SEQ ID NO: 2199473 - RNA, 14 nt, Streptococcus pneumoniae R6
aaaucagaaaagua

SEQ ID NO: 2199474 - RNA, 16 nt, Streptococcus pneumoniae R6
aaaucagauaagcacc

SEQ ID NO: 2199475 - RNA, 19 nt, Streptococcus pneumoniae R6
aaaucacgcuaaguagaaa

SEQ ID NO: 2199476 - RNA, 23 nt, Streptococcus pneumoniae R6
aaaucacguggagucugaccaug

SEQ ID NO: 2199477 - RNA, 17 nt, Streptococcus pneumoniae R6
aaaucauaauccaacac

SEQ ID NO: 2199478 - RNA, 17 nt, Streptococcus pneumoniae R6
aaaucauacugccaaga

SEQ ID NO: 2199479 - RNA, 18 nt, Streptococcus pneumoniae R6
aaaucauaaacuauccag

SEQ ID NO: 2199480 - RNA, 18 nt, Streptococcus pneumoniae R6
aaaucauaaagccagucg

SEQ ID NO: 2199481 - RNA, 19 nt, Streptococcus pneumoniae R6
aaaucagguguucaaaaac

SEQ ID NO: 2199482 - RNA, 22 nt, Streptococcus pneumoniae R6
aaaucaggucuuauagaaacau

SEQ ID NO: 2199483 - RNA, 18 nt, Streptococcus pneumoniae R6
aaaucagcucucugauuu

SEQ ID NO: 2199484 - RNA, 15 nt, Streptococcus pneumoniae R6
aaaucaggaaaucuu

SEQ ID NO: 2199485 - RNA, 15 nt, Streptococcus pneumoniae R6
aaaucaggauuuuua

SEQ ID NO: 2199486 - RNA, 17 nt, Streptococcus pneumoniae R6
aaaucaagggaaaauga

SEQ ID NO: 2199487 - RNA, 13 nt, Streptococcus pneumoniae R6
aaaucaaauuuau

SEQ ID NO: 2199488 - RNA, 21 nt, Streptococcus pneumoniae R6
aaaucaacggccgaacuuuug

SEQ ID NO: 2199489 - RNA, 14 nt, Streptococcus pneumoniae R6
aaaucaaugacaau

SEQ ID NO: 2199490 - RNA, 13 nt, Streptococcus pneumoniae R6
aaaucaauuucua

SEQ ID NO: 2199491 - RNA, 13 nt, Streptococcus pneumoniae R6
aaaucaauuuuua

SEQ ID NO: 2199492 - RNA, 14 nt, Streptococcus pneumoniae R6
aaaucaauuuuccu

SEQ ID NO: 2199493 - RNA, 19 nt, Streptococcus pneumoniae R6
aaaucacaauuccuaagau

SEQ ID NO: 2199494 - RNA, 13 nt, Streptococcus pneumoniae R6
aaaucacaaaaac

SEQ ID NO: 2199495 - RNA, 14 nt, Streptococcus pneumoniae R6
aaaucacagaccga

SEQ ID NO: 2199496 - RNA, 16 nt, Streptococcus pneumoniae R6
aaaucacaucugcuag

SEQ ID NO: 2199497 - RNA, 17 nt, Streptococcus pneumoniae R6
aaauaugauggaagacu

SEQ ID NO: 2199498 - RNA, 14 nt, Streptococcus pneumoniae R6
aaauaugaucgauu

SEQ ID NO: 2199499 - RNA, 13 nt, Streptococcus pneumoniae R6
aaauaugaucuau

SEQ ID NO: 2199500 - RNA, 15 nt, Streptococcus pneumoniae R6
aaauauggcacaaaa

SEQ ID NO: 2199501 - RNA, 14 nt, Streptococcus pneumoniae R6
aaauauucaccaca

SEQ ID NO: 2199502 - RNA, 11 nt, Streptococcus pneumoniae R6
aaauaggcucc

SEQ ID NO: 2199503 - RNA, 17 nt, Streptococcus pneumoniae R6
aaauaguacgaaacaau

SEQ ID NO: 2199504 - RNA, 20 nt, Streptococcus pneumoniae R6
aaauaguauaccacacuaaa

SEQ ID NO: 2199505 - RNA, 12 nt, Streptococcus pneumoniae R6
aaaucaaaauau

SEQ ID NO: 2199506 - RNA, 14 nt, Streptococcus pneumoniae R6
aaaucaaaauauag

SEQ ID NO: 2199507 - RNA, 11 nt, Streptococcus pneumoniae R6
aaaucaaagac

SEQ ID NO: 2199508 - RNA, 13 nt, Streptococcus pneumoniae R6
aaaucaaagagca

SEQ ID NO: 2199509 - RNA, 14 nt, Streptococcus pneumoniae R6
aaaucaaagagcaa

SEQ ID NO: 2199510 - RNA, 17 nt, Streptococcus pneumoniae R6
aaaucaaagagcaaacu

SEQ ID NO: 2199511 - RNA, 21 nt, Streptococcus pneumoniae R6
aaauauuguuuuaauauaaua

SEQ ID NO: 2199512 - RNA, 17 nt, Streptococcus pneumoniae R6
aaauauuuuaaacguuu

SEQ ID NO: 2199513 - RNA, 17 nt, Streptococcus pneumoniae R6
aaauauuuuaguauucc

SEQ ID NO: 2199514 - RNA, 18 nt, Streptococcus pneumoniae R6
aaauauuuugcuguuuau

SEQ ID NO: 2199515 - RNA, 22 nt, Streptococcus pneumoniae R6
aaauauuuugcuguuuauaucu

SEQ ID NO: 2199516 - RNA, 16 nt, Streptococcus pneumoniae R6
aaauauuuuuuacuuu

SEQ ID NO: 2199517 - RNA, 20 nt, Streptococcus pneumoniae R6
aaauauuucgcuuauaaacu

SEQ ID NO: 2199518 - RNA, 16 nt, Streptococcus pneumoniae R6
aaauaaucaaaacuau

SEQ ID NO: 2199519 - RNA, 16 nt, Streptococcus pneumoniae R6
aaauaaucucugaacu

SEQ ID NO: 2199520 - RNA, 19 nt, Streptococcus pneumoniae R6
aaauacuaaaaaaaaaaag

SEQ ID NO: 2199521 - RNA, 21 nt, Streptococcus pneumoniae R6
aaauacuagauucuauuuuuu

SEQ ID NO: 2199522 - RNA, 23 nt, Streptococcus pneumoniae R6
aaauacucggaggacaucacugu

SEQ ID NO: 2199523 - RNA, 16 nt, Streptococcus pneumoniae R6
aaauacuaucaauaaa

SEQ ID NO: 2199524 - RNA, 20 nt, Streptococcus pneumoniae R6
aaauagcuccuuuaacauuu

SEQ ID NO: 2199525 - RNA, 17 nt, Streptococcus pneumoniae R6
aaauaggaaucaaccaa

SEQ ID NO: 2199526 - RNA, 21 nt, Streptococcus pneumoniae R6
aaauagccaagaccaauccua

SEQ ID NO: 2199527 - RNA, 18 nt, Streptococcus pneumoniae R6
aaauagcauccaccacuu

SEQ ID NO: 2199528 - RNA, 14 nt, Streptococcus pneumoniae R6
aaauagcaguaacu

SEQ ID NO: 2199529 - RNA, 23 nt, Streptococcus pneumoniae R6
aaauagcaguaacuucugucuau

SEQ ID NO: 2199530 - RNA, 16 nt, Streptococcus pneumoniae R6
aaauagccccuagaua

SEQ ID NO: 2199531 - RNA, 22 nt, Streptococcus pneumoniae R6
aaauagccccuagauauuuuga

SEQ ID NO: 2199532 - RNA, 18 nt, Streptococcus pneumoniae R6
aaauagcccuucggauaa

SEQ ID NO: 2199533 - RNA, 11 nt, Streptococcus pneumoniae R6
aaauacuugua

SEQ ID NO: 2199534 - RNA, 21 nt, Streptococcus pneumoniae R6
aaauaaaauuuuuuucaaauu

SEQ ID NO: 2199535 - RNA, 17 nt, Streptococcus pneumoniae R6
aaagucggaaggcauga

SEQ ID NO: 2199536 - RNA, 18 nt, Streptococcus pneumoniae R6
aaaguccucauuucaaua

SEQ ID NO: 2199537 - RNA, 14 nt, Streptococcus pneumoniae R6
aaauaacaaaccaa

SEQ ID NO: 2199538 - RNA, 20 nt, Streptococcus pneumoniae R6
aaauaacaaaccaagaauaa

SEQ ID NO: 2199539 - RNA, 23 nt, Streptococcus pneumoniae R6
aaauaacccaccaagucaucaaa

SEQ ID NO: 2199540 - RNA, 16 nt, Streptococcus pneumoniae R6
aaauaacuguaauuuc

SEQ ID NO: 2199541 - RNA, 15 nt, Streptococcus pneumoniae R6
aaauaagaaagacca

SEQ ID NO: 2199542 - RNA, 20 nt, Streptococcus pneumoniae R6
aaauaacgccucuacacuau

SEQ ID NO: 2199543 - RNA, 11 nt, Streptococcus pneumoniae R6
aaauaagcucg

SEQ ID NO: 2199544 - RNA, 16 nt, Streptococcus pneumoniae R6
aaauaagcucuguuuu

SEQ ID NO: 2199545 - RNA, 23 nt, Streptococcus pneumoniae R6
aaauaagcucuguuuuuggauuu

SEQ ID NO: 2199546 - RNA, 22 nt, Streptococcus pneumoniae R6
aaauaagggcaaagaaaaggaa

SEQ ID NO: 2199547 - RNA, 18 nt, Streptococcus pneumoniae R6
aaauaagguuuagcaaaa

SEQ ID NO: 2199548 - RNA, 21 nt, Streptococcus pneumoniae R6
aaauaagguuuagcaaaagca

SEQ ID NO: 2199549 - RNA, 21 nt, Streptococcus pneumoniae R6
aaauaagccgaagccaaucaa

SEQ ID NO: 2199550 - RNA, 16 nt, Streptococcus pneumoniae R6
aaauaagaacaggaca

SEQ ID NO: 2199551 - RNA, 17 nt, Streptococcus pneumoniae R6
aaauaagaacaggacaa

SEQ ID NO: 2199552 - RNA, 20 nt, Streptococcus pneumoniae R6
aaauaauaagcuuugaaaau

SEQ ID NO: 2199553 - RNA, 22 nt, Streptococcus pneumoniae R6
aaauaauaagcuuugaaaauuc

SEQ ID NO: 2199554 - RNA, 19 nt, Streptococcus pneumoniae R6
aaauaaguucaacaaauca

SEQ ID NO: 2199555 - RNA, 22 nt, Streptococcus pneumoniae R6
aaauaaguucaacaaaucagaa

SEQ ID NO: 2199556 - RNA, 17 nt, Streptococcus pneumoniae R6
aaauaaguucuguuuag

SEQ ID NO: 2199557 - RNA, 21 nt, Streptococcus pneumoniae R6
aaauaagucagcucacaaaaa

SEQ ID NO: 2199558 - RNA, 19 nt, Streptococcus pneumoniae R6
aaauaauacucaaugaaaa

SEQ ID NO: 2199559 - RNA, 20 nt, Streptococcus pneumoniae R6
aaauaauacucaaugaaaau

SEQ ID NO: 2199560 - RNA, 15 nt, Streptococcus pneumoniae R6
aaauuccuuuaaaaa

SEQ ID NO: 2199561 - RNA, 21 nt, Streptococcus pneumoniae R6
aaauuccuugaugagcaaagg

SEQ ID NO: 2199562 - RNA, 20 nt, Streptococcus pneumoniae R6
aaauucccucugacgagaaa

SEQ ID NO: 2199563 - RNA, 20 nt, Streptococcus pneumoniae R6
aaauucccuuauccacauca

SEQ ID NO: 2199564 - RNA, 23 nt, Streptococcus pneumoniae R6
aaauucccuuauccacaucauca

SEQ ID NO: 2199565 - RNA, 23 nt, Streptococcus pneumoniae R6
aaauucccuuuuugauuuuaaau

SEQ ID NO: 2199566 - RNA, 18 nt, Streptococcus pneumoniae R6
aaauucuccacagaccug

SEQ ID NO: 2199567 - RNA, 17 nt, Streptococcus pneumoniae R6
aaauucguccuuucuuu

SEQ ID NO: 2199568 - RNA, 14 nt, Streptococcus pneumoniae R6
aaauucguuucauu

SEQ ID NO: 2199569 - RNA, 16 nt, Streptococcus pneumoniae R6
aaauucguuucauuau

SEQ ID NO: 2199570 - RNA, 14 nt, Streptococcus pneumoniae R6
aaauucaagaauga

SEQ ID NO: 2199571 - RNA, 17 nt, Streptococcus pneumoniae R6
aaauucaauguuuacuc

SEQ ID NO: 2199572 - RNA, 14 nt, Streptococcus pneumoniae R6
aaauucaccaacua

SEQ ID NO: 2199573 - RNA, 16 nt, Streptococcus pneumoniae R6
aaauucaccaauuuua

SEQ ID NO: 2199574 - RNA, 21 nt, Streptococcus pneumoniae R6
aaauucaccaauuuuaccuuu

SEQ ID NO: 2199575 - RNA, 15 nt, Streptococcus pneumoniae R6
aaauucaauucacua

SEQ ID NO: 2199576 - RNA, 21 nt, Streptococcus pneumoniae R6
aaauuccaucguuccugucuu

SEQ ID NO: 2199577 - RNA, 13 nt, Streptococcus pneumoniae R6
aaauuccauucga

SEQ ID NO: 2199578 - RNA, 15 nt, Streptococcus pneumoniae R6
aaauuaugaugcaua

SEQ ID NO: 2199579 - RNA, 18 nt, Streptococcus pneumoniae R6
aaauuauguuuuugaaua

SEQ ID NO: 2199580 - RNA, 15 nt, Streptococcus pneumoniae R6
aaauuauucuuaucu

SEQ ID NO: 2199581 - RNA, 20 nt, Streptococcus pneumoniae R6
aaauguugaaucauuuuguu

SEQ ID NO: 2199582 - RNA, 14 nt, Streptococcus pneumoniae R6
aaauguucuguaau

SEQ ID NO: 2199583 - RNA, 20 nt, Streptococcus pneumoniae R6
aaauguucuguaaugaaaua

SEQ ID NO: 2199584 - RNA, 16 nt, Streptococcus pneumoniae R6
aaauuaaaaugcaaga

SEQ ID NO: 2199585 - RNA, 18 nt, Streptococcus pneumoniae R6
aaauuaacaaucccuuca

SEQ ID NO: 2199586 - RNA, 19 nt, Streptococcus pneumoniae R6
aaauuaauuuauagaaaaa

SEQ ID NO: 2199587 - RNA, 23 nt, Streptococcus pneumoniae R6
aaauuaauuuauagaaauauuuu

SEQ ID NO: 2199588 - RNA, 13 nt, Streptococcus pneumoniae R6
aaauuaauuugaa

SEQ ID NO: 2199589 - RNA, 13 nt, Streptococcus pneumoniae R6
aaauuaauuuuac

SEQ ID NO: 2199590 - RNA, 15 nt, Streptococcus pneumoniae R6
aaaaaggaaccaguu

SEQ ID NO: 2199591 - RNA, 14 nt, Streptococcus pneumoniae R6
aaaaaggaguaacu

SEQ ID NO: 2199592 - RNA, 16 nt, Streptococcus pneumoniae R6
aaaaagcuucauuuau

SEQ ID NO: 2199593 - RNA, 22 nt, Streptococcus pneumoniae R6
aaaaagcuugaguggaaaaacc

SEQ ID NO: 2199594 - RNA, 17 nt, Streptococcus pneumoniae R6
aaaaagcccuugaauua

SEQ ID NO: 2199595 - RNA, 23 nt, Streptococcus pneumoniae R6
aaaucaucugcaucaagaacaau

SEQ ID NO: 2199596 - RNA, 22 nt, Streptococcus pneumoniae R6
aaaucauagcauagaugacaaa

SEQ ID NO: 2199597 - RNA, 18 nt, Streptococcus pneumoniae R6
aaaucaucauaaaaauaa

SEQ ID NO: 2199598 - RNA, 20 nt, Streptococcus pneumoniae R6
aaaucaucgccaaaucauca

SEQ ID NO: 2199599 - RNA, 22 nt, Streptococcus pneumoniae R6
aaaucaucgccaaaucaucaaa

SEQ ID NO: 2199600 - RNA, 16 nt, Streptococcus pneumoniae R6
aaaucgauuauauuua

SEQ ID NO: 2199601 - RNA, 15 nt, Streptococcus pneumoniae R6
aaaucgauuucuaac

SEQ ID NO: 2199602 - RNA, 24 nt, Streptococcus pneumoniae R6
aaaucgauuucuaacaauguuuua

SEQ ID NO: 2199603 - RNA, 16 nt, Streptococcus pneumoniae R6
aaaucuaggacaaagc

SEQ ID NO: 2199604 - RNA, 13 nt, Streptococcus pneumoniae R6
aaaucuacuaucu

SEQ ID NO: 2199605 - RNA, 11 nt, Streptococcus pneumoniae R6
aaaucuaacuu

SEQ ID NO: 2199606 - RNA, 18 nt, Streptococcus pneumoniae R6
aaaucuaagucaaauaag

SEQ ID NO: 2199607 - RNA, 22 nt, Streptococcus pneumoniae R6
aaaucguuccagcgguaucaau

SEQ ID NO: 2199608 - RNA, 22 nt, Streptococcus pneumoniae R6
aaaucguuuaucacucaguuuc

SEQ ID NO: 2199609 - RNA, 18 nt, Streptococcus pneumoniae R6
aaaucuccagaccaccuu

SEQ ID NO: 2199610 - RNA, 17 nt, Streptococcus pneumoniae R6
aaaucucacuauucauc

SEQ ID NO: 2199611 - RNA, 20 nt, Streptococcus pneumoniae R6
aaaucuguacuaagcaugau

SEQ ID NO: 2199612 - RNA, 16 nt, Streptococcus pneumoniae R6
aaaucuccucuaccug

SEQ ID NO: 2199613 - RNA, 18 nt, Streptococcus pneumoniae R6
aaaucugucuaccuucag

SEQ ID NO: 2199614 - RNA, 16 nt, Streptococcus pneumoniae R6
aaaucuguuaaaaaau

SEQ ID NO: 2199615 - RNA, 17 nt, Streptococcus pneumoniae R6
aaaucuguuaaaaaaua

SEQ ID NO: 2199616 - RNA, 21 nt, Streptococcus pneumoniae R6
aaaucuguuaaaaaauaauca

SEQ ID NO: 2199617 - RNA, 18 nt, Streptococcus pneumoniae R6
aaaugaaauuuuucugcu

SEQ ID NO: 2199618 - RNA, 19 nt, Streptococcus pneumoniae R6
aaaugaaauuuuucugcuu

SEQ ID NO: 2199619 - RNA, 17 nt, Streptococcus pneumoniae R6
aaaugaaauauuuuuua

SEQ ID NO: 2199620 - RNA, 20 nt, Streptococcus pneumoniae R6
aaaugaaauauuuuuuacuu

SEQ ID NO: 2199621 - RNA, 23 nt, Streptococcus pneumoniae R6
aaaugaugaaucugaaucaaaau

SEQ ID NO: 2199622 - RNA, 14 nt, Streptococcus pneumoniae R6
aaaugaaauaaaau

SEQ ID NO: 2199623 - RNA, 20 nt, Streptococcus pneumoniae R6
aaaugaaauaauaacaggac

SEQ ID NO: 2199624 - RNA, 15 nt, Streptococcus pneumoniae R6
aaaugaaauaauacu

SEQ ID NO: 2199625 - RNA, 18 nt, Streptococcus pneumoniae R6
aaaugaaaaggcagauuc

SEQ ID NO: 2199626 - RNA, 14 nt, Streptococcus pneumoniae R6
aaaucuuuuacuuc

SEQ ID NO: 2199627 - RNA, 19 nt, Streptococcus pneumoniae R6
aaaucuucggauaaauuaa

SEQ ID NO: 2199628 - RNA, 22 nt, Streptococcus pneumoniae R6
aaaucuucccacaauaaaaagc

SEQ ID NO: 2199629 - RNA, 21 nt, Streptococcus pneumoniae R6
aaaucuuccuacauauguaag

SEQ ID NO: 2199630 - RNA, 19 nt, Streptococcus pneumoniae R6
aaaugcgccaccaacugca

SEQ ID NO: 2199631 - RNA, 23 nt, Streptococcus pneumoniae R6
aaaugcuucuuugauagcauuug

SEQ ID NO: 2199632 - RNA, 16 nt, Streptococcus pneumoniae R6
aauaaaacaaaaaaga

SEQ ID NO: 2199633 - RNA, 21 nt, Streptococcus pneumoniae R6
aaguuuuucccaccuuuucuc

SEQ ID NO: 2199634 - RNA, 21 nt, Streptococcus pneumoniae R6
aaguuuuugguaauuuucuuu

SEQ ID NO: 2199635 - RNA, 12 nt, Streptococcus pneumoniae R6
aaguuuuuguau

SEQ ID NO: 2199636 - RNA, 14 nt, Streptococcus pneumoniae R6
aaguuuuuugauuu

SEQ ID NO: 2199637 - RNA, 19 nt, Streptococcus pneumoniae R6
aaguuuuuugauuucuucu

SEQ ID NO: 2199638 - RNA, 19 nt, Streptococcus pneumoniae R6
aauaaacagcgagauugaa

SEQ ID NO: 2199639 - RNA, 13 nt, Streptococcus pneumoniae R6
aauaaaauuugaa

SEQ ID NO: 2199640 - RNA, 23 nt, Streptococcus pneumoniae R6
aauaaaauuugaacaaauuaauu

SEQ ID NO: 2199641 - RNA, 19 nt, Streptococcus pneumoniae R6
aauaaaauuccuuuaaaaa

SEQ ID NO: 2199642 - RNA, 16 nt, Streptococcus pneumoniae R6
aauaaaaugaaauaag

SEQ ID NO: 2199643 - RNA, 16 nt, Streptococcus pneumoniae R6
aauaaaaugaaauaau

SEQ ID NO: 2199644 - RNA, 14 nt, Streptococcus pneumoniae R6
aauaaaauauaacu

SEQ ID NO: 2199645 - RNA, 20 nt, Streptococcus pneumoniae R6
aauaaaacgcauaauaccaa

SEQ ID NO: 2199646 - RNA, 23 nt, Streptococcus pneumoniae R6
aauaaaacgcauaguacaagguu

SEQ ID NO: 2199647 - RNA, 19 nt, Streptococcus pneumoniae R6
aauaaaacgcauaguauca

SEQ ID NO: 2199648 - RNA, 15 nt, Streptococcus pneumoniae R6
aauaaaacuuuuaaa

SEQ ID NO: 2199649 - RNA, 13 nt, Streptococcus pneumoniae R6
aauaaagaaacuu

SEQ ID NO: 2199650 - RNA, 16 nt, Streptococcus pneumoniae R6
aauaaagacacuaaga

SEQ ID NO: 2199651 - RNA, 17 nt, Streptococcus pneumoniae R6
aauaaagacacuaagaa

SEQ ID NO: 2199652 - RNA, 14 nt, Streptococcus pneumoniae R6
aauaaauaaaacuc

SEQ ID NO: 2199653 - RNA, 19 nt, Streptococcus pneumoniae R6
aauaaagguaaaaccaaua

SEQ ID NO: 2199654 - RNA, 15 nt, Streptococcus pneumoniae R6
aauaaaguuccuuua

SEQ ID NO: 2199655 - RNA, 18 nt, Streptococcus pneumoniae R6
aauaacacgagaaacaau

SEQ ID NO: 2199656 - RNA, 21 nt, Streptococcus pneumoniae R6
aauaacacgagaaacaauaaa

SEQ ID NO: 2199657 - RNA, 15 nt, Streptococcus pneumoniae R6
aauaacacuccauuu

SEQ ID NO: 2199658 - RNA, 17 nt, Streptococcus pneumoniae R6
aauaacaaagucugguu

SEQ ID NO: 2199659 - RNA, 22 nt, Streptococcus pneumoniae R6
aaguggauuuuucuucuuuucu

SEQ ID NO: 2199660 - RNA, 14 nt, Streptococcus pneumoniae R6
aaguggcauugcuu

SEQ ID NO: 2199661 - RNA, 19 nt, Streptococcus pneumoniae R6
aaguggcauugcuucauaa

SEQ ID NO: 2199662 - RNA, 15 nt, Streptococcus pneumoniae R6
aagugggaacuagag

SEQ ID NO: 2199663 - RNA, 16 nt, Streptococcus pneumoniae R6
aagugcuuuugugauu

SEQ ID NO: 2199664 - RNA, 17 nt, Streptococcus pneumoniae R6
aagugcuuuugugauuu

SEQ ID NO: 2199665 - RNA, 16 nt, Streptococcus pneumoniae R6
aaguggaaagagcaga

SEQ ID NO: 2199666 - RNA, 17 nt, Streptococcus pneumoniae R6
aaguggaaagagcagaa

SEQ ID NO: 2199667 - RNA, 13 nt, Streptococcus pneumoniae R6
aagugcuaagaua

SEQ ID NO: 2199668 - RNA, 16 nt, Streptococcus pneumoniae R6
aagugcuaagauaaua

SEQ ID NO: 2199669 - RNA, 20 nt, Streptococcus pneumoniae R6
aagugauuuaaauguuuucu

SEQ ID NO: 2199670 - RNA, 23 nt, Streptococcus pneumoniae R6
aagugauuuaaauguuuucucau

SEQ ID NO: 2199671 - RNA, 17 nt, Streptococcus pneumoniae R6
aagucuugccuucaacc

SEQ ID NO: 2199672 - RNA, 17 nt, Streptococcus pneumoniae R6
aagucuugacaaagaaa

SEQ ID NO: 2199673 - RNA, 19 nt, Streptococcus pneumoniae R6
aagucuugacaaagaaaaa

SEQ ID NO: 2199674 - RNA, 20 nt, Streptococcus pneumoniae R6
aagucuugacaaagaaaaaa

SEQ ID NO: 2199675 - RNA, 14 nt, Streptococcus pneumoniae R6
aagucuuguuugag

SEQ ID NO: 2199676 - RNA, 16 nt, Streptococcus pneumoniae R6
aagucuuguuugagaa

SEQ ID NO: 2199677 - RNA, 12 nt, Streptococcus pneumoniae R6
aagucuuuaaaa

SEQ ID NO: 2199678 - RNA, 15 nt, Streptococcus pneumoniae R6
aaguaagaaucugca

SEQ ID NO: 2199679 - RNA, 22 nt, Streptococcus pneumoniae R6
aaguaagagaaacucaaaugua

SEQ ID NO: 2199680 - RNA, 18 nt, Streptococcus pneumoniae R6
aaguaacaccucuuccga

SEQ ID NO: 2199681 - RNA, 22 nt, Streptococcus pneumoniae R6
aaguaaaucuacaaagguuuga

SEQ ID NO: 2199682 - RNA, 18 nt, Streptococcus pneumoniae R6
aagucugggaaaaauuuu

SEQ ID NO: 2199683 - RNA, 18 nt, Streptococcus pneumoniae R6
aagucuguuauuucuuga

SEQ ID NO: 2199684 - RNA, 13 nt, Streptococcus pneumoniae R6
aagucuguauaga

SEQ ID NO: 2199685 - RNA, 23 nt, Streptococcus pneumoniae R6
aagucuguauagaccugaucaaa

SEQ ID NO: 2199686 - RNA, 18 nt, Streptococcus pneumoniae R6
aagucugucaccuuauca

SEQ ID NO: 2199687 - RNA, 22 nt, Streptococcus pneumoniae R6
aagucugucaccuuaucacgaa

SEQ ID NO: 2199688 - RNA, 13 nt, Streptococcus pneumoniae R6
aagucuuauaaua

SEQ ID NO: 2199689 - RNA, 21 nt, Streptococcus pneumoniae R6
aagucuucggagaagaaaaca

SEQ ID NO: 2199690 - RNA, 21 nt, Streptococcus pneumoniae R6
aagucuucuaacagcauguag

SEQ ID NO: 2199691 - RNA, 18 nt, Streptococcus pneumoniae R6
aaguaaugccaggccagu

SEQ ID NO: 2199692 - RNA, 22 nt, Streptococcus pneumoniae R6
aagucugaugccaucuucguaa

SEQ ID NO: 2199693 - RNA, 20 nt, Streptococcus pneumoniae R6
aaguucuuuucauaaagaga

SEQ ID NO: 2199694 - RNA, 15 nt, Streptococcus pneumoniae R6
aaguucuucucuuuu

SEQ ID NO: 2199695 - RNA, 14 nt, Streptococcus pneumoniae R6
aaguucuuuuguaa

SEQ ID NO: 2199696 - RNA, 21 nt, Streptococcus pneumoniae R6
aaguuggaauaguccucccuu

SEQ ID NO: 2199697 - RNA, 19 nt, Streptococcus pneumoniae R6
aaguuugguuuuuugacug

SEQ ID NO: 2199698 - RNA, 16 nt, Streptococcus pneumoniae R6
aaguuucggcaccaau

SEQ ID NO: 2199699 - RNA, 19 nt, Streptococcus pneumoniae R6
aaguuucggcaccaauaca

SEQ ID NO: 2199700 - RNA, 18 nt, Streptococcus pneumoniae R6
aaguuucuguaauuucua

SEQ ID NO: 2199701 - RNA, 15 nt, Streptococcus pneumoniae R6
aaguuugaugagauu

SEQ ID NO: 2199702 - RNA, 18 nt, Streptococcus pneumoniae R6
aaguuugaugagauuauu

SEQ ID NO: 2199703 - RNA, 17 nt, Streptococcus pneumoniae R6
aaguuuaucuagaauuu

SEQ ID NO: 2199704 - RNA, 23 nt, Streptococcus pneumoniae R6
aaguuuagaaucgucuguacaaa

SEQ ID NO: 2199705 - RNA, 18 nt, Streptococcus pneumoniae R6
aaguuuagauuaaaaaau

SEQ ID NO: 2199706 - RNA, 18 nt, Streptococcus pneumoniae R6
aaguuuauaucuaauaau

SEQ ID NO: 2199707 - RNA, 23 nt, Streptococcus pneumoniae R6
aaguuuauaucuaauaauuuuuc

SEQ ID NO: 2199708 - RNA, 17 nt, Streptococcus pneumoniae R6
aaguuuaugccuugcag

SEQ ID NO: 2199709 - RNA, 20 nt, Streptococcus pneumoniae R6
aaguucgaaaggcuuuauuc

SEQ ID NO: 2199710 - RNA, 19 nt, Streptococcus pneumoniae R6
aaguucggccguugauuua

SEQ ID NO: 2199711 - RNA, 23 nt, Streptococcus pneumoniae R6
aaguucgaugucaccaaacaaau

SEQ ID NO: 2199712 - RNA, 17 nt, Streptococcus pneumoniae R6
aaguuccuaaaaccaaa

SEQ ID NO: 2199713 - RNA, 19 nt, Streptococcus pneumoniae R6
aaguuagguuuuguuucuu

SEQ ID NO: 2199714 - RNA, 12 nt, Streptococcus pneumoniae R6
aaguuagaauaa

SEQ ID NO: 2199715 - RNA, 15 nt, Streptococcus pneumoniae R6
aaguuagaauaagga

SEQ ID NO: 2199716 - RNA, 21 nt, Streptococcus pneumoniae R6
aaguuagaauaaggaaaacau

SEQ ID NO: 2199717 - RNA, 18 nt, Streptococcus pneumoniae R6
aagugucuggaaugauaa

SEQ ID NO: 2199718 - RNA, 14 nt, Streptococcus pneumoniae R6
aagugucucccuuu

SEQ ID NO: 2199719 - RNA, 15 nt, Streptococcus pneumoniae R6
aaguuagacagaaaa

SEQ ID NO: 2199720 - RNA, 17 nt, Streptococcus pneumoniae R6
aaguuagacagaaaaaa

SEQ ID NO: 2199721 - RNA, 21 nt, Streptococcus pneumoniae R6
aagugguguuacgauuucaag

SEQ ID NO: 2199722 - RNA, 15 nt, Streptococcus pneumoniae R6
aagugguaucauaua

SEQ ID NO: 2199723 - RNA, 13 nt, Streptococcus pneumoniae R6
aauaauuaaauca

SEQ ID NO: 2199724 - RNA, 19 nt, Streptococcus pneumoniae R6
aauaauuaguucagaauuu

SEQ ID NO: 2199725 - RNA, 21 nt, Streptococcus pneumoniae R6
aauaaucccaccuagaacaag

SEQ ID NO: 2199726 - RNA, 20 nt, Streptococcus pneumoniae R6
aauacagcuuuuuucuuugc

SEQ ID NO: 2199727 - RNA, 22 nt, Streptococcus pneumoniae R6
aauacaagcucaucuuugauuu

SEQ ID NO: 2199728 - RNA, 21 nt, Streptococcus pneumoniae R6
aauacaauugcucuucugaaa

SEQ ID NO: 2199729 - RNA, 17 nt, Streptococcus pneumoniae R6
aauaauuucaaaaucuu

SEQ ID NO: 2199730 - RNA, 14 nt, Streptococcus pneumoniae R6
aauacaacaggaaa

SEQ ID NO: 2199731 - RNA, 19 nt, Streptococcus pneumoniae R6
aauacaacaggaaaagucu

SEQ ID NO: 2199732 - RNA, 14 nt, Streptococcus pneumoniae R6
aaaaauaucauuaa

SEQ ID NO: 2199733 - RNA, 15 nt, Streptococcus pneumoniae R6
aaaaauaugcauaau

SEQ ID NO: 2199734 - RNA, 18 nt, Streptococcus pneumoniae R6
aaaaauaugcuauugaaa

SEQ ID NO: 2199735 - RNA, 14 nt, Streptococcus pneumoniae R6
aaaaauauggcaca

SEQ ID NO: 2199736 - RNA, 19 nt, Streptococcus pneumoniae R6
aaaaaucaagcacuagacc

SEQ ID NO: 2199737 - RNA, 16 nt, Streptococcus pneumoniae R6
aaaaauccagauaggu

SEQ ID NO: 2199738 - RNA, 18 nt, Streptococcus pneumoniae R6
aauaaucaaaauauguuu

SEQ ID NO: 2199739 - RNA, 14 nt, Streptococcus pneumoniae R6
aauacgcaaaauca

SEQ ID NO: 2199740 - RNA, 14 nt, Streptococcus pneumoniae R6
aauacgaccaaucu

SEQ ID NO: 2199741 - RNA, 18 nt, Streptococcus pneumoniae R6
aauacggacauagcagau

SEQ ID NO: 2199742 - RNA, 20 nt, Streptococcus pneumoniae R6
aauacguuuucaaagcuacu

SEQ ID NO: 2199743 - RNA, 16 nt, Streptococcus pneumoniae R6
aauacuaaaauauuuc

SEQ ID NO: 2199744 - RNA, 18 nt, Streptococcus pneumoniae R6
aauacuaaaauauuucua

SEQ ID NO: 2199745 - RNA, 19 nt, Streptococcus pneumoniae R6
aauacuaaggaaagucaaa

SEQ ID NO: 2199746 - RNA, 23 nt, Streptococcus pneumoniae R6
aauacauauucccacaauaaaac

SEQ ID NO: 2199747 - RNA, 14 nt, Streptococcus pneumoniae R6
aauacuuuuuccug

SEQ ID NO: 2199748 - RNA, 20 nt, Streptococcus pneumoniae R6
aauacuuuuucguuugguaa

SEQ ID NO: 2199749 - RNA, 13 nt, Streptococcus pneumoniae R6
aauagaaaacaaa

SEQ ID NO: 2199750 - RNA, 12 nt, Streptococcus pneumoniae R6
aauagaaaaaau

SEQ ID NO: 2199751 - RNA, 19 nt, Streptococcus pneumoniae R6
aauagaaacaaaauauaua

SEQ ID NO: 2199752 - RNA, 23 nt, Streptococcus pneumoniae R6
aauacuuggacuagggaaagaag

SEQ ID NO: 2199753 - RNA, 13 nt, Streptococcus pneumoniae R6
aauagaaauaaaa

SEQ ID NO: 2199754 - RNA, 13 nt, Streptococcus pneumoniae R6
aauacuacaauaa

SEQ ID NO: 2199755 - RNA, 23 nt, Streptococcus pneumoniae R6
aauacuguggaauauagaggaua

SEQ ID NO: 2199756 - RNA, 14 nt, Streptococcus pneumoniae R6
aauacuucaacaaa

SEQ ID NO: 2199757 - RNA, 16 nt, Streptococcus pneumoniae R6
aauacugaaacaacau

SEQ ID NO: 2199758 - RNA, 17 nt, Streptococcus pneumoniae R6
aauacugauaaaaacau

SEQ ID NO: 2199759 - RNA, 20 nt, Streptococcus pneumoniae R6
aagaucuuuuuauacucaau

SEQ ID NO: 2199760 - RNA, 17 nt, Streptococcus pneumoniae R6
aagaucuugucugcaug

SEQ ID NO: 2199761 - RNA, 20 nt, Streptococcus pneumoniae R6
aagaugauuuuucuaaauuu

SEQ ID NO: 2199762 - RNA, 19 nt, Streptococcus pneumoniae R6
aagaugacaucuaaauaau

SEQ ID NO: 2199763 - RNA, 20 nt, Streptococcus pneumoniae R6
aagaugagacuugcaagaaa

SEQ ID NO: 2199764 - RNA, 17 nt, Streptococcus pneumoniae R6
aagaauuaggaaaacau

SEQ ID NO: 2199765 - RNA, 19 nt, Streptococcus pneumoniae R6
aagaauuaggaaaacauga

SEQ ID NO: 2199766 - RNA, 22 nt, Streptococcus pneumoniae R6
aagaucuagaaaggacaaauuu

SEQ ID NO: 2199767 - RNA, 23 nt, Streptococcus pneumoniae R6
aagaaugggauacuaucuccuuu

SEQ ID NO: 2199768 - RNA, 17 nt, Streptococcus pneumoniae R6
aagaaugggcucccacu

SEQ ID NO: 2199769 - RNA, 19 nt, Streptococcus pneumoniae R6
aagaaugggcucccacuuu

SEQ ID NO: 2199770 - RNA, 22 nt, Streptococcus pneumoniae R6
aagaaugggcucccacuuucaa

SEQ ID NO: 2199771 - RNA, 22 nt, Streptococcus pneumoniae R6
aagauguauaauggauugaaau

SEQ ID NO: 2199772 - RNA, 15 nt, Streptococcus pneumoniae R6
aagauguaaaaguuu

SEQ ID NO: 2199773 - RNA, 13 nt, Streptococcus pneumoniae R6
aagauggaaaaac

SEQ ID NO: 2199774 - RNA, 19 nt, Streptococcus pneumoniae R6
aagauggaguguucuaaaa

SEQ ID NO: 2199775 - RNA, 13 nt, Streptococcus pneumoniae R6
aagauuacagauc

SEQ ID NO: 2199776 - RNA, 23 nt, Streptococcus pneumoniae R6
aagauuccacguuucuaauaauu

SEQ ID NO: 2199777 - RNA, 17 nt, Streptococcus pneumoniae R6
aagauucaacaucacuu

SEQ ID NO: 2199778 - RNA, 14 nt, Streptococcus pneumoniae R6
aagauucuucuggu

SEQ ID NO: 2199779 - RNA, 19 nt, Streptococcus pneumoniae R6
aagauuccuccgagaagua

SEQ ID NO: 2199780 - RNA, 13 nt, Streptococcus pneumoniae R6
aagcaagugacaa

SEQ ID NO: 2199781 - RNA, 19 nt, Streptococcus pneumoniae R6
aagcaagugacaaagaccu

SEQ ID NO: 2199782 - RNA, 14 nt, Streptococcus pneumoniae R6
aagcaacuuuacga

SEQ ID NO: 2199783 - RNA, 17 nt, Streptococcus pneumoniae R6
aagcacacaaaucuucu

SEQ ID NO: 2199784 - RNA, 22 nt, Streptococcus pneumoniae R6
aagcacacaaaucuucuguaga

SEQ ID NO: 2199785 - RNA, 20 nt, Streptococcus pneumoniae R6
aagcaauuuugaaagauucg

SEQ ID NO: 2199786 - RNA, 20 nt, Streptococcus pneumoniae R6
aagauuuccuccauaaacgc

SEQ ID NO: 2199787 - RNA, 14 nt, Streptococcus pneumoniae R6
aagauuuccugauu

SEQ ID NO: 2199788 - RNA, 16 nt, Streptococcus pneumoniae R6
aagauuugaaacuaaa

SEQ ID NO: 2199789 - RNA, 23 nt, Streptococcus pneumoniae R6
aagauuuuaccuauaacauccug

SEQ ID NO: 2199790 - RNA, 15 nt, Streptococcus pneumoniae R6
aagauuuuuggaaaa

SEQ ID NO: 2199791 - RNA, 14 nt, Streptococcus pneumoniae R6
aagauuuuuuaaaa

SEQ ID NO: 2199792 - RNA, 16 nt, Streptococcus pneumoniae R6
aagauuuuuuaaaaag

SEQ ID NO: 2199793 - RNA, 19 nt, Streptococcus pneumoniae R6
aagauuuuuuaaaaaguuu

SEQ ID NO: 2199794 - RNA, 20 nt, Streptococcus pneumoniae R6
aagauuuuuuggauucucaa

SEQ ID NO: 2199795 - RNA, 10 nt, Streptococcus pneumoniae R6
aagcaaaaaa

SEQ ID NO: 2199796 - RNA, 13 nt, Streptococcus pneumoniae R6
aagcaaacauucc

SEQ ID NO: 2199797 - RNA, 15 nt, Streptococcus pneumoniae R6
aagcaaaaaaagccc

SEQ ID NO: 2199798 - RNA, 13 nt, Streptococcus pneumoniae R6
aagcaaaagaaca

SEQ ID NO: 2199799 - RNA, 22 nt, Streptococcus pneumoniae R6
aagcaaaaauggcaucugguuu

SEQ ID NO: 2199800 - RNA, 15 nt, Streptococcus pneumoniae R6
aagcaugauaugaag

SEQ ID NO: 2199801 - RNA, 16 nt, Streptococcus pneumoniae R6
aagcacggagaacaau

SEQ ID NO: 2199802 - RNA, 18 nt, Streptococcus pneumoniae R6
aagcacggagaacaauau

SEQ ID NO: 2199803 - RNA, 24 nt, Streptococcus pneumoniae R6
aagcaccuacaacauagacuuuac

SEQ ID NO: 2199804 - RNA, 20 nt, Streptococcus pneumoniae R6
aagcaccuaguacaaagaau

SEQ ID NO: 2199805 - RNA, 13 nt, Streptococcus pneumoniae R6
aagcccaaagaua

SEQ ID NO: 2199806 - RNA, 17 nt, Streptococcus pneumoniae R6
aagcccaugauaucuuu

SEQ ID NO: 2199807 - RNA, 15 nt, Streptococcus pneumoniae R6
aagcccuacuguacu

SEQ ID NO: 2199808 - RNA, 14 nt, Streptococcus pneumoniae R6
aagcauuuaaucca

SEQ ID NO: 2199809 - RNA, 20 nt, Streptococcus pneumoniae R6
aagcauuuucauaaggaagu

SEQ ID NO: 2199810 - RNA, 16 nt, Streptococcus pneumoniae R6
aagcauucuauuccau

SEQ ID NO: 2199811 - RNA, 13 nt, Streptococcus pneumoniae R6
aaguaaauauuuc

SEQ ID NO: 2199812 - RNA, 24 nt, Streptococcus pneumoniae R6
aagguuuagcaaaagcagcgacau

SEQ ID NO: 2199813 - RNA, 17 nt, Streptococcus pneumoniae R6
aagguuuccaaaccaac

SEQ ID NO: 2199814 - RNA, 18 nt, Streptococcus pneumoniae R6
aagguugaugaguaaguu

SEQ ID NO: 2199815 - RNA, 21 nt, Streptococcus pneumoniae R6
aagguugcauagaccaagaga

SEQ ID NO: 2199816 - RNA, 19 nt, Streptococcus pneumoniae R6
aagguuauaccaaaaaaac

SEQ ID NO: 2199817 - RNA, 17 nt, Streptococcus pneumoniae R6
aaggugcagagagauaa

SEQ ID NO: 2199818 - RNA, 19 nt, Streptococcus pneumoniae R6
aagguuaacgucaaaugac

SEQ ID NO: 2199819 - RNA, 17 nt, Streptococcus pneumoniae R6
aagguguucaauccaau

SEQ ID NO: 2199820 - RNA, 15 nt, Streptococcus pneumoniae R6
aagguauucauaaaa

SEQ ID NO: 2199821 - RNA, 18 nt, Streptococcus pneumoniae R6
aagguauucauaaaauac

SEQ ID NO: 2199822 - RNA, 15 nt, Streptococcus pneumoniae R6
aaggucaaaaugaug

SEQ ID NO: 2199823 - RNA, 22 nt, Streptococcus pneumoniae R6
aaggucaaaauuccuaaaauaa

SEQ ID NO: 2199824 - RNA, 14 nt, Streptococcus pneumoniae R6
aaggucaagagaaa

SEQ ID NO: 2199825 - RNA, 15 nt, Streptococcus pneumoniae R6
aaggucaagagaaaa

SEQ ID NO: 2199826 - RNA, 15 nt, Streptococcus pneumoniae R6
aagguacuugauuua

SEQ ID NO: 2199827 - RNA, 20 nt, Streptococcus pneumoniae R6
aagguaauccaauugaggaa

SEQ ID NO: 2199828 - RNA, 23 nt, Streptococcus pneumoniae R6
aagguaauccaauugaggaagua

SEQ ID NO: 2199829 - RNA, 14 nt, Streptococcus pneumoniae R6
aagguagagacaga

SEQ ID NO: 2199830 - RNA, 16 nt, Streptococcus pneumoniae R6
aagguaggagugaaaa

SEQ ID NO: 2199831 - RNA, 17 nt, Streptococcus pneumoniae R6
aagguaggagugaaaaa

SEQ ID NO: 2199832 - RNA, 17 nt, Streptococcus pneumoniae R6
aaggucauuugaaucau

SEQ ID NO: 2199833 - RNA, 18 nt, Streptococcus pneumoniae R6
aaggucugacaggcuauu

SEQ ID NO: 2199834 - RNA, 17 nt, Streptococcus pneumoniae R6
aaggucuuucaagcgaa

SEQ ID NO: 2199835 - RNA, 22 nt, Streptococcus pneumoniae R6
aaggucuuucaagcgaacaucu

SEQ ID NO: 2199836 - RNA, 21 nt, Streptococcus pneumoniae R6
aaggucuuuugucuugcuugc

SEQ ID NO: 2199837 - RNA, 14 nt, Streptococcus pneumoniae R6
aaggugaaaagggu

SEQ ID NO: 2199838 - RNA, 21 nt, Streptococcus pneumoniae R6
aaggugagggcugagaaggcu

SEQ ID NO: 2199839 - RNA, 23 nt, Streptococcus pneumoniae R6
aaggcaagacuugguuuggcauu

SEQ ID NO: 2199840 - RNA, 15 nt, Streptococcus pneumoniae R6
aaggauuuaguucug

SEQ ID NO: 2199841 - RNA, 21 nt, Streptococcus pneumoniae R6
aaggauuuugugaauuuucaa

SEQ ID NO: 2199842 - RNA, 13 nt, Streptococcus pneumoniae R6
aaggauuucugcu

SEQ ID NO: 2199843 - RNA, 20 nt, Streptococcus pneumoniae R6
aaggauuucugcuuuuuaua

SEQ ID NO: 2199844 - RNA, 19 nt, Streptococcus pneumoniae R6
aagggaugaaaccccaaga

SEQ ID NO: 2199845 - RNA, 19 nt, Streptococcus pneumoniae R6
aagggaugauguuaucaaa

SEQ ID NO: 2199846 - RNA, 21 nt, Streptococcus pneumoniae R6
aaggguuagucauucccuccu

SEQ ID NO: 2199847 - RNA, 12 nt, Streptococcus pneumoniae R6
aagguaaaauau

SEQ ID NO: 2199848 - RNA, 13 nt, Streptococcus pneumoniae R6
aagguaaaauaua

SEQ ID NO: 2199849 - RNA, 18 nt, Streptococcus pneumoniae R6
aaggguagccaauuccuu

SEQ ID NO: 2199850 - RNA, 23 nt, Streptococcus pneumoniae R6
aagggcaccaaacuuaggaagca

SEQ ID NO: 2199851 - RNA, 15 nt, Streptococcus pneumoniae R6
aagcguguaggaaac

SEQ ID NO: 2199852 - RNA, 14 nt, Streptococcus pneumoniae R6
aagcguucaaucag

SEQ ID NO: 2199853 - RNA, 16 nt, Streptococcus pneumoniae R6
aagcuaauagagcuga

SEQ ID NO: 2199854 - RNA, 19 nt, Streptococcus pneumoniae R6
aagcuaagaaaguaagaau

SEQ ID NO: 2199855 - RNA, 15 nt, Streptococcus pneumoniae R6
aagcuaaauccuuuu

SEQ ID NO: 2199856 - RNA, 16 nt, Streptococcus pneumoniae R6
aagcguuuacgaugau

SEQ ID NO: 2199857 - RNA, 16 nt, Streptococcus pneumoniae R6
aagcuccuuuagugau

SEQ ID NO: 2199858 - RNA, 12 nt, Streptococcus pneumoniae R6
aagcggagagca

SEQ ID NO: 2199859 - RNA, 20 nt, Streptococcus pneumoniae R6
aagcuuauauacccaaaaca

SEQ ID NO: 2199860 - RNA, 13 nt, Streptococcus pneumoniae R6
aagcugagcucuu

SEQ ID NO: 2199861 - RNA, 19 nt, Streptococcus pneumoniae R6
aagcugaucaauauucucc

SEQ ID NO: 2199862 - RNA, 15 nt, Streptococcus pneumoniae R6
aagcugaugcgguuu

SEQ ID NO: 2199863 - RNA, 22 nt, Streptococcus pneumoniae R6
aagcugacgcgguuugaagaga

SEQ ID NO: 2199864 - RNA, 19 nt, Streptococcus pneumoniae R6
aagcugacgggcaaauuuc

SEQ ID NO: 2199865 - RNA, 21 nt, Streptococcus pneumoniae R6
aagcugacgggcaaauuucau

SEQ ID NO: 2199866 - RNA, 16 nt, Streptococcus pneumoniae R6
aagcugauuuuuucau

SEQ ID NO: 2199867 - RNA, 15 nt, Streptococcus pneumoniae R6
aagcugccaaagcau

SEQ ID NO: 2199868 - RNA, 18 nt, Streptococcus pneumoniae R6
aaggaggugauaaagucc

SEQ ID NO: 2199869 - RNA, 14 nt, Streptococcus pneumoniae R6
aaggaggcaaagaa

SEQ ID NO: 2199870 - RNA, 16 nt, Streptococcus pneumoniae R6
aaggaggcaaagaaaa

SEQ ID NO: 2199871 - RNA, 18 nt, Streptococcus pneumoniae R6
aaggaggcaaagaaaaaa

SEQ ID NO: 2199872 - RNA, 19 nt, Streptococcus pneumoniae R6
aaggagaggagaauuuuug

SEQ ID NO: 2199873 - RNA, 15 nt, Streptococcus pneumoniae R6
aaggagaagauuuca

SEQ ID NO: 2199874 - RNA, 13 nt, Streptococcus pneumoniae R6
aaggagaaaaaau

SEQ ID NO: 2199875 - RNA, 15 nt, Streptococcus pneumoniae R6
aaggagaaaaaauau

SEQ ID NO: 2199876 - RNA, 23 nt, Streptococcus pneumoniae R6
aagcuuuuuguuagauuuauaau

SEQ ID NO: 2199877 - RNA, 15 nt, Streptococcus pneumoniae R6
aaggaaaaaggcaac

SEQ ID NO: 2199878 - RNA, 14 nt, Streptococcus pneumoniae R6
aaggaaaauugauu

SEQ ID NO: 2199879 - RNA, 20 nt, Streptococcus pneumoniae R6
aagcuuccaauaauagaaaa

SEQ ID NO: 2199880 - RNA, 16 nt, Streptococcus pneumoniae R6
aagcuuuugaguacuu

SEQ ID NO: 2199881 - RNA, 19 nt, Streptococcus pneumoniae R6
aacgccaucguagauuaaa

SEQ ID NO: 2199882 - RNA, 21 nt, Streptococcus pneumoniae R6
aacgcccucacacggaaguau

SEQ ID NO: 2199883 - RNA, 16 nt, Streptococcus pneumoniae R6
aacgcuuaaaggcucu

SEQ ID NO: 2199884 - RNA, 16 nt, Streptococcus pneumoniae R6
aacgcugcucaaaauc

SEQ ID NO: 2199885 - RNA, 14 nt, Streptococcus pneumoniae R6
aacgguaacaaaac

SEQ ID NO: 2199886 - RNA, 17 nt, Streptococcus pneumoniae R6
aacgguaacaaaacuaa

SEQ ID NO: 2199887 - RNA, 18 nt, Streptococcus pneumoniae R6
aacggacguugauuuguc

SEQ ID NO: 2199888 - RNA, 17 nt, Streptococcus pneumoniae R6
aacggacaaaacuguaa

SEQ ID NO: 2199889 - RNA, 22 nt, Streptococcus pneumoniae R6
aacgguaucuugaauauuuuuc

SEQ ID NO: 2199890 - RNA, 19 nt, Streptococcus pneumoniae R6
aacgguguuuugagcugac

SEQ ID NO: 2199891 - RNA, 21 nt, Streptococcus pneumoniae R6
aacuacacccgcauaaauacu

SEQ ID NO: 2199892 - RNA, 19 nt, Streptococcus pneumoniae R6
aacuacgucagcuuccauc

SEQ ID NO: 2199893 - RNA, 18 nt, Streptococcus pneumoniae R6
aacuaggaaacuagcugc

SEQ ID NO: 2199894 - RNA, 14 nt, Streptococcus pneumoniae R6
aacuaguuuucuaa

SEQ ID NO: 2199895 - RNA, 19 nt, Streptococcus pneumoniae R6
aacuaguuuucuaaagaau

SEQ ID NO: 2199896 - RNA, 17 nt, Streptococcus pneumoniae R6
aacuaguuuugagaauc

SEQ ID NO: 2199897 - RNA, 16 nt, Streptococcus pneumoniae R6
aacuauaaaaucugaa

SEQ ID NO: 2199898 - RNA, 20 nt, Streptococcus pneumoniae R6
aacuauaaaaucugaagaaa

SEQ ID NO: 2199899 - RNA, 22 nt, Streptococcus pneumoniae R6
aacuauaaaaucugaagaaagc

SEQ ID NO: 2199900 - RNA, 20 nt, Streptococcus pneumoniae R6
aacuagcauccaucccauuu

SEQ ID NO: 2199901 - RNA, 12 nt, Streptococcus pneumoniae R6
aacuagcugcag

SEQ ID NO: 2199902 - RNA, 17 nt, Streptococcus pneumoniae R6
aacuaguaaauugucua

SEQ ID NO: 2199903 - RNA, 22 nt, Streptococcus pneumoniae R6
aacuaguaaauugucuaaaaau

SEQ ID NO: 2199904 - RNA, 16 nt, Streptococcus pneumoniae R6
aacuagaucaaccagu

SEQ ID NO: 2199905 - RNA, 15 nt, Streptococcus pneumoniae R6
aacuagauuucugaa

SEQ ID NO: 2199906 - RNA, 15 nt, Streptococcus pneumoniae R6
aacuagcaagugcua

SEQ ID NO: 2199907 - RNA, 24 nt, Streptococcus pneumoniae R6
aacuagcaagugcuaagauaauag

SEQ ID NO: 2199908 - RNA, 18 nt, Streptococcus pneumoniae R6
aacuaauguaaaaaaguu

SEQ ID NO: 2199909 - RNA, 22 nt, Streptococcus pneumoniae R6
aacuaauuagucguaaauaaua

SEQ ID NO: 2199910 - RNA, 20 nt, Streptococcus pneumoniae R6
aacuaauucacgaacaugaa

SEQ ID NO: 2199911 - RNA, 16 nt, Streptococcus pneumoniae R6
aacuaauuuagagaau

SEQ ID NO: 2199912 - RNA, 22 nt, Streptococcus pneumoniae R6
aacuaauuuagagaaugaaaua

SEQ ID NO: 2199913 - RNA, 19 nt, Streptococcus pneumoniae R6
aacuaagauuuguuuuuca

SEQ ID NO: 2199914 - RNA, 16 nt, Streptococcus pneumoniae R6
aacuaagcuuauauac

SEQ ID NO: 2199915 - RNA, 18 nt, Streptococcus pneumoniae R6
aacuaagcuucaaaaaag

SEQ ID NO: 2199916 - RNA, 20 nt, Streptococcus pneumoniae R6
aacuaaaguuccuaauuguu

SEQ ID NO: 2199917 - RNA, 21 nt, Streptococcus pneumoniae R6
aacuaaauaccuuauccaauu

SEQ ID NO: 2199918 - RNA, 17 nt, Streptococcus pneumoniae R6
aacuaaauuacugauug

SEQ ID NO: 2199919 - RNA, 22 nt, Streptococcus pneumoniae R6
aacguuuuuacuuuggcaaaga

SEQ ID NO: 2199920 - RNA, 17 nt, Streptococcus pneumoniae R6
aacguuguuaaaucaac

SEQ ID NO: 2199921 - RNA, 20 nt, Streptococcus pneumoniae R6
aacguucuuuucaagaacug

SEQ ID NO: 2199922 - RNA, 18 nt, Streptococcus pneumoniae R6
aacgugauaauaaggccu

SEQ ID NO: 2199923 - RNA, 13 nt, Streptococcus pneumoniae R6
aacguccagccuu

SEQ ID NO: 2199924 - RNA, 15 nt, Streptococcus pneumoniae R6
aacgucuaaacugua

SEQ ID NO: 2199925 - RNA, 17 nt, Streptococcus pneumoniae R6
aacgucuucaauaccaa

SEQ ID NO: 2199926 - RNA, 12 nt, Streptococcus pneumoniae R6
aacgucuuuucg

SEQ ID NO: 2199927 - RNA, 20 nt, Streptococcus pneumoniae R6
aacguacgagauaagcuucu

SEQ ID NO: 2199928 - RNA, 21 nt, Streptococcus pneumoniae R6
aacugcugcuuggaaggaagc

SEQ ID NO: 2199929 - RNA, 13 nt, Streptococcus pneumoniae R6
aacuggaaagaua

SEQ ID NO: 2199930 - RNA, 16 nt, Streptococcus pneumoniae R6
aacugcuugagcugcu

SEQ ID NO: 2199931 - RNA, 18 nt, Streptococcus pneumoniae R6
aacuggaccaaguuuaag

SEQ ID NO: 2199932 - RNA, 12 nt, Streptococcus pneumoniae R6
aacuggagacuu

SEQ ID NO: 2199933 - RNA, 21 nt, Streptococcus pneumoniae R6
aacuggaucaaugauaccuug

SEQ ID NO: 2199934 - RNA, 17 nt, Streptococcus pneumoniae R6
aacuauuuuauuuuuua

SEQ ID NO: 2199935 - RNA, 14 nt, Streptococcus pneumoniae R6
aacucaaaagaaga

SEQ ID NO: 2199936 - RNA, 20 nt, Streptococcus pneumoniae R6
aacucaaaagaagauugguc

SEQ ID NO: 2199937 - RNA, 17 nt, Streptococcus pneumoniae R6
aacucuuguccuaaaua

SEQ ID NO: 2199938 - RNA, 12 nt, Streptococcus pneumoniae R6
aacucaaauuua

SEQ ID NO: 2199939 - RNA, 17 nt, Streptococcus pneumoniae R6
aacucaagaauuauuua

SEQ ID NO: 2199940 - RNA, 13 nt, Streptococcus pneumoniae R6
aacugauucuacu

SEQ ID NO: 2199941 - RNA, 16 nt, Streptococcus pneumoniae R6
aacugaagcuguuucc

SEQ ID NO: 2199942 - RNA, 20 nt, Streptococcus pneumoniae R6
aacugaaucuggaauaggau

SEQ ID NO: 2199943 - RNA, 17 nt, Streptococcus pneumoniae R6
aacugaacaaauuaauu

SEQ ID NO: 2199944 - RNA, 22 nt, Streptococcus pneumoniae R6
aacuuacauuugaguuucucuu

SEQ ID NO: 2199945 - RNA, 23 nt, Streptococcus pneumoniae R6
aacuuaguaaacagucccauaaa

SEQ ID NO: 2199946 - RNA, 21 nt, Streptococcus pneumoniae R6
aacuuaggaagcaguccaagg

SEQ ID NO: 2199947 - RNA, 18 nt, Streptococcus pneumoniae R6
aacuuagguuaucguaac

SEQ ID NO: 2199948 - RNA, 18 nt, Streptococcus pneumoniae R6
aacuguuuuuucaacagc

SEQ ID NO: 2199949 - RNA, 13 nt, Streptococcus pneumoniae R6
aacuuaaaaagag

SEQ ID NO: 2199950 - RNA, 14 nt, Streptococcus pneumoniae R6
aacuuaaaaagagg

SEQ ID NO: 2199951 - RNA, 13 nt, Streptococcus pneumoniae R6
aacugguccagag

SEQ ID NO: 2199952 - RNA, 16 nt, Streptococcus pneumoniae R6
aacugguccagagaua

SEQ ID NO: 2199953 - RNA, 16 nt, Streptococcus pneumoniae R6
aacuucuuuuugauuu

SEQ ID NO: 2199954 - RNA, 18 nt, Streptococcus pneumoniae R6
aacuucuuuuugauuuau

SEQ ID NO: 2199955 - RNA, 14 nt, Streptococcus pneumoniae R6
aacuucuuuuugua

SEQ ID NO: 2199956 - RNA, 22 nt, Streptococcus pneumoniae R6
aacuugaaaauaccaaguucau

SEQ ID NO: 2199957 - RNA, 13 nt, Streptococcus pneumoniae R6
aacuugaaaugau

SEQ ID NO: 2199958 - RNA, 20 nt, Streptococcus pneumoniae R6
aacuugaagcaaaucaacug

SEQ ID NO: 2199959 - RNA, 24 nt, Streptococcus pneumoniae R6
aacuugaagcaaaucaacuggcau

SEQ ID NO: 2199960 - RNA, 18 nt, Streptococcus pneumoniae R6
aacuugaauccuucguaa

SEQ ID NO: 2199961 - RNA, 17 nt, Streptococcus pneumoniae R6
aacuucugcaauuagua

SEQ ID NO: 2199962 - RNA, 17 nt, Streptococcus pneumoniae R6
aacuucaagaacuuuaa

SEQ ID NO: 2199963 - RNA, 15 nt, Streptococcus pneumoniae R6
aacuuaucagcuagc

SEQ ID NO: 2199964 - RNA, 12 nt, Streptococcus pneumoniae R6
aacuuauuuuaa

SEQ ID NO: 2199965 - RNA, 13 nt, Streptococcus pneumoniae R6
aagaaauuuucuu

SEQ ID NO: 2199966 - RNA, 15 nt, Streptococcus pneumoniae R6
aagaaaguccucauu

SEQ ID NO: 2199967 - RNA, 16 nt, Streptococcus pneumoniae R6
aagaaagcaacuaaaa

SEQ ID NO: 2199968 - RNA, 17 nt, Streptococcus pneumoniae R6
aagaaagcagcuuaucu

SEQ ID NO: 2199969 - RNA, 20 nt, Streptococcus pneumoniae R6
aagaaagcauagagaaaaac

SEQ ID NO: 2199970 - RNA, 20 nt, Streptococcus pneumoniae R6
aagaaagcgaagaucuagaa

SEQ ID NO: 2199971 - RNA, 14 nt, Streptococcus pneumoniae R6
aagaacaucuacaa

SEQ ID NO: 2199972 - RNA, 20 nt, Streptococcus pneumoniae R6
aagaacaucuacaauugaaa

SEQ ID NO: 2199973 - RNA, 21 nt, Streptococcus pneumoniae R6
aagaacaugaaagaugaagca

SEQ ID NO: 2199974 - RNA, 14 nt, Streptococcus pneumoniae R6
aagaacaaguaaag

SEQ ID NO: 2199975 - RNA, 18 nt, Streptococcus pneumoniae R6
aagaacaaguaaagaguc

SEQ ID NO: 2199976 - RNA, 15 nt, Streptococcus pneumoniae R6
aagaacaauccaaau

SEQ ID NO: 2199977 - RNA, 19 nt, Streptococcus pneumoniae R6
aagaaauuccaccugugaa

SEQ ID NO: 2199978 - RNA, 13 nt, Streptococcus pneumoniae R6
aacuuggcaaaau

SEQ ID NO: 2199979 - RNA, 14 nt, Streptococcus pneumoniae R6
aacuugcucagagg

SEQ ID NO: 2199980 - RNA, 17 nt, Streptococcus pneumoniae R6
aacuuguaagucaaguc

SEQ ID NO: 2199981 - RNA, 20 nt, Streptococcus pneumoniae R6
aacuugguaauuugaacaaa

SEQ ID NO: 2199982 - RNA, 13 nt, Streptococcus pneumoniae R6
aagaaaaagaagg

SEQ ID NO: 2199983 - RNA, 21 nt, Streptococcus pneumoniae R6
aagaaaaacugcuuagaaccg

SEQ ID NO: 2199984 - RNA, 19 nt, Streptococcus pneumoniae R6
aagaaacucuaaacaaacu

SEQ ID NO: 2199985 - RNA, 16 nt, Streptococcus pneumoniae R6
aagaaaacagaaaaau

SEQ ID NO: 2199986 - RNA, 23 nt, Streptococcus pneumoniae R6
aagaaaaaguguuugauaucuau

SEQ ID NO: 2199987 - RNA, 19 nt, Streptococcus pneumoniae R6
aagaagagggcuucuucaa

SEQ ID NO: 2199988 - RNA, 23 nt, Streptococcus pneumoniae R6
aagaagauuggucaaucuuaucu

SEQ ID NO: 2199989 - RNA, 16 nt, Streptococcus pneumoniae R6
aagaagcuguaaaucu

SEQ ID NO: 2199990 - RNA, 20 nt, Streptococcus pneumoniae R6
aagaagcuguaaaucuagga

SEQ ID NO: 2199991 - RNA, 17 nt, Streptococcus pneumoniae R6
aagaacuccagugaaaa

SEQ ID NO: 2199992 - RNA, 23 nt, Streptococcus pneumoniae R6
aagaacuccagugaaaacaggag

SEQ ID NO: 2199993 - RNA, 21 nt, Streptococcus pneumoniae R6
aagaacuccuuaaauuuuaua

SEQ ID NO: 2199994 - RNA, 22 nt, Streptococcus pneumoniae R6
aagaacuccuuaaauuuuauac

SEQ ID NO: 2199995 - RNA, 15 nt, Streptococcus pneumoniae R6
aagaacuuuuuaaag

SEQ ID NO: 2199996 - RNA, 18 nt, Streptococcus pneumoniae R6
aagaacuuuuuaaaguau

SEQ ID NO: 2199997 - RNA, 16 nt, Streptococcus pneumoniae R6
aagaaggauugagaag

SEQ ID NO: 2199998 - RNA, 20 nt, Streptococcus pneumoniae R6
aagaagguauucauaaaaua

SEQ ID NO: 2199999 - RNA, 18 nt, Streptococcus pneumoniae R6
aagaagugguuuaaaguc

SEQ ID NO: 2200000 - RNA, 12 nt, Streptococcus pneumoniae R6
aagaauccaauu

SEQ ID NO: 2200001 - RNA, 19 nt, Streptococcus pneumoniae R6
aagaauaggacgaaucguu

SEQ ID NO: 2200002 - RNA, 16 nt, Streptococcus pneumoniae R6
aagaauaucaagauaa

SEQ ID NO: 2200003 - RNA, 17 nt, Streptococcus pneumoniae R6
aagaauagcgauuuaau

SEQ ID NO: 2200004 - RNA, 15 nt, Streptococcus pneumoniae R6
aagaauaaaauaguu

SEQ ID NO: 2200005 - RNA, 13 nt, Streptococcus pneumoniae R6
aagaaguuuuccu

SEQ ID NO: 2200006 - RNA, 16 nt, Streptococcus pneumoniae R6
aaccacaacaaaaaag

SEQ ID NO: 2200007 - RNA, 21 nt, Streptococcus pneumoniae R6
aaccaauuucuuaauagcuga

SEQ ID NO: 2200008 - RNA, 13 nt, Streptococcus pneumoniae R6
aaccaauuucuaa

SEQ ID NO: 2200009 - RNA, 20 nt, Streptococcus pneumoniae R6
aaccaaucagacuauaauau

SEQ ID NO: 2200010 - RNA, 21 nt, Streptococcus pneumoniae R6
aaccaaucagacuauaauaua

SEQ ID NO: 2200011 - RNA, 12 nt, Streptococcus pneumoniae R6
aaccaacuucuu

SEQ ID NO: 2200012 - RNA, 14 nt, Streptococcus pneumoniae R6
aaccaacuucuuuu

SEQ ID NO: 2200013 - RNA, 14 nt, Streptococcus pneumoniae R6
aaccaacuuuugaa

SEQ ID NO: 2200014 - RNA, 15 nt, Streptococcus pneumoniae R6
aaccaacuuuugaau

SEQ ID NO: 2200015 - RNA, 21 nt, Streptococcus pneumoniae R6
aaccaagaucuugucugcaug

SEQ ID NO: 2200016 - RNA, 20 nt, Streptococcus pneumoniae R6
aaccaagcaaggucaaaaug

SEQ ID NO: 2200017 - RNA, 14 nt, Streptococcus pneumoniae R6
aaccaauaauaaaa

SEQ ID NO: 2200018 - RNA, 21 nt, Streptococcus pneumoniae R6
aaccaauagccgcaaacuugg

SEQ ID NO: 2200019 - RNA, 23 nt, Streptococcus pneumoniae R6
aaccaauagccgcaaacuugguc

SEQ ID NO: 2200020 - RNA, 16 nt, Streptococcus pneumoniae R6
aacauugugagaaauu

SEQ ID NO: 2200021 - RNA, 14 nt, Streptococcus pneumoniae R6
aacauugugaggaa

SEQ ID NO: 2200022 - RNA, 16 nt, Streptococcus pneumoniae R6
aacauuguuaaaaauu

SEQ ID NO: 2200023 - RNA, 17 nt, Streptococcus pneumoniae R6
aaccaacauagauaaag

SEQ ID NO: 2200024 - RNA, 18 nt, Streptococcus pneumoniae R6
aacauuauccaugaaaaa

SEQ ID NO: 2200025 - RNA, 19 nt, Streptococcus pneumoniae R6
aacauucucccgcccuuuu

SEQ ID NO: 2200026 - RNA, 21 nt, Streptococcus pneumoniae R6
aacauucuuaucaauugauuu

SEQ ID NO: 2200027 - RNA, 20 nt, Streptococcus pneumoniae R6
aacauugacuugcuguuuuc

SEQ ID NO: 2200028 - RNA, 18 nt, Streptococcus pneumoniae R6
aacaugucuauagaacua

SEQ ID NO: 2200029 - RNA, 21 nt, Streptococcus pneumoniae R6
aacauguuuugagcugacuuc

SEQ ID NO: 2200030 - RNA, 21 nt, Streptococcus pneumoniae R6
aacauuacccauagauuuuua

SEQ ID NO: 2200031 - RNA, 14 nt, Streptococcus pneumoniae R6
aacauacugugcca

SEQ ID NO: 2200032 - RNA, 19 nt, Streptococcus pneumoniae R6
aacauaauuuuagugcauu

SEQ ID NO: 2200033 - RNA, 13 nt, Streptococcus pneumoniae R6
aacagccaucaga

SEQ ID NO: 2200034 - RNA, 16 nt, Streptococcus pneumoniae R6
aacaucgaaguugugu

SEQ ID NO: 2200035 - RNA, 17 nt, Streptococcus pneumoniae R6
aacaucuguccccucac

SEQ ID NO: 2200036 - RNA, 19 nt, Streptococcus pneumoniae R6
aacaucuuuugauagauga

SEQ ID NO: 2200037 - RNA, 20 nt, Streptococcus pneumoniae R6
aacaucuucuguaccaauac

SEQ ID NO: 2200038 - RNA, 14 nt, Streptococcus pneumoniae R6
aacaucuuugaaga

SEQ ID NO: 2200039 - RNA, 12 nt, Streptococcus pneumoniae R6
aacaucaucugc

SEQ ID NO: 2200040 - RNA, 17 nt, Streptococcus pneumoniae R6
aacaucccaaggauaga

SEQ ID NO: 2200041 - RNA, 13 nt, Streptococcus pneumoniae R6
aacccuguuuuau

SEQ ID NO: 2200042 - RNA, 18 nt, Streptococcus pneumoniae R6
aaccgauuuaagauaagu

SEQ ID NO: 2200043 - RNA, 18 nt, Streptococcus pneumoniae R6
aaccgaugacaaaaauag

SEQ ID NO: 2200044 - RNA, 14 nt, Streptococcus pneumoniae R6
aaccgcaaaagcuu

SEQ ID NO: 2200045 - RNA, 13 nt, Streptococcus pneumoniae R6
aacccacuacagu

SEQ ID NO: 2200046 - RNA, 15 nt, Streptococcus pneumoniae R6
aacccauaccagagc

SEQ ID NO: 2200047 - RNA, 20 nt, Streptococcus pneumoniae R6
aaccaucuucauuuugguaa

SEQ ID NO: 2200048 - RNA, 15 nt, Streptococcus pneumoniae R6
aaccauucaaaauac

SEQ ID NO: 2200049 - RNA, 13 nt, Streptococcus pneumoniae R6
aacaauaaucuau

SEQ ID NO: 2200050 - RNA, 14 nt, Streptococcus pneumoniae R6
aacaauacuuucca

SEQ ID NO: 2200051 - RNA, 23 nt, Streptococcus pneumoniae R6
aacaagucuuaaaaucacaaaaa

SEQ ID NO: 2200052 - RNA, 15 nt, Streptococcus pneumoniae R6
aacaaguucuuuucu

SEQ ID NO: 2200053 - RNA, 14 nt, Streptococcus pneumoniae R6
aacaauaagagaau

SEQ ID NO: 2200054 - RNA, 18 nt, Streptococcus pneumoniae R6
aacaauaagagaauuaag

SEQ ID NO: 2200055 - RNA, 14 nt, Streptococcus pneumoniae R6
aacaaguugugcag

SEQ ID NO: 2200056 - RNA, 15 nt, Streptococcus pneumoniae R6
aacaauaaaaucaaa

SEQ ID NO: 2200057 - RNA, 16 nt, Streptococcus pneumoniae R6
aaauucucuuuucaua

SEQ ID NO: 2200058 - RNA, 22 nt, Streptococcus pneumoniae R6
aaauucugucuuagacuuucuc

SEQ ID NO: 2200059 - RNA, 18 nt, Streptococcus pneumoniae R6
aaauucuuaaagccacua

SEQ ID NO: 2200060 - RNA, 15 nt, Streptococcus pneumoniae R6
aacaagucagcucaa

SEQ ID NO: 2200061 - RNA, 18 nt, Streptococcus pneumoniae R6
aacaagucagcucaaagc

SEQ ID NO: 2200062 - RNA, 18 nt, Streptococcus pneumoniae R6
aaauucuuuagaaaacua

SEQ ID NO: 2200063 - RNA, 16 nt, Streptococcus pneumoniae R6
aacaauugcuaaaaca

SEQ ID NO: 2200064 - RNA, 17 nt, Streptococcus pneumoniae R6
aacaauugcuaaaacau

SEQ ID NO: 2200065 - RNA, 23 nt, Streptococcus pneumoniae R6
aacaauugcuaaaacauuuauag

SEQ ID NO: 2200066 - RNA, 17 nt, Streptococcus pneumoniae R6
aacaaugguaacagucu

SEQ ID NO: 2200067 - RNA, 23 nt, Streptococcus pneumoniae R6
aacaaugguaacagucuuagcaa

SEQ ID NO: 2200068 - RNA, 15 nt, Streptococcus pneumoniae R6
aacaauggaaaugau

SEQ ID NO: 2200069 - RNA, 16 nt, Streptococcus pneumoniae R6
aacaauuaauucuaaa

SEQ ID NO: 2200070 - RNA, 20 nt, Streptococcus pneumoniae R6
aacaauuaauucuaaaucuu

SEQ ID NO: 2200071 - RNA, 14 nt, Streptococcus pneumoniae R6
aacaauuaauuggu

SEQ ID NO: 2200072 - RNA, 14 nt, Streptococcus pneumoniae R6
aacaauuaggaacu

SEQ ID NO: 2200073 - RNA, 15 nt, Streptococcus pneumoniae R6
aacaauuaggaacuu

SEQ ID NO: 2200074 - RNA, 21 nt, Streptococcus pneumoniae R6
aacaauguuuuagaaaucaca

SEQ ID NO: 2200075 - RNA, 22 nt, Streptococcus pneumoniae R6
aacaauguuuugaucugacuuc

SEQ ID NO: 2200076 - RNA, 14 nt, Streptococcus pneumoniae R6
aacaauugacuguc

SEQ ID NO: 2200077 - RNA, 17 nt, Streptococcus pneumoniae R6
aacaauugacugucaau

SEQ ID NO: 2200078 - RNA, 14 nt, Streptococcus pneumoniae R6
aacaauuucacaac

SEQ ID NO: 2200079 - RNA, 21 nt, Streptococcus pneumoniae R6
aacaauuucacaacucuuaua

SEQ ID NO: 2200080 - RNA, 15 nt, Streptococcus pneumoniae R6
aacaaugaaaaaaac

SEQ ID NO: 2200081 - RNA, 19 nt, Streptococcus pneumoniae R6
aacaaugacucccauaaaa

SEQ ID NO: 2200082 - RNA, 20 nt, Streptococcus pneumoniae R6
aacaaugacucccauaaaaa

SEQ ID NO: 2200083 - RNA, 14 nt, Streptococcus pneumoniae R6
aacaaucuaucuuu

SEQ ID NO: 2200084 - RNA, 14 nt, Streptococcus pneumoniae R6
aacaauauuuuaga

SEQ ID NO: 2200085 - RNA, 12 nt, Streptococcus pneumoniae R6
aacaaucguaac

SEQ ID NO: 2200086 - RNA, 22 nt, Streptococcus pneumoniae R6
aaaaagggggaacguuuuuaaa

SEQ ID NO: 2200087 - RNA, 22 nt, Streptococcus pneumoniae R6
aaaaagggggcaaaacuuucau

SEQ ID NO: 2200088 - RNA, 23 nt, Streptococcus pneumoniae R6
aaaaaggucaucagcagagaaag

SEQ ID NO: 2200089 - RNA, 15 nt, Streptococcus pneumoniae R6
aacacacgaagcaua

SEQ ID NO: 2200090 - RNA, 21 nt, Streptococcus pneumoniae R6
aacacauauugauauuuauag

SEQ ID NO: 2200091 - RNA, 22 nt, Streptococcus pneumoniae R6
aacacacuguuuugagguugug

SEQ ID NO: 2200092 - RNA, 17 nt, Streptococcus pneumoniae R6
aaaaagugauguaauuu

SEQ ID NO: 2200093 - RNA, 16 nt, Streptococcus pneumoniae R6
aaaaagucguuaaaag

SEQ ID NO: 2200094 - RNA, 16 nt, Streptococcus pneumoniae R6
aaaaagugaaaggaag

SEQ ID NO: 2200095 - RNA, 17 nt, Streptococcus pneumoniae R6
aaaaagugaaaggaaga

SEQ ID NO: 2200096 - RNA, 14 nt, Streptococcus pneumoniae R6
aaaaaguauacucu

SEQ ID NO: 2200097 - RNA, 22 nt, Streptococcus pneumoniae R6
aaaaaguauacucuaauugaaa

SEQ ID NO: 2200098 - RNA, 14 nt, Streptococcus pneumoniae R6
aaaaagucaauaau

SEQ ID NO: 2200099 - RNA, 14 nt, Streptococcus pneumoniae R6
aaaaaguaaaucuu

SEQ ID NO: 2200100 - RNA, 18 nt, Streptococcus pneumoniae R6
aacacgagaaacaauaaa

SEQ ID NO: 2200101 - RNA, 15 nt, Streptococcus pneumoniae R6
aacaccuuuauuauu

SEQ ID NO: 2200102 - RNA, 14 nt, Streptococcus pneumoniae R6
aacacgaaaccagu

SEQ ID NO: 2200103 - RNA, 17 nt, Streptococcus pneumoniae R6
aacaccugauacuaugc

SEQ ID NO: 2200104 - RNA, 14 nt, Streptococcus pneumoniae R6
aacaccugauuuua

SEQ ID NO: 2200105 - RNA, 14 nt, Streptococcus pneumoniae R6
aacacccauaauau

SEQ ID NO: 2200106 - RNA, 15 nt, Streptococcus pneumoniae R6
aacacguaaauuaua

SEQ ID NO: 2200107 - RNA, 14 nt, Streptococcus pneumoniae R6
aacacguuugauaa

SEQ ID NO: 2200108 - RNA, 20 nt, Streptococcus pneumoniae R6
aacacuagaggggugauuuu

SEQ ID NO: 2200109 - RNA, 15 nt, Streptococcus pneumoniae R6
aacacuugcuaggaa

SEQ ID NO: 2200110 - RNA, 19 nt, Streptococcus pneumoniae R6
aacagauuuuucuguuuuc

SEQ ID NO: 2200111 - RNA, 22 nt, Streptococcus pneumoniae R6
aacagcauuuccaccugcagca

SEQ ID NO: 2200112 - RNA, 11 nt, Streptococcus pneumoniae R6
aacagccaaua

SEQ ID NO: 2200113 - RNA, 13 nt, Streptococcus pneumoniae R6
aacagagaaaauu

SEQ ID NO: 2200114 - RNA, 15 nt, Streptococcus pneumoniae R6
aacagaggcuggaca

SEQ ID NO: 2200115 - RNA, 15 nt, Streptococcus pneumoniae R6
aauguaaaaaaguug

SEQ ID NO: 2200116 - RNA, 18 nt, Streptococcus pneumoniae R6
aauguaaaaaaguugaag

SEQ ID NO: 2200117 - RNA, 13 nt, Streptococcus pneumoniae R6
aauggcaugagga

SEQ ID NO: 2200118 - RNA, 23 nt, Streptococcus pneumoniae R6
aauggccuccuucauuaagucau

SEQ ID NO: 2200119 - RNA, 13 nt, Streptococcus pneumoniae R6
aaugcuucuuuga

SEQ ID NO: 2200120 - RNA, 18 nt, Streptococcus pneumoniae R6
aaugcuugcgacaaaaag

SEQ ID NO: 2200121 - RNA, 20 nt, Streptococcus pneumoniae R6
aaugcuuuuugaaagcagau

SEQ ID NO: 2200122 - RNA, 13 nt, Streptococcus pneumoniae R6
aauggaaaugaua

SEQ ID NO: 2200123 - RNA, 19 nt, Streptococcus pneumoniae R6
aaugccuguuccaacauug

SEQ ID NO: 2200124 - RNA, 13 nt, Streptococcus pneumoniae R6
aaugcaaagccaa

SEQ ID NO: 2200125 - RNA, 19 nt, Streptococcus pneumoniae R6
aaucuucuccaguuuuaau

SEQ ID NO: 2200126 - RNA, 14 nt, Streptococcus pneumoniae R6
aaucuucuguguuu

SEQ ID NO: 2200127 - RNA, 16 nt, Streptococcus pneumoniae R6
aaucuucuuacauaug

SEQ ID NO: 2200128 - RNA, 15 nt, Streptococcus pneumoniae R6
aaugauuuuuuacug

SEQ ID NO: 2200129 - RNA, 14 nt, Streptococcus pneumoniae R6
aaugauuugaacau

SEQ ID NO: 2200130 - RNA, 19 nt, Streptococcus pneumoniae R6
aauguucuguaaugaaaua

SEQ ID NO: 2200131 - RNA, 21 nt, Streptococcus pneumoniae R6
aaugugauuucuguaaaaaua

SEQ ID NO: 2200132 - RNA, 18 nt, Streptococcus pneumoniae R6
aaugugggaaacagauuu

SEQ ID NO: 2200133 - RNA, 22 nt, Streptococcus pneumoniae R6
aauguauugugguauacuauuu

SEQ ID NO: 2200134 - RNA, 13 nt, Streptococcus pneumoniae R6
aauguauuugaaa

SEQ ID NO: 2200135 - RNA, 19 nt, Streptococcus pneumoniae R6
aauguccuugauagcagaa

SEQ ID NO: 2200136 - RNA, 22 nt, Streptococcus pneumoniae R6
aaugucuucugcucgcuggaga

SEQ ID NO: 2200137 - RNA, 18 nt, Streptococcus pneumoniae R6
aaugucuuggcagaaagg

SEQ ID NO: 2200138 - RNA, 15 nt, Streptococcus pneumoniae R6
aaugucuaaaucuuu

SEQ ID NO: 2200139 - RNA, 14 nt, Streptococcus pneumoniae R6
aaugucucugcuau

SEQ ID NO: 2200140 - RNA, 20 nt, Streptococcus pneumoniae R6
aaugucuaguaauuuuguga

SEQ ID NO: 2200141 - RNA, 17 nt, Streptococcus pneumoniae R6
aauuaaauaaaauaaaa

SEQ ID NO: 2200142 - RNA, 21 nt, Streptococcus pneumoniae R6
aauuaaaaugugauuucugua

SEQ ID NO: 2200143 - RNA, 16 nt, Streptococcus pneumoniae R6
aauuaaaucauccaua

SEQ ID NO: 2200144 - RNA, 13 nt, Streptococcus pneumoniae R6
aauuaacaaaaag

SEQ ID NO: 2200145 - RNA, 14 nt, Streptococcus pneumoniae R6
aauguuuucucaua

SEQ ID NO: 2200146 - RNA, 14 nt, Streptococcus pneumoniae R6
aauguuuuauuaca

SEQ ID NO: 2200147 - RNA, 16 nt, Streptococcus pneumoniae R6
aauguuuuauuacaua

SEQ ID NO: 2200148 - RNA, 15 nt, Streptococcus pneumoniae R6
aauguuuuagaaaua

SEQ ID NO: 2200149 - RNA, 14 nt, Streptococcus pneumoniae R6
aauguugucaauuu

SEQ ID NO: 2200150 - RNA, 20 nt, Streptococcus pneumoniae R6
aauguugucaauuuccauuu

SEQ ID NO: 2200151 - RNA, 15 nt, Streptococcus pneumoniae R6
aauguugaauaguuu

SEQ ID NO: 2200152 - RNA, 14 nt, Streptococcus pneumoniae R6
aauguugaaucauu

SEQ ID NO: 2200153 - RNA, 19 nt, Streptococcus pneumoniae R6
aauguugaaucauuuuguu

SEQ ID NO: 2200154 - RNA, 11 nt, Streptococcus pneumoniae R6
aauucugccaa

SEQ ID NO: 2200155 - RNA, 15 nt, Streptococcus pneumoniae R6
aauucucuaaauaag

SEQ ID NO: 2200156 - RNA, 23 nt, Streptococcus pneumoniae R6
aauucuccauuuuggauauaaga

SEQ ID NO: 2200157 - RNA, 13 nt, Streptococcus pneumoniae R6
aauucuauaucua

SEQ ID NO: 2200158 - RNA, 13 nt, Streptococcus pneumoniae R6
aauuccuugauau

SEQ ID NO: 2200159 - RNA, 18 nt, Streptococcus pneumoniae R6
aauuccccaucuucaacu

SEQ ID NO: 2200160 - RNA, 16 nt, Streptococcus pneumoniae R6
aauuccuuuaaaaaca

SEQ ID NO: 2200161 - RNA, 21 nt, Streptococcus pneumoniae R6
aauuccuuuaaaaacaaucac

SEQ ID NO: 2200162 - RNA, 10 nt, Streptococcus pneumoniae R6
aauucauagg

SEQ ID NO: 2200163 - RNA, 19 nt, Streptococcus pneumoniae R6
aauucauuugauuuuccua

SEQ ID NO: 2200164 - RNA, 23 nt, Streptococcus pneumoniae R6
aauucauuugauuuuccuaauca

SEQ ID NO: 2200165 - RNA, 15 nt, Streptococcus pneumoniae R6
aauuccacgagccaa

SEQ ID NO: 2200166 - RNA, 16 nt, Streptococcus pneumoniae R6
aauuccacgagccaaa

SEQ ID NO: 2200167 - RNA, 15 nt, Streptococcus pneumoniae R6
aauuccauugucaug

SEQ ID NO: 2200168 - RNA, 15 nt, Streptococcus pneumoniae R6
aauuccauaccuaaa

SEQ ID NO: 2200169 - RNA, 21 nt, Streptococcus pneumoniae R6
aauuccauaccuaaacuuuga

SEQ ID NO: 2200170 - RNA, 19 nt, Streptococcus pneumoniae R6
aauuauauauaaaaagcua

SEQ ID NO: 2200171 - RNA, 16 nt, Streptococcus pneumoniae R6
aauuaucuaucucaac

SEQ ID NO: 2200172 - RNA, 20 nt, Streptococcus pneumoniae R6
aauuauacuauaaaacaaua

SEQ ID NO: 2200173 - RNA, 19 nt, Streptococcus pneumoniae R6
aauuauacucuuagaaaau

SEQ ID NO: 2200174 - RNA, 20 nt, Streptococcus pneumoniae R6
aauuaacugguuaauuaauu

SEQ ID NO: 2200175 - RNA, 22 nt, Streptococcus pneumoniae R6
aauuaacugguuaauuaauuua

SEQ ID NO: 2200176 - RNA, 16 nt, Streptococcus pneumoniae R6
aauucagccuuaucca

SEQ ID NO: 2200177 - RNA, 20 nt, Streptococcus pneumoniae R6
aauucaggugauuuaccaua

SEQ ID NO: 2200178 - RNA, 20 nt, Streptococcus pneumoniae R6
aauucacugagaucuucuuc

SEQ ID NO: 2200179 - RNA, 16 nt, Streptococcus pneumoniae R6
aauucaccaauuuuac

SEQ ID NO: 2200180 - RNA, 22 nt, Streptococcus pneumoniae R6
aauuauuggucgcuucaaguuu

SEQ ID NO: 2200181 - RNA, 18 nt, Streptococcus pneumoniae R6
aauuauucucuaucuuuu

SEQ ID NO: 2200182 - RNA, 21 nt, Streptococcus pneumoniae R6
aauuguauagugaacugaauc

SEQ ID NO: 2200183 - RNA, 17 nt, Streptococcus pneumoniae R6
aauuguagauguucuuu

SEQ ID NO: 2200184 - RNA, 21 nt, Streptococcus pneumoniae R6
aauuguagauguucuuugaaa

SEQ ID NO: 2200185 - RNA, 16 nt, Streptococcus pneumoniae R6
aauuguaggaaagaag

SEQ ID NO: 2200186 - RNA, 14 nt, Streptococcus pneumoniae R6
aauuguaaaaagag

SEQ ID NO: 2200187 - RNA, 20 nt, Streptococcus pneumoniae R6
aauugguuugaauucuccaa

SEQ ID NO: 2200188 - RNA, 14 nt, Streptococcus pneumoniae R6
aauugguuacgauu

SEQ ID NO: 2200189 - RNA, 14 nt, Streptococcus pneumoniae R6
aauuguaaacaaaa

SEQ ID NO: 2200190 - RNA, 16 nt, Streptococcus pneumoniae R6
aauuguaaacaaaaau

SEQ ID NO: 2200191 - RNA, 20 nt, Streptococcus pneumoniae R6
aauuguaaagacuuuuugcc

SEQ ID NO: 2200192 - RNA, 19 nt, Streptococcus pneumoniae R6
aauugugcauaagaaacuc

SEQ ID NO: 2200193 - RNA, 15 nt, Streptococcus pneumoniae R6
aauuguguuuuugcc

SEQ ID NO: 2200194 - RNA, 14 nt, Streptococcus pneumoniae R6
aauuguuaaaguuc

SEQ ID NO: 2200195 - RNA, 19 nt, Streptococcus pneumoniae R6
aauugucuaaaaauuuaaa

SEQ ID NO: 2200196 - RNA, 13 nt, Streptococcus pneumoniae R6
aauugucuaacuu

SEQ ID NO: 2200197 - RNA, 19 nt, Streptococcus pneumoniae R6
aauugucuaagcgaaacaa

SEQ ID NO: 2200198 - RNA, 20 nt, Streptococcus pneumoniae R6
aauugucuaagcgaaacaac

SEQ ID NO: 2200199 - RNA, 11 nt, Streptococcus pneumoniae R6
aauuuaaaaag

SEQ ID NO: 2200200 - RNA, 17 nt, Streptococcus pneumoniae R6
aauuuaaaaagaaauau

SEQ ID NO: 2200201 - RNA, 21 nt, Streptococcus pneumoniae R6
aauuguugucccuuuuucacu

SEQ ID NO: 2200202 - RNA, 18 nt, Streptococcus pneumoniae R6
aauuguuuugugcuggaa

SEQ ID NO: 2200203 - RNA, 23 nt, Streptococcus pneumoniae R6
aauuguuucguacuauuucagau

SEQ ID NO: 2200204 - RNA, 15 nt, Streptococcus pneumoniae R6
aauuuaaucauguac

SEQ ID NO: 2200205 - RNA, 19 nt, Streptococcus pneumoniae R6
aauuuaauccacuauaaua

SEQ ID NO: 2200206 - RNA, 20 nt, Streptococcus pneumoniae R6
aauugccugauaacgaagag

SEQ ID NO: 2200207 - RNA, 23 nt, Streptococcus pneumoniae R6
aauugccugauaacgaagagcug

SEQ ID NO: 2200208 - RNA, 21 nt, Streptococcus pneumoniae R6
aauuggaguguguccaugugc

SEQ ID NO: 2200209 - RNA, 15 nt, Streptococcus pneumoniae R6
aauugggccuuagua

SEQ ID NO: 2200210 - RNA, 21 nt, Streptococcus pneumoniae R6
aauugguguaaauagaaacca

SEQ ID NO: 2200211 - RNA, 16 nt, Streptococcus pneumoniae R6
aaaacaauaaaucugu

SEQ ID NO: 2200212 - RNA, 20 nt, Streptococcus pneumoniae R6
aaaacaaguucuuuucuguu

SEQ ID NO: 2200213 - RNA, 16 nt, Streptococcus pneumoniae R6
aauugcaggagaaaau

SEQ ID NO: 2200214 - RNA, 20 nt, Streptococcus pneumoniae R6
aauugcaggagaaaaugaaa

SEQ ID NO: 2200215 - RNA, 21 nt, Streptococcus pneumoniae R6
aauugcaggagaaaaugaaau

SEQ ID NO: 2200216 - RNA, 20 nt, Streptococcus pneumoniae R6
aaaacaaaguauuaaaauaa

SEQ ID NO: 2200217 - RNA, 17 nt, Streptococcus pneumoniae R6
aaaacaaaauucuuccu

SEQ ID NO: 2200218 - RNA, 13 nt, Streptococcus pneumoniae R6
aaaacaaagagau

SEQ ID NO: 2200219 - RNA, 19 nt, Streptococcus pneumoniae R6
aaaacaaaggauuucugcu

SEQ ID NO: 2200220 - RNA, 15 nt, Streptococcus pneumoniae R6
aaaacaaagaaaaag

SEQ ID NO: 2200221 - RNA, 16 nt, Streptococcus pneumoniae R6
aaaacaaagaaaaaga

SEQ ID NO: 2200222 - RNA, 18 nt, Streptococcus pneumoniae R6
aaaacaaccaauuucuua

SEQ ID NO: 2200223 - RNA, 12 nt, Streptococcus pneumoniae R6
aauugaaacaag

SEQ ID NO: 2200224 - RNA, 18 nt, Streptococcus pneumoniae R6
aauugaaaauucacaaaa

SEQ ID NO: 2200225 - RNA, 18 nt, Streptococcus pneumoniae R6
aauugaaaacgguaacaa

SEQ ID NO: 2200226 - RNA, 11 nt, Streptococcus pneumoniae R6
aauucuuuucg

SEQ ID NO: 2200227 - RNA, 21 nt, Streptococcus pneumoniae R6
aauucuuuucgaaacucuuuu

SEQ ID NO: 2200228 - RNA, 17 nt, Streptococcus pneumoniae R6
aauucugcuuuuaaaua

SEQ ID NO: 2200229 - RNA, 17 nt, Streptococcus pneumoniae R6
aaucaaaaagcaacaca

SEQ ID NO: 2200230 - RNA, 12 nt, Streptococcus pneumoniae R6
aaucaaaauaua

SEQ ID NO: 2200231 - RNA, 18 nt, Streptococcus pneumoniae R6
aaucaaacgagaaucugu

SEQ ID NO: 2200232 - RNA, 14 nt, Streptococcus pneumoniae R6
aaucaaagaacaaa

SEQ ID NO: 2200233 - RNA, 16 nt, Streptococcus pneumoniae R6
aaucaaagaacaaacu

SEQ ID NO: 2200234 - RNA, 21 nt, Streptococcus pneumoniae R6
aaucaaagaacaaacuaggaa

SEQ ID NO: 2200235 - RNA, 17 nt, Streptococcus pneumoniae R6
aaucaaaucaauaacac

SEQ ID NO: 2200236 - RNA, 10 nt, Streptococcus pneumoniae R6
aaucaaauca

SEQ ID NO: 2200237 - RNA, 11 nt, Streptococcus pneumoniae R6
aaucaaaucaa

SEQ ID NO: 2200238 - RNA, 12 nt, Streptococcus pneumoniae R6
aaucaaaucaau

SEQ ID NO: 2200239 - RNA, 12 nt, Streptococcus pneumoniae R6
aaucaaagagca

SEQ ID NO: 2200240 - RNA, 17 nt, Streptococcus pneumoniae R6
aaucaaagagcaaacua

SEQ ID NO: 2200241 - RNA, 14 nt, Streptococcus pneumoniae R6
aaucaaagcuagca

SEQ ID NO: 2200242 - RNA, 21 nt, Streptococcus pneumoniae R6
aaucaaauucauucguaaucc

SEQ ID NO: 2200243 - RNA, 21 nt, Streptococcus pneumoniae R6
aaucaaauuuuauccaacuga

SEQ ID NO: 2200244 - RNA, 16 nt, Streptococcus pneumoniae R6
aaucaacauauccaag

SEQ ID NO: 2200245 - RNA, 16 nt, Streptococcus pneumoniae R6
aaucaaccaacuuuug

SEQ ID NO: 2200246 - RNA, 21 nt, Streptococcus pneumoniae R6
aaucaagugaguuaggagcca

SEQ ID NO: 2200247 - RNA, 21 nt, Streptococcus pneumoniae R6
aaucaagguuuccaaaccaac

SEQ ID NO: 2200248 - RNA, 17 nt, Streptococcus pneumoniae R6
aaucaagggaaaaugaa

SEQ ID NO: 2200249 - RNA, 17 nt, Streptococcus pneumoniae R6
aaucaacugcuguuuuc

SEQ ID NO: 2200250 - RNA, 12 nt, Streptococcus pneumoniae R6
aaucacaaaaac

SEQ ID NO: 2200251 - RNA, 21 nt, Streptococcus pneumoniae R6
aaucaauugguuaaaagcuca

SEQ ID NO: 2200252 - RNA, 15 nt, Streptococcus pneumoniae R6
aaucaauuagaaaau

SEQ ID NO: 2200253 - RNA, 18 nt, Streptococcus pneumoniae R6
aaucaauguacuggauaa

SEQ ID NO: 2200254 - RNA, 23 nt, Streptococcus pneumoniae R6
aaucaaucguccuugauuuagaa

SEQ ID NO: 2200255 - RNA, 20 nt, Streptococcus pneumoniae R6
aaucaaucuucaaaaucuca

SEQ ID NO: 2200256 - RNA, 13 nt, Streptococcus pneumoniae R6
aaucacaucugcu

SEQ ID NO: 2200257 - RNA, 14 nt, Streptococcus pneumoniae R6
aaucacaucugcua

SEQ ID NO: 2200258 - RNA, 20 nt, Streptococcus pneumoniae R6
aaucacauuggcaagagcug

SEQ ID NO: 2200259 - RNA, 23 nt, Streptococcus pneumoniae R6
aaucacauuggcaagagcuguuc

SEQ ID NO: 2200260 - RNA, 16 nt, Streptococcus pneumoniae R6
aaucaccguuugauuc

SEQ ID NO: 2200261 - RNA, 21 nt, Streptococcus pneumoniae R6
aaucaccuaguccaagacguu

SEQ ID NO: 2200262 - RNA, 13 nt, Streptococcus pneumoniae R6
aaucaccuauucu

SEQ ID NO: 2200263 - RNA, 20 nt, Streptococcus pneumoniae R6
aaucaccuauucuaagucca

SEQ ID NO: 2200264 - RNA, 13 nt, Streptococcus pneumoniae R6
aaucagaaaaaac

SEQ ID NO: 2200265 - RNA, 13 nt, Streptococcus pneumoniae R6
aaucagaaaagua

SEQ ID NO: 2200266 - RNA, 15 nt, Streptococcus pneumoniae R6
aaucacuuaguugaa

SEQ ID NO: 2200267 - RNA, 23 nt, Streptococcus pneumoniae R6
aaucacuuaguugaauuaucaua

SEQ ID NO: 2200268 - RNA, 16 nt, Streptococcus pneumoniae R6
aaucacuuggaaaaau

SEQ ID NO: 2200269 - RNA, 13 nt, Streptococcus pneumoniae R6
aaucacuugacca

SEQ ID NO: 2200270 - RNA, 14 nt, Streptococcus pneumoniae R6
aaucacuugaccaa

SEQ ID NO: 2200271 - RNA, 15 nt, Streptococcus pneumoniae R6
aaucacuugaccaaa

SEQ ID NO: 2200272 - RNA, 20 nt, Streptococcus pneumoniae R6
aaucacucuaacuucugcua

SEQ ID NO: 2200273 - RNA, 18 nt, Streptococcus pneumoniae R6
aaucacgcuaaguagaaa

SEQ ID NO: 2200274 - RNA, 21 nt, Streptococcus pneumoniae R6
aaucacgcuaaguagaaaguu

SEQ ID NO: 2200275 - RNA, 20 nt, Streptococcus pneumoniae R6
aaucacgugugaaaaccuug

SEQ ID NO: 2200276 - RNA, 15 nt, Streptococcus pneumoniae R6
aauagauaauuuaaa

SEQ ID NO: 2200277 - RNA, 15 nt, Streptococcus pneumoniae R6
aauagcacuuaaaaa

SEQ ID NO: 2200278 - RNA, 19 nt, Streptococcus pneumoniae R6
aauagauacaaaaccaaac

SEQ ID NO: 2200279 - RNA, 14 nt, Streptococcus pneumoniae R6
aauagcaguaacuu

SEQ ID NO: 2200280 - RNA, 12 nt, Streptococcus pneumoniae R6
aauagccaagac

SEQ ID NO: 2200281 - RNA, 16 nt, Streptococcus pneumoniae R6
aauagcauccaccacu

SEQ ID NO: 2200282 - RNA, 15 nt, Streptococcus pneumoniae R6
aauagcccacuguga

SEQ ID NO: 2200283 - RNA, 18 nt, Streptococcus pneumoniae R6
aauagcccauaaagagag

SEQ ID NO: 2200284 - RNA, 14 nt, Streptococcus pneumoniae R6
aauaugauggaaga

SEQ ID NO: 2200285 - RNA, 15 nt, Streptococcus pneumoniae R6
aauaugcuauugaaa

SEQ ID NO: 2200286 - RNA, 22 nt, Streptococcus pneumoniae R6
aauauuaugcguuuuuucugau

SEQ ID NO: 2200287 - RNA, 23 nt, Streptococcus pneumoniae R6
aauauuagucggaaucuuuaaga

SEQ ID NO: 2200288 - RNA, 21 nt, Streptococcus pneumoniae R6
aauauuacuucuaaaacauuc

SEQ ID NO: 2200289 - RNA, 22 nt, Streptococcus pneumoniae R6
aauauuagaugauuuuucuguu

SEQ ID NO: 2200290 - RNA, 18 nt, Streptococcus pneumoniae R6
aauauuagcaaaaaagca

SEQ ID NO: 2200291 - RNA, 15 nt, Streptococcus pneumoniae R6
aauauggcaacuuuu

SEQ ID NO: 2200292 - RNA, 20 nt, Streptococcus pneumoniae R6
aauauguauuucauuuucua

SEQ ID NO: 2200293 - RNA, 13 nt, Streptococcus pneumoniae R6
aauauguuuucuu

SEQ ID NO: 2200294 - RNA, 15 nt, Streptococcus pneumoniae R6
aauauuggcuacugu

SEQ ID NO: 2200295 - RNA, 15 nt, Streptococcus pneumoniae R6
aauauucuuggcaaa

SEQ ID NO: 2200296 - RNA, 21 nt, Streptococcus pneumoniae R6
aauauuuauaguaauuccaca

SEQ ID NO: 2200297 - RNA, 12 nt, Streptococcus pneumoniae R6
aauauuuacuuc

SEQ ID NO: 2200298 - RNA, 16 nt, Streptococcus pneumoniae R6
aauauuuaauuguaua

SEQ ID NO: 2200299 - RNA, 19 nt, Streptococcus pneumoniae R6
aauauuucuagaaauuaau

SEQ ID NO: 2200300 - RNA, 17 nt, Streptococcus pneumoniae R6
aauauuucuaugauaaa

SEQ ID NO: 2200301 - RNA, 23 nt, Streptococcus pneumoniae R6
aauauuucuaugauaaaacgcau

SEQ ID NO: 2200302 - RNA, 15 nt, Streptococcus pneumoniae R6
aauauuuuuuacuuu

SEQ ID NO: 2200303 - RNA, 14 nt, Streptococcus pneumoniae R6
aauauuuuagaagc

SEQ ID NO: 2200304 - RNA, 22 nt, Streptococcus pneumoniae R6
aaucuguuaaaaaauaaucaaa

SEQ ID NO: 2200305 - RNA, 15 nt, Streptococcus pneumoniae R6
aaucuuagcaaagau

SEQ ID NO: 2200306 - RNA, 23 nt, Streptococcus pneumoniae R6
aaucuguacuaagcaugauauga

SEQ ID NO: 2200307 - RNA, 23 nt, Streptococcus pneumoniae R6
aaucuucauauacacuaaacaaa

SEQ ID NO: 2200308 - RNA, 10 nt, Streptococcus pneumoniae R6
aaucuucccg

SEQ ID NO: 2200309 - RNA, 17 nt, Streptococcus pneumoniae R6
aaucuucccguagguuu

SEQ ID NO: 2200310 - RNA, 13 nt, Streptococcus pneumoniae R6
aaucuucaaaauc

SEQ ID NO: 2200311 - RNA, 13 nt, Streptococcus pneumoniae R6
aaucuucaaauuu

SEQ ID NO: 2200312 - RNA, 16 nt, Streptococcus pneumoniae R6
aaucuucaaauuuuuc

SEQ ID NO: 2200313 - RNA, 15 nt, Streptococcus pneumoniae R6
aaucuuaucuaagac

SEQ ID NO: 2200314 - RNA, 23 nt, Streptococcus pneumoniae R6
aaucuuaucucuaucucuuaaaa

SEQ ID NO: 2200315 - RNA, 20 nt, Streptococcus pneumoniae R6
aaucuuauauuuaguacucu

SEQ ID NO: 2200316 - RNA, 16 nt, Streptococcus pneumoniae R6
aaucugaugaaccuuc

SEQ ID NO: 2200317 - RNA, 14 nt, Streptococcus pneumoniae R6
aaucugaaauauaa

SEQ ID NO: 2200318 - RNA, 12 nt, Streptococcus pneumoniae R6
aaucugaaucaa

SEQ ID NO: 2200319 - RNA, 21 nt, Streptococcus pneumoniae R6
aaucucuugucuuacuugcgu

SEQ ID NO: 2200320 - RNA, 12 nt, Streptococcus pneumoniae R6
aaucucuugaac

SEQ ID NO: 2200321 - RNA, 11 nt, Streptococcus pneumoniae R6
aaucugcauga

SEQ ID NO: 2200322 - RNA, 19 nt, Streptococcus pneumoniae R6
aaucugccagauuccugaa

SEQ ID NO: 2200323 - RNA, 18 nt, Streptococcus pneumoniae R6
aaucugccucaagaagug

SEQ ID NO: 2200324 - RNA, 23 nt, Streptococcus pneumoniae R6
aaucugccuuuuuauccaaaaua

SEQ ID NO: 2200325 - RNA, 18 nt, Streptococcus pneumoniae R6
aaucugcucaaucuuauc

SEQ ID NO: 2200326 - RNA, 16 nt, Streptococcus pneumoniae R6
aaucuggugccccagu

SEQ ID NO: 2200327 - RNA, 18 nt, Streptococcus pneumoniae R6
aaucuggucuuaagacac

SEQ ID NO: 2200328 - RNA, 15 nt, Streptococcus pneumoniae R6
aaucgcaaguuuuuc

SEQ ID NO: 2200329 - RNA, 16 nt, Streptococcus pneumoniae R6
aaucgcaaguuuuucc

SEQ ID NO: 2200330 - RNA, 22 nt, Streptococcus pneumoniae R6
aaucgauuuguucucaucuuau

SEQ ID NO: 2200331 - RNA, 21 nt, Streptococcus pneumoniae R6
aaaaauugauuugacuuccaa

SEQ ID NO: 2200332 - RNA, 15 nt, Streptococcus pneumoniae R6
aaucguccuugauuu

SEQ ID NO: 2200333 - RNA, 13 nt, Streptococcus pneumoniae R6
aaucucuucaaac

SEQ ID NO: 2200334 - RNA, 16 nt, Streptococcus pneumoniae R6
aaucucuucaaaccac

SEQ ID NO: 2200335 - RNA, 22 nt, Streptococcus pneumoniae R6
aaucucacguaacauauuuuca

SEQ ID NO: 2200336 - RNA, 23 nt, Streptococcus pneumoniae R6
aaucuauuuaugaaaaaguuuau

SEQ ID NO: 2200337 - RNA, 14 nt, Streptococcus pneumoniae R6
aaucucaaaacagu

SEQ ID NO: 2200338 - RNA, 12 nt, Streptococcus pneumoniae R6
aaucucaaaaga

SEQ ID NO: 2200339 - RNA, 19 nt, Streptococcus pneumoniae R6
aaucucaaaagaaagcaua

SEQ ID NO: 2200340 - RNA, 18 nt, Streptococcus pneumoniae R6
aaucuaaggucauuugaa

SEQ ID NO: 2200341 - RNA, 16 nt, Streptococcus pneumoniae R6
aaucuaagucaaauaa

SEQ ID NO: 2200342 - RNA, 18 nt, Streptococcus pneumoniae R6
aaucuacgcuuuaaaaau

SEQ ID NO: 2200343 - RNA, 11 nt, Streptococcus pneumoniae R6
aaucuacaaag

SEQ ID NO: 2200344 - RNA, 21 nt, Streptococcus pneumoniae R6
aaucccuucaauggaguaaaa

SEQ ID NO: 2200345 - RNA, 14 nt, Streptococcus pneumoniae R6
aauccgauaauaua

SEQ ID NO: 2200346 - RNA, 14 nt, Streptococcus pneumoniae R6
aauccgaguuuuuc

SEQ ID NO: 2200347 - RNA, 17 nt, Streptococcus pneumoniae R6
aauccgacuucaauaaa

SEQ ID NO: 2200348 - RNA, 23 nt, Streptococcus pneumoniae R6
aauccgacuucaauaaaauauaa

SEQ ID NO: 2200349 - RNA, 16 nt, Streptococcus pneumoniae R6
aauccgaaaaauuucu

SEQ ID NO: 2200350 - RNA, 15 nt, Streptococcus pneumoniae R6
aauccgaaaaucacu

SEQ ID NO: 2200351 - RNA, 17 nt, Streptococcus pneumoniae R6
aauccgcuugggaaacc

SEQ ID NO: 2200352 - RNA, 18 nt, Streptococcus pneumoniae R6
aauccgcuugggaaacca

SEQ ID NO: 2200353 - RNA, 19 nt, Streptococcus pneumoniae R6
aauccgcuugggaaaccaa

SEQ ID NO: 2200354 - RNA, 20 nt, Streptococcus pneumoniae R6
aauccgcuugggaaaccaaa

SEQ ID NO: 2200355 - RNA, 24 nt, Streptococcus pneumoniae R6
aauccgcuugggaaaccaaacgga

SEQ ID NO: 2200356 - RNA, 13 nt, Streptococcus pneumoniae R6
aauccuuauuuuc

SEQ ID NO: 2200357 - RNA, 15 nt, Streptococcus pneumoniae R6
aauccuuauuuucua

SEQ ID NO: 2200358 - RNA, 20 nt, Streptococcus pneumoniae R6
aauccuaguucaugauugau

SEQ ID NO: 2200359 - RNA, 15 nt, Streptococcus pneumoniae R6
aaucgauaaagaaga

SEQ ID NO: 2200360 - RNA, 19 nt, Streptococcus pneumoniae R6
aauccuugucgucauacca

SEQ ID NO: 2200361 - RNA, 13 nt, Streptococcus pneumoniae R6
aaucaucuuguuu

SEQ ID NO: 2200362 - RNA, 16 nt, Streptococcus pneumoniae R6
aaucauuuaauaauga

SEQ ID NO: 2200363 - RNA, 14 nt, Streptococcus pneumoniae R6
aaucaugagaauau

SEQ ID NO: 2200364 - RNA, 24 nt, Streptococcus pneumoniae R6
aaucauuuccuucguuuucacaau

SEQ ID NO: 2200365 - RNA, 13 nt, Streptococcus pneumoniae R6
aaucauuuuguaa

SEQ ID NO: 2200366 - RNA, 19 nt, Streptococcus pneumoniae R6
aauccaaaagcaggaguuu

SEQ ID NO: 2200367 - RNA, 17 nt, Streptococcus pneumoniae R6
aauccacuugggaaacc

SEQ ID NO: 2200368 - RNA, 18 nt, Streptococcus pneumoniae R6
aauccacuugggaaacca

SEQ ID NO: 2200369 - RNA, 24 nt, Streptococcus pneumoniae R6
aauccacuugggaaaccaaacgga

SEQ ID NO: 2200370 - RNA, 20 nt, Streptococcus pneumoniae R6
aauccacucagacagcugag

SEQ ID NO: 2200371 - RNA, 16 nt, Streptococcus pneumoniae R6
aauccauggaauacca

SEQ ID NO: 2200372 - RNA, 19 nt, Streptococcus pneumoniae R6
aauccaugaccgaaugaag

SEQ ID NO: 2200373 - RNA, 23 nt, Streptococcus pneumoniae R6
aaucccaaagaaggacuccacca

SEQ ID NO: 2200374 - RNA, 13 nt, Streptococcus pneumoniae R6
aaucccaaucaug

SEQ ID NO: 2200375 - RNA, 20 nt, Streptococcus pneumoniae R6
aaucccaaucauggcuggga

SEQ ID NO: 2200376 - RNA, 22 nt, Streptococcus pneumoniae R6
acaauauuuuugagccuuuccu

SEQ ID NO: 2200377 - RNA, 17 nt, Streptococcus pneumoniae R6
acaauccaguuaacuac

SEQ ID NO: 2200378 - RNA, 17 nt, Streptococcus pneumoniae R6
acaaucauagacuuaau

SEQ ID NO: 2200379 - RNA, 15 nt, Streptococcus pneumoniae R6
acaauccugcgaaau

SEQ ID NO: 2200380 - RNA, 18 nt, Streptococcus pneumoniae R6
acaaucguuucaaaaaau

SEQ ID NO: 2200381 - RNA, 20 nt, Streptococcus pneumoniae R6
acaaugacucccauaaaaau

SEQ ID NO: 2200382 - RNA, 23 nt, Streptococcus pneumoniae R6
acaaugacucccauaaaaauaau

SEQ ID NO: 2200383 - RNA, 15 nt, Streptococcus pneumoniae R6
acaauugcuaaaaca

SEQ ID NO: 2200384 - RNA, 16 nt, Streptococcus pneumoniae R6
acaauuuuaggagaaa

SEQ ID NO: 2200385 - RNA, 14 nt, Streptococcus pneumoniae R6
acaauuuucaucca

SEQ ID NO: 2200386 - RNA, 15 nt, Streptococcus pneumoniae R6
acaauuccuaagaua

SEQ ID NO: 2200387 - RNA, 14 nt, Streptococcus pneumoniae R6
acaauaccuuuccu

SEQ ID NO: 2200388 - RNA, 19 nt, Streptococcus pneumoniae R6
acaauacaguagaugauuu

SEQ ID NO: 2200389 - RNA, 22 nt, Streptococcus pneumoniae R6
acaauaauugguacauuuugau

SEQ ID NO: 2200390 - RNA, 14 nt, Streptococcus pneumoniae R6
acaaguguuuucac

SEQ ID NO: 2200391 - RNA, 23 nt, Streptococcus pneumoniae R6
acaaguaaguagcaucuugcucg

SEQ ID NO: 2200392 - RNA, 13 nt, Streptococcus pneumoniae R6
acaaguucuuuuc

SEQ ID NO: 2200393 - RNA, 13 nt, Streptococcus pneumoniae R6
acaaguuaaauaa

SEQ ID NO: 2200394 - RNA, 14 nt, Streptococcus pneumoniae R6
acaaguuagccaca

SEQ ID NO: 2200395 - RNA, 22 nt, Streptococcus pneumoniae R6
acaaguuagccacaacuaggaa

SEQ ID NO: 2200396 - RNA, 14 nt, Streptococcus pneumoniae R6
acaagguguuuuag

SEQ ID NO: 2200397 - RNA, 15 nt, Streptococcus pneumoniae R6
acaagggauuuuucu

SEQ ID NO: 2200398 - RNA, 14 nt, Streptococcus pneumoniae R6
acaagcucaucuuu

SEQ ID NO: 2200399 - RNA, 16 nt, Streptococcus pneumoniae R6
acaagcucaucuuuga

SEQ ID NO: 2200400 - RNA, 19 nt, Streptococcus pneumoniae R6
acaagcgcuauuaaaauuc

SEQ ID NO: 2200401 - RNA, 13 nt, Streptococcus pneumoniae R6
acaaccuuaaaac

SEQ ID NO: 2200402 - RNA, 16 nt, Streptococcus pneumoniae R6
acaaccuuaaaacagu

SEQ ID NO: 2200403 - RNA, 18 nt, Streptococcus pneumoniae R6
acaaccuuaaaacagugu

SEQ ID NO: 2200404 - RNA, 24 nt, Streptococcus pneumoniae R6
acaacgaguguauuguacuuucca

SEQ ID NO: 2200405 - RNA, 23 nt, Streptococcus pneumoniae R6
acacgauaaucugggcuaauucu

SEQ ID NO: 2200406 - RNA, 23 nt, Streptococcus pneumoniae R6
acacgaaucaauuucuucacacc

SEQ ID NO: 2200407 - RNA, 22 nt, Streptococcus pneumoniae R6
acacgaucauccauucuuuuuu

SEQ ID NO: 2200408 - RNA, 12 nt, Streptococcus pneumoniae R6
acacggaaguau

SEQ ID NO: 2200409 - RNA, 13 nt, Streptococcus pneumoniae R6
acacgcuucuuua

SEQ ID NO: 2200410 - RNA, 19 nt, Streptococcus pneumoniae R6
acacgaagcauaucagaca

SEQ ID NO: 2200411 - RNA, 11 nt, Streptococcus pneumoniae R6
acacaaaauag

SEQ ID NO: 2200412 - RNA, 13 nt, Streptococcus pneumoniae R6
acacaaaaagucc

SEQ ID NO: 2200413 - RNA, 23 nt, Streptococcus pneumoniae R6
acacaagauccaauccuuuucuu

SEQ ID NO: 2200414 - RNA, 17 nt, Streptococcus pneumoniae R6
acacauucguuccuuua

SEQ ID NO: 2200415 - RNA, 18 nt, Streptococcus pneumoniae R6
acacauguuaacaaauuc

SEQ ID NO: 2200416 - RNA, 21 nt, Streptococcus pneumoniae R6
acacccacgucacaaagaaca

SEQ ID NO: 2200417 - RNA, 18 nt, Streptococcus pneumoniae R6
acaccaauuuuacaaaua

SEQ ID NO: 2200418 - RNA, 12 nt, Streptococcus pneumoniae R6
acaaaaagaggc

SEQ ID NO: 2200419 - RNA, 12 nt, Streptococcus pneumoniae R6
acaaaaagaccu

SEQ ID NO: 2200420 - RNA, 17 nt, Streptococcus pneumoniae R6
acaaaaaguccucuuuc

SEQ ID NO: 2200421 - RNA, 19 nt, Streptococcus pneumoniae R6
acaaaaaguccucuuucca

SEQ ID NO: 2200422 - RNA, 11 nt, Streptococcus pneumoniae R6
acaaaaacagg

SEQ ID NO: 2200423 - RNA, 14 nt, Streptococcus pneumoniae R6
acaaaaagaaaaaa

SEQ ID NO: 2200424 - RNA, 14 nt, Streptococcus pneumoniae R6
aauuuauaauauaa

SEQ ID NO: 2200425 - RNA, 17 nt, Streptococcus pneumoniae R6
aauuuauacuaauacau

SEQ ID NO: 2200426 - RNA, 23 nt, Streptococcus pneumoniae R6
aauuuauacuaauacauuuugua

SEQ ID NO: 2200427 - RNA, 14 nt, Streptococcus pneumoniae R6
acaaaaaaucaaaa

SEQ ID NO: 2200428 - RNA, 22 nt, Streptococcus pneumoniae R6
acaaaaaaagcuuuaaaacuaa

SEQ ID NO: 2200429 - RNA, 14 nt, Streptococcus pneumoniae R6
aauuuauagaaaua

SEQ ID NO: 2200430 - RNA, 22 nt, Streptococcus pneumoniae R6
acaaaacuugggauauccuuau

SEQ ID NO: 2200431 - RNA, 14 nt, Streptococcus pneumoniae R6
acaaaagauaagau

SEQ ID NO: 2200432 - RNA, 12 nt, Streptococcus pneumoniae R6
acaaaagagaaa

SEQ ID NO: 2200433 - RNA, 22 nt, Streptococcus pneumoniae R6
acaaaagcguguaggaaaccaa

SEQ ID NO: 2200434 - RNA, 13 nt, Streptococcus pneumoniae R6
acaaaaggcucau

SEQ ID NO: 2200435 - RNA, 18 nt, Streptococcus pneumoniae R6
acaaaaggcucauaguuu

SEQ ID NO: 2200436 - RNA, 20 nt, Streptococcus pneumoniae R6
acaaaaggcucauaguuuau

SEQ ID NO: 2200437 - RNA, 18 nt, Streptococcus pneumoniae R6
acaaaauccgcuugggaa

SEQ ID NO: 2200438 - RNA, 22 nt, Streptococcus pneumoniae R6
acaaaauccgcuugggaaacca

SEQ ID NO: 2200439 - RNA, 23 nt, Streptococcus pneumoniae R6
acaaaauccgcuugggaaaccaa

SEQ ID NO: 2200440 - RNA, 15 nt, Streptococcus pneumoniae R6
acaaaauccuuuguu

SEQ ID NO: 2200441 - RNA, 12 nt, Streptococcus pneumoniae R6
acaaaauuacca

SEQ ID NO: 2200442 - RNA, 13 nt, Streptococcus pneumoniae R6
acaaaauuaccau

SEQ ID NO: 2200443 - RNA, 22 nt, Streptococcus pneumoniae R6
acaaaauguucaguuucuauuu

SEQ ID NO: 2200444 - RNA, 23 nt, Streptococcus pneumoniae R6
acaaaauguucaguuucuauuuc

SEQ ID NO: 2200445 - RNA, 17 nt, Streptococcus pneumoniae R6
acaaacacgcauaguau

SEQ ID NO: 2200446 - RNA, 19 nt, Streptococcus pneumoniae R6
acaaacaaggugaacuuga

SEQ ID NO: 2200447 - RNA, 18 nt, Streptococcus pneumoniae R6
acaaaauucguccuuucu

SEQ ID NO: 2200448 - RNA, 14 nt, Streptococcus pneumoniae R6
acaaaauucuuccu

SEQ ID NO: 2200449 - RNA, 21 nt, Streptococcus pneumoniae R6
acaaaauucuuccuacugaua

SEQ ID NO: 2200450 - RNA, 16 nt, Streptococcus pneumoniae R6
acaaaauugauaauag

SEQ ID NO: 2200451 - RNA, 13 nt, Streptococcus pneumoniae R6
acaaaauuugguu

SEQ ID NO: 2200452 - RNA, 21 nt, Streptococcus pneumoniae R6
acaaacgcccucucaauuccu

SEQ ID NO: 2200453 - RNA, 20 nt, Streptococcus pneumoniae R6
acaaaccaccgacaaucguu

SEQ ID NO: 2200454 - RNA, 16 nt, Streptococcus pneumoniae R6
acaaagagauugccca

SEQ ID NO: 2200455 - RNA, 18 nt, Streptococcus pneumoniae R6
acaaagagccaaaaaaga

SEQ ID NO: 2200456 - RNA, 21 nt, Streptococcus pneumoniae R6
acaaagagccaaaaaagaaag

SEQ ID NO: 2200457 - RNA, 17 nt, Streptococcus pneumoniae R6
acaaagauaaaauugau

SEQ ID NO: 2200458 - RNA, 15 nt, Streptococcus pneumoniae R6
acaaagaauaaaaua

SEQ ID NO: 2200459 - RNA, 16 nt, Streptococcus pneumoniae R6
acaaagaaaaaacaaa

SEQ ID NO: 2200460 - RNA, 18 nt, Streptococcus pneumoniae R6
acaaagaaaaaacaaagu

SEQ ID NO: 2200461 - RNA, 22 nt, Streptococcus pneumoniae R6
acaaagaaaacgccugcuuuuu

SEQ ID NO: 2200462 - RNA, 13 nt, Streptococcus pneumoniae R6
acaaagggcaagc

SEQ ID NO: 2200463 - RNA, 21 nt, Streptococcus pneumoniae R6
acaaagcccauacgcccucca

SEQ ID NO: 2200464 - RNA, 18 nt, Streptococcus pneumoniae R6
acaaagccggguuuucca

SEQ ID NO: 2200465 - RNA, 23 nt, Streptococcus pneumoniae R6
acaaauuaauucggaaagccaaa

SEQ ID NO: 2200466 - RNA, 23 nt, Streptococcus pneumoniae R6
acaaauuaauugcggaauucaaa

SEQ ID NO: 2200467 - RNA, 13 nt, Streptococcus pneumoniae R6
acaaauucuccac

SEQ ID NO: 2200468 - RNA, 22 nt, Streptococcus pneumoniae R6
acaaauucgacugccucucuuc

SEQ ID NO: 2200469 - RNA, 19 nt, Streptococcus pneumoniae R6
acaaauccaaucuucuagc

SEQ ID NO: 2200470 - RNA, 17 nt, Streptococcus pneumoniae R6
acaaaucagaaaaguaa

SEQ ID NO: 2200471 - RNA, 16 nt, Streptococcus pneumoniae R6
acaaaucaauuagaaa

SEQ ID NO: 2200472 - RNA, 15 nt, Streptococcus pneumoniae R6
acaaaucaauugcua

SEQ ID NO: 2200473 - RNA, 18 nt, Streptococcus pneumoniae R6
acaaaucuaagucaaaua

SEQ ID NO: 2200474 - RNA, 22 nt, Streptococcus pneumoniae R6
acaaaucuaagucaaauaagaa

SEQ ID NO: 2200475 - RNA, 13 nt, Streptococcus pneumoniae R6
acaaaucccauga

SEQ ID NO: 2200476 - RNA, 19 nt, Streptococcus pneumoniae R6
acaaaucgauugggaaagu

SEQ ID NO: 2200477 - RNA, 16 nt, Streptococcus pneumoniae R6
acaaauaauuuaucca

SEQ ID NO: 2200478 - RNA, 18 nt, Streptococcus pneumoniae R6
acaaauaauuuauccaaa

SEQ ID NO: 2200479 - RNA, 17 nt, Streptococcus pneumoniae R6
acaaauaccauaaacua

SEQ ID NO: 2200480 - RNA, 20 nt, Streptococcus pneumoniae R6
acaaauaaacggacaaaacu

SEQ ID NO: 2200481 - RNA, 22 nt, Streptococcus pneumoniae R6
acaaauaaacggacaaaacugu

SEQ ID NO: 2200482 - RNA, 20 nt, Streptococcus pneumoniae R6
acaaaguauuaaaauaaguu

SEQ ID NO: 2200483 - RNA, 23 nt, Streptococcus pneumoniae R6
acaaagguuugauuaguccauuc

SEQ ID NO: 2200484 - RNA, 20 nt, Streptococcus pneumoniae R6
acaacaaugagaaauuuuug

SEQ ID NO: 2200485 - RNA, 17 nt, Streptococcus pneumoniae R6
acaacaauggaaaugau

SEQ ID NO: 2200486 - RNA, 16 nt, Streptococcus pneumoniae R6
acaacaauacuuucca

SEQ ID NO: 2200487 - RNA, 15 nt, Streptococcus pneumoniae R6
acaacauaacugcua

SEQ ID NO: 2200488 - RNA, 18 nt, Streptococcus pneumoniae R6
acaacagcugucgcaccu

SEQ ID NO: 2200489 - RNA, 13 nt, Streptococcus pneumoniae R6
acaaauugauuug

SEQ ID NO: 2200490 - RNA, 20 nt, Streptococcus pneumoniae R6
acaaauugauuugaauucca

SEQ ID NO: 2200491 - RNA, 14 nt, Streptococcus pneumoniae R6
acaaauuugaaaau

SEQ ID NO: 2200492 - RNA, 17 nt, Streptococcus pneumoniae R6
acaaauuugaaaaucuu

SEQ ID NO: 2200493 - RNA, 14 nt, Streptococcus pneumoniae R6
acaacaaaaaaggu

SEQ ID NO: 2200494 - RNA, 19 nt, Streptococcus pneumoniae R6
acaacaaaaaaggucauca

SEQ ID NO: 2200495 - RNA, 13 nt, Streptococcus pneumoniae R6
acaacaucuuucc

SEQ ID NO: 2200496 - RNA, 14 nt, Streptococcus pneumoniae R6
acaaccaaacuguc

SEQ ID NO: 2200497 - RNA, 16 nt, Streptococcus pneumoniae R6
acaaccucaaaacaau

SEQ ID NO: 2200498 - RNA, 22 nt, Streptococcus pneumoniae R6
acaaccucaaaacaguguuuug

SEQ ID NO: 2200499 - RNA, 18 nt, Streptococcus pneumoniae R6
acaaccucaaagcagugc

SEQ ID NO: 2200500 - RNA, 22 nt, Streptococcus pneumoniae R6
acaaccaggucaucugcuuuag

SEQ ID NO: 2200501 - RNA, 15 nt, Streptococcus pneumoniae R6
acaaccgauaagaau

SEQ ID NO: 2200502 - RNA, 16 nt, Streptococcus pneumoniae R6
acaaccgauaagaauu

SEQ ID NO: 2200503 - RNA, 16 nt, Streptococcus pneumoniae R6
acaaccgagcuaauuu

SEQ ID NO: 2200504 - RNA, 17 nt, Streptococcus pneumoniae R6
accaaauuucauauuuu

SEQ ID NO: 2200505 - RNA, 20 nt, Streptococcus pneumoniae R6
accaaauuucauauuuucag

SEQ ID NO: 2200506 - RNA, 19 nt, Streptococcus pneumoniae R6
accaaauuuucaguuuuau

SEQ ID NO: 2200507 - RNA, 20 nt, Streptococcus pneumoniae R6
accaacauagauaaagacac

SEQ ID NO: 2200508 - RNA, 18 nt, Streptococcus pneumoniae R6
accaaagcaucaaucaaa

SEQ ID NO: 2200509 - RNA, 18 nt, Streptococcus pneumoniae R6
accaaaggaagcugagcu

SEQ ID NO: 2200510 - RNA, 21 nt, Streptococcus pneumoniae R6
accaaaggcauugcgcuugau

SEQ ID NO: 2200511 - RNA, 19 nt, Streptococcus pneumoniae R6
accaaaggcauugcguuug

SEQ ID NO: 2200512 - RNA, 22 nt, Streptococcus pneumoniae R6
accaaaggcauugugcuugaua

SEQ ID NO: 2200513 - RNA, 14 nt, Streptococcus pneumoniae R6
accaaaucagauaa

SEQ ID NO: 2200514 - RNA, 14 nt, Streptococcus pneumoniae R6
accaaaacuauauu

SEQ ID NO: 2200515 - RNA, 13 nt, Streptococcus pneumoniae R6
accaaaacucaag

SEQ ID NO: 2200516 - RNA, 11 nt, Streptococcus pneumoniae R6
accaaaaccuu

SEQ ID NO: 2200517 - RNA, 14 nt, Streptococcus pneumoniae R6
accaaaaccaauca

SEQ ID NO: 2200518 - RNA, 19 nt, Streptococcus pneumoniae R6
accaaaaaugugaacaucc

SEQ ID NO: 2200519 - RNA, 11 nt, Streptococcus pneumoniae R6
accaaaacagg

SEQ ID NO: 2200520 - RNA, 12 nt, Streptococcus pneumoniae R6
accaaaaucaua

SEQ ID NO: 2200521 - RNA, 17 nt, Streptococcus pneumoniae R6
accaaacagucucaccu

SEQ ID NO: 2200522 - RNA, 16 nt, Streptococcus pneumoniae R6
accaaacggauuuugu

SEQ ID NO: 2200523 - RNA, 14 nt, Streptococcus pneumoniae R6
accaaagaaaaacu

SEQ ID NO: 2200524 - RNA, 19 nt, Streptococcus pneumoniae R6
accaaagaaaaacucuugu

SEQ ID NO: 2200525 - RNA, 20 nt, Streptococcus pneumoniae R6
acauucuuaucaauugauuu

SEQ ID NO: 2200526 - RNA, 12 nt, Streptococcus pneumoniae R6
acauuagaauuc

SEQ ID NO: 2200527 - RNA, 20 nt, Streptococcus pneumoniae R6
acauuacccauagauuuuua

SEQ ID NO: 2200528 - RNA, 19 nt, Streptococcus pneumoniae R6
acauugaaaaugugaaaua

SEQ ID NO: 2200529 - RNA, 22 nt, Streptococcus pneumoniae R6
acauugauaauaggagcuuuug

SEQ ID NO: 2200530 - RNA, 16 nt, Streptococcus pneumoniae R6
acauuguuuguacuug

SEQ ID NO: 2200531 - RNA, 13 nt, Streptococcus pneumoniae R6
acauugauuucca

SEQ ID NO: 2200532 - RNA, 20 nt, Streptococcus pneumoniae R6
acauuguuaaaaauugauuu

SEQ ID NO: 2200533 - RNA, 21 nt, Streptococcus pneumoniae R6
acauuguuaaaaauugauuug

SEQ ID NO: 2200534 - RNA, 23 nt, Streptococcus pneumoniae R6
acauuuacgaaucucuuuccaca

SEQ ID NO: 2200535 - RNA, 15 nt, Streptococcus pneumoniae R6
acauuuggaaggcug

SEQ ID NO: 2200536 - RNA, 19 nt, Streptococcus pneumoniae R6
acauuugaguuucucuuac

SEQ ID NO: 2200537 - RNA, 23 nt, Streptococcus pneumoniae R6
acaucucuaucaggaaagucaaa

SEQ ID NO: 2200538 - RNA, 19 nt, Streptococcus pneumoniae R6
acaucugccauaucaucgu

SEQ ID NO: 2200539 - RNA, 21 nt, Streptococcus pneumoniae R6
acaucuguguagcacuuuucc

SEQ ID NO: 2200540 - RNA, 22 nt, Streptococcus pneumoniae R6
acaucuguguagcacuuuucca

SEQ ID NO: 2200541 - RNA, 11 nt, Streptococcus pneumoniae R6
acaucuaucuc

SEQ ID NO: 2200542 - RNA, 14 nt, Streptococcus pneumoniae R6
acaucuaccuauuc

SEQ ID NO: 2200543 - RNA, 15 nt, Streptococcus pneumoniae R6
acauguguuaccaua

SEQ ID NO: 2200544 - RNA, 20 nt, Streptococcus pneumoniae R6
acauguguuaccauaguucc

SEQ ID NO: 2200545 - RNA, 21 nt, Streptococcus pneumoniae R6
acauguguuaccauaguuccg

SEQ ID NO: 2200546 - RNA, 20 nt, Streptococcus pneumoniae R6
acauguccauucaucggaau

SEQ ID NO: 2200547 - RNA, 23 nt, Streptococcus pneumoniae R6
acauguccauucaucggaauggu

SEQ ID NO: 2200548 - RNA, 18 nt, Streptococcus pneumoniae R6
acauguauauuacagauu

SEQ ID NO: 2200549 - RNA, 15 nt, Streptococcus pneumoniae R6
acaugagaauacaaa

SEQ ID NO: 2200550 - RNA, 22 nt, Streptococcus pneumoniae R6
acaugagaauacaaaaaucuaa

SEQ ID NO: 2200551 - RNA, 13 nt, Streptococcus pneumoniae R6
acauaaucaagau

SEQ ID NO: 2200552 - RNA, 20 nt, Streptococcus pneumoniae R6
acaucaauaaccaucauuuu

SEQ ID NO: 2200553 - RNA, 17 nt, Streptococcus pneumoniae R6
acaucauugucaaacaa

SEQ ID NO: 2200554 - RNA, 22 nt, Streptococcus pneumoniae R6
acaguaaguaccugacgaaaga

SEQ ID NO: 2200555 - RNA, 13 nt, Streptococcus pneumoniae R6
acagucaguucau

SEQ ID NO: 2200556 - RNA, 17 nt, Streptococcus pneumoniae R6
acagucaaaucgauuuc

SEQ ID NO: 2200557 - RNA, 20 nt, Streptococcus pneumoniae R6
acagucaaaucgauuucuaa

SEQ ID NO: 2200558 - RNA, 16 nt, Streptococcus pneumoniae R6
acagucgcaaagagga

SEQ ID NO: 2200559 - RNA, 17 nt, Streptococcus pneumoniae R6
acagucgcaaagaggaa

SEQ ID NO: 2200560 - RNA, 18 nt, Streptococcus pneumoniae R6
acaggggauugauuaucc

SEQ ID NO: 2200561 - RNA, 21 nt, Streptococcus pneumoniae R6
acagggccuuuugcauaauga

SEQ ID NO: 2200562 - RNA, 15 nt, Streptococcus pneumoniae R6
acaggugcuuaaaua

SEQ ID NO: 2200563 - RNA, 16 nt, Streptococcus pneumoniae R6
acauaaaguauuauaa

SEQ ID NO: 2200564 - RNA, 21 nt, Streptococcus pneumoniae R6
acauaaccagauauaggcaua

SEQ ID NO: 2200565 - RNA, 21 nt, Streptococcus pneumoniae R6
acauaaaucgaucauauuuau

SEQ ID NO: 2200566 - RNA, 19 nt, Streptococcus pneumoniae R6
acaguuuuuaauuuuucuu

SEQ ID NO: 2200567 - RNA, 13 nt, Streptococcus pneumoniae R6
acaguuuugaggu

SEQ ID NO: 2200568 - RNA, 17 nt, Streptococcus pneumoniae R6
acaguuuguguuucuuu

SEQ ID NO: 2200569 - RNA, 17 nt, Streptococcus pneumoniae R6
acaguuugcucagcauu

SEQ ID NO: 2200570 - RNA, 16 nt, Streptococcus pneumoniae R6
acaguugggaaauucu

SEQ ID NO: 2200571 - RNA, 16 nt, Streptococcus pneumoniae R6
acaguuagacaauuaa

SEQ ID NO: 2200572 - RNA, 15 nt, Streptococcus pneumoniae R6
acaguguacauacuu

SEQ ID NO: 2200573 - RNA, 12 nt, Streptococcus pneumoniae R6
acaguguuuuaa

SEQ ID NO: 2200574 - RNA, 21 nt, Streptococcus pneumoniae R6
acaguguuuugagcaaccugc

SEQ ID NO: 2200575 - RNA, 17 nt, Streptococcus pneumoniae R6
acaguguuuugagcuga

SEQ ID NO: 2200576 - RNA, 15 nt, Streptococcus pneumoniae R6
acagucugaaaaaua

SEQ ID NO: 2200577 - RNA, 16 nt, Streptococcus pneumoniae R6
acagucugaaaaauag

SEQ ID NO: 2200578 - RNA, 16 nt, Streptococcus pneumoniae R6
acagccaaaaguccaa

SEQ ID NO: 2200579 - RNA, 15 nt, Streptococcus pneumoniae R6
acagccaucagagag

SEQ ID NO: 2200580 - RNA, 20 nt, Streptococcus pneumoniae R6
acagccaucagagaggucca

SEQ ID NO: 2200581 - RNA, 20 nt, Streptococcus pneumoniae R6
acacguccauaaugagcugu

SEQ ID NO: 2200582 - RNA, 12 nt, Streptococcus pneumoniae R6
acagcaccaacu

SEQ ID NO: 2200583 - RNA, 13 nt, Streptococcus pneumoniae R6
acagcaccaacuc

SEQ ID NO: 2200584 - RNA, 13 nt, Streptococcus pneumoniae R6
acagcaaggucaa

SEQ ID NO: 2200585 - RNA, 15 nt, Streptococcus pneumoniae R6
acagcuuuuuucuuu

SEQ ID NO: 2200586 - RNA, 12 nt, Streptococcus pneumoniae R6
acaggaaaacca

SEQ ID NO: 2200587 - RNA, 20 nt, Streptococcus pneumoniae R6
acaggaaaagucuuauaaua

SEQ ID NO: 2200588 - RNA, 15 nt, Streptococcus pneumoniae R6
acagcuuguugcuuu

SEQ ID NO: 2200589 - RNA, 16 nt, Streptococcus pneumoniae R6
acaggcuauugaagaa

SEQ ID NO: 2200590 - RNA, 14 nt, Streptococcus pneumoniae R6
acaggcuuucuccc

SEQ ID NO: 2200591 - RNA, 15 nt, Streptococcus pneumoniae R6
acagcuccugaaaua

SEQ ID NO: 2200592 - RNA, 14 nt, Streptococcus pneumoniae R6
acagcuccauaaca

SEQ ID NO: 2200593 - RNA, 19 nt, Streptococcus pneumoniae R6
acagcuugguaaugcucca

SEQ ID NO: 2200594 - RNA, 22 nt, Streptococcus pneumoniae R6
acagcuugcauagacuucaaca

SEQ ID NO: 2200595 - RNA, 14 nt, Streptococcus pneumoniae R6
acagcuagucuagu

SEQ ID NO: 2200596 - RNA, 14 nt, Streptococcus pneumoniae R6
acagcuaaagcacc

SEQ ID NO: 2200597 - RNA, 17 nt, Streptococcus pneumoniae R6
acagcuaaagcaccuga

SEQ ID NO: 2200598 - RNA, 20 nt, Streptococcus pneumoniae R6
agacgaccagcaguaucaau

SEQ ID NO: 2200599 - RNA, 21 nt, Streptococcus pneumoniae R6
agacgaguuaaaacaaagaaa

SEQ ID NO: 2200600 - RNA, 22 nt, Streptococcus pneumoniae R6
agacgaguuaaaacaaagaaaa

SEQ ID NO: 2200601 - RNA, 14 nt, Streptococcus pneumoniae R6
aaaacaucucagaa

SEQ ID NO: 2200602 - RNA, 17 nt, Streptococcus pneumoniae R6
aaaacaucugguuuaau

SEQ ID NO: 2200603 - RNA, 19 nt, Streptococcus pneumoniae R6
agaccucaauaugcucacu

SEQ ID NO: 2200604 - RNA, 20 nt, Streptococcus pneumoniae R6
agaccguagguauaaaccac

SEQ ID NO: 2200605 - RNA, 18 nt, Streptococcus pneumoniae R6
agacuaaguuagaauaag

SEQ ID NO: 2200606 - RNA, 19 nt, Streptococcus pneumoniae R6
agacuauaacagagaagaa

SEQ ID NO: 2200607 - RNA, 19 nt, Streptococcus pneumoniae R6
agacuaggcuuguucacuu

SEQ ID NO: 2200608 - RNA, 17 nt, Streptococcus pneumoniae R6
agacuaggugagcauca

SEQ ID NO: 2200609 - RNA, 23 nt, Streptococcus pneumoniae R6
agacuagguuagucaaaaagaag

SEQ ID NO: 2200610 - RNA, 22 nt, Streptococcus pneumoniae R6
agacuacuuccguaaucuuguu

SEQ ID NO: 2200611 - RNA, 23 nt, Streptococcus pneumoniae R6
agacuacuuccguaaucuuguua

SEQ ID NO: 2200612 - RNA, 17 nt, Streptococcus pneumoniae R6
agacuauucuguagaau

SEQ ID NO: 2200613 - RNA, 22 nt, Streptococcus pneumoniae R6
agacuauuaugaguuauuucag

SEQ ID NO: 2200614 - RNA, 19 nt, Streptococcus pneumoniae R6
agacuaucugcuaacugcu

SEQ ID NO: 2200615 - RNA, 22 nt, Streptococcus pneumoniae R6
agacuaucugcuaacugcugga

SEQ ID NO: 2200616 - RNA, 18 nt, Streptococcus pneumoniae R6
agacuccucuuuacaugc

SEQ ID NO: 2200617 - RNA, 15 nt, Streptococcus pneumoniae R6
agacuucccagccua

SEQ ID NO: 2200618 - RNA, 20 nt, Streptococcus pneumoniae R6
agacuuagucuucuuuucuu

SEQ ID NO: 2200619 - RNA, 23 nt, Streptococcus pneumoniae R6
agacuugcccaucacgaccaaug

SEQ ID NO: 2200620 - RNA, 15 nt, Streptococcus pneumoniae R6
agacuguuaccacuu

SEQ ID NO: 2200621 - RNA, 17 nt, Streptococcus pneumoniae R6
agacuggugagauaaaa

SEQ ID NO: 2200622 - RNA, 17 nt, Streptococcus pneumoniae R6
agacugacgaagucagc

SEQ ID NO: 2200623 - RNA, 21 nt, Streptococcus pneumoniae R6
agacugacgaagucagcucaa

SEQ ID NO: 2200624 - RNA, 18 nt, Streptococcus pneumoniae R6
agacucuuuaagagaguu

SEQ ID NO: 2200625 - RNA, 15 nt, Streptococcus pneumoniae R6
agacugaaaauuuga

SEQ ID NO: 2200626 - RNA, 16 nt, Streptococcus pneumoniae R6
agacuuucaaaccauu

SEQ ID NO: 2200627 - RNA, 21 nt, Streptococcus pneumoniae R6
agacuuggaacaguccuuguu

SEQ ID NO: 2200628 - RNA, 14 nt, Streptococcus pneumoniae R6
agacuuuaaaaauu

SEQ ID NO: 2200629 - RNA, 11 nt, Streptococcus pneumoniae R6
agagaaaacca

SEQ ID NO: 2200630 - RNA, 21 nt, Streptococcus pneumoniae R6
agacuuuuugagccaagcguu

SEQ ID NO: 2200631 - RNA, 19 nt, Streptococcus pneumoniae R6
agacuuuuauccaccuauu

SEQ ID NO: 2200632 - RNA, 14 nt, Streptococcus pneumoniae R6
agagaaagaaaaac

SEQ ID NO: 2200633 - RNA, 17 nt, Streptococcus pneumoniae R6
agagaaugaaauauaga

SEQ ID NO: 2200634 - RNA, 22 nt, Streptococcus pneumoniae R6
agagaacuucacguucuuccaa

SEQ ID NO: 2200635 - RNA, 18 nt, Streptococcus pneumoniae R6
agagaagaucaauaguga

SEQ ID NO: 2200636 - RNA, 14 nt, Streptococcus pneumoniae R6
agagaagagagcau

SEQ ID NO: 2200637 - RNA, 17 nt, Streptococcus pneumoniae R6
agagaagagagcauuaa

SEQ ID NO: 2200638 - RNA, 21 nt, Streptococcus pneumoniae R6
agagaaggauugacauaccac

SEQ ID NO: 2200639 - RNA, 14 nt, Streptococcus pneumoniae R6
agagaagcaaguga

SEQ ID NO: 2200640 - RNA, 17 nt, Streptococcus pneumoniae R6
agagaagcacaugccuu

SEQ ID NO: 2200641 - RNA, 16 nt, Streptococcus pneumoniae R6
agagaagccaagagua

SEQ ID NO: 2200642 - RNA, 12 nt, Streptococcus pneumoniae R6
agagaagccacc

SEQ ID NO: 2200643 - RNA, 21 nt, Streptococcus pneumoniae R6
agagaagccaccgccagaacu

SEQ ID NO: 2200644 - RNA, 20 nt, Streptococcus pneumoniae R6
agagacauaaucaagaugaa

SEQ ID NO: 2200645 - RNA, 14 nt, Streptococcus pneumoniae R6
agagacagaagaua

SEQ ID NO: 2200646 - RNA, 12 nt, Streptococcus pneumoniae R6
agagacagcagu

SEQ ID NO: 2200647 - RNA, 14 nt, Streptococcus pneumoniae R6
agagacagcaguua

SEQ ID NO: 2200648 - RNA, 15 nt, Streptococcus pneumoniae R6
agagacuacggaguu

SEQ ID NO: 2200649 - RNA, 22 nt, Streptococcus pneumoniae R6
agagacuacuuccguaaucuug

SEQ ID NO: 2200650 - RNA, 18 nt, Streptococcus pneumoniae R6
agagagcagauagggcua

SEQ ID NO: 2200651 - RNA, 13 nt, Streptococcus pneumoniae R6
agagagacagcag

SEQ ID NO: 2200652 - RNA, 15 nt, Streptococcus pneumoniae R6
agagagcuccaaaga

SEQ ID NO: 2200653 - RNA, 17 nt, Streptococcus pneumoniae R6
agagagcuccaaagaag

SEQ ID NO: 2200654 - RNA, 18 nt, Streptococcus pneumoniae R6
agagagcuccaaagaaga

SEQ ID NO: 2200655 - RNA, 19 nt, Streptococcus pneumoniae R6
agagagcuccaaagaagau

SEQ ID NO: 2200656 - RNA, 21 nt, Streptococcus pneumoniae R6
agagagcuuucuaaacaaugu

SEQ ID NO: 2200657 - RNA, 15 nt, Streptococcus pneumoniae R6
agagauaaguggcaa

SEQ ID NO: 2200658 - RNA, 21 nt, Streptococcus pneumoniae R6
agagaggggaggauagaccug

SEQ ID NO: 2200659 - RNA, 20 nt, Streptococcus pneumoniae R6
agagauaggucaagccgagc

SEQ ID NO: 2200660 - RNA, 17 nt, Streptococcus pneumoniae R6
agagauaccuuuuccuu

SEQ ID NO: 2200661 - RNA, 17 nt, Streptococcus pneumoniae R6
agagcaaacuaggaagc

SEQ ID NO: 2200662 - RNA, 20 nt, Streptococcus pneumoniae R6
agagcaaacuaggaagcuag

SEQ ID NO: 2200663 - RNA, 12 nt, Streptococcus pneumoniae R6
agagcaaaaaca

SEQ ID NO: 2200664 - RNA, 23 nt, Streptococcus pneumoniae R6
agagcuccaaauggcaugaggag

SEQ ID NO: 2200665 - RNA, 22 nt, Streptococcus pneumoniae R6
aaaaccaauucccaaacaucug

SEQ ID NO: 2200666 - RNA, 13 nt, Streptococcus pneumoniae R6
aaaaccaaaggca

SEQ ID NO: 2200667 - RNA, 15 nt, Streptococcus pneumoniae R6
agagcuaacuuuucc

SEQ ID NO: 2200668 - RNA, 22 nt, Streptococcus pneumoniae R6
agagcguugacgauuuuuucuu

SEQ ID NO: 2200669 - RNA, 20 nt, Streptococcus pneumoniae R6
agagcccaauauucucuaga

SEQ ID NO: 2200670 - RNA, 21 nt, Streptococcus pneumoniae R6
agagcccaauauucucuagaa

SEQ ID NO: 2200671 - RNA, 22 nt, Streptococcus pneumoniae R6
agagcauucuuuuguucaucau

SEQ ID NO: 2200672 - RNA, 15 nt, Streptococcus pneumoniae R6
agagcauuugaaaaa

SEQ ID NO: 2200673 - RNA, 22 nt, Streptococcus pneumoniae R6
agagcauuaaccuuaggaauga

SEQ ID NO: 2200674 - RNA, 15 nt, Streptococcus pneumoniae R6
agagccaaaaaagaa

SEQ ID NO: 2200675 - RNA, 16 nt, Streptococcus pneumoniae R6
agagccaaaaaagaaa

SEQ ID NO: 2200676 - RNA, 19 nt, Streptococcus pneumoniae R6
agagccaaaaaagaaagga

SEQ ID NO: 2200677 - RNA, 20 nt, Streptococcus pneumoniae R6
agaugggucaagauuuccug

SEQ ID NO: 2200678 - RNA, 18 nt, Streptococcus pneumoniae R6
agauggucaaaauauuug

SEQ ID NO: 2200679 - RNA, 21 nt, Streptococcus pneumoniae R6
agauggucaugauagcuagcg

SEQ ID NO: 2200680 - RNA, 13 nt, Streptococcus pneumoniae R6
agauggaacugac

SEQ ID NO: 2200681 - RNA, 18 nt, Streptococcus pneumoniae R6
agauuaaaccuuccaaga

SEQ ID NO: 2200682 - RNA, 14 nt, Streptococcus pneumoniae R6
agaugauuacucaa

SEQ ID NO: 2200683 - RNA, 22 nt, Streptococcus pneumoniae R6
agaugauuccugucauggcuga

SEQ ID NO: 2200684 - RNA, 20 nt, Streptococcus pneumoniae R6
agaugauucucagguuuuuc

SEQ ID NO: 2200685 - RNA, 15 nt, Streptococcus pneumoniae R6
agaugauuuucaaau

SEQ ID NO: 2200686 - RNA, 22 nt, Streptococcus pneumoniae R6
agaugauuuucaaauuuucuuu

SEQ ID NO: 2200687 - RNA, 21 nt, Streptococcus pneumoniae R6
agaugauuuuucuguuuucuu

SEQ ID NO: 2200688 - RNA, 22 nt, Streptococcus pneumoniae R6
agaugaucgagcagauuucuuu

SEQ ID NO: 2200689 - RNA, 19 nt, Streptococcus pneumoniae R6
agaugaagacauuugcuug

SEQ ID NO: 2200690 - RNA, 21 nt, Streptococcus pneumoniae R6
agaugaaacugacgaagucag

SEQ ID NO: 2200691 - RNA, 16 nt, Streptococcus pneumoniae R6
agaucuuuuuauacuc

SEQ ID NO: 2200692 - RNA, 18 nt, Streptococcus pneumoniae R6
agaucuuuuuauacucaa

SEQ ID NO: 2200693 - RNA, 15 nt, Streptococcus pneumoniae R6
agaucuugucugcau

SEQ ID NO: 2200694 - RNA, 16 nt, Streptococcus pneumoniae R6
agaucuugucugcaug

SEQ ID NO: 2200695 - RNA, 15 nt, Streptococcus pneumoniae R6
agaucuagaaaggac

SEQ ID NO: 2200696 - RNA, 16 nt, Streptococcus pneumoniae R6
agauccuucaaauccu

SEQ ID NO: 2200697 - RNA, 19 nt, Streptococcus pneumoniae R6
agauccuucaaauccugca

SEQ ID NO: 2200698 - RNA, 18 nt, Streptococcus pneumoniae R6
agauaacaccguucuaaa

SEQ ID NO: 2200699 - RNA, 14 nt, Streptococcus pneumoniae R6
agauaacuuuucug

SEQ ID NO: 2200700 - RNA, 17 nt, Streptococcus pneumoniae R6
agauaacuuuucugcua

SEQ ID NO: 2200701 - RNA, 16 nt, Streptococcus pneumoniae R6
agauaacguucaccgu

SEQ ID NO: 2200702 - RNA, 14 nt, Streptococcus pneumoniae R6
agauaauauacccu

SEQ ID NO: 2200703 - RNA, 21 nt, Streptococcus pneumoniae R6
agaguuuugguugaugaagaa

SEQ ID NO: 2200704 - RNA, 18 nt, Streptococcus pneumoniae R6
agauaaaaccugccugug

SEQ ID NO: 2200705 - RNA, 15 nt, Streptococcus pneumoniae R6
agaguuuuuuaucuu

SEQ ID NO: 2200706 - RNA, 17 nt, Streptococcus pneumoniae R6
agaguggcuuuugauuu

SEQ ID NO: 2200707 - RNA, 21 nt, Streptococcus pneumoniae R6
agaguuguucacaucuuauuu

SEQ ID NO: 2200708 - RNA, 22 nt, Streptococcus pneumoniae R6
agaguauaaaaccuugaagagu

SEQ ID NO: 2200709 - RNA, 18 nt, Streptococcus pneumoniae R6
agaguauaaaauuuugac

SEQ ID NO: 2200710 - RNA, 21 nt, Streptococcus pneumoniae R6
agagucaagacaaggauaaaa

SEQ ID NO: 2200711 - RNA, 21 nt, Streptococcus pneumoniae R6
agagucacaaaggucauuuuc

SEQ ID NO: 2200712 - RNA, 16 nt, Streptococcus pneumoniae R6
agaguauuacaaucau

SEQ ID NO: 2200713 - RNA, 24 nt, Streptococcus pneumoniae R6
agagugacagggccuuuugcauaa

SEQ ID NO: 2200714 - RNA, 16 nt, Streptococcus pneumoniae R6
agagucuggaacaaaa

SEQ ID NO: 2200715 - RNA, 18 nt, Streptococcus pneumoniae R6
agagucagggucaaagua

SEQ ID NO: 2200716 - RNA, 23 nt, Streptococcus pneumoniae R6
agaguccugcccacuaaaaauau

SEQ ID NO: 2200717 - RNA, 21 nt, Streptococcus pneumoniae R6
agauauaauuguaaacaaaaa

SEQ ID NO: 2200718 - RNA, 16 nt, Streptococcus pneumoniae R6
agauaguucaaucaua

SEQ ID NO: 2200719 - RNA, 17 nt, Streptococcus pneumoniae R6
agauagucgauaaaaag

SEQ ID NO: 2200720 - RNA, 18 nt, Streptococcus pneumoniae R6
agauagucgauaaaaagg

SEQ ID NO: 2200721 - RNA, 19 nt, Streptococcus pneumoniae R6
agauagucgauaaaaaggu

SEQ ID NO: 2200722 - RNA, 16 nt, Streptococcus pneumoniae R6
agauagggcugaagga

SEQ ID NO: 2200723 - RNA, 20 nt, Streptococcus pneumoniae R6
agauaguauuuuaaaacgaa

SEQ ID NO: 2200724 - RNA, 14 nt, Streptococcus pneumoniae R6
agauaguaucaaau

SEQ ID NO: 2200725 - RNA, 15 nt, Streptococcus pneumoniae R6
agauagcugugaagc

SEQ ID NO: 2200726 - RNA, 15 nt, Streptococcus pneumoniae R6
agauaggagaccagc

SEQ ID NO: 2200727 - RNA, 17 nt, Streptococcus pneumoniae R6
agauaggagaccagcua

SEQ ID NO: 2200728 - RNA, 12 nt, Streptococcus pneumoniae R6
agauagcugcag

SEQ ID NO: 2200729 - RNA, 16 nt, Streptococcus pneumoniae R6
agauagcugcagcuga

SEQ ID NO: 2200730 - RNA, 21 nt, Streptococcus pneumoniae R6
agauagcgcugggcugucucu

SEQ ID NO: 2200731 - RNA, 22 nt, Streptococcus pneumoniae R6
agauagcgcugggcugucucua

SEQ ID NO: 2200732 - RNA, 14 nt, Streptococcus pneumoniae R6
agauacauuuuuuc

SEQ ID NO: 2200733 - RNA, 14 nt, Streptococcus pneumoniae R6
agauacaaaaccaa

SEQ ID NO: 2200734 - RNA, 15 nt, Streptococcus pneumoniae R6
agauacaaaaccaaa

SEQ ID NO: 2200735 - RNA, 16 nt, Streptococcus pneumoniae R6
agauacaaaaccaaac

SEQ ID NO: 2200736 - RNA, 18 nt, Streptococcus pneumoniae R6
agauaaugcccaagagac

SEQ ID NO: 2200737 - RNA, 14 nt, Streptococcus pneumoniae R6
agauaaucaucugg

SEQ ID NO: 2200738 - RNA, 22 nt, Streptococcus pneumoniae R6
agaaccuuggaaauaacggucg

SEQ ID NO: 2200739 - RNA, 23 nt, Streptococcus pneumoniae R6
agaaccucuguauaaauagcuac

SEQ ID NO: 2200740 - RNA, 15 nt, Streptococcus pneumoniae R6
agaacgauuuuagau

SEQ ID NO: 2200741 - RNA, 20 nt, Streptococcus pneumoniae R6
agaacauuacccauagauuu

SEQ ID NO: 2200742 - RNA, 23 nt, Streptococcus pneumoniae R6
agaacauuacccauagauuuuua

SEQ ID NO: 2200743 - RNA, 13 nt, Streptococcus pneumoniae R6
agaacauuuuaau

SEQ ID NO: 2200744 - RNA, 14 nt, Streptococcus pneumoniae R6
agaaccaauaugua

SEQ ID NO: 2200745 - RNA, 15 nt, Streptococcus pneumoniae R6
agaaccaggaaacca

SEQ ID NO: 2200746 - RNA, 14 nt, Streptococcus pneumoniae R6
agaagaagugacag

SEQ ID NO: 2200747 - RNA, 19 nt, Streptococcus pneumoniae R6
agaagacgccuaguacauu

SEQ ID NO: 2200748 - RNA, 16 nt, Streptococcus pneumoniae R6
agaacuuuaacuugaa

SEQ ID NO: 2200749 - RNA, 20 nt, Streptococcus pneumoniae R6
agaacuuucuuuuuuuccau

SEQ ID NO: 2200750 - RNA, 14 nt, Streptococcus pneumoniae R6
agaacuuuuaacuu

SEQ ID NO: 2200751 - RNA, 20 nt, Streptococcus pneumoniae R6
agaacuugguuugucaucgu

SEQ ID NO: 2200752 - RNA, 19 nt, Streptococcus pneumoniae R6
agaacuugcuccaaaggag

SEQ ID NO: 2200753 - RNA, 17 nt, Streptococcus pneumoniae R6
agaaaucacaauuccua

SEQ ID NO: 2200754 - RNA, 16 nt, Streptococcus pneumoniae R6
agaaaucaauuugacu

SEQ ID NO: 2200755 - RNA, 21 nt, Streptococcus pneumoniae R6
agaaaucauacaccucuucug

SEQ ID NO: 2200756 - RNA, 15 nt, Streptococcus pneumoniae R6
agaaaugcccaauuc

SEQ ID NO: 2200757 - RNA, 12 nt, Streptococcus pneumoniae R6
agaaauuucaac

SEQ ID NO: 2200758 - RNA, 15 nt, Streptococcus pneumoniae R6
agaaauuucaacaaa

SEQ ID NO: 2200759 - RNA, 14 nt, Streptococcus pneumoniae R6
agaaauuucugaaa

SEQ ID NO: 2200760 - RNA, 21 nt, Streptococcus pneumoniae R6
agaaauuuucuuuuuccuaau

SEQ ID NO: 2200761 - RNA, 19 nt, Streptococcus pneumoniae R6
agaaacguuguuaaaucaa

SEQ ID NO: 2200762 - RNA, 23 nt, Streptococcus pneumoniae R6
agaaacuaugaugugcuauucua

SEQ ID NO: 2200763 - RNA, 20 nt, Streptococcus pneumoniae R6
agaaacguccaaggcugaaa

SEQ ID NO: 2200764 - RNA, 11 nt, Streptococcus pneumoniae R6
aaaacacuguu

SEQ ID NO: 2200765 - RNA, 16 nt, Streptococcus pneumoniae R6
aaaacacuguuuuaag

SEQ ID NO: 2200766 - RNA, 22 nt, Streptococcus pneumoniae R6
aaaacacuguuuuaagguugua

SEQ ID NO: 2200767 - RNA, 13 nt, Streptococcus pneumoniae R6
agaaacaauaaaa

SEQ ID NO: 2200768 - RNA, 14 nt, Streptococcus pneumoniae R6
agaaacaauaaaau

SEQ ID NO: 2200769 - RNA, 18 nt, Streptococcus pneumoniae R6
agaaacaauaaaaucaaa

SEQ ID NO: 2200770 - RNA, 18 nt, Streptococcus pneumoniae R6
agaaacacauuuuuagaa

SEQ ID NO: 2200771 - RNA, 17 nt, Streptococcus pneumoniae R6
agaaaccgucaucagca

SEQ ID NO: 2200772 - RNA, 16 nt, Streptococcus pneumoniae R6
agaaacgacggucaug

SEQ ID NO: 2200773 - RNA, 21 nt, Streptococcus pneumoniae R6
agaaacgacggucaugcgaaa

SEQ ID NO: 2200774 - RNA, 17 nt, Streptococcus pneumoniae R6
agaauaagggauucgaa

SEQ ID NO: 2200775 - RNA, 16 nt, Streptococcus pneumoniae R6
agaauaguacacuucu

SEQ ID NO: 2200776 - RNA, 20 nt, Streptococcus pneumoniae R6
agaauagagggauucuccau

SEQ ID NO: 2200777 - RNA, 16 nt, Streptococcus pneumoniae R6
agaauagcgauuuaau

SEQ ID NO: 2200778 - RNA, 21 nt, Streptococcus pneumoniae R6
agaauacucuuuacuuugcuu

SEQ ID NO: 2200779 - RNA, 16 nt, Streptococcus pneumoniae R6
agaaguugucugucuu

SEQ ID NO: 2200780 - RNA, 21 nt, Streptococcus pneumoniae R6
agaaguuggccaacuaaccaa

SEQ ID NO: 2200781 - RNA, 16 nt, Streptococcus pneumoniae R6
agaaguggauuuucuu

SEQ ID NO: 2200782 - RNA, 20 nt, Streptococcus pneumoniae R6
agaagucgguacuuaaacgu

SEQ ID NO: 2200783 - RNA, 20 nt, Streptococcus pneumoniae R6
agaagagucagcucuuuuuu

SEQ ID NO: 2200784 - RNA, 23 nt, Streptococcus pneumoniae R6
agaagaggcugugguccuuguag

SEQ ID NO: 2200785 - RNA, 18 nt, Streptococcus pneumoniae R6
agaagccugauggaaaca

SEQ ID NO: 2200786 - RNA, 21 nt, Streptococcus pneumoniae R6
agaauucagcuuuguucacuu

SEQ ID NO: 2200787 - RNA, 21 nt, Streptococcus pneumoniae R6
agaaugcuugcgacaaaaaga

SEQ ID NO: 2200788 - RNA, 14 nt, Streptococcus pneumoniae R6
agaaucugcaugac

SEQ ID NO: 2200789 - RNA, 15 nt, Streptococcus pneumoniae R6
agaaucaacaugaga

SEQ ID NO: 2200790 - RNA, 17 nt, Streptococcus pneumoniae R6
agaauauccauaccugc

SEQ ID NO: 2200791 - RNA, 15 nt, Streptococcus pneumoniae R6
agaauaucaagauaa

SEQ ID NO: 2200792 - RNA, 16 nt, Streptococcus pneumoniae R6
agaauaucaagauaag

SEQ ID NO: 2200793 - RNA, 20 nt, Streptococcus pneumoniae R6
agaauaucaagauaagaaaa

SEQ ID NO: 2200794 - RNA, 17 nt, Streptococcus pneumoniae R6
agaauaguguaguugaa

SEQ ID NO: 2200795 - RNA, 22 nt, Streptococcus pneumoniae R6
agaaucgucuguacaaauccca

SEQ ID NO: 2200796 - RNA, 18 nt, Streptococcus pneumoniae R6
agaaucgugaguuccugu

SEQ ID NO: 2200797 - RNA, 19 nt, Streptococcus pneumoniae R6
agaaucgugaguuccuguu

SEQ ID NO: 2200798 - RNA, 18 nt, Streptococcus pneumoniae R6
agaaucaauagaagugga

SEQ ID NO: 2200799 - RNA, 13 nt, Streptococcus pneumoniae R6
acuuuuaaugaga

SEQ ID NO: 2200800 - RNA, 16 nt, Streptococcus pneumoniae R6
acuuuuaagaaaucau

SEQ ID NO: 2200801 - RNA, 17 nt, Streptococcus pneumoniae R6
acuuuuaagaaaucaua

SEQ ID NO: 2200802 - RNA, 20 nt, Streptococcus pneumoniae R6
acuuugguuauaaaaaacaa

SEQ ID NO: 2200803 - RNA, 21 nt, Streptococcus pneumoniae R6
acuuugauuuuaaagaaauag

SEQ ID NO: 2200804 - RNA, 17 nt, Streptococcus pneumoniae R6
acuuucuaauuauuuca

SEQ ID NO: 2200805 - RNA, 18 nt, Streptococcus pneumoniae R6
acuuucuaauuauuucaa

SEQ ID NO: 2200806 - RNA, 22 nt, Streptococcus pneumoniae R6
acuuucuaauuauuucaauuag

SEQ ID NO: 2200807 - RNA, 15 nt, Streptococcus pneumoniae R6
acuuugagcaaccug

SEQ ID NO: 2200808 - RNA, 20 nt, Streptococcus pneumoniae R6
acuuucucacgaauaaccaa

SEQ ID NO: 2200809 - RNA, 18 nt, Streptococcus pneumoniae R6
acuuucucugacuuuucc

SEQ ID NO: 2200810 - RNA, 19 nt, Streptococcus pneumoniae R6
acuuucuggucuuuuugcu

SEQ ID NO: 2200811 - RNA, 18 nt, Streptococcus pneumoniae R6
acuuuuucuuccuuucuc

SEQ ID NO: 2200812 - RNA, 22 nt, Streptococcus pneumoniae R6
acuuuuucuuccuuucucugug

SEQ ID NO: 2200813 - RNA, 14 nt, Streptococcus pneumoniae R6
acuuuuuguuuaau

SEQ ID NO: 2200814 - RNA, 15 nt, Streptococcus pneumoniae R6
acuuuuucaaaguuu

SEQ ID NO: 2200815 - RNA, 13 nt, Streptococcus pneumoniae R6
acuuuugaaaaaa

SEQ ID NO: 2200816 - RNA, 19 nt, Streptococcus pneumoniae R6
acuuuugaaaaaaauguca

SEQ ID NO: 2200817 - RNA, 19 nt, Streptococcus pneumoniae R6
acuuuuccaguaauuuccc

SEQ ID NO: 2200818 - RNA, 16 nt, Streptococcus pneumoniae R6
acuuuuccauuguuuu

SEQ ID NO: 2200819 - RNA, 22 nt, Streptococcus pneumoniae R6
acuuuuccuguuguauuuauau

SEQ ID NO: 2200820 - RNA, 14 nt, Streptococcus pneumoniae R6
acuuuuccuuaaca

SEQ ID NO: 2200821 - RNA, 18 nt, Streptococcus pneumoniae R6
acuuuucuaagaugauuu

SEQ ID NO: 2200822 - RNA, 22 nt, Streptococcus pneumoniae R6
acuuuucuaagaugauuuuucu

SEQ ID NO: 2200823 - RNA, 16 nt, Streptococcus pneumoniae R6
agaaaaugaggaaaau

SEQ ID NO: 2200824 - RNA, 14 nt, Streptococcus pneumoniae R6
agaaaaucucuuca

SEQ ID NO: 2200825 - RNA, 15 nt, Streptococcus pneumoniae R6
agaaacaacaaugga

SEQ ID NO: 2200826 - RNA, 17 nt, Streptococcus pneumoniae R6
agaaacaacaauggaaa

SEQ ID NO: 2200827 - RNA, 21 nt, Streptococcus pneumoniae R6
agaaacaacaauggaaaugau

SEQ ID NO: 2200828 - RNA, 18 nt, Streptococcus pneumoniae R6
agaaaauucaaauuaauu

SEQ ID NO: 2200829 - RNA, 14 nt, Streptococcus pneumoniae R6
agaaaauucuaaag

SEQ ID NO: 2200830 - RNA, 22 nt, Streptococcus pneumoniae R6
agaaaaaaucaagggaaaauga

SEQ ID NO: 2200831 - RNA, 14 nt, Streptococcus pneumoniae R6
agaaaaaaucuaac

SEQ ID NO: 2200832 - RNA, 20 nt, Streptococcus pneumoniae R6
agaaaaaagcuugaguggaa

SEQ ID NO: 2200833 - RNA, 11 nt, Streptococcus pneumoniae R6
agaaaaaaauu

SEQ ID NO: 2200834 - RNA, 13 nt, Streptococcus pneumoniae R6
agaaaaaaauuuu

SEQ ID NO: 2200835 - RNA, 16 nt, Streptococcus pneumoniae R6
agaaaaaacagccgag

SEQ ID NO: 2200836 - RNA, 14 nt, Streptococcus pneumoniae R6
acuuuuuugcgaag

SEQ ID NO: 2200837 - RNA, 23 nt, Streptococcus pneumoniae R6
acuuuuuucuuugauaagauaaa

SEQ ID NO: 2200838 - RNA, 12 nt, Streptococcus pneumoniae R6
acuuuuuucuua

SEQ ID NO: 2200839 - RNA, 13 nt, Streptococcus pneumoniae R6
agaaaaaaaguaa

SEQ ID NO: 2200840 - RNA, 13 nt, Streptococcus pneumoniae R6
acuuuuuuucuuc

SEQ ID NO: 2200841 - RNA, 16 nt, Streptococcus pneumoniae R6
acuuuaacuugaacuu

SEQ ID NO: 2200842 - RNA, 19 nt, Streptococcus pneumoniae R6
acuuuaacuggaucaauga

SEQ ID NO: 2200843 - RNA, 17 nt, Streptococcus pneumoniae R6
acuuuaagauuacgacg

SEQ ID NO: 2200844 - RNA, 14 nt, Streptococcus pneumoniae R6
acuuuacaacacuu

SEQ ID NO: 2200845 - RNA, 22 nt, Streptococcus pneumoniae R6
acuuuaagggaauuagagaguu

SEQ ID NO: 2200846 - RNA, 19 nt, Streptococcus pneumoniae R6
acuuuagcagcuuucaaag

SEQ ID NO: 2200847 - RNA, 20 nt, Streptococcus pneumoniae R6
acuuuauuuucucaucaaau

SEQ ID NO: 2200848 - RNA, 15 nt, Streptococcus pneumoniae R6
acuuucauugauggu

SEQ ID NO: 2200849 - RNA, 22 nt, Streptococcus pneumoniae R6
acuugcuguuuucuuggucauu

SEQ ID NO: 2200850 - RNA, 20 nt, Streptococcus pneumoniae R6
acuugcucagaggagaugaa

SEQ ID NO: 2200851 - RNA, 20 nt, Streptococcus pneumoniae R6
acuugcuccaaaggagaaga

SEQ ID NO: 2200852 - RNA, 17 nt, Streptococcus pneumoniae R6
acuugcgaguugugaau

SEQ ID NO: 2200853 - RNA, 15 nt, Streptococcus pneumoniae R6
acuugcaagaaagua

SEQ ID NO: 2200854 - RNA, 18 nt, Streptococcus pneumoniae R6
acuuauaaaaaacacaaa

SEQ ID NO: 2200855 - RNA, 19 nt, Streptococcus pneumoniae R6
acuuaguauccuugaugcg

SEQ ID NO: 2200856 - RNA, 20 nt, Streptococcus pneumoniae R6
acuuauagaggagauuuaaa

SEQ ID NO: 2200857 - RNA, 15 nt, Streptococcus pneumoniae R6
acuuguguuuuuccu

SEQ ID NO: 2200858 - RNA, 22 nt, Streptococcus pneumoniae R6
acuuguguuuuuccuuugagua

SEQ ID NO: 2200859 - RNA, 12 nt, Streptococcus pneumoniae R6
acuugugucaua

SEQ ID NO: 2200860 - RNA, 17 nt, Streptococcus pneumoniae R6
acuuguggcaaggagua

SEQ ID NO: 2200861 - RNA, 20 nt, Streptococcus pneumoniae R6
acuuguaggcuucuugacca

SEQ ID NO: 2200862 - RNA, 14 nt, Streptococcus pneumoniae R6
acuuguauccuccu

SEQ ID NO: 2200863 - RNA, 20 nt, Streptococcus pneumoniae R6
acuuguaacuagcugccuag

SEQ ID NO: 2200864 - RNA, 14 nt, Streptococcus pneumoniae R6
acuuguacucaaug

SEQ ID NO: 2200865 - RNA, 16 nt, Streptococcus pneumoniae R6
acuuguacuugagauu

SEQ ID NO: 2200866 - RNA, 18 nt, Streptococcus pneumoniae R6
acuugguguugagaaagc

SEQ ID NO: 2200867 - RNA, 19 nt, Streptococcus pneumoniae R6
acuugguguugagaaagca

SEQ ID NO: 2200868 - RNA, 15 nt, Streptococcus pneumoniae R6
acuugguuacaucaa

SEQ ID NO: 2200869 - RNA, 21 nt, Streptococcus pneumoniae R6
acuugguugauuuaccauuuu

SEQ ID NO: 2200870 - RNA, 23 nt, Streptococcus pneumoniae R6
acuuguaaacaucaucugcauua

SEQ ID NO: 2200871 - RNA, 21 nt, Streptococcus pneumoniae R6
acuuguaaagaguacagucuu

SEQ ID NO: 2200872 - RNA, 20 nt, Streptococcus pneumoniae R6
acuuguaaagcgaaaggaga

SEQ ID NO: 2200873 - RNA, 23 nt, Streptococcus pneumoniae R6
acuuguaaagcgaaaggagaaaa

SEQ ID NO: 2200874 - RNA, 19 nt, Streptococcus pneumoniae R6
acuugggucguaaaccuuc

SEQ ID NO: 2200875 - RNA, 15 nt, Streptococcus pneumoniae R6
acuuggauaagagaa

SEQ ID NO: 2200876 - RNA, 19 nt, Streptococcus pneumoniae R6
agcccuccuauagaaaaau

SEQ ID NO: 2200877 - RNA, 19 nt, Streptococcus pneumoniae R6
agccgaagccaaucaaacu

SEQ ID NO: 2200878 - RNA, 18 nt, Streptococcus pneumoniae R6
agccgacccaggcaaaga

SEQ ID NO: 2200879 - RNA, 22 nt, Streptococcus pneumoniae R6
agccgacccaggcaaagagucc

SEQ ID NO: 2200880 - RNA, 17 nt, Streptococcus pneumoniae R6
agccgaugaccuugagc

SEQ ID NO: 2200881 - RNA, 20 nt, Streptococcus pneumoniae R6
agccuucuggucugauuuuc

SEQ ID NO: 2200882 - RNA, 21 nt, Streptococcus pneumoniae R6
agccuucuggucugauuuuca

SEQ ID NO: 2200883 - RNA, 12 nt, Streptococcus pneumoniae R6
agccuucuuuuu

SEQ ID NO: 2200884 - RNA, 17 nt, Streptococcus pneumoniae R6
agccuucuuuuuacaua

SEQ ID NO: 2200885 - RNA, 20 nt, Streptococcus pneumoniae R6
agccuucuugguuuuugcca

SEQ ID NO: 2200886 - RNA, 21 nt, Streptococcus pneumoniae R6
agcgaagaucuagaaaggaca

SEQ ID NO: 2200887 - RNA, 12 nt, Streptococcus pneumoniae R6
agcgaacaucuc

SEQ ID NO: 2200888 - RNA, 15 nt, Streptococcus pneumoniae R6
agcgaacaucuccaa

SEQ ID NO: 2200889 - RNA, 13 nt, Streptococcus pneumoniae R6
agcgaaauucucg

SEQ ID NO: 2200890 - RNA, 22 nt, Streptococcus pneumoniae R6
agccuuaccaccuuuaaauccu

SEQ ID NO: 2200891 - RNA, 17 nt, Streptococcus pneumoniae R6
agccucaaugauaccau

SEQ ID NO: 2200892 - RNA, 14 nt, Streptococcus pneumoniae R6
agccuccaauagca

SEQ ID NO: 2200893 - RNA, 17 nt, Streptococcus pneumoniae R6
agccuaccugcggauaa

SEQ ID NO: 2200894 - RNA, 16 nt, Streptococcus pneumoniae R6
agccggcuugucuuug

SEQ ID NO: 2200895 - RNA, 14 nt, Streptococcus pneumoniae R6
agccgggauuuuuu

SEQ ID NO: 2200896 - RNA, 19 nt, Streptococcus pneumoniae R6
agcgcaggaagaaagagga

SEQ ID NO: 2200897 - RNA, 17 nt, Streptococcus pneumoniae R6
agcggauauucguugga

SEQ ID NO: 2200898 - RNA, 19 nt, Streptococcus pneumoniae R6
agcggauguuauagcugga

SEQ ID NO: 2200899 - RNA, 22 nt, Streptococcus pneumoniae R6
agcggauuuggcuuuuuuguau

SEQ ID NO: 2200900 - RNA, 13 nt, Streptococcus pneumoniae R6
agcggauuuucaa

SEQ ID NO: 2200901 - RNA, 15 nt, Streptococcus pneumoniae R6
agcgcuugauagccu

SEQ ID NO: 2200902 - RNA, 19 nt, Streptococcus pneumoniae R6
agcguagucuuuuaaacua

SEQ ID NO: 2200903 - RNA, 16 nt, Streptococcus pneumoniae R6
agcggugaaucuagua

SEQ ID NO: 2200904 - RNA, 13 nt, Streptococcus pneumoniae R6
agcgguaucaauc

SEQ ID NO: 2200905 - RNA, 18 nt, Streptococcus pneumoniae R6
aaaaccuaucauauccag

SEQ ID NO: 2200906 - RNA, 16 nt, Streptococcus pneumoniae R6
aaaaccuugauauuau

SEQ ID NO: 2200907 - RNA, 21 nt, Streptococcus pneumoniae R6
aaaaccuuguuuuaaaauguu

SEQ ID NO: 2200908 - RNA, 15 nt, Streptococcus pneumoniae R6
agcagacuucuuuuu

SEQ ID NO: 2200909 - RNA, 14 nt, Streptococcus pneumoniae R6
agcagagaaagaaa

SEQ ID NO: 2200910 - RNA, 15 nt, Streptococcus pneumoniae R6
agcagagaaagaaaa

SEQ ID NO: 2200911 - RNA, 13 nt, Streptococcus pneumoniae R6
agcagagaagagg

SEQ ID NO: 2200912 - RNA, 16 nt, Streptococcus pneumoniae R6
agcagagaagcacaug

SEQ ID NO: 2200913 - RNA, 19 nt, Streptococcus pneumoniae R6
agcaggaagguaacuccca

SEQ ID NO: 2200914 - RNA, 15 nt, Streptococcus pneumoniae R6
agcauaauagcagaa

SEQ ID NO: 2200915 - RNA, 21 nt, Streptococcus pneumoniae R6
agcauaagccggcuugucuuu

SEQ ID NO: 2200916 - RNA, 19 nt, Streptococcus pneumoniae R6
agcauauuuuguuucgcug

SEQ ID NO: 2200917 - RNA, 17 nt, Streptococcus pneumoniae R6
agcaucaaucaaacgag

SEQ ID NO: 2200918 - RNA, 19 nt, Streptococcus pneumoniae R6
agcaucgagaauuucuggu

SEQ ID NO: 2200919 - RNA, 18 nt, Streptococcus pneumoniae R6
agcauaacgacagaagaa

SEQ ID NO: 2200920 - RNA, 21 nt, Streptococcus pneumoniae R6
agcauaacgacagaagaagug

SEQ ID NO: 2200921 - RNA, 12 nt, Streptococcus pneumoniae R6
agccaauacugc

SEQ ID NO: 2200922 - RNA, 21 nt, Streptococcus pneumoniae R6
agccaacaacugauucuacuu

SEQ ID NO: 2200923 - RNA, 12 nt, Streptococcus pneumoniae R6
agccaaaucaau

SEQ ID NO: 2200924 - RNA, 18 nt, Streptococcus pneumoniae R6
agccaaaccguucaagac

SEQ ID NO: 2200925 - RNA, 23 nt, Streptococcus pneumoniae R6
agccaaacuaggauuuucuuaca

SEQ ID NO: 2200926 - RNA, 15 nt, Streptococcus pneumoniae R6
agccaauauuagucg

SEQ ID NO: 2200927 - RNA, 18 nt, Streptococcus pneumoniae R6
agccaauggguugaagua

SEQ ID NO: 2200928 - RNA, 18 nt, Streptococcus pneumoniae R6
agccaauguauuaagaac

SEQ ID NO: 2200929 - RNA, 14 nt, Streptococcus pneumoniae R6
agccaauugagggu

SEQ ID NO: 2200930 - RNA, 17 nt, Streptococcus pneumoniae R6
agccacugcaucugguu

SEQ ID NO: 2200931 - RNA, 16 nt, Streptococcus pneumoniae R6
agccagaaaaaucccu

SEQ ID NO: 2200932 - RNA, 17 nt, Streptococcus pneumoniae R6
agccacuguacguccaa

SEQ ID NO: 2200933 - RNA, 21 nt, Streptococcus pneumoniae R6
agcaucucccgucaagacuag

SEQ ID NO: 2200934 - RNA, 21 nt, Streptococcus pneumoniae R6
agcaucuuaucagaaaauaaa

SEQ ID NO: 2200935 - RNA, 15 nt, Streptococcus pneumoniae R6
agcaucugguuucgu

SEQ ID NO: 2200936 - RNA, 22 nt, Streptococcus pneumoniae R6
agcaucugguuucguagcagaa

SEQ ID NO: 2200937 - RNA, 14 nt, Streptococcus pneumoniae R6
agcauggucaggcu

SEQ ID NO: 2200938 - RNA, 18 nt, Streptococcus pneumoniae R6
agcauggucaggcuagga

SEQ ID NO: 2200939 - RNA, 17 nt, Streptococcus pneumoniae R6
agcaucuucuucuggug

SEQ ID NO: 2200940 - RNA, 22 nt, Streptococcus pneumoniae R6
agcauucuaguccaucuccgau

SEQ ID NO: 2200941 - RNA, 18 nt, Streptococcus pneumoniae R6
agcauugucauuuaugua

SEQ ID NO: 2200942 - RNA, 22 nt, Streptococcus pneumoniae R6
agcauuuccaccugcagcaagu

SEQ ID NO: 2200943 - RNA, 17 nt, Streptococcus pneumoniae R6
agcauuuucaaagaaga

SEQ ID NO: 2200944 - RNA, 20 nt, Streptococcus pneumoniae R6
agcauuuucaaagaagaggu

SEQ ID NO: 2200945 - RNA, 20 nt, Streptococcus pneumoniae R6
agcauuuucuuuuugaaguu

SEQ ID NO: 2200946 - RNA, 18 nt, Streptococcus pneumoniae R6
agccaaaaaagaaaggac

SEQ ID NO: 2200947 - RNA, 15 nt, Streptococcus pneumoniae R6
agcaccaaaagcaga

SEQ ID NO: 2200948 - RNA, 18 nt, Streptococcus pneumoniae R6
agcacggagaaucuuccc

SEQ ID NO: 2200949 - RNA, 16 nt, Streptococcus pneumoniae R6
agcacggaucuugaac

SEQ ID NO: 2200950 - RNA, 13 nt, Streptococcus pneumoniae R6
agcacgauuauua

SEQ ID NO: 2200951 - RNA, 14 nt, Streptococcus pneumoniae R6
agcagaauuuaacu

SEQ ID NO: 2200952 - RNA, 19 nt, Streptococcus pneumoniae R6
agcagaaccccgauaacag

SEQ ID NO: 2200953 - RNA, 22 nt, Streptococcus pneumoniae R6
agcagaaccccgauaacagccg

SEQ ID NO: 2200954 - RNA, 19 nt, Streptococcus pneumoniae R6
agcacaaugcuguuucuau

SEQ ID NO: 2200955 - RNA, 21 nt, Streptococcus pneumoniae R6
agcacacaaaucuucuguaga

SEQ ID NO: 2200956 - RNA, 20 nt, Streptococcus pneumoniae R6
agcaauucuugguugccuuu

SEQ ID NO: 2200957 - RNA, 16 nt, Streptococcus pneumoniae R6
agcaauucaauuuuau

SEQ ID NO: 2200958 - RNA, 21 nt, Streptococcus pneumoniae R6
agcaaucauaccugcauuguc

SEQ ID NO: 2200959 - RNA, 22 nt, Streptococcus pneumoniae R6
agcaaucauaccugcauugucu

SEQ ID NO: 2200960 - RNA, 15 nt, Streptococcus pneumoniae R6
agcaaucaaaauugu

SEQ ID NO: 2200961 - RNA, 16 nt, Streptococcus pneumoniae R6
agcaauaauaaugguu

SEQ ID NO: 2200962 - RNA, 16 nt, Streptococcus pneumoniae R6
agcaaugccaaaggua

SEQ ID NO: 2200963 - RNA, 12 nt, Streptococcus pneumoniae R6
agcaaugccaaa

SEQ ID NO: 2200964 - RNA, 18 nt, Streptococcus pneumoniae R6
agcaacuucagauucacu

SEQ ID NO: 2200965 - RNA, 18 nt, Streptococcus pneumoniae R6
agcaacuguuuuuucaac

SEQ ID NO: 2200966 - RNA, 20 nt, Streptococcus pneumoniae R6
agcaacuaaaaaggaaccag

SEQ ID NO: 2200967 - RNA, 13 nt, Streptococcus pneumoniae R6
agcaacuaaaauc

SEQ ID NO: 2200968 - RNA, 14 nt, Streptococcus pneumoniae R6
agcaacuaaaauca

SEQ ID NO: 2200969 - RNA, 17 nt, Streptococcus pneumoniae R6
agcaacuauaagauacu

SEQ ID NO: 2200970 - RNA, 15 nt, Streptococcus pneumoniae R6
agcaacgucuucaau

SEQ ID NO: 2200971 - RNA, 15 nt, Streptococcus pneumoniae R6
agcaagcuccuaaau

SEQ ID NO: 2200972 - RNA, 21 nt, Streptococcus pneumoniae R6
agcaagaauucaauugcagga

SEQ ID NO: 2200973 - RNA, 14 nt, Streptococcus pneumoniae R6
agcaagacaaaaac

SEQ ID NO: 2200974 - RNA, 16 nt, Streptococcus pneumoniae R6
agcaagauaguaaaga

SEQ ID NO: 2200975 - RNA, 24 nt, Streptococcus pneumoniae R6
agcaagugguucuccaaagauaga

SEQ ID NO: 2200976 - RNA, 16 nt, Streptococcus pneumoniae R6
agcaaguuuugaacuu

SEQ ID NO: 2200977 - RNA, 22 nt, Streptococcus pneumoniae R6
acucaauuaagaaauuuucuuu

SEQ ID NO: 2200978 - RNA, 13 nt, Streptococcus pneumoniae R6
acucaaugaaaau

SEQ ID NO: 2200979 - RNA, 17 nt, Streptococcus pneumoniae R6
acucaaugaaaaucaaa

SEQ ID NO: 2200980 - RNA, 22 nt, Streptococcus pneumoniae R6
acucaaugaaaaucaaagagca

SEQ ID NO: 2200981 - RNA, 23 nt, Streptococcus pneumoniae R6
acucaaugaaaaucaaagagcaa

SEQ ID NO: 2200982 - RNA, 21 nt, Streptococcus pneumoniae R6
acucaaugaaaaucaaagugc

SEQ ID NO: 2200983 - RNA, 12 nt, Streptococcus pneumoniae R6
acucaauuguau

SEQ ID NO: 2200984 - RNA, 22 nt, Streptococcus pneumoniae R6
acucaauugugcauaagaaacu

SEQ ID NO: 2200985 - RNA, 18 nt, Streptococcus pneumoniae R6
acucaagacauagucaag

SEQ ID NO: 2200986 - RNA, 17 nt, Streptococcus pneumoniae R6
acucaacaagcuguagu

SEQ ID NO: 2200987 - RNA, 21 nt, Streptococcus pneumoniae R6
acuaugauuagguuuccuuua

SEQ ID NO: 2200988 - RNA, 23 nt, Streptococcus pneumoniae R6
acuaugauuagguuuccuuuaac

SEQ ID NO: 2200989 - RNA, 16 nt, Streptococcus pneumoniae R6
acuaugcguuuuauug

SEQ ID NO: 2200990 - RNA, 22 nt, Streptococcus pneumoniae R6
acuaugcguuuugcuuuauccu

SEQ ID NO: 2200991 - RNA, 16 nt, Streptococcus pneumoniae R6
acuaugcuuuuuauug

SEQ ID NO: 2200992 - RNA, 19 nt, Streptococcus pneumoniae R6
acuauggagaaucguauuc

SEQ ID NO: 2200993 - RNA, 17 nt, Streptococcus pneumoniae R6
acuaugguauguugcgu

SEQ ID NO: 2200994 - RNA, 18 nt, Streptococcus pneumoniae R6
acuauguucugugauaaa

SEQ ID NO: 2200995 - RNA, 19 nt, Streptococcus pneumoniae R6
acuauggcuccgaugaccu

SEQ ID NO: 2200996 - RNA, 22 nt, Streptococcus pneumoniae R6
acuaugggagcuaacucaaguu

SEQ ID NO: 2200997 - RNA, 20 nt, Streptococcus pneumoniae R6
acucaaaagcuuguuuaaaa

SEQ ID NO: 2200998 - RNA, 22 nt, Streptococcus pneumoniae R6
acuacuaagauagagguuauuc

SEQ ID NO: 2200999 - RNA, 13 nt, Streptococcus pneumoniae R6
acuacuaaaacau

SEQ ID NO: 2201000 - RNA, 16 nt, Streptococcus pneumoniae R6
acuacuaaaacauuuc

SEQ ID NO: 2201001 - RNA, 14 nt, Streptococcus pneumoniae R6
acuacuaaaccaau

SEQ ID NO: 2201002 - RNA, 19 nt, Streptococcus pneumoniae R6
acuacgcgaccuauuucau

SEQ ID NO: 2201003 - RNA, 17 nt, Streptococcus pneumoniae R6
acuagcuggugagaaga

SEQ ID NO: 2201004 - RNA, 21 nt, Streptococcus pneumoniae R6
acuagcuuauuauucuaguga

SEQ ID NO: 2201005 - RNA, 16 nt, Streptococcus pneumoniae R6
acuacuuuugucagua

SEQ ID NO: 2201006 - RNA, 18 nt, Streptococcus pneumoniae R6
acuacuuuugucaguaaa

SEQ ID NO: 2201007 - RNA, 14 nt, Streptococcus pneumoniae R6
acuagggaaacacc

SEQ ID NO: 2201008 - RNA, 19 nt, Streptococcus pneumoniae R6
acuagggaaagaagguauu

SEQ ID NO: 2201009 - RNA, 21 nt, Streptococcus pneumoniae R6
acuaguauucaucuuaucaac

SEQ ID NO: 2201010 - RNA, 13 nt, Streptococcus pneumoniae R6
acuaggauuuucu

SEQ ID NO: 2201011 - RNA, 17 nt, Streptococcus pneumoniae R6
acuaguaaauugucuaa

SEQ ID NO: 2201012 - RNA, 17 nt, Streptococcus pneumoniae R6
acuaguaauaauuucaa

SEQ ID NO: 2201013 - RNA, 22 nt, Streptococcus pneumoniae R6
acuagugaagcgccuagccaaa

SEQ ID NO: 2201014 - RNA, 14 nt, Streptococcus pneumoniae R6
acuaguucugcaga

SEQ ID NO: 2201015 - RNA, 18 nt, Streptococcus pneumoniae R6
acuaucccuuuaccauuc

SEQ ID NO: 2201016 - RNA, 15 nt, Streptococcus pneumoniae R6
acuaucgaaaaauau

SEQ ID NO: 2201017 - RNA, 21 nt, Streptococcus pneumoniae R6
acuauccagagcauucuuuug

SEQ ID NO: 2201018 - RNA, 13 nt, Streptococcus pneumoniae R6
acuaucuaaaaaa

SEQ ID NO: 2201019 - RNA, 14 nt, Streptococcus pneumoniae R6
acuaucuaaaaaaa

SEQ ID NO: 2201020 - RNA, 13 nt, Streptococcus pneumoniae R6
acucacuuacaua

SEQ ID NO: 2201021 - RNA, 20 nt, Streptococcus pneumoniae R6
acucacuucccugagacuua

SEQ ID NO: 2201022 - RNA, 19 nt, Streptococcus pneumoniae R6
acucagcuucguaaucaua

SEQ ID NO: 2201023 - RNA, 16 nt, Streptococcus pneumoniae R6
acucaggaaagaugau

SEQ ID NO: 2201024 - RNA, 16 nt, Streptococcus pneumoniae R6
acucagcauuuucuuu

SEQ ID NO: 2201025 - RNA, 17 nt, Streptococcus pneumoniae R6
acucagcauuuucuuuu

SEQ ID NO: 2201026 - RNA, 19 nt, Streptococcus pneumoniae R6
acucaguuucugacuaucu

SEQ ID NO: 2201027 - RNA, 14 nt, Streptococcus pneumoniae R6
acucaguauuacau

SEQ ID NO: 2201028 - RNA, 20 nt, Streptococcus pneumoniae R6
acucaguauuacauccacca

SEQ ID NO: 2201029 - RNA, 15 nt, Streptococcus pneumoniae R6
acucaguauuuggau

SEQ ID NO: 2201030 - RNA, 15 nt, Streptococcus pneumoniae R6
acucaguuaaaauca

SEQ ID NO: 2201031 - RNA, 19 nt, Streptococcus pneumoniae R6
acuccaaacgcgauacaau

SEQ ID NO: 2201032 - RNA, 21 nt, Streptococcus pneumoniae R6
acuccaagcaagcgaagggcu

SEQ ID NO: 2201033 - RNA, 21 nt, Streptococcus pneumoniae R6
acuccaccauaguguuucucu

SEQ ID NO: 2201034 - RNA, 20 nt, Streptococcus pneumoniae R6
acucaucuguuuucaaaaag

SEQ ID NO: 2201035 - RNA, 21 nt, Streptococcus pneumoniae R6
acucaucuguuuucaaaaagc

SEQ ID NO: 2201036 - RNA, 21 nt, Streptococcus pneumoniae R6
acucaucugcuuucaaaaagc

SEQ ID NO: 2201037 - RNA, 20 nt, Streptococcus pneumoniae R6
acucauuuaaaaucaaaaag

SEQ ID NO: 2201038 - RNA, 18 nt, Streptococcus pneumoniae R6
acucauugauuuggacua

SEQ ID NO: 2201039 - RNA, 20 nt, Streptococcus pneumoniae R6
acucaugugucuugcauuuu

SEQ ID NO: 2201040 - RNA, 23 nt, Streptococcus pneumoniae R6
acucaugugucuugcauuuuaau

SEQ ID NO: 2201041 - RNA, 15 nt, Streptococcus pneumoniae R6
acucgaucugaaugu

SEQ ID NO: 2201042 - RNA, 15 nt, Streptococcus pneumoniae R6
acuccuugaaucauc

SEQ ID NO: 2201043 - RNA, 16 nt, Streptococcus pneumoniae R6
acuccuugaaucauca

SEQ ID NO: 2201044 - RNA, 15 nt, Streptococcus pneumoniae R6
acucccuguuccaaa

SEQ ID NO: 2201045 - RNA, 16 nt, Streptococcus pneumoniae R6
acuccaugccaagaaa

SEQ ID NO: 2201046 - RNA, 18 nt, Streptococcus pneumoniae R6
acugccucucuucuguuc

SEQ ID NO: 2201047 - RNA, 17 nt, Streptococcus pneumoniae R6
acugcccugaaauccca

SEQ ID NO: 2201048 - RNA, 17 nt, Streptococcus pneumoniae R6
acugcuaccaauucagu

SEQ ID NO: 2201049 - RNA, 14 nt, Streptococcus pneumoniae R6
acugcuagcaucau

SEQ ID NO: 2201050 - RNA, 21 nt, Streptococcus pneumoniae R6
acugcuguuguuacuuggcga

SEQ ID NO: 2201051 - RNA, 14 nt, Streptococcus pneumoniae R6
acugauucuacuuu

SEQ ID NO: 2201052 - RNA, 16 nt, Streptococcus pneumoniae R6
acugauucuacuuuuu

SEQ ID NO: 2201053 - RNA, 23 nt, Streptococcus pneumoniae R6
acugauucuacuuuuucaaaguu

SEQ ID NO: 2201054 - RNA, 18 nt, Streptococcus pneumoniae R6
acugcaaguccagaaccg

SEQ ID NO: 2201055 - RNA, 22 nt, Streptococcus pneumoniae R6
acugccauuaauuccugagaac

SEQ ID NO: 2201056 - RNA, 16 nt, Streptococcus pneumoniae R6
acugccccccaaaaaa

SEQ ID NO: 2201057 - RNA, 20 nt, Streptococcus pneumoniae R6
acugccccccaaaaguuaga

SEQ ID NO: 2201058 - RNA, 22 nt, Streptococcus pneumoniae R6
acugccccccaaaaguuagaca

SEQ ID NO: 2201059 - RNA, 13 nt, Streptococcus pneumoniae R6
acugaugagagau

SEQ ID NO: 2201060 - RNA, 20 nt, Streptococcus pneumoniae R6
acugacuucgucaguucuau

SEQ ID NO: 2201061 - RNA, 16 nt, Streptococcus pneumoniae R6
acugaauccgcacugu

SEQ ID NO: 2201062 - RNA, 15 nt, Streptococcus pneumoniae R6
acugacgaagucagc

SEQ ID NO: 2201063 - RNA, 15 nt, Streptococcus pneumoniae R6
acugacgaagucagu

SEQ ID NO: 2201064 - RNA, 22 nt, Streptococcus pneumoniae R6
acucuauuuuugagcagaacaa

SEQ ID NO: 2201065 - RNA, 16 nt, Streptococcus pneumoniae R6
acugaacaaauuaauu

SEQ ID NO: 2201066 - RNA, 15 nt, Streptococcus pneumoniae R6
acugaacaaugaaaa

SEQ ID NO: 2201067 - RNA, 17 nt, Streptococcus pneumoniae R6
acugaacaaugaaaaaa

SEQ ID NO: 2201068 - RNA, 17 nt, Streptococcus pneumoniae R6
acugaaucguuggcaaa

SEQ ID NO: 2201069 - RNA, 22 nt, Streptococcus pneumoniae R6
acugaaucguuggcaaagcucu

SEQ ID NO: 2201070 - RNA, 15 nt, Streptococcus pneumoniae R6
acugaaucuaaaaua

SEQ ID NO: 2201071 - RNA, 14 nt, Streptococcus pneumoniae R6
acucuaguuuuuau

SEQ ID NO: 2201072 - RNA, 17 nt, Streptococcus pneumoniae R6
acuguaaaguagcaaaa

SEQ ID NO: 2201073 - RNA, 21 nt, Streptococcus pneumoniae R6
acuguaaaguagcaaaacacu

SEQ ID NO: 2201074 - RNA, 22 nt, Streptococcus pneumoniae R6
acugguucucucuuuuugauuu

SEQ ID NO: 2201075 - RNA, 23 nt, Streptococcus pneumoniae R6
acugguuccauuuaacaaaccac

SEQ ID NO: 2201076 - RNA, 13 nt, Streptococcus pneumoniae R6
acugguccagaga

SEQ ID NO: 2201077 - RNA, 18 nt, Streptococcus pneumoniae R6
acuggucuugccagccug

SEQ ID NO: 2201078 - RNA, 21 nt, Streptococcus pneumoniae R6
acuggucuugccagccugccu

SEQ ID NO: 2201079 - RNA, 15 nt, Streptococcus pneumoniae R6
acuggguugaagauu

SEQ ID NO: 2201080 - RNA, 18 nt, Streptococcus pneumoniae R6
acuggguguuugccaucu

SEQ ID NO: 2201081 - RNA, 17 nt, Streptococcus pneumoniae R6
acuggucacauugaaaa

SEQ ID NO: 2201082 - RNA, 15 nt, Streptococcus pneumoniae R6
acugcuugagcugcu

SEQ ID NO: 2201083 - RNA, 13 nt, Streptococcus pneumoniae R6
acuggcugccauu

SEQ ID NO: 2201084 - RNA, 14 nt, Streptococcus pneumoniae R6
acuggcugccauug

SEQ ID NO: 2201085 - RNA, 19 nt, Streptococcus pneumoniae R6
acuggcugccauugguguu

SEQ ID NO: 2201086 - RNA, 19 nt, Streptococcus pneumoniae R6
acuuaaugaauaccauaga

SEQ ID NO: 2201087 - RNA, 20 nt, Streptococcus pneumoniae R6
acuuaggguuagauuauugc

SEQ ID NO: 2201088 - RNA, 16 nt, Streptococcus pneumoniae R6
acuuaggcuauccaga

SEQ ID NO: 2201089 - RNA, 16 nt, Streptococcus pneumoniae R6
acuguuuuccuuucaa

SEQ ID NO: 2201090 - RNA, 21 nt, Streptococcus pneumoniae R6
acuguuuugagauuacugaua

SEQ ID NO: 2201091 - RNA, 16 nt, Streptococcus pneumoniae R6
acuguuuugagguugu

SEQ ID NO: 2201092 - RNA, 13 nt, Streptococcus pneumoniae R6
acuguuuuucuug

SEQ ID NO: 2201093 - RNA, 20 nt, Streptococcus pneumoniae R6
acuguuauagauucaauaua

SEQ ID NO: 2201094 - RNA, 15 nt, Streptococcus pneumoniae R6
acuguuucagagaca

SEQ ID NO: 2201095 - RNA, 13 nt, Streptococcus pneumoniae R6
acuguuuuaaggu

SEQ ID NO: 2201096 - RNA, 14 nt, Streptococcus pneumoniae R6
acuguuuuagcguu

SEQ ID NO: 2201097 - RNA, 22 nt, Streptococcus pneumoniae R6
acuguuugggggcaguacagaa

SEQ ID NO: 2201098 - RNA, 17 nt, Streptococcus pneumoniae R6
acuguggaaaauagaaa

SEQ ID NO: 2201099 - RNA, 16 nt, Streptococcus pneumoniae R6
acuguccacaaagaua

SEQ ID NO: 2201100 - RNA, 17 nt, Streptococcus pneumoniae R6
acuguccuuaucgauuu

SEQ ID NO: 2201101 - RNA, 22 nt, Streptococcus pneumoniae R6
acugugccagccauaagcuaca

SEQ ID NO: 2201102 - RNA, 20 nt, Streptococcus pneumoniae R6
acuguaguggguugaaaaaa

SEQ ID NO: 2201103 - RNA, 20 nt, Streptococcus pneumoniae R6
acuguaguggguugaagaaa

SEQ ID NO: 2201104 - RNA, 14 nt, Streptococcus pneumoniae R6
acuguaugagaaac

SEQ ID NO: 2201105 - RNA, 18 nt, Streptococcus pneumoniae R6
acuguauucuaggaaaac

SEQ ID NO: 2201106 - RNA, 20 nt, Streptococcus pneumoniae R6
acuguauucuaggaaaacga

SEQ ID NO: 2201107 - RNA, 21 nt, Streptococcus pneumoniae R6
acuguacuucccggagcuuuc

SEQ ID NO: 2201108 - RNA, 17 nt, Streptococcus pneumoniae R6
acgccucccaauuaaaa

SEQ ID NO: 2201109 - RNA, 19 nt, Streptococcus pneumoniae R6
acgccucccaauuaaaaua

SEQ ID NO: 2201110 - RNA, 13 nt, Streptococcus pneumoniae R6
acgccuuaaaaaa

SEQ ID NO: 2201111 - RNA, 17 nt, Streptococcus pneumoniae R6
acgccuuaaaaaaccaa

SEQ ID NO: 2201112 - RNA, 17 nt, Streptococcus pneumoniae R6
acgcuggaaauaagaau

SEQ ID NO: 2201113 - RNA, 21 nt, Streptococcus pneumoniae R6
acgcgauacaauaaagguguu

SEQ ID NO: 2201114 - RNA, 17 nt, Streptococcus pneumoniae R6
acgcgcccaaguuaaaa

SEQ ID NO: 2201115 - RNA, 14 nt, Streptococcus pneumoniae R6
acgucguaaccaga

SEQ ID NO: 2201116 - RNA, 20 nt, Streptococcus pneumoniae R6
acgucguaaucuuaaaguua

SEQ ID NO: 2201117 - RNA, 17 nt, Streptococcus pneumoniae R6
acgugauaaaguuucug

SEQ ID NO: 2201118 - RNA, 17 nt, Streptococcus pneumoniae R6
acgugauaauaaggccu

SEQ ID NO: 2201119 - RNA, 14 nt, Streptococcus pneumoniae R6
acguccuguugcuu

SEQ ID NO: 2201120 - RNA, 14 nt, Streptococcus pneumoniae R6
acguccuuggaaga

SEQ ID NO: 2201121 - RNA, 15 nt, Streptococcus pneumoniae R6
acgugguuugaagag

SEQ ID NO: 2201122 - RNA, 20 nt, Streptococcus pneumoniae R6
acgugguuugaagagauuuu

SEQ ID NO: 2201123 - RNA, 15 nt, Streptococcus pneumoniae R6
acgugucaaagcauu

SEQ ID NO: 2201124 - RNA, 14 nt, Streptococcus pneumoniae R6
acguccaccacaaa

SEQ ID NO: 2201125 - RNA, 15 nt, Streptococcus pneumoniae R6
acguccaccacaaaa

SEQ ID NO: 2201126 - RNA, 23 nt, Streptococcus pneumoniae R6
acguccaccacaaaagagaaaga

SEQ ID NO: 2201127 - RNA, 19 nt, Streptococcus pneumoniae R6
acgucagcuuccaucugca

SEQ ID NO: 2201128 - RNA, 20 nt, Streptococcus pneumoniae R6
acguccgucaagaagagcuu

SEQ ID NO: 2201129 - RNA, 12 nt, Streptococcus pneumoniae R6
acguccuagcuc

SEQ ID NO: 2201130 - RNA, 16 nt, Streptococcus pneumoniae R6
acguccuagcucucgg

SEQ ID NO: 2201131 - RNA, 23 nt, Streptococcus pneumoniae R6
acgguugagcauguagucaauca

SEQ ID NO: 2201132 - RNA, 13 nt, Streptococcus pneumoniae R6
acgucaagaacuu

SEQ ID NO: 2201133 - RNA, 23 nt, Streptococcus pneumoniae R6
acgucaagaacuuuaguuugagu

SEQ ID NO: 2201134 - RNA, 16 nt, Streptococcus pneumoniae R6
acgucacaaagaacau

SEQ ID NO: 2201135 - RNA, 17 nt, Streptococcus pneumoniae R6
acggcaccuucuacagc

SEQ ID NO: 2201136 - RNA, 17 nt, Streptococcus pneumoniae R6
acggcauugaggacaau

SEQ ID NO: 2201137 - RNA, 18 nt, Streptococcus pneumoniae R6
acgguaucuguuucuguu

SEQ ID NO: 2201138 - RNA, 18 nt, Streptococcus pneumoniae R6
acgggguccuuaccuguu

SEQ ID NO: 2201139 - RNA, 15 nt, Streptococcus pneumoniae R6
acggucaccgacaac

SEQ ID NO: 2201140 - RNA, 13 nt, Streptococcus pneumoniae R6
acggucaaaguca

SEQ ID NO: 2201141 - RNA, 15 nt, Streptococcus pneumoniae R6
acggugaacuucuuc

SEQ ID NO: 2201142 - RNA, 15 nt, Streptococcus pneumoniae R6
acgggcaaauuucau

SEQ ID NO: 2201143 - RNA, 19 nt, Streptococcus pneumoniae R6
accugcacauugguucuuu

SEQ ID NO: 2201144 - RNA, 14 nt, Streptococcus pneumoniae R6
accugcaacaauac

SEQ ID NO: 2201145 - RNA, 16 nt, Streptococcus pneumoniae R6
accugcaacaauaccu

SEQ ID NO: 2201146 - RNA, 16 nt, Streptococcus pneumoniae R6
accugcggauaaaaga

SEQ ID NO: 2201147 - RNA, 18 nt, Streptococcus pneumoniae R6
accugcggauaaaagaga

SEQ ID NO: 2201148 - RNA, 19 nt, Streptococcus pneumoniae R6
accugccuuccaagauaau

SEQ ID NO: 2201149 - RNA, 19 nt, Streptococcus pneumoniae R6
accugcggcuagcuuccua

SEQ ID NO: 2201150 - RNA, 19 nt, Streptococcus pneumoniae R6
accugcuaccguugaaauc

SEQ ID NO: 2201151 - RNA, 17 nt, Streptococcus pneumoniae R6
accuguaccuaauuuuu

SEQ ID NO: 2201152 - RNA, 18 nt, Streptococcus pneumoniae R6
accuuguggaauuggugc

SEQ ID NO: 2201153 - RNA, 14 nt, Streptococcus pneumoniae R6
accuugguggcuac

SEQ ID NO: 2201154 - RNA, 16 nt, Streptococcus pneumoniae R6
accuuucucagauaau

SEQ ID NO: 2201155 - RNA, 11 nt, Streptococcus pneumoniae R6
accuugaagag

SEQ ID NO: 2201156 - RNA, 19 nt, Streptococcus pneumoniae R6
accuugaccagccaagaca

SEQ ID NO: 2201157 - RNA, 17 nt, Streptococcus pneumoniae R6
accuuggcauccaguaa

SEQ ID NO: 2201158 - RNA, 23 nt, Streptococcus pneumoniae R6
acgagcaguuccacgauauuguu

SEQ ID NO: 2201159 - RNA, 15 nt, Streptococcus pneumoniae R6
acgauaucugaagau

SEQ ID NO: 2201160 - RNA, 23 nt, Streptococcus pneumoniae R6
acgaguuaaaacaaagaaaaaga

SEQ ID NO: 2201161 - RNA, 14 nt, Streptococcus pneumoniae R6
acgagugaagaauu

SEQ ID NO: 2201162 - RNA, 15 nt, Streptococcus pneumoniae R6
acgagugaagaauug

SEQ ID NO: 2201163 - RNA, 20 nt, Streptococcus pneumoniae R6
acgaccagcaguaucaauca

SEQ ID NO: 2201164 - RNA, 18 nt, Streptococcus pneumoniae R6
acgacgucauggccucua

SEQ ID NO: 2201165 - RNA, 19 nt, Streptococcus pneumoniae R6
acgacuaggaauauugaaa

SEQ ID NO: 2201166 - RNA, 19 nt, Streptococcus pneumoniae R6
accuuuuccuucauuucca

SEQ ID NO: 2201167 - RNA, 17 nt, Streptococcus pneumoniae R6
acgaaaagucaucuaua

SEQ ID NO: 2201168 - RNA, 23 nt, Streptococcus pneumoniae R6
acgaaaauaauuaguucagaauu

SEQ ID NO: 2201169 - RNA, 15 nt, Streptococcus pneumoniae R6
acgaaacaauugcua

SEQ ID NO: 2201170 - RNA, 12 nt, Streptococcus pneumoniae R6
acgaaaccaguc

SEQ ID NO: 2201171 - RNA, 19 nt, Streptococcus pneumoniae R6
acgaaacgaagaaggaaga

SEQ ID NO: 2201172 - RNA, 23 nt, Streptococcus pneumoniae R6
acgaaacgaagaaggaagaguca

SEQ ID NO: 2201173 - RNA, 23 nt, Streptococcus pneumoniae R6
acgaauauccucuucacugugac

SEQ ID NO: 2201174 - RNA, 15 nt, Streptococcus pneumoniae R6
acgacagaagaagug

SEQ ID NO: 2201175 - RNA, 18 nt, Streptococcus pneumoniae R6
acgacaugcguuaaaagu

SEQ ID NO: 2201176 - RNA, 15 nt, Streptococcus pneumoniae R6
acgaccagaaaauca

SEQ ID NO: 2201177 - RNA, 20 nt, Streptococcus pneumoniae R6
acgaccaaucuuuuccaacu

SEQ ID NO: 2201178 - RNA, 14 nt, Streptococcus pneumoniae R6
acgaauuuuuuggc

SEQ ID NO: 2201179 - RNA, 14 nt, Streptococcus pneumoniae R6
acgaauuauuuccu

SEQ ID NO: 2201180 - RNA, 18 nt, Streptococcus pneumoniae R6
acgaauuagguugaccau

SEQ ID NO: 2201181 - RNA, 15 nt, Streptococcus pneumoniae R6
accguugaaaucaau

SEQ ID NO: 2201182 - RNA, 15 nt, Streptococcus pneumoniae R6
accguccucauauuc

SEQ ID NO: 2201183 - RNA, 21 nt, Streptococcus pneumoniae R6
accucaaaacaauguuuugau

SEQ ID NO: 2201184 - RNA, 13 nt, Streptococcus pneumoniae R6
accucaaaacagu

SEQ ID NO: 2201185 - RNA, 21 nt, Streptococcus pneumoniae R6
accucaaagcaguacuuugag

SEQ ID NO: 2201186 - RNA, 22 nt, Streptococcus pneumoniae R6
accucaaaacgguguuuugagc

SEQ ID NO: 2201187 - RNA, 21 nt, Streptococcus pneumoniae R6
accuauuauacaaaguuaagu

SEQ ID NO: 2201188 - RNA, 21 nt, Streptococcus pneumoniae R6
accuacuguuagaacagucag

SEQ ID NO: 2201189 - RNA, 15 nt, Streptococcus pneumoniae R6
accuaccagaggaua

SEQ ID NO: 2201190 - RNA, 14 nt, Streptococcus pneumoniae R6
accguuugaaaaag

SEQ ID NO: 2201191 - RNA, 16 nt, Streptococcus pneumoniae R6
accuaaaguagagaua

SEQ ID NO: 2201192 - RNA, 17 nt, Streptococcus pneumoniae R6
accuaaaaguacuuuca

SEQ ID NO: 2201193 - RNA, 15 nt, Streptococcus pneumoniae R6
accuaauuuuuuggc

SEQ ID NO: 2201194 - RNA, 16 nt, Streptococcus pneumoniae R6
accuaaccaaauaaua

SEQ ID NO: 2201195 - RNA, 22 nt, Streptococcus pneumoniae R6
accguauguaugguuacugacu

SEQ ID NO: 2201196 - RNA, 19 nt, Streptococcus pneumoniae R6
accguaugauucguuugaa

SEQ ID NO: 2201197 - RNA, 21 nt, Streptococcus pneumoniae R6
accgcuucagcgauuucuuca

SEQ ID NO: 2201198 - RNA, 15 nt, Streptococcus pneumoniae R6
accgcaaaagcuucu

SEQ ID NO: 2201199 - RNA, 19 nt, Streptococcus pneumoniae R6
accauccugaauagugaag

SEQ ID NO: 2201200 - RNA, 13 nt, Streptococcus pneumoniae R6
accauagguuuug

SEQ ID NO: 2201201 - RNA, 12 nt, Streptococcus pneumoniae R6
accauaguucca

SEQ ID NO: 2201202 - RNA, 15 nt, Streptococcus pneumoniae R6
accauaguuccaguc

SEQ ID NO: 2201203 - RNA, 21 nt, Streptococcus pneumoniae R6
accauaaacuaagcuuauaua

SEQ ID NO: 2201204 - RNA, 18 nt, Streptococcus pneumoniae R6
accagucuccuagucuac

SEQ ID NO: 2201205 - RNA, 17 nt, Streptococcus pneumoniae R6
accaguccuugaaaaac

SEQ ID NO: 2201206 - RNA, 17 nt, Streptococcus pneumoniae R6
accagucgcagaguggu

SEQ ID NO: 2201207 - RNA, 23 nt, Streptococcus pneumoniae R6
accaguacuuucaacuccuuacu

SEQ ID NO: 2201208 - RNA, 13 nt, Streptococcus pneumoniae R6
accaguuaccauu

SEQ ID NO: 2201209 - RNA, 14 nt, Streptococcus pneumoniae R6
accaguuucuucuu

SEQ ID NO: 2201210 - RNA, 21 nt, Streptococcus pneumoniae R6
accaguugccauagcuccuga

SEQ ID NO: 2201211 - RNA, 19 nt, Streptococcus pneumoniae R6
accagcuaccagaccaagu

SEQ ID NO: 2201212 - RNA, 14 nt, Streptococcus pneumoniae R6
accagcuauuaaga

SEQ ID NO: 2201213 - RNA, 15 nt, Streptococcus pneumoniae R6
accaggaaaccagcu

SEQ ID NO: 2201214 - RNA, 18 nt, Streptococcus pneumoniae R6
accaggcauuauuucacu

SEQ ID NO: 2201215 - RNA, 17 nt, Streptococcus pneumoniae R6
accagguuuuucaccag

SEQ ID NO: 2201216 - RNA, 17 nt, Streptococcus pneumoniae R6
accagguucuucaauca

SEQ ID NO: 2201217 - RNA, 15 nt, Streptococcus pneumoniae R6
accagccuguuuuca

SEQ ID NO: 2201218 - RNA, 19 nt, Streptococcus pneumoniae R6
accagcgauagcuccaucu

SEQ ID NO: 2201219 - RNA, 22 nt, Streptococcus pneumoniae R6
accagcgauagcuccaucucca

SEQ ID NO: 2201220 - RNA, 17 nt, Streptococcus pneumoniae R6
accagcauggcaccgcc

SEQ ID NO: 2201221 - RNA, 17 nt, Streptococcus pneumoniae R6
accagcaguaucaauca

SEQ ID NO: 2201222 - RNA, 15 nt, Streptococcus pneumoniae R6
accaacuuuuccuug

SEQ ID NO: 2201223 - RNA, 12 nt, Streptococcus pneumoniae R6
accaacuuuaag

SEQ ID NO: 2201224 - RNA, 19 nt, Streptococcus pneumoniae R6
accaacuuuaagagcuucu

SEQ ID NO: 2201225 - RNA, 18 nt, Streptococcus pneumoniae R6
accaagaucuugucugca

SEQ ID NO: 2201226 - RNA, 15 nt, Streptococcus pneumoniae R6
accaagagacgauuc

SEQ ID NO: 2201227 - RNA, 20 nt, Streptococcus pneumoniae R6
accaagagacgauuccaaac

SEQ ID NO: 2201228 - RNA, 18 nt, Streptococcus pneumoniae R6
accaagagcaaaaacaau

SEQ ID NO: 2201229 - RNA, 11 nt, Streptococcus pneumoniae R6
accaagaaguc

SEQ ID NO: 2201230 - RNA, 14 nt, Streptococcus pneumoniae R6
accaagaaguccau

SEQ ID NO: 2201231 - RNA, 15 nt, Streptococcus pneumoniae R6
accaagaaccuuggu

SEQ ID NO: 2201232 - RNA, 20 nt, Streptococcus pneumoniae R6
accagagcgaauaccaccaa

SEQ ID NO: 2201233 - RNA, 23 nt, Streptococcus pneumoniae R6
acccaugucgcaucgucaucacg

SEQ ID NO: 2201234 - RNA, 20 nt, Streptococcus pneumoniae R6
acccauuuauggaaaaaaug

SEQ ID NO: 2201235 - RNA, 14 nt, Streptococcus pneumoniae R6
accccaagaaacaa

SEQ ID NO: 2201236 - RNA, 19 nt, Streptococcus pneumoniae R6
accaucuuuaggaucauga

SEQ ID NO: 2201237 - RNA, 21 nt, Streptococcus pneumoniae R6
accaucuguaccgaccuuguc

SEQ ID NO: 2201238 - RNA, 11 nt, Streptococcus pneumoniae R6
accaucucaca

SEQ ID NO: 2201239 - RNA, 21 nt, Streptococcus pneumoniae R6
accaucuaacucauagcagau

SEQ ID NO: 2201240 - RNA, 18 nt, Streptococcus pneumoniae R6
accaucuaagguauauuc

SEQ ID NO: 2201241 - RNA, 15 nt, Streptococcus pneumoniae R6
acccacggauuaaga

SEQ ID NO: 2201242 - RNA, 13 nt, Streptococcus pneumoniae R6
acccauagauuuu

SEQ ID NO: 2201243 - RNA, 15 nt, Streptococcus pneumoniae R6
acccauaauaucaua

SEQ ID NO: 2201244 - RNA, 13 nt, Streptococcus pneumoniae R6
acccuaggcaagc

SEQ ID NO: 2201245 - RNA, 20 nt, Streptococcus pneumoniae R6
acccuugauuuuuuccuauu

SEQ ID NO: 2201246 - RNA, 16 nt, Streptococcus pneumoniae R6
acccuugcuuuuucuu

SEQ ID NO: 2201247 - RNA, 21 nt, Streptococcus pneumoniae R6
acccuucuuuuuauaggcucu

SEQ ID NO: 2201248 - RNA, 20 nt, Streptococcus pneumoniae R6
acccuguccgugauuguuuu

SEQ ID NO: 2201249 - RNA, 22 nt, Streptococcus pneumoniae R6
accgacagcaaggucaauaaca

SEQ ID NO: 2201250 - RNA, 23 nt, Streptococcus pneumoniae R6
accgauaagaauuggcacaaaag

SEQ ID NO: 2201251 - RNA, 17 nt, Streptococcus pneumoniae R6
accgauggacuuuauca

SEQ ID NO: 2201252 - RNA, 14 nt, Streptococcus pneumoniae R6
accgacuucugagc

SEQ ID NO: 2201253 - RNA, 12 nt, Streptococcus pneumoniae R6
accgaauuuuuc

SEQ ID NO: 2201254 - RNA, 16 nt, Streptococcus pneumoniae R6
accgaauguggauacu

SEQ ID NO: 2201255 - RNA, 18 nt, Streptococcus pneumoniae R6
accgaaaaucuccucuac

SEQ ID NO: 2201256 - RNA, 14 nt, Streptococcus pneumoniae R6
agcucucugauuuu

SEQ ID NO: 2201257 - RNA, 23 nt, Streptococcus pneumoniae R6
agcucuuaaaagcaaaagaacaa

SEQ ID NO: 2201258 - RNA, 12 nt, Streptococcus pneumoniae R6
agcucugugcaa

SEQ ID NO: 2201259 - RNA, 21 nt, Streptococcus pneumoniae R6
agcucugugcaauacagaacu

SEQ ID NO: 2201260 - RNA, 23 nt, Streptococcus pneumoniae R6
agcucguucuauggcuuguucaa

SEQ ID NO: 2201261 - RNA, 23 nt, Streptococcus pneumoniae R6
agcucuuuuguuaauaacucgau

SEQ ID NO: 2201262 - RNA, 17 nt, Streptococcus pneumoniae R6
agcucuuuuuugauauc

SEQ ID NO: 2201263 - RNA, 22 nt, Streptococcus pneumoniae R6
agcucuuuuuugauaucuuccu

SEQ ID NO: 2201264 - RNA, 18 nt, Streptococcus pneumoniae R6
agcucuuugacagaaagg

SEQ ID NO: 2201265 - RNA, 20 nt, Streptococcus pneumoniae R6
agcucuuuagucccagcuuc

SEQ ID NO: 2201266 - RNA, 22 nt, Streptococcus pneumoniae R6
agcucuuuagucccagcuucuu

SEQ ID NO: 2201267 - RNA, 14 nt, Streptococcus pneumoniae R6
agcucuucuaaaaa

SEQ ID NO: 2201268 - RNA, 19 nt, Streptococcus pneumoniae R6
agcugacgggcaaauuuca

SEQ ID NO: 2201269 - RNA, 13 nt, Streptococcus pneumoniae R6
agcugaauaggua

SEQ ID NO: 2201270 - RNA, 18 nt, Streptococcus pneumoniae R6
agcugacuucgucaguuc

SEQ ID NO: 2201271 - RNA, 21 nt, Streptococcus pneumoniae R6
agcugacuucgucaguuccau

SEQ ID NO: 2201272 - RNA, 21 nt, Streptococcus pneumoniae R6
agcugacuucgucaguucuau

SEQ ID NO: 2201273 - RNA, 18 nt, Streptococcus pneumoniae R6
agcugacuucgucaguuu

SEQ ID NO: 2201274 - RNA, 18 nt, Streptococcus pneumoniae R6
agcucgcucuuacuauua

SEQ ID NO: 2201275 - RNA, 14 nt, Streptococcus pneumoniae R6
agcuccuucaaguu

SEQ ID NO: 2201276 - RNA, 15 nt, Streptococcus pneumoniae R6
agcucgagaaaggac

SEQ ID NO: 2201277 - RNA, 22 nt, Streptococcus pneumoniae R6
agcucgagaaaggacaaauuuc

SEQ ID NO: 2201278 - RNA, 15 nt, Streptococcus pneumoniae R6
agcucgauaaaggac

SEQ ID NO: 2201279 - RNA, 19 nt, Streptococcus pneumoniae R6
agcucgauaaaggacaaaa

SEQ ID NO: 2201280 - RNA, 23 nt, Streptococcus pneumoniae R6
agcgucuaacaauuaggaacuuu

SEQ ID NO: 2201281 - RNA, 23 nt, Streptococcus pneumoniae R6
agcucccgcuucauuuagaacac

SEQ ID NO: 2201282 - RNA, 19 nt, Streptococcus pneumoniae R6
agcuguuccaccaccugca

SEQ ID NO: 2201283 - RNA, 18 nt, Streptococcus pneumoniae R6
agcuggcuccuucuuuuu

SEQ ID NO: 2201284 - RNA, 15 nt, Streptococcus pneumoniae R6
agcugcagcugagga

SEQ ID NO: 2201285 - RNA, 21 nt, Streptococcus pneumoniae R6
agcugcggcuuucuucacauc

SEQ ID NO: 2201286 - RNA, 23 nt, Streptococcus pneumoniae R6
agcugcggcuuucuucacaucac

SEQ ID NO: 2201287 - RNA, 16 nt, Streptococcus pneumoniae R6
agcuuuaaugcuauga

SEQ ID NO: 2201288 - RNA, 15 nt, Streptococcus pneumoniae R6
agcuuuaccauccug

SEQ ID NO: 2201289 - RNA, 14 nt, Streptococcus pneumoniae R6
agcuuguuguuaaa

SEQ ID NO: 2201290 - RNA, 17 nt, Streptococcus pneumoniae R6
agcuuguuguuaaacaa

SEQ ID NO: 2201291 - RNA, 19 nt, Streptococcus pneumoniae R6
agcuuguuguuaaacaagg

SEQ ID NO: 2201292 - RNA, 17 nt, Streptococcus pneumoniae R6
agcuuguuguugugaua

SEQ ID NO: 2201293 - RNA, 18 nt, Streptococcus pneumoniae R6
agcuuguuuaaaaucucu

SEQ ID NO: 2201294 - RNA, 14 nt, Streptococcus pneumoniae R6
agcuuuuucuuguu

SEQ ID NO: 2201295 - RNA, 15 nt, Streptococcus pneumoniae R6
agcuuuuucuuguug

SEQ ID NO: 2201296 - RNA, 17 nt, Streptococcus pneumoniae R6
agcuuuugugauaaagg

SEQ ID NO: 2201297 - RNA, 12 nt, Streptococcus pneumoniae R6
agcuuuuuucuu

SEQ ID NO: 2201298 - RNA, 14 nt, Streptococcus pneumoniae R6
agcuuuuuucuuug

SEQ ID NO: 2201299 - RNA, 19 nt, Streptococcus pneumoniae R6
agcuuuaucugcaaccuca

SEQ ID NO: 2201300 - RNA, 15 nt, Streptococcus pneumoniae R6
agcuuucagagcugc

SEQ ID NO: 2201301 - RNA, 16 nt, Streptococcus pneumoniae R6
agcuuucagagcugca

SEQ ID NO: 2201302 - RNA, 18 nt, Streptococcus pneumoniae R6
agcuuuauuaagcccuac

SEQ ID NO: 2201303 - RNA, 16 nt, Streptococcus pneumoniae R6
agcuuuugcagcacca

SEQ ID NO: 2201304 - RNA, 23 nt, Streptococcus pneumoniae R6
agcuuucuagccuguaugauggg

SEQ ID NO: 2201305 - RNA, 18 nt, Streptococcus pneumoniae R6
agcuuucuaguuugcucu

SEQ ID NO: 2201306 - RNA, 15 nt, Streptococcus pneumoniae R6
agcuucuuuuggauu

SEQ ID NO: 2201307 - RNA, 22 nt, Streptococcus pneumoniae R6
agcuucuuuuuauauauaaaau

SEQ ID NO: 2201308 - RNA, 22 nt, Streptococcus pneumoniae R6
agcuugaaacaaauaaaucauu

SEQ ID NO: 2201309 - RNA, 22 nt, Streptococcus pneumoniae R6
agcuucuugcauucguucuugg

SEQ ID NO: 2201310 - RNA, 20 nt, Streptococcus pneumoniae R6
agcuugcgauaaagcuaaag

SEQ ID NO: 2201311 - RNA, 22 nt, Streptococcus pneumoniae R6
agcuugcucaaaguacagauuu

SEQ ID NO: 2201312 - RNA, 17 nt, Streptococcus pneumoniae R6
agcuugcuccauucuuu

SEQ ID NO: 2201313 - RNA, 23 nt, Streptococcus pneumoniae R6
agcuuauuauucuagugaaaaau

SEQ ID NO: 2201314 - RNA, 18 nt, Streptococcus pneumoniae R6
agcuucaaaccguguucu

SEQ ID NO: 2201315 - RNA, 23 nt, Streptococcus pneumoniae R6
aggaaucaacauauccaaguuuu

SEQ ID NO: 2201316 - RNA, 19 nt, Streptococcus pneumoniae R6
aggaaagaagguguuuuua

SEQ ID NO: 2201317 - RNA, 18 nt, Streptococcus pneumoniae R6
aggaaguuuagauuaaaa

SEQ ID NO: 2201318 - RNA, 23 nt, Streptococcus pneumoniae R6
aggaaacucuuacaaaaaaucaa

SEQ ID NO: 2201319 - RNA, 20 nt, Streptococcus pneumoniae R6
aggaaaaaaugaagcaaaca

SEQ ID NO: 2201320 - RNA, 22 nt, Streptococcus pneumoniae R6
aggaaaacaugaaguaaauauu

SEQ ID NO: 2201321 - RNA, 11 nt, Streptococcus pneumoniae R6
aggaaaaugau

SEQ ID NO: 2201322 - RNA, 22 nt, Streptococcus pneumoniae R6
aggaaaauugauuuauagaaau

SEQ ID NO: 2201323 - RNA, 20 nt, Streptococcus pneumoniae R6
aggaaaauacugauaaaaac

SEQ ID NO: 2201324 - RNA, 16 nt, Streptococcus pneumoniae R6
aggaaaccaaucucaa

SEQ ID NO: 2201325 - RNA, 22 nt, Streptococcus pneumoniae R6
aggaaacgcucgguuucaacug

SEQ ID NO: 2201326 - RNA, 20 nt, Streptococcus pneumoniae R6
aggacgaaucguucaggaca

SEQ ID NO: 2201327 - RNA, 23 nt, Streptococcus pneumoniae R6
aggaccugaguucauuacucaag

SEQ ID NO: 2201328 - RNA, 22 nt, Streptococcus pneumoniae R6
aggaauuaauggcagugcuuuu

SEQ ID NO: 2201329 - RNA, 20 nt, Streptococcus pneumoniae R6
aggauaugaggagaaagaag

SEQ ID NO: 2201330 - RNA, 21 nt, Streptococcus pneumoniae R6
aggagguaaaucccaaguaaa

SEQ ID NO: 2201331 - RNA, 20 nt, Streptococcus pneumoniae R6
aggaguaggaguaguaaaac

SEQ ID NO: 2201332 - RNA, 17 nt, Streptococcus pneumoniae R6
aggacuaaauacaaaaa

SEQ ID NO: 2201333 - RNA, 16 nt, Streptococcus pneumoniae R6
aggaggcuagccgcac

SEQ ID NO: 2201334 - RNA, 18 nt, Streptococcus pneumoniae R6
aggaggcaaagaaaaaag

SEQ ID NO: 2201335 - RNA, 20 nt, Streptococcus pneumoniae R6
aggaggcaaagaaaaaagcu

SEQ ID NO: 2201336 - RNA, 17 nt, Streptococcus pneumoniae R6
aggauaauagugauugg

SEQ ID NO: 2201337 - RNA, 22 nt, Streptococcus pneumoniae R6
aggauagcuccuccaaguccaa

SEQ ID NO: 2201338 - RNA, 20 nt, Streptococcus pneumoniae R6
aggaguuucaccuugccauc

SEQ ID NO: 2201339 - RNA, 16 nt, Streptococcus pneumoniae R6
aggauaaagcaaaacg

SEQ ID NO: 2201340 - RNA, 19 nt, Streptococcus pneumoniae R6
aggcauaauacuguggaau

SEQ ID NO: 2201341 - RNA, 17 nt, Streptococcus pneumoniae R6
aggcauaaaucaaaucg

SEQ ID NO: 2201342 - RNA, 14 nt, Streptococcus pneumoniae R6
aggcaauuaaaagg

SEQ ID NO: 2201343 - RNA, 22 nt, Streptococcus pneumoniae R6
aggcaaagcugacgugguuuga

SEQ ID NO: 2201344 - RNA, 18 nt, Streptococcus pneumoniae R6
aggcaaagagucccuuag

SEQ ID NO: 2201345 - RNA, 14 nt, Streptococcus pneumoniae R6
aggcaaagaaaaaa

SEQ ID NO: 2201346 - RNA, 21 nt, Streptococcus pneumoniae R6
aggaugccuuuuauaauagaa

SEQ ID NO: 2201347 - RNA, 22 nt, Streptococcus pneumoniae R6
aggaugccuuuuauaauagaaa

SEQ ID NO: 2201348 - RNA, 11 nt, Streptococcus pneumoniae R6
aggauguaggg

SEQ ID NO: 2201349 - RNA, 14 nt, Streptococcus pneumoniae R6
aggcugauuccugg

SEQ ID NO: 2201350 - RNA, 15 nt, Streptococcus pneumoniae R6
aggcuguaguuuuac

SEQ ID NO: 2201351 - RNA, 21 nt, Streptococcus pneumoniae R6
aggcuguaaugccaaagaaau

SEQ ID NO: 2201352 - RNA, 16 nt, Streptococcus pneumoniae R6
aggcugcucaaaacac

SEQ ID NO: 2201353 - RNA, 16 nt, Streptococcus pneumoniae R6
aggcugacaauaaaga

SEQ ID NO: 2201354 - RNA, 17 nt, Streptococcus pneumoniae R6
aggcugacaauaaagau

SEQ ID NO: 2201355 - RNA, 21 nt, Streptococcus pneumoniae R6
aggcuaauugcaaauuuagca

SEQ ID NO: 2201356 - RNA, 22 nt, Streptococcus pneumoniae R6
aggcuaauugcaaauuuagcaa

SEQ ID NO: 2201357 - RNA, 17 nt, Streptococcus pneumoniae R6
aggcuaagagagaagcc

SEQ ID NO: 2201358 - RNA, 17 nt, Streptococcus pneumoniae R6
aggcuaaugagucuauu

SEQ ID NO: 2201359 - RNA, 14 nt, Streptococcus pneumoniae R6
aggcguuucguuug

SEQ ID NO: 2201360 - RNA, 14 nt, Streptococcus pneumoniae R6
aggggacagauguu

SEQ ID NO: 2201361 - RNA, 20 nt, Streptococcus pneumoniae R6
agggcuuuucuaucacucca

SEQ ID NO: 2201362 - RNA, 16 nt, Streptococcus pneumoniae R6
aggggagcaacuucag

SEQ ID NO: 2201363 - RNA, 22 nt, Streptococcus pneumoniae R6
aggggugauuuuauauaaaaua

SEQ ID NO: 2201364 - RNA, 23 nt, Streptococcus pneumoniae R6
aggggugauuuuauauaaaauaa

SEQ ID NO: 2201365 - RNA, 20 nt, Streptococcus pneumoniae R6
aggggucaugacuagugaag

SEQ ID NO: 2201366 - RNA, 15 nt, Streptococcus pneumoniae R6
agggggcaaaaaggg

SEQ ID NO: 2201367 - RNA, 20 nt, Streptococcus pneumoniae R6
agggggcauauaaauacaac

SEQ ID NO: 2201368 - RNA, 19 nt, Streptococcus pneumoniae R6
agggucaaaguagugaaug

SEQ ID NO: 2201369 - RNA, 17 nt, Streptococcus pneumoniae R6
agggucuuuguucugaa

SEQ ID NO: 2201370 - RNA, 20 nt, Streptococcus pneumoniae R6
agggucuuuguucugaaagu

SEQ ID NO: 2201371 - RNA, 23 nt, Streptococcus pneumoniae R6
agggucuuuguucugaaagugaa

SEQ ID NO: 2201372 - RNA, 20 nt, Streptococcus pneumoniae R6
agguaaaaucuuaaaaaggg

SEQ ID NO: 2201373 - RNA, 19 nt, Streptococcus pneumoniae R6
aggguggguuuuuugauuu

SEQ ID NO: 2201374 - RNA, 18 nt, Streptococcus pneumoniae R6
aggguuagauuauugcag

SEQ ID NO: 2201375 - RNA, 14 nt, Streptococcus pneumoniae R6
aggguguuuucaau

SEQ ID NO: 2201376 - RNA, 21 nt, Streptococcus pneumoniae R6
agggcauuaaucauucccugg

SEQ ID NO: 2201377 - RNA, 12 nt, Streptococcus pneumoniae R6
agggauuaauaa

SEQ ID NO: 2201378 - RNA, 11 nt, Streptococcus pneumoniae R6
agguucauuag

SEQ ID NO: 2201379 - RNA, 14 nt, Streptococcus pneumoniae R6
agguucaaucccca

SEQ ID NO: 2201380 - RNA, 16 nt, Streptococcus pneumoniae R6
agguuccgagauaaaa

SEQ ID NO: 2201381 - RNA, 15 nt, Streptococcus pneumoniae R6
agguuuuaaacaaag

SEQ ID NO: 2201382 - RNA, 13 nt, Streptococcus pneumoniae R6
agguuuucaagcc

SEQ ID NO: 2201383 - RNA, 11 nt, Streptococcus pneumoniae R6
aguaaaaaaag

SEQ ID NO: 2201384 - RNA, 14 nt, Streptococcus pneumoniae R6
aguaaaaaaagaag

SEQ ID NO: 2201385 - RNA, 15 nt, Streptococcus pneumoniae R6
aguaaaaaaagaagc

SEQ ID NO: 2201386 - RNA, 14 nt, Streptococcus pneumoniae R6
agguuuuugaaaaa

SEQ ID NO: 2201387 - RNA, 23 nt, Streptococcus pneumoniae R6
agguuuuugaacaccugauagga

SEQ ID NO: 2201388 - RNA, 20 nt, Streptococcus pneumoniae R6
agguuuuugcaccuuacauu

SEQ ID NO: 2201389 - RNA, 19 nt, Streptococcus pneumoniae R6
aguaagaugaguuugcuuu

SEQ ID NO: 2201390 - RNA, 13 nt, Streptococcus pneumoniae R6
aguaacuaugaau

SEQ ID NO: 2201391 - RNA, 20 nt, Streptococcus pneumoniae R6
aguaacucuuguucaaagug

SEQ ID NO: 2201392 - RNA, 16 nt, Streptococcus pneumoniae R6
aguaacggcuuccugu

SEQ ID NO: 2201393 - RNA, 17 nt, Streptococcus pneumoniae R6
aguaacuaacgccaaau

SEQ ID NO: 2201394 - RNA, 20 nt, Streptococcus pneumoniae R6
aguaaaugugagcuuugguu

SEQ ID NO: 2201395 - RNA, 12 nt, Streptococcus pneumoniae R6
aguaaugccagg

SEQ ID NO: 2201396 - RNA, 13 nt, Streptococcus pneumoniae R6
aguaaugacuugu

SEQ ID NO: 2201397 - RNA, 23 nt, Streptococcus pneumoniae R6
aguaaugggcgcauuuuccuugg

SEQ ID NO: 2201398 - RNA, 16 nt, Streptococcus pneumoniae R6
aguaaggacuuugcuu

SEQ ID NO: 2201399 - RNA, 15 nt, Streptococcus pneumoniae R6
aguacaagguuugua

SEQ ID NO: 2201400 - RNA, 13 nt, Streptococcus pneumoniae R6
aguacaauaccuu

SEQ ID NO: 2201401 - RNA, 20 nt, Streptococcus pneumoniae R6
aguacauucaacaccugaua

SEQ ID NO: 2201402 - RNA, 19 nt, Streptococcus pneumoniae R6
aguacgaaacaauugcuaa

SEQ ID NO: 2201403 - RNA, 21 nt, Streptococcus pneumoniae R6
aguacgaacaaguugugcagu

SEQ ID NO: 2201404 - RNA, 17 nt, Streptococcus pneumoniae R6
agguuagucaaaaagaa

SEQ ID NO: 2201405 - RNA, 19 nt, Streptococcus pneumoniae R6
agguuauucaaaaacauaa

SEQ ID NO: 2201406 - RNA, 18 nt, Streptococcus pneumoniae R6
agguuaacgucaaaugac

SEQ ID NO: 2201407 - RNA, 14 nt, Streptococcus pneumoniae R6
agguuaaaggaaac

SEQ ID NO: 2201408 - RNA, 14 nt, Streptococcus pneumoniae R6
agguguuucugguc

SEQ ID NO: 2201409 - RNA, 15 nt, Streptococcus pneumoniae R6
agguuaaaaucuuuu

SEQ ID NO: 2201410 - RNA, 18 nt, Streptococcus pneumoniae R6
agguuaaaaucuuuuacu

SEQ ID NO: 2201411 - RNA, 17 nt, Streptococcus pneumoniae R6
agguguucuaucacauu

SEQ ID NO: 2201412 - RNA, 18 nt, Streptococcus pneumoniae R6
aggugagggcugagaagg

SEQ ID NO: 2201413 - RNA, 18 nt, Streptococcus pneumoniae R6
aggugaguaggaaggaag

SEQ ID NO: 2201414 - RNA, 20 nt, Streptococcus pneumoniae R6
aggugauaucugguugccaa

SEQ ID NO: 2201415 - RNA, 17 nt, Streptococcus pneumoniae R6
aggugagcaucaggaaa

SEQ ID NO: 2201416 - RNA, 22 nt, Streptococcus pneumoniae R6
aggugcgagacaaaaaaaacac

SEQ ID NO: 2201417 - RNA, 20 nt, Streptococcus pneumoniae R6
aggugcgagccucuuuuuug

SEQ ID NO: 2201418 - RNA, 16 nt, Streptococcus pneumoniae R6
aggugccaguacaaua

SEQ ID NO: 2201419 - RNA, 14 nt, Streptococcus pneumoniae R6
agguguacuauucu

SEQ ID NO: 2201420 - RNA, 16 nt, Streptococcus pneumoniae R6
aggugguuugaaaaug

SEQ ID NO: 2201421 - RNA, 17 nt, Streptococcus pneumoniae R6
agguggguggguauaaa

SEQ ID NO: 2201422 - RNA, 16 nt, Streptococcus pneumoniae R6
agguggggcaaaaaca

SEQ ID NO: 2201423 - RNA, 21 nt, Streptococcus pneumoniae R6
aggucaaccaacuuuuccuug

SEQ ID NO: 2201424 - RNA, 13 nt, Streptococcus pneumoniae R6
aggucaaaaugau

SEQ ID NO: 2201425 - RNA, 22 nt, Streptococcus pneumoniae R6
aggucaaacuuuuucucucuga

SEQ ID NO: 2201426 - RNA, 20 nt, Streptococcus pneumoniae R6
agguauuucuuguuuucuaa

SEQ ID NO: 2201427 - RNA, 15 nt, Streptococcus pneumoniae R6
agguauucauaaaau

SEQ ID NO: 2201428 - RNA, 20 nt, Streptococcus pneumoniae R6
agguaaauucugucacaacu

SEQ ID NO: 2201429 - RNA, 17 nt, Streptococcus pneumoniae R6
aggucaauggcaaaaaa

SEQ ID NO: 2201430 - RNA, 21 nt, Streptococcus pneumoniae R6
aggucgaagccauccuuggua

SEQ ID NO: 2201431 - RNA, 16 nt, Streptococcus pneumoniae R6
aggucagugacuugug

SEQ ID NO: 2201432 - RNA, 19 nt, Streptococcus pneumoniae R6
aggucaguugcaagaagca

SEQ ID NO: 2201433 - RNA, 19 nt, Streptococcus pneumoniae R6
agucagcucgacacuagau

SEQ ID NO: 2201434 - RNA, 17 nt, Streptococcus pneumoniae R6
agucagcuaagcucgau

SEQ ID NO: 2201435 - RNA, 20 nt, Streptococcus pneumoniae R6
agucagacuuggaacagucc

SEQ ID NO: 2201436 - RNA, 22 nt, Streptococcus pneumoniae R6
agucacaaaggucauuuuccac

SEQ ID NO: 2201437 - RNA, 19 nt, Streptococcus pneumoniae R6
agucaauuucucuacaaau

SEQ ID NO: 2201438 - RNA, 23 nt, Streptococcus pneumoniae R6
agucaauuucucuacaaauaaga

SEQ ID NO: 2201439 - RNA, 14 nt, Streptococcus pneumoniae R6
aguagagagucaca

SEQ ID NO: 2201440 - RNA, 19 nt, Streptococcus pneumoniae R6
aguagacugaaucugaaau

SEQ ID NO: 2201441 - RNA, 19 nt, Streptococcus pneumoniae R6
aguagacuugaccgcagau

SEQ ID NO: 2201442 - RNA, 21 nt, Streptococcus pneumoniae R6
agucaagacaaggauaaaaag

SEQ ID NO: 2201443 - RNA, 22 nt, Streptococcus pneumoniae R6
agucaagacaaggauaaaaagu

SEQ ID NO: 2201444 - RNA, 14 nt, Streptococcus pneumoniae R6
agucaagaguuggg

SEQ ID NO: 2201445 - RNA, 21 nt, Streptococcus pneumoniae R6
agucaagaguugggcagaagu

SEQ ID NO: 2201446 - RNA, 18 nt, Streptococcus pneumoniae R6
aguagagauaaguggcaa

SEQ ID NO: 2201447 - RNA, 15 nt, Streptococcus pneumoniae R6
agucaacagaguuuc

SEQ ID NO: 2201448 - RNA, 19 nt, Streptococcus pneumoniae R6
aguacuuugagcaaccugc

SEQ ID NO: 2201449 - RNA, 23 nt, Streptococcus pneumoniae R6
aguacuuugagcaaccugcgacu

SEQ ID NO: 2201450 - RNA, 16 nt, Streptococcus pneumoniae R6
aguacuuuuaauauac

SEQ ID NO: 2201451 - RNA, 15 nt, Streptococcus pneumoniae R6
aguagaaaaugaaau

SEQ ID NO: 2201452 - RNA, 15 nt, Streptococcus pneumoniae R6
aguacugaacaauga

SEQ ID NO: 2201453 - RNA, 13 nt, Streptococcus pneumoniae R6
aguacuucuuugu

SEQ ID NO: 2201454 - RNA, 13 nt, Streptococcus pneumoniae R6
aguacuugagaau

SEQ ID NO: 2201455 - RNA, 15 nt, Streptococcus pneumoniae R6
aguacuugcuggaau

SEQ ID NO: 2201456 - RNA, 13 nt, Streptococcus pneumoniae R6
aguccauaggcug

SEQ ID NO: 2201457 - RNA, 13 nt, Streptococcus pneumoniae R6
aguccacugcaau

SEQ ID NO: 2201458 - RNA, 19 nt, Streptococcus pneumoniae R6
aguccaaacguccagccuu

SEQ ID NO: 2201459 - RNA, 19 nt, Streptococcus pneumoniae R6
aguccaacuguaaagacau

SEQ ID NO: 2201460 - RNA, 16 nt, Streptococcus pneumoniae R6
aguccaagauucaaca

SEQ ID NO: 2201461 - RNA, 22 nt, Streptococcus pneumoniae R6
aguccaagcccaguugacugug

SEQ ID NO: 2201462 - RNA, 15 nt, Streptococcus pneumoniae R6
agucauucaauccau

SEQ ID NO: 2201463 - RNA, 17 nt, Streptococcus pneumoniae R6
agucauuccauggcuga

SEQ ID NO: 2201464 - RNA, 17 nt, Streptococcus pneumoniae R6
agucaucuauaaucaau

SEQ ID NO: 2201465 - RNA, 20 nt, Streptococcus pneumoniae R6
agucaugaccccuaaauaua

SEQ ID NO: 2201466 - RNA, 19 nt, Streptococcus pneumoniae R6
agucaugcaaaaaaaauga

SEQ ID NO: 2201467 - RNA, 22 nt, Streptococcus pneumoniae R6
agucaugcaaaaaaaaugaaaa

SEQ ID NO: 2201468 - RNA, 23 nt, Streptococcus pneumoniae R6
agucaucagaaaaaaggcaucca

SEQ ID NO: 2201469 - RNA, 18 nt, Streptococcus pneumoniae R6
agucauccaugauaaugg

SEQ ID NO: 2201470 - RNA, 15 nt, Streptococcus pneumoniae R6
agucagggucaaagu

SEQ ID NO: 2201471 - RNA, 21 nt, Streptococcus pneumoniae R6
agucaguaaccauacauacga

SEQ ID NO: 2201472 - RNA, 16 nt, Streptococcus pneumoniae R6
agucagcucuuuuuug

SEQ ID NO: 2201473 - RNA, 24 nt, Streptococcus pneumoniae R6
agucagcucuuuuuugauaucuuc

SEQ ID NO: 2201474 - RNA, 15 nt, Streptococcus pneumoniae R6
agucagcugucuuuu

SEQ ID NO: 2201475 - RNA, 19 nt, Streptococcus pneumoniae R6
agucagcugucuuuucaaa

SEQ ID NO: 2201476 - RNA, 14 nt, Streptococcus pneumoniae R6
agucauaacauucu

SEQ ID NO: 2201477 - RNA, 17 nt, Streptococcus pneumoniae R6
agucauaaacaucuguc

SEQ ID NO: 2201478 - RNA, 18 nt, Streptococcus pneumoniae R6
agucauaaacaucugucg

SEQ ID NO: 2201479 - RNA, 21 nt, Streptococcus pneumoniae R6
agucagugguucacuggcauu

SEQ ID NO: 2201480 - RNA, 19 nt, Streptococcus pneumoniae R6
agucuugacaaagaaaaaa

SEQ ID NO: 2201481 - RNA, 15 nt, Streptococcus pneumoniae R6
agucuucuuuucuuu

SEQ ID NO: 2201482 - RNA, 22 nt, Streptococcus pneumoniae R6
agucuugauggacaacaaugag

SEQ ID NO: 2201483 - RNA, 23 nt, Streptococcus pneumoniae R6
agucuugauggacaacaaugaga

SEQ ID NO: 2201484 - RNA, 21 nt, Streptococcus pneumoniae R6
agucuucauguggcuaucugu

SEQ ID NO: 2201485 - RNA, 18 nt, Streptococcus pneumoniae R6
agucuucggaauagcuca

SEQ ID NO: 2201486 - RNA, 21 nt, Streptococcus pneumoniae R6
agucuucuguacauuagaauu

SEQ ID NO: 2201487 - RNA, 16 nt, Streptococcus pneumoniae R6
agucuugcgaagugau

SEQ ID NO: 2201488 - RNA, 16 nt, Streptococcus pneumoniae R6
agugaaaggaagagag

SEQ ID NO: 2201489 - RNA, 15 nt, Streptococcus pneumoniae R6
agucuugcucuucau

SEQ ID NO: 2201490 - RNA, 20 nt, Streptococcus pneumoniae R6
agucugggaaaaauuuucaa

SEQ ID NO: 2201491 - RNA, 19 nt, Streptococcus pneumoniae R6
agucucagugggcuauucc

SEQ ID NO: 2201492 - RNA, 22 nt, Streptococcus pneumoniae R6
agucucagcagucguuccuuuu

SEQ ID NO: 2201493 - RNA, 22 nt, Streptococcus pneumoniae R6
agucucauagucguguugacuu

SEQ ID NO: 2201494 - RNA, 15 nt, Streptococcus pneumoniae R6
agucuuaaaaucaca

SEQ ID NO: 2201495 - RNA, 21 nt, Streptococcus pneumoniae R6
agucuguuauuucuugagaac

SEQ ID NO: 2201496 - RNA, 15 nt, Streptococcus pneumoniae R6
agucuuauaguaacg

SEQ ID NO: 2201497 - RNA, 22 nt, Streptococcus pneumoniae R6
agucuuaucugcaaccucaaaa

SEQ ID NO: 2201498 - RNA, 13 nt, Streptococcus pneumoniae R6
agucuucacaauc

SEQ ID NO: 2201499 - RNA, 18 nt, Streptococcus pneumoniae R6
agugaacuauuuuauccc

SEQ ID NO: 2201500 - RNA, 13 nt, Streptococcus pneumoniae R6
agugaauugaaau

SEQ ID NO: 2201501 - RNA, 21 nt, Streptococcus pneumoniae R6
agugacagucgcaaagaggaa

SEQ ID NO: 2201502 - RNA, 22 nt, Streptococcus pneumoniae R6
agugacagucgcaaagaggaag

SEQ ID NO: 2201503 - RNA, 16 nt, Streptococcus pneumoniae R6
agugaacaagccuagu

SEQ ID NO: 2201504 - RNA, 21 nt, Streptococcus pneumoniae R6
agugacuuuuucgaagcuugc

SEQ ID NO: 2201505 - RNA, 14 nt, Streptococcus pneumoniae R6
agucguuaaaagca

SEQ ID NO: 2201506 - RNA, 16 nt, Streptococcus pneumoniae R6
agucguuaaaagcaaa

SEQ ID NO: 2201507 - RNA, 16 nt, Streptococcus pneumoniae R6
agucguucucuuauug

SEQ ID NO: 2201508 - RNA, 14 nt, Streptococcus pneumoniae R6
agucuacaaauuca

SEQ ID NO: 2201509 - RNA, 20 nt, Streptococcus pneumoniae R6
agucuagcauaaaagccucc

SEQ ID NO: 2201510 - RNA, 16 nt, Streptococcus pneumoniae R6
agucuauuauauauau

SEQ ID NO: 2201511 - RNA, 21 nt, Streptococcus pneumoniae R6
agucguaaauaauauuauucu

SEQ ID NO: 2201512 - RNA, 19 nt, Streptococcus pneumoniae R6
agucgcaggcgaaaucauu

SEQ ID NO: 2201513 - RNA, 21 nt, Streptococcus pneumoniae R6
aguccuuacucaaauaaaaga

SEQ ID NO: 2201514 - RNA, 23 nt, Streptococcus pneumoniae R6
aguccuggaaaaacguggacugg

SEQ ID NO: 2201515 - RNA, 21 nt, Streptococcus pneumoniae R6
aguccuuuugauuacauaaau

SEQ ID NO: 2201516 - RNA, 20 nt, Streptococcus pneumoniae R6
aguccuuuuaguuuuaccuu

SEQ ID NO: 2201517 - RNA, 19 nt, Streptococcus pneumoniae R6
agucccugguaaaagagca

SEQ ID NO: 2201518 - RNA, 20 nt, Streptococcus pneumoniae R6
agucccugguaaaagagcaa

SEQ ID NO: 2201519 - RNA, 17 nt, Streptococcus pneumoniae R6
agucccuuuuaagaguu

SEQ ID NO: 2201520 - RNA, 16 nt, Streptococcus pneumoniae R6
aguccgaaaaauuucu

SEQ ID NO: 2201521 - RNA, 15 nt, Streptococcus pneumoniae R6
agucccauaaaacua

SEQ ID NO: 2201522 - RNA, 20 nt, Streptococcus pneumoniae R6
agucccauaaaacuauaauc

SEQ ID NO: 2201523 - RNA, 13 nt, Streptococcus pneumoniae R6
agucccauuuuca

SEQ ID NO: 2201524 - RNA, 14 nt, Streptococcus pneumoniae R6
agucccauuuucag

SEQ ID NO: 2201525 - RNA, 22 nt, Streptococcus pneumoniae R6
agucccauuuucagaaagaagg

SEQ ID NO: 2201526 - RNA, 23 nt, Streptococcus pneumoniae R6
agugagauuuuuugauuggcuuu

SEQ ID NO: 2201527 - RNA, 20 nt, Streptococcus pneumoniae R6
agugagcaccaucuauaagu

SEQ ID NO: 2201528 - RNA, 10 nt, Streptococcus pneumoniae R6
agugagucca

SEQ ID NO: 2201529 - RNA, 22 nt, Streptococcus pneumoniae R6
agugauaacauaaccuuccuug

SEQ ID NO: 2201530 - RNA, 13 nt, Streptococcus pneumoniae R6
agugcucacagag

SEQ ID NO: 2201531 - RNA, 21 nt, Streptococcus pneumoniae R6
agugcucacagaguagaaguu

SEQ ID NO: 2201532 - RNA, 17 nt, Streptococcus pneumoniae R6
aguggaauucauuuucu

SEQ ID NO: 2201533 - RNA, 18 nt, Streptococcus pneumoniae R6
aguggaauucauuuucuu

SEQ ID NO: 2201534 - RNA, 20 nt, Streptococcus pneumoniae R6
aguggaacguagaucaucug

SEQ ID NO: 2201535 - RNA, 19 nt, Streptococcus pneumoniae R6
aguguaaaaagaaaguccu

SEQ ID NO: 2201536 - RNA, 19 nt, Streptococcus pneumoniae R6
aguggcuuuugauuugauu

SEQ ID NO: 2201537 - RNA, 18 nt, Streptococcus pneumoniae R6
agugggaacuagagaguu

SEQ ID NO: 2201538 - RNA, 14 nt, Streptococcus pneumoniae R6
agugugacacuagc

SEQ ID NO: 2201539 - RNA, 21 nt, Streptococcus pneumoniae R6
aguguucugucuuguaaaaaa

SEQ ID NO: 2201540 - RNA, 14 nt, Streptococcus pneumoniae R6
aguguugaaaaccc

SEQ ID NO: 2201541 - RNA, 18 nt, Streptococcus pneumoniae R6
aguguugaauguugaaac

SEQ ID NO: 2201542 - RNA, 16 nt, Streptococcus pneumoniae R6
aguguucuaaaauaag

SEQ ID NO: 2201543 - RNA, 19 nt, Streptococcus pneumoniae R6
aguguucuaaaauaaguuc

SEQ ID NO: 2201544 - RNA, 17 nt, Streptococcus pneumoniae R6
aguguuagauuaggaau

SEQ ID NO: 2201545 - RNA, 20 nt, Streptococcus pneumoniae R6
aguuaaaacaaagaaaaaga

SEQ ID NO: 2201546 - RNA, 22 nt, Streptococcus pneumoniae R6
aguuaaaacaaagaaaaagaag

SEQ ID NO: 2201547 - RNA, 13 nt, Streptococcus pneumoniae R6
aguuaaaaaagau

SEQ ID NO: 2201548 - RNA, 15 nt, Streptococcus pneumoniae R6
aguuaaaaaagauuu

SEQ ID NO: 2201549 - RNA, 21 nt, Streptococcus pneumoniae R6
aguguuuuaagcugacuucgu

SEQ ID NO: 2201550 - RNA, 23 nt, Streptococcus pneumoniae R6
aguguuuucacuuccuuaccauc

SEQ ID NO: 2201551 - RNA, 14 nt, Streptococcus pneumoniae R6
aguguuuugagcac

SEQ ID NO: 2201552 - RNA, 15 nt, Streptococcus pneumoniae R6
aguguuuugagcuga

SEQ ID NO: 2201553 - RNA, 14 nt, Streptococcus pneumoniae R6
aguuaaauuauaaa

SEQ ID NO: 2201554 - RNA, 16 nt, Streptococcus pneumoniae R6
aguuaaauuauaaauu

SEQ ID NO: 2201555 - RNA, 22 nt, Streptococcus pneumoniae R6
aguugaaugccuccaagaaaga

SEQ ID NO: 2201556 - RNA, 12 nt, Streptococcus pneumoniae R6
aguugacaaagu

SEQ ID NO: 2201557 - RNA, 21 nt, Streptococcus pneumoniae R6
aguugacgauaaauugcugga

SEQ ID NO: 2201558 - RNA, 17 nt, Streptococcus pneumoniae R6
aguugacuguguuugag

SEQ ID NO: 2201559 - RNA, 17 nt, Streptococcus pneumoniae R6
aguugcuguaaucacau

SEQ ID NO: 2201560 - RNA, 23 nt, Streptococcus pneumoniae R6
aguugcuugauuacaugauguga

SEQ ID NO: 2201561 - RNA, 17 nt, Streptococcus pneumoniae R6
aguuggagcaucugguu

SEQ ID NO: 2201562 - RNA, 12 nt, Streptococcus pneumoniae R6
aguugaaaucaa

SEQ ID NO: 2201563 - RNA, 13 nt, Streptococcus pneumoniae R6
aguugaaaucaag

SEQ ID NO: 2201564 - RNA, 12 nt, Streptococcus pneumoniae R6
aguugaaaugac

SEQ ID NO: 2201565 - RNA, 17 nt, Streptococcus pneumoniae R6
aguucuuuaacaaagaa

SEQ ID NO: 2201566 - RNA, 21 nt, Streptococcus pneumoniae R6
aguucuuuaagguuagcugca

SEQ ID NO: 2201567 - RNA, 17 nt, Streptococcus pneumoniae R6
aguucuugcucaaucaa

SEQ ID NO: 2201568 - RNA, 19 nt, Streptococcus pneumoniae R6
aguucgaagauaucucuuu

SEQ ID NO: 2201569 - RNA, 22 nt, Streptococcus pneumoniae R6
aguucgaaaucacgcuuuucuu

SEQ ID NO: 2201570 - RNA, 19 nt, Streptococcus pneumoniae R6
aguucgcauauaagcggcu

SEQ ID NO: 2201571 - RNA, 18 nt, Streptococcus pneumoniae R6
aguuauuuuaguaaaaaa

SEQ ID NO: 2201572 - RNA, 15 nt, Streptococcus pneumoniae R6
aguucacaaaugaga

SEQ ID NO: 2201573 - RNA, 20 nt, Streptococcus pneumoniae R6
aguucaaucagcuaaaaaua

SEQ ID NO: 2201574 - RNA, 14 nt, Streptococcus pneumoniae R6
aguuaaguuuuuug

SEQ ID NO: 2201575 - RNA, 15 nt, Streptococcus pneumoniae R6
aguuaguguauaagg

SEQ ID NO: 2201576 - RNA, 13 nt, Streptococcus pneumoniae R6
aguuccuccauug

SEQ ID NO: 2201577 - RNA, 12 nt, Streptococcus pneumoniae R6
aguuccuaauug

SEQ ID NO: 2201578 - RNA, 23 nt, Streptococcus pneumoniae R6
aguuccuguuucaggaaguuuuu

SEQ ID NO: 2201579 - RNA, 20 nt, Streptococcus pneumoniae R6
aguucccugcauuucuuuua

SEQ ID NO: 2201580 - RNA, 19 nt, Streptococcus pneumoniae R6
aguucaucuggaguagcau

SEQ ID NO: 2201581 - RNA, 18 nt, Streptococcus pneumoniae R6
aguucaucuucaaaauca

SEQ ID NO: 2201582 - RNA, 14 nt, Streptococcus pneumoniae R6
aguuccaucuacaa

SEQ ID NO: 2201583 - RNA, 19 nt, Streptococcus pneumoniae R6
auaagagaagagagcauua

SEQ ID NO: 2201584 - RNA, 13 nt, Streptococcus pneumoniae R6
auaagacuuuucc

SEQ ID NO: 2201585 - RNA, 21 nt, Streptococcus pneumoniae R6
auaagacuuuuccuguuguau

SEQ ID NO: 2201586 - RNA, 15 nt, Streptococcus pneumoniae R6
auaagauaaggcauc

SEQ ID NO: 2201587 - RNA, 20 nt, Streptococcus pneumoniae R6
auaagaggucugaaacuacu

SEQ ID NO: 2201588 - RNA, 20 nt, Streptococcus pneumoniae R6
auaagaaaaaacagccgagg

SEQ ID NO: 2201589 - RNA, 17 nt, Streptococcus pneumoniae R6
auaagaaaccgucauca

SEQ ID NO: 2201590 - RNA, 14 nt, Streptococcus pneumoniae R6
auaagacaauuggu

SEQ ID NO: 2201591 - RNA, 16 nt, Streptococcus pneumoniae R6
auaagacuccucuuua

SEQ ID NO: 2201592 - RNA, 19 nt, Streptococcus pneumoniae R6
auaagacugacgaagucag

SEQ ID NO: 2201593 - RNA, 22 nt, Streptococcus pneumoniae R6
auaacuuguuuacguuuuaaaa

SEQ ID NO: 2201594 - RNA, 13 nt, Streptococcus pneumoniae R6
auaacuuuaucca

SEQ ID NO: 2201595 - RNA, 13 nt, Streptococcus pneumoniae R6
auaacuccgaacu

SEQ ID NO: 2201596 - RNA, 18 nt, Streptococcus pneumoniae R6
auaacuugaaguaaagac

SEQ ID NO: 2201597 - RNA, 14 nt, Streptococcus pneumoniae R6
auaacucaaaagcu

SEQ ID NO: 2201598 - RNA, 21 nt, Streptococcus pneumoniae R6
auaaauuucgaaaaaugcucu

SEQ ID NO: 2201599 - RNA, 18 nt, Streptococcus pneumoniae R6
auaacgaagagcuggcug

SEQ ID NO: 2201600 - RNA, 19 nt, Streptococcus pneumoniae R6
auaaauugggcgaugaaga

SEQ ID NO: 2201601 - RNA, 16 nt, Streptococcus pneumoniae R6
auaaauugcuggagaa

SEQ ID NO: 2201602 - RNA, 17 nt, Streptococcus pneumoniae R6
auaagccggcuugucuu

SEQ ID NO: 2201603 - RNA, 19 nt, Streptococcus pneumoniae R6
auaagccggcuugucuuug

SEQ ID NO: 2201604 - RNA, 19 nt, Streptococcus pneumoniae R6
auaagcccgaaaaauuucu

SEQ ID NO: 2201605 - RNA, 13 nt, Streptococcus pneumoniae R6
auaagauuuuugg

SEQ ID NO: 2201606 - RNA, 19 nt, Streptococcus pneumoniae R6
auaagauuuuuggaaaaaa

SEQ ID NO: 2201607 - RNA, 20 nt, Streptococcus pneumoniae R6
auaagauuuuuggaaaaaau

SEQ ID NO: 2201608 - RNA, 22 nt, Streptococcus pneumoniae R6
auaagauuuuuggaaaaaauaa

SEQ ID NO: 2201609 - RNA, 17 nt, Streptococcus pneumoniae R6
auaagaugagaacaaau

SEQ ID NO: 2201610 - RNA, 22 nt, Streptococcus pneumoniae R6
auaagaugacaucuaaauaaua

SEQ ID NO: 2201611 - RNA, 16 nt, Streptococcus pneumoniae R6
auaaggaauuuuagaa

SEQ ID NO: 2201612 - RNA, 17 nt, Streptococcus pneumoniae R6
auaaggaauuuuagaag

SEQ ID NO: 2201613 - RNA, 16 nt, Streptococcus pneumoniae R6
auaaggacaggugcuu

SEQ ID NO: 2201614 - RNA, 19 nt, Streptococcus pneumoniae R6
auaagcuugugaaagcucu

SEQ ID NO: 2201615 - RNA, 20 nt, Streptococcus pneumoniae R6
auaagcuuguuaccugauaa

SEQ ID NO: 2201616 - RNA, 13 nt, Streptococcus pneumoniae R6
auaagcuuugaaa

SEQ ID NO: 2201617 - RNA, 19 nt, Streptococcus pneumoniae R6
auaaggccuauauagcgga

SEQ ID NO: 2201618 - RNA, 17 nt, Streptococcus pneumoniae R6
auaaggcaucuuaacau

SEQ ID NO: 2201619 - RNA, 15 nt, Streptococcus pneumoniae R6
auaaggcgaugcuga

SEQ ID NO: 2201620 - RNA, 20 nt, Streptococcus pneumoniae R6
auaagggcaaagaaaaggaa

SEQ ID NO: 2201621 - RNA, 17 nt, Streptococcus pneumoniae R6
auaagguaauugaagag

SEQ ID NO: 2201622 - RNA, 19 nt, Streptococcus pneumoniae R6
auaagguacagacgauuaa

SEQ ID NO: 2201623 - RNA, 19 nt, Streptococcus pneumoniae R6
auaagguuuagcaaaagca

SEQ ID NO: 2201624 - RNA, 13 nt, Streptococcus pneumoniae R6
auaagguuacuuu

SEQ ID NO: 2201625 - RNA, 21 nt, Streptococcus pneumoniae R6
auaagguuauccuuauuuugc

SEQ ID NO: 2201626 - RNA, 18 nt, Streptococcus pneumoniae R6
auaaucguuuaaaacacc

SEQ ID NO: 2201627 - RNA, 20 nt, Streptococcus pneumoniae R6
auaaucguuuaaaacaccuu

SEQ ID NO: 2201628 - RNA, 18 nt, Streptococcus pneumoniae R6
auaauccgcauacuuggu

SEQ ID NO: 2201629 - RNA, 16 nt, Streptococcus pneumoniae R6
auaaucgcuggcauuu

SEQ ID NO: 2201630 - RNA, 18 nt, Streptococcus pneumoniae R6
auaaucgcuggcauuucc

SEQ ID NO: 2201631 - RNA, 20 nt, Streptococcus pneumoniae R6
auaauguuaaccacaaaaag

SEQ ID NO: 2201632 - RNA, 19 nt, Streptococcus pneumoniae R6
auaauuaccaccaacaugu

SEQ ID NO: 2201633 - RNA, 16 nt, Streptococcus pneumoniae R6
auaauuauagaaauga

SEQ ID NO: 2201634 - RNA, 16 nt, Streptococcus pneumoniae R6
auaauuauauauaaaa

SEQ ID NO: 2201635 - RNA, 17 nt, Streptococcus pneumoniae R6
auaauuauauauaaaaa

SEQ ID NO: 2201636 - RNA, 17 nt, Streptococcus pneumoniae R6
auaaguaccaaucccau

SEQ ID NO: 2201637 - RNA, 18 nt, Streptococcus pneumoniae R6
auaagucauaacauucua

SEQ ID NO: 2201638 - RNA, 15 nt, Streptococcus pneumoniae R6
auaauagcacuuaaa

SEQ ID NO: 2201639 - RNA, 16 nt, Streptococcus pneumoniae R6
auaauagcuugcaauu

SEQ ID NO: 2201640 - RNA, 23 nt, Streptococcus pneumoniae R6
auaauagcuugcaauucuuuagc

SEQ ID NO: 2201641 - RNA, 18 nt, Streptococcus pneumoniae R6
auaauagaaaacagacaa

SEQ ID NO: 2201642 - RNA, 14 nt, Streptococcus pneumoniae R6
auaauagacuuccu

SEQ ID NO: 2201643 - RNA, 16 nt, Streptococcus pneumoniae R6
auaauauuuucuuuau

SEQ ID NO: 2201644 - RNA, 22 nt, Streptococcus pneumoniae R6
auaauauugucaaauuacgaug

SEQ ID NO: 2201645 - RNA, 13 nt, Streptococcus pneumoniae R6
auaaucaaacuag

SEQ ID NO: 2201646 - RNA, 14 nt, Streptococcus pneumoniae R6
auaaucaaacuagc

SEQ ID NO: 2201647 - RNA, 23 nt, Streptococcus pneumoniae R6
auaaucaaacuagcaagugcuaa

SEQ ID NO: 2201648 - RNA, 14 nt, Streptococcus pneumoniae R6
auaauauuauucua

SEQ ID NO: 2201649 - RNA, 16 nt, Streptococcus pneumoniae R6
auaauauguauuuaua

SEQ ID NO: 2201650 - RNA, 14 nt, Streptococcus pneumoniae R6
auaaucaauauaga

SEQ ID NO: 2201651 - RNA, 14 nt, Streptococcus pneumoniae R6
auaaucaauauagu

SEQ ID NO: 2201652 - RNA, 18 nt, Streptococcus pneumoniae R6
auaauccaacaccaauuu

SEQ ID NO: 2201653 - RNA, 14 nt, Streptococcus pneumoniae R6
auaaucaucuggau

SEQ ID NO: 2201654 - RNA, 22 nt, Streptococcus pneumoniae R6
auaaaagauagcuaugaauaug

SEQ ID NO: 2201655 - RNA, 23 nt, Streptococcus pneumoniae R6
auaaaagaggagguaaaucccaa

SEQ ID NO: 2201656 - RNA, 14 nt, Streptococcus pneumoniae R6
auaaaaggcuuagc

SEQ ID NO: 2201657 - RNA, 16 nt, Streptococcus pneumoniae R6
auaaaacuuuuaaaau

SEQ ID NO: 2201658 - RNA, 21 nt, Streptococcus pneumoniae R6
auaaaaauccguuuuuugaag

SEQ ID NO: 2201659 - RNA, 21 nt, Streptococcus pneumoniae R6
auaaaaauccuuuuuuugaag

SEQ ID NO: 2201660 - RNA, 13 nt, Streptococcus pneumoniae R6
auaaaacaaaaaa

SEQ ID NO: 2201661 - RNA, 19 nt, Streptococcus pneumoniae R6
auaaaacauuuccgauuuc

SEQ ID NO: 2201662 - RNA, 20 nt, Streptococcus pneumoniae R6
auaaaacauuucggauuuua

SEQ ID NO: 2201663 - RNA, 17 nt, Streptococcus pneumoniae R6
auaaaaccaaaaagugg

SEQ ID NO: 2201664 - RNA, 21 nt, Streptococcus pneumoniae R6
auaaaaacugaacaaauuaau

SEQ ID NO: 2201665 - RNA, 12 nt, Streptococcus pneumoniae R6
auaaaaagaccg

SEQ ID NO: 2201666 - RNA, 20 nt, Streptococcus pneumoniae R6
auaaaaagagaagaaauaug

SEQ ID NO: 2201667 - RNA, 20 nt, Streptococcus pneumoniae R6
aguuuuguuuuuuauaacag

SEQ ID NO: 2201668 - RNA, 16 nt, Streptococcus pneumoniae R6
aguuuuuaauuuuucu

SEQ ID NO: 2201669 - RNA, 19 nt, Streptococcus pneumoniae R6
aguuuuuaauuuuucuuug

SEQ ID NO: 2201670 - RNA, 21 nt, Streptococcus pneumoniae R6
aguuuuucagccaagugagua

SEQ ID NO: 2201671 - RNA, 20 nt, Streptococcus pneumoniae R6
aguuuuugguaauuuucuuu

SEQ ID NO: 2201672 - RNA, 18 nt, Streptococcus pneumoniae R6
aguuuuugcacaccugau

SEQ ID NO: 2201673 - RNA, 12 nt, Streptococcus pneumoniae R6
aguuuuugcaau

SEQ ID NO: 2201674 - RNA, 13 nt, Streptococcus pneumoniae R6
aguuuuuucucug

SEQ ID NO: 2201675 - RNA, 16 nt, Streptococcus pneumoniae R6
aguuuuuuaucuuugg

SEQ ID NO: 2201676 - RNA, 18 nt, Streptococcus pneumoniae R6
aguuuuuucacaaauucu

SEQ ID NO: 2201677 - RNA, 17 nt, Streptococcus pneumoniae R6
auaaaaaagucugggaa

SEQ ID NO: 2201678 - RNA, 16 nt, Streptococcus pneumoniae R6
auaaaaaagugaacaa

SEQ ID NO: 2201679 - RNA, 15 nt, Streptococcus pneumoniae R6
auaaaaaacacaaaa

SEQ ID NO: 2201680 - RNA, 17 nt, Streptococcus pneumoniae R6
aguuuuuugacuucaau

SEQ ID NO: 2201681 - RNA, 17 nt, Streptococcus pneumoniae R6
aguuuuuugacuucugu

SEQ ID NO: 2201682 - RNA, 16 nt, Streptococcus pneumoniae R6
aguuggcuuugagaua

SEQ ID NO: 2201683 - RNA, 22 nt, Streptococcus pneumoniae R6
aguuggucacgacggugaacaa

SEQ ID NO: 2201684 - RNA, 14 nt, Streptococcus pneumoniae R6
aguugguuguucag

SEQ ID NO: 2201685 - RNA, 20 nt, Streptococcus pneumoniae R6
aguugguagguauauucuga

SEQ ID NO: 2201686 - RNA, 19 nt, Streptococcus pneumoniae R6
aguuggucauauuaaagag

SEQ ID NO: 2201687 - RNA, 22 nt, Streptococcus pneumoniae R6
aguugguccguguaaaaccuuu

SEQ ID NO: 2201688 - RNA, 17 nt, Streptococcus pneumoniae R6
aguuggugacugacuaa

SEQ ID NO: 2201689 - RNA, 22 nt, Streptococcus pneumoniae R6
aguuuugauagcguucguucau

SEQ ID NO: 2201690 - RNA, 10 nt, Streptococcus pneumoniae R6
aguuuugcua

SEQ ID NO: 2201691 - RNA, 22 nt, Streptococcus pneumoniae R6
aguuuugcccauucuuuagcag

SEQ ID NO: 2201692 - RNA, 15 nt, Streptococcus pneumoniae R6
aguuuugguuuuucu

SEQ ID NO: 2201693 - RNA, 20 nt, Streptococcus pneumoniae R6
aguuuuggaauggaguagua

SEQ ID NO: 2201694 - RNA, 21 nt, Streptococcus pneumoniae R6
aguuguaaucuuagcaaagau

SEQ ID NO: 2201695 - RNA, 14 nt, Streptococcus pneumoniae R6
aguuuuccguucuc

SEQ ID NO: 2201696 - RNA, 15 nt, Streptococcus pneumoniae R6
aguuuucuaaagaau

SEQ ID NO: 2201697 - RNA, 13 nt, Streptococcus pneumoniae R6
aguuuucuaguuu

SEQ ID NO: 2201698 - RNA, 17 nt, Streptococcus pneumoniae R6
auaaacuaagcuuauau

SEQ ID NO: 2201699 - RNA, 18 nt, Streptococcus pneumoniae R6
auaaacuaagcuuauaua

SEQ ID NO: 2201700 - RNA, 19 nt, Streptococcus pneumoniae R6
auaaacuauccagagcauu

SEQ ID NO: 2201701 - RNA, 12 nt, Streptococcus pneumoniae R6
auaaacagcgag

SEQ ID NO: 2201702 - RNA, 22 nt, Streptococcus pneumoniae R6
auaaacuuuuucauaaauagau

SEQ ID NO: 2201703 - RNA, 23 nt, Streptococcus pneumoniae R6
auaaacuuugguuauaaaaaaca

SEQ ID NO: 2201704 - RNA, 14 nt, Streptococcus pneumoniae R6
auaaacuugcagga

SEQ ID NO: 2201705 - RNA, 15 nt, Streptococcus pneumoniae R6
auaaacuuguaggcu

SEQ ID NO: 2201706 - RNA, 23 nt, Streptococcus pneumoniae R6
auaaacuggguugaagauuucau

SEQ ID NO: 2201707 - RNA, 21 nt, Streptococcus pneumoniae R6
auaaacuguaaacgaauacuu

SEQ ID NO: 2201708 - RNA, 16 nt, Streptococcus pneumoniae R6
auaaagcuaaagauga

SEQ ID NO: 2201709 - RNA, 13 nt, Streptococcus pneumoniae R6
auaaagcugauuu

SEQ ID NO: 2201710 - RNA, 17 nt, Streptococcus pneumoniae R6
auaaaggcagauuucaa

SEQ ID NO: 2201711 - RNA, 14 nt, Streptococcus pneumoniae R6
auaaaggacaaaau

SEQ ID NO: 2201712 - RNA, 14 nt, Streptococcus pneumoniae R6
auaaagauacgaug

SEQ ID NO: 2201713 - RNA, 11 nt, Streptococcus pneumoniae R6
auaaagagaag

SEQ ID NO: 2201714 - RNA, 19 nt, Streptococcus pneumoniae R6
auaaauggacaaucuuaaa

SEQ ID NO: 2201715 - RNA, 14 nt, Streptococcus pneumoniae R6
auaaaugcaaagcc

SEQ ID NO: 2201716 - RNA, 16 nt, Streptococcus pneumoniae R6
auaaaugcaaagccaa

SEQ ID NO: 2201717 - RNA, 13 nt, Streptococcus pneumoniae R6
auaaauucauuug

SEQ ID NO: 2201718 - RNA, 14 nt, Streptococcus pneumoniae R6
auaaauucauuuga

SEQ ID NO: 2201719 - RNA, 15 nt, Streptococcus pneumoniae R6
auaaaucuucuaaau

SEQ ID NO: 2201720 - RNA, 14 nt, Streptococcus pneumoniae R6
auaaaucuugaugu

SEQ ID NO: 2201721 - RNA, 14 nt, Streptococcus pneumoniae R6
auaaaguggucuuu

SEQ ID NO: 2201722 - RNA, 18 nt, Streptococcus pneumoniae R6
auaaaguuaugaaaaaga

SEQ ID NO: 2201723 - RNA, 18 nt, Streptococcus pneumoniae R6
auaaagugauauacuaug

SEQ ID NO: 2201724 - RNA, 16 nt, Streptococcus pneumoniae R6
auaaaggccuuggccu

SEQ ID NO: 2201725 - RNA, 13 nt, Streptococcus pneumoniae R6
aaaacuauauucu

SEQ ID NO: 2201726 - RNA, 18 nt, Streptococcus pneumoniae R6
aaaacuauugacuuuucu

SEQ ID NO: 2201727 - RNA, 23 nt, Streptococcus pneumoniae R6
aaaacuagaauagaaacaaaaua

SEQ ID NO: 2201728 - RNA, 11 nt, Streptococcus pneumoniae R6
aaaacuagcaa

SEQ ID NO: 2201729 - RNA, 17 nt, Streptococcus pneumoniae R6
aaaacuagcaaugccaa

SEQ ID NO: 2201730 - RNA, 15 nt, Streptococcus pneumoniae R6
aucauacuuagcuaa

SEQ ID NO: 2201731 - RNA, 21 nt, Streptococcus pneumoniae R6
aucauacuuagcuaauuuucu

SEQ ID NO: 2201732 - RNA, 14 nt, Streptococcus pneumoniae R6
aaaacuagugaagc

SEQ ID NO: 2201733 - RNA, 19 nt, Streptococcus pneumoniae R6
aaaacuaguuuaaaagacu

SEQ ID NO: 2201734 - RNA, 22 nt, Streptococcus pneumoniae R6
aaaacuccaaacgcgauacaau

SEQ ID NO: 2201735 - RNA, 19 nt, Streptococcus pneumoniae R6
aucauacgauugaaaggaa

SEQ ID NO: 2201736 - RNA, 16 nt, Streptococcus pneumoniae R6
aucaucuugcuaaaaa

SEQ ID NO: 2201737 - RNA, 19 nt, Streptococcus pneumoniae R6
aucaucuugcuaaaaaaag

SEQ ID NO: 2201738 - RNA, 22 nt, Streptococcus pneumoniae R6
aucaucugcaucaagaacaauu

SEQ ID NO: 2201739 - RNA, 17 nt, Streptococcus pneumoniae R6
aucaugacugagagcua

SEQ ID NO: 2201740 - RNA, 16 nt, Streptococcus pneumoniae R6
aucaugacuggacggu

SEQ ID NO: 2201741 - RNA, 23 nt, Streptococcus pneumoniae R6
aucaugaauauuccuaugauuaa

SEQ ID NO: 2201742 - RNA, 24 nt, Streptococcus pneumoniae R6
aucaugaaaccaccgacaacccag

SEQ ID NO: 2201743 - RNA, 20 nt, Streptococcus pneumoniae R6
aucauguaccuaagauuaga

SEQ ID NO: 2201744 - RNA, 13 nt, Streptococcus pneumoniae R6
aucaugguugcuc

SEQ ID NO: 2201745 - RNA, 14 nt, Streptococcus pneumoniae R6
aaaacugaacaaga

SEQ ID NO: 2201746 - RNA, 23 nt, Streptococcus pneumoniae R6
aaaacugaacaagacgaaccaau

SEQ ID NO: 2201747 - RNA, 23 nt, Streptococcus pneumoniae R6
aaaacucuucuuuuggcaauaaa

SEQ ID NO: 2201748 - RNA, 20 nt, Streptococcus pneumoniae R6
aucaugcgaaucaauuuuuc

SEQ ID NO: 2201749 - RNA, 15 nt, Streptococcus pneumoniae R6
aucauggauuuuucu

SEQ ID NO: 2201750 - RNA, 22 nt, Streptococcus pneumoniae R6
aaaacuguaaaguagcaaaaca

SEQ ID NO: 2201751 - RNA, 15 nt, Streptococcus pneumoniae R6
aaaacuguaugagaa

SEQ ID NO: 2201752 - RNA, 15 nt, Streptococcus pneumoniae R6
aaaagaacaaguaaa

SEQ ID NO: 2201753 - RNA, 21 nt, Streptococcus pneumoniae R6
aaaagaacaaguaaagaguca

SEQ ID NO: 2201754 - RNA, 14 nt, Streptococcus pneumoniae R6
aaaagaaauauaua

SEQ ID NO: 2201755 - RNA, 22 nt, Streptococcus pneumoniae R6
aaaagaaggguuagucauuccc

SEQ ID NO: 2201756 - RNA, 22 nt, Streptococcus pneumoniae R6
aaaagaagccugauggaaacau

SEQ ID NO: 2201757 - RNA, 21 nt, Streptococcus pneumoniae R6
aaaagaauuaggaaaacauga

SEQ ID NO: 2201758 - RNA, 17 nt, Streptococcus pneumoniae R6
aucauuccugauaaaag

SEQ ID NO: 2201759 - RNA, 19 nt, Streptococcus pneumoniae R6
aucauucugaacuaaaaaa

SEQ ID NO: 2201760 - RNA, 13 nt, Streptococcus pneumoniae R6
aucauucugcaug

SEQ ID NO: 2201761 - RNA, 22 nt, Streptococcus pneumoniae R6
aucauucugcauguaucacagu

SEQ ID NO: 2201762 - RNA, 22 nt, Streptococcus pneumoniae R6
aucauucuuauuuggcaauuca

SEQ ID NO: 2201763 - RNA, 15 nt, Streptococcus pneumoniae R6
aucauugaguuggcu

SEQ ID NO: 2201764 - RNA, 17 nt, Streptococcus pneumoniae R6
aucauugaguuggcuug

SEQ ID NO: 2201765 - RNA, 13 nt, Streptococcus pneumoniae R6
auccaacugaucc

SEQ ID NO: 2201766 - RNA, 20 nt, Streptococcus pneumoniae R6
auccaacugaucccuccauu

SEQ ID NO: 2201767 - RNA, 23 nt, Streptococcus pneumoniae R6
aucauugcuaucuaggcugacaa

SEQ ID NO: 2201768 - RNA, 16 nt, Streptococcus pneumoniae R6
aucauugucaaacaag

SEQ ID NO: 2201769 - RNA, 19 nt, Streptococcus pneumoniae R6
auccaaacacgaaaccagu

SEQ ID NO: 2201770 - RNA, 22 nt, Streptococcus pneumoniae R6
auccaaagauuaaucuucaaau

SEQ ID NO: 2201771 - RNA, 14 nt, Streptococcus pneumoniae R6
auccacacuuccaa

SEQ ID NO: 2201772 - RNA, 15 nt, Streptococcus pneumoniae R6
auccaauuucuaacg

SEQ ID NO: 2201773 - RNA, 12 nt, Streptococcus pneumoniae R6
auccacaaccuc

SEQ ID NO: 2201774 - RNA, 12 nt, Streptococcus pneumoniae R6
auccacaaccuu

SEQ ID NO: 2201775 - RNA, 18 nt, Streptococcus pneumoniae R6
auccacaaccuuaaaaca

SEQ ID NO: 2201776 - RNA, 16 nt, Streptococcus pneumoniae R6
auccaauucuucagca

SEQ ID NO: 2201777 - RNA, 21 nt, Streptococcus pneumoniae R6
auccacucaguauuacaucca

SEQ ID NO: 2201778 - RNA, 17 nt, Streptococcus pneumoniae R6
auccacuauaauaaaau

SEQ ID NO: 2201779 - RNA, 18 nt, Streptococcus pneumoniae R6
auccacuauaauaaaaug

SEQ ID NO: 2201780 - RNA, 22 nt, Streptococcus pneumoniae R6
auccagagcauucuuuuguuca

SEQ ID NO: 2201781 - RNA, 13 nt, Streptococcus pneumoniae R6
auccagauuuuuc

SEQ ID NO: 2201782 - RNA, 20 nt, Streptococcus pneumoniae R6
auccauaccgccaaucacuu

SEQ ID NO: 2201783 - RNA, 14 nt, Streptococcus pneumoniae R6
auccagucgugcaa

SEQ ID NO: 2201784 - RNA, 18 nt, Streptococcus pneumoniae R6
auccaugauccuucauuc

SEQ ID NO: 2201785 - RNA, 20 nt, Streptococcus pneumoniae R6
auccaugaaaaaugcaugag

SEQ ID NO: 2201786 - RNA, 16 nt, Streptococcus pneumoniae R6
aucccaaagaauccau

SEQ ID NO: 2201787 - RNA, 20 nt, Streptococcus pneumoniae R6
auccauggaauaccaauauc

SEQ ID NO: 2201788 - RNA, 13 nt, Streptococcus pneumoniae R6
aucccauucuuca

SEQ ID NO: 2201789 - RNA, 19 nt, Streptococcus pneumoniae R6
aucccaugacaaucauuuc

SEQ ID NO: 2201790 - RNA, 23 nt, Streptococcus pneumoniae R6
aucccaugacaaucauuucaguu

SEQ ID NO: 2201791 - RNA, 22 nt, Streptococcus pneumoniae R6
aucccauguaguucaaaacugc

SEQ ID NO: 2201792 - RNA, 17 nt, Streptococcus pneumoniae R6
aucccaugucaauucuc

SEQ ID NO: 2201793 - RNA, 18 nt, Streptococcus pneumoniae R6
aucccaugucuuuuaaau

SEQ ID NO: 2201794 - RNA, 15 nt, Streptococcus pneumoniae R6
auccguuuuucuccu

SEQ ID NO: 2201795 - RNA, 14 nt, Streptococcus pneumoniae R6
auccguuuuuuaaa

SEQ ID NO: 2201796 - RNA, 21 nt, Streptococcus pneumoniae R6
auccguuuuuugaaguuuuca

SEQ ID NO: 2201797 - RNA, 22 nt, Streptococcus pneumoniae R6
auccguucugagauaggugggu

SEQ ID NO: 2201798 - RNA, 20 nt, Streptococcus pneumoniae R6
auccuauucggacuuuggcu

SEQ ID NO: 2201799 - RNA, 15 nt, Streptococcus pneumoniae R6
auccgucgcauauuu

SEQ ID NO: 2201800 - RNA, 23 nt, Streptococcus pneumoniae R6
auccuuuuccaagaccuuaaacu

SEQ ID NO: 2201801 - RNA, 11 nt, Streptococcus pneumoniae R6
auccuuuucug

SEQ ID NO: 2201802 - RNA, 16 nt, Streptococcus pneumoniae R6
auccuuuacuuguuuu

SEQ ID NO: 2201803 - RNA, 23 nt, Streptococcus pneumoniae R6
auccuuuacuuguuuuagaugau

SEQ ID NO: 2201804 - RNA, 12 nt, Streptococcus pneumoniae R6
auccuuaaccca

SEQ ID NO: 2201805 - RNA, 14 nt, Streptococcus pneumoniae R6
auccuuauuuugca

SEQ ID NO: 2201806 - RNA, 20 nt, Streptococcus pneumoniae R6
auccuuacggucaaagucau

SEQ ID NO: 2201807 - RNA, 14 nt, Streptococcus pneumoniae R6
auccugcaaagaua

SEQ ID NO: 2201808 - RNA, 16 nt, Streptococcus pneumoniae R6
auccugcaaggcauaa

SEQ ID NO: 2201809 - RNA, 19 nt, Streptococcus pneumoniae R6
auccugagucuaucuaaga

SEQ ID NO: 2201810 - RNA, 17 nt, Streptococcus pneumoniae R6
auccugaaaagccacgu

SEQ ID NO: 2201811 - RNA, 14 nt, Streptococcus pneumoniae R6
auccugaauaguga

SEQ ID NO: 2201812 - RNA, 18 nt, Streptococcus pneumoniae R6
auccugaauagugaagau

SEQ ID NO: 2201813 - RNA, 17 nt, Streptococcus pneumoniae R6
auccucaaaauucuguc

SEQ ID NO: 2201814 - RNA, 18 nt, Streptococcus pneumoniae R6
auccucaaaauucugucu

SEQ ID NO: 2201815 - RNA, 16 nt, Streptococcus pneumoniae R6
auccuauuuauuacuu

SEQ ID NO: 2201816 - RNA, 14 nt, Streptococcus pneumoniae R6
auccuauuucacuc

SEQ ID NO: 2201817 - RNA, 14 nt, Streptococcus pneumoniae R6
aucgccucuucaau

SEQ ID NO: 2201818 - RNA, 17 nt, Streptococcus pneumoniae R6
aucgcgaccaagagcaa

SEQ ID NO: 2201819 - RNA, 14 nt, Streptococcus pneumoniae R6
aucgauuuguccug

SEQ ID NO: 2201820 - RNA, 19 nt, Streptococcus pneumoniae R6
aucgauuuguucuguucuu

SEQ ID NO: 2201821 - RNA, 14 nt, Streptococcus pneumoniae R6
aucgaucuguucuu

SEQ ID NO: 2201822 - RNA, 23 nt, Streptococcus pneumoniae R6
aucgagaagauuuccugauuuug

SEQ ID NO: 2201823 - RNA, 16 nt, Streptococcus pneumoniae R6
aucgagaauuucuggu

SEQ ID NO: 2201824 - RNA, 17 nt, Streptococcus pneumoniae R6
auccuuuuuuugaaguu

SEQ ID NO: 2201825 - RNA, 17 nt, Streptococcus pneumoniae R6
aucgacuuguuuuuuga

SEQ ID NO: 2201826 - RNA, 12 nt, Streptococcus pneumoniae R6
aucgaaaaauau

SEQ ID NO: 2201827 - RNA, 20 nt, Streptococcus pneumoniae R6
aucgcagcaucgagaauuuc

SEQ ID NO: 2201828 - RNA, 16 nt, Streptococcus pneumoniae R6
aucgcaaguuuuuccc

SEQ ID NO: 2201829 - RNA, 16 nt, Streptococcus pneumoniae R6
aucuaaaauagaagga

SEQ ID NO: 2201830 - RNA, 16 nt, Streptococcus pneumoniae R6
aucuaacaauaagaua

SEQ ID NO: 2201831 - RNA, 15 nt, Streptococcus pneumoniae R6
aucuaaauaauacuu

SEQ ID NO: 2201832 - RNA, 17 nt, Streptococcus pneumoniae R6
aucguuccugucuuauu

SEQ ID NO: 2201833 - RNA, 23 nt, Streptococcus pneumoniae R6
aucguuuuacggacauguauauu

SEQ ID NO: 2201834 - RNA, 16 nt, Streptococcus pneumoniae R6
aucuaaaaaaaugaua

SEQ ID NO: 2201835 - RNA, 15 nt, Streptococcus pneumoniae R6
aucuaaucauucuga

SEQ ID NO: 2201836 - RNA, 15 nt, Streptococcus pneumoniae R6
aucuaauaauuuuuc

SEQ ID NO: 2201837 - RNA, 16 nt, Streptococcus pneumoniae R6
aucuaauaauuuuuca

SEQ ID NO: 2201838 - RNA, 21 nt, Streptococcus pneumoniae R6
aucuaagguauauucaaaaua

SEQ ID NO: 2201839 - RNA, 17 nt, Streptococcus pneumoniae R6
aucuaaggucaaacuuu

SEQ ID NO: 2201840 - RNA, 20 nt, Streptococcus pneumoniae R6
aucuaagcauuuaauccaaa

SEQ ID NO: 2201841 - RNA, 13 nt, Streptococcus pneumoniae R6
aucuaauagacua

SEQ ID NO: 2201842 - RNA, 15 nt, Streptococcus pneumoniae R6
aucuaauugauuuaa

SEQ ID NO: 2201843 - RNA, 18 nt, Streptococcus pneumoniae R6
aucuacgcuuuaaaaauc

SEQ ID NO: 2201844 - RNA, 20 nt, Streptococcus pneumoniae R6
aucuauuccuagucagaaua

SEQ ID NO: 2201845 - RNA, 23 nt, Streptococcus pneumoniae R6
aucuacuucuuuaacuacuugau

SEQ ID NO: 2201846 - RNA, 18 nt, Streptococcus pneumoniae R6
aucuacuggcaaauuuuc

SEQ ID NO: 2201847 - RNA, 19 nt, Streptococcus pneumoniae R6
aucuacuggcaaauuuucu

SEQ ID NO: 2201848 - RNA, 14 nt, Streptococcus pneumoniae R6
aucuacuauauuuu

SEQ ID NO: 2201849 - RNA, 16 nt, Streptococcus pneumoniae R6
aucuacuauauuuuug

SEQ ID NO: 2201850 - RNA, 18 nt, Streptococcus pneumoniae R6
aucuacuaucucuacauu

SEQ ID NO: 2201851 - RNA, 16 nt, Streptococcus pneumoniae R6
aucguucaggacaguc

SEQ ID NO: 2201852 - RNA, 21 nt, Streptococcus pneumoniae R6
aucguucaggacagucaaauc

SEQ ID NO: 2201853 - RNA, 16 nt, Streptococcus pneumoniae R6
aucgugaguuccuguu

SEQ ID NO: 2201854 - RNA, 16 nt, Streptococcus pneumoniae R6
aucgucucacgguaaa

SEQ ID NO: 2201855 - RNA, 22 nt, Streptococcus pneumoniae R6
aucgucucacgguaaauguaga

SEQ ID NO: 2201856 - RNA, 16 nt, Streptococcus pneumoniae R6
aucucuuacaguuugc

SEQ ID NO: 2201857 - RNA, 16 nt, Streptococcus pneumoniae R6
aucucuuagaccaagu

SEQ ID NO: 2201858 - RNA, 18 nt, Streptococcus pneumoniae R6
aucucaaaacaguguuuu

SEQ ID NO: 2201859 - RNA, 11 nt, Streptococcus pneumoniae R6
aucuauuuuua

SEQ ID NO: 2201860 - RNA, 15 nt, Streptococcus pneumoniae R6
aucuauuuuuaaauu

SEQ ID NO: 2201861 - RNA, 19 nt, Streptococcus pneumoniae R6
aucuauuuaugaaaaaguu

SEQ ID NO: 2201862 - RNA, 18 nt, Streptococcus pneumoniae R6
aucuggaggcuuuuucuc

SEQ ID NO: 2201863 - RNA, 15 nt, Streptococcus pneumoniae R6
aucugccaccucaaa

SEQ ID NO: 2201864 - RNA, 17 nt, Streptococcus pneumoniae R6
aucugccgcaugacaaa

SEQ ID NO: 2201865 - RNA, 20 nt, Streptococcus pneumoniae R6
aucugccucaagaagugguu

SEQ ID NO: 2201866 - RNA, 18 nt, Streptococcus pneumoniae R6
aucugcaaccucaaaaca

SEQ ID NO: 2201867 - RNA, 19 nt, Streptococcus pneumoniae R6
aucugcaaccucaaaacag

SEQ ID NO: 2201868 - RNA, 17 nt, Streptococcus pneumoniae R6
aucugcaaccuuaaaac

SEQ ID NO: 2201869 - RNA, 14 nt, Streptococcus pneumoniae R6
aucugcaauaacaa

SEQ ID NO: 2201870 - RNA, 19 nt, Streptococcus pneumoniae R6
aucugauuggaaacuuuuu

SEQ ID NO: 2201871 - RNA, 13 nt, Streptococcus pneumoniae R6
aucugauauauuu

SEQ ID NO: 2201872 - RNA, 20 nt, Streptococcus pneumoniae R6
aucugacuucgucaguucua

SEQ ID NO: 2201873 - RNA, 21 nt, Streptococcus pneumoniae R6
aucugacuucgucaguucuau

SEQ ID NO: 2201874 - RNA, 18 nt, Streptococcus pneumoniae R6
aucuuuagggaaauuauu

SEQ ID NO: 2201875 - RNA, 18 nt, Streptococcus pneumoniae R6
aucuuuaaggcacuagcu

SEQ ID NO: 2201876 - RNA, 17 nt, Streptococcus pneumoniae R6
aucuuuaagguacuuga

SEQ ID NO: 2201877 - RNA, 20 nt, Streptococcus pneumoniae R6
aucuuuaagauacuugauuu

SEQ ID NO: 2201878 - RNA, 16 nt, Streptococcus pneumoniae R6
aucuugucuaaaaaua

SEQ ID NO: 2201879 - RNA, 17 nt, Streptococcus pneumoniae R6
aucuugucuaaaaauag

SEQ ID NO: 2201880 - RNA, 13 nt, Streptococcus pneumoniae R6
aucuugucaagaa

SEQ ID NO: 2201881 - RNA, 17 nt, Streptococcus pneumoniae R6
aucuuguccacucgaaa

SEQ ID NO: 2201882 - RNA, 21 nt, Streptococcus pneumoniae R6
aucuuguccacucgaaacaag

SEQ ID NO: 2201883 - RNA, 19 nt, Streptococcus pneumoniae R6
aucuuggcgaauauagaca

SEQ ID NO: 2201884 - RNA, 22 nt, Streptococcus pneumoniae R6
aucuuggcgaauauagacaaaa

SEQ ID NO: 2201885 - RNA, 14 nt, Streptococcus pneumoniae R6
aucuuggauuauau

SEQ ID NO: 2201886 - RNA, 17 nt, Streptococcus pneumoniae R6
aucuuggauuauauaug

SEQ ID NO: 2201887 - RNA, 20 nt, Streptococcus pneumoniae R6
aucuuugaggaagguuuuaa

SEQ ID NO: 2201888 - RNA, 12 nt, Streptococcus pneumoniae R6
aucuuugaaaua

SEQ ID NO: 2201889 - RNA, 14 nt, Streptococcus pneumoniae R6
aucuuugaaauaau

SEQ ID NO: 2201890 - RNA, 19 nt, Streptococcus pneumoniae R6
aucuuuggacauagccaau

SEQ ID NO: 2201891 - RNA, 17 nt, Streptococcus pneumoniae R6
aucuuugauuucuugug

SEQ ID NO: 2201892 - RNA, 12 nt, Streptococcus pneumoniae R6
aucuuugauuuu

SEQ ID NO: 2201893 - RNA, 13 nt, Streptococcus pneumoniae R6
aucuuugauuuua

SEQ ID NO: 2201894 - RNA, 16 nt, Streptococcus pneumoniae R6
aucuuugcuggugcuu

SEQ ID NO: 2201895 - RNA, 20 nt, Streptococcus pneumoniae R6
aucuuuuggacucacuaaaa

SEQ ID NO: 2201896 - RNA, 22 nt, Streptococcus pneumoniae R6
aucuuuuucgcuuggauuuuca

SEQ ID NO: 2201897 - RNA, 12 nt, Streptococcus pneumoniae R6
aucuugacaauc

SEQ ID NO: 2201898 - RNA, 15 nt, Streptococcus pneumoniae R6
aucuucuugauacug

SEQ ID NO: 2201899 - RNA, 21 nt, Streptococcus pneumoniae R6
aucuucuugauacugaucaaa

SEQ ID NO: 2201900 - RNA, 15 nt, Streptococcus pneumoniae R6
aucuuggauauucaa

SEQ ID NO: 2201901 - RNA, 20 nt, Streptococcus pneumoniae R6
aucuugcugguuugugaagc

SEQ ID NO: 2201902 - RNA, 13 nt, Streptococcus pneumoniae R6
aucuugauuuucu

SEQ ID NO: 2201903 - RNA, 16 nt, Streptococcus pneumoniae R6
aucuugauauucuuau

SEQ ID NO: 2201904 - RNA, 22 nt, Streptococcus pneumoniae R6
aucuugauauucuuaucaaauc

SEQ ID NO: 2201905 - RNA, 15 nt, Streptococcus pneumoniae R6
aucuguguagcacuu

SEQ ID NO: 2201906 - RNA, 21 nt, Streptococcus pneumoniae R6
aucugucuaccuucaggagau

SEQ ID NO: 2201907 - RNA, 17 nt, Streptococcus pneumoniae R6
aucugucuuaccacaaa

SEQ ID NO: 2201908 - RNA, 16 nt, Streptococcus pneumoniae R6
aucugugauuucaguu

SEQ ID NO: 2201909 - RNA, 19 nt, Streptococcus pneumoniae R6
aucugguuucguagcagaa

SEQ ID NO: 2201910 - RNA, 14 nt, Streptococcus pneumoniae R6
aucugguuuuuccc

SEQ ID NO: 2201911 - RNA, 21 nt, Streptococcus pneumoniae R6
aucuucuagcuaucuccucau

SEQ ID NO: 2201912 - RNA, 18 nt, Streptococcus pneumoniae R6
aucuucuccaaaccauuu

SEQ ID NO: 2201913 - RNA, 17 nt, Streptococcus pneumoniae R6
aucuucuauugcauaua

SEQ ID NO: 2201914 - RNA, 21 nt, Streptococcus pneumoniae R6
aucuucucacguccuagcucu

SEQ ID NO: 2201915 - RNA, 19 nt, Streptococcus pneumoniae R6
aucuucucaggcuuuuucu

SEQ ID NO: 2201916 - RNA, 20 nt, Streptococcus pneumoniae R6
aucuucucaggcuuuuucug

SEQ ID NO: 2201917 - RNA, 17 nt, Streptococcus pneumoniae R6
aucuucuccaguuuuaa

SEQ ID NO: 2201918 - RNA, 22 nt, Streptococcus pneumoniae R6
augaccaugucguuuccuucca

SEQ ID NO: 2201919 - RNA, 18 nt, Streptococcus pneumoniae R6
augacccaagcuuuaugc

SEQ ID NO: 2201920 - RNA, 18 nt, Streptococcus pneumoniae R6
augacacguaucggaaau

SEQ ID NO: 2201921 - RNA, 21 nt, Streptococcus pneumoniae R6
augacacguaucggaaauauu

SEQ ID NO: 2201922 - RNA, 14 nt, Streptococcus pneumoniae R6
augacaauaaaaua

SEQ ID NO: 2201923 - RNA, 17 nt, Streptococcus pneumoniae R6
augacaaucauuucagu

SEQ ID NO: 2201924 - RNA, 16 nt, Streptococcus pneumoniae R6
augacaauuauauaaa

SEQ ID NO: 2201925 - RNA, 17 nt, Streptococcus pneumoniae R6
augaccagaauagcugu

SEQ ID NO: 2201926 - RNA, 11 nt, Streptococcus pneumoniae R6
augagagauuc

SEQ ID NO: 2201927 - RNA, 15 nt, Streptococcus pneumoniae R6
augagagcuuauuuu

SEQ ID NO: 2201928 - RNA, 13 nt, Streptococcus pneumoniae R6
augagaguuugau

SEQ ID NO: 2201929 - RNA, 21 nt, Streptococcus pneumoniae R6
augagauaagcgauuuuauag

SEQ ID NO: 2201930 - RNA, 23 nt, Streptococcus pneumoniae R6
augagacuugcaagaaaguagag

SEQ ID NO: 2201931 - RNA, 15 nt, Streptococcus pneumoniae R6
augagaaagauuuuc

SEQ ID NO: 2201932 - RNA, 21 nt, Streptococcus pneumoniae R6
augagaaacagcuccugaaau

SEQ ID NO: 2201933 - RNA, 16 nt, Streptococcus pneumoniae R6
augacgaaacgaagaa

SEQ ID NO: 2201934 - RNA, 21 nt, Streptococcus pneumoniae R6
augacgaaacgaagaaggaag

SEQ ID NO: 2201935 - RNA, 22 nt, Streptococcus pneumoniae R6
augacaaaguacuugagaaucu

SEQ ID NO: 2201936 - RNA, 18 nt, Streptococcus pneumoniae R6
augacaacaccgacagca

SEQ ID NO: 2201937 - RNA, 16 nt, Streptococcus pneumoniae R6
augacaacauggcuuc

SEQ ID NO: 2201938 - RNA, 17 nt, Streptococcus pneumoniae R6
augacaaauccauucuu

SEQ ID NO: 2201939 - RNA, 18 nt, Streptococcus pneumoniae R6
augacaaaucuaagucaa

SEQ ID NO: 2201940 - RNA, 23 nt, Streptococcus pneumoniae R6
augacaaaucuaagucaaauaag

SEQ ID NO: 2201941 - RNA, 17 nt, Streptococcus pneumoniae R6
augaauuacaugaaacu

SEQ ID NO: 2201942 - RNA, 12 nt, Streptococcus pneumoniae R6
augaauauauuc

SEQ ID NO: 2201943 - RNA, 21 nt, Streptococcus pneumoniae R6
augaaagcugaugcgguuuga

SEQ ID NO: 2201944 - RNA, 14 nt, Streptococcus pneumoniae R6
augaaagauauuuu

SEQ ID NO: 2201945 - RNA, 21 nt, Streptococcus pneumoniae R6
augaagauugauaaaggcaga

SEQ ID NO: 2201946 - RNA, 12 nt, Streptococcus pneumoniae R6
augaaaaaaauu

SEQ ID NO: 2201947 - RNA, 15 nt, Streptococcus pneumoniae R6
augaaaccccaagaa

SEQ ID NO: 2201948 - RNA, 22 nt, Streptococcus pneumoniae R6
augaaacuguggaaaauagaaa

SEQ ID NO: 2201949 - RNA, 23 nt, Streptococcus pneumoniae R6
augaaacuaauagguacaaaaau

SEQ ID NO: 2201950 - RNA, 17 nt, Streptococcus pneumoniae R6
auaccuaaucuuucugc

SEQ ID NO: 2201951 - RNA, 20 nt, Streptococcus pneumoniae R6
auacggucaaucaacuucca

SEQ ID NO: 2201952 - RNA, 17 nt, Streptococcus pneumoniae R6
auacuaaggaaagucaa

SEQ ID NO: 2201953 - RNA, 19 nt, Streptococcus pneumoniae R6
auacuaauacauuuuguaa

SEQ ID NO: 2201954 - RNA, 12 nt, Streptococcus pneumoniae R6
auacuaaaaaaa

SEQ ID NO: 2201955 - RNA, 22 nt, Streptococcus pneumoniae R6
auacugaaacaacaucuuucca

SEQ ID NO: 2201956 - RNA, 22 nt, Streptococcus pneumoniae R6
auacugaucaaaaaauuucauu

SEQ ID NO: 2201957 - RNA, 12 nt, Streptococcus pneumoniae R6
auacugauaaaa

SEQ ID NO: 2201958 - RNA, 19 nt, Streptococcus pneumoniae R6
auacucuucgaaaaucucu

SEQ ID NO: 2201959 - RNA, 21 nt, Streptococcus pneumoniae R6
auacucuucgaaaaucucuuc

SEQ ID NO: 2201960 - RNA, 13 nt, Streptococcus pneumoniae R6
auacucuuagaaa

SEQ ID NO: 2201961 - RNA, 19 nt, Streptococcus pneumoniae R6
auacucuuagaaaaucucu

SEQ ID NO: 2201962 - RNA, 21 nt, Streptococcus pneumoniae R6
auacucuuagaaaaucucuuc

SEQ ID NO: 2201963 - RNA, 21 nt, Streptococcus pneumoniae R6
auacucuucaaaaaucucuuc

SEQ ID NO: 2201964 - RNA, 15 nt, Streptococcus pneumoniae R6
auagaaguacuaaug

SEQ ID NO: 2201965 - RNA, 20 nt, Streptococcus pneumoniae R6
auagaaguaggccaaacuug

SEQ ID NO: 2201966 - RNA, 16 nt, Streptococcus pneumoniae R6
auagaaggucaagaga

SEQ ID NO: 2201967 - RNA, 21 nt, Streptococcus pneumoniae R6
auagaaggucaagagaaaacc

SEQ ID NO: 2201968 - RNA, 20 nt, Streptococcus pneumoniae R6
auagaaucguuucugacaga

SEQ ID NO: 2201969 - RNA, 13 nt, Streptococcus pneumoniae R6
auagaauagcaga

SEQ ID NO: 2201970 - RNA, 20 nt, Streptococcus pneumoniae R6
auagacacaaugguuagaaa

SEQ ID NO: 2201971 - RNA, 15 nt, Streptococcus pneumoniae R6
auagacauuuucugu

SEQ ID NO: 2201972 - RNA, 15 nt, Streptococcus pneumoniae R6
auagaccaagagacg

SEQ ID NO: 2201973 - RNA, 19 nt, Streptococcus pneumoniae R6
auagagacauaaucaagau

SEQ ID NO: 2201974 - RNA, 17 nt, Streptococcus pneumoniae R6
auagaccugaucaaagg

SEQ ID NO: 2201975 - RNA, 16 nt, Streptococcus pneumoniae R6
auagacgaaaagucau

SEQ ID NO: 2201976 - RNA, 22 nt, Streptococcus pneumoniae R6
auagacccuuguuucuaaaaca

SEQ ID NO: 2201977 - RNA, 21 nt, Streptococcus pneumoniae R6
auagaacugacgaagucaguc

SEQ ID NO: 2201978 - RNA, 23 nt, Streptococcus pneumoniae R6
auagaaauuaauuuuacuuuccc

SEQ ID NO: 2201979 - RNA, 14 nt, Streptococcus pneumoniae R6
auagaaauauuuac

SEQ ID NO: 2201980 - RNA, 17 nt, Streptococcus pneumoniae R6
auagaaccgauacgaug

SEQ ID NO: 2201981 - RNA, 13 nt, Streptococcus pneumoniae R6
auagaaauuuuua

SEQ ID NO: 2201982 - RNA, 16 nt, Streptococcus pneumoniae R6
auacuguacguuuuau

SEQ ID NO: 2201983 - RNA, 17 nt, Streptococcus pneumoniae R6
auacuguaguuuuuccu

SEQ ID NO: 2201984 - RNA, 22 nt, Streptococcus pneumoniae R6
auacuguggaauauagaggaua

SEQ ID NO: 2201985 - RNA, 23 nt, Streptococcus pneumoniae R6
auacuuaacuuuguauaauaggu

SEQ ID NO: 2201986 - RNA, 14 nt, Streptococcus pneumoniae R6
auagaaagcuuaca

SEQ ID NO: 2201987 - RNA, 18 nt, Streptococcus pneumoniae R6
auagaaagauuugcugga

SEQ ID NO: 2201988 - RNA, 17 nt, Streptococcus pneumoniae R6
auaccacucuugcauuu

SEQ ID NO: 2201989 - RNA, 13 nt, Streptococcus pneumoniae R6
auaccagagcgac

SEQ ID NO: 2201990 - RNA, 23 nt, Streptococcus pneumoniae R6
auaccagagguagcuuagaaaua

SEQ ID NO: 2201991 - RNA, 22 nt, Streptococcus pneumoniae R6
auaccaucuaacucauagcaga

SEQ ID NO: 2201992 - RNA, 14 nt, Streptococcus pneumoniae R6
auacccaaaacaca

SEQ ID NO: 2201993 - RNA, 14 nt, Streptococcus pneumoniae R6
auaccauuuuccaa

SEQ ID NO: 2201994 - RNA, 15 nt, Streptococcus pneumoniae R6
auaccaguuuuugau

SEQ ID NO: 2201995 - RNA, 22 nt, Streptococcus pneumoniae R6
auaccagucguuucaagauaag

SEQ ID NO: 2201996 - RNA, 15 nt, Streptococcus pneumoniae R6
auaccauagagcgga

SEQ ID NO: 2201997 - RNA, 16 nt, Streptococcus pneumoniae R6
auaccauagagcggac

SEQ ID NO: 2201998 - RNA, 16 nt, Streptococcus pneumoniae R6
auacccaugcuuuucu

SEQ ID NO: 2201999 - RNA, 15 nt, Streptococcus pneumoniae R6
auacauuuuguaaaa

SEQ ID NO: 2202000 - RNA, 18 nt, Streptococcus pneumoniae R6
auacauuuuuucugaaga

SEQ ID NO: 2202001 - RNA, 18 nt, Streptococcus pneumoniae R6
auacaucuggguuaaaaa

SEQ ID NO: 2202002 - RNA, 19 nt, Streptococcus pneumoniae R6
auaauucggagauacuggu

SEQ ID NO: 2202003 - RNA, 14 nt, Streptococcus pneumoniae R6
auaauucaccuauu

SEQ ID NO: 2202004 - RNA, 15 nt, Streptococcus pneumoniae R6
auaauucaccuauua

SEQ ID NO: 2202005 - RNA, 22 nt, Streptococcus pneumoniae R6
auaauucaccuauuaacaauaa

SEQ ID NO: 2202006 - RNA, 14 nt, Streptococcus pneumoniae R6
auaauuccagauug

SEQ ID NO: 2202007 - RNA, 21 nt, Streptococcus pneumoniae R6
auacaguccucccuuguuuuu

SEQ ID NO: 2202008 - RNA, 19 nt, Streptococcus pneumoniae R6
auacagugaaggcuuuaaa

SEQ ID NO: 2202009 - RNA, 23 nt, Streptococcus pneumoniae R6
auacagugaaggcuuuaaaugcu

SEQ ID NO: 2202010 - RNA, 20 nt, Streptococcus pneumoniae R6
auacauagcuaaaaucaggu

SEQ ID NO: 2202011 - RNA, 19 nt, Streptococcus pneumoniae R6
auagccauaaaacauuucc

SEQ ID NO: 2202012 - RNA, 14 nt, Streptococcus pneumoniae R6
auagccaucucuac

SEQ ID NO: 2202013 - RNA, 20 nt, Streptococcus pneumoniae R6
auagaggagauuuaaaaaug

SEQ ID NO: 2202014 - RNA, 18 nt, Streptococcus pneumoniae R6
auagccccuaugcuuucc

SEQ ID NO: 2202015 - RNA, 22 nt, Streptococcus pneumoniae R6
auagccccuaugcuuuccuuuc

SEQ ID NO: 2202016 - RNA, 21 nt, Streptococcus pneumoniae R6
auagagccuucuuccaucuuc

SEQ ID NO: 2202017 - RNA, 23 nt, Streptococcus pneumoniae R6
auagagauagaaggucaagagaa

SEQ ID NO: 2202018 - RNA, 16 nt, Streptococcus pneumoniae R6
auagcgcuagagacua

SEQ ID NO: 2202019 - RNA, 22 nt, Streptococcus pneumoniae R6
auagcccguuggcuaaagauaa

SEQ ID NO: 2202020 - RNA, 22 nt, Streptococcus pneumoniae R6
auaggagcuauguagccacucu

SEQ ID NO: 2202021 - RNA, 22 nt, Streptococcus pneumoniae R6
auaggaugaaccugcuuaagau

SEQ ID NO: 2202022 - RNA, 15 nt, Streptococcus pneumoniae R6
auaggauauugacaa

SEQ ID NO: 2202023 - RNA, 17 nt, Streptococcus pneumoniae R6
auaggcagcuuguucuu

SEQ ID NO: 2202024 - RNA, 14 nt, Streptococcus pneumoniae R6
auagcuuuuuauau

SEQ ID NO: 2202025 - RNA, 17 nt, Streptococcus pneumoniae R6
auagcuuuuuauauaua

SEQ ID NO: 2202026 - RNA, 17 nt, Streptococcus pneumoniae R6
auagcuguuucaacacg

SEQ ID NO: 2202027 - RNA, 15 nt, Streptococcus pneumoniae R6
auagcuggucaagaa

SEQ ID NO: 2202028 - RNA, 18 nt, Streptococcus pneumoniae R6
auagcuggucaagaagcg

SEQ ID NO: 2202029 - RNA, 13 nt, Streptococcus pneumoniae R6
auagguaguucaa

SEQ ID NO: 2202030 - RNA, 23 nt, Streptococcus pneumoniae R6
auagguaaaaucuuaaaaaggga

SEQ ID NO: 2202031 - RNA, 15 nt, Streptococcus pneumoniae R6
auagguugcaaagag

SEQ ID NO: 2202032 - RNA, 21 nt, Streptococcus pneumoniae R6
auagguggguggguauaaaag

SEQ ID NO: 2202033 - RNA, 22 nt, Streptococcus pneumoniae R6
auaggcucuuugucaacuguag

SEQ ID NO: 2202034 - RNA, 13 nt, Streptococcus pneumoniae R6
auagggcuuuuuu

SEQ ID NO: 2202035 - RNA, 14 nt, Streptococcus pneumoniae R6
auagggaagguaug

SEQ ID NO: 2202036 - RNA, 15 nt, Streptococcus pneumoniae R6
auaggcgauaauuuc

SEQ ID NO: 2202037 - RNA, 19 nt, Streptococcus pneumoniae R6
auaggccucuucaaagaag

SEQ ID NO: 2202038 - RNA, 17 nt, Streptococcus pneumoniae R6
auaggccuuguggaaga

SEQ ID NO: 2202039 - RNA, 20 nt, Streptococcus pneumoniae R6
auaguaacgagucaaaaaag

SEQ ID NO: 2202040 - RNA, 14 nt, Streptococcus pneumoniae R6
auaguaaaaugaaa

SEQ ID NO: 2202041 - RNA, 19 nt, Streptococcus pneumoniae R6
auaguaaaaugaaauaaga

SEQ ID NO: 2202042 - RNA, 17 nt, Streptococcus pneumoniae R6
auaguaaaggacaccag

SEQ ID NO: 2202043 - RNA, 15 nt, Streptococcus pneumoniae R6
auaguaaacuucuuc

SEQ ID NO: 2202044 - RNA, 21 nt, Streptococcus pneumoniae R6
auaguaaacuucuucuuccau

SEQ ID NO: 2202045 - RNA, 22 nt, Streptococcus pneumoniae R6
auaguaccaguuaccauugacu

SEQ ID NO: 2202046 - RNA, 15 nt, Streptococcus pneumoniae R6
auaguacgaaacaau

SEQ ID NO: 2202047 - RNA, 21 nt, Streptococcus pneumoniae R6
auaguacgaaacaauugcuaa

SEQ ID NO: 2202048 - RNA, 22 nt, Streptococcus pneumoniae R6
auaguacgaaacaauugcuaaa

SEQ ID NO: 2202049 - RNA, 19 nt, Streptococcus pneumoniae R6
auaguacacaucuacuucu

SEQ ID NO: 2202050 - RNA, 13 nt, Streptococcus pneumoniae R6
auaguagccuuga

SEQ ID NO: 2202051 - RNA, 16 nt, Streptococcus pneumoniae R6
auaguagccuugacca

SEQ ID NO: 2202052 - RNA, 23 nt, Streptococcus pneumoniae R6
auagucauuccauggcugacaac

SEQ ID NO: 2202053 - RNA, 21 nt, Streptococcus pneumoniae R6
auagucauguagcgcuugaaa

SEQ ID NO: 2202054 - RNA, 15 nt, Streptococcus pneumoniae R6
auaguagccaauuga

SEQ ID NO: 2202055 - RNA, 17 nt, Streptococcus pneumoniae R6
auaguaucugaugcuga

SEQ ID NO: 2202056 - RNA, 19 nt, Streptococcus pneumoniae R6
auaguaucugaugcugaca

SEQ ID NO: 2202057 - RNA, 20 nt, Streptococcus pneumoniae R6
auaguaucugaugcugacaa

SEQ ID NO: 2202058 - RNA, 13 nt, Streptococcus pneumoniae R6
auaguaucaaaug

SEQ ID NO: 2202059 - RNA, 13 nt, Streptococcus pneumoniae R6
auaguaucaaguu

SEQ ID NO: 2202060 - RNA, 15 nt, Streptococcus pneumoniae R6
auaguaucagguguu

SEQ ID NO: 2202061 - RNA, 19 nt, Streptococcus pneumoniae R6
auaguauaagguaauuuuc

SEQ ID NO: 2202062 - RNA, 17 nt, Streptococcus pneumoniae R6
auaucauuuccaacaaa

SEQ ID NO: 2202063 - RNA, 13 nt, Streptococcus pneumoniae R6
auauccuaaaaaa

SEQ ID NO: 2202064 - RNA, 14 nt, Streptococcus pneumoniae R6
auauccuaaaaaag

SEQ ID NO: 2202065 - RNA, 15 nt, Streptococcus pneumoniae R6
auauccuaaaaaaga

SEQ ID NO: 2202066 - RNA, 18 nt, Streptococcus pneumoniae R6
auaucagauauucuaaaa

SEQ ID NO: 2202067 - RNA, 16 nt, Streptococcus pneumoniae R6
auaucaugcuuuacua

SEQ ID NO: 2202068 - RNA, 16 nt, Streptococcus pneumoniae R6
auaucaccaucaagga

SEQ ID NO: 2202069 - RNA, 23 nt, Streptococcus pneumoniae R6
auaucacgauacuguaguuuuuc

SEQ ID NO: 2202070 - RNA, 15 nt, Streptococcus pneumoniae R6
auauauaauuauaua

SEQ ID NO: 2202071 - RNA, 15 nt, Streptococcus pneumoniae R6
auauaugcacagaca

SEQ ID NO: 2202072 - RNA, 20 nt, Streptococcus pneumoniae R6
auauaugcacagacauauga

SEQ ID NO: 2202073 - RNA, 14 nt, Streptococcus pneumoniae R6
auauauaaaugaaa

SEQ ID NO: 2202074 - RNA, 12 nt, Streptococcus pneumoniae R6
auauauaaaaag

SEQ ID NO: 2202075 - RNA, 14 nt, Streptococcus pneumoniae R6
auaucaaucucugc

SEQ ID NO: 2202076 - RNA, 13 nt, Streptococcus pneumoniae R6
auaucaaguuuuc

SEQ ID NO: 2202077 - RNA, 15 nt, Streptococcus pneumoniae R6
auaucaagguuuuug

SEQ ID NO: 2202078 - RNA, 16 nt, Streptococcus pneumoniae R6
auaucaagguuuuugc

SEQ ID NO: 2202079 - RNA, 15 nt, Streptococcus pneumoniae R6
auauaguuuaaucaa

SEQ ID NO: 2202080 - RNA, 20 nt, Streptococcus pneumoniae R6
auauaguuaaaaaagauuug

SEQ ID NO: 2202081 - RNA, 16 nt, Streptococcus pneumoniae R6
auauaguagauugaaa

SEQ ID NO: 2202082 - RNA, 19 nt, Streptococcus pneumoniae R6
auauaguagauugaaauaa

SEQ ID NO: 2202083 - RNA, 22 nt, Streptococcus pneumoniae R6
auauaguagauugaaauaagau

SEQ ID NO: 2202084 - RNA, 22 nt, Streptococcus pneumoniae R6
auauagcauacugaauuuagaa

SEQ ID NO: 2202085 - RNA, 19 nt, Streptococcus pneumoniae R6
auauaauuguaggaaagaa

SEQ ID NO: 2202086 - RNA, 14 nt, Streptococcus pneumoniae R6
auauagaguauuuc

SEQ ID NO: 2202087 - RNA, 16 nt, Streptococcus pneumoniae R6
auauagagugacaggg

SEQ ID NO: 2202088 - RNA, 16 nt, Streptococcus pneumoniae R6
auauagauaaaaaaca

SEQ ID NO: 2202089 - RNA, 18 nt, Streptococcus pneumoniae R6
auagugugggacuccuac

SEQ ID NO: 2202090 - RNA, 19 nt, Streptococcus pneumoniae R6
auagugugggacuccuaca

SEQ ID NO: 2202091 - RNA, 14 nt, Streptococcus pneumoniae R6
auaguguuucucug

SEQ ID NO: 2202092 - RNA, 13 nt, Streptococcus pneumoniae R6
auaguuaaaaaag

SEQ ID NO: 2202093 - RNA, 15 nt, Streptococcus pneumoniae R6
auaguuaaaaaagau

SEQ ID NO: 2202094 - RNA, 22 nt, Streptococcus pneumoniae R6
auaguuaaaaaagauuugaaac

SEQ ID NO: 2202095 - RNA, 21 nt, Streptococcus pneumoniae R6
auagucuaauagauaguuaaa

SEQ ID NO: 2202096 - RNA, 19 nt, Streptococcus pneumoniae R6
auagucuacaauuucucgu

SEQ ID NO: 2202097 - RNA, 15 nt, Streptococcus pneumoniae R6
auagucuauaauggc

SEQ ID NO: 2202098 - RNA, 15 nt, Streptococcus pneumoniae R6
auagucccuuuauaa

SEQ ID NO: 2202099 - RNA, 20 nt, Streptococcus pneumoniae R6
auaguccagauaguggguuu

SEQ ID NO: 2202100 - RNA, 16 nt, Streptococcus pneumoniae R6
auaguuauagaguguu

SEQ ID NO: 2202101 - RNA, 22 nt, Streptococcus pneumoniae R6
auaguuacuccuuuuuugacuc

SEQ ID NO: 2202102 - RNA, 20 nt, Streptococcus pneumoniae R6
auaguuaggcauauaauggu

SEQ ID NO: 2202103 - RNA, 14 nt, Streptococcus pneumoniae R6
aucaaaaauagaaa

SEQ ID NO: 2202104 - RNA, 17 nt, Streptococcus pneumoniae R6
aucaaaaauagaaauaa

SEQ ID NO: 2202105 - RNA, 21 nt, Streptococcus pneumoniae R6
aucaaaaaccgcucagcugag

SEQ ID NO: 2202106 - RNA, 19 nt, Streptococcus pneumoniae R6
aucaaaaaaauucuucaca

SEQ ID NO: 2202107 - RNA, 16 nt, Streptococcus pneumoniae R6
auauuuuuuacuuuug

SEQ ID NO: 2202108 - RNA, 15 nt, Streptococcus pneumoniae R6
aucaaaaaaagaagu

SEQ ID NO: 2202109 - RNA, 15 nt, Streptococcus pneumoniae R6
auauuuuucaaauaa

SEQ ID NO: 2202110 - RNA, 17 nt, Streptococcus pneumoniae R6
auauuuuuccuucauca

SEQ ID NO: 2202111 - RNA, 19 nt, Streptococcus pneumoniae R6
auauuuuuccuucaucaaa

SEQ ID NO: 2202112 - RNA, 15 nt, Streptococcus pneumoniae R6
auauuucuucuuuuc

SEQ ID NO: 2202113 - RNA, 20 nt, Streptococcus pneumoniae R6
auauuucuuaauuguagcuu

SEQ ID NO: 2202114 - RNA, 19 nt, Streptococcus pneumoniae R6
auauucuuaucaaaucccu

SEQ ID NO: 2202115 - RNA, 19 nt, Streptococcus pneumoniae R6
auauuuaguacucuguaaa

SEQ ID NO: 2202116 - RNA, 12 nt, Streptococcus pneumoniae R6
auauuuacuaau

SEQ ID NO: 2202117 - RNA, 15 nt, Streptococcus pneumoniae R6
auauuuauagaaaau

SEQ ID NO: 2202118 - RNA, 15 nt, Streptococcus pneumoniae R6
auauuuauagaauuu

SEQ ID NO: 2202119 - RNA, 13 nt, Streptococcus pneumoniae R6
auauuuauccauu

SEQ ID NO: 2202120 - RNA, 15 nt, Streptococcus pneumoniae R6
auauuuauccauuca

SEQ ID NO: 2202121 - RNA, 22 nt, Streptococcus pneumoniae R6
auauuuaggggucaugacuagu

SEQ ID NO: 2202122 - RNA, 21 nt, Streptococcus pneumoniae R6
auauuuauuaauuucauuacu

SEQ ID NO: 2202123 - RNA, 12 nt, Streptococcus pneumoniae R6
auauuuauuaua

SEQ ID NO: 2202124 - RNA, 16 nt, Streptococcus pneumoniae R6
auauuucuagaaauua

SEQ ID NO: 2202125 - RNA, 20 nt, Streptococcus pneumoniae R6
aucaaauuuuauccaacuga

SEQ ID NO: 2202126 - RNA, 14 nt, Streptococcus pneumoniae R6
aucaaauugaaaua

SEQ ID NO: 2202127 - RNA, 17 nt, Streptococcus pneumoniae R6
aucaaauuuauucagac

SEQ ID NO: 2202128 - RNA, 22 nt, Streptococcus pneumoniae R6
aucaacaugagaauacaaaaau

SEQ ID NO: 2202129 - RNA, 13 nt, Streptococcus pneumoniae R6
aucaacuauucuu

SEQ ID NO: 2202130 - RNA, 16 nt, Streptococcus pneumoniae R6
aucaacuauucuuuuu

SEQ ID NO: 2202131 - RNA, 19 nt, Streptococcus pneumoniae R6
aucaacugcuguuuucaug

SEQ ID NO: 2202132 - RNA, 21 nt, Streptococcus pneumoniae R6
aucaacugcuguuuucauguu

SEQ ID NO: 2202133 - RNA, 22 nt, Streptococcus pneumoniae R6
aucaaaugacuaagcccaaaga

SEQ ID NO: 2202134 - RNA, 16 nt, Streptococcus pneumoniae R6
aucaaaucccuagcuc

SEQ ID NO: 2202135 - RNA, 18 nt, Streptococcus pneumoniae R6
aucaaaucgauaaagaag

SEQ ID NO: 2202136 - RNA, 19 nt, Streptococcus pneumoniae R6
aucaaaucgauaaagaaga

SEQ ID NO: 2202137 - RNA, 23 nt, Streptococcus pneumoniae R6
aucaaaguuuacgacacauucua

SEQ ID NO: 2202138 - RNA, 12 nt, Streptococcus pneumoniae R6
aucaaagagcaa

SEQ ID NO: 2202139 - RNA, 13 nt, Streptococcus pneumoniae R6
aucaaagagcaaa

SEQ ID NO: 2202140 - RNA, 20 nt, Streptococcus pneumoniae R6
aucaaagagcaaacuagaaa

SEQ ID NO: 2202141 - RNA, 17 nt, Streptococcus pneumoniae R6
aucaaagccaccauccu

SEQ ID NO: 2202142 - RNA, 18 nt, Streptococcus pneumoniae R6
aucaaaguagcucuuuug

SEQ ID NO: 2202143 - RNA, 16 nt, Streptococcus pneumoniae R6
aucaaaggucucuucu

SEQ ID NO: 2202144 - RNA, 17 nt, Streptococcus pneumoniae R6
aucaaaggucucuucuu

SEQ ID NO: 2202145 - RNA, 18 nt, Streptococcus pneumoniae R6
auauggauaauugaauau

SEQ ID NO: 2202146 - RNA, 21 nt, Streptococcus pneumoniae R6
auauggcacaaaagguucuuu

SEQ ID NO: 2202147 - RNA, 15 nt, Streptococcus pneumoniae R6
auauggaugauuuaa

SEQ ID NO: 2202148 - RNA, 23 nt, Streptococcus pneumoniae R6
auaugcuagugucauaguccuga

SEQ ID NO: 2202149 - RNA, 16 nt, Streptococcus pneumoniae R6
auauccucuucacugu

SEQ ID NO: 2202150 - RNA, 23 nt, Streptococcus pneumoniae R6
auauggugcguuuuuugauuaag

SEQ ID NO: 2202151 - RNA, 15 nt, Streptococcus pneumoniae R6
auaugguaauguucu

SEQ ID NO: 2202152 - RNA, 21 nt, Streptococcus pneumoniae R6
auaugguaggcuuuaucaagc

SEQ ID NO: 2202153 - RNA, 21 nt, Streptococcus pneumoniae R6
auauguaaacaguaauaaaga

SEQ ID NO: 2202154 - RNA, 20 nt, Streptococcus pneumoniae R6
auaugggcuuacaucaaaaa

SEQ ID NO: 2202155 - RNA, 23 nt, Streptococcus pneumoniae R6
auaugucuagccaguauuuuuag

SEQ ID NO: 2202156 - RNA, 19 nt, Streptococcus pneumoniae R6
auauuaccaaguuaaacaa

SEQ ID NO: 2202157 - RNA, 21 nt, Streptococcus pneumoniae R6
auauuagaugauuuuucuguu

SEQ ID NO: 2202158 - RNA, 13 nt, Streptococcus pneumoniae R6
auauuagcaaaaa

SEQ ID NO: 2202159 - RNA, 13 nt, Streptococcus pneumoniae R6
auauuaagaaucu

SEQ ID NO: 2202160 - RNA, 19 nt, Streptococcus pneumoniae R6
auauuaagaaucuuuucua

SEQ ID NO: 2202161 - RNA, 20 nt, Streptococcus pneumoniae R6
auauucguuggauauaggag

SEQ ID NO: 2202162 - RNA, 16 nt, Streptococcus pneumoniae R6
auauuagggcaaauaa

SEQ ID NO: 2202163 - RNA, 20 nt, Streptococcus pneumoniae R6
auauuagggcaaauaaaaag

SEQ ID NO: 2202164 - RNA, 15 nt, Streptococcus pneumoniae R6
auauuaguaaauaga

SEQ ID NO: 2202165 - RNA, 17 nt, Streptococcus pneumoniae R6
auauuaugcguuuuuca

SEQ ID NO: 2202166 - RNA, 20 nt, Streptococcus pneumoniae R6
auauuaugcguuuuucagau

SEQ ID NO: 2202167 - RNA, 23 nt, Streptococcus pneumoniae R6
auauuaugcguuuuuucugauuu

SEQ ID NO: 2202168 - RNA, 15 nt, Streptococcus pneumoniae R6
auauuauuucaaaga

SEQ ID NO: 2202169 - RNA, 15 nt, Streptococcus pneumoniae R6
aucacacuagcaauu

SEQ ID NO: 2202170 - RNA, 20 nt, Streptococcus pneumoniae R6
aucacagaccgacacaccau

SEQ ID NO: 2202171 - RNA, 14 nt, Streptococcus pneumoniae R6
aucacaguuuacaa

SEQ ID NO: 2202172 - RNA, 13 nt, Streptococcus pneumoniae R6
aucacauuguguu

SEQ ID NO: 2202173 - RNA, 18 nt, Streptococcus pneumoniae R6
aucacaucgucaagcagu

SEQ ID NO: 2202174 - RNA, 17 nt, Streptococcus pneumoniae R6
aucacaauuccuaagau

SEQ ID NO: 2202175 - RNA, 15 nt, Streptococcus pneumoniae R6
aucaauuucuucaca

SEQ ID NO: 2202176 - RNA, 12 nt, Streptococcus pneumoniae R6
aucaauuucuag

SEQ ID NO: 2202177 - RNA, 16 nt, Streptococcus pneumoniae R6
aucaauuucuagcaaa

SEQ ID NO: 2202178 - RNA, 23 nt, Streptococcus pneumoniae R6
aucaauuucuagcaaaguuuuag

SEQ ID NO: 2202179 - RNA, 22 nt, Streptococcus pneumoniae R6
aucaauuuguaucaccaagcau

SEQ ID NO: 2202180 - RNA, 23 nt, Streptococcus pneumoniae R6
aucaauuuguucguauccuauuu

SEQ ID NO: 2202181 - RNA, 23 nt, Streptococcus pneumoniae R6
aucaauuuuccuuuccuaaucga

SEQ ID NO: 2202182 - RNA, 19 nt, Streptococcus pneumoniae R6
aucaauuuuacaggaauau

SEQ ID NO: 2202183 - RNA, 19 nt, Streptococcus pneumoniae R6
aucaauuguaacuugaccu

SEQ ID NO: 2202184 - RNA, 18 nt, Streptococcus pneumoniae R6
aucaauugcuagcaaugg

SEQ ID NO: 2202185 - RNA, 22 nt, Streptococcus pneumoniae R6
aucaauugcugcaccuucaacu

SEQ ID NO: 2202186 - RNA, 12 nt, Streptococcus pneumoniae R6
aucacccaaaac

SEQ ID NO: 2202187 - RNA, 21 nt, Streptococcus pneumoniae R6
aucaccgaagucgaaaauaaa

SEQ ID NO: 2202188 - RNA, 13 nt, Streptococcus pneumoniae R6
aucaccaaucuua

SEQ ID NO: 2202189 - RNA, 21 nt, Streptococcus pneumoniae R6
aucacguugcuuauacucaau

SEQ ID NO: 2202190 - RNA, 17 nt, Streptococcus pneumoniae R6
aucacgugugaaaaccu

SEQ ID NO: 2202191 - RNA, 16 nt, Streptococcus pneumoniae R6
aucacguggagucuga

SEQ ID NO: 2202192 - RNA, 18 nt, Streptococcus pneumoniae R6
aucacgaauuucuuguuc

SEQ ID NO: 2202193 - RNA, 18 nt, Streptococcus pneumoniae R6
aucacgaaccuaauuaug

SEQ ID NO: 2202194 - RNA, 12 nt, Streptococcus pneumoniae R6
aucacucuaacu

SEQ ID NO: 2202195 - RNA, 15 nt, Streptococcus pneumoniae R6
aucacucaguuucug

SEQ ID NO: 2202196 - RNA, 12 nt, Streptococcus pneumoniae R6
aucacucaucug

SEQ ID NO: 2202197 - RNA, 15 nt, Streptococcus pneumoniae R6
aucacuccaaaaaua

SEQ ID NO: 2202198 - RNA, 13 nt, Streptococcus pneumoniae R6
aucacuccagcac

SEQ ID NO: 2202199 - RNA, 17 nt, Streptococcus pneumoniae R6
aucacuccagcacuggu

SEQ ID NO: 2202200 - RNA, 18 nt, Streptococcus pneumoniae R6
aucagcuaaaaauaacua

SEQ ID NO: 2202201 - RNA, 22 nt, Streptococcus pneumoniae R6
aucaggauuuuuucauggaugc

SEQ ID NO: 2202202 - RNA, 23 nt, Streptococcus pneumoniae R6
aucaggauuuuuucauggaugca

SEQ ID NO: 2202203 - RNA, 18 nt, Streptococcus pneumoniae R6
aucacuguuuuuuauccc

SEQ ID NO: 2202204 - RNA, 12 nt, Streptococcus pneumoniae R6
aucagaaaagua

SEQ ID NO: 2202205 - RNA, 13 nt, Streptococcus pneumoniae R6
aucagaaaaguaa

SEQ ID NO: 2202206 - RNA, 15 nt, Streptococcus pneumoniae R6
aucagaaaauaaaau

SEQ ID NO: 2202207 - RNA, 13 nt, Streptococcus pneumoniae R6
aucagcagagaaa

SEQ ID NO: 2202208 - RNA, 18 nt, Streptococcus pneumoniae R6
aaaacgcugcucaaaauc

SEQ ID NO: 2202209 - RNA, 13 nt, Streptococcus pneumoniae R6
aaaacgguugagc

SEQ ID NO: 2202210 - RNA, 15 nt, Streptococcus pneumoniae R6
aaaacgguaacaaaa

SEQ ID NO: 2202211 - RNA, 18 nt, Streptococcus pneumoniae R6
aaaacgguaacaaaacua

SEQ ID NO: 2202212 - RNA, 19 nt, Streptococcus pneumoniae R6
aaaacguaguuuuuuuugu

SEQ ID NO: 2202213 - RNA, 16 nt, Streptococcus pneumoniae R6
aucagucaaucuacuu

SEQ ID NO: 2202214 - RNA, 19 nt, Streptococcus pneumoniae R6
aucaguccuauuccuuuuu

SEQ ID NO: 2202215 - RNA, 17 nt, Streptococcus pneumoniae R6
aucaguucauuuuuccu

SEQ ID NO: 2202216 - RNA, 18 nt, Streptococcus pneumoniae R6
aucaguucauuuuuccuu

SEQ ID NO: 2202217 - RNA, 20 nt, Streptococcus pneumoniae R6
aucagguaggauuucuccug

SEQ ID NO: 2202218 - RNA, 13 nt, Streptococcus pneumoniae R6
aucaggucuuaua

SEQ ID NO: 2202219 - RNA, 16 nt, Streptococcus pneumoniae R6
aucaggucuuauagaa

SEQ ID NO: 2202220 - RNA, 16 nt, Streptococcus pneumoniae R6
aucaguaaucucaaaa

SEQ ID NO: 2202221 - RNA, 19 nt, Streptococcus pneumoniae R6
aucaguaaucucaaaacag

SEQ ID NO: 2202222 - RNA, 17 nt, Streptococcus pneumoniae R6
aucagggaguuguuuuu

SEQ ID NO: 2202223 - RNA, 14 nt, Streptococcus pneumoniae R6
caaguccaagccuu

SEQ ID NO: 2202224 - RNA, 14 nt, Streptococcus pneumoniae R6
caagucaacuugaa

SEQ ID NO: 2202225 - RNA, 22 nt, Streptococcus pneumoniae R6
caaguauuguaagaauuugauu

SEQ ID NO: 2202226 - RNA, 19 nt, Streptococcus pneumoniae R6
caaggauuucuuugaaauc

SEQ ID NO: 2202227 - RNA, 20 nt, Streptococcus pneumoniae R6
caaggauuucuuugaaaucu

SEQ ID NO: 2202228 - RNA, 13 nt, Streptococcus pneumoniae R6
caaggcaaagcug

SEQ ID NO: 2202229 - RNA, 18 nt, Streptococcus pneumoniae R6
caaggaguaccguucaua

SEQ ID NO: 2202230 - RNA, 16 nt, Streptococcus pneumoniae R6
caagcuugaaacaaau

SEQ ID NO: 2202231 - RNA, 18 nt, Streptococcus pneumoniae R6
caagcuugaaacaaauaa

SEQ ID NO: 2202232 - RNA, 13 nt, Streptococcus pneumoniae R6
caaguuaaaaaac

SEQ ID NO: 2202233 - RNA, 16 nt, Streptococcus pneumoniae R6
caaguguuuucacuuc

SEQ ID NO: 2202234 - RNA, 18 nt, Streptococcus pneumoniae R6
caaguggaauucauuuuc

SEQ ID NO: 2202235 - RNA, 23 nt, Streptococcus pneumoniae R6
caaguggaauucauuuucuuaaa

SEQ ID NO: 2202236 - RNA, 17 nt, Streptococcus pneumoniae R6
caaguggcauugcuuca

SEQ ID NO: 2202237 - RNA, 23 nt, Streptococcus pneumoniae R6
caagugcugcgucugcuccuccg

SEQ ID NO: 2202238 - RNA, 15 nt, Streptococcus pneumoniae R6
caagugcuaagauaa

SEQ ID NO: 2202239 - RNA, 21 nt, Streptococcus pneumoniae R6
caagucugacgcuggaaauaa

SEQ ID NO: 2202240 - RNA, 12 nt, Streptococcus pneumoniae R6
caagucugcaug

SEQ ID NO: 2202241 - RNA, 22 nt, Streptococcus pneumoniae R6
caagucuuaaaaucacaaaaac

SEQ ID NO: 2202242 - RNA, 16 nt, Streptococcus pneumoniae R6
caagucuucuugguau

SEQ ID NO: 2202243 - RNA, 18 nt, Streptococcus pneumoniae R6
caagucuuccgaauagcu

SEQ ID NO: 2202244 - RNA, 16 nt, Streptococcus pneumoniae R6
caagucuguauagacc

SEQ ID NO: 2202245 - RNA, 23 nt, Streptococcus pneumoniae R6
caagucuguauagaccugaucaa

SEQ ID NO: 2202246 - RNA, 14 nt, Streptococcus pneumoniae R6
caaguccagaaccg

SEQ ID NO: 2202247 - RNA, 18 nt, Streptococcus pneumoniae R6
caauaaaacgcauaauau

SEQ ID NO: 2202248 - RNA, 21 nt, Streptococcus pneumoniae R6
caauaaaacgcaucauaucaa

SEQ ID NO: 2202249 - RNA, 23 nt, Streptococcus pneumoniae R6
caauaaaauaugaucuauuguug

SEQ ID NO: 2202250 - RNA, 19 nt, Streptococcus pneumoniae R6
caauaaaaucaaacaaaag

SEQ ID NO: 2202251 - RNA, 11 nt, Streptococcus pneumoniae R6
caauaaaauau

SEQ ID NO: 2202252 - RNA, 10 nt, Streptococcus pneumoniae R6
caauaaaaua

SEQ ID NO: 2202253 - RNA, 18 nt, Streptococcus pneumoniae R6
caauaaaccaucguguag

SEQ ID NO: 2202254 - RNA, 13 nt, Streptococcus pneumoniae R6
caauaaacaucuc

SEQ ID NO: 2202255 - RNA, 15 nt, Streptococcus pneumoniae R6
caaguuucuuuauuc

SEQ ID NO: 2202256 - RNA, 13 nt, Streptococcus pneumoniae R6
caaguuuucacac

SEQ ID NO: 2202257 - RNA, 15 nt, Streptococcus pneumoniae R6
caaguuuucacaccu

SEQ ID NO: 2202258 - RNA, 15 nt, Streptococcus pneumoniae R6
caaguuugcaaaguu

SEQ ID NO: 2202259 - RNA, 22 nt, Streptococcus pneumoniae R6
caaguuuuagaugagaaagauu

SEQ ID NO: 2202260 - RNA, 12 nt, Streptococcus pneumoniae R6
caaguuaaauaa

SEQ ID NO: 2202261 - RNA, 13 nt, Streptococcus pneumoniae R6
caaguuaaauaau

SEQ ID NO: 2202262 - RNA, 16 nt, Streptococcus pneumoniae R6
caaguucacucaaacc

SEQ ID NO: 2202263 - RNA, 13 nt, Streptococcus pneumoniae R6
caaguucacucau

SEQ ID NO: 2202264 - RNA, 18 nt, Streptococcus pneumoniae R6
caauaauaaaacuuuuaa

SEQ ID NO: 2202265 - RNA, 21 nt, Streptococcus pneumoniae R6
caauaauaaaacuuuuaaaau

SEQ ID NO: 2202266 - RNA, 15 nt, Streptococcus pneumoniae R6
caauaauagaaaaca

SEQ ID NO: 2202267 - RNA, 17 nt, Streptococcus pneumoniae R6
caauaauuucuuuuugu

SEQ ID NO: 2202268 - RNA, 18 nt, Streptococcus pneumoniae R6
caauaaguccgaaaaauu

SEQ ID NO: 2202269 - RNA, 12 nt, Streptococcus pneumoniae R6
caauaaagauaa

SEQ ID NO: 2202270 - RNA, 20 nt, Streptococcus pneumoniae R6
caauaagcccgaaaaauuuc

SEQ ID NO: 2202271 - RNA, 13 nt, Streptococcus pneumoniae R6
caauacaggaaaa

SEQ ID NO: 2202272 - RNA, 19 nt, Streptococcus pneumoniae R6
caauacuacaauaauuggu

SEQ ID NO: 2202273 - RNA, 23 nt, Streptococcus pneumoniae R6
caauauagccuaagacaaccaaa

SEQ ID NO: 2202274 - RNA, 20 nt, Streptococcus pneumoniae R6
caauauagucuacaauagcu

SEQ ID NO: 2202275 - RNA, 22 nt, Streptococcus pneumoniae R6
caauauagugaaauuaacaaaa

SEQ ID NO: 2202276 - RNA, 14 nt, Streptococcus pneumoniae R6
caauauauccaaaa

SEQ ID NO: 2202277 - RNA, 15 nt, Streptococcus pneumoniae R6
caauaucaaaaccaa

SEQ ID NO: 2202278 - RNA, 17 nt, Streptococcus pneumoniae R6
caauaucguaucuuugg

SEQ ID NO: 2202279 - RNA, 15 nt, Streptococcus pneumoniae R6
caaucaaucguccuu

SEQ ID NO: 2202280 - RNA, 14 nt, Streptococcus pneumoniae R6
caaucaauuuaauc

SEQ ID NO: 2202281 - RNA, 13 nt, Streptococcus pneumoniae R6
caauaucuucugc

SEQ ID NO: 2202282 - RNA, 16 nt, Streptococcus pneumoniae R6
caauaucuuuaaagcu

SEQ ID NO: 2202283 - RNA, 23 nt, Streptococcus pneumoniae R6
caauaucuuuauugaugaagucu

SEQ ID NO: 2202284 - RNA, 12 nt, Streptococcus pneumoniae R6
caauauuuuuga

SEQ ID NO: 2202285 - RNA, 15 nt, Streptococcus pneumoniae R6
caauauuuuugagcc

SEQ ID NO: 2202286 - RNA, 15 nt, Streptococcus pneumoniae R6
caaucaacuuccaug

SEQ ID NO: 2202287 - RNA, 14 nt, Streptococcus pneumoniae R6
caaucaaauucauu

SEQ ID NO: 2202288 - RNA, 21 nt, Streptococcus pneumoniae R6
caaucaaauugugcaguuuuc

SEQ ID NO: 2202289 - RNA, 17 nt, Streptococcus pneumoniae R6
caaucagacuauaauau

SEQ ID NO: 2202290 - RNA, 16 nt, Streptococcus pneumoniae R6
caaucauagauucacc

SEQ ID NO: 2202291 - RNA, 12 nt, Streptococcus pneumoniae R6
caauccaauugu

SEQ ID NO: 2202292 - RNA, 14 nt, Streptococcus pneumoniae R6
caauccacggcuca

SEQ ID NO: 2202293 - RNA, 17 nt, Streptococcus pneumoniae R6
caaucgauuuguucuca

SEQ ID NO: 2202294 - RNA, 22 nt, Streptococcus pneumoniae R6
caaucgauuuguucucaucuua

SEQ ID NO: 2202295 - RNA, 14 nt, Streptococcus pneumoniae R6
caauccuuuucuga

SEQ ID NO: 2202296 - RNA, 16 nt, Streptococcus pneumoniae R6
caaucccaagcccugc

SEQ ID NO: 2202297 - RNA, 14 nt, Streptococcus pneumoniae R6
caaucguuucaagu

SEQ ID NO: 2202298 - RNA, 18 nt, Streptococcus pneumoniae R6
caaucuauuuaugaaaaa

SEQ ID NO: 2202299 - RNA, 19 nt, Streptococcus pneumoniae R6
caaucuauuuaugaaaaag

SEQ ID NO: 2202300 - RNA, 19 nt, Streptococcus pneumoniae R6
caaucuggaggcuuuuucu

SEQ ID NO: 2202301 - RNA, 13 nt, Streptococcus pneumoniae R6
caagagaaaucau

SEQ ID NO: 2202302 - RNA, 13 nt, Streptococcus pneumoniae R6
caagagaaaacca

SEQ ID NO: 2202303 - RNA, 15 nt, Streptococcus pneumoniae R6
caagagaaaaccaaa

SEQ ID NO: 2202304 - RNA, 16 nt, Streptococcus pneumoniae R6
caagagaaaaccaaaa

SEQ ID NO: 2202305 - RNA, 21 nt, Streptococcus pneumoniae R6
caagacuuuuugagccaagcg

SEQ ID NO: 2202306 - RNA, 19 nt, Streptococcus pneumoniae R6
caagacuuucaauucuuca

SEQ ID NO: 2202307 - RNA, 23 nt, Streptococcus pneumoniae R6
caagaccgagaaacaagaacucu

SEQ ID NO: 2202308 - RNA, 13 nt, Streptococcus pneumoniae R6
caagaccauggcg

SEQ ID NO: 2202309 - RNA, 17 nt, Streptococcus pneumoniae R6
caagaccauuuccaucu

SEQ ID NO: 2202310 - RNA, 18 nt, Streptococcus pneumoniae R6
caagagaccuuucauaaa

SEQ ID NO: 2202311 - RNA, 20 nt, Streptococcus pneumoniae R6
caagagacgauuccaaacaa

SEQ ID NO: 2202312 - RNA, 14 nt, Streptococcus pneumoniae R6
caagagacucuuua

SEQ ID NO: 2202313 - RNA, 23 nt, Streptococcus pneumoniae R6
caagagcaccgcggauguuauac

SEQ ID NO: 2202314 - RNA, 23 nt, Streptococcus pneumoniae R6
caagagauuuucaaaaaaagcug

SEQ ID NO: 2202315 - RNA, 16 nt, Streptococcus pneumoniae R6
caagagcaaaaacaau

SEQ ID NO: 2202316 - RNA, 23 nt, Streptococcus pneumoniae R6
caagauccaauccuuuucuuuua

SEQ ID NO: 2202317 - RNA, 14 nt, Streptococcus pneumoniae R6
caagauagcuguga

SEQ ID NO: 2202318 - RNA, 17 nt, Streptococcus pneumoniae R6
caagauaguaaagagcu

SEQ ID NO: 2202319 - RNA, 16 nt, Streptococcus pneumoniae R6
caagauagaacuauga

SEQ ID NO: 2202320 - RNA, 18 nt, Streptococcus pneumoniae R6
caagauagagagcuccaa

SEQ ID NO: 2202321 - RNA, 16 nt, Streptococcus pneumoniae R6
caagauauucuugauu

SEQ ID NO: 2202322 - RNA, 16 nt, Streptococcus pneumoniae R6
caagaccaauccuaug

SEQ ID NO: 2202323 - RNA, 14 nt, Streptococcus pneumoniae R6
caagacaaaaacuc

SEQ ID NO: 2202324 - RNA, 17 nt, Streptococcus pneumoniae R6
caagaagguuucaugug

SEQ ID NO: 2202325 - RNA, 19 nt, Streptococcus pneumoniae R6
caagcguuuuucuucugua

SEQ ID NO: 2202326 - RNA, 13 nt, Streptococcus pneumoniae R6
caagcuaucagag

SEQ ID NO: 2202327 - RNA, 14 nt, Streptococcus pneumoniae R6
caagcgaagggcuu

SEQ ID NO: 2202328 - RNA, 16 nt, Streptococcus pneumoniae R6
caagcgaacaucucca

SEQ ID NO: 2202329 - RNA, 17 nt, Streptococcus pneumoniae R6
caagcgaacaucuccaa

SEQ ID NO: 2202330 - RNA, 18 nt, Streptococcus pneumoniae R6
caagcgaacaucuccaac

SEQ ID NO: 2202331 - RNA, 19 nt, Streptococcus pneumoniae R6
caagccuuauugcucuuga

SEQ ID NO: 2202332 - RNA, 14 nt, Streptococcus pneumoniae R6
caagccuuacucuu

SEQ ID NO: 2202333 - RNA, 15 nt, Streptococcus pneumoniae R6
caagccuagucuucu

SEQ ID NO: 2202334 - RNA, 23 nt, Streptococcus pneumoniae R6
caagccugcuaucuuuuuuugau

SEQ ID NO: 2202335 - RNA, 21 nt, Streptococcus pneumoniae R6
caagcauuuucauaaggaagu

SEQ ID NO: 2202336 - RNA, 16 nt, Streptococcus pneumoniae R6
caagcccuuauuucca

SEQ ID NO: 2202337 - RNA, 20 nt, Streptococcus pneumoniae R6
caagcauaacagcauuucca

SEQ ID NO: 2202338 - RNA, 19 nt, Streptococcus pneumoniae R6
caacgugauuagauaagag

SEQ ID NO: 2202339 - RNA, 21 nt, Streptococcus pneumoniae R6
caacuagauuucugaauaucc

SEQ ID NO: 2202340 - RNA, 21 nt, Streptococcus pneumoniae R6
caacucagcauuuucuuuuug

SEQ ID NO: 2202341 - RNA, 21 nt, Streptococcus pneumoniae R6
caacucaauuucagaagaaaa

SEQ ID NO: 2202342 - RNA, 13 nt, Streptococcus pneumoniae R6
caacuauucuuuu

SEQ ID NO: 2202343 - RNA, 15 nt, Streptococcus pneumoniae R6
caacuauucuuuuuc

SEQ ID NO: 2202344 - RNA, 18 nt, Streptococcus pneumoniae R6
caacgucuucaauaccaa

SEQ ID NO: 2202345 - RNA, 20 nt, Streptococcus pneumoniae R6
caacgucuuuugccuuagca

SEQ ID NO: 2202346 - RNA, 16 nt, Streptococcus pneumoniae R6
caacucgggcugaaua

SEQ ID NO: 2202347 - RNA, 20 nt, Streptococcus pneumoniae R6
caacucuuauacuuuucucu

SEQ ID NO: 2202348 - RNA, 22 nt, Streptococcus pneumoniae R6
caacucuauuuuugagcagaac

SEQ ID NO: 2202349 - RNA, 15 nt, Streptococcus pneumoniae R6
caacuuauaaaaaac

SEQ ID NO: 2202350 - RNA, 21 nt, Streptococcus pneumoniae R6
caacuuauaaaaaacacaaaa

SEQ ID NO: 2202351 - RNA, 23 nt, Streptococcus pneumoniae R6
caacuuacauuugaguuucucuu

SEQ ID NO: 2202352 - RNA, 21 nt, Streptococcus pneumoniae R6
caacuuaucuagggcauuaau

SEQ ID NO: 2202353 - RNA, 23 nt, Streptococcus pneumoniae R6
caacuggcauccccagcucaaga

SEQ ID NO: 2202354 - RNA, 23 nt, Streptococcus pneumoniae R6
caacuggagacuuucguuccaga

SEQ ID NO: 2202355 - RNA, 22 nt, Streptococcus pneumoniae R6
caacugcuucuaagaucugguu

SEQ ID NO: 2202356 - RNA, 21 nt, Streptococcus pneumoniae R6
caacugcuguuuucauguucc

SEQ ID NO: 2202357 - RNA, 22 nt, Streptococcus pneumoniae R6
caacgguaucuugaauauuuuu

SEQ ID NO: 2202358 - RNA, 14 nt, Streptococcus pneumoniae R6
caacgcgugauuug

SEQ ID NO: 2202359 - RNA, 15 nt, Streptococcus pneumoniae R6
caaaucucauuugau

SEQ ID NO: 2202360 - RNA, 22 nt, Streptococcus pneumoniae R6
caaaucuacuggcaaauuuucu

SEQ ID NO: 2202361 - RNA, 23 nt, Streptococcus pneumoniae R6
caaaugaauuucuacaaauguuu

SEQ ID NO: 2202362 - RNA, 22 nt, Streptococcus pneumoniae R6
caaaugaaauauuuuuuacuuu

SEQ ID NO: 2202363 - RNA, 14 nt, Streptococcus pneumoniae R6
caaauguauuugaa

SEQ ID NO: 2202364 - RNA, 15 nt, Streptococcus pneumoniae R6
caaauuuauaaaucu

SEQ ID NO: 2202365 - RNA, 19 nt, Streptococcus pneumoniae R6
caaauuuauaaaucuucua

SEQ ID NO: 2202366 - RNA, 16 nt, Streptococcus pneumoniae R6
caaauuuauacuaaua

SEQ ID NO: 2202367 - RNA, 15 nt, Streptococcus pneumoniae R6
caaauuuagcaauga

SEQ ID NO: 2202368 - RNA, 18 nt, Streptococcus pneumoniae R6
caaauuucauauuuucag

SEQ ID NO: 2202369 - RNA, 16 nt, Streptococcus pneumoniae R6
caaauuguaaggauuu

SEQ ID NO: 2202370 - RNA, 14 nt, Streptococcus pneumoniae R6
caaauuuaccaaug

SEQ ID NO: 2202371 - RNA, 16 nt, Streptococcus pneumoniae R6
caaauucaccaauuuu

SEQ ID NO: 2202372 - RNA, 12 nt, Streptococcus pneumoniae R6
caaagucugaaa

SEQ ID NO: 2202373 - RNA, 22 nt, Streptococcus pneumoniae R6
caaaguccucccaccaaacuuu

SEQ ID NO: 2202374 - RNA, 15 nt, Streptococcus pneumoniae R6
caaaguccuuacuca

SEQ ID NO: 2202375 - RNA, 18 nt, Streptococcus pneumoniae R6
caaagggaaaucugaaaa

SEQ ID NO: 2202376 - RNA, 22 nt, Streptococcus pneumoniae R6
caaaguacugccuugagguuuu

SEQ ID NO: 2202377 - RNA, 23 nt, Streptococcus pneumoniae R6
caaaguacuugagaaucuuaugc

SEQ ID NO: 2202378 - RNA, 16 nt, Streptococcus pneumoniae R6
caaaguauuaaaauaa

SEQ ID NO: 2202379 - RNA, 20 nt, Streptococcus pneumoniae R6
caaagggaugauguuaucaa

SEQ ID NO: 2202380 - RNA, 21 nt, Streptococcus pneumoniae R6
caaauaucuucggauuuuucu

SEQ ID NO: 2202381 - RNA, 19 nt, Streptococcus pneumoniae R6
caaauauucaccacaugac

SEQ ID NO: 2202382 - RNA, 16 nt, Streptococcus pneumoniae R6
caaaucgauaaagaag

SEQ ID NO: 2202383 - RNA, 16 nt, Streptococcus pneumoniae R6
caaaucccaugacaau

SEQ ID NO: 2202384 - RNA, 23 nt, Streptococcus pneumoniae R6
caaaucccaugacaaucauuuca

SEQ ID NO: 2202385 - RNA, 20 nt, Streptococcus pneumoniae R6
caaaucagaaaaguaacuau

SEQ ID NO: 2202386 - RNA, 22 nt, Streptococcus pneumoniae R6
caaaucagccauugaaaauccu

SEQ ID NO: 2202387 - RNA, 12 nt, Streptococcus pneumoniae R6
caaaucaacugg

SEQ ID NO: 2202388 - RNA, 14 nt, Streptococcus pneumoniae R6
caaaucauccgaag

SEQ ID NO: 2202389 - RNA, 14 nt, Streptococcus pneumoniae R6
caacauuguuugua

SEQ ID NO: 2202390 - RNA, 14 nt, Streptococcus pneumoniae R6
caaccaggucaucu

SEQ ID NO: 2202391 - RNA, 19 nt, Streptococcus pneumoniae R6
caacauuauccaugaaaaa

SEQ ID NO: 2202392 - RNA, 21 nt, Streptococcus pneumoniae R6
caacccucucuucaaauuuga

SEQ ID NO: 2202393 - RNA, 23 nt, Streptococcus pneumoniae R6
caacccucucuucaaauuugacu

SEQ ID NO: 2202394 - RNA, 14 nt, Streptococcus pneumoniae R6
caaccauuuucuca

SEQ ID NO: 2202395 - RNA, 13 nt, Streptococcus pneumoniae R6
caacccacuacag

SEQ ID NO: 2202396 - RNA, 12 nt, Streptococcus pneumoniae R6
caaccaguugcc

SEQ ID NO: 2202397 - RNA, 14 nt, Streptococcus pneumoniae R6
caaccaucaaaaua

SEQ ID NO: 2202398 - RNA, 23 nt, Streptococcus pneumoniae R6
caacaucuuuccagaacuucaau

SEQ ID NO: 2202399 - RNA, 19 nt, Streptococcus pneumoniae R6
caacaaaucuuccuagaau

SEQ ID NO: 2202400 - RNA, 19 nt, Streptococcus pneumoniae R6
caaaaucgagguauuucuu

SEQ ID NO: 2202401 - RNA, 22 nt, Streptococcus pneumoniae R6
caaaauccgcuugggaaaccaa

SEQ ID NO: 2202402 - RNA, 15 nt, Streptococcus pneumoniae R6
caaaauccuugacca

SEQ ID NO: 2202403 - RNA, 14 nt, Streptococcus pneumoniae R6
caaaauaguucuca

SEQ ID NO: 2202404 - RNA, 23 nt, Streptococcus pneumoniae R6
caaaauaguucucaaccacaaaa

SEQ ID NO: 2202405 - RNA, 20 nt, Streptococcus pneumoniae R6
caaaauaggcuccauaauau

SEQ ID NO: 2202406 - RNA, 20 nt, Streptococcus pneumoniae R6
caaaauuagcucaaaacacu

SEQ ID NO: 2202407 - RNA, 14 nt, Streptococcus pneumoniae R6
caaaauuccuaaaa

SEQ ID NO: 2202408 - RNA, 17 nt, Streptococcus pneumoniae R6
caaaauuccuaaaauaa

SEQ ID NO: 2202409 - RNA, 12 nt, Streptococcus pneumoniae R6
caaacaaaaaac

SEQ ID NO: 2202410 - RNA, 23 nt, Streptococcus pneumoniae R6
caaacaaaaaaccccagcauaaa

SEQ ID NO: 2202411 - RNA, 15 nt, Streptococcus pneumoniae R6
caaaauguucaguuu

SEQ ID NO: 2202412 - RNA, 15 nt, Streptococcus pneumoniae R6
caaaagucgaguuca

SEQ ID NO: 2202413 - RNA, 16 nt, Streptococcus pneumoniae R6
caaaaguccaaagaug

SEQ ID NO: 2202414 - RNA, 17 nt, Streptococcus pneumoniae R6
caaaaguccaaagauga

SEQ ID NO: 2202415 - RNA, 11 nt, Streptococcus pneumoniae R6
caaaauaauuu

SEQ ID NO: 2202416 - RNA, 20 nt, Streptococcus pneumoniae R6
caaaauacuagauucuauuu

SEQ ID NO: 2202417 - RNA, 19 nt, Streptococcus pneumoniae R6
caaaagcuuguuuaaaauc

SEQ ID NO: 2202418 - RNA, 20 nt, Streptococcus pneumoniae R6
caaaagcuuguuuaaaaucu

SEQ ID NO: 2202419 - RNA, 12 nt, Streptococcus pneumoniae R6
caaaagccugag

SEQ ID NO: 2202420 - RNA, 17 nt, Streptococcus pneumoniae R6
caaaagccugagaagac

SEQ ID NO: 2202421 - RNA, 19 nt, Streptococcus pneumoniae R6
caaaagcguguaggaaacc

SEQ ID NO: 2202422 - RNA, 21 nt, Streptococcus pneumoniae R6
caaaagcguguaggaaaccaa

SEQ ID NO: 2202423 - RNA, 17 nt, Streptococcus pneumoniae R6
caaaacgagucaagaag

SEQ ID NO: 2202424 - RNA, 17 nt, Streptococcus pneumoniae R6
caaaacuaacccuagaa

SEQ ID NO: 2202425 - RNA, 22 nt, Streptococcus pneumoniae R6
caaaacuaauucacgaacauga

SEQ ID NO: 2202426 - RNA, 14 nt, Streptococcus pneumoniae R6
caaaacuaauuuag

SEQ ID NO: 2202427 - RNA, 19 nt, Streptococcus pneumoniae R6
caaaacgcugcucaaaauc

SEQ ID NO: 2202428 - RNA, 22 nt, Streptococcus pneumoniae R6
caaaacgguugagcauguaguc

SEQ ID NO: 2202429 - RNA, 13 nt, Streptococcus pneumoniae R6
caaaacuuuuuaa

SEQ ID NO: 2202430 - RNA, 14 nt, Streptococcus pneumoniae R6
caaaacuuuuuaaa

SEQ ID NO: 2202431 - RNA, 19 nt, Streptococcus pneumoniae R6
caaaacuuuuuaaaaaauc

SEQ ID NO: 2202432 - RNA, 15 nt, Streptococcus pneumoniae R6
caaaacuuucauaau

SEQ ID NO: 2202433 - RNA, 18 nt, Streptococcus pneumoniae R6
caaaagaaagcauagaga

SEQ ID NO: 2202434 - RNA, 19 nt, Streptococcus pneumoniae R6
caaaacuauaaaugaugaa

SEQ ID NO: 2202435 - RNA, 14 nt, Streptococcus pneumoniae R6
caaaacuauauucu

SEQ ID NO: 2202436 - RNA, 14 nt, Streptococcus pneumoniae R6
caaaacucaagguc

SEQ ID NO: 2202437 - RNA, 21 nt, Streptococcus pneumoniae R6
caaaacuguaaaguagcaaaa

SEQ ID NO: 2202438 - RNA, 17 nt, Streptococcus pneumoniae R6
caaaacugguccagaga

SEQ ID NO: 2202439 - RNA, 14 nt, Streptococcus pneumoniae R6
caaaagcagaggca

SEQ ID NO: 2202440 - RNA, 20 nt, Streptococcus pneumoniae R6
caaaagcaggaguuuucccu

SEQ ID NO: 2202441 - RNA, 16 nt, Streptococcus pneumoniae R6
caaaagauagaugauu

SEQ ID NO: 2202442 - RNA, 18 nt, Streptococcus pneumoniae R6
caaaagaccguuugaaaa

SEQ ID NO: 2202443 - RNA, 22 nt, Streptococcus pneumoniae R6
caaaagaccguuugaaaaagcg

SEQ ID NO: 2202444 - RNA, 20 nt, Streptococcus pneumoniae R6
caaacaaaucagccauugaa

SEQ ID NO: 2202445 - RNA, 14 nt, Streptococcus pneumoniae R6
caaacaacaauacu

SEQ ID NO: 2202446 - RNA, 20 nt, Streptococcus pneumoniae R6
caaacaacaauacuuuccaa

SEQ ID NO: 2202447 - RNA, 20 nt, Streptococcus pneumoniae R6
caaacaaggugaacuugacc

SEQ ID NO: 2202448 - RNA, 17 nt, Streptococcus pneumoniae R6
caaaccaaacagucuca

SEQ ID NO: 2202449 - RNA, 16 nt, Streptococcus pneumoniae R6
caaaccaacauagaua

SEQ ID NO: 2202450 - RNA, 15 nt, Streptococcus pneumoniae R6
caaaccaauuucuaa

SEQ ID NO: 2202451 - RNA, 21 nt, Streptococcus pneumoniae R6
caaaccugauaggaugcguuu

SEQ ID NO: 2202452 - RNA, 16 nt, Streptococcus pneumoniae R6
caaaccgcgucagcuu

SEQ ID NO: 2202453 - RNA, 18 nt, Streptococcus pneumoniae R6
caaaccguccucuucagc

SEQ ID NO: 2202454 - RNA, 19 nt, Streptococcus pneumoniae R6
caaaccguguucugucaug

SEQ ID NO: 2202455 - RNA, 21 nt, Streptococcus pneumoniae R6
caaaccguguucugucaugcg

SEQ ID NO: 2202456 - RNA, 21 nt, Streptococcus pneumoniae R6
caaaccaugagguaagagaac

SEQ ID NO: 2202457 - RNA, 19 nt, Streptococcus pneumoniae R6
caaacuguccacaaagaua

SEQ ID NO: 2202458 - RNA, 19 nt, Streptococcus pneumoniae R6
caaacuucuaaggaaaaag

SEQ ID NO: 2202459 - RNA, 15 nt, Streptococcus pneumoniae R6
caaacuuguacuuga

SEQ ID NO: 2202460 - RNA, 19 nt, Streptococcus pneumoniae R6
caaacuuuccaauauguuc

SEQ ID NO: 2202461 - RNA, 19 nt, Streptococcus pneumoniae R6
caaacgaauguuguuacua

SEQ ID NO: 2202462 - RNA, 12 nt, Streptococcus pneumoniae R6
caaacggauuuu

SEQ ID NO: 2202463 - RNA, 13 nt, Streptococcus pneumoniae R6
caaagacaaggga

SEQ ID NO: 2202464 - RNA, 14 nt, Streptococcus pneumoniae R6
caaagacaagggau

SEQ ID NO: 2202465 - RNA, 14 nt, Streptococcus pneumoniae R6
caaagacaaagguc

SEQ ID NO: 2202466 - RNA, 14 nt, Streptococcus pneumoniae R6
caaagaaaaagaag

SEQ ID NO: 2202467 - RNA, 15 nt, Streptococcus pneumoniae R6
caaagaaaaaacaaa

SEQ ID NO: 2202468 - RNA, 12 nt, Streptococcus pneumoniae R6
caaagaaaaaag

SEQ ID NO: 2202469 - RNA, 16 nt, Streptococcus pneumoniae R6
caaagaaaaaagcugu

SEQ ID NO: 2202470 - RNA, 18 nt, Streptococcus pneumoniae R6
caaagaccuuugaaaacu

SEQ ID NO: 2202471 - RNA, 20 nt, Streptococcus pneumoniae R6
caaagaccaccucaucuuga

SEQ ID NO: 2202472 - RNA, 17 nt, Streptococcus pneumoniae R6
caaagacuggguguuug

SEQ ID NO: 2202473 - RNA, 22 nt, Streptococcus pneumoniae R6
caaagacuuauacucuucaaaa

SEQ ID NO: 2202474 - RNA, 13 nt, Streptococcus pneumoniae R6
caaagacuucuug

SEQ ID NO: 2202475 - RNA, 15 nt, Streptococcus pneumoniae R6
caaagacuucuugag

SEQ ID NO: 2202476 - RNA, 19 nt, Streptococcus pneumoniae R6
caaagauuaaucuucaaau

SEQ ID NO: 2202477 - RNA, 15 nt, Streptococcus pneumoniae R6
caaagccggguuuuc

SEQ ID NO: 2202478 - RNA, 22 nt, Streptococcus pneumoniae R6
caaagcgggugacgagaaucga

SEQ ID NO: 2202479 - RNA, 22 nt, Streptococcus pneumoniae R6
caaaggauuuaguucuguacug

SEQ ID NO: 2202480 - RNA, 20 nt, Streptococcus pneumoniae R6
caaaggcuuuuucuucuucg

SEQ ID NO: 2202481 - RNA, 14 nt, Streptococcus pneumoniae R6
caccaguagacuug

SEQ ID NO: 2202482 - RNA, 16 nt, Streptococcus pneumoniae R6
cacccauaauaucaua

SEQ ID NO: 2202483 - RNA, 16 nt, Streptococcus pneumoniae R6
caccccacgaaggaca

SEQ ID NO: 2202484 - RNA, 16 nt, Streptococcus pneumoniae R6
cacccugcaugagcug

SEQ ID NO: 2202485 - RNA, 14 nt, Streptococcus pneumoniae R6
caccgaccaauucu

SEQ ID NO: 2202486 - RNA, 23 nt, Streptococcus pneumoniae R6
caccgagaaaggcgacaucaucc

SEQ ID NO: 2202487 - RNA, 16 nt, Streptococcus pneumoniae R6
caccuaguacaaagaa

SEQ ID NO: 2202488 - RNA, 17 nt, Streptococcus pneumoniae R6
caccuaguccaagacgu

SEQ ID NO: 2202489 - RNA, 21 nt, Streptococcus pneumoniae R6
caccuaguccaagacguucaa

SEQ ID NO: 2202490 - RNA, 14 nt, Streptococcus pneumoniae R6
caccuauuaacaau

SEQ ID NO: 2202491 - RNA, 23 nt, Streptococcus pneumoniae R6
caccuauucuaaguccaucacua

SEQ ID NO: 2202492 - RNA, 14 nt, Streptococcus pneumoniae R6
caccguuuuuguag

SEQ ID NO: 2202493 - RNA, 13 nt, Streptococcus pneumoniae R6
aaaauaacacucc

SEQ ID NO: 2202494 - RNA, 13 nt, Streptococcus pneumoniae R6
cacggacuucugc

SEQ ID NO: 2202495 - RNA, 13 nt, Streptococcus pneumoniae R6
cacggauuaagag

SEQ ID NO: 2202496 - RNA, 17 nt, Streptococcus pneumoniae R6
aaaauagggcaugccaa

SEQ ID NO: 2202497 - RNA, 16 nt, Streptococcus pneumoniae R6
aaaauaguacgaaaca

SEQ ID NO: 2202498 - RNA, 19 nt, Streptococcus pneumoniae R6
aaaauaguacgaaacaauu

SEQ ID NO: 2202499 - RNA, 15 nt, Streptococcus pneumoniae R6
aaaauaggcagaaca

SEQ ID NO: 2202500 - RNA, 12 nt, Streptococcus pneumoniae R6
aaaauaggcucc

SEQ ID NO: 2202501 - RNA, 16 nt, Streptococcus pneumoniae R6
cacgggggaaaucaua

SEQ ID NO: 2202502 - RNA, 23 nt, Streptococcus pneumoniae R6
cacgauuaucuagucgaagcuuc

SEQ ID NO: 2202503 - RNA, 15 nt, Streptococcus pneumoniae R6
cacgauuggggucag

SEQ ID NO: 2202504 - RNA, 21 nt, Streptococcus pneumoniae R6
aaaauacaguauccacauucg

SEQ ID NO: 2202505 - RNA, 14 nt, Streptococcus pneumoniae R6
aaaauacaaaccaa

SEQ ID NO: 2202506 - RNA, 13 nt, Streptococcus pneumoniae R6
aaaauacaucuau

SEQ ID NO: 2202507 - RNA, 15 nt, Streptococcus pneumoniae R6
aaaauaauuuugauu

SEQ ID NO: 2202508 - RNA, 21 nt, Streptococcus pneumoniae R6
aaaauaauuaaaaugugauuu

SEQ ID NO: 2202509 - RNA, 15 nt, Streptococcus pneumoniae R6
caccuguugcuggca

SEQ ID NO: 2202510 - RNA, 21 nt, Streptococcus pneumoniae R6
caccuguugcuggcaagauuu

SEQ ID NO: 2202511 - RNA, 13 nt, Streptococcus pneumoniae R6
aaaauacgcaaaa

SEQ ID NO: 2202512 - RNA, 17 nt, Streptococcus pneumoniae R6
caccuuaucacgaauuu

SEQ ID NO: 2202513 - RNA, 15 nt, Streptococcus pneumoniae R6
caccugcuacagaga

SEQ ID NO: 2202514 - RNA, 21 nt, Streptococcus pneumoniae R6
cacgaauuucuuguucaacca

SEQ ID NO: 2202515 - RNA, 19 nt, Streptococcus pneumoniae R6
cacgaccagaaaaucauug

SEQ ID NO: 2202516 - RNA, 18 nt, Streptococcus pneumoniae R6
cacgagccaagacuuuuu

SEQ ID NO: 2202517 - RNA, 12 nt, Streptococcus pneumoniae R6
cacauuuucaau

SEQ ID NO: 2202518 - RNA, 13 nt, Streptococcus pneumoniae R6
cacauucauacca

SEQ ID NO: 2202519 - RNA, 16 nt, Streptococcus pneumoniae R6
cacauucccauucccu

SEQ ID NO: 2202520 - RNA, 13 nt, Streptococcus pneumoniae R6
caccaaacaaauc

SEQ ID NO: 2202521 - RNA, 21 nt, Streptococcus pneumoniae R6
caccaaacuuucccuucgucu

SEQ ID NO: 2202522 - RNA, 15 nt, Streptococcus pneumoniae R6
caccaaacuuaggaa

SEQ ID NO: 2202523 - RNA, 19 nt, Streptococcus pneumoniae R6
caccaaauuucauauuuuc

SEQ ID NO: 2202524 - RNA, 14 nt, Streptococcus pneumoniae R6
cacaucacuuucug

SEQ ID NO: 2202525 - RNA, 17 nt, Streptococcus pneumoniae R6
cacauauugauauuuau

SEQ ID NO: 2202526 - RNA, 18 nt, Streptococcus pneumoniae R6
cacauauugauauuuaua

SEQ ID NO: 2202527 - RNA, 18 nt, Streptococcus pneumoniae R6
cacauccaguguauggag

SEQ ID NO: 2202528 - RNA, 18 nt, Streptococcus pneumoniae R6
cacauagcuggucaagaa

SEQ ID NO: 2202529 - RNA, 20 nt, Streptococcus pneumoniae R6
cacagcuugguaaugcucca

SEQ ID NO: 2202530 - RNA, 18 nt, Streptococcus pneumoniae R6
cacagcguuucuauauuu

SEQ ID NO: 2202531 - RNA, 19 nt, Streptococcus pneumoniae R6
aaaaguguugacaagugaa

SEQ ID NO: 2202532 - RNA, 22 nt, Streptococcus pneumoniae R6
aaaagugguaucauauaaauau

SEQ ID NO: 2202533 - RNA, 17 nt, Streptococcus pneumoniae R6
aaaaguggaaagagcag

SEQ ID NO: 2202534 - RNA, 14 nt, Streptococcus pneumoniae R6
aaaauaaaauuccu

SEQ ID NO: 2202535 - RNA, 19 nt, Streptococcus pneumoniae R6
caccagcuauuaagaaaaa

SEQ ID NO: 2202536 - RNA, 23 nt, Streptococcus pneumoniae R6
caccagcuauuaagaaaaaugau

SEQ ID NO: 2202537 - RNA, 15 nt, Streptococcus pneumoniae R6
cacacggaaacagcu

SEQ ID NO: 2202538 - RNA, 19 nt, Streptococcus pneumoniae R6
cacaaucguuucaaaaaau

SEQ ID NO: 2202539 - RNA, 24 nt, Streptococcus pneumoniae R6
cacagaaacaccuuuaucagccaa

SEQ ID NO: 2202540 - RNA, 20 nt, Streptococcus pneumoniae R6
cacaauaaaacgcaucauau

SEQ ID NO: 2202541 - RNA, 22 nt, Streptococcus pneumoniae R6
caauuugauauauaaaugaaaa

SEQ ID NO: 2202542 - RNA, 17 nt, Streptococcus pneumoniae R6
caauuucuuuauauaaa

SEQ ID NO: 2202543 - RNA, 18 nt, Streptococcus pneumoniae R6
caauuucuuuucauucca

SEQ ID NO: 2202544 - RNA, 14 nt, Streptococcus pneumoniae R6
cacaaccucaaaac

SEQ ID NO: 2202545 - RNA, 15 nt, Streptococcus pneumoniae R6
cacaaccucaaaaca

SEQ ID NO: 2202546 - RNA, 18 nt, Streptococcus pneumoniae R6
cacaacucuuauacuuuu

SEQ ID NO: 2202547 - RNA, 21 nt, Streptococcus pneumoniae R6
cacaacucuuauacuuuucuc

SEQ ID NO: 2202548 - RNA, 14 nt, Streptococcus pneumoniae R6
cacaacuuuuaaau

SEQ ID NO: 2202549 - RNA, 22 nt, Streptococcus pneumoniae R6
caauggcaaaaaauugagaaag

SEQ ID NO: 2202550 - RNA, 15 nt, Streptococcus pneumoniae R6
caauggccuguucua

SEQ ID NO: 2202551 - RNA, 20 nt, Streptococcus pneumoniae R6
caauggcugguauuaagaac

SEQ ID NO: 2202552 - RNA, 17 nt, Streptococcus pneumoniae R6
caauggguucaucucug

SEQ ID NO: 2202553 - RNA, 21 nt, Streptococcus pneumoniae R6
caaugguaacagucuuagcaa

SEQ ID NO: 2202554 - RNA, 18 nt, Streptococcus pneumoniae R6
caaugggguucaucucug

SEQ ID NO: 2202555 - RNA, 20 nt, Streptococcus pneumoniae R6
caaugaauccgaaaaauuuc

SEQ ID NO: 2202556 - RNA, 14 nt, Streptococcus pneumoniae R6
caaucuuaucaauc

SEQ ID NO: 2202557 - RNA, 17 nt, Streptococcus pneumoniae R6
caaucuuaucaaucaaa

SEQ ID NO: 2202558 - RNA, 17 nt, Streptococcus pneumoniae R6
caaucuuaccaaccuca

SEQ ID NO: 2202559 - RNA, 14 nt, Streptococcus pneumoniae R6
caaucuucaaaauc

SEQ ID NO: 2202560 - RNA, 16 nt, Streptococcus pneumoniae R6
caauggaaaugauaau

SEQ ID NO: 2202561 - RNA, 18 nt, Streptococcus pneumoniae R6
caauuucucuacaaauaa

SEQ ID NO: 2202562 - RNA, 20 nt, Streptococcus pneumoniae R6
caauuucuaacauauuucua

SEQ ID NO: 2202563 - RNA, 20 nt, Streptococcus pneumoniae R6
caauuucuauuuuaaaaaua

SEQ ID NO: 2202564 - RNA, 22 nt, Streptococcus pneumoniae R6
caauugcaggagaaaaugaaau

SEQ ID NO: 2202565 - RNA, 17 nt, Streptococcus pneumoniae R6
caauugcucaacuucuu

SEQ ID NO: 2202566 - RNA, 18 nt, Streptococcus pneumoniae R6
caauugcucaacuucuuu

SEQ ID NO: 2202567 - RNA, 15 nt, Streptococcus pneumoniae R6
caauuguaaaaagag

SEQ ID NO: 2202568 - RNA, 14 nt, Streptococcus pneumoniae R6
caauuuaucuccua

SEQ ID NO: 2202569 - RNA, 16 nt, Streptococcus pneumoniae R6
caauugugcauaagaa

SEQ ID NO: 2202570 - RNA, 21 nt, Streptococcus pneumoniae R6
caaugugcucagaaacaagaa

SEQ ID NO: 2202571 - RNA, 22 nt, Streptococcus pneumoniae R6
caaugugcucagaaacaagaaa

SEQ ID NO: 2202572 - RNA, 20 nt, Streptococcus pneumoniae R6
caauucccguuaaaggugug

SEQ ID NO: 2202573 - RNA, 20 nt, Streptococcus pneumoniae R6
caauuccuuauccugaugau

SEQ ID NO: 2202574 - RNA, 23 nt, Streptococcus pneumoniae R6
caauucuucguaagauucuucug

SEQ ID NO: 2202575 - RNA, 15 nt, Streptococcus pneumoniae R6
caauucucacuugac

SEQ ID NO: 2202576 - RNA, 18 nt, Streptococcus pneumoniae R6
augcaaguagaacgcuga

SEQ ID NO: 2202577 - RNA, 13 nt, Streptococcus pneumoniae R6
augcaagauauuc

SEQ ID NO: 2202578 - RNA, 21 nt, Streptococcus pneumoniae R6
augcaacuuguuuuuccugau

SEQ ID NO: 2202579 - RNA, 14 nt, Streptococcus pneumoniae R6
augauuuuuuacug

SEQ ID NO: 2202580 - RNA, 15 nt, Streptococcus pneumoniae R6
augcaaaaaaaauga

SEQ ID NO: 2202581 - RNA, 21 nt, Streptococcus pneumoniae R6
augauuuggcgaugauuuuag

SEQ ID NO: 2202582 - RNA, 16 nt, Streptococcus pneumoniae R6
augauuucaagaccau

SEQ ID NO: 2202583 - RNA, 11 nt, Streptococcus pneumoniae R6
augauuucaau

SEQ ID NO: 2202584 - RNA, 16 nt, Streptococcus pneumoniae R6
augauuugcaggcugu

SEQ ID NO: 2202585 - RNA, 21 nt, Streptococcus pneumoniae R6
augauuggaaauucaagaaug

SEQ ID NO: 2202586 - RNA, 21 nt, Streptococcus pneumoniae R6
augauugagaaaguuaaaaaa

SEQ ID NO: 2202587 - RNA, 22 nt, Streptococcus pneumoniae R6
augauugagaaaguuaaaaaaa

SEQ ID NO: 2202588 - RNA, 20 nt, Streptococcus pneumoniae R6
augauuuaauuagaaaaaaa

SEQ ID NO: 2202589 - RNA, 21 nt, Streptococcus pneumoniae R6
augauuuaauuagaaaaaaau

SEQ ID NO: 2202590 - RNA, 23 nt, Streptococcus pneumoniae R6
augauuuaauuagaaaaaaauuu

SEQ ID NO: 2202591 - RNA, 14 nt, Streptococcus pneumoniae R6
augauugaaaggau

SEQ ID NO: 2202592 - RNA, 15 nt, Streptococcus pneumoniae R6
augauucuuucuaau

SEQ ID NO: 2202593 - RNA, 17 nt, Streptococcus pneumoniae R6
augauucuuuucaaaau

SEQ ID NO: 2202594 - RNA, 19 nt, Streptococcus pneumoniae R6
augauucaaggaguugucu

SEQ ID NO: 2202595 - RNA, 12 nt, Streptococcus pneumoniae R6
augauuagaaau

SEQ ID NO: 2202596 - RNA, 14 nt, Streptococcus pneumoniae R6
augauuagaaauag

SEQ ID NO: 2202597 - RNA, 23 nt, Streptococcus pneumoniae R6
augauguucggcuuaccaagucc

SEQ ID NO: 2202598 - RNA, 13 nt, Streptococcus pneumoniae R6
augaugugcuauu

SEQ ID NO: 2202599 - RNA, 16 nt, Streptococcus pneumoniae R6
augaugcguuuuauaa

SEQ ID NO: 2202600 - RNA, 20 nt, Streptococcus pneumoniae R6
augaugaaucugaaucaaaa

SEQ ID NO: 2202601 - RNA, 23 nt, Streptococcus pneumoniae R6
augaugcaaaaggugcacacgaa

SEQ ID NO: 2202602 - RNA, 18 nt, Streptococcus pneumoniae R6
augaugcaagauauucau

SEQ ID NO: 2202603 - RNA, 16 nt, Streptococcus pneumoniae R6
augaucuauuccuagu

SEQ ID NO: 2202604 - RNA, 23 nt, Streptococcus pneumoniae R6
augaucuauuguugcauuaaaaa

SEQ ID NO: 2202605 - RNA, 17 nt, Streptococcus pneumoniae R6
augagccacuauuuauu

SEQ ID NO: 2202606 - RNA, 15 nt, Streptococcus pneumoniae R6
augaucuuaaauuuu

SEQ ID NO: 2202607 - RNA, 19 nt, Streptococcus pneumoniae R6
augagauuucgcuccagca

SEQ ID NO: 2202608 - RNA, 23 nt, Streptococcus pneumoniae R6
augagcacuauuguuauuuuucu

SEQ ID NO: 2202609 - RNA, 18 nt, Streptococcus pneumoniae R6
augccuccaagaaagaga

SEQ ID NO: 2202610 - RNA, 17 nt, Streptococcus pneumoniae R6
augccuguuccaacauu

SEQ ID NO: 2202611 - RNA, 22 nt, Streptococcus pneumoniae R6
augcgaacuagcuaacugcuuc

SEQ ID NO: 2202612 - RNA, 18 nt, Streptococcus pneumoniae R6
augccaugagcgucuuuc

SEQ ID NO: 2202613 - RNA, 20 nt, Streptococcus pneumoniae R6
augccaugagcgucuuucuu

SEQ ID NO: 2202614 - RNA, 18 nt, Streptococcus pneumoniae R6
augcagacugcuucggga

SEQ ID NO: 2202615 - RNA, 19 nt, Streptococcus pneumoniae R6
augccaaucgacccuggau

SEQ ID NO: 2202616 - RNA, 14 nt, Streptococcus pneumoniae R6
augccaagaaaguu

SEQ ID NO: 2202617 - RNA, 16 nt, Streptococcus pneumoniae R6
augcuccucuguauca

SEQ ID NO: 2202618 - RNA, 14 nt, Streptococcus pneumoniae R6
augcucccuucuuu

SEQ ID NO: 2202619 - RNA, 15 nt, Streptococcus pneumoniae R6
augcuuccagcuuua

SEQ ID NO: 2202620 - RNA, 16 nt, Streptococcus pneumoniae R6
augcuuggauccauug

SEQ ID NO: 2202621 - RNA, 17 nt, Streptococcus pneumoniae R6
augcuugauucaaaguc

SEQ ID NO: 2202622 - RNA, 16 nt, Streptococcus pneumoniae R6
augcuugcaaaucauu

SEQ ID NO: 2202623 - RNA, 22 nt, Streptococcus pneumoniae R6
augcuuuccauuaauucgauuu

SEQ ID NO: 2202624 - RNA, 12 nt, Streptococcus pneumoniae R6
augcuuuccaac

SEQ ID NO: 2202625 - RNA, 15 nt, Streptococcus pneumoniae R6
augcuuuacuaguuc

SEQ ID NO: 2202626 - RNA, 19 nt, Streptococcus pneumoniae R6
auggaguguucuaaaauaa

SEQ ID NO: 2202627 - RNA, 22 nt, Streptococcus pneumoniae R6
auggcacgccagucauuaccag

SEQ ID NO: 2202628 - RNA, 19 nt, Streptococcus pneumoniae R6
auggcacgggggaaaucau

SEQ ID NO: 2202629 - RNA, 16 nt, Streptococcus pneumoniae R6
auggacuguuauagau

SEQ ID NO: 2202630 - RNA, 16 nt, Streptococcus pneumoniae R6
auggagggucaaaaca

SEQ ID NO: 2202631 - RNA, 13 nt, Streptococcus pneumoniae R6
auggaaaaugaua

SEQ ID NO: 2202632 - RNA, 20 nt, Streptococcus pneumoniae R6
auggaagguugaguuuuuga

SEQ ID NO: 2202633 - RNA, 17 nt, Streptococcus pneumoniae R6
auggaagagaagcuguc

SEQ ID NO: 2202634 - RNA, 15 nt, Streptococcus pneumoniae R6
auggaacuaagauuu

SEQ ID NO: 2202635 - RNA, 16 nt, Streptococcus pneumoniae R6
auggaacuaagauuug

SEQ ID NO: 2202636 - RNA, 23 nt, Streptococcus pneumoniae R6
auggacacgauaaucugggcuaa

SEQ ID NO: 2202637 - RNA, 15 nt, Streptococcus pneumoniae R6
auggaaguaauuuga

SEQ ID NO: 2202638 - RNA, 17 nt, Streptococcus pneumoniae R6
auggcuaacuucauuau

SEQ ID NO: 2202639 - RNA, 23 nt, Streptococcus pneumoniae R6
auggcugaacgacgaauuugcuc

SEQ ID NO: 2202640 - RNA, 23 nt, Streptococcus pneumoniae R6
augguguuaauuggaaaauaaau

SEQ ID NO: 2202641 - RNA, 21 nt, Streptococcus pneumoniae R6
auggugacgaugucuugguau

SEQ ID NO: 2202642 - RNA, 19 nt, Streptococcus pneumoniae R6
augguauccaaaacaacca

SEQ ID NO: 2202643 - RNA, 16 nt, Streptococcus pneumoniae R6
augguaucaaaggcaa

SEQ ID NO: 2202644 - RNA, 16 nt, Streptococcus pneumoniae R6
augguaucacauucaa

SEQ ID NO: 2202645 - RNA, 21 nt, Streptococcus pneumoniae R6
augguaggcuuuaucaagcaa

SEQ ID NO: 2202646 - RNA, 22 nt, Streptococcus pneumoniae R6
auguaaacaaguugcuugaaaa

SEQ ID NO: 2202647 - RNA, 19 nt, Streptococcus pneumoniae R6
auguaauuucugaaaucaa

SEQ ID NO: 2202648 - RNA, 22 nt, Streptococcus pneumoniae R6
auguaauuucugaaaucaacac

SEQ ID NO: 2202649 - RNA, 17 nt, Streptococcus pneumoniae R6
augguucgggauaaaau

SEQ ID NO: 2202650 - RNA, 18 nt, Streptococcus pneumoniae R6
augguucgggauaaaaua

SEQ ID NO: 2202651 - RNA, 19 nt, Streptococcus pneumoniae R6
augguucgggauaaaauag

SEQ ID NO: 2202652 - RNA, 23 nt, Streptococcus pneumoniae R6
augguuacugacuucgucaguuc

SEQ ID NO: 2202653 - RNA, 23 nt, Streptococcus pneumoniae R6
augguuacugacuucgucaguuu

SEQ ID NO: 2202654 - RNA, 15 nt, Streptococcus pneumoniae R6
augucuauuuucuuu

SEQ ID NO: 2202655 - RNA, 13 nt, Streptococcus pneumoniae R6
augucuaaaucuu

SEQ ID NO: 2202656 - RNA, 14 nt, Streptococcus pneumoniae R6
augucguuuccuuc

SEQ ID NO: 2202657 - RNA, 20 nt, Streptococcus pneumoniae R6
augucguucaagguaauaau

SEQ ID NO: 2202658 - RNA, 21 nt, Streptococcus pneumoniae R6
augucggauugcccaaaauga

SEQ ID NO: 2202659 - RNA, 14 nt, Streptococcus pneumoniae R6
auguaccuaagauu

SEQ ID NO: 2202660 - RNA, 17 nt, Streptococcus pneumoniae R6
auguaccugcaaauuua

SEQ ID NO: 2202661 - RNA, 16 nt, Streptococcus pneumoniae R6
auguacgaaaagcacu

SEQ ID NO: 2202662 - RNA, 17 nt, Streptococcus pneumoniae R6
augucuuggauuuuuga

SEQ ID NO: 2202663 - RNA, 14 nt, Streptococcus pneumoniae R6
augucugaauauau

SEQ ID NO: 2202664 - RNA, 17 nt, Streptococcus pneumoniae R6
augucugaauauauaau

SEQ ID NO: 2202665 - RNA, 21 nt, Streptococcus pneumoniae R6
auguguuaccgguuacauaua

SEQ ID NO: 2202666 - RNA, 13 nt, Streptococcus pneumoniae R6
auguggugcuucu

SEQ ID NO: 2202667 - RNA, 13 nt, Streptococcus pneumoniae R6
auguucaucuucu

SEQ ID NO: 2202668 - RNA, 19 nt, Streptococcus pneumoniae R6
auguucaucuucuuucucc

SEQ ID NO: 2202669 - RNA, 12 nt, Streptococcus pneumoniae R6
auguuaugauuc

SEQ ID NO: 2202670 - RNA, 17 nt, Streptococcus pneumoniae R6
auguuaaaaugagucua

SEQ ID NO: 2202671 - RNA, 17 nt, Streptococcus pneumoniae R6
auguguuggguagcaua

SEQ ID NO: 2202672 - RNA, 20 nt, Streptococcus pneumoniae R6
auguuaagugcuucuuugua

SEQ ID NO: 2202673 - RNA, 22 nt, Streptococcus pneumoniae R6
auguuacugauuucgucaguuc

SEQ ID NO: 2202674 - RNA, 22 nt, Streptococcus pneumoniae R6
auguugaauaguuuaguaaguc

SEQ ID NO: 2202675 - RNA, 17 nt, Streptococcus pneumoniae R6
auguucugugauaaacu

SEQ ID NO: 2202676 - RNA, 12 nt, Streptococcus pneumoniae R6
auguucuaagaa

SEQ ID NO: 2202677 - RNA, 15 nt, Streptococcus pneumoniae R6
auguucggcuuacca

SEQ ID NO: 2202678 - RNA, 15 nt, Streptococcus pneumoniae R6
auguuuuaaauaaac

SEQ ID NO: 2202679 - RNA, 14 nt, Streptococcus pneumoniae R6
auguuuuagaaaua

SEQ ID NO: 2202680 - RNA, 21 nt, Streptococcus pneumoniae R6
auuaaaacggagaauaaggga

SEQ ID NO: 2202681 - RNA, 15 nt, Streptococcus pneumoniae R6
auuaaaacuucgaua

SEQ ID NO: 2202682 - RNA, 14 nt, Streptococcus pneumoniae R6
auuaaagauuuuuu

SEQ ID NO: 2202683 - RNA, 14 nt, Streptococcus pneumoniae R6
auuaagauuacaga

SEQ ID NO: 2202684 - RNA, 17 nt, Streptococcus pneumoniae R6
auuaagauuacagauca

SEQ ID NO: 2202685 - RNA, 23 nt, Streptococcus pneumoniae R6
auuaagaaauuuucuuuuuccua

SEQ ID NO: 2202686 - RNA, 14 nt, Streptococcus pneumoniae R6
auuaagauaaaacu

SEQ ID NO: 2202687 - RNA, 21 nt, Streptococcus pneumoniae R6
auuaaggcgauugcuacaauc

SEQ ID NO: 2202688 - RNA, 12 nt, Streptococcus pneumoniae R6
auuaaauggaau

SEQ ID NO: 2202689 - RNA, 22 nt, Streptococcus pneumoniae R6
auuaacgaucaaucaauuuaau

SEQ ID NO: 2202690 - RNA, 18 nt, Streptococcus pneumoniae R6
auuaacgauggacuuuau

SEQ ID NO: 2202691 - RNA, 20 nt, Streptococcus pneumoniae R6
auuaacgauggacuuuauca

SEQ ID NO: 2202692 - RNA, 21 nt, Streptococcus pneumoniae R6
auuauagugguguuucaaguc

SEQ ID NO: 2202693 - RNA, 20 nt, Streptococcus pneumoniae R6
auuauauaaaccaaaggaag

SEQ ID NO: 2202694 - RNA, 13 nt, Streptococcus pneumoniae R6
auuauaguagagu

SEQ ID NO: 2202695 - RNA, 14 nt, Streptococcus pneumoniae R6
auuauauauaaaaa

SEQ ID NO: 2202696 - RNA, 19 nt, Streptococcus pneumoniae R6
auuauauauaugcacagac

SEQ ID NO: 2202697 - RNA, 15 nt, Streptococcus pneumoniae R6
auuagucaagaguug

SEQ ID NO: 2202698 - RNA, 17 nt, Streptococcus pneumoniae R6
auuaguaugagcacuau

SEQ ID NO: 2202699 - RNA, 11 nt, Streptococcus pneumoniae R6
aaaagcuaagc

SEQ ID NO: 2202700 - RNA, 13 nt, Streptococcus pneumoniae R6
auuaguaauuugc

SEQ ID NO: 2202701 - RNA, 15 nt, Streptococcus pneumoniae R6
aaaagcuacuauaaa

SEQ ID NO: 2202702 - RNA, 22 nt, Streptococcus pneumoniae R6
aaaagcuacuauaaaagaggag

SEQ ID NO: 2202703 - RNA, 17 nt, Streptococcus pneumoniae R6
auuaguccguauuuuaa

SEQ ID NO: 2202704 - RNA, 22 nt, Streptococcus pneumoniae R6
auuaguccguauuuuaaaauau

SEQ ID NO: 2202705 - RNA, 22 nt, Streptococcus pneumoniae R6
auuagugaaguguuuaggcaag

SEQ ID NO: 2202706 - RNA, 22 nt, Streptococcus pneumoniae R6
auuaugcguuuuugugauuuua

SEQ ID NO: 2202707 - RNA, 22 nt, Streptococcus pneumoniae R6
auuaugcguuuuuuugauuuua

SEQ ID NO: 2202708 - RNA, 13 nt, Streptococcus pneumoniae R6
auuauguaaacaa

SEQ ID NO: 2202709 - RNA, 17 nt, Streptococcus pneumoniae R6
auuauguaaauaaauau

SEQ ID NO: 2202710 - RNA, 14 nt, Streptococcus pneumoniae R6
auuauggaccaugc

SEQ ID NO: 2202711 - RNA, 18 nt, Streptococcus pneumoniae R6
auuauguuuuaaauaaac

SEQ ID NO: 2202712 - RNA, 20 nt, Streptococcus pneumoniae R6
auuauguuuuugaauaaccu

SEQ ID NO: 2202713 - RNA, 19 nt, Streptococcus pneumoniae R6
auuauuaaaaucccauauu

SEQ ID NO: 2202714 - RNA, 13 nt, Streptococcus pneumoniae R6
auuauuuuuuaac

SEQ ID NO: 2202715 - RNA, 16 nt, Streptococcus pneumoniae R6
auuauuuuugaaagua

SEQ ID NO: 2202716 - RNA, 18 nt, Streptococcus pneumoniae R6
auuauuuuugaaaguacu

SEQ ID NO: 2202717 - RNA, 13 nt, Streptococcus pneumoniae R6
auucaaaauacaa

SEQ ID NO: 2202718 - RNA, 17 nt, Streptococcus pneumoniae R6
auucaaaauacaaaagu

SEQ ID NO: 2202719 - RNA, 16 nt, Streptococcus pneumoniae R6
auucaaagaaccugca

SEQ ID NO: 2202720 - RNA, 19 nt, Streptococcus pneumoniae R6
auucaaagucauaaacauc

SEQ ID NO: 2202721 - RNA, 17 nt, Streptococcus pneumoniae R6
aaaagcuguuaaaaacu

SEQ ID NO: 2202722 - RNA, 20 nt, Streptococcus pneumoniae R6
aaaagcuucauuuaucuucu

SEQ ID NO: 2202723 - RNA, 13 nt, Streptococcus pneumoniae R6
auuauuucuuuug

SEQ ID NO: 2202724 - RNA, 20 nt, Streptococcus pneumoniae R6
auuauuugccuaugaaauga

SEQ ID NO: 2202725 - RNA, 13 nt, Streptococcus pneumoniae R6
auuauuuuacugu

SEQ ID NO: 2202726 - RNA, 13 nt, Streptococcus pneumoniae R6
auuacugauaaaa

SEQ ID NO: 2202727 - RNA, 15 nt, Streptococcus pneumoniae R6
auuacucccauucuu

SEQ ID NO: 2202728 - RNA, 23 nt, Streptococcus pneumoniae R6
auuacuacuaucccuuuaccauu

SEQ ID NO: 2202729 - RNA, 23 nt, Streptococcus pneumoniae R6
auuaccucuuuuuauucuuuuuc

SEQ ID NO: 2202730 - RNA, 14 nt, Streptococcus pneumoniae R6
auuaauauauaaaa

SEQ ID NO: 2202731 - RNA, 15 nt, Streptococcus pneumoniae R6
auuacauaaguuuau

SEQ ID NO: 2202732 - RNA, 13 nt, Streptococcus pneumoniae R6
auuaccaagguug

SEQ ID NO: 2202733 - RNA, 22 nt, Streptococcus pneumoniae R6
auuaccaaguuaaacaaccuug

SEQ ID NO: 2202734 - RNA, 19 nt, Streptococcus pneumoniae R6
auuacaugaugugaagaac

SEQ ID NO: 2202735 - RNA, 20 nt, Streptococcus pneumoniae R6
auuacauccaccagcuauua

SEQ ID NO: 2202736 - RNA, 14 nt, Streptococcus pneumoniae R6
auuagaaaaaaauu

SEQ ID NO: 2202737 - RNA, 18 nt, Streptococcus pneumoniae R6
auuagaaaaaaauuuuua

SEQ ID NO: 2202738 - RNA, 19 nt, Streptococcus pneumoniae R6
auuagaaaaagacuugaaa

SEQ ID NO: 2202739 - RNA, 14 nt, Streptococcus pneumoniae R6
auuagaccugccau

SEQ ID NO: 2202740 - RNA, 17 nt, Streptococcus pneumoniae R6
auuacugucauaucaua

SEQ ID NO: 2202741 - RNA, 18 nt, Streptococcus pneumoniae R6
auuacuuaacccauucac

SEQ ID NO: 2202742 - RNA, 23 nt, Streptococcus pneumoniae R6
auuagcaaaaaagcaaauagcag

SEQ ID NO: 2202743 - RNA, 14 nt, Streptococcus pneumoniae R6
auuagagguuugcu

SEQ ID NO: 2202744 - RNA, 15 nt, Streptococcus pneumoniae R6
auuagagguuugcuu

SEQ ID NO: 2202745 - RNA, 23 nt, Streptococcus pneumoniae R6
auuagcaucuuaucagaaaauaa

SEQ ID NO: 2202746 - RNA, 18 nt, Streptococcus pneumoniae R6
auuccaaauuagaaaaag

SEQ ID NO: 2202747 - RNA, 21 nt, Streptococcus pneumoniae R6
auuccaaguuccucuuucaaa

SEQ ID NO: 2202748 - RNA, 15 nt, Streptococcus pneumoniae R6
auuccaaucaucauc

SEQ ID NO: 2202749 - RNA, 19 nt, Streptococcus pneumoniae R6
auuccaagguagcaacagc

SEQ ID NO: 2202750 - RNA, 23 nt, Streptococcus pneumoniae R6
auuccaagguagcaacagcugga

SEQ ID NO: 2202751 - RNA, 17 nt, Streptococcus pneumoniae R6
auuccaccauucuuucc

SEQ ID NO: 2202752 - RNA, 19 nt, Streptococcus pneumoniae R6
auuccaaacaacaauacuu

SEQ ID NO: 2202753 - RNA, 14 nt, Streptococcus pneumoniae R6
auuccauaccuaaa

SEQ ID NO: 2202754 - RNA, 16 nt, Streptococcus pneumoniae R6
auuccuacuucaaauc

SEQ ID NO: 2202755 - RNA, 21 nt, Streptococcus pneumoniae R6
auuccuguguacuguucuaaa

SEQ ID NO: 2202756 - RNA, 14 nt, Streptococcus pneumoniae R6
auucccugagccau

SEQ ID NO: 2202757 - RNA, 14 nt, Streptococcus pneumoniae R6
auuccgucauguuc

SEQ ID NO: 2202758 - RNA, 23 nt, Streptococcus pneumoniae R6
auucccaaacuuguacuugagau

SEQ ID NO: 2202759 - RNA, 22 nt, Streptococcus pneumoniae R6
auucccaaggucugacaggcua

SEQ ID NO: 2202760 - RNA, 13 nt, Streptococcus pneumoniae R6
aaaaggaaaauac

SEQ ID NO: 2202761 - RNA, 22 nt, Streptococcus pneumoniae R6
aaaagcuucucggacuuuuucc

SEQ ID NO: 2202762 - RNA, 23 nt, Streptococcus pneumoniae R6
aaaagcuucucggacuuuuucca

SEQ ID NO: 2202763 - RNA, 19 nt, Streptococcus pneumoniae R6
aaaagcuugaguggaaaaa

SEQ ID NO: 2202764 - RNA, 15 nt, Streptococcus pneumoniae R6
aaaagcuuguuuaaa

SEQ ID NO: 2202765 - RNA, 14 nt, Streptococcus pneumoniae R6
aaaagcuuuaaaac

SEQ ID NO: 2202766 - RNA, 18 nt, Streptococcus pneumoniae R6
aaaaggaguagaaaauga

SEQ ID NO: 2202767 - RNA, 17 nt, Streptococcus pneumoniae R6
auucaucaagagacaga

SEQ ID NO: 2202768 - RNA, 22 nt, Streptococcus pneumoniae R6
auucaucauuuauaguuuugau

SEQ ID NO: 2202769 - RNA, 18 nt, Streptococcus pneumoniae R6
auucaucacgaucaaagu

SEQ ID NO: 2202770 - RNA, 17 nt, Streptococcus pneumoniae R6
auucaugacaucuucca

SEQ ID NO: 2202771 - RNA, 19 nt, Streptococcus pneumoniae R6
auucaugacaucuuccaaa

SEQ ID NO: 2202772 - RNA, 13 nt, Streptococcus pneumoniae R6
auucauuaaguca

SEQ ID NO: 2202773 - RNA, 13 nt, Streptococcus pneumoniae R6
auucauucugcua

SEQ ID NO: 2202774 - RNA, 13 nt, Streptococcus pneumoniae R6
auucauuuucuua

SEQ ID NO: 2202775 - RNA, 17 nt, Streptococcus pneumoniae R6
auucauuugauuuuccu

SEQ ID NO: 2202776 - RNA, 17 nt, Streptococcus pneumoniae R6
auuccuugauaaguucu

SEQ ID NO: 2202777 - RNA, 21 nt, Streptococcus pneumoniae R6
auuccuugauaaguucuuuuu

SEQ ID NO: 2202778 - RNA, 17 nt, Streptococcus pneumoniae R6
auuccuuuaaaaacaau

SEQ ID NO: 2202779 - RNA, 14 nt, Streptococcus pneumoniae R6
auucgcuuacauaa

SEQ ID NO: 2202780 - RNA, 15 nt, Streptococcus pneumoniae R6
auucgucuaaaagua

SEQ ID NO: 2202781 - RNA, 16 nt, Streptococcus pneumoniae R6
auucguccauccaagc

SEQ ID NO: 2202782 - RNA, 13 nt, Streptococcus pneumoniae R6
auucguacucucu

SEQ ID NO: 2202783 - RNA, 19 nt, Streptococcus pneumoniae R6
auucuaauuaaauaaaaua

SEQ ID NO: 2202784 - RNA, 15 nt, Streptococcus pneumoniae R6
auucuaacuuauuuu

SEQ ID NO: 2202785 - RNA, 16 nt, Streptococcus pneumoniae R6
auucugacuaggaaua

SEQ ID NO: 2202786 - RNA, 16 nt, Streptococcus pneumoniae R6
auucugaaugcuuucc

SEQ ID NO: 2202787 - RNA, 13 nt, Streptococcus pneumoniae R6
auucugcaaucaa

SEQ ID NO: 2202788 - RNA, 17 nt, Streptococcus pneumoniae R6
auucugcaaucaagguu

SEQ ID NO: 2202789 - RNA, 19 nt, Streptococcus pneumoniae R6
auucucuggcagaaggauu

SEQ ID NO: 2202790 - RNA, 18 nt, Streptococcus pneumoniae R6
auucucuuuucauacuca

SEQ ID NO: 2202791 - RNA, 19 nt, Streptococcus pneumoniae R6
auucucuuuucauacucau

SEQ ID NO: 2202792 - RNA, 22 nt, Streptococcus pneumoniae R6
auucucuuuucauacucauuua

SEQ ID NO: 2202793 - RNA, 18 nt, Streptococcus pneumoniae R6
auucugaaagugaaacag

SEQ ID NO: 2202794 - RNA, 16 nt, Streptococcus pneumoniae R6
auucugaacuaaaaaa

SEQ ID NO: 2202795 - RNA, 20 nt, Streptococcus pneumoniae R6
auucuucuucugaaaagacg

SEQ ID NO: 2202796 - RNA, 20 nt, Streptococcus pneumoniae R6
auucuucuuuuccaaacaua

SEQ ID NO: 2202797 - RNA, 13 nt, Streptococcus pneumoniae R6
auucuucugguuu

SEQ ID NO: 2202798 - RNA, 16 nt, Streptococcus pneumoniae R6
auucuucucuugaaaa

SEQ ID NO: 2202799 - RNA, 18 nt, Streptococcus pneumoniae R6
auucuucucuugaaaaug

SEQ ID NO: 2202800 - RNA, 16 nt, Streptococcus pneumoniae R6
auucuugguaaagagg

SEQ ID NO: 2202801 - RNA, 17 nt, Streptococcus pneumoniae R6
auucuugguaaagagga

SEQ ID NO: 2202802 - RNA, 18 nt, Streptococcus pneumoniae R6
auucuugagcgauuuuaa

SEQ ID NO: 2202803 - RNA, 20 nt, Streptococcus pneumoniae R6
auucugcauguaucacagua

SEQ ID NO: 2202804 - RNA, 15 nt, Streptococcus pneumoniae R6
auucuggaagugaaa

SEQ ID NO: 2202805 - RNA, 18 nt, Streptococcus pneumoniae R6
auucuggaagugaaaaag

SEQ ID NO: 2202806 - RNA, 18 nt, Streptococcus pneumoniae R6
auucuggaagugaaacag

SEQ ID NO: 2202807 - RNA, 12 nt, Streptococcus pneumoniae R6
auugaugaacug

SEQ ID NO: 2202808 - RNA, 16 nt, Streptococcus pneumoniae R6
auugaugaacugcuug

SEQ ID NO: 2202809 - RNA, 20 nt, Streptococcus pneumoniae R6
auugaaacuggaauaguaca

SEQ ID NO: 2202810 - RNA, 20 nt, Streptococcus pneumoniae R6
auugaaacuagaauaguaca

SEQ ID NO: 2202811 - RNA, 18 nt, Streptococcus pneumoniae R6
auugaugauguuuaaaau

SEQ ID NO: 2202812 - RNA, 13 nt, Streptococcus pneumoniae R6
auugaugcaaauc

SEQ ID NO: 2202813 - RNA, 16 nt, Streptococcus pneumoniae R6
auugaaacagcuaaag

SEQ ID NO: 2202814 - RNA, 17 nt, Streptococcus pneumoniae R6
auugaaacaagaacaag

SEQ ID NO: 2202815 - RNA, 18 nt, Streptococcus pneumoniae R6
auugaaaauucacaaaau

SEQ ID NO: 2202816 - RNA, 17 nt, Streptococcus pneumoniae R6
auucuuuuuuaauucuu

SEQ ID NO: 2202817 - RNA, 17 nt, Streptococcus pneumoniae R6
auugcaaaggagaggag

SEQ ID NO: 2202818 - RNA, 13 nt, Streptococcus pneumoniae R6
auugcaagagaaa

SEQ ID NO: 2202819 - RNA, 17 nt, Streptococcus pneumoniae R6
auugcaagagggcuuca

SEQ ID NO: 2202820 - RNA, 21 nt, Streptococcus pneumoniae R6
auugcaacuugguaauaccuu

SEQ ID NO: 2202821 - RNA, 15 nt, Streptococcus pneumoniae R6
auugcauauacuuua

SEQ ID NO: 2202822 - RNA, 21 nt, Streptococcus pneumoniae R6
auugcaggagaaaaugaaaua

SEQ ID NO: 2202823 - RNA, 14 nt, Streptococcus pneumoniae R6
auugcuaaaacauu

SEQ ID NO: 2202824 - RNA, 17 nt, Streptococcus pneumoniae R6
auugcuaaaacauuuau

SEQ ID NO: 2202825 - RNA, 22 nt, Streptococcus pneumoniae R6
auugcggcugauuuugguguuc

SEQ ID NO: 2202826 - RNA, 15 nt, Streptococcus pneumoniae R6
auugccaacaaacau

SEQ ID NO: 2202827 - RNA, 17 nt, Streptococcus pneumoniae R6
auugccgauaucaccaa

SEQ ID NO: 2202828 - RNA, 20 nt, Streptococcus pneumoniae R6
auuguugaaacggcauaaaa

SEQ ID NO: 2202829 - RNA, 12 nt, Streptococcus pneumoniae R6
auuguucagagg

SEQ ID NO: 2202830 - RNA, 15 nt, Streptococcus pneumoniae R6
auuguucagaggcac

SEQ ID NO: 2202831 - RNA, 19 nt, Streptococcus pneumoniae R6
auuguuccauaugauucuu

SEQ ID NO: 2202832 - RNA, 14 nt, Streptococcus pneumoniae R6
auuguuauuuuucu

SEQ ID NO: 2202833 - RNA, 18 nt, Streptococcus pneumoniae R6
auuguuagaaaucgauuu

SEQ ID NO: 2202834 - RNA, 18 nt, Streptococcus pneumoniae R6
auugucucuaaaaauaaa

SEQ ID NO: 2202835 - RNA, 22 nt, Streptococcus pneumoniae R6
auugucucuaaaaauaaaaaag

SEQ ID NO: 2202836 - RNA, 20 nt, Streptococcus pneumoniae R6
auugugggaauguuugcuuc

SEQ ID NO: 2202837 - RNA, 14 nt, Streptococcus pneumoniae R6
auugucuaaaauuu

SEQ ID NO: 2202838 - RNA, 16 nt, Streptococcus pneumoniae R6
auugucuaaaauuuca

SEQ ID NO: 2202839 - RNA, 15 nt, Streptococcus pneumoniae R6
auuguuaaacaauuc

SEQ ID NO: 2202840 - RNA, 12 nt, Streptococcus pneumoniae R6
auuuaaauguuu

SEQ ID NO: 2202841 - RNA, 20 nt, Streptococcus pneumoniae R6
auuguugucccuuuuucacu

SEQ ID NO: 2202842 - RNA, 15 nt, Streptococcus pneumoniae R6
auuguugcauuaaaa

SEQ ID NO: 2202843 - RNA, 17 nt, Streptococcus pneumoniae R6
auuguuuauaaaauaac

SEQ ID NO: 2202844 - RNA, 22 nt, Streptococcus pneumoniae R6
auuuaaagcaaauuaaccuuau

SEQ ID NO: 2202845 - RNA, 14 nt, Streptococcus pneumoniae R6
auugucauuuaugu

SEQ ID NO: 2202846 - RNA, 17 nt, Streptococcus pneumoniae R6
auugucauuuuucugcu

SEQ ID NO: 2202847 - RNA, 12 nt, Streptococcus pneumoniae R6
auuguaggugua

SEQ ID NO: 2202848 - RNA, 21 nt, Streptococcus pneumoniae R6
auuguaggaaagaagguguuu

SEQ ID NO: 2202849 - RNA, 20 nt, Streptococcus pneumoniae R6
auuguaggacuuccuuuucu

SEQ ID NO: 2202850 - RNA, 15 nt, Streptococcus pneumoniae R6
auuguagaggaggau

SEQ ID NO: 2202851 - RNA, 18 nt, Streptococcus pneumoniae R6
auuguagauguucuuuga

SEQ ID NO: 2202852 - RNA, 22 nt, Streptococcus pneumoniae R6
auuguaaagcgaaaggagaaaa

SEQ ID NO: 2202853 - RNA, 23 nt, Streptococcus pneumoniae R6
auuguaaaggaugacaauagcua

SEQ ID NO: 2202854 - RNA, 15 nt, Streptococcus pneumoniae R6
auuguaaacaaaaau

SEQ ID NO: 2202855 - RNA, 18 nt, Streptococcus pneumoniae R6
auuguaaggauuuacuug

SEQ ID NO: 2202856 - RNA, 13 nt, Streptococcus pneumoniae R6
auuguaaaaagag

SEQ ID NO: 2202857 - RNA, 17 nt, Streptococcus pneumoniae R6
auuguaaaaagagggau

SEQ ID NO: 2202858 - RNA, 21 nt, Streptococcus pneumoniae R6
aaaagggggaacguuuuuaaa

SEQ ID NO: 2202859 - RNA, 17 nt, Streptococcus pneumoniae R6
aaaagggggcaaaacuu

SEQ ID NO: 2202860 - RNA, 22 nt, Streptococcus pneumoniae R6
auuggcguguuugucaaacauc

SEQ ID NO: 2202861 - RNA, 15 nt, Streptococcus pneumoniae R6
auugcuggagaauca

SEQ ID NO: 2202862 - RNA, 13 nt, Streptococcus pneumoniae R6
auugguucugcuc

SEQ ID NO: 2202863 - RNA, 16 nt, Streptococcus pneumoniae R6
auugguucuuuuuacu

SEQ ID NO: 2202864 - RNA, 14 nt, Streptococcus pneumoniae R6
auugguguuugguu

SEQ ID NO: 2202865 - RNA, 15 nt, Streptococcus pneumoniae R6
auugguguaaauaga

SEQ ID NO: 2202866 - RNA, 20 nt, Streptococcus pneumoniae R6
aaaagggacuggauuuuaag

SEQ ID NO: 2202867 - RNA, 23 nt, Streptococcus pneumoniae R6
aaaagggacaaaacuuuuuaaaa

SEQ ID NO: 2202868 - RNA, 23 nt, Streptococcus pneumoniae R6
caaaaaaagcuguuaaaaacuca

SEQ ID NO: 2202869 - RNA, 16 nt, Streptococcus pneumoniae R6
caaaaaaaucguaaaa

SEQ ID NO: 2202870 - RNA, 14 nt, Streptococcus pneumoniae R6
caaaaaaagaaguu

SEQ ID NO: 2202871 - RNA, 22 nt, Streptococcus pneumoniae R6
caaaaaauugcacuuuccucuu

SEQ ID NO: 2202872 - RNA, 12 nt, Streptococcus pneumoniae R6
caaaaaaugccu

SEQ ID NO: 2202873 - RNA, 20 nt, Streptococcus pneumoniae R6
caaaaaauguagucauucga

SEQ ID NO: 2202874 - RNA, 13 nt, Streptococcus pneumoniae R6
caaaaaaucuucc

SEQ ID NO: 2202875 - RNA, 14 nt, Streptococcus pneumoniae R6
auuuuuucaccaaa

SEQ ID NO: 2202876 - RNA, 21 nt, Streptococcus pneumoniae R6
auuuuuucaccaaaaccaauc

SEQ ID NO: 2202877 - RNA, 21 nt, Streptococcus pneumoniae R6
auuuuuuauuaagccucuuuc

SEQ ID NO: 2202878 - RNA, 13 nt, Streptococcus pneumoniae R6
auuuuuuaugguu

SEQ ID NO: 2202879 - RNA, 16 nt, Streptococcus pneumoniae R6
caaaaaaaaugaaaaa

SEQ ID NO: 2202880 - RNA, 18 nt, Streptococcus pneumoniae R6
caaaaaaaaugaaaaaaa

SEQ ID NO: 2202881 - RNA, 21 nt, Streptococcus pneumoniae R6
caaaaaaaacuacguuuugcu

SEQ ID NO: 2202882 - RNA, 15 nt, Streptococcus pneumoniae R6
auuuuucuucuuuuc

SEQ ID NO: 2202883 - RNA, 23 nt, Streptococcus pneumoniae R6
auuuuucuucuuuucuuuuaugu

SEQ ID NO: 2202884 - RNA, 18 nt, Streptococcus pneumoniae R6
auuuuucgacugugauuu

SEQ ID NO: 2202885 - RNA, 20 nt, Streptococcus pneumoniae R6
auuuuucgaaauuuauaaua

SEQ ID NO: 2202886 - RNA, 20 nt, Streptococcus pneumoniae R6
auuuuugagccguuucuuug

SEQ ID NO: 2202887 - RNA, 19 nt, Streptococcus pneumoniae R6
auuuuugaauauuaguaaa

SEQ ID NO: 2202888 - RNA, 15 nt, Streptococcus pneumoniae R6
auuuuugaaaguacu

SEQ ID NO: 2202889 - RNA, 17 nt, Streptococcus pneumoniae R6
auuuuugaaaguacuuu

SEQ ID NO: 2202890 - RNA, 17 nt, Streptococcus pneumoniae R6
auuuuuuaauuaaucac

SEQ ID NO: 2202891 - RNA, 23 nt, Streptococcus pneumoniae R6
auuuuuuaucgaaaagacuuagu

SEQ ID NO: 2202892 - RNA, 19 nt, Streptococcus pneumoniae R6
auuuuuuaucuaguauacu

SEQ ID NO: 2202893 - RNA, 17 nt, Streptococcus pneumoniae R6
auuuucuacacuugauu

SEQ ID NO: 2202894 - RNA, 19 nt, Streptococcus pneumoniae R6
auuuucuacacuugauuua

SEQ ID NO: 2202895 - RNA, 16 nt, Streptococcus pneumoniae R6
auuuucuacuaaaauu

SEQ ID NO: 2202896 - RNA, 14 nt, Streptococcus pneumoniae R6
auuuucauugagua

SEQ ID NO: 2202897 - RNA, 21 nt, Streptococcus pneumoniae R6
auuuucauugaguaugaaaua

SEQ ID NO: 2202898 - RNA, 16 nt, Streptococcus pneumoniae R6
auuuucgaagaguauu

SEQ ID NO: 2202899 - RNA, 19 nt, Streptococcus pneumoniae R6
auuuucgauuuaaugauau

SEQ ID NO: 2202900 - RNA, 22 nt, Streptococcus pneumoniae R6
auuuuggaagucaaaucaauuu

SEQ ID NO: 2202901 - RNA, 17 nt, Streptococcus pneumoniae R6
auuuugugaauuuucaa

SEQ ID NO: 2202902 - RNA, 20 nt, Streptococcus pneumoniae R6
auuuugugauaaaauguaau

SEQ ID NO: 2202903 - RNA, 19 nt, Streptococcus pneumoniae R6
auuuugugaaaaacuuagu

SEQ ID NO: 2202904 - RNA, 22 nt, Streptococcus pneumoniae R6
auuuugugguugaaaacaauau

SEQ ID NO: 2202905 - RNA, 21 nt, Streptococcus pneumoniae R6
auuuuguucuccauaggccaa

SEQ ID NO: 2202906 - RNA, 18 nt, Streptococcus pneumoniae R6
auuuuguucuuuuucaaa

SEQ ID NO: 2202907 - RNA, 13 nt, Streptococcus pneumoniae R6
auuuuucaauauc

SEQ ID NO: 2202908 - RNA, 16 nt, Streptococcus pneumoniae R6
auuuuuaaauucuucc

SEQ ID NO: 2202909 - RNA, 19 nt, Streptococcus pneumoniae R6
auuuuucauuuaauauauu

SEQ ID NO: 2202910 - RNA, 21 nt, Streptococcus pneumoniae R6
auuuuucaaggugaaguucac

SEQ ID NO: 2202911 - RNA, 23 nt, Streptococcus pneumoniae R6
auuugaguaaaagacaucagaug

SEQ ID NO: 2202912 - RNA, 15 nt, Streptococcus pneumoniae R6
auuugauauauaaau

SEQ ID NO: 2202913 - RNA, 20 nt, Streptococcus pneumoniae R6
auuuguuucaagcuugccua

SEQ ID NO: 2202914 - RNA, 23 nt, Streptococcus pneumoniae R6
auuuguuuaguguauaugaagau

SEQ ID NO: 2202915 - RNA, 17 nt, Streptococcus pneumoniae R6
auuugaugagaaaauaa

SEQ ID NO: 2202916 - RNA, 12 nt, Streptococcus pneumoniae R6
auuuguuuuugg

SEQ ID NO: 2202917 - RNA, 13 nt, Streptococcus pneumoniae R6
auuuuaaaauauu

SEQ ID NO: 2202918 - RNA, 16 nt, Streptococcus pneumoniae R6
auuuuaaaauauuagc

SEQ ID NO: 2202919 - RNA, 18 nt, Streptococcus pneumoniae R6
auuuuaaaauauuagcaa

SEQ ID NO: 2202920 - RNA, 12 nt, Streptococcus pneumoniae R6
auuuguuuucaa

SEQ ID NO: 2202921 - RNA, 15 nt, Streptococcus pneumoniae R6
auuuguuuucaagug

SEQ ID NO: 2202922 - RNA, 21 nt, Streptococcus pneumoniae R6
auuuguuuucaagugacauau

SEQ ID NO: 2202923 - RNA, 14 nt, Streptococcus pneumoniae R6
auuuguuuuucaaa

SEQ ID NO: 2202924 - RNA, 21 nt, Streptococcus pneumoniae R6
auuuuaaauuauguaaauaaa

SEQ ID NO: 2202925 - RNA, 15 nt, Streptococcus pneumoniae R6
auuuuaaauuuuucu

SEQ ID NO: 2202926 - RNA, 22 nt, Streptococcus pneumoniae R6
auuuuaaauuuuucugcaaaaa

SEQ ID NO: 2202927 - RNA, 15 nt, Streptococcus pneumoniae R6
auuuuacuucuuccc

SEQ ID NO: 2202928 - RNA, 18 nt, Streptococcus pneumoniae R6
auuuuacuuuccugauag

SEQ ID NO: 2202929 - RNA, 22 nt, Streptococcus pneumoniae R6
auuuuacuuuccugauagaguu

SEQ ID NO: 2202930 - RNA, 19 nt, Streptococcus pneumoniae R6
auuuuacuauauaucaugc

SEQ ID NO: 2202931 - RNA, 23 nt, Streptococcus pneumoniae R6
auuuuaaugcuaauuuagaaaua

SEQ ID NO: 2202932 - RNA, 19 nt, Streptococcus pneumoniae R6
auuuuaauaauuuuguuaa

SEQ ID NO: 2202933 - RNA, 24 nt, Streptococcus pneumoniae R6
auuuuaauugggccuuaguaaaua

SEQ ID NO: 2202934 - RNA, 14 nt, Streptococcus pneumoniae R6
auuuuacaaauacc

SEQ ID NO: 2202935 - RNA, 12 nt, Streptococcus pneumoniae R6
auuuuagauuuu

SEQ ID NO: 2202936 - RNA, 14 nt, Streptococcus pneumoniae R6
auuuuagauuuuuu

SEQ ID NO: 2202937 - RNA, 15 nt, Streptococcus pneumoniae R6
auuuuagaagcagag

SEQ ID NO: 2202938 - RNA, 21 nt, Streptococcus pneumoniae R6
auuuuagugaguccaaaagau

SEQ ID NO: 2202939 - RNA, 13 nt, Streptococcus pneumoniae R6
auuuuaguagaaa

SEQ ID NO: 2202940 - RNA, 14 nt, Streptococcus pneumoniae R6
auuuuaguagaaaa

SEQ ID NO: 2202941 - RNA, 19 nt, Streptococcus pneumoniae R6
auuuuaguaaaaaaagaag

SEQ ID NO: 2202942 - RNA, 19 nt, Streptococcus pneumoniae R6
auuuuaggagaaaaagaag

SEQ ID NO: 2202943 - RNA, 23 nt, Streptococcus pneumoniae R6
auuuuauccgaagggcuauuuuu

SEQ ID NO: 2202944 - RNA, 16 nt, Streptococcus pneumoniae R6
auuuuauccaacugau

SEQ ID NO: 2202945 - RNA, 14 nt, Streptococcus pneumoniae R6
auuuuauacucauc

SEQ ID NO: 2202946 - RNA, 15 nt, Streptococcus pneumoniae R6
auuuuauauaaaaua

SEQ ID NO: 2202947 - RNA, 18 nt, Streptococcus pneumoniae R6
auuuuauauaaaauaauu

SEQ ID NO: 2202948 - RNA, 13 nt, Streptococcus pneumoniae R6
auuuucaacuuga

SEQ ID NO: 2202949 - RNA, 17 nt, Streptococcus pneumoniae R6
auuuucaaaaucagaaa

SEQ ID NO: 2202950 - RNA, 18 nt, Streptococcus pneumoniae R6
auuuucaaaaugacaauu

SEQ ID NO: 2202951 - RNA, 14 nt, Streptococcus pneumoniae R6
auuuucaaagagua

SEQ ID NO: 2202952 - RNA, 22 nt, Streptococcus pneumoniae R6
auuuucaaagaguauuaaacaa

SEQ ID NO: 2202953 - RNA, 16 nt, Streptococcus pneumoniae R6
auuuuauuuuuuaagg

SEQ ID NO: 2202954 - RNA, 16 nt, Streptococcus pneumoniae R6
auuuucaaaaaucauu

SEQ ID NO: 2202955 - RNA, 18 nt, Streptococcus pneumoniae R6
auuuucaaaaaaaucgua

SEQ ID NO: 2202956 - RNA, 13 nt, Streptococcus pneumoniae R6
auuuuauuucauu

SEQ ID NO: 2202957 - RNA, 16 nt, Streptococcus pneumoniae R6
auuuucauauaauaaa

SEQ ID NO: 2202958 - RNA, 21 nt, Streptococcus pneumoniae R6
auuuucauauaauaaauugua

SEQ ID NO: 2202959 - RNA, 23 nt, Streptococcus pneumoniae R6
auuuucauacucgugaagaaauc

SEQ ID NO: 2202960 - RNA, 14 nt, Streptococcus pneumoniae R6
auuucuucuggaag

SEQ ID NO: 2202961 - RNA, 16 nt, Streptococcus pneumoniae R6
auuucuugacauacaa

SEQ ID NO: 2202962 - RNA, 21 nt, Streptococcus pneumoniae R6
auuucuugacauacaacuuaa

SEQ ID NO: 2202963 - RNA, 22 nt, Streptococcus pneumoniae R6
auuucuucaguauaaacuguaa

SEQ ID NO: 2202964 - RNA, 15 nt, Streptococcus pneumoniae R6
auuucuuaauagcug

SEQ ID NO: 2202965 - RNA, 14 nt, Streptococcus pneumoniae R6
auuugaacauuacu

SEQ ID NO: 2202966 - RNA, 19 nt, Streptococcus pneumoniae R6
auuugaacuugaauccuuc

SEQ ID NO: 2202967 - RNA, 17 nt, Streptococcus pneumoniae R6
auuucuggauuuccauu

SEQ ID NO: 2202968 - RNA, 17 nt, Streptococcus pneumoniae R6
auuucuguaaaaauaca

SEQ ID NO: 2202969 - RNA, 23 nt, Streptococcus pneumoniae R6
auuucuggauaacugaaauugag

SEQ ID NO: 2202970 - RNA, 17 nt, Streptococcus pneumoniae R6
auuucugcuaauuuuau

SEQ ID NO: 2202971 - RNA, 14 nt, Streptococcus pneumoniae R6
auuucucuacaaau

SEQ ID NO: 2202972 - RNA, 16 nt, Streptococcus pneumoniae R6
auuucucuacaaauaa

SEQ ID NO: 2202973 - RNA, 16 nt, Streptococcus pneumoniae R6
auuucugaaaucaaca

SEQ ID NO: 2202974 - RNA, 23 nt, Streptococcus pneumoniae R6
auuucugaaaucaacacaggauu

SEQ ID NO: 2202975 - RNA, 15 nt, Streptococcus pneumoniae R6
auuucguccuuucuu

SEQ ID NO: 2202976 - RNA, 14 nt, Streptococcus pneumoniae R6
auuucuaaagagua

SEQ ID NO: 2202977 - RNA, 12 nt, Streptococcus pneumoniae R6
auuucuaaaaau

SEQ ID NO: 2202978 - RNA, 21 nt, Streptococcus pneumoniae R6
auuuccaucucggucaucauc

SEQ ID NO: 2202979 - RNA, 22 nt, Streptococcus pneumoniae R6
auuuccaucucggucaucauca

SEQ ID NO: 2202980 - RNA, 19 nt, Streptococcus pneumoniae R6
auuuccauuggaguaugcu

SEQ ID NO: 2202981 - RNA, 13 nt, Streptococcus pneumoniae R6
auuuccauuuucc

SEQ ID NO: 2202982 - RNA, 12 nt, Streptococcus pneumoniae R6
auuuccaucaac

SEQ ID NO: 2202983 - RNA, 14 nt, Streptococcus pneumoniae R6
auuuccaucaacua

SEQ ID NO: 2202984 - RNA, 18 nt, Streptococcus pneumoniae R6
auuucacaguuaaauuau

SEQ ID NO: 2202985 - RNA, 19 nt, Streptococcus pneumoniae R6
auuucacaguuaaauuaua

SEQ ID NO: 2202986 - RNA, 13 nt, Streptococcus pneumoniae R6
auuucacauuuuc

SEQ ID NO: 2202987 - RNA, 14 nt, Streptococcus pneumoniae R6
auuucacauuuuca

SEQ ID NO: 2202988 - RNA, 16 nt, Streptococcus pneumoniae R6
auuucacgcaccuugg

SEQ ID NO: 2202989 - RNA, 17 nt, Streptococcus pneumoniae R6
auuucacuagaaaauga

SEQ ID NO: 2202990 - RNA, 18 nt, Streptococcus pneumoniae R6
auuucgcuauuuaaacug

SEQ ID NO: 2202991 - RNA, 17 nt, Streptococcus pneumoniae R6
auuuccauguaaaauua

SEQ ID NO: 2202992 - RNA, 14 nt, Streptococcus pneumoniae R6
auuucccauuugua

SEQ ID NO: 2202993 - RNA, 21 nt, Streptococcus pneumoniae R6
auuucccauuuuuugcaucaa

SEQ ID NO: 2202994 - RNA, 18 nt, Streptococcus pneumoniae R6
auuuccgauuucagaauc

SEQ ID NO: 2202995 - RNA, 17 nt, Streptococcus pneumoniae R6
aaaagucugggaaaaau

SEQ ID NO: 2202996 - RNA, 15 nt, Streptococcus pneumoniae R6
aaaagucuuuaaaau

SEQ ID NO: 2202997 - RNA, 17 nt, Streptococcus pneumoniae R6
aaaagucuuuaaaauua

SEQ ID NO: 2202998 - RNA, 18 nt, Streptococcus pneumoniae R6
aaaagucuuuaaaauuau

SEQ ID NO: 2202999 - RNA, 22 nt, Streptococcus pneumoniae R6
aaaagugagauauauugacuuu

SEQ ID NO: 2203000 - RNA, 23 nt, Streptococcus pneumoniae R6
aaaagugcaugaguuagauagau

SEQ ID NO: 2203001 - RNA, 15 nt, Streptococcus pneumoniae R6
auuuauggaaaaaau

SEQ ID NO: 2203002 - RNA, 22 nt, Streptococcus pneumoniae R6
auuuauggaaaaaaugaaauua

SEQ ID NO: 2203003 - RNA, 18 nt, Streptococcus pneumoniae R6
auuuauucagacuauaua

SEQ ID NO: 2203004 - RNA, 17 nt, Streptococcus pneumoniae R6
auuuauuuaauauguau

SEQ ID NO: 2203005 - RNA, 22 nt, Streptococcus pneumoniae R6
auuuauuacuucaauuucuaau

SEQ ID NO: 2203006 - RNA, 14 nt, Streptococcus pneumoniae R6
auuucaauuuuaaa

SEQ ID NO: 2203007 - RNA, 15 nt, Streptococcus pneumoniae R6
auuucaauuuuaaau

SEQ ID NO: 2203008 - RNA, 23 nt, Streptococcus pneumoniae R6
auuucaauuuuaaauuuuucugc

SEQ ID NO: 2203009 - RNA, 24 nt, Streptococcus pneumoniae R6
auuucaauccauuauacaucuucc

SEQ ID NO: 2203010 - RNA, 21 nt, Streptococcus pneumoniae R6
auuucaaucuacuauagaaaa

SEQ ID NO: 2203011 - RNA, 13 nt, Streptococcus pneumoniae R6
auuucaaucugcu

SEQ ID NO: 2203012 - RNA, 15 nt, Streptococcus pneumoniae R6
auuucaaucugcuau

SEQ ID NO: 2203013 - RNA, 15 nt, Streptococcus pneumoniae R6
auuucaaaaucuucu

SEQ ID NO: 2203014 - RNA, 15 nt, Streptococcus pneumoniae R6
auuucaauagaaauc

SEQ ID NO: 2203015 - RNA, 14 nt, Streptococcus pneumoniae R6
auuucaaagaacau

SEQ ID NO: 2203016 - RNA, 19 nt, Streptococcus pneumoniae R6
auuucaaaggcuuuuucuu

SEQ ID NO: 2203017 - RNA, 14 nt, Streptococcus pneumoniae R6
auuuauuuuucuuu

SEQ ID NO: 2203018 - RNA, 21 nt, Streptococcus pneumoniae R6
auuuauuuuucuuuuucagaa

SEQ ID NO: 2203019 - RNA, 20 nt, Streptococcus pneumoniae R6
auuuaucuagugcuauagua

SEQ ID NO: 2203020 - RNA, 17 nt, Streptococcus pneumoniae R6
auuuauccgaagauuua

SEQ ID NO: 2203021 - RNA, 19 nt, Streptococcus pneumoniae R6
auuuauccauucacaacau

SEQ ID NO: 2203022 - RNA, 21 nt, Streptococcus pneumoniae R6
auuuaucaguauauugaaaug

SEQ ID NO: 2203023 - RNA, 22 nt, Streptococcus pneumoniae R6
aaaaguauacucuaauugaaaa

SEQ ID NO: 2203024 - RNA, 23 nt, Streptococcus pneumoniae R6
aaaagucaucuauaaucaauaua

SEQ ID NO: 2203025 - RNA, 13 nt, Streptococcus pneumoniae R6
aaaaguccaaaga

SEQ ID NO: 2203026 - RNA, 17 nt, Streptococcus pneumoniae R6
aaaaguagggcgauaaa

SEQ ID NO: 2203027 - RNA, 17 nt, Streptococcus pneumoniae R6
aaaaguaggacgauaaa

SEQ ID NO: 2203028 - RNA, 20 nt, Streptococcus pneumoniae R6
aaaaguaggacgauaaaaac

SEQ ID NO: 2203029 - RNA, 21 nt, Streptococcus pneumoniae R6
aaaaguaggacgauaaaaacg

SEQ ID NO: 2203030 - RNA, 15 nt, Streptococcus pneumoniae R6
auuuaucuauaaaca

SEQ ID NO: 2203031 - RNA, 18 nt, Streptococcus pneumoniae R6
auuuauauaaaaagaaau

SEQ ID NO: 2203032 - RNA, 19 nt, Streptococcus pneumoniae R6
auuuauaguaaaaugaaau

SEQ ID NO: 2203033 - RNA, 13 nt, Streptococcus pneumoniae R6
auuuauagaaaua

SEQ ID NO: 2203034 - RNA, 13 nt, Streptococcus pneumoniae R6
auuuauagaaauu

SEQ ID NO: 2203035 - RNA, 14 nt, Streptococcus pneumoniae R6
auuuauagaaauua

SEQ ID NO: 2203036 - RNA, 15 nt, Streptococcus pneumoniae R6
auuuauaauuucaac

SEQ ID NO: 2203037 - RNA, 18 nt, Streptococcus pneumoniae R6
auuuaauacggcauugag

SEQ ID NO: 2203038 - RNA, 21 nt, Streptococcus pneumoniae R6
auuuaauacggcauugaggac

SEQ ID NO: 2203039 - RNA, 20 nt, Streptococcus pneumoniae R6
auuuaauaaugaagacauca

SEQ ID NO: 2203040 - RNA, 14 nt, Streptococcus pneumoniae R6
auuuaacaaaccac

SEQ ID NO: 2203041 - RNA, 16 nt, Streptococcus pneumoniae R6
auuuaaccaaaccaac

SEQ ID NO: 2203042 - RNA, 20 nt, Streptococcus pneumoniae R6
cagcuaaaauguuuuucguc

SEQ ID NO: 2203043 - RNA, 17 nt, Streptococcus pneumoniae R6
cagcuaaaagcaaagca

SEQ ID NO: 2203044 - RNA, 16 nt, Streptococcus pneumoniae R6
cagcuaaaaauaacua

SEQ ID NO: 2203045 - RNA, 24 nt, Streptococcus pneumoniae R6
aaaauugauaauaguaugucugaa

SEQ ID NO: 2203046 - RNA, 13 nt, Streptococcus pneumoniae R6
cagcucuuuuuug

SEQ ID NO: 2203047 - RNA, 18 nt, Streptococcus pneumoniae R6
cagcuuuauagucaugaa

SEQ ID NO: 2203048 - RNA, 16 nt, Streptococcus pneumoniae R6
caggaaaccagcugcg

SEQ ID NO: 2203049 - RNA, 15 nt, Streptococcus pneumoniae R6
caggaaagacuaggg

SEQ ID NO: 2203050 - RNA, 17 nt, Streptococcus pneumoniae R6
caggaaaggcauuccag

SEQ ID NO: 2203051 - RNA, 13 nt, Streptococcus pneumoniae R6
caggaaggaaaua

SEQ ID NO: 2203052 - RNA, 18 nt, Streptococcus pneumoniae R6
caggaagcgaucaaccga

SEQ ID NO: 2203053 - RNA, 13 nt, Streptococcus pneumoniae R6
caggaagaaagag

SEQ ID NO: 2203054 - RNA, 16 nt, Streptococcus pneumoniae R6
cagcuucuauuucuug

SEQ ID NO: 2203055 - RNA, 21 nt, Streptococcus pneumoniae R6
cagcuuguuguuaaacaaggc

SEQ ID NO: 2203056 - RNA, 20 nt, Streptococcus pneumoniae R6
cagcuuguucuucugcuguc

SEQ ID NO: 2203057 - RNA, 22 nt, Streptococcus pneumoniae R6
aaaauuucauuucgacugaaaa

SEQ ID NO: 2203058 - RNA, 16 nt, Streptococcus pneumoniae R6
aaaauuucauuuucua

SEQ ID NO: 2203059 - RNA, 17 nt, Streptococcus pneumoniae R6
caggaccgaugauuaca

SEQ ID NO: 2203060 - RNA, 22 nt, Streptococcus pneumoniae R6
caggaauuucgcuauuuaaacu

SEQ ID NO: 2203061 - RNA, 22 nt, Streptococcus pneumoniae R6
caggacagucaaaucgauuucu

SEQ ID NO: 2203062 - RNA, 16 nt, Streptococcus pneumoniae R6
caggaguucuuuuaca

SEQ ID NO: 2203063 - RNA, 14 nt, Streptococcus pneumoniae R6
caggcaaagagucc

SEQ ID NO: 2203064 - RNA, 16 nt, Streptococcus pneumoniae R6
caggauugauaaaauu

SEQ ID NO: 2203065 - RNA, 16 nt, Streptococcus pneumoniae R6
caggauuuuuucaugg

SEQ ID NO: 2203066 - RNA, 20 nt, Streptococcus pneumoniae R6
caggauuuuguucuuuuuca

SEQ ID NO: 2203067 - RNA, 19 nt, Streptococcus pneumoniae R6
caggauuuuuaacuuacua

SEQ ID NO: 2203068 - RNA, 17 nt, Streptococcus pneumoniae R6
caggauuuuuacaguau

SEQ ID NO: 2203069 - RNA, 17 nt, Streptococcus pneumoniae R6
caggcuuggucauuaaa

SEQ ID NO: 2203070 - RNA, 16 nt, Streptococcus pneumoniae R6
caggcuuucucccuuu

SEQ ID NO: 2203071 - RNA, 17 nt, Streptococcus pneumoniae R6
caggccuacaauuggaa

SEQ ID NO: 2203072 - RNA, 16 nt, Streptococcus pneumoniae R6
cagggucuuuguucug

SEQ ID NO: 2203073 - RNA, 18 nt, Streptococcus pneumoniae R6
cagggucuuuguucugaa

SEQ ID NO: 2203074 - RNA, 20 nt, Streptococcus pneumoniae R6
aaacaaaaauccagauaggu

SEQ ID NO: 2203075 - RNA, 24 nt, Streptococcus pneumoniae R6
aaaauuuuuuucuaauuaaaucau

SEQ ID NO: 2203076 - RNA, 10 nt, Streptococcus pneumoniae R6
aaacaaaagu

SEQ ID NO: 2203077 - RNA, 15 nt, Streptococcus pneumoniae R6
aaacaaaagucuucu

SEQ ID NO: 2203078 - RNA, 11 nt, Streptococcus pneumoniae R6
aaacaaaauua

SEQ ID NO: 2203079 - RNA, 16 nt, Streptococcus pneumoniae R6
aaacaaaauucuuccu

SEQ ID NO: 2203080 - RNA, 19 nt, Streptococcus pneumoniae R6
aaacaaaauucuuccuacu

SEQ ID NO: 2203081 - RNA, 13 nt, Streptococcus pneumoniae R6
aaacaaagaaaaa

SEQ ID NO: 2203082 - RNA, 23 nt, Streptococcus pneumoniae R6
cagccuguuuucauaucuccauu

SEQ ID NO: 2203083 - RNA, 22 nt, Streptococcus pneumoniae R6
cagcgauagcuccaucuccaac

SEQ ID NO: 2203084 - RNA, 12 nt, Streptococcus pneumoniae R6
cagccaagacac

SEQ ID NO: 2203085 - RNA, 15 nt, Streptococcus pneumoniae R6
cagccaauuucuuua

SEQ ID NO: 2203086 - RNA, 12 nt, Streptococcus pneumoniae R6
cagccaaaccgu

SEQ ID NO: 2203087 - RNA, 21 nt, Streptococcus pneumoniae R6
cagccaaacuaggauuuucuu

SEQ ID NO: 2203088 - RNA, 15 nt, Streptococcus pneumoniae R6
cagccagagcaccaa

SEQ ID NO: 2203089 - RNA, 12 nt, Streptococcus pneumoniae R6
cagccaguugcu

SEQ ID NO: 2203090 - RNA, 20 nt, Streptococcus pneumoniae R6
cagccauaagcuacauagag

SEQ ID NO: 2203091 - RNA, 20 nt, Streptococcus pneumoniae R6
aaaauuaaaaagaguagaaa

SEQ ID NO: 2203092 - RNA, 23 nt, Streptococcus pneumoniae R6
aaaauguucaguuucuauuucau

SEQ ID NO: 2203093 - RNA, 11 nt, Streptococcus pneumoniae R6
aaaauuaaaau

SEQ ID NO: 2203094 - RNA, 22 nt, Streptococcus pneumoniae R6
aaaauuauuuugcgcauguaaa

SEQ ID NO: 2203095 - RNA, 18 nt, Streptococcus pneumoniae R6
aaaauucacaaaauccuu

SEQ ID NO: 2203096 - RNA, 20 nt, Streptococcus pneumoniae R6
aaaauuauguuuuugaauaa

SEQ ID NO: 2203097 - RNA, 17 nt, Streptococcus pneumoniae R6
aaaauuagcucaaaaca

SEQ ID NO: 2203098 - RNA, 19 nt, Streptococcus pneumoniae R6
aaaauucggugcgcacacc

SEQ ID NO: 2203099 - RNA, 13 nt, Streptococcus pneumoniae R6
aaaauucuaaagg

SEQ ID NO: 2203100 - RNA, 21 nt, Streptococcus pneumoniae R6
aaaauucguuucauuauuucu

SEQ ID NO: 2203101 - RNA, 12 nt, Streptococcus pneumoniae R6
aaaauucuuuga

SEQ ID NO: 2203102 - RNA, 14 nt, Streptococcus pneumoniae R6
aaaauucuuugaaa

SEQ ID NO: 2203103 - RNA, 15 nt, Streptococcus pneumoniae R6
aaaauucuuugaaau

SEQ ID NO: 2203104 - RNA, 18 nt, Streptococcus pneumoniae R6
aaaauuccuuuaaaaaca

SEQ ID NO: 2203105 - RNA, 20 nt, Streptococcus pneumoniae R6
aaaauucccuuauccacauc

SEQ ID NO: 2203106 - RNA, 16 nt, Streptococcus pneumoniae R6
cacugaugaaacuaau

SEQ ID NO: 2203107 - RNA, 23 nt, Streptococcus pneumoniae R6
cacugaguuuuucccagccuuca

SEQ ID NO: 2203108 - RNA, 18 nt, Streptococcus pneumoniae R6
cacugcaauuucuaaaaa

SEQ ID NO: 2203109 - RNA, 22 nt, Streptococcus pneumoniae R6
cacugauuucaaggcauuuuuu

SEQ ID NO: 2203110 - RNA, 17 nt, Streptococcus pneumoniae R6
cacugauuugagguugu

SEQ ID NO: 2203111 - RNA, 16 nt, Streptococcus pneumoniae R6
cacugcaucugguucu

SEQ ID NO: 2203112 - RNA, 18 nt, Streptococcus pneumoniae R6
cacucucauucaucacca

SEQ ID NO: 2203113 - RNA, 21 nt, Streptococcus pneumoniae R6
cacucuugcauuucuuuugau

SEQ ID NO: 2203114 - RNA, 20 nt, Streptococcus pneumoniae R6
cacucgccaguugcugcguu

SEQ ID NO: 2203115 - RNA, 20 nt, Streptococcus pneumoniae R6
cacucgcugacacuggcaua

SEQ ID NO: 2203116 - RNA, 20 nt, Streptococcus pneumoniae R6
cacuaaggacacgcuucuuu

SEQ ID NO: 2203117 - RNA, 17 nt, Streptococcus pneumoniae R6
cacuaaagguugaugag

SEQ ID NO: 2203118 - RNA, 21 nt, Streptococcus pneumoniae R6
cacuaauucaccuaaccaaau

SEQ ID NO: 2203119 - RNA, 14 nt, Streptococcus pneumoniae R6
cacuacaguugaca

SEQ ID NO: 2203120 - RNA, 18 nt, Streptococcus pneumoniae R6
cacuacaguugacaaaga

SEQ ID NO: 2203121 - RNA, 23 nt, Streptococcus pneumoniae R6
cacuacgauuggggauuuuuagu

SEQ ID NO: 2203122 - RNA, 20 nt, Streptococcus pneumoniae R6
cacgugccugcauggcuccu

SEQ ID NO: 2203123 - RNA, 16 nt, Streptococcus pneumoniae R6
aaaauaguuuuugcaa

SEQ ID NO: 2203124 - RNA, 15 nt, Streptococcus pneumoniae R6
aaaauauacaaaaaa

SEQ ID NO: 2203125 - RNA, 17 nt, Streptococcus pneumoniae R6
cacguuuuucuucuuuu

SEQ ID NO: 2203126 - RNA, 15 nt, Streptococcus pneumoniae R6
cacuaucgaaaaaua

SEQ ID NO: 2203127 - RNA, 21 nt, Streptococcus pneumoniae R6
cacuauggagaaucguauucu

SEQ ID NO: 2203128 - RNA, 15 nt, Streptococcus pneumoniae R6
cacuauuagcaucuu

SEQ ID NO: 2203129 - RNA, 12 nt, Streptococcus pneumoniae R6
cacuauucauca

SEQ ID NO: 2203130 - RNA, 21 nt, Streptococcus pneumoniae R6
cacuauugaugaaguaaaugu

SEQ ID NO: 2203131 - RNA, 23 nt, Streptococcus pneumoniae R6
cacuauugaugaaguaaauguga

SEQ ID NO: 2203132 - RNA, 17 nt, Streptococcus pneumoniae R6
cacuauuguauuuaugu

SEQ ID NO: 2203133 - RNA, 17 nt, Streptococcus pneumoniae R6
cacuauaauaaaaugaa

SEQ ID NO: 2203134 - RNA, 18 nt, Streptococcus pneumoniae R6
cacuauaauaaaaugaaa

SEQ ID NO: 2203135 - RNA, 16 nt, Streptococcus pneumoniae R6
cacuauaauaauuuau

SEQ ID NO: 2203136 - RNA, 21 nt, Streptococcus pneumoniae R6
cacuaguuuuaggacauaaau

SEQ ID NO: 2203137 - RNA, 22 nt, Streptococcus pneumoniae R6
cacuagcgagggaaacagccaa

SEQ ID NO: 2203138 - RNA, 22 nt, Streptococcus pneumoniae R6
cacuagucaugaccccuaaaua

SEQ ID NO: 2203139 - RNA, 17 nt, Streptococcus pneumoniae R6
cacuacuuccaucuaca

SEQ ID NO: 2203140 - RNA, 12 nt, Streptococcus pneumoniae R6
cacucaaaccug

SEQ ID NO: 2203141 - RNA, 20 nt, Streptococcus pneumoniae R6
cacuauuuguagcaaauuca

SEQ ID NO: 2203142 - RNA, 14 nt, Streptococcus pneumoniae R6
cacucaaaucauau

SEQ ID NO: 2203143 - RNA, 15 nt, Streptococcus pneumoniae R6
cacucaauuuaucua

SEQ ID NO: 2203144 - RNA, 14 nt, Streptococcus pneumoniae R6
cacuccaaaaauaa

SEQ ID NO: 2203145 - RNA, 18 nt, Streptococcus pneumoniae R6
cacucaguauuacaucca

SEQ ID NO: 2203146 - RNA, 20 nt, Streptococcus pneumoniae R6
cacucaguauuacauccacc

SEQ ID NO: 2203147 - RNA, 23 nt, Streptococcus pneumoniae R6
cacucaguauuacauccaccagc

SEQ ID NO: 2203148 - RNA, 19 nt, Streptococcus pneumoniae R6
cacuggcauuaaggcuuug

SEQ ID NO: 2203149 - RNA, 18 nt, Streptococcus pneumoniae R6
cacuggcauuuagcacua

SEQ ID NO: 2203150 - RNA, 20 nt, Streptococcus pneumoniae R6
cacuggauaauuucuuuaau

SEQ ID NO: 2203151 - RNA, 14 nt, Streptococcus pneumoniae R6
cacuuaagugugaa

SEQ ID NO: 2203152 - RNA, 17 nt, Streptococcus pneumoniae R6
cacugugauuucuaaaa

SEQ ID NO: 2203153 - RNA, 14 nt, Streptococcus pneumoniae R6
cacuuauaguacua

SEQ ID NO: 2203154 - RNA, 22 nt, Streptococcus pneumoniae R6
cacuuaguugaauuaucauagu

SEQ ID NO: 2203155 - RNA, 16 nt, Streptococcus pneumoniae R6
cacuuaugaagaaauu

SEQ ID NO: 2203156 - RNA, 14 nt, Streptococcus pneumoniae R6
cacuugaugaaaaa

SEQ ID NO: 2203157 - RNA, 15 nt, Streptococcus pneumoniae R6
cacuugcgaugauga

SEQ ID NO: 2203158 - RNA, 16 nt, Streptococcus pneumoniae R6
cacuugcgaguuguga

SEQ ID NO: 2203159 - RNA, 22 nt, Streptococcus pneumoniae R6
cacuucugcuucuaaaacauug

SEQ ID NO: 2203160 - RNA, 12 nt, Streptococcus pneumoniae R6
cacuucuacuau

SEQ ID NO: 2203161 - RNA, 15 nt, Streptococcus pneumoniae R6
cacuucaucaacagu

SEQ ID NO: 2203162 - RNA, 14 nt, Streptococcus pneumoniae R6
cacuucacuaauuc

SEQ ID NO: 2203163 - RNA, 15 nt, Streptococcus pneumoniae R6
cacuuccuuaccauc

SEQ ID NO: 2203164 - RNA, 15 nt, Streptococcus pneumoniae R6
cacuuugauuuuuau

SEQ ID NO: 2203165 - RNA, 22 nt, Streptococcus pneumoniae R6
aaaauaugaucuauuguugcau

SEQ ID NO: 2203166 - RNA, 15 nt, Streptococcus pneumoniae R6
aaaauauuagcaaaa

SEQ ID NO: 2203167 - RNA, 21 nt, Streptococcus pneumoniae R6
aaaauaugcuauugaaaggaa

SEQ ID NO: 2203168 - RNA, 23 nt, Streptococcus pneumoniae R6
aaaauaugcuauugaaaggaaaa

SEQ ID NO: 2203169 - RNA, 16 nt, Streptococcus pneumoniae R6
aaaauauggcacaaaa

SEQ ID NO: 2203170 - RNA, 23 nt, Streptococcus pneumoniae R6
aaaauauggcacaaaagguucuu

SEQ ID NO: 2203171 - RNA, 21 nt, Streptococcus pneumoniae R6
cacuuguguagccagugagaa

SEQ ID NO: 2203172 - RNA, 13 nt, Streptococcus pneumoniae R6
cagaaaauaaaau

SEQ ID NO: 2203173 - RNA, 11 nt, Streptococcus pneumoniae R6
cagaaacuguc

SEQ ID NO: 2203174 - RNA, 17 nt, Streptococcus pneumoniae R6
cagaaagaacaaaaaau

SEQ ID NO: 2203175 - RNA, 21 nt, Streptococcus pneumoniae R6
cagaaaaaugacaauaaaaua

SEQ ID NO: 2203176 - RNA, 14 nt, Streptococcus pneumoniae R6
cagaaaaauuucau

SEQ ID NO: 2203177 - RNA, 16 nt, Streptococcus pneumoniae R6
cacuuuuauuauggua

SEQ ID NO: 2203178 - RNA, 14 nt, Streptococcus pneumoniae R6
cagaacuuccacuu

SEQ ID NO: 2203179 - RNA, 24 nt, Streptococcus pneumoniae R6
cagaacuuccacuuccagaagaua

SEQ ID NO: 2203180 - RNA, 20 nt, Streptococcus pneumoniae R6
cagaacucccuguuccaaag

SEQ ID NO: 2203181 - RNA, 17 nt, Streptococcus pneumoniae R6
cagaagcugccccaccu

SEQ ID NO: 2203182 - RNA, 18 nt, Streptococcus pneumoniae R6
cagaagcugccccaccug

SEQ ID NO: 2203183 - RNA, 15 nt, Streptococcus pneumoniae R6
cagaaauaaaaguaa

SEQ ID NO: 2203184 - RNA, 20 nt, Streptococcus pneumoniae R6
cagaacauuuuaauuuugga

SEQ ID NO: 2203185 - RNA, 18 nt, Streptococcus pneumoniae R6
cagaaccccgauaacagc

SEQ ID NO: 2203186 - RNA, 23 nt, Streptococcus pneumoniae R6
cagaacccuuauuuccugcuuua

SEQ ID NO: 2203187 - RNA, 11 nt, Streptococcus pneumoniae R6
cagaaccuuaa

SEQ ID NO: 2203188 - RNA, 17 nt, Streptococcus pneumoniae R6
cagacgaguuaaaacaa

SEQ ID NO: 2203189 - RNA, 21 nt, Streptococcus pneumoniae R6
cagacgaguuaaaacaaagaa

SEQ ID NO: 2203190 - RNA, 15 nt, Streptococcus pneumoniae R6
cagacugcaaggcaa

SEQ ID NO: 2203191 - RNA, 17 nt, Streptococcus pneumoniae R6
cagaauuuucuuacuuc

SEQ ID NO: 2203192 - RNA, 12 nt, Streptococcus pneumoniae R6
cagaauacucuu

SEQ ID NO: 2203193 - RNA, 20 nt, Streptococcus pneumoniae R6
cagaauacucuuucaguuuc

SEQ ID NO: 2203194 - RNA, 16 nt, Streptococcus pneumoniae R6
cagaaucccagauaaa

SEQ ID NO: 2203195 - RNA, 16 nt, Streptococcus pneumoniae R6
cagaaucccaaagaag

SEQ ID NO: 2203196 - RNA, 17 nt, Streptococcus pneumoniae R6
cagaaucccaaagaagg

SEQ ID NO: 2203197 - RNA, 18 nt, Streptococcus pneumoniae R6
cagaaucccaaagaagga

SEQ ID NO: 2203198 - RNA, 22 nt, Streptococcus pneumoniae R6
cagagaaaaugggcuuuuucug

SEQ ID NO: 2203199 - RNA, 20 nt, Streptococcus pneumoniae R6
cagacugggcaguaaaucuu

SEQ ID NO: 2203200 - RNA, 20 nt, Streptococcus pneumoniae R6
cagacuggugucguugaaug

SEQ ID NO: 2203201 - RNA, 15 nt, Streptococcus pneumoniae R6
cagacugguucucuc

SEQ ID NO: 2203202 - RNA, 18 nt, Streptococcus pneumoniae R6
aaaaucaagggaaaauga

SEQ ID NO: 2203203 - RNA, 21 nt, Streptococcus pneumoniae R6
aaaaucaagggaaaaugaaac

SEQ ID NO: 2203204 - RNA, 18 nt, Streptococcus pneumoniae R6
aaaaucaaugacaaucuc

SEQ ID NO: 2203205 - RNA, 14 nt, Streptococcus pneumoniae R6
aaaaucacaaaaac

SEQ ID NO: 2203206 - RNA, 19 nt, Streptococcus pneumoniae R6
cagagauauuuugcauaaa

SEQ ID NO: 2203207 - RNA, 23 nt, Streptococcus pneumoniae R6
cagagauugcgauacuguuauag

SEQ ID NO: 2203208 - RNA, 14 nt, Streptococcus pneumoniae R6
cagaguuuugaaaa

SEQ ID NO: 2203209 - RNA, 14 nt, Streptococcus pneumoniae R6
cagauaaagcugac

SEQ ID NO: 2203210 - RNA, 21 nt, Streptococcus pneumoniae R6
cagaguagaaguugcuacgau

SEQ ID NO: 2203211 - RNA, 20 nt, Streptococcus pneumoniae R6
cagaguagucuuuuuguuuc

SEQ ID NO: 2203212 - RNA, 15 nt, Streptococcus pneumoniae R6
cagaguacuaaauau

SEQ ID NO: 2203213 - RNA, 16 nt, Streptococcus pneumoniae R6
cagagcgauaaaaauc

SEQ ID NO: 2203214 - RNA, 19 nt, Streptococcus pneumoniae R6
cagagccuugaguggauuu

SEQ ID NO: 2203215 - RNA, 16 nt, Streptococcus pneumoniae R6
cagauaggauugcccu

SEQ ID NO: 2203216 - RNA, 19 nt, Streptococcus pneumoniae R6
aaaaucccccaagcauuau

SEQ ID NO: 2203217 - RNA, 17 nt, Streptococcus pneumoniae R6
cagauagacauuuucug

SEQ ID NO: 2203218 - RNA, 21 nt, Streptococcus pneumoniae R6
cagauagagcuaacuuuuccu

SEQ ID NO: 2203219 - RNA, 23 nt, Streptococcus pneumoniae R6
cagauagguggggcaaaaacaca

SEQ ID NO: 2203220 - RNA, 20 nt, Streptococcus pneumoniae R6
aaaaucgcaaguuuuuccca

SEQ ID NO: 2203221 - RNA, 19 nt, Streptococcus pneumoniae R6
aaaauccuuuuuuugaagu

SEQ ID NO: 2203222 - RNA, 20 nt, Streptococcus pneumoniae R6
aaaauccuuuuuuugaaguu

SEQ ID NO: 2203223 - RNA, 23 nt, Streptococcus pneumoniae R6
aaaauccucugaguauuuagcaa

SEQ ID NO: 2203224 - RNA, 21 nt, Streptococcus pneumoniae R6
aaaauccguuuuuugaaguuu

SEQ ID NO: 2203225 - RNA, 22 nt, Streptococcus pneumoniae R6
aaaauccgcuugggaaaccaaa

SEQ ID NO: 2203226 - RNA, 23 nt, Streptococcus pneumoniae R6
aaaauccgcuugggaaaccaaac

SEQ ID NO: 2203227 - RNA, 20 nt, Streptococcus pneumoniae R6
cagauauaggcauaucugau

SEQ ID NO: 2203228 - RNA, 17 nt, Streptococcus pneumoniae R6
cagauauucuaaaaccu

SEQ ID NO: 2203229 - RNA, 15 nt, Streptococcus pneumoniae R6
aaaaugguuccaaaa

SEQ ID NO: 2203230 - RNA, 19 nt, Streptococcus pneumoniae R6
aaaaugguuccaaaaggca

SEQ ID NO: 2203231 - RNA, 21 nt, Streptococcus pneumoniae R6
aaaauggcgaguccuacgaac

SEQ ID NO: 2203232 - RNA, 16 nt, Streptococcus pneumoniae R6
aaaaugguaugucucg

SEQ ID NO: 2203233 - RNA, 15 nt, Streptococcus pneumoniae R6
cagcacguuuuucuu

SEQ ID NO: 2203234 - RNA, 20 nt, Streptococcus pneumoniae R6
cagcacguuuuucuucuuuu

SEQ ID NO: 2203235 - RNA, 20 nt, Streptococcus pneumoniae R6
aaaaugugauuucuguaaaa

SEQ ID NO: 2203236 - RNA, 14 nt, Streptococcus pneumoniae R6
cagcaccaguugag

SEQ ID NO: 2203237 - RNA, 16 nt, Streptococcus pneumoniae R6
cagcaccaguugaguu

SEQ ID NO: 2203238 - RNA, 14 nt, Streptococcus pneumoniae R6
aaaaucguaaaaaa

SEQ ID NO: 2203239 - RNA, 23 nt, Streptococcus pneumoniae R6
aaaaucuagucaucagaaaaaag

SEQ ID NO: 2203240 - RNA, 22 nt, Streptococcus pneumoniae R6
aaaaucuauuuuuaaauuuuau

SEQ ID NO: 2203241 - RNA, 16 nt, Streptococcus pneumoniae R6
aaaaucuguuaaaaaa

SEQ ID NO: 2203242 - RNA, 16 nt, Streptococcus pneumoniae R6
aaaaucuucaaaaaag

SEQ ID NO: 2203243 - RNA, 17 nt, Streptococcus pneumoniae R6
cagauugcucaaaacac

SEQ ID NO: 2203244 - RNA, 18 nt, Streptococcus pneumoniae R6
cagauugcucaaaacacu

SEQ ID NO: 2203245 - RNA, 17 nt, Streptococcus pneumoniae R6
cagauucugacaaucca

SEQ ID NO: 2203246 - RNA, 17 nt, Streptococcus pneumoniae R6
aaaaugcaccaaaacag

SEQ ID NO: 2203247 - RNA, 19 nt, Streptococcus pneumoniae R6
aaaaugaugcuuacugcug

SEQ ID NO: 2203248 - RNA, 17 nt, Streptococcus pneumoniae R6
aaaaugauugaaaggau

SEQ ID NO: 2203249 - RNA, 16 nt, Streptococcus pneumoniae R6
aaaaugaggaaaaucu

SEQ ID NO: 2203250 - RNA, 21 nt, Streptococcus pneumoniae R6
cagcaaaggacuaugaucagc

SEQ ID NO: 2203251 - RNA, 19 nt, Streptococcus pneumoniae R6
aaaaugccaaagaaagauu

SEQ ID NO: 2203252 - RNA, 16 nt, Streptococcus pneumoniae R6
cagcaagaaugaacau

SEQ ID NO: 2203253 - RNA, 17 nt, Streptococcus pneumoniae R6
cagcaagaaugaacauc

SEQ ID NO: 2203254 - RNA, 21 nt, Streptococcus pneumoniae R6
caguggcagcauugucauuua

SEQ ID NO: 2203255 - RNA, 23 nt, Streptococcus pneumoniae R6
caguguauggagcuuuuuuauaa

SEQ ID NO: 2203256 - RNA, 15 nt, Streptococcus pneumoniae R6
caguguacauacuuu

SEQ ID NO: 2203257 - RNA, 22 nt, Streptococcus pneumoniae R6
caguguacauacuuuaucuucu

SEQ ID NO: 2203258 - RNA, 16 nt, Streptococcus pneumoniae R6
cagugguucacuggca

SEQ ID NO: 2203259 - RNA, 20 nt, Streptococcus pneumoniae R6
caguguuuuaagcugacuuc

SEQ ID NO: 2203260 - RNA, 23 nt, Streptococcus pneumoniae R6
caguguuuuaagcugacuucguc

SEQ ID NO: 2203261 - RNA, 19 nt, Streptococcus pneumoniae R6
caguguuuugagcaaccug

SEQ ID NO: 2203262 - RNA, 23 nt, Streptococcus pneumoniae R6
caguguuuugagcaaccugcggc

SEQ ID NO: 2203263 - RNA, 22 nt, Streptococcus pneumoniae R6
caguguuuugaucugacuucgu

SEQ ID NO: 2203264 - RNA, 23 nt, Streptococcus pneumoniae R6
caguguuuugaucugacuucguc

SEQ ID NO: 2203265 - RNA, 22 nt, Streptococcus pneumoniae R6
caguuauuuuaguaaaaaaaga

SEQ ID NO: 2203266 - RNA, 19 nt, Streptococcus pneumoniae R6
caguuauucuuaaaugaca

SEQ ID NO: 2203267 - RNA, 19 nt, Streptococcus pneumoniae R6
caguuaugauauugaguuu

SEQ ID NO: 2203268 - RNA, 23 nt, Streptococcus pneumoniae R6
caguucagcauaagacaauuggu

SEQ ID NO: 2203269 - RNA, 12 nt, Streptococcus pneumoniae R6
caguucaucaug

SEQ ID NO: 2203270 - RNA, 16 nt, Streptococcus pneumoniae R6
caguucauuuuuccuu

SEQ ID NO: 2203271 - RNA, 13 nt, Streptococcus pneumoniae R6
caguugaaaaggc

SEQ ID NO: 2203272 - RNA, 16 nt, Streptococcus pneumoniae R6
caguugacaaagagcc

SEQ ID NO: 2203273 - RNA, 23 nt, Streptococcus pneumoniae R6
caguugacaaagagccauaaaaa

SEQ ID NO: 2203274 - RNA, 13 nt, Streptococcus pneumoniae R6
caguucuucaugg

SEQ ID NO: 2203275 - RNA, 22 nt, Streptococcus pneumoniae R6
caguucuucauggacuuuuuug

SEQ ID NO: 2203276 - RNA, 16 nt, Streptococcus pneumoniae R6
caguugccucagauuc

SEQ ID NO: 2203277 - RNA, 13 nt, Streptococcus pneumoniae R6
caguugcgccacu

SEQ ID NO: 2203278 - RNA, 21 nt, Streptococcus pneumoniae R6
caguugcugcguuaaauccua

SEQ ID NO: 2203279 - RNA, 23 nt, Streptococcus pneumoniae R6
caguugcugcguuaaauccuaua

SEQ ID NO: 2203280 - RNA, 13 nt, Streptococcus pneumoniae R6
caguucuauccac

SEQ ID NO: 2203281 - RNA, 15 nt, Streptococcus pneumoniae R6
caguucuaucuacaa

SEQ ID NO: 2203282 - RNA, 15 nt, Streptococcus pneumoniae R6
caguucuaucugcaa

SEQ ID NO: 2203283 - RNA, 22 nt, Streptococcus pneumoniae R6
caguuccaucuacaaccuuaaa

SEQ ID NO: 2203284 - RNA, 15 nt, Streptococcus pneumoniae R6
caguuccgauguguu

SEQ ID NO: 2203285 - RNA, 14 nt, Streptococcus pneumoniae R6
caguugguuauaca

SEQ ID NO: 2203286 - RNA, 16 nt, Streptococcus pneumoniae R6
caguugguuauacaua

SEQ ID NO: 2203287 - RNA, 20 nt, Streptococcus pneumoniae R6
caguuucuauuucauuuuac

SEQ ID NO: 2203288 - RNA, 15 nt, Streptococcus pneumoniae R6
caguuuugagguugu

SEQ ID NO: 2203289 - RNA, 16 nt, Streptococcus pneumoniae R6
caguuuugucuguaac

SEQ ID NO: 2203290 - RNA, 22 nt, Streptococcus pneumoniae R6
caguuuuugauaccacagaguu

SEQ ID NO: 2203291 - RNA, 18 nt, Streptococcus pneumoniae R6
cauaaaaaaauccuccag

SEQ ID NO: 2203292 - RNA, 21 nt, Streptococcus pneumoniae R6
caguuuuagauugcuuuccaa

SEQ ID NO: 2203293 - RNA, 20 nt, Streptococcus pneumoniae R6
caguuuuccguucucaaagc

SEQ ID NO: 2203294 - RNA, 18 nt, Streptococcus pneumoniae R6
caguuuggcguuggaaua

SEQ ID NO: 2203295 - RNA, 20 nt, Streptococcus pneumoniae R6
caguuucugugcuuuuucaa

SEQ ID NO: 2203296 - RNA, 15 nt, Streptococcus pneumoniae R6
cauaccgccuugucc

SEQ ID NO: 2203297 - RNA, 23 nt, Streptococcus pneumoniae R6
cauaccgccaaucacuugaccaa

SEQ ID NO: 2203298 - RNA, 15 nt, Streptococcus pneumoniae R6
cauaccaucaaagac

SEQ ID NO: 2203299 - RNA, 23 nt, Streptococcus pneumoniae R6
cauaccagagcgaauaccaccaa

SEQ ID NO: 2203300 - RNA, 14 nt, Streptococcus pneumoniae R6
cauaccacgguaag

SEQ ID NO: 2203301 - RNA, 20 nt, Streptococcus pneumoniae R6
cauaccaaguucuuuggcga

SEQ ID NO: 2203302 - RNA, 17 nt, Streptococcus pneumoniae R6
cauacaacuuaaaaaga

SEQ ID NO: 2203303 - RNA, 13 nt, Streptococcus pneumoniae R6
cauacaagcugcc

SEQ ID NO: 2203304 - RNA, 16 nt, Streptococcus pneumoniae R6
cauacaagcugccaaa

SEQ ID NO: 2203305 - RNA, 14 nt, Streptococcus pneumoniae R6
cauacacuggaugu

SEQ ID NO: 2203306 - RNA, 18 nt, Streptococcus pneumoniae R6
cauaaucgcuggcauuuc

SEQ ID NO: 2203307 - RNA, 18 nt, Streptococcus pneumoniae R6
cauaaucuuggucaacau

SEQ ID NO: 2203308 - RNA, 16 nt, Streptococcus pneumoniae R6
cauaaugauuucaaga

SEQ ID NO: 2203309 - RNA, 16 nt, Streptococcus pneumoniae R6
cauaauuuuaguagaa

SEQ ID NO: 2203310 - RNA, 15 nt, Streptococcus pneumoniae R6
cauaaucaagaugaa

SEQ ID NO: 2203311 - RNA, 20 nt, Streptococcus pneumoniae R6
cauaauagcagaaaaaugac

SEQ ID NO: 2203312 - RNA, 19 nt, Streptococcus pneumoniae R6
cauaauacuguggaauaua

SEQ ID NO: 2203313 - RNA, 14 nt, Streptococcus pneumoniae R6
cauaauaucauaau

SEQ ID NO: 2203314 - RNA, 18 nt, Streptococcus pneumoniae R6
cauaauaucauaaugagc

SEQ ID NO: 2203315 - RNA, 18 nt, Streptococcus pneumoniae R6
cauaauaaaagugucuua

SEQ ID NO: 2203316 - RNA, 21 nt, Streptococcus pneumoniae R6
cauaaguuguaguacugaaca

SEQ ID NO: 2203317 - RNA, 17 nt, Streptococcus pneumoniae R6
cauaagucauaacauuc

SEQ ID NO: 2203318 - RNA, 12 nt, Streptococcus pneumoniae R6
cauaaacaagag

SEQ ID NO: 2203319 - RNA, 19 nt, Streptococcus pneumoniae R6
cauaaacaagagcaaggaa

SEQ ID NO: 2203320 - RNA, 19 nt, Streptococcus pneumoniae R6
cauaaacuaagcuuauaua

SEQ ID NO: 2203321 - RNA, 12 nt, Streptococcus pneumoniae R6
cauaaagagaag

SEQ ID NO: 2203322 - RNA, 14 nt, Streptococcus pneumoniae R6
cauaaagagaagga

SEQ ID NO: 2203323 - RNA, 22 nt, Streptococcus pneumoniae R6
cauaaacgcaagcaacaaaaac

SEQ ID NO: 2203324 - RNA, 14 nt, Streptococcus pneumoniae R6
cauaaaaauugaca

SEQ ID NO: 2203325 - RNA, 12 nt, Streptococcus pneumoniae R6
cauaaaacauuu

SEQ ID NO: 2203326 - RNA, 23 nt, Streptococcus pneumoniae R6
cauaaaacauuuccgauuucaga

SEQ ID NO: 2203327 - RNA, 15 nt, Streptococcus pneumoniae R6
cauaaaagucuggcu

SEQ ID NO: 2203328 - RNA, 19 nt, Streptococcus pneumoniae R6
cauaaaaaaguuuccaauc

SEQ ID NO: 2203329 - RNA, 12 nt, Streptococcus pneumoniae R6
cauaaaaauaac

SEQ ID NO: 2203330 - RNA, 18 nt, Streptococcus pneumoniae R6
cauaaaaauaacuucaga

SEQ ID NO: 2203331 - RNA, 21 nt, Streptococcus pneumoniae R6
cauaaaucaauuuuucguaug

SEQ ID NO: 2203332 - RNA, 18 nt, Streptococcus pneumoniae R6
cauaaaucgaucauauuu

SEQ ID NO: 2203333 - RNA, 22 nt, Streptococcus pneumoniae R6
cauaaaguauuauaauauaauu

SEQ ID NO: 2203334 - RNA, 12 nt, Streptococcus pneumoniae R6
cauaaagccuuu

SEQ ID NO: 2203335 - RNA, 19 nt, Streptococcus pneumoniae R6
cauaaauacuaucaauaaa

SEQ ID NO: 2203336 - RNA, 22 nt, Streptococcus pneumoniae R6
cauaaguaccaaucccauguca

SEQ ID NO: 2203337 - RNA, 18 nt, Streptococcus pneumoniae R6
cauaagcuggucuuuuuu

SEQ ID NO: 2203338 - RNA, 13 nt, Streptococcus pneumoniae R6
cauaagaaacucu

SEQ ID NO: 2203339 - RNA, 19 nt, Streptococcus pneumoniae R6
cauaagaggucugaaacua

SEQ ID NO: 2203340 - RNA, 23 nt, Streptococcus pneumoniae R6
cauaagaggucugaaacuacuuu

SEQ ID NO: 2203341 - RNA, 17 nt, Streptococcus pneumoniae R6
cauaacagcauuuccac

SEQ ID NO: 2203342 - RNA, 17 nt, Streptococcus pneumoniae R6
cauaacacccugcauga

SEQ ID NO: 2203343 - RNA, 23 nt, Streptococcus pneumoniae R6
cauaacgaguaaaagauaaucau

SEQ ID NO: 2203344 - RNA, 16 nt, Streptococcus pneumoniae R6
cauaacgcaauuccug

SEQ ID NO: 2203345 - RNA, 14 nt, Streptococcus pneumoniae R6
cauaacgacagaag

SEQ ID NO: 2203346 - RNA, 19 nt, Streptococcus pneumoniae R6
cauaacgacagaagaagug

SEQ ID NO: 2203347 - RNA, 20 nt, Streptococcus pneumoniae R6
cauaacgacagaagaaguga

SEQ ID NO: 2203348 - RNA, 22 nt, Streptococcus pneumoniae R6
caucaauauuagaugauuuuuc

SEQ ID NO: 2203349 - RNA, 15 nt, Streptococcus pneumoniae R6
caucaacuauucuuu

SEQ ID NO: 2203350 - RNA, 21 nt, Streptococcus pneumoniae R6
caucaaccgugcagucuuuuu

SEQ ID NO: 2203351 - RNA, 20 nt, Streptococcus pneumoniae R6
caucaaaaauagaaauaaaa

SEQ ID NO: 2203352 - RNA, 22 nt, Streptococcus pneumoniae R6
cauauuggaugaguuuacuauc

SEQ ID NO: 2203353 - RNA, 17 nt, Streptococcus pneumoniae R6
cauauuaaagaguuuca

SEQ ID NO: 2203354 - RNA, 14 nt, Streptococcus pneumoniae R6
cauauguaagaaga

SEQ ID NO: 2203355 - RNA, 20 nt, Streptococcus pneumoniae R6
cauauggaagagaagcuguc

SEQ ID NO: 2203356 - RNA, 14 nt, Streptococcus pneumoniae R6
cauauccauuccuc

SEQ ID NO: 2203357 - RNA, 18 nt, Streptococcus pneumoniae R6
cauauccauuccucccau

SEQ ID NO: 2203358 - RNA, 11 nt, Streptococcus pneumoniae R6
cauauacuuua

SEQ ID NO: 2203359 - RNA, 18 nt, Streptococcus pneumoniae R6
cauauacuuuaucacaua

SEQ ID NO: 2203360 - RNA, 20 nt, Streptococcus pneumoniae R6
cauauagaccaacuauuuuc

SEQ ID NO: 2203361 - RNA, 21 nt, Streptococcus pneumoniae R6
cauauagaccaacuauuuuca

SEQ ID NO: 2203362 - RNA, 18 nt, Streptococcus pneumoniae R6
cauauagauaaaaaacaa

SEQ ID NO: 2203363 - RNA, 19 nt, Streptococcus pneumoniae R6
cauauagauaaaaaacaac

SEQ ID NO: 2203364 - RNA, 20 nt, Streptococcus pneumoniae R6
cauauagcauuguccauaac

SEQ ID NO: 2203365 - RNA, 12 nt, Streptococcus pneumoniae R6
cauaucaaucuc

SEQ ID NO: 2203366 - RNA, 15 nt, Streptococcus pneumoniae R6
cauaucaaucucugc

SEQ ID NO: 2203367 - RNA, 17 nt, Streptococcus pneumoniae R6
cauaugauugucuccuu

SEQ ID NO: 2203368 - RNA, 20 nt, Streptococcus pneumoniae R6
cauaucuuuagggaaauuau

SEQ ID NO: 2203369 - RNA, 16 nt, Streptococcus pneumoniae R6
cauaucuuauuucaau

SEQ ID NO: 2203370 - RNA, 21 nt, Streptococcus pneumoniae R6
cauaucugucuuaccacaaac

SEQ ID NO: 2203371 - RNA, 21 nt, Streptococcus pneumoniae R6
cauaucuccauuacuugcauu

SEQ ID NO: 2203372 - RNA, 19 nt, Streptococcus pneumoniae R6
cauaucugauauagauacc

SEQ ID NO: 2203373 - RNA, 16 nt, Streptococcus pneumoniae R6
cauauccccagacaua

SEQ ID NO: 2203374 - RNA, 14 nt, Streptococcus pneumoniae R6
cauaguccugaaaa

SEQ ID NO: 2203375 - RNA, 14 nt, Streptococcus pneumoniae R6
cauaguguuucucu

SEQ ID NO: 2203376 - RNA, 18 nt, Streptococcus pneumoniae R6
cauaguuacucaggauaa

SEQ ID NO: 2203377 - RNA, 20 nt, Streptococcus pneumoniae R6
cauaguuacucaggauaaaa

SEQ ID NO: 2203378 - RNA, 19 nt, Streptococcus pneumoniae R6
cauaguaccaguuaccauu

SEQ ID NO: 2203379 - RNA, 17 nt, Streptococcus pneumoniae R6
cauacucauuuaaaauc

SEQ ID NO: 2203380 - RNA, 17 nt, Streptococcus pneumoniae R6
cauaguauaucacuuua

SEQ ID NO: 2203381 - RNA, 19 nt, Streptococcus pneumoniae R6
caucaaucuuagucaaaac

SEQ ID NO: 2203382 - RNA, 22 nt, Streptococcus pneumoniae R6
caucaaucuugcguugagcgaa

SEQ ID NO: 2203383 - RNA, 13 nt, Streptococcus pneumoniae R6
caucauccaccuu

SEQ ID NO: 2203384 - RNA, 21 nt, Streptococcus pneumoniae R6
caucaucccgcccaucaugcu

SEQ ID NO: 2203385 - RNA, 14 nt, Streptococcus pneumoniae R6
caucaguuccagca

SEQ ID NO: 2203386 - RNA, 14 nt, Streptococcus pneumoniae R6
caucauaaaaauaa

SEQ ID NO: 2203387 - RNA, 18 nt, Streptococcus pneumoniae R6
cauccuuacggucaaagu

SEQ ID NO: 2203388 - RNA, 22 nt, Streptococcus pneumoniae R6
caucauuccugauaaaagauag

SEQ ID NO: 2203389 - RNA, 19 nt, Streptococcus pneumoniae R6
cauccguuuuucuccucua

SEQ ID NO: 2203390 - RNA, 21 nt, Streptococcus pneumoniae R6
cauccuaucauucgacuaauu

SEQ ID NO: 2203391 - RNA, 11 nt, Streptococcus pneumoniae R6
cauccuauuua

SEQ ID NO: 2203392 - RNA, 14 nt, Streptococcus pneumoniae R6
caucuccaacugca

SEQ ID NO: 2203393 - RNA, 14 nt, Streptococcus pneumoniae R6
caucuccauccuca

SEQ ID NO: 2203394 - RNA, 21 nt, Streptococcus pneumoniae R6
caucucccgucaagacuaggu

SEQ ID NO: 2203395 - RNA, 14 nt, Streptococcus pneumoniae R6
caucuaucaaaaga

SEQ ID NO: 2203396 - RNA, 17 nt, Streptococcus pneumoniae R6
caucuacaaccucaaaa

SEQ ID NO: 2203397 - RNA, 22 nt, Streptococcus pneumoniae R6
caucuaagguauauucaaaaua

SEQ ID NO: 2203398 - RNA, 15 nt, Streptococcus pneumoniae R6
caucgguugcaaguu

SEQ ID NO: 2203399 - RNA, 16 nt, Streptococcus pneumoniae R6
caucgcuaucaauggu

SEQ ID NO: 2203400 - RNA, 13 nt, Streptococcus pneumoniae R6
caucuaaaacugg

SEQ ID NO: 2203401 - RNA, 22 nt, Streptococcus pneumoniae R6
caucuaaaacuggugauaagua

SEQ ID NO: 2203402 - RNA, 20 nt, Streptococcus pneumoniae R6
caucucugguguguauggag

SEQ ID NO: 2203403 - RNA, 23 nt, Streptococcus pneumoniae R6
caucucuuacaguuugcucagca

SEQ ID NO: 2203404 - RNA, 16 nt, Streptococcus pneumoniae R6
caucucgugaauagag

SEQ ID NO: 2203405 - RNA, 23 nt, Streptococcus pneumoniae R6
caucucgugcauuucauccccau

SEQ ID NO: 2203406 - RNA, 14 nt, Streptococcus pneumoniae R6
caucuccugucaau

SEQ ID NO: 2203407 - RNA, 19 nt, Streptococcus pneumoniae R6
caucucuuguaacccaaac

SEQ ID NO: 2203408 - RNA, 12 nt, Streptococcus pneumoniae R6
caucugaaaucc

SEQ ID NO: 2203409 - RNA, 21 nt, Streptococcus pneumoniae R6
caucugaaaucccuuguucca

SEQ ID NO: 2203410 - RNA, 15 nt, Streptococcus pneumoniae R6
caucuucaacuucua

SEQ ID NO: 2203411 - RNA, 12 nt, Streptococcus pneumoniae R6
caucuuauuuca

SEQ ID NO: 2203412 - RNA, 18 nt, Streptococcus pneumoniae R6
caucuuauuucaaucuac

SEQ ID NO: 2203413 - RNA, 20 nt, Streptococcus pneumoniae R6
caucuuauuucaaucuacua

SEQ ID NO: 2203414 - RNA, 14 nt, Streptococcus pneumoniae R6
caucuuaacauucu

SEQ ID NO: 2203415 - RNA, 14 nt, Streptococcus pneumoniae R6
caucuguuuuaaac

SEQ ID NO: 2203416 - RNA, 14 nt, Streptococcus pneumoniae R6
caucuguuuucaaa

SEQ ID NO: 2203417 - RNA, 15 nt, Streptococcus pneumoniae R6
caucuguuuucaaaa

SEQ ID NO: 2203418 - RNA, 19 nt, Streptococcus pneumoniae R6
caucuguccccucacaucu

SEQ ID NO: 2203419 - RNA, 17 nt, Streptococcus pneumoniae R6
caucuggguuaaaaauu

SEQ ID NO: 2203420 - RNA, 21 nt, Streptococcus pneumoniae R6
caucuggauuuucagccucua

SEQ ID NO: 2203421 - RNA, 18 nt, Streptococcus pneumoniae R6
caucugcuauaauaguaa

SEQ ID NO: 2203422 - RNA, 15 nt, Streptococcus pneumoniae R6
caucugcuuucaaaa

SEQ ID NO: 2203423 - RNA, 20 nt, Streptococcus pneumoniae R6
caucuggaguagcaucccca

SEQ ID NO: 2203424 - RNA, 21 nt, Streptococcus pneumoniae R6
ccaaauauugcucauaacgca

SEQ ID NO: 2203425 - RNA, 21 nt, Streptococcus pneumoniae R6
ccaaauauuguaaauucuuaa

SEQ ID NO: 2203426 - RNA, 21 nt, Streptococcus pneumoniae R6
ccaaaucaaugagucagggaa

SEQ ID NO: 2203427 - RNA, 23 nt, Streptococcus pneumoniae R6
ccaaagguaauccaauugaggaa

SEQ ID NO: 2203428 - RNA, 23 nt, Streptococcus pneumoniae R6
ccaaaguaaaauacaaaccaaac

SEQ ID NO: 2203429 - RNA, 19 nt, Streptococcus pneumoniae R6
ccaaaggauuuaguucugu

SEQ ID NO: 2203430 - RNA, 22 nt, Streptococcus pneumoniae R6
cauuuuauuauuaauauauaaa

SEQ ID NO: 2203431 - RNA, 13 nt, Streptococcus pneumoniae R6
ccaagcucugaau

SEQ ID NO: 2203432 - RNA, 14 nt, Streptococcus pneumoniae R6
ccaagcucugaaug

SEQ ID NO: 2203433 - RNA, 15 nt, Streptococcus pneumoniae R6
ccaaggauugguaaa

SEQ ID NO: 2203434 - RNA, 23 nt, Streptococcus pneumoniae R6
ccaaggaagaagcuguaaaucua

SEQ ID NO: 2203435 - RNA, 19 nt, Streptococcus pneumoniae R6
ccaaggaagucuuguuuga

SEQ ID NO: 2203436 - RNA, 16 nt, Streptococcus pneumoniae R6
ccaaggaauucauuua

SEQ ID NO: 2203437 - RNA, 20 nt, Streptococcus pneumoniae R6
ccaaggaaaguucuuccccu

SEQ ID NO: 2203438 - RNA, 20 nt, Streptococcus pneumoniae R6
ccaagaucuugucugcaugg

SEQ ID NO: 2203439 - RNA, 16 nt, Streptococcus pneumoniae R6
ccaagaucuuuuuaua

SEQ ID NO: 2203440 - RNA, 16 nt, Streptococcus pneumoniae R6
ccaagauucaacauca

SEQ ID NO: 2203441 - RNA, 21 nt, Streptococcus pneumoniae R6
ccaagauauugccgauaucac

SEQ ID NO: 2203442 - RNA, 23 nt, Streptococcus pneumoniae R6
ccaagauagaagguaaauucugu

SEQ ID NO: 2203443 - RNA, 22 nt, Streptococcus pneumoniae R6
ccaagauagagagcuccaaaga

SEQ ID NO: 2203444 - RNA, 21 nt, Streptococcus pneumoniae R6
ccaagaguagagagaaaggag

SEQ ID NO: 2203445 - RNA, 13 nt, Streptococcus pneumoniae R6
ccaacgauuuuau

SEQ ID NO: 2203446 - RNA, 17 nt, Streptococcus pneumoniae R6
ccaacugaucccuccau

SEQ ID NO: 2203447 - RNA, 20 nt, Streptococcus pneumoniae R6
ccaagucaucaaaaauagaa

SEQ ID NO: 2203448 - RNA, 17 nt, Streptococcus pneumoniae R6
ccaagucaacaccuguc

SEQ ID NO: 2203449 - RNA, 19 nt, Streptococcus pneumoniae R6
ccaagucgaaccuuccuga

SEQ ID NO: 2203450 - RNA, 18 nt, Streptococcus pneumoniae R6
ccaagucggcaggcuggu

SEQ ID NO: 2203451 - RNA, 13 nt, Streptococcus pneumoniae R6
ccaaguuaaaaaa

SEQ ID NO: 2203452 - RNA, 20 nt, Streptococcus pneumoniae R6
ccaaguggaagucugucacc

SEQ ID NO: 2203453 - RNA, 16 nt, Streptococcus pneumoniae R6
ccaaguucauuuuuua

SEQ ID NO: 2203454 - RNA, 13 nt, Streptococcus pneumoniae R6
ccaaguucuuuuc

SEQ ID NO: 2203455 - RNA, 18 nt, Streptococcus pneumoniae R6
ccaaguuuguaucuuccu

SEQ ID NO: 2203456 - RNA, 12 nt, Streptococcus pneumoniae R6
ccaauagcgauu

SEQ ID NO: 2203457 - RNA, 22 nt, Streptococcus pneumoniae R6
ccaauagcgauucccaagucug

SEQ ID NO: 2203458 - RNA, 16 nt, Streptococcus pneumoniae R6
ccaauacuacaauaau

SEQ ID NO: 2203459 - RNA, 16 nt, Streptococcus pneumoniae R6
ccaauaucaucgauuu

SEQ ID NO: 2203460 - RNA, 22 nt, Streptococcus pneumoniae R6
ccaauaucaucgauuuuuucac

SEQ ID NO: 2203461 - RNA, 12 nt, Streptococcus pneumoniae R6
ccaauacaggaa

SEQ ID NO: 2203462 - RNA, 18 nt, Streptococcus pneumoniae R6
ccaauacaggaaaaccag

SEQ ID NO: 2203463 - RNA, 13 nt, Streptococcus pneumoniae R6
ccaaucaucaucg

SEQ ID NO: 2203464 - RNA, 18 nt, Streptococcus pneumoniae R6
ccaaucauggcugggaug

SEQ ID NO: 2203465 - RNA, 21 nt, Streptococcus pneumoniae R6
ccaaucccaugucaauucuca

SEQ ID NO: 2203466 - RNA, 16 nt, Streptococcus pneumoniae R6
ccaaucauuuggaaaa

SEQ ID NO: 2203467 - RNA, 17 nt, Streptococcus pneumoniae R6
ccaauccuaaauccucu

SEQ ID NO: 2203468 - RNA, 18 nt, Streptococcus pneumoniae R6
ccaauccuaaauccucua

SEQ ID NO: 2203469 - RNA, 22 nt, Streptococcus pneumoniae R6
ccaauccuaugauacccaaaau

SEQ ID NO: 2203470 - RNA, 22 nt, Streptococcus pneumoniae R6
ccaauccuuguaugacaucuug

SEQ ID NO: 2203471 - RNA, 21 nt, Streptococcus pneumoniae R6
ccaaucgauuuguucucaucu

SEQ ID NO: 2203472 - RNA, 14 nt, Streptococcus pneumoniae R6
ccaaucguaaacug

SEQ ID NO: 2203473 - RNA, 20 nt, Streptococcus pneumoniae R6
ccaauauuagucggaaucuu

SEQ ID NO: 2203474 - RNA, 15 nt, Streptococcus pneumoniae R6
ccaauucuucuucug

SEQ ID NO: 2203475 - RNA, 21 nt, Streptococcus pneumoniae R6
ccaauucuuucaagcgcucca

SEQ ID NO: 2203476 - RNA, 16 nt, Streptococcus pneumoniae R6
ccaauugauuaugaau

SEQ ID NO: 2203477 - RNA, 12 nt, Streptococcus pneumoniae R6
ccaauuuuuccu

SEQ ID NO: 2203478 - RNA, 13 nt, Streptococcus pneumoniae R6
ccaauuuuuccuu

SEQ ID NO: 2203479 - RNA, 19 nt, Streptococcus pneumoniae R6
ccaauggguugaaguaacu

SEQ ID NO: 2203480 - RNA, 14 nt, Streptococcus pneumoniae R6
ccaaucucaaaucc

SEQ ID NO: 2203481 - RNA, 21 nt, Streptococcus pneumoniae R6
ccaaucuggaggcuuuuucuc

SEQ ID NO: 2203482 - RNA, 15 nt, Streptococcus pneumoniae R6
ccacagcguuucuau

SEQ ID NO: 2203483 - RNA, 23 nt, Streptococcus pneumoniae R6
ccacagaguugggguuuggaaau

SEQ ID NO: 2203484 - RNA, 23 nt, Streptococcus pneumoniae R6
ccacuacacuugacaaagagcca

SEQ ID NO: 2203485 - RNA, 17 nt, Streptococcus pneumoniae R6
ccacuacaguugacaaa

SEQ ID NO: 2203486 - RNA, 23 nt, Streptococcus pneumoniae R6
ccacuacaguugacaaagagcca

SEQ ID NO: 2203487 - RNA, 23 nt, Streptococcus pneumoniae R6
ccacuacaguugacaaagagccc

SEQ ID NO: 2203488 - RNA, 17 nt, Streptococcus pneumoniae R6
ccacuaucuaaaaaaau

SEQ ID NO: 2203489 - RNA, 21 nt, Streptococcus pneumoniae R6
ccacuagcagccacuuuuuau

SEQ ID NO: 2203490 - RNA, 19 nt, Streptococcus pneumoniae R6
ccacucaaaucauuucuuu

SEQ ID NO: 2203491 - RNA, 15 nt, Streptococcus pneumoniae R6
ccacguguuuuucgu

SEQ ID NO: 2203492 - RNA, 16 nt, Streptococcus pneumoniae R6
ccacguccgucaagaa

SEQ ID NO: 2203493 - RNA, 22 nt, Streptococcus pneumoniae R6
ccacguccgucaagaagagcuu

SEQ ID NO: 2203494 - RNA, 18 nt, Streptococcus pneumoniae R6
ccacggaguuuggcagcg

SEQ ID NO: 2203495 - RNA, 20 nt, Streptococcus pneumoniae R6
ccacgcuggcuggaucagcu

SEQ ID NO: 2203496 - RNA, 15 nt, Streptococcus pneumoniae R6
ccaccugcagcaagu

SEQ ID NO: 2203497 - RNA, 13 nt, Streptococcus pneumoniae R6
cauguaagaguuc

SEQ ID NO: 2203498 - RNA, 19 nt, Streptococcus pneumoniae R6
caugucgcaucgucaucac

SEQ ID NO: 2203499 - RNA, 16 nt, Streptococcus pneumoniae R6
cauggcauggaaagca

SEQ ID NO: 2203500 - RNA, 18 nt, Streptococcus pneumoniae R6
caucuucacucuucaaau

SEQ ID NO: 2203501 - RNA, 16 nt, Streptococcus pneumoniae R6
caucuucauuuuggua

SEQ ID NO: 2203502 - RNA, 16 nt, Streptococcus pneumoniae R6
caucuuccaagaccug

SEQ ID NO: 2203503 - RNA, 22 nt, Streptococcus pneumoniae R6
caucuucguaacgaguuucugg

SEQ ID NO: 2203504 - RNA, 23 nt, Streptococcus pneumoniae R6
caugcugaccgcaaaagcuacuc

SEQ ID NO: 2203505 - RNA, 18 nt, Streptococcus pneumoniae R6
caugcugacaaagagauu

SEQ ID NO: 2203506 - RNA, 14 nt, Streptococcus pneumoniae R6
caugcuugccugaa

SEQ ID NO: 2203507 - RNA, 17 nt, Streptococcus pneumoniae R6
cauggaaagcaucucca

SEQ ID NO: 2203508 - RNA, 18 nt, Streptococcus pneumoniae R6
cauggaaccaaaguuccu

SEQ ID NO: 2203509 - RNA, 20 nt, Streptococcus pneumoniae R6
cauggaaccaaaguuccucc

SEQ ID NO: 2203510 - RNA, 19 nt, Streptococcus pneumoniae R6
caugcuggcagaaacuguc

SEQ ID NO: 2203511 - RNA, 15 nt, Streptococcus pneumoniae R6
cauggcaagcaaguc

SEQ ID NO: 2203512 - RNA, 21 nt, Streptococcus pneumoniae R6
cauggcaagcaagucuagacu

SEQ ID NO: 2203513 - RNA, 14 nt, Streptococcus pneumoniae R6
cauggaugcaauuu

SEQ ID NO: 2203514 - RNA, 13 nt, Streptococcus pneumoniae R6
cauggaucauuuc

SEQ ID NO: 2203515 - RNA, 13 nt, Streptococcus pneumoniae R6
cauuagaauucag

SEQ ID NO: 2203516 - RNA, 21 nt, Streptococcus pneumoniae R6
cauuacuaucaaaaucaauga

SEQ ID NO: 2203517 - RNA, 21 nt, Streptococcus pneumoniae R6
cauuacucaaguccuuuugau

SEQ ID NO: 2203518 - RNA, 13 nt, Streptococcus pneumoniae R6
cauguuagaaaaa

SEQ ID NO: 2203519 - RNA, 14 nt, Streptococcus pneumoniae R6
caugucuuuuaaau

SEQ ID NO: 2203520 - RNA, 18 nt, Streptococcus pneumoniae R6
caugucuuuuaaauauuu

SEQ ID NO: 2203521 - RNA, 13 nt, Streptococcus pneumoniae R6
cauguggcuaucu

SEQ ID NO: 2203522 - RNA, 21 nt, Streptococcus pneumoniae R6
cauuauagaccuuucagaacu

SEQ ID NO: 2203523 - RNA, 20 nt, Streptococcus pneumoniae R6
cauuauaggucauaugggac

SEQ ID NO: 2203524 - RNA, 13 nt, Streptococcus pneumoniae R6
cauuauaguuuaa

SEQ ID NO: 2203525 - RNA, 23 nt, Streptococcus pneumoniae R6
cauuauaguuuaaguaguaacca

SEQ ID NO: 2203526 - RNA, 15 nt, Streptococcus pneumoniae R6
cauuauuuaacuaaa

SEQ ID NO: 2203527 - RNA, 18 nt, Streptococcus pneumoniae R6
cauuauuuaacuaaaucu

SEQ ID NO: 2203528 - RNA, 20 nt, Streptococcus pneumoniae R6
cauucaauacgaaucaauac

SEQ ID NO: 2203529 - RNA, 23 nt, Streptococcus pneumoniae R6
cauucaagagacucuuuaagaga

SEQ ID NO: 2203530 - RNA, 17 nt, Streptococcus pneumoniae R6
cauucaaagaaccugca

SEQ ID NO: 2203531 - RNA, 18 nt, Streptococcus pneumoniae R6
cauucaauccaucuccaa

SEQ ID NO: 2203532 - RNA, 17 nt, Streptococcus pneumoniae R6
cauuauacaucuuccca

SEQ ID NO: 2203533 - RNA, 14 nt, Streptococcus pneumoniae R6
cauuauagaaggca

SEQ ID NO: 2203534 - RNA, 21 nt, Streptococcus pneumoniae R6
cauuauagaaggcaauuaaaa

SEQ ID NO: 2203535 - RNA, 15 nt, Streptococcus pneumoniae R6
cauuagcuguaucua

SEQ ID NO: 2203536 - RNA, 18 nt, Streptococcus pneumoniae R6
cauucauagguucaucua

SEQ ID NO: 2203537 - RNA, 18 nt, Streptococcus pneumoniae R6
cauuccugcuccuccgag

SEQ ID NO: 2203538 - RNA, 18 nt, Streptococcus pneumoniae R6
cauucgaaugauauuuuc

SEQ ID NO: 2203539 - RNA, 19 nt, Streptococcus pneumoniae R6
cauucgaaugauauuuuca

SEQ ID NO: 2203540 - RNA, 19 nt, Streptococcus pneumoniae R6
cauucgaaugauuucucuu

SEQ ID NO: 2203541 - RNA, 15 nt, Streptococcus pneumoniae R6
cauucuaaaacgcau

SEQ ID NO: 2203542 - RNA, 20 nt, Streptococcus pneumoniae R6
cauugauuuucaucaucaca

SEQ ID NO: 2203543 - RNA, 18 nt, Streptococcus pneumoniae R6
cauugcgcuugauaaguu

SEQ ID NO: 2203544 - RNA, 16 nt, Streptococcus pneumoniae R6
cauuggaaguucuuuu

SEQ ID NO: 2203545 - RNA, 18 nt, Streptococcus pneumoniae R6
cauugcguuugauaaguu

SEQ ID NO: 2203546 - RNA, 16 nt, Streptococcus pneumoniae R6
cauugugaugaagauu

SEQ ID NO: 2203547 - RNA, 19 nt, Streptococcus pneumoniae R6
cauugugcuugauaaguuu

SEQ ID NO: 2203548 - RNA, 22 nt, Streptococcus pneumoniae R6
cauuguuaaaaaucgauuugac

SEQ ID NO: 2203549 - RNA, 17 nt, Streptococcus pneumoniae R6
cauuguuucguuucuuc

SEQ ID NO: 2203550 - RNA, 15 nt, Streptococcus pneumoniae R6
cauuuaagccuuuuu

SEQ ID NO: 2203551 - RNA, 16 nt, Streptococcus pneumoniae R6
cauuuaauauauuuau

SEQ ID NO: 2203552 - RNA, 19 nt, Streptococcus pneumoniae R6
cauuuaauccaaaguaaaa

SEQ ID NO: 2203553 - RNA, 16 nt, Streptococcus pneumoniae R6
cauuuaauaaugaaga

SEQ ID NO: 2203554 - RNA, 13 nt, Streptococcus pneumoniae R6
cauuuacagaagc

SEQ ID NO: 2203555 - RNA, 16 nt, Streptococcus pneumoniae R6
cauugguucuuuuuac

SEQ ID NO: 2203556 - RNA, 19 nt, Streptococcus pneumoniae R6
cauuguagaggaggauaga

SEQ ID NO: 2203557 - RNA, 15 nt, Streptococcus pneumoniae R6
cauugucauuuaugu

SEQ ID NO: 2203558 - RNA, 22 nt, Streptococcus pneumoniae R6
cauuuuaaaggucaauuccuca

SEQ ID NO: 2203559 - RNA, 13 nt, Streptococcus pneumoniae R6
cauuuguaaaucu

SEQ ID NO: 2203560 - RNA, 19 nt, Streptococcus pneumoniae R6
cauuuggguaggucuuuuu

SEQ ID NO: 2203561 - RNA, 19 nt, Streptococcus pneumoniae R6
cauuugggcaaucgccaau

SEQ ID NO: 2203562 - RNA, 19 nt, Streptococcus pneumoniae R6
cauuuggcaccgaauuuuu

SEQ ID NO: 2203563 - RNA, 16 nt, Streptococcus pneumoniae R6
cauuuggcuauaaaaa

SEQ ID NO: 2203564 - RNA, 22 nt, Streptococcus pneumoniae R6
cauuuggcccuaccugcuccaa

SEQ ID NO: 2203565 - RNA, 14 nt, Streptococcus pneumoniae R6
cauuucuucaacaa

SEQ ID NO: 2203566 - RNA, 13 nt, Streptococcus pneumoniae R6
cauuugaauagaa

SEQ ID NO: 2203567 - RNA, 15 nt, Streptococcus pneumoniae R6
cauuugaaucaaaaa

SEQ ID NO: 2203568 - RNA, 16 nt, Streptococcus pneumoniae R6
cauuugaugagaaaau

SEQ ID NO: 2203569 - RNA, 21 nt, Streptococcus pneumoniae R6
cauuugaugagaaaauaaagu

SEQ ID NO: 2203570 - RNA, 22 nt, Streptococcus pneumoniae R6
cauuugauuuuccuaaucaauu

SEQ ID NO: 2203571 - RNA, 19 nt, Streptococcus pneumoniae R6
cauuugcgcgcuugaauga

SEQ ID NO: 2203572 - RNA, 15 nt, Streptococcus pneumoniae R6
cauuucuggauaacu

SEQ ID NO: 2203573 - RNA, 12 nt, Streptococcus pneumoniae R6
cauuucuuuucu

SEQ ID NO: 2203574 - RNA, 22 nt, Streptococcus pneumoniae R6
cauuucuuuugcaaucauuuca

SEQ ID NO: 2203575 - RNA, 23 nt, Streptococcus pneumoniae R6
cauuucuuccgacaauacaguag

SEQ ID NO: 2203576 - RNA, 15 nt, Streptococcus pneumoniae R6
cauuucuucuaugca

SEQ ID NO: 2203577 - RNA, 20 nt, Streptococcus pneumoniae R6
cauuucuauaaaucaauuuu

SEQ ID NO: 2203578 - RNA, 12 nt, Streptococcus pneumoniae R6
cauuucacgcgc

SEQ ID NO: 2203579 - RNA, 22 nt, Streptococcus pneumoniae R6
cauuuacucuccuccauaaaaa

SEQ ID NO: 2203580 - RNA, 22 nt, Streptococcus pneumoniae R6
cauuuaggcuaagagagaagcc

SEQ ID NO: 2203581 - RNA, 17 nt, Streptococcus pneumoniae R6
cauuuauggaaaaaaug

SEQ ID NO: 2203582 - RNA, 18 nt, Streptococcus pneumoniae R6
cauuuauauaaaaagaaa

SEQ ID NO: 2203583 - RNA, 21 nt, Streptococcus pneumoniae R6
cauuuccauuguuguuucuug

SEQ ID NO: 2203584 - RNA, 20 nt, Streptococcus pneumoniae R6
cauuucgacugaaaauauuu

SEQ ID NO: 2203585 - RNA, 16 nt, Streptococcus pneumoniae R6
ccagcuaggagagcua

SEQ ID NO: 2203586 - RNA, 21 nt, Streptococcus pneumoniae R6
ccagcuaugccagugcccaua

SEQ ID NO: 2203587 - RNA, 23 nt, Streptococcus pneumoniae R6
ccagcuucuuuuuauauauaaaa

SEQ ID NO: 2203588 - RNA, 12 nt, Streptococcus pneumoniae R6
ccagcuucuugg

SEQ ID NO: 2203589 - RNA, 15 nt, Streptococcus pneumoniae R6
ccaggaaaccagcug

SEQ ID NO: 2203590 - RNA, 16 nt, Streptococcus pneumoniae R6
ccaggcuaauugcaaa

SEQ ID NO: 2203591 - RNA, 17 nt, Streptococcus pneumoniae R6
ccauaauaucauaauga

SEQ ID NO: 2203592 - RNA, 17 nt, Streptococcus pneumoniae R6
ccauacuuucucugacu

SEQ ID NO: 2203593 - RNA, 13 nt, Streptococcus pneumoniae R6
ccauauaaaucuc

SEQ ID NO: 2203594 - RNA, 13 nt, Streptococcus pneumoniae R6
ccauaaaucuuga

SEQ ID NO: 2203595 - RNA, 13 nt, Streptococcus pneumoniae R6
ccaucugcagccu

SEQ ID NO: 2203596 - RNA, 11 nt, Streptococcus pneumoniae R6
ccaucuguaau

SEQ ID NO: 2203597 - RNA, 15 nt, Streptococcus pneumoniae R6
ccaucuccaaccauc

SEQ ID NO: 2203598 - RNA, 18 nt, Streptococcus pneumoniae R6
ccaucucggucaucauca

SEQ ID NO: 2203599 - RNA, 17 nt, Streptococcus pneumoniae R6
ccaucuccgauuaccga

SEQ ID NO: 2203600 - RNA, 13 nt, Streptococcus pneumoniae R6
ccaucuagaauca

SEQ ID NO: 2203601 - RNA, 21 nt, Streptococcus pneumoniae R6
ccaucuagaaucaauagaagu

SEQ ID NO: 2203602 - RNA, 14 nt, Streptococcus pneumoniae R6
ccaucuacaaccuu

SEQ ID NO: 2203603 - RNA, 20 nt, Streptococcus pneumoniae R6
ccaucuacacccacgucaca

SEQ ID NO: 2203604 - RNA, 23 nt, Streptococcus pneumoniae R6
ccaucuacacccacgucacaaag

SEQ ID NO: 2203605 - RNA, 18 nt, Streptococcus pneumoniae R6
ccaucguuccguucuuau

SEQ ID NO: 2203606 - RNA, 20 nt, Streptococcus pneumoniae R6
ccaucguuccugucuuauuu

SEQ ID NO: 2203607 - RNA, 19 nt, Streptococcus pneumoniae R6
ccaucccauuuauauaaaa

SEQ ID NO: 2203608 - RNA, 17 nt, Streptococcus pneumoniae R6
aaacaaggcagagaugu

SEQ ID NO: 2203609 - RNA, 22 nt, Streptococcus pneumoniae R6
aaacaaguugcuugaaaacuca

SEQ ID NO: 2203610 - RNA, 17 nt, Streptococcus pneumoniae R6
aaacaagggauuuuucu

SEQ ID NO: 2203611 - RNA, 19 nt, Streptococcus pneumoniae R6
aaacaaggugaacuugacc

SEQ ID NO: 2203612 - RNA, 19 nt, Streptococcus pneumoniae R6
ccaucauccaccuugcaaa

SEQ ID NO: 2203613 - RNA, 22 nt, Streptococcus pneumoniae R6
aaacaagauaggagaccagcua

SEQ ID NO: 2203614 - RNA, 14 nt, Streptococcus pneumoniae R6
aaacaagaacaaga

SEQ ID NO: 2203615 - RNA, 18 nt, Streptococcus pneumoniae R6
aaacaagaacaagacaaa

SEQ ID NO: 2203616 - RNA, 16 nt, Streptococcus pneumoniae R6
cccaccaagucaucaa

SEQ ID NO: 2203617 - RNA, 18 nt, Streptococcus pneumoniae R6
cccacuacaguugacaaa

SEQ ID NO: 2203618 - RNA, 22 nt, Streptococcus pneumoniae R6
cccacuacaguugacaaagagc

SEQ ID NO: 2203619 - RNA, 14 nt, Streptococcus pneumoniae R6
cccacuaaaaauau

SEQ ID NO: 2203620 - RNA, 23 nt, Streptococcus pneumoniae R6
cccacugcgaagagggcaaggau

SEQ ID NO: 2203621 - RNA, 21 nt, Streptococcus pneumoniae R6
cccagacuuuuuuauacuuuu

SEQ ID NO: 2203622 - RNA, 13 nt, Streptococcus pneumoniae R6
cccaaauuccugg

SEQ ID NO: 2203623 - RNA, 11 nt, Streptococcus pneumoniae R6
cccaaaucauc

SEQ ID NO: 2203624 - RNA, 12 nt, Streptococcus pneumoniae R6
cccaaaucauca

SEQ ID NO: 2203625 - RNA, 20 nt, Streptococcus pneumoniae R6
cccaaacauagugaccugga

SEQ ID NO: 2203626 - RNA, 12 nt, Streptococcus pneumoniae R6
cccaaaaugagg

SEQ ID NO: 2203627 - RNA, 16 nt, Streptococcus pneumoniae R6
cccaaaaugagggucc

SEQ ID NO: 2203628 - RNA, 13 nt, Streptococcus pneumoniae R6
cccaaacaaaaaa

SEQ ID NO: 2203629 - RNA, 14 nt, Streptococcus pneumoniae R6
cccaaagaauccau

SEQ ID NO: 2203630 - RNA, 22 nt, Streptococcus pneumoniae R6
cccaaagaauccaucugauaaa

SEQ ID NO: 2203631 - RNA, 15 nt, Streptococcus pneumoniae R6
cccaaacucuucaca

SEQ ID NO: 2203632 - RNA, 13 nt, Streptococcus pneumoniae R6
ccauuuauauaaa

SEQ ID NO: 2203633 - RNA, 18 nt, Streptococcus pneumoniae R6
cccaaaaguuagauuuuu

SEQ ID NO: 2203634 - RNA, 20 nt, Streptococcus pneumoniae R6
cccaaaaguuagauuuuuuc

SEQ ID NO: 2203635 - RNA, 22 nt, Streptococcus pneumoniae R6
cccaaaagauagaugauuuagu

SEQ ID NO: 2203636 - RNA, 12 nt, Streptococcus pneumoniae R6
cccaaccacuuc

SEQ ID NO: 2203637 - RNA, 17 nt, Streptococcus pneumoniae R6
cccaauaacgaagucua

SEQ ID NO: 2203638 - RNA, 14 nt, Streptococcus pneumoniae R6
cccaaguuaaaaaa

SEQ ID NO: 2203639 - RNA, 17 nt, Streptococcus pneumoniae R6
cccaaguuaaaaaacuu

SEQ ID NO: 2203640 - RNA, 22 nt, Streptococcus pneumoniae R6
ccauugucaugucauguuagaa

SEQ ID NO: 2203641 - RNA, 14 nt, Streptococcus pneumoniae R6
ccauuguauccuga

SEQ ID NO: 2203642 - RNA, 22 nt, Streptococcus pneumoniae R6
ccauugguguuugguugaccag

SEQ ID NO: 2203643 - RNA, 18 nt, Streptococcus pneumoniae R6
ccauucuucuuuuccaaa

SEQ ID NO: 2203644 - RNA, 15 nt, Streptococcus pneumoniae R6
ccauugagaaaauau

SEQ ID NO: 2203645 - RNA, 16 nt, Streptococcus pneumoniae R6
ccauugagaaaauaug

SEQ ID NO: 2203646 - RNA, 13 nt, Streptococcus pneumoniae R6
ccauugacagauu

SEQ ID NO: 2203647 - RNA, 12 nt, Streptococcus pneumoniae R6
ccauucacaaca

SEQ ID NO: 2203648 - RNA, 15 nt, Streptococcus pneumoniae R6
ccauucacaacaucu

SEQ ID NO: 2203649 - RNA, 19 nt, Streptococcus pneumoniae R6
ccaugcugaccgcaaaagc

SEQ ID NO: 2203650 - RNA, 14 nt, Streptococcus pneumoniae R6
ccaugcugacgaug

SEQ ID NO: 2203651 - RNA, 16 nt, Streptococcus pneumoniae R6
ccccuacucgauuuua

SEQ ID NO: 2203652 - RNA, 22 nt, Streptococcus pneumoniae R6
cccgauggguuaagugcauucg

SEQ ID NO: 2203653 - RNA, 22 nt, Streptococcus pneumoniae R6
cccgcauaaauacuaucaauaa

SEQ ID NO: 2203654 - RNA, 15 nt, Streptococcus pneumoniae R6
cccgcccaucaugcu

SEQ ID NO: 2203655 - RNA, 18 nt, Streptococcus pneumoniae R6
cccauuuauggaaaaaau

SEQ ID NO: 2203656 - RNA, 19 nt, Streptococcus pneumoniae R6
ccccaagaaugggcuccca

SEQ ID NO: 2203657 - RNA, 14 nt, Streptococcus pneumoniae R6
cccagcauggucag

SEQ ID NO: 2203658 - RNA, 18 nt, Streptococcus pneumoniae R6
cccagcauggucaggcua

SEQ ID NO: 2203659 - RNA, 20 nt, Streptococcus pneumoniae R6
cccccaagaaugggcuccca

SEQ ID NO: 2203660 - RNA, 16 nt, Streptococcus pneumoniae R6
ccccauuuaccaagcu

SEQ ID NO: 2203661 - RNA, 17 nt, Streptococcus pneumoniae R6
ccccauuuaccaagcuc

SEQ ID NO: 2203662 - RNA, 18 nt, Streptococcus pneumoniae R6
aaacacuaccaagcacga

SEQ ID NO: 2203663 - RNA, 13 nt, Streptococcus pneumoniae R6
ccgauaucaccaa

SEQ ID NO: 2203664 - RNA, 16 nt, Streptococcus pneumoniae R6
ccgauacugccgccac

SEQ ID NO: 2203665 - RNA, 14 nt, Streptococcus pneumoniae R6
ccgacuauuuuuug

SEQ ID NO: 2203666 - RNA, 19 nt, Streptococcus pneumoniae R6
ccgagucaaaauucuuuga

SEQ ID NO: 2203667 - RNA, 13 nt, Streptococcus pneumoniae R6
ccgauaacagccg

SEQ ID NO: 2203668 - RNA, 11 nt, Streptococcus pneumoniae R6
cccugucuuua

SEQ ID NO: 2203669 - RNA, 20 nt, Streptococcus pneumoniae R6
cccuugucuacauucuuuuu

SEQ ID NO: 2203670 - RNA, 14 nt, Streptococcus pneumoniae R6
cccuugauuuccuu

SEQ ID NO: 2203671 - RNA, 13 nt, Streptococcus pneumoniae R6
cccuucuuuuuau

SEQ ID NO: 2203672 - RNA, 15 nt, Streptococcus pneumoniae R6
aaacacuguuuuaag

SEQ ID NO: 2203673 - RNA, 23 nt, Streptococcus pneumoniae R6
aaacacuguuuugagguugcaga

SEQ ID NO: 2203674 - RNA, 21 nt, Streptococcus pneumoniae R6
aaacagaaaaaucuguuaaaa

SEQ ID NO: 2203675 - RNA, 18 nt, Streptococcus pneumoniae R6
cccugcgacaaaauugau

SEQ ID NO: 2203676 - RNA, 15 nt, Streptococcus pneumoniae R6
cccuggaggauagca

SEQ ID NO: 2203677 - RNA, 14 nt, Streptococcus pneumoniae R6
cccuuugcugcuuu

SEQ ID NO: 2203678 - RNA, 23 nt, Streptococcus pneumoniae R6
aaacagaggcuggacaaaaacuc

SEQ ID NO: 2203679 - RNA, 19 nt, Streptococcus pneumoniae R6
aaacagagguggaaaagca

SEQ ID NO: 2203680 - RNA, 13 nt, Streptococcus pneumoniae R6
aaacagacaaaac

SEQ ID NO: 2203681 - RNA, 19 nt, Streptococcus pneumoniae R6
aaacaucucagaauaauau

SEQ ID NO: 2203682 - RNA, 22 nt, Streptococcus pneumoniae R6
aaacaucuaccuauucauauau

SEQ ID NO: 2203683 - RNA, 21 nt, Streptococcus pneumoniae R6
aaacaguuagacaauuaauuu

SEQ ID NO: 2203684 - RNA, 17 nt, Streptococcus pneumoniae R6
aaacaguguuuuaagcu

SEQ ID NO: 2203685 - RNA, 15 nt, Streptococcus pneumoniae R6
aaacagugcuagaaa

SEQ ID NO: 2203686 - RNA, 22 nt, Streptococcus pneumoniae R6
aaacagugcuagaaauugacug

SEQ ID NO: 2203687 - RNA, 16 nt, Streptococcus pneumoniae R6
ccgaaccguguuguau

SEQ ID NO: 2203688 - RNA, 22 nt, Streptococcus pneumoniae R6
ccgaagucaagccuccaauagc

SEQ ID NO: 2203689 - RNA, 14 nt, Streptococcus pneumoniae R6
ccgaagaaggccaa

SEQ ID NO: 2203690 - RNA, 14 nt, Streptococcus pneumoniae R6
aaacauuuccgauu

SEQ ID NO: 2203691 - RNA, 18 nt, Streptococcus pneumoniae R6
ccgacaaucguugcaccu

SEQ ID NO: 2203692 - RNA, 19 nt, Streptococcus pneumoniae R6
ccgacaccaguauucuuuu

SEQ ID NO: 2203693 - RNA, 13 nt, Streptococcus pneumoniae R6
aaaccaauaauaa

SEQ ID NO: 2203694 - RNA, 22 nt, Streptococcus pneumoniae R6
aaaccaauagccgcaaacuugg

SEQ ID NO: 2203695 - RNA, 11 nt, Streptococcus pneumoniae R6
aaaccaagaac

SEQ ID NO: 2203696 - RNA, 16 nt, Streptococcus pneumoniae R6
aaaccaagaaccuugg

SEQ ID NO: 2203697 - RNA, 13 nt, Streptococcus pneumoniae R6
aaaccaagaaguc

SEQ ID NO: 2203698 - RNA, 21 nt, Streptococcus pneumoniae R6
aaaccaagaaguccauagcgu

SEQ ID NO: 2203699 - RNA, 17 nt, Streptococcus pneumoniae R6
aaaccaauucccaaaca

SEQ ID NO: 2203700 - RNA, 18 nt, Streptococcus pneumoniae R6
aaaccaaucucaaauccu

SEQ ID NO: 2203701 - RNA, 13 nt, Streptococcus pneumoniae R6
aaaccaauuuuaa

SEQ ID NO: 2203702 - RNA, 23 nt, Streptococcus pneumoniae R6
aaaccaccagaguggauuugguu

SEQ ID NO: 2203703 - RNA, 18 nt, Streptococcus pneumoniae R6
aaaccaaacggauuuugu

SEQ ID NO: 2203704 - RNA, 18 nt, Streptococcus pneumoniae R6
aaaccaaacggauuuuuu

SEQ ID NO: 2203705 - RNA, 14 nt, Streptococcus pneumoniae R6
aaaccaaaggaagc

SEQ ID NO: 2203706 - RNA, 13 nt, Streptococcus pneumoniae R6
aaaccaaaggcau

SEQ ID NO: 2203707 - RNA, 20 nt, Streptococcus pneumoniae R6
aaaccaaaggcauugugcuu

SEQ ID NO: 2203708 - RNA, 21 nt, Streptococcus pneumoniae R6
ccuguaaaaagugaaaggaag

SEQ ID NO: 2203709 - RNA, 20 nt, Streptococcus pneumoniae R6
ccuguagggggcauauaaau

SEQ ID NO: 2203710 - RNA, 14 nt, Streptococcus pneumoniae R6
ccugugauuuucuu

SEQ ID NO: 2203711 - RNA, 17 nt, Streptococcus pneumoniae R6
ccuguucuuguuucaau

SEQ ID NO: 2203712 - RNA, 21 nt, Streptococcus pneumoniae R6
ccuguucuaagguuucaaaac

SEQ ID NO: 2203713 - RNA, 18 nt, Streptococcus pneumoniae R6
ccuguuguaauuuuaaaa

SEQ ID NO: 2203714 - RNA, 21 nt, Streptococcus pneumoniae R6
ccuguucuauagcagccuccg

SEQ ID NO: 2203715 - RNA, 10 nt, Streptococcus pneumoniae R6
ccuuaaaaaa

SEQ ID NO: 2203716 - RNA, 14 nt, Streptococcus pneumoniae R6
ccuuaaaacagugu

SEQ ID NO: 2203717 - RNA, 18 nt, Streptococcus pneumoniae R6
ccuuaaaacaguguuuug

SEQ ID NO: 2203718 - RNA, 11 nt, Streptococcus pneumoniae R6
ccuuaaaacca

SEQ ID NO: 2203719 - RNA, 16 nt, Streptococcus pneumoniae R6
ccuuaaaaccauguuu

SEQ ID NO: 2203720 - RNA, 18 nt, Streptococcus pneumoniae R6
ccuguuugaaucaauucu

SEQ ID NO: 2203721 - RNA, 16 nt, Streptococcus pneumoniae R6
ccuguuuggucagacu

SEQ ID NO: 2203722 - RNA, 17 nt, Streptococcus pneumoniae R6
ccuguuuguguuucugg

SEQ ID NO: 2203723 - RNA, 14 nt, Streptococcus pneumoniae R6
ccuguuuucacauu

SEQ ID NO: 2203724 - RNA, 23 nt, Streptococcus pneumoniae R6
ccuguuuucacuggaguucuuuu

SEQ ID NO: 2203725 - RNA, 13 nt, Streptococcus pneumoniae R6
ccuuauauuuuuu

SEQ ID NO: 2203726 - RNA, 17 nt, Streptococcus pneumoniae R6
ccuuauccacaucauca

SEQ ID NO: 2203727 - RNA, 21 nt, Streptococcus pneumoniae R6
ccuucaucaaaugacuaaccu

SEQ ID NO: 2203728 - RNA, 17 nt, Streptococcus pneumoniae R6
ccuucaucauagaaaua

SEQ ID NO: 2203729 - RNA, 17 nt, Streptococcus pneumoniae R6
ccuucauuuuacaucug

SEQ ID NO: 2203730 - RNA, 12 nt, Streptococcus pneumoniae R6
ccuuaagucugu

SEQ ID NO: 2203731 - RNA, 14 nt, Streptococcus pneumoniae R6
ccuuaagaacaucu

SEQ ID NO: 2203732 - RNA, 17 nt, Streptococcus pneumoniae R6
ccuuaacuggagcagga

SEQ ID NO: 2203733 - RNA, 21 nt, Streptococcus pneumoniae R6
ccuuagcaacuguuuuuucaa

SEQ ID NO: 2203734 - RNA, 13 nt, Streptococcus pneumoniae R6
ccuuagucucaaa

SEQ ID NO: 2203735 - RNA, 14 nt, Streptococcus pneumoniae R6
ccuucguaaauaag

SEQ ID NO: 2203736 - RNA, 17 nt, Streptococcus pneumoniae R6
ccuucuccaauugcaag

SEQ ID NO: 2203737 - RNA, 17 nt, Streptococcus pneumoniae R6
ccuuccaugauagaugg

SEQ ID NO: 2203738 - RNA, 16 nt, Streptococcus pneumoniae R6
ccuugauucggccacu

SEQ ID NO: 2203739 - RNA, 17 nt, Streptococcus pneumoniae R6
ccuugccaucugcuuca

SEQ ID NO: 2203740 - RNA, 16 nt, Streptococcus pneumoniae R6
ccuugcaggauuuuug

SEQ ID NO: 2203741 - RNA, 21 nt, Streptococcus pneumoniae R6
ccuucuggcaauuuaucccaa

SEQ ID NO: 2203742 - RNA, 17 nt, Streptococcus pneumoniae R6
ccuugauaaugcguuua

SEQ ID NO: 2203743 - RNA, 20 nt, Streptococcus pneumoniae R6
ccuugccuaauuuuucaaua

SEQ ID NO: 2203744 - RNA, 22 nt, Streptococcus pneumoniae R6
ccuuucucgagcuuagcuuuuc

SEQ ID NO: 2203745 - RNA, 21 nt, Streptococcus pneumoniae R6
ccuuucuuuuuugauguucag

SEQ ID NO: 2203746 - RNA, 14 nt, Streptococcus pneumoniae R6
ccuuugauagcauc

SEQ ID NO: 2203747 - RNA, 22 nt, Streptococcus pneumoniae R6
ccuuuuaugaggugcuuuuuga

SEQ ID NO: 2203748 - RNA, 21 nt, Streptococcus pneumoniae R6
ccuuuuaguuuuaucuuaauu

SEQ ID NO: 2203749 - RNA, 15 nt, Streptococcus pneumoniae R6
ccuuuucgugagcga

SEQ ID NO: 2203750 - RNA, 15 nt, Streptococcus pneumoniae R6
ccuuuucuacugaaa

SEQ ID NO: 2203751 - RNA, 21 nt, Streptococcus pneumoniae R6
ccuuuuuucuuuacucuuugg

SEQ ID NO: 2203752 - RNA, 22 nt, Streptococcus pneumoniae R6
ccuuuuuucuaugcuuuuauuc

SEQ ID NO: 2203753 - RNA, 13 nt, Streptococcus pneumoniae R6
ccuuuuuuguuuc

SEQ ID NO: 2203754 - RNA, 18 nt, Streptococcus pneumoniae R6
ccuuuuugauaagauaau

SEQ ID NO: 2203755 - RNA, 18 nt, Streptococcus pneumoniae R6
ccuuuuugcccuuuuuga

SEQ ID NO: 2203756 - RNA, 14 nt, Streptococcus pneumoniae R6
ccuuuuugcagaag

SEQ ID NO: 2203757 - RNA, 17 nt, Streptococcus pneumoniae R6
cgaaaaaugcuggcgga

SEQ ID NO: 2203758 - RNA, 17 nt, Streptococcus pneumoniae R6
cgaaaaguaggacgaua

SEQ ID NO: 2203759 - RNA, 15 nt, Streptococcus pneumoniae R6
cgaaaaucacuccag

SEQ ID NO: 2203760 - RNA, 15 nt, Streptococcus pneumoniae R6
cgaaaaucuccucua

SEQ ID NO: 2203761 - RNA, 21 nt, Streptococcus pneumoniae R6
cgaaacaauugcuaaaacauu

SEQ ID NO: 2203762 - RNA, 18 nt, Streptococcus pneumoniae R6
cgaaacucuuuuuaaacc

SEQ ID NO: 2203763 - RNA, 18 nt, Streptococcus pneumoniae R6
cgaaacuccauaaaauca

SEQ ID NO: 2203764 - RNA, 15 nt, Streptococcus pneumoniae R6
cgaaacgaagaagga

SEQ ID NO: 2203765 - RNA, 17 nt, Streptococcus pneumoniae R6
cgaaaucugucuaccuu

SEQ ID NO: 2203766 - RNA, 15 nt, Streptococcus pneumoniae R6
cgaaaggcuuuauuc

SEQ ID NO: 2203767 - RNA, 14 nt, Streptococcus pneumoniae R6
cgaaaggagaaaaa

SEQ ID NO: 2203768 - RNA, 20 nt, Streptococcus pneumoniae R6
cgaacgccuuaaaaaaccaa

SEQ ID NO: 2203769 - RNA, 13 nt, Streptococcus pneumoniae R6
cgaaauucguacu

SEQ ID NO: 2203770 - RNA, 17 nt, Streptococcus pneumoniae R6
cgaaauucguacucucu

SEQ ID NO: 2203771 - RNA, 12 nt, Streptococcus pneumoniae R6
cgaacaaaucaa

SEQ ID NO: 2203772 - RNA, 14 nt, Streptococcus pneumoniae R6
cgaagucagcucaa

SEQ ID NO: 2203773 - RNA, 17 nt, Streptococcus pneumoniae R6
cgaagguuauaccaaaa

SEQ ID NO: 2203774 - RNA, 20 nt, Streptococcus pneumoniae R6
cgaagguuauaccaaaaaaa

SEQ ID NO: 2203775 - RNA, 14 nt, Streptococcus pneumoniae R6
cgaagacggggcug

SEQ ID NO: 2203776 - RNA, 12 nt, Streptococcus pneumoniae R6
cgaagagcuggc

SEQ ID NO: 2203777 - RNA, 19 nt, Streptococcus pneumoniae R6
cgaagaguauaagucucua

SEQ ID NO: 2203778 - RNA, 19 nt, Streptococcus pneumoniae R6
cgaagaguucaauagcucu

SEQ ID NO: 2203779 - RNA, 12 nt, Streptococcus pneumoniae R6
ccugccaauggu

SEQ ID NO: 2203780 - RNA, 21 nt, Streptococcus pneumoniae R6
ccugauauuaugcguuuuuca

SEQ ID NO: 2203781 - RNA, 13 nt, Streptococcus pneumoniae R6
ccugaucgauuug

SEQ ID NO: 2203782 - RNA, 14 nt, Streptococcus pneumoniae R6
ccugcaaaacuaga

SEQ ID NO: 2203783 - RNA, 23 nt, Streptococcus pneumoniae R6
ccucuuuuuauucuuuuucaaag

SEQ ID NO: 2203784 - RNA, 22 nt, Streptococcus pneumoniae R6
ccucuuuacaugcgcaaaauaa

SEQ ID NO: 2203785 - RNA, 10 nt, Streptococcus pneumoniae R6
ccugaagaau

SEQ ID NO: 2203786 - RNA, 23 nt, Streptococcus pneumoniae R6
ccugaaauauacucauaaagucu

SEQ ID NO: 2203787 - RNA, 21 nt, Streptococcus pneumoniae R6
ccugacaauuuaaccaaacca

SEQ ID NO: 2203788 - RNA, 21 nt, Streptococcus pneumoniae R6
ccugacauucuuuagcuuuca

SEQ ID NO: 2203789 - RNA, 22 nt, Streptococcus pneumoniae R6
ccugaauuagcaaucacucuaa

SEQ ID NO: 2203790 - RNA, 21 nt, Streptococcus pneumoniae R6
ccugaaucuccucaggaacuu

SEQ ID NO: 2203791 - RNA, 18 nt, Streptococcus pneumoniae R6
ccugaaugaauugccuga

SEQ ID NO: 2203792 - RNA, 20 nt, Streptococcus pneumoniae R6
ccugaaugauuucuucuugg

SEQ ID NO: 2203793 - RNA, 22 nt, Streptococcus pneumoniae R6
ccugauacuaugcuuuuuucua

SEQ ID NO: 2203794 - RNA, 21 nt, Streptococcus pneumoniae R6
ccugauaagauuuuuggaaaa

SEQ ID NO: 2203795 - RNA, 20 nt, Streptococcus pneumoniae R6
ccugauaacgaagagcuggc

SEQ ID NO: 2203796 - RNA, 21 nt, Streptococcus pneumoniae R6
ccugauaacgaagagcuggcu

SEQ ID NO: 2203797 - RNA, 16 nt, Streptococcus pneumoniae R6
ccugaguguaaacuga

SEQ ID NO: 2203798 - RNA, 19 nt, Streptococcus pneumoniae R6
ccugagaagacaucuucuc

SEQ ID NO: 2203799 - RNA, 19 nt, Streptococcus pneumoniae R6
ccucacggagcgagacaaa

SEQ ID NO: 2203800 - RNA, 18 nt, Streptococcus pneumoniae R6
ccucagcucccgcuucau

SEQ ID NO: 2203801 - RNA, 13 nt, Streptococcus pneumoniae R6
ccucaaaaugaaa

SEQ ID NO: 2203802 - RNA, 13 nt, Streptococcus pneumoniae R6
ccucaagaagugg

SEQ ID NO: 2203803 - RNA, 16 nt, Streptococcus pneumoniae R6
ccuauucccugagugu

SEQ ID NO: 2203804 - RNA, 12 nt, Streptococcus pneumoniae R6
ccuaugcuuucc

SEQ ID NO: 2203805 - RNA, 17 nt, Streptococcus pneumoniae R6
ccuauuaacaauaaucu

SEQ ID NO: 2203806 - RNA, 13 nt, Streptococcus pneumoniae R6
ccucauuuucuag

SEQ ID NO: 2203807 - RNA, 16 nt, Streptococcus pneumoniae R6
ccucauuucaauagaa

SEQ ID NO: 2203808 - RNA, 14 nt, Streptococcus pneumoniae R6
ccucccauuuugug

SEQ ID NO: 2203809 - RNA, 23 nt, Streptococcus pneumoniae R6
ccuccguaccaacacauucaagu

SEQ ID NO: 2203810 - RNA, 13 nt, Streptococcus pneumoniae R6
ccuccgccuccag

SEQ ID NO: 2203811 - RNA, 12 nt, Streptococcus pneumoniae R6
ccuccuaguuug

SEQ ID NO: 2203812 - RNA, 17 nt, Streptococcus pneumoniae R6
ccuccuaaggaguaguu

SEQ ID NO: 2203813 - RNA, 18 nt, Streptococcus pneumoniae R6
ccucucuucaaauuugac

SEQ ID NO: 2203814 - RNA, 15 nt, Streptococcus pneumoniae R6
ccucuaccaagcccu

SEQ ID NO: 2203815 - RNA, 23 nt, Streptococcus pneumoniae R6
ccucuaccaagcccucagccagu

SEQ ID NO: 2203816 - RNA, 13 nt, Streptococcus pneumoniae R6
ccucuacaauaac

SEQ ID NO: 2203817 - RNA, 18 nt, Streptococcus pneumoniae R6
ccucuacaccauaaauau

SEQ ID NO: 2203818 - RNA, 22 nt, Streptococcus pneumoniae R6
ccucuacaccauaaauauuugc

SEQ ID NO: 2203819 - RNA, 23 nt, Streptococcus pneumoniae R6
ccucuacaccauaaauauuugcu

SEQ ID NO: 2203820 - RNA, 16 nt, Streptococcus pneumoniae R6
ccgccuucuacuuccu

SEQ ID NO: 2203821 - RNA, 18 nt, Streptococcus pneumoniae R6
ccgccuucuacuuccugc

SEQ ID NO: 2203822 - RNA, 16 nt, Streptococcus pneumoniae R6
ccgcgucagcuuuauc

SEQ ID NO: 2203823 - RNA, 21 nt, Streptococcus pneumoniae R6
aaaccuguaaucccucagagu

SEQ ID NO: 2203824 - RNA, 16 nt, Streptococcus pneumoniae R6
aaaccugagaaggaga

SEQ ID NO: 2203825 - RNA, 14 nt, Streptococcus pneumoniae R6
ccggcuuucacaaa

SEQ ID NO: 2203826 - RNA, 15 nt, Streptococcus pneumoniae R6
ccgucuuggucuguc

SEQ ID NO: 2203827 - RNA, 14 nt, Streptococcus pneumoniae R6
ccgucuuuagagag

SEQ ID NO: 2203828 - RNA, 17 nt, Streptococcus pneumoniae R6
aaaccuucccacaauaa

SEQ ID NO: 2203829 - RNA, 18 nt, Streptococcus pneumoniae R6
aaaccuucccacaauaaa

SEQ ID NO: 2203830 - RNA, 18 nt, Streptococcus pneumoniae R6
aaaccuuauuuuuuaugg

SEQ ID NO: 2203831 - RNA, 14 nt, Streptococcus pneumoniae R6
aaaccuugauuuua

SEQ ID NO: 2203832 - RNA, 15 nt, Streptococcus pneumoniae R6
aaaccuuguuuuuuc

SEQ ID NO: 2203833 - RNA, 13 nt, Streptococcus pneumoniae R6
aaaccuugaagag

SEQ ID NO: 2203834 - RNA, 19 nt, Streptococcus pneumoniae R6
aaaccuuuugggcacgaag

SEQ ID NO: 2203835 - RNA, 16 nt, Streptococcus pneumoniae R6
aaacgaagaaggaaga

SEQ ID NO: 2203836 - RNA, 14 nt, Streptococcus pneumoniae R6
aaacgaauacuuug

SEQ ID NO: 2203837 - RNA, 12 nt, Streptococcus pneumoniae R6
ccguagauagcu

SEQ ID NO: 2203838 - RNA, 23 nt, Streptococcus pneumoniae R6
ccguauucuuauuucaaaaaaug

SEQ ID NO: 2203839 - RNA, 11 nt, Streptococcus pneumoniae R6
ccgucaacagu

SEQ ID NO: 2203840 - RNA, 19 nt, Streptococcus pneumoniae R6
ccgucaacgucaagaacuu

SEQ ID NO: 2203841 - RNA, 16 nt, Streptococcus pneumoniae R6
ccguagguuuucuccu

SEQ ID NO: 2203842 - RNA, 22 nt, Streptococcus pneumoniae R6
ccggugaacccaauagcgauuc

SEQ ID NO: 2203843 - RNA, 18 nt, Streptococcus pneumoniae R6
aaacguucccccuuuuuu

SEQ ID NO: 2203844 - RNA, 21 nt, Streptococcus pneumoniae R6
aaacguuuaucacucaguuua

SEQ ID NO: 2203845 - RNA, 20 nt, Streptococcus pneumoniae R6
aaacgucguaaucuuaaagu

SEQ ID NO: 2203846 - RNA, 15 nt, Streptococcus pneumoniae R6
aaacguaauuucauu

SEQ ID NO: 2203847 - RNA, 12 nt, Streptococcus pneumoniae R6
cgcccugucuuu

SEQ ID NO: 2203848 - RNA, 13 nt, Streptococcus pneumoniae R6
cgcccugucuuua

SEQ ID NO: 2203849 - RNA, 21 nt, Streptococcus pneumoniae R6
cgcccugucuuuagcuugcaa

SEQ ID NO: 2203850 - RNA, 15 nt, Streptococcus pneumoniae R6
cgcccuccauuauga

SEQ ID NO: 2203851 - RNA, 17 nt, Streptococcus pneumoniae R6
cgccugcggcugcagcu

SEQ ID NO: 2203852 - RNA, 19 nt, Streptococcus pneumoniae R6
cgccugcucaccaucuucc

SEQ ID NO: 2203853 - RNA, 18 nt, Streptococcus pneumoniae R6
cgcgauugauuuccaaaa

SEQ ID NO: 2203854 - RNA, 16 nt, Streptococcus pneumoniae R6
cgcggguucaauacaa

SEQ ID NO: 2203855 - RNA, 21 nt, Streptococcus pneumoniae R6
cgauauggccugcuaggcuga

SEQ ID NO: 2203856 - RNA, 22 nt, Streptococcus pneumoniae R6
cgaucaaaguuggucauauuaa

SEQ ID NO: 2203857 - RNA, 22 nt, Streptococcus pneumoniae R6
cgaugauuggugcuaauucuuu

SEQ ID NO: 2203858 - RNA, 11 nt, Streptococcus pneumoniae R6
cgaugauuuua

SEQ ID NO: 2203859 - RNA, 19 nt, Streptococcus pneumoniae R6
cgauuuguuuuugguaaga

SEQ ID NO: 2203860 - RNA, 12 nt, Streptococcus pneumoniae R6
cgauuuucaaaa

SEQ ID NO: 2203861 - RNA, 22 nt, Streptococcus pneumoniae R6
cgauuuucccuuuuguauucca

SEQ ID NO: 2203862 - RNA, 15 nt, Streptococcus pneumoniae R6
cgauuuuuucaccaa

SEQ ID NO: 2203863 - RNA, 17 nt, Streptococcus pneumoniae R6
cgauuuuuucaccaaaa

SEQ ID NO: 2203864 - RNA, 23 nt, Streptococcus pneumoniae R6
cgcaaacuuggucgcugaguaaa

SEQ ID NO: 2203865 - RNA, 13 nt, Streptococcus pneumoniae R6
cgcaaaagcuacu

SEQ ID NO: 2203866 - RNA, 17 nt, Streptococcus pneumoniae R6
cgauguuacagacaaaa

SEQ ID NO: 2203867 - RNA, 12 nt, Streptococcus pneumoniae R6
cgauuuguucuc

SEQ ID NO: 2203868 - RNA, 20 nt, Streptococcus pneumoniae R6
cgauuuguccuggucuuauu

SEQ ID NO: 2203869 - RNA, 21 nt, Streptococcus pneumoniae R6
cgauugauuucggccaauucu

SEQ ID NO: 2203870 - RNA, 18 nt, Streptococcus pneumoniae R6
cgauuggggucagaaaga

SEQ ID NO: 2203871 - RNA, 14 nt, Streptococcus pneumoniae R6
cgauugguaucuug

SEQ ID NO: 2203872 - RNA, 24 nt, Streptococcus pneumoniae R6
cgcacaaacuucaucccaguggcu

SEQ ID NO: 2203873 - RNA, 14 nt, Streptococcus pneumoniae R6
cgcacaccuuacag

SEQ ID NO: 2203874 - RNA, 21 nt, Streptococcus pneumoniae R6
cgcaaauccgaaaaucacucc

SEQ ID NO: 2203875 - RNA, 14 nt, Streptococcus pneumoniae R6
cgcacgaagggcuu

SEQ ID NO: 2203876 - RNA, 21 nt, Streptococcus pneumoniae R6
cgcauacuuggugcccaaaua

SEQ ID NO: 2203877 - RNA, 23 nt, Streptococcus pneumoniae R6
cgcauaguaucaagguuuuucug

SEQ ID NO: 2203878 - RNA, 16 nt, Streptococcus pneumoniae R6
cgcauaguaucaaguu

SEQ ID NO: 2203879 - RNA, 17 nt, Streptococcus pneumoniae R6
cgcauaguugcauuaaa

SEQ ID NO: 2203880 - RNA, 16 nt, Streptococcus pneumoniae R6
cgcaugauaucaaacu

SEQ ID NO: 2203881 - RNA, 18 nt, Streptococcus pneumoniae R6
cgcagagguggaaugaua

SEQ ID NO: 2203882 - RNA, 16 nt, Streptococcus pneumoniae R6
cgcaggacuaaaucca

SEQ ID NO: 2203883 - RNA, 21 nt, Streptococcus pneumoniae R6
cgagauaaugcccaagagacu

SEQ ID NO: 2203884 - RNA, 10 nt, Streptococcus pneumoniae R6
cgagccucuu

SEQ ID NO: 2203885 - RNA, 14 nt, Streptococcus pneumoniae R6
cgagccucuuuuuu

SEQ ID NO: 2203886 - RNA, 15 nt, Streptococcus pneumoniae R6
cgagccucuuuuuug

SEQ ID NO: 2203887 - RNA, 14 nt, Streptococcus pneumoniae R6
cgagacaaaaaaaa

SEQ ID NO: 2203888 - RNA, 21 nt, Streptococcus pneumoniae R6
cgagagcuuugacauccuuuu

SEQ ID NO: 2203889 - RNA, 14 nt, Streptococcus pneumoniae R6
cgagagcugauaag

SEQ ID NO: 2203890 - RNA, 22 nt, Streptococcus pneumoniae R6
cgagagugauaacauaaccuuc

SEQ ID NO: 2203891 - RNA, 18 nt, Streptococcus pneumoniae R6
cgacuucugagcuacuau

SEQ ID NO: 2203892 - RNA, 22 nt, Streptococcus pneumoniae R6
cgacuugguaguugagcuggcu

SEQ ID NO: 2203893 - RNA, 16 nt, Streptococcus pneumoniae R6
cgagaaacaagaacuc

SEQ ID NO: 2203894 - RNA, 18 nt, Streptococcus pneumoniae R6
cgagaaacaauaaaauca

SEQ ID NO: 2203895 - RNA, 14 nt, Streptococcus pneumoniae R6
cgagaaagaucauu

SEQ ID NO: 2203896 - RNA, 14 nt, Streptococcus pneumoniae R6
cgacuacuaaaaca

SEQ ID NO: 2203897 - RNA, 16 nt, Streptococcus pneumoniae R6
cgaauagaguucuaaa

SEQ ID NO: 2203898 - RNA, 13 nt, Streptococcus pneumoniae R6
cgaauaccauaca

SEQ ID NO: 2203899 - RNA, 23 nt, Streptococcus pneumoniae R6
cgaauaccaccaaucauuuggaa

SEQ ID NO: 2203900 - RNA, 16 nt, Streptococcus pneumoniae R6
cgaauagcucaaaagc

SEQ ID NO: 2203901 - RNA, 18 nt, Streptococcus pneumoniae R6
cgacucugaagucacuac

SEQ ID NO: 2203902 - RNA, 18 nt, Streptococcus pneumoniae R6
cgacugguaaagaaugga

SEQ ID NO: 2203903 - RNA, 19 nt, Streptococcus pneumoniae R6
cgacugaggguuuugugcu

SEQ ID NO: 2203904 - RNA, 22 nt, Streptococcus pneumoniae R6
aaacggaggauuuuugaauauu

SEQ ID NO: 2203905 - RNA, 13 nt, Streptococcus pneumoniae R6
cgagcucaaauca

SEQ ID NO: 2203906 - RNA, 18 nt, Streptococcus pneumoniae R6
cgaggaggagaaaaagcg

SEQ ID NO: 2203907 - RNA, 20 nt, Streptococcus pneumoniae R6
cgaggauuucccaaguacga

SEQ ID NO: 2203908 - RNA, 21 nt, Streptococcus pneumoniae R6
cgauagcuuuugcagcaccag

SEQ ID NO: 2203909 - RNA, 18 nt, Streptococcus pneumoniae R6
cgauagcuccaucuccaa

SEQ ID NO: 2203910 - RNA, 16 nt, Streptococcus pneumoniae R6
cgauaauuauuuuuua

SEQ ID NO: 2203911 - RNA, 21 nt, Streptococcus pneumoniae R6
cgauacaguuagcauggucaa

SEQ ID NO: 2203912 - RNA, 15 nt, Streptococcus pneumoniae R6
cgaguuucugggucu

SEQ ID NO: 2203913 - RNA, 23 nt, Streptococcus pneumoniae R6
cgauaaaaguaagaauguugcuu

SEQ ID NO: 2203914 - RNA, 18 nt, Streptococcus pneumoniae R6
cgauaaaaucguuuauca

SEQ ID NO: 2203915 - RNA, 22 nt, Streptococcus pneumoniae R6
cgauaaacaagggcaaaaaaga

SEQ ID NO: 2203916 - RNA, 23 nt, Streptococcus pneumoniae R6
cgaggguaaaggguuuggucaga

SEQ ID NO: 2203917 - RNA, 23 nt, Streptococcus pneumoniae R6
cgagguauuucuuguuuucuaaa

SEQ ID NO: 2203918 - RNA, 22 nt, Streptococcus pneumoniae R6
cgaguaaaagauaaucaucugg

SEQ ID NO: 2203919 - RNA, 17 nt, Streptococcus pneumoniae R6
cgagucaaaauucuuug

SEQ ID NO: 2203920 - RNA, 23 nt, Streptococcus pneumoniae R6
cgagugcaagagcgucaucugau

SEQ ID NO: 2203921 - RNA, 16 nt, Streptococcus pneumoniae R6
cgaguguauuguacuu

SEQ ID NO: 2203922 - RNA, 23 nt, Streptococcus pneumoniae R6
cggcauuguuggcaaccaagucu

SEQ ID NO: 2203923 - RNA, 22 nt, Streptococcus pneumoniae R6
cggcauugugaugaagauugau

SEQ ID NO: 2203924 - RNA, 20 nt, Streptococcus pneumoniae R6
cggccuucuuuuuaauuauu

SEQ ID NO: 2203925 - RNA, 18 nt, Streptococcus pneumoniae R6
cggaacucuagcuuuuua

SEQ ID NO: 2203926 - RNA, 17 nt, Streptococcus pneumoniae R6
cggaaguuggucuccca

SEQ ID NO: 2203927 - RNA, 12 nt, Streptococcus pneumoniae R6
cggaaauauuuu

SEQ ID NO: 2203928 - RNA, 20 nt, Streptococcus pneumoniae R6
cggaaagccaaaucaauuuc

SEQ ID NO: 2203929 - RNA, 13 nt, Streptococcus pneumoniae R6
cggaacaucuuuu

SEQ ID NO: 2203930 - RNA, 23 nt, Streptococcus pneumoniae R6
cggagaaagaauccaauucaaag

SEQ ID NO: 2203931 - RNA, 16 nt, Streptococcus pneumoniae R6
cggagauaguaccauu

SEQ ID NO: 2203932 - RNA, 10 nt, Streptococcus pneumoniae R6
cggagaugga

SEQ ID NO: 2203933 - RNA, 15 nt, Streptococcus pneumoniae R6
cggaauagcucaaaa

SEQ ID NO: 2203934 - RNA, 23 nt, Streptococcus pneumoniae R6
cggacgauuaaaaguaagagaaa

SEQ ID NO: 2203935 - RNA, 17 nt, Streptococcus pneumoniae R6
cggauucucucagcuac

SEQ ID NO: 2203936 - RNA, 22 nt, Streptococcus pneumoniae R6
cggauaaaaccuguuugaauca

SEQ ID NO: 2203937 - RNA, 21 nt, Streptococcus pneumoniae R6
cggauaaaccaccagagugga

SEQ ID NO: 2203938 - RNA, 15 nt, Streptococcus pneumoniae R6
cggauaaaagagaau

SEQ ID NO: 2203939 - RNA, 20 nt, Streptococcus pneumoniae R6
cggaguuuuuuugaugagga

SEQ ID NO: 2203940 - RNA, 20 nt, Streptococcus pneumoniae R6
cggagggucuuuuguccugu

SEQ ID NO: 2203941 - RNA, 11 nt, Streptococcus pneumoniae R6
cggauaacagu

SEQ ID NO: 2203942 - RNA, 20 nt, Streptococcus pneumoniae R6
cggcaccuucuacagcaccu

SEQ ID NO: 2203943 - RNA, 22 nt, Human
uucaauaaaacuuuuccaauga

SEQ ID NO: 2203944 - RNA, 17 nt, Human
uuauaugcuucuguuuu

SEQ ID NO: 2203945 - RNA, 15 nt, Human
uuagcuggaaaagua

SEQ ID NO: 2203946 - RNA, 19 nt, Human
uuaaaagaaugauuaugaa

SEQ ID NO: 2203947 - RNA, 14 nt, Human
uuaaauggucaauu

SEQ ID NO: 2203948 - RNA, 12 nt, Human
uccagcugcccc

SEQ ID NO: 2203949 - RNA, 22 nt, Human
ugacccacaagaaaugaaagca

SEQ ID NO: 2203950 - RNA, 17 nt, Human
ugaauggcuaagcaaaa

SEQ ID NO: 2203951 - RNA, 20 nt, Human
ugcuacagggcucacagaau

SEQ ID NO: 2203952 - RNA, 20 nt, Human
ugcuauugggguuggggggg

SEQ ID NO: 2203953 - RNA, 17 nt, Human
ugcagauaaacaguagu

SEQ ID NO: 2203954 - RNA, 19 nt, Human
ugcacuccagccugagcga

SEQ ID NO: 2203955 - RNA, 16 nt, Human
uggaacucucgagcgu

SEQ ID NO: 2203956 - RNA, 18 nt, Human
uggacgagaaaacaauaa

SEQ ID NO: 2203957 - RNA, 22 nt, Human
ugggacauuugcucauggaauu

SEQ ID NO: 2203958 - RNA, 23 nt, Human
uguuuaggauguugaaaaaguuc

SEQ ID NO: 2203959 - RNA, 15 nt, Human
uaguauuucuaugaa

SEQ ID NO: 2203960 - RNA, 13 nt, Human
uauaaauaaaaau

SEQ ID NO: 2203961 - RNA, 21 nt, Human
uauagcuacuaauuuuaaaau

SEQ ID NO: 2203962 - RNA, 13 nt, Human
uauaauuuaaaau

SEQ ID NO: 2203963 - RNA, 14 nt, Human
uauaauuuaaauau

SEQ ID NO: 2203964 - RNA, 16 nt, Human
uaguaucaaaagaaag

SEQ ID NO: 2203965 - RNA, 15 nt, Human
ucaauuuaaaaaaaa

SEQ ID NO: 2203966 - RNA, 17 nt, Human
uauaucaauuuaaaaaa

SEQ ID NO: 2203967 - RNA, 15 nt, Human
uaucaaaagaaagaa

SEQ ID NO: 2203968 - RNA, 18 nt, Human
uaucaaaagaaagaaaau

SEQ ID NO: 2203969 - RNA, 13 nt, Human
uaacaaugaaagu

SEQ ID NO: 2203970 - RNA, 21 nt, Human
gcuacaaaugcauuucuaaag

SEQ ID NO: 2203971 - RNA, 12 nt, Human
guucaucaauga

SEQ ID NO: 2203972 - RNA, 21 nt, Human
gccuuuguugcuaucaaucca

SEQ ID NO: 2203973 - RNA, 13 nt, Human
gccuguaaucaca

SEQ ID NO: 2203974 - RNA, 23 nt, Human
cuacaaaugcauuucuaaagcca

SEQ ID NO: 2203975 - RNA, 14 nt, Human
cuaaaugucaauca

SEQ ID NO: 2203976 - RNA, 19 nt, Human
cuaauuuuaacucuauaau

SEQ ID NO: 2203977 - RNA, 19 nt, Human
cgcucggccugcucgccca

SEQ ID NO: 2203978 - RNA, 20 nt, Human
cgcccacuagacccacugga

SEQ ID NO: 2203979 - RNA, 17 nt, Human
cgcuguuccucgccacg

SEQ ID NO: 2203980 - RNA, 13 nt, Human
cuaucuuugagcg

SEQ ID NO: 2203981 - RNA, 22 nt, Human
cuagucucuaucauuaaaguuc

SEQ ID NO: 2203982 - RNA, 18 nt, Human
cuccauccugaggcucca

SEQ ID NO: 2203983 - RNA, 12 nt, Human
cugaagaagcac

SEQ ID NO: 2203984 - RNA, 18 nt, Human
cugaagaagcaccaauca

SEQ ID NO: 2203985 - RNA, 10 nt, Human
cugaugcagu

SEQ ID NO: 2203986 - RNA, 13 nt, Human
uucugaagaagau

SEQ ID NO: 2203987 - RNA, 15 nt, Human
uugacacuuaaaaau

SEQ ID NO: 2203988 - RNA, 13 nt, Human
uugacccacaaga

SEQ ID NO: 2203989 - RNA, 15 nt, Human
uugaaaccuucacuu

SEQ ID NO: 2203990 - RNA, 19 nt, Human
uuaggccaugggacaggga

SEQ ID NO: 2203991 - RNA, 17 nt, Human
uuccaacuaucucauuu

SEQ ID NO: 2203992 - RNA, 22 nt, Human
uuagugcaaauugucacaggac

SEQ ID NO: 2203993 - RNA, 18 nt, Human
ccucuggcuccagcuggc

SEQ ID NO: 2203994 - RNA, 16 nt, Human
ccuggugggcagagag

SEQ ID NO: 2203995 - RNA, 11 nt, Human
gacccaaaagg

SEQ ID NO: 2203996 - RNA, 17 nt, Human
gaacuuuuuguuuuguu

SEQ ID NO: 2203997 - RNA, 16 nt, Human
gaaugauuaugaauua

SEQ ID NO: 2203998 - RNA, 23 nt, Human
gaaauauuauguuaaaacuggga

SEQ ID NO: 2203999 - RNA, 13 nt, Human
cuguuauaaucuu

SEQ ID NO: 2204000 - RNA, 18 nt, Human
cuuggucugugagaugcu

SEQ ID NO: 2204001 - RNA, 21 nt, Human
cuucuuuccacagaagcucca

SEQ ID NO: 2204002 - RNA, 17 nt, Human
gcaccaaucaugaauua

SEQ ID NO: 2204003 - RNA, 19 nt, Human
gcauggguuuuauuauaua

SEQ ID NO: 2204004 - RNA, 14 nt, Human
gcaggaggcaucca

SEQ ID NO: 2204005 - RNA, 14 nt, Human
gaugcuacaggauu

SEQ ID NO: 2204006 - RNA, 16 nt, Human
gagauugugccccugc

SEQ ID NO: 2204007 - RNA, 13 nt, Human
gagccccaaaagg

SEQ ID NO: 2204008 - RNA, 16 nt, Human
gagccuccagcugccc

SEQ ID NO: 2204009 - RNA, 18 nt, Human
aaaugugauauguaccua

SEQ ID NO: 2204010 - RNA, 13 nt, Human
aaaugaaagcagg

SEQ ID NO: 2204011 - RNA, 14 nt, Human
aaauggugugacca

SEQ ID NO: 2204012 - RNA, 14 nt, Human
aaauugagcuaggg

SEQ ID NO: 2204013 - RNA, 17 nt, Human
aacacaugauccugcaa

SEQ ID NO: 2204014 - RNA, 18 nt, Human
aacaagccuccuuuuaaa

SEQ ID NO: 2204015 - RNA, 16 nt, Human
aaaguucuagugaccg

SEQ ID NO: 2204016 - RNA, 21 nt, Human
aagcuuguauuccuuuuucuc

SEQ ID NO: 2204017 - RNA, 14 nt, Human
aacauguuuaucgu

SEQ ID NO: 2204018 - RNA, 16 nt, Human
aacgauaaaagacagu

SEQ ID NO: 2204019 - RNA, 16 nt, Human
aagaccucauuuugaa

SEQ ID NO: 2204020 - RNA, 17 nt, Human
aagagccggagccucca

SEQ ID NO: 2204021 - RNA, 21 nt, Human
aagacaaggaaaaaauaacaa

SEQ ID NO: 2204022 - RNA, 19 nt, Human
aacuucagcgguuuauaua

SEQ ID NO: 2204023 - RNA, 21 nt, Human
uguaauaggcguaacuaauuu

SEQ ID NO: 2204024 - RNA, 19 nt, Human
uguaaaggaauuuaaaaau

SEQ ID NO: 2204025 - RNA, 20 nt, Human
ugguuuaaauggucaauuuu

SEQ ID NO: 2204026 - RNA, 20 nt, Human
uguauauuuuauaucaauuu

SEQ ID NO: 2204027 - RNA, 21 nt, Human
uguauauuuuauaucaauuua

SEQ ID NO: 2204028 - RNA, 22 nt, Human
ugugauauguaccuaacgaagu

SEQ ID NO: 2204029 - RNA, 16 nt, Human
ugugagaugcuagaac

SEQ ID NO: 2204030 - RNA, 22 nt, Human
uguggguagacacacaugaagu

SEQ ID NO: 2204031 - RNA, 16 nt, Human
uguggucacaggaagu

SEQ ID NO: 2204032 - RNA, 15 nt, Human
ugggaguacaaaagu

SEQ ID NO: 2204033 - RNA, 23 nt, Human
ugggacagucaccucauggaauu

SEQ ID NO: 2204034 - RNA, 14 nt, Human
uggaaaaguauguu

SEQ ID NO: 2204035 - RNA, 13 nt, Human
uggaguugaaaau

SEQ ID NO: 2204036 - RNA, 14 nt, Human
ugagccccaaaagg

SEQ ID NO: 2204037 - RNA, 15 nt, Human
ugacaagcucacaga

SEQ ID NO: 2204038 - RNA, 15 nt, Human
ugagagugaacaaau

SEQ ID NO: 2204039 - RNA, 15 nt, Human
ugaauuacauuugua

SEQ ID NO: 2204040 - RNA, 18 nt, Human
ugaaggggcggcggcccu

SEQ ID NO: 2204041 - RNA, 15 nt, Human
ucccuugcaugguuu

SEQ ID NO: 2204042 - RNA, 17 nt, Human
uccuggcaauagucaaa

SEQ ID NO: 2204043 - RNA, 17 nt, Human
uccccaagccuggcaag

SEQ ID NO: 2204044 - RNA, 18 nt, Human
ugaaauauugacuuuuua

SEQ ID NO: 2204045 - RNA, 15 nt, Human
ucuuuccacagaagc

SEQ ID NO: 2204046 - RNA, 17 nt, Human
guauggugggaaguugg

SEQ ID NO: 2204047 - RNA, 15 nt, Human
guauuauuuuuuaaa

SEQ ID NO: 2204048 - RNA, 14 nt, Human
guacuuuauuuucu

SEQ ID NO: 2204049 - RNA, 19 nt, Human
ggcaagaccugauuucuga

SEQ ID NO: 2204050 - RNA, 15 nt, Human
ggacgcucucuggcc

SEQ ID NO: 2204051 - RNA, 18 nt, Human
gucaccucauggaauugg

SEQ ID NO: 2204052 - RNA, 14 nt, Human
gucauuguucuugu

SEQ ID NO: 2204053 - RNA, 22 nt, Human
guccaggucuaccaaaaaucuc

SEQ ID NO: 2204054 - RNA, 13 nt, Human
guauuuuaaucac

SEQ ID NO: 2204055 - RNA, 14 nt, Human
guauuuuaaucacc

SEQ ID NO: 2204056 - RNA, 18 nt, Human
gucugugagaugcuagaa

SEQ ID NO: 2204057 - RNA, 17 nt, Human
uaaaaauacaaaaaaaa

SEQ ID NO: 2204058 - RNA, 14 nt, Human
guuggugaacuugg

SEQ ID NO: 2204059 - RNA, 13 nt, Human
gugacaagcucac

SEQ ID NO: 2204060 - RNA, 17 nt, Human
uaaaguguuugaaagcu

SEQ ID NO: 2204061 - RNA, 13 nt, Human
uaacucuauaaug

SEQ ID NO: 2204062 - RNA, 13 nt, Human
uaguauuucuaug

SEQ ID NO: 2204063 - RNA, 20 nt, Human
uauaagcuuguauuccuuuu

SEQ ID NO: 2204064 - RNA, 16 nt, Human
uauuauauuuacaaau

SEQ ID NO: 2204065 - RNA, 19 nt, Human
uauuauuuuuuaaaaaaau

SEQ ID NO: 2204066 - RNA, 15 nt, Human
uauugucuagugaaa

SEQ ID NO: 2204067 - RNA, 23 nt, Human
uauguucuaagaagugaaaaucu

SEQ ID NO: 2204068 - RNA, 16 nt, Human
uaucaauuuaaaaaaa

SEQ ID NO: 2204069 - RNA, 15 nt, Human
uccacuuauaggaau

SEQ ID NO: 2204070 - RNA, 16 nt, Human
uccauggggugggggu

SEQ ID NO: 2204071 - RNA, 16 nt, Human
uccauuuuuagugaaa

SEQ ID NO: 2204072 - RNA, 14 nt, Human
cggccuccauccug

SEQ ID NO: 2204073 - RNA, 16 nt, Human
cuaagagagaaugaga

SEQ ID NO: 2204074 - RNA, 19 nt, Human
cuagcaugucgucaaagcu

SEQ ID NO: 2204075 - RNA, 19 nt, Human
gaauacuuuauaaaggauu

SEQ ID NO: 2204076 - RNA, 14 nt, Human
cuggcuccagcugg

SEQ ID NO: 2204077 - RNA, 22 nt, Human
gagcucccaggaggggcuucug

SEQ ID NO: 2204078 - RNA, 15 nt, Human
gaauuggagcucgug

SEQ ID NO: 2204079 - RNA, 12 nt, Human
gauaaauaguuu

SEQ ID NO: 2204080 - RNA, 20 nt, Human
gauaaugaauacuuuauaaa

SEQ ID NO: 2204081 - RNA, 17 nt, Human
gcccauccugccccuga

SEQ ID NO: 2204082 - RNA, 22 nt, Human
gaugaauuaaguuuuuuuuuaa

SEQ ID NO: 2204083 - RNA, 20 nt, Human
gccauuguaguccuguaaug

SEQ ID NO: 2204084 - RNA, 11 nt, Human
gcuuccgcauc

SEQ ID NO: 2204085 - RNA, 14 nt, Human
gcuguuauaaucuu

SEQ ID NO: 2204086 - RNA, 17 nt, Human
gcugagggcauagaagu

SEQ ID NO: 2204087 - RNA, 18 nt, Human
gcugcgcgccgcgcuccu

SEQ ID NO: 2204088 - RNA, 19 nt, Human
auguuacaacacggacgaa

SEQ ID NO: 2204089 - RNA, 15 nt, Human
cacacagauuugagc

SEQ ID NO: 2204090 - RNA, 13 nt, Human
cauuucuaaagcc

SEQ ID NO: 2204091 - RNA, 22 nt, Human
cauagguuuaauaauuuuuaau

SEQ ID NO: 2204092 - RNA, 19 nt, Human
cauaugaaaaggcuaagcu

SEQ ID NO: 2204093 - RNA, 19 nt, Human
cagcgguuuauauaagcuu

SEQ ID NO: 2204094 - RNA, 22 nt, Human
ccuccaugaauaucaguuauuu

SEQ ID NO: 2204095 - RNA, 23 nt, Human
ccagaucaagccugccucaauca

SEQ ID NO: 2204096 - RNA, 20 nt, Human
acuuggucugugagaugcua

SEQ ID NO: 2204097 - RNA, 16 nt, Human
agcaaaauuuuuucuc

SEQ ID NO: 2204098 - RNA, 17 nt, Human
agaugcaguucugaaga

SEQ ID NO: 2204099 - RNA, 18 nt, Human
aggucuaccaaaaaucuc

SEQ ID NO: 2204100 - RNA, 14 nt, Human
aggggcgcucgcuu

SEQ ID NO: 2204101 - RNA, 19 nt, Human
auauauuuuuuuuuuuaaa

SEQ ID NO: 2204102 - RNA, 23 nt, Human
aguaauuccguagguuauuuuca

SEQ ID NO: 2204103 - RNA, 16 nt, Human
aucaguuauuuuuaaa

SEQ ID NO: 2204104 - RNA, 19 nt, Human
aucaugaauuaguuuuaua

SEQ ID NO: 2204105 - RNA, 15 nt, Human
aucaaaagaaagaaa

SEQ ID NO: 2204106 - RNA, 17 nt, Human
aucacaugaacuuguaa

SEQ ID NO: 2204107 - RNA, 17 nt, Human
aagccuggcaagggaau

SEQ ID NO: 2204108 - RNA, 22 nt, Human
aagagccggagccuccagcugc

SEQ ID NO: 2204109 - RNA, 17 nt, Human
aagcaaaauuuuuucuc

SEQ ID NO: 2204110 - RNA, 19 nt, Human
aacaaugcuguauuuuaaa

SEQ ID NO: 2204111 - RNA, 19 nt, Human
aaauguuuacagaucccca

SEQ ID NO: 2204112 - RNA, 15 nt, Human
aacaagcacuaaaca

SEQ ID NO: 2204113 - RNA, 23 nt, Human
aacuuuuuguuuuguuucuuccu

SEQ ID NO: 2204114 - RNA, 23 nt, Human
aagacagugaaagaaaauaacaa

SEQ ID NO: 2204115 - RNA, 20 nt, Human
acccuacaaaaccacuggaa

SEQ ID NO: 2204116 - RNA, 22 nt, Human
acucauuaaauggaaguaaaug

SEQ ID NO: 2204117 - RNA, 18 nt, Human
acgagaaaacaauaacga

SEQ ID NO: 2204118 - RNA, 14 nt, Human
acucccuuucaaca

SEQ ID NO: 2204119 - RNA, 22 nt, Human
acuguaaaauaauaacugggaa

SEQ ID NO: 2204120 - RNA, 13 nt, Human
uuuugaaaaaaag

SEQ ID NO: 2204121 - RNA, 15 nt, Human
uuucuucucacauuu

SEQ ID NO: 2204122 - RNA, 22 nt, Human
uuggagcucguggaacaguuac

SEQ ID NO: 2204123 - RNA, 19 nt, Human
uugccaugugcuaguaauu

SEQ ID NO: 2204124 - RNA, 23 nt, Human
uuguuauguauauuuuauaucaa

SEQ ID NO: 2204125 - RNA, 17 nt, Human
uuuauagcuacuaauuu

SEQ ID NO: 2204126 - RNA, 14 nt, Human
uucauucaauaucu

SEQ ID NO: 2204127 - RNA, 12 nt, Human
uuccucaaaacu

SEQ ID NO: 2204128 - RNA, 16 nt, Human
uucggccuccauccug

SEQ ID NO: 2204129 - RNA, 15 nt, Human
uucuacuacauggaa

SEQ ID NO: 2204130 - RNA, 23 nt, Human
uucauagcagcuuauucacaaga

SEQ ID NO: 2204131 - RNA, 23 nt, Human
ugaaacgaggauugggaaaaagu

SEQ ID NO: 2204132 - RNA, 23 nt, Human
ugaaauauugacuuuuuauggca

SEQ ID NO: 2204133 - RNA, 14 nt, Human
uggguuccuuccuc

SEQ ID NO: 2204134 - RNA, 21 nt, Human
ucuugugaacccaaaguguga

SEQ ID NO: 2204135 - RNA, 21 nt, Human
ucaaaggacaccauuuuggca

SEQ ID NO: 2204136 - RNA, 23 nt, Human
ucaaaggacaccauuuuggcaag

SEQ ID NO: 2204137 - RNA, 21 nt, Human
ucaaaacuucagacauagaau

SEQ ID NO: 2204138 - RNA, 20 nt, Human
ucaaaggacaccauuuuggc

SEQ ID NO: 2204139 - RNA, 19 nt, Human
ucaaauugugugaaaggua

SEQ ID NO: 2204140 - RNA, 18 nt, Human
uccaugggccauaugaaa

SEQ ID NO: 2204141 - RNA, 13 nt, Human
uccucggacggcu

SEQ ID NO: 2204142 - RNA, 17 nt, Human
uccccugucacgugugg

SEQ ID NO: 2204143 - RNA, 17 nt, Human
uauuauuuuuuaaaaaa

SEQ ID NO: 2204144 - RNA, 20 nt, Human
uauucacaagacccaaaagg

SEQ ID NO: 2204145 - RNA, 23 nt, Human
uauuuacaaaugggaaacaaaag

SEQ ID NO: 2204146 - RNA, 18 nt, Human
uacuaaaaauacaaaaaa

SEQ ID NO: 2204147 - RNA, 13 nt, Human
uacgcgcgcuccg

SEQ ID NO: 2204148 - RNA, 13 nt, Human
uacuguaagaaaa

SEQ ID NO: 2204149 - RNA, 19 nt, Human
gucgucaaagcugaaaugg

SEQ ID NO: 2204150 - RNA, 15 nt, Human
gucucuaucauuaaa

SEQ ID NO: 2204151 - RNA, 21 nt, Human
guauugcauuuaauuuauuga

SEQ ID NO: 2204152 - RNA, 13 nt, Human
gucuggagggaag

SEQ ID NO: 2204153 - RNA, 16 nt, Human
uacaaauccaaugaaa

SEQ ID NO: 2204154 - RNA, 18 nt, Human
ggaaaaaauaacaaugaa

SEQ ID NO: 2204155 - RNA, 20 nt, Human
ggagcuuugaaacgaggauu

SEQ ID NO: 2204156 - RNA, 12 nt, Human
guauauuuuaua

SEQ ID NO: 2204157 - RNA, 20 nt, Human
guacuuuauuuucuauaauu

SEQ ID NO: 2204158 - RNA, 16 nt, Human
aaagacaaggaaaaaa

SEQ ID NO: 2204159 - RNA, 21 nt, Human
aaagaaaauaacgauaaaaga

SEQ ID NO: 2204160 - RNA, 13 nt, Human
aaaaguucugcag

SEQ ID NO: 2204161 - RNA, 19 nt, Human
aaaauaugccccauucaac

SEQ ID NO: 2204162 - RNA, 23 nt, Human
aaaauaugccccauucaacaucu

SEQ ID NO: 2204163 - RNA, 17 nt, Human
aaaauaugcucuaaaca

SEQ ID NO: 2204164 - RNA, 15 nt, Human
agccuccagcugccc

SEQ ID NO: 2204165 - RNA, 18 nt, Human
acaugaaguccaagcauu

SEQ ID NO: 2204166 - RNA, 11 nt, Human
accaaggcuag

SEQ ID NO: 2204167 - RNA, 12 nt, Human
acagugaaagaa

SEQ ID NO: 2204168 - RNA, 18 nt, Human
acagugaaagaaaauaac

SEQ ID NO: 2204169 - RNA, 13 nt, Human
aguugaaaaucuu

SEQ ID NO: 2204170 - RNA, 23 nt, Human
auaagcuuguauuccuuuuucuc

SEQ ID NO: 2204171 - RNA, 21 nt, Human
auaauccucaguuuuugugaa

SEQ ID NO: 2204172 - RNA, 12 nt, Human
auaauuuuuaau

SEQ ID NO: 2204173 - RNA, 20 nt, Human
auaaaagacagugaaagaaa

SEQ ID NO: 2204174 - RNA, 18 nt, Human
auaaaguguuugaaagcu

SEQ ID NO: 2204175 - RNA, 16 nt, Human
aggaauuuaaaaaucc

SEQ ID NO: 2204176 - RNA, 17 nt, Human
aggaauuuaaaaauccu

SEQ ID NO: 2204177 - RNA, 15 nt, Human
caaauguucaucaau

SEQ ID NO: 2204178 - RNA, 23 nt, Human
caccgcagggugaacugcagcga

SEQ ID NO: 2204179 - RNA, 18 nt, Human
auuucuaugaaauauuau

SEQ ID NO: 2204180 - RNA, 13 nt, Human
caaagcccagcuu

SEQ ID NO: 2204181 - RNA, 14 nt, Human
auccugaggcucca

SEQ ID NO: 2204182 - RNA, 19 nt, Human
auccuacuuccccuuccua

SEQ ID NO: 2204183 - RNA, 17 nt, Human
auuacuguaagaaaaua

SEQ ID NO: 2204184 - RNA, 22 nt, Human
auuacauuuguauaaaauaauu

SEQ ID NO: 2204185 - RNA, 19 nt, Human
auucacaagacccaaaagg

SEQ ID NO: 2204186 - RNA, 17 nt, Human
auucugagguaaccuca

SEQ ID NO: 2204187 - RNA, 16 nt, Human
acuucagacauagaau

SEQ ID NO: 2204188 - RNA, 15 nt, Human
acugcagaagacagu

SEQ ID NO: 2204189 - RNA, 19 nt, Human
acuagaguuuagcuggaaa

SEQ ID NO: 2204190 - RNA, 22 nt, Human
acucauacauguuacaacacgg

SEQ ID NO: 2204191 - RNA, 17 nt, Human
accugagccccaaaagg

SEQ ID NO: 2204192 - RNA, 16 nt, Human
accuuguacuuuauuu

SEQ ID NO: 2204193 - RNA, 20 nt, Human
accccugagcuugcagagau

SEQ ID NO: 2204194 - RNA, 21 nt, Human
aaguguuugaaagcuuuauuu

SEQ ID NO: 2204195 - RNA, 16 nt, Human
aaguuggcuggugucc

SEQ ID NO: 2204196 - RNA, 18 nt, Human
aauaacugggaauucugg

SEQ ID NO: 2204197 - RNA, 17 nt, Human
acuuggucugugagaug

SEQ ID NO: 2204198 - RNA, 23 nt, Human
agaacuuauuuguacauuuuuuu

SEQ ID NO: 2204199 - RNA, 12 nt, Human
agaaaauaacga

SEQ ID NO: 2204200 - RNA, 20 nt, Human
aaugagagacacacugaaga

SEQ ID NO: 2204201 - RNA, 15 nt, Human
aaugauaacuggaaa

SEQ ID NO: 2204202 - RNA, 18 nt, Human
aauauaugcuaagucuua

SEQ ID NO: 2204203 - RNA, 21 nt, Human
aauaucacuugucaauaaaau

SEQ ID NO: 2204204 - RNA, 19 nt, Human
aauaugccccauucaacau

SEQ ID NO: 2204205 - RNA, 12 nt, Human
acaguaaaaucc

SEQ ID NO: 2204206 - RNA, 23 nt, Human
accaaggagccaaacauccuaca

SEQ ID NO: 2204207 - RNA, 21 nt, Human
aauuuuaugcggcauuuucuu

SEQ ID NO: 2204208 - RNA, 17 nt, Human
acaagccuccuuuuaaa

SEQ ID NO: 2204209 - RNA, 22 nt, Human
aauuacuaugucauuugcugga

SEQ ID NO: 2204210 - RNA, 12 nt, Human
aaaaaucucaau

SEQ ID NO: 2204211 - RNA, 20 nt, Human
aaaacaauaacgauaaaaga

SEQ ID NO: 2204212 - RNA, 14 nt, Human
aaaauuuuuucucu

SEQ ID NO: 2204213 - RNA, 18 nt, Human
aaaauccacagaccaacc

SEQ ID NO: 2204214 - RNA, 19 nt, Human
aaaauccacagaccaaccu

SEQ ID NO: 2204215 - RNA, 13 nt, Human
aauccuugaagau

SEQ ID NO: 2204216 - RNA, 12 nt, Human
aauauuucagau

SEQ ID NO: 2204217 - RNA, 12 nt, Human
aauacuuuauaa

SEQ ID NO: 2204218 - RNA, 14 nt, Human
aauaauccuaaaca

SEQ ID NO: 2204219 - RNA, 22 nt, Human
aaggauuuauguuuaauucuga

SEQ ID NO: 2204220 - RNA, 18 nt, Human
agaugcuagaacucccuu

SEQ ID NO: 2204221 - RNA, 17 nt, Human
agacagagcuauucucc

SEQ ID NO: 2204222 - RNA, 18 nt, Human
cacuuggucugugagaug

SEQ ID NO: 2204223 - RNA, 13 nt, Human
cacuuauaggaau

SEQ ID NO: 2204224 - RNA, 20 nt, Human
cagaauucauucacucaaca

SEQ ID NO: 2204225 - RNA, 17 nt, Human
caggcuggcaccgcugu

SEQ ID NO: 2204226 - RNA, 23 nt, Human
cuccaaacugacucuuaagaaga

SEQ ID NO: 2204227 - RNA, 12 nt, Human
cuaucuuugagc

SEQ ID NO: 2204228 - RNA, 16 nt, Human
cuuuauuuucuauaau

SEQ ID NO: 2204229 - RNA, 15 nt, Human
agccagauuuuccug

SEQ ID NO: 2204230 - RNA, 20 nt, Human
gaaaaaaagcuuuuuuugaa

SEQ ID NO: 2204231 - RNA, 14 nt, Human
gaaaauaacaauaa

SEQ ID NO: 2204232 - RNA, 21 nt, Human
gaaccacaagacugcacauca

SEQ ID NO: 2204233 - RNA, 14 nt, Human
gacccaaaaggcag

SEQ ID NO: 2204234 - RNA, 22 nt, Human
gcauacucauuaggauggcuag

SEQ ID NO: 2204235 - RNA, 23 nt, Human
gagccccaaaagguauuuuaauc

SEQ ID NO: 2204236 - RNA, 14 nt, Human
gcucauggaauugg

SEQ ID NO: 2204237 - RNA, 15 nt, Human
gcuacuaauuuuaaa

SEQ ID NO: 2204238 - RNA, 20 nt, Human
gcuacaaaugcauuucuaaa

SEQ ID NO: 2204239 - RNA, 19 nt, Human
gugggcagagagguaggga

SEQ ID NO: 2204240 - RNA, 15 nt, Human
guaaugauaacugga

SEQ ID NO: 2204241 - RNA, 13 nt, Human
ucuuagaugcagu

SEQ ID NO: 2204242 - RNA, 23 nt, Human
ucuggccuucggccuccauccug

SEQ ID NO: 2204243 - RNA, 17 nt, Human
ugcaaauugucacagga

SEQ ID NO: 2204244 - RNA, 13 nt, Human
ugaugaagaaguu

SEQ ID NO: 2204245 - RNA, 21 nt, Human
ugauauuggacaguaaaaucc

SEQ ID NO: 2204246 - RNA, 22 nt, Human
ucauuaaaguucuagugaccga

SEQ ID NO: 2204247 - RNA, 22 nt, Human
ucucuaucauuaaaguucuagu

SEQ ID NO: 2204248 - RNA, 19 nt, Human
ucacaagacccaaaaggca

SEQ ID NO: 2204249 - RNA, 15 nt, Human
uacuaaaaauacaaa

SEQ ID NO: 2204250 - RNA, 13 nt, Human
guucugauauugg

SEQ ID NO: 2204251 - RNA, 16 nt, Human
guucuugugaacccaa

SEQ ID NO: 2204252 - RNA, 12 nt, Human
guucugaagaag

SEQ ID NO: 2204253 - RNA, 13 nt, Human
guggggauaguga

SEQ ID NO: 2204254 - RNA, 14 nt, Human
uaauucugaaagca

SEQ ID NO: 2204255 - RNA, 14 nt, Human
uaauuggaaaggca

SEQ ID NO: 2204256 - RNA, 21 nt, Human
agucccagaucaagccugccu

SEQ ID NO: 2204257 - RNA, 17 nt, Human
agucauucugccugccc

SEQ ID NO: 2204258 - RNA, 18 nt, Human
aguucuucaaagauaggg

SEQ ID NO: 2204259 - RNA, 11 nt, Human
uuugaaauugu

SEQ ID NO: 2204260 - RNA, 15 nt, Human
uuucucuaggaaaua

SEQ ID NO: 2204261 - RNA, 17 nt, Human
uuuuaaaaaagaaacau

SEQ ID NO: 2204262 - RNA, 21 nt, Human
uuuuugugaaaagcuccauuu

SEQ ID NO: 2204263 - RNA, 12 nt, Human
uuuuuuuaauaa

SEQ ID NO: 2204264 - RNA, 16 nt, Human
agccagcccucuucug

SEQ ID NO: 2204265 - RNA, 18 nt, Human
agccgggaaagaagagcc

SEQ ID NO: 2204266 - RNA, 16 nt, Human
uuguacaccaauauuc

SEQ ID NO: 2204267 - RNA, 15 nt, Human
uugugugaaagguac

SEQ ID NO: 2204268 - RNA, 14 nt, Human
uuuccacagaagcu

SEQ ID NO: 2204269 - RNA, 19 nt, Human
uugguuuuaauuagugaac

SEQ ID NO: 2204270 - RNA, 19 nt, Human
uuggucucagugucaaugc

SEQ ID NO: 2204271 - RNA, 15 nt, Human
aucaguaugaaaaug

SEQ ID NO: 2204272 - RNA, 19 nt, Human
auauuguuugcuaagcauu

SEQ ID NO: 2204273 - RNA, 19 nt, Human
auaugcuucuguuuuauaa

SEQ ID NO: 2204274 - RNA, 16 nt, Human
auauguaccuaacgaa

SEQ ID NO: 2204275 - RNA, 18 nt, Human
auaucaguuauuuuuaaa

SEQ ID NO: 2204276 - RNA, 17 nt, Human
aguuucccuugcauggu

SEQ ID NO: 2204277 - RNA, 14 nt, Human
auaaaacuuuucca

SEQ ID NO: 2204278 - RNA, 17 nt, Human
auaaaauaauuuuuaua

SEQ ID NO: 2204279 - RNA, 17 nt, Human
augguucccuugaugaa

SEQ ID NO: 2204280 - RNA, 13 nt, Human
auuauuuuuuaaa

SEQ ID NO: 2204281 - RNA, 15 nt, Human
auuaaaguucuagug

SEQ ID NO: 2204282 - RNA, 17 nt, Human
auuaaaguucuagugac

SEQ ID NO: 2204283 - RNA, 18 nt, Human
ccacuagcuaugguguca

SEQ ID NO: 2204284 - RNA, 15 nt, Human
cauuaaaguucuagu

SEQ ID NO: 2204285 - RNA, 13 nt, Human
cauuuaaauaaag

SEQ ID NO: 2204286 - RNA, 14 nt, Human
ccacagaagcucca

SEQ ID NO: 2204287 - RNA, 15 nt, Human
ccaaaaaucucaaua

SEQ ID NO: 2204288 - RNA, 21 nt, Human
caugggacagggaggacgcuc

SEQ ID NO: 2204289 - RNA, 22 nt, Human
caucuagcaugucgucaaagcu

SEQ ID NO: 2204290 - RNA, 14 nt, Human
cacagauuugagcu

SEQ ID NO: 2204291 - RNA, 20 nt, Human
cacaacacacagauuugagc

SEQ ID NO: 2204292 - RNA, 19 nt, Human
cacagaccuuugaacuaga

SEQ ID NO: 2204293 - RNA, 18 nt, Human
cacacugaagaagcacca

SEQ ID NO: 2204294 - RNA, 15 nt, Human
cacacaugaagucca

SEQ ID NO: 2204295 - RNA, 20 nt, Human
cagaaaacaaggaugaauua

SEQ ID NO: 2204296 - RNA, 16 nt, Human
cacuuaaaaaugguuu

SEQ ID NO: 2204297 - RNA, 19 nt, Human
caaaggacaccauuuuggc

SEQ ID NO: 2204298 - RNA, 18 nt, Human
caacacacagauuugagc

SEQ ID NO: 2204299 - RNA, 18 nt, Human
caaccucucccaacuaua

SEQ ID NO: 2204300 - RNA, 12 nt, Human
caagaacuuauu

SEQ ID NO: 2204301 - RNA, 20 nt, Human
auuauuuuuuaaaaaaauuc

SEQ ID NO: 2204302 - RNA, 21 nt, Human
auuaugaauuacauuuguaua

SEQ ID NO: 2204303 - RNA, 14 nt, Human
auuccuuuuucucu

SEQ ID NO: 2204304 - RNA, 19 nt, Human
augugcauauuuuauuaua

SEQ ID NO: 2204305 - RNA, 14 nt, Human
cauuaaaguucuag

SEQ ID NO: 2204306 - RNA, 19 nt, Human
cugcgcgccgcgcuccucg

SEQ ID NO: 2204307 - RNA, 14 nt, Human
cacuaaacaaagag

SEQ ID NO: 2204308 - RNA, 19 nt, Human
cuuccuaauuccacagcug

SEQ ID NO: 2204309 - RNA, 16 nt, Human
aauuuuuaauuauaug

SEQ ID NO: 2204310 - RNA, 18 nt, Human
gccggagccuccagcugc

SEQ ID NO: 2204311 - RNA, 14 nt, Human
uauaaauaaaaaua

SEQ ID NO: 2204312 - RNA, 17 nt, Human
cucuggucaagaagcau

SEQ ID NO: 2204313 - RNA, 14 nt, Human
acaagagcuuaaca

SEQ ID NO: 2204314 - RNA, 19 nt, Human
ccucucuuccucccuggaa

SEQ ID NO: 2204315 - RNA, 18 nt, Human
cugcagcgaguacuuccc

SEQ ID NO: 2204316 - RNA, 14 nt, Human
uuucuaugaaauau

SEQ ID NO: 2204317 - RNA, 19 nt, Human
accccugagcuugcagaga

SEQ ID NO: 2204318 - RNA, 14 nt, Human
cuugagguaaaagc

SEQ ID NO: 2204319 - RNA, 20 nt, Human
cccagcuagaauucacucca

SEQ ID NO: 2204320 - RNA, 20 nt, Human
aggcugagaugggagaauca

SEQ ID NO: 2204321 - RNA, 16 nt, Human
gcugcagccccuggga

SEQ ID NO: 2204322 - RNA, 15 nt, Human
auuucuaugaaauau

SEQ ID NO: 2204323 - RNA, 15 nt, Human
agccgggaaagaaga

SEQ ID NO: 2204324 - RNA, 17 nt, Human
ugugcauauuuuauuau

SEQ ID NO: 2204325 - RNA, 21 nt, Human
cuaguaucaaaagaaagaaaa

SEQ ID NO: 2204326 - RNA, 17 nt, Human
guuuaauucugaaagca

SEQ ID NO: 2204327 - RNA, 17 nt, Human
caagccuccuuuuaaag

SEQ ID NO: 2204328 - RNA, 16 nt, Human
uaaauaaaaauaaucc

SEQ ID NO: 2204329 - RNA, 19 nt, Human
ucaauucuugccaaauaua

SEQ ID NO: 2204330 - RNA, 12 nt, Human
agaaaacaauaa

SEQ ID NO: 2204331 - RNA, 19 nt, Human
guuauuauauuuacaaaug

SEQ ID NO: 2204332 - RNA, 18 nt, Human
aaaucuuauaauuuaaaa

SEQ ID NO: 2204333 - RNA, 12 nt, Human
aaaugaaagcag

SEQ ID NO: 2204334 - RNA, 22 nt, Human
ugaaaaaguucugcagauaaac

SEQ ID NO: 2204335 - RNA, 21 nt, Human
cagagguccacaacacacaga

SEQ ID NO: 2204336 - RNA, 21 nt, Human
gugccugagcggaccuuccca

SEQ ID NO: 2204337 - RNA, 14 nt, Human
agcaaguauuagaa

SEQ ID NO: 2204338 - RNA, 21 nt, Human
acagcccuucuuuccacagaa

SEQ ID NO: 2204339 - RNA, 23 nt, Human
uaacgauaaaagacagugaaaga

SEQ ID NO: 2204340 - RNA, 17 nt, Human
gacagugaaagaaaaua

SEQ ID NO: 2204341 - RNA, 12 nt, Human
uuuugaaaccaa

SEQ ID NO: 2204342 - RNA, 23 nt, Human
caccucauggaauuggagcucgu

SEQ ID NO: 2204343 - RNA, 20 nt, Human
ucaauaaaauccauacauuu

SEQ ID NO: 2204344 - RNA, 18 nt, Human
gcccacuuccucccggcc

SEQ ID NO: 2204345 - RNA, 13 nt, Human
uccuacuuccccu

SEQ ID NO: 2204346 - RNA, 20 nt, Human
cucgcccacuuccucccggc

SEQ ID NO: 2204347 - RNA, 22 nt, Human
ugaguguugccuaauuuguuuu

SEQ ID NO: 2204348 - RNA, 21 nt, Human
caccagucugacuguuuccau

SEQ ID NO: 2204349 - RNA, 19 nt, Human
ugaaaccaaaccagagccu

SEQ ID NO: 2204350 - RNA, 13 nt, Human
aguaugaaaaugu

SEQ ID NO: 2204351 - RNA, 12 nt, Human
auggguuuuauu

SEQ ID NO: 2204352 - RNA, 18 nt, Human
ggggucagccagcccucu

SEQ ID NO: 2204353 - RNA, 22 nt, Human
ccgggaggcagagguugcagug

SEQ ID NO: 2204354 - RNA, 22 nt, Human
uuguaacaagccuccuuuuaaa

SEQ ID NO: 2204355 - RNA, 21 nt, Human
uaauaggcguaacuaauuuua

SEQ ID NO: 2204356 - RNA, 20 nt, Human
aaauccuugaagauuuacca

SEQ ID NO: 2204357 - RNA, 16 nt, Human
gccucagucucccucc

SEQ ID NO: 2204358 - RNA, 16 nt, Human
agguacuucaaauccu

SEQ ID NO: 2204359 - RNA, 23 nt, Human
gccggcgcgcucaucccacccgc

SEQ ID NO: 2204360 - RNA, 13 nt, Human
uauuucuaugaaa

SEQ ID NO: 2204361 - RNA, 21 nt, Human
ugcccugaaagucccagauca

SEQ ID NO: 2204362 - RNA, 15 nt, Human
cccggccggcgcgcu

SEQ ID NO: 2204363 - RNA, 19 nt, Human
augaaguacucauacaugu

SEQ ID NO: 2204364 - RNA, 20 nt, Human
gagccucagucucccucccu

SEQ ID NO: 2204365 - RNA, 22 nt, Human
aaaaaaccugagccccaaaagg

SEQ ID NO: 2204366 - RNA, 22 nt, Human
ggcugcugguggcgcuggcugc

SEQ ID NO: 2204367 - RNA, 12 nt, Human
cagugaaagaaa

SEQ ID NO: 2204368 - RNA, 21 nt, Human
gcaggaccaucccggccggcg

SEQ ID NO: 2204369 - RNA, 16 nt, Human
acaaauccaaugaaau

SEQ ID NO: 2204370 - RNA, 15 nt, Human
ugaaauuguauuaca

SEQ ID NO: 2204371 - RNA, 16 nt, Human
gcagcucaggcuggca

SEQ ID NO: 2204372 - RNA, 14 nt, Human
auggcaggaggcau

SEQ ID NO: 2204373 - RNA, 16 nt, Human
augcuguauuuuaaaa

SEQ ID NO: 2204374 - RNA, 16 nt, Human
gcuccggacgcugcug

SEQ ID NO: 2204375 - RNA, 13 nt, Human
agggagggaaggg

SEQ ID NO: 2204376 - RNA, 17 nt, Human
agcucugcccauccugc

SEQ ID NO: 2204377 - RNA, 18 nt, Human
gccuucggccuccauccu

SEQ ID NO: 2204378 - RNA, 22 nt, Human
cucagcccuggugggcagagag

SEQ ID NO: 2204379 - RNA, 21 nt, Human
caaggaaaaaauaacaaugaa

SEQ ID NO: 2204380 - RNA, 21 nt, Human
ccaaggaugccccgucccccu

SEQ ID NO: 2204381 - RNA, 19 nt, Human
ugaucaguaugaaaauguc

SEQ ID NO: 2204382 - RNA, 14 nt, Human
gccucagucucccu

SEQ ID NO: 2204383 - RNA, 13 nt, Human
gaagagccggagc

SEQ ID NO: 2204384 - RNA, 15 nt, Human
auccugccccugagc

SEQ ID NO: 2204385 - RNA, 13 nt, Human
agguaccuucuca

SEQ ID NO: 2204386 - RNA, 13 nt, Human
gccuccccagcuc

SEQ ID NO: 2204387 - RNA, 16 nt, Human
caaaaggauaaugaau

SEQ ID NO: 2204388 - RNA, 20 nt, Human
cucuucugacacuaaaacac

SEQ ID NO: 2204389 - RNA, 10 nt, Human
uuuuuaaaaa

SEQ ID NO: 2204390 - RNA, 17 nt, Human
aaagcuccauuuuuagu

SEQ ID NO: 2204391 - RNA, 17 nt, Human
uucugacacuaaaacac

SEQ ID NO: 2204392 - RNA, 20 nt, Human
accucugccucagaaaacaa

SEQ ID NO: 2204393 - RNA, 23 nt, Human
ugaaaugaguuuuucuuuucauu

SEQ ID NO: 2204394 - RNA, 23 nt, Human
ccagguaccuucucaccugugag

SEQ ID NO: 2204395 - RNA, 16 nt, Human
ggcauggguuuuauua

SEQ ID NO: 2204396 - RNA, 23 nt, Human
uggaaauguuuacagauccccaa

SEQ ID NO: 2204397 - RNA, 23 nt, Human
gaacaugagccuuuguugcuauc

SEQ ID NO: 2204398 - RNA, 18 nt, Human
gaauaauccuaaacauau

SEQ ID NO: 2204399 - RNA, 20 nt, Human
acuagaguuuagcuggaaaa

SEQ ID NO: 2204400 - RNA, 16 nt, Human
uccugcaauuccacuu

SEQ ID NO: 2204401 - RNA, 13 nt, Human
ccaaaagguauuu

SEQ ID NO: 2204402 - RNA, 14 nt, Human
cgucccccucuggc

SEQ ID NO: 2204403 - RNA, 21 nt, Human
cuuucaugaaggggcggcggc

SEQ ID NO: 2204404 - RNA, 17 nt, Human
aaucuuucacaggggac

SEQ ID NO: 2204405 - RNA, 11 nt, Human
uuuuuuuaaaa

SEQ ID NO: 2204406 - RNA, 23 nt, Human
ccccugggaccaggcacccccag

SEQ ID NO: 2204407 - RNA, 21 nt, Human
ccacauccugugggaccuggg

SEQ ID NO: 2204408 - RNA, 18 nt, Human
cugagucccaggcugagc

SEQ ID NO: 2204409 - RNA, 17 nt, Human
ggcccugugcggccugg

SEQ ID NO: 2204410 - RNA, 15 nt, Human
ccugccccccagccc

SEQ ID NO: 2204411 - RNA, 19 nt, Human
cccccucuggcuccagcug

SEQ ID NO: 2204412 - RNA, 15 nt, Human
caggaaguagaggag

SEQ ID NO: 2204413 - RNA, 22 nt, Human
ccaaaggcuccugagacacaug

SEQ ID NO: 2204414 - RNA, 13 nt, Human
ccucauggaauug

SEQ ID NO: 2204415 - RNA, 17 nt, Human
gccuaagugcagccccg

SEQ ID NO: 2204416 - RNA, 21 nt, Human
gcgcucaucccacccgcccac

SEQ ID NO: 2204417 - RNA, 22 nt, Human
ccucccuuggggccuaugcaga

SEQ ID NO: 2204418 - RNA, 18 nt, Human
agaagcaacccaaauguu

SEQ ID NO: 2204419 - RNA, 19 nt, Human
ugagucccaggcugagccu

SEQ ID NO: 2204420 - RNA, 19 nt, Human
agaguuuagcuggaaaagu

SEQ ID NO: 2204421 - RNA, 14 nt, Human
caaggaaaaaauaa

SEQ ID NO: 2204422 - RNA, 15 nt, Human
gagaugcuagaacuc

SEQ ID NO: 2204423 - RNA, 23 nt, Human
uuuguauaaaauaauuuuuauau

SEQ ID NO: 2204424 - RNA, 19 nt, Human
agugaggagcuuugaaacg

SEQ ID NO: 2204425 - RNA, 19 nt, Human
ccccugcaaagcccagcuu

SEQ ID NO: 2204426 - RNA, 20 nt, Human
guccccuauccuacuucccc

SEQ ID NO: 2204427 - RNA, 20 nt, Human
cgcaggaccaucccggccgg

SEQ ID NO: 2204428 - RNA, 13 nt, Human
agcucugcccauc

SEQ ID NO: 2204429 - RNA, 18 nt, Human
gaaaugaaagcagggacu

SEQ ID NO: 2204430 - RNA, 18 nt, Human
aauuuuuuugugggaaau

SEQ ID NO: 2204431 - RNA, 11 nt, Human
gagguaaaagc

SEQ ID NO: 2204432 - RNA, 22 nt, Human
caaaugggaaacaaaaggauaa

SEQ ID NO: 2204433 - RNA, 23 nt, Human
ggaugaauuaaguuuuuuuuuaa

SEQ ID NO: 2204434 - RNA, 16 nt, Human
ucccagaucaagccug

SEQ ID NO: 2204435 - RNA, 19 nt, Human
uccauccugaggcuccacu

SEQ ID NO: 2204436 - RNA, 23 nt, Human
acugucuuguuggacgagaaaac

SEQ ID NO: 2204437 - RNA, 15 nt, Human
uucugcacacagcac

SEQ ID NO: 2204438 - RNA, 21 nt, Human
gggagccugaucaccugcccu

SEQ ID NO: 2204439 - RNA, 16 nt, Human
augccccgucccccuc

SEQ ID NO: 2204440 - RNA, 12 nt, Human
gaaaauaacaau

SEQ ID NO: 2204441 - RNA, 15 nt, Human
gacaugggccccaga

SEQ ID NO: 2204442 - RNA, 15 nt, Human
gccuaagugcagccc

SEQ ID NO: 2204443 - RNA, 17 nt, Human
cugguggcgcuggcugc

SEQ ID NO: 2204444 - RNA, 18 nt, Human
caaucaguauucauauuu

SEQ ID NO: 2204445 - RNA, 16 nt, Human
aaauauaaauaaaaau

SEQ ID NO: 2204446 - RNA, 17 nt, Human
ccucuggcuccagcugg

SEQ ID NO: 2204447 - RNA, 16 nt, Human
ugccucaccccuugcc

SEQ ID NO: 2204448 - RNA, 23 nt, Human
agcucugcccauccugccccuga

SEQ ID NO: 2204449 - RNA, 14 nt, Human
aauauuuauuuuaa

SEQ ID NO: 2204450 - RNA, 19 nt, Human
ugaacaaauuuacagagac

SEQ ID NO: 2204451 - RNA, 20 nt, Human
aaacuuuaugcuaagugaaa

SEQ ID NO: 2204452 - RNA, 14 nt, Human
caguucugaagaag

SEQ ID NO: 2204453 - RNA, 16 nt, Human
aaauccacacugagcu

SEQ ID NO: 2204454 - RNA, 19 nt, Human
cuucccgcuguuccucgcc

SEQ ID NO: 2204455 - RNA, 18 nt, Human
uuggggccuaugcagagg

SEQ ID NO: 2204456 - RNA, 17 nt, Human
ugaucaccugcccugcu

SEQ ID NO: 2204457 - RNA, 23 nt, Human
uaaguuuuuuuuuaaaaaagaaa

SEQ ID NO: 2204458 - RNA, 21 nt, Human
cauuucuugagguaaaagcau

SEQ ID NO: 2204459 - RNA, 15 nt, Human
cuaucuuugagcgcc

SEQ ID NO: 2204460 - RNA, 24 nt, Human
cauucuggaauaauccuaaacaua

SEQ ID NO: 2204461 - RNA, 22 nt, Human
auaacaaugcuguauuuuaaaa

SEQ ID NO: 2204462 - RNA, 16 nt, Human
aaacuaggugcugcag

SEQ ID NO: 2204463 - RNA, 18 nt, Human
gaggcggauugagaagga

SEQ ID NO: 2204464 - RNA, 18 nt, Human
uaaauguuguuuuaggaa

SEQ ID NO: 2204465 - RNA, 14 nt, Human
ugcagccccuggga

SEQ ID NO: 2204466 - RNA, 15 nt, Human
auuuuaaaagaauga

SEQ ID NO: 2204467 - RNA, 19 nt, Human
cagcacgggggccaaggau

SEQ ID NO: 2204468 - RNA, 22 nt, Human
acaccuuguacuuuauuuucua

SEQ ID NO: 2204469 - RNA, 11 nt, Human
ccugagcccca

SEQ ID NO: 2204470 - RNA, 19 nt, Human
agaaaauaacgauaaaaga

SEQ ID NO: 2204471 - RNA, 23 nt, Human
ggcugcgcucggccugcucgccc

SEQ ID NO: 2204472 - RNA, 20 nt, Human
ugagagacacacugaagaag

SEQ ID NO: 2204473 - RNA, 18 nt, Human
auugagaaggagcuccca

SEQ ID NO: 2204474 - RNA, 14 nt, Human
uuucaauaaaacuu

SEQ ID NO: 2204475 - RNA, 22 nt, Human
gaaugaccuggccgcagugagg

SEQ ID NO: 2204476 - RNA, 23 nt, Human
aaaauaucacuugucaauaaaau

SEQ ID NO: 2204477 - RNA, 18 nt, Human
acaaaugggaaacaaaag

SEQ ID NO: 2204478 - RNA, 16 nt, Human
uccuagucucuaucau

SEQ ID NO: 2204479 - RNA, 16 nt, Human
cuucaacucccugccc

SEQ ID NO: 2204480 - RNA, 14 nt, Human
aauauuauuuuaua

SEQ ID NO: 2204481 - RNA, 22 nt, Human
augcagagguccacaacacaca

SEQ ID NO: 2204482 - RNA, 22 nt, Human
ugucucuacuaaaaauacaaaa

SEQ ID NO: 2204483 - RNA, 17 nt, Human
cuaucucauuuccaagc

SEQ ID NO: 2204484 - RNA, 13 nt, Human
uccccagcucuau

SEQ ID NO: 2204485 - RNA, 22 nt, Human
aucaucaagucuuucacauuua

SEQ ID NO: 2204486 - RNA, 11 nt, Human
ucaccuccccc

SEQ ID NO: 2204487 - RNA, 21 nt, Human
cuucucacauuuauauuuuug

SEQ ID NO: 2204488 - RNA, 22 nt, Human
ccauagucauucugccugcccu

SEQ ID NO: 2204489 - RNA, 18 nt, Human
auuuaggccaugggacag

SEQ ID NO: 2204490 - RNA, 13 nt, Human
aggauuugaaauu

SEQ ID NO: 2204491 - RNA, 20 nt, Human
cugacacuaaaacaccucag

SEQ ID NO: 2204492 - RNA, 16 nt, Human
aaauauuuauuuuaau

SEQ ID NO: 2204493 - RNA, 19 nt, Human
cuuggggccuaugcagagg

SEQ ID NO: 2204494 - RNA, 22 nt, Human
guacacugccuucucaacucca

SEQ ID NO: 2204495 - RNA, 18 nt, Human
uacauaaaguaugugcau

SEQ ID NO: 2204496 - RNA, 15 nt, Human
gugaacuugguuuua

SEQ ID NO: 2204497 - RNA, 21 nt, Human
ucauucacucaacaaacauaa

SEQ ID NO: 2204498 - RNA, 17 nt, Human
cugcgcucggccugcuc

SEQ ID NO: 2204499 - RNA, 20 nt, Human
gggaggcagagguugcagug

SEQ ID NO: 2204500 - RNA, 17 nt, Human
gccggagccuccagcug

SEQ ID NO: 2204501 - RNA, 22 nt, Human
auauuuacaaaugggaaacaaa

SEQ ID NO: 2204502 - RNA, 14 nt, Human
augauguuuagaaa

SEQ ID NO: 2204503 - RNA, 22 nt, Human
uuuaauaauguuucaaacauau

SEQ ID NO: 2204504 - RNA, 22 nt, Human
uauccuacuuccccuuccuaau

SEQ ID NO: 2204505 - RNA, 16 nt, Human
aauaaaguguuugaaa

SEQ ID NO: 2204506 - RNA, 21 nt, Human
gccggcgcgcucaucccaccc

SEQ ID NO: 2204507 - RNA, 17 nt, Human
uuauaucaauuuaaaaa

SEQ ID NO: 2204508 - RNA, 19 nt, Human
ucaguccaugaagauguag

SEQ ID NO: 2204509 - RNA, 14 nt, Human
ggggaacaugagcc

SEQ ID NO: 2204510 - RNA, 17 nt, Human
acuguaaagcuuugugc

SEQ ID NO: 2204511 - RNA, 19 nt, Human
cucaccucccccaucucuu

SEQ ID NO: 2204512 - RNA, 15 nt, Human
agacagcucugcaua

SEQ ID NO: 2204513 - RNA, 20 nt, Human
gaaaauaacaauaaaagaca

SEQ ID NO: 2204514 - RNA, 17 nt, Human
agucccaggcugagccu

SEQ ID NO: 2204515 - RNA, 15 nt, Human
ccaaggagccaaaca

SEQ ID NO: 2204516 - RNA, 22 nt, Human
ggacagcccuucuuuccacaga

SEQ ID NO: 2204517 - RNA, 19 nt, Human
gaaggagcucccaggaggg

SEQ ID NO: 2204518 - RNA, 16 nt, Human
auagucauucugccug

SEQ ID NO: 2204519 - RNA, 22 nt, Human
gucaagaagcaucgugucuggc

SEQ ID NO: 2204520 - RNA, 16 nt, Human
ggcgggagggcgcggg

SEQ ID NO: 2204521 - RNA, 12 nt, Human
ucaagaagcauc

SEQ ID NO: 2204522 - RNA, 20 nt, Human
acuaaauugacacuuaaaaa

SEQ ID NO: 2204523 - RNA, 16 nt, Human
gacauagaauuaacac

SEQ ID NO: 2204524 - RNA, 13 nt, Human
ccagcccuccuua

SEQ ID NO: 2204525 - RNA, 18 nt, Human
gaagagccggagccucca

SEQ ID NO: 2204526 - RNA, 19 nt, Human
ugaaauggacuuuuguaca

SEQ ID NO: 2204527 - RNA, 19 nt, Human
uguauacugugugcuaaaa

SEQ ID NO: 2204528 - RNA, 19 nt, Human
gagguacugagagugaaca

SEQ ID NO: 2204529 - RNA, 14 nt, Human
uggacucaccuccc

SEQ ID NO: 2204530 - RNA, 21 nt, Human
cgaaguauccuucagccugaa

SEQ ID NO: 2204531 - RNA, 11 nt, Human
ugcagugagcc

SEQ ID NO: 2204532 - RNA, 22 nt, Human
cuuuccacagaagcuccaggua

SEQ ID NO: 2204533 - RNA, 16 nt, Human
ucagucucccucccuu

SEQ ID NO: 2204534 - RNA, 21 nt, Human
uguaaaauggugugaccacug

SEQ ID NO: 2204535 - RNA, 14 nt, Human
uccacuuggucugu

SEQ ID NO: 2204536 - RNA, 13 nt, Human
gcccccgggccga

SEQ ID NO: 2204537 - RNA, 15 nt, Human
gccuugggaccccug

SEQ ID NO: 2204538 - RNA, 23 nt, Human
ugucacgugugggcaauguuccc

SEQ ID NO: 2204539 - RNA, 19 nt, Human
cuaagcuucacuguaaaau

SEQ ID NO: 2204540 - RNA, 17 nt, Human
uaugugcauauuuuauu

SEQ ID NO: 2204541 - RNA, 16 nt, Human
cucagcugccucccca

SEQ ID NO: 2204542 - RNA, 15 nt, Human
auaaauaaaaauaau

SEQ ID NO: 2204543 - RNA, 15 nt, Human
ccucagucucccucc

SEQ ID NO: 2204544 - RNA, 22 nt, Human
gccauagucauucugccugccc

SEQ ID NO: 2204545 - RNA, 17 nt, Human
uggcuaagcaaaaugug

SEQ ID NO: 2204546 - RNA, 22 nt, Human
cuucaacucccugccccccagc

SEQ ID NO: 2204547 - RNA, 23 nt, Human
aucaccaaggcugauuaaaccaa

SEQ ID NO: 2204548 - RNA, 14 nt, Human
accugugagaccaa

SEQ ID NO: 2204549 - RNA, 14 nt, Human
aagcucuaucacca

SEQ ID NO: 2204550 - RNA, 21 nt, Human
cucaaaacuucagacauagaa

SEQ ID NO: 2204551 - RNA, 21 nt, Human
uuuuauggcacuaguauuucu

SEQ ID NO: 2204552 - RNA, 11 nt, Human
gggaccugggc

SEQ ID NO: 2204553 - RNA, 22 nt, Human
auuuucuucucacauuuauauu

SEQ ID NO: 2204554 - RNA, 19 nt, Human
auuuugugaagcaaaauuu

SEQ ID NO: 2204555 - RNA, 15 nt, Human
ccacaggaaccacaa

SEQ ID NO: 2204556 - RNA, 22 nt, Human
uugacccacaagaaaugaaagc

SEQ ID NO: 2204557 - RNA, 12 nt, Human
acaagaaaugaa

SEQ ID NO: 2204558 - RNA, 12 nt, Human
cggcccugugcg

SEQ ID NO: 2204559 - RNA, 16 nt, Human
uaggauguugaaaaag

SEQ ID NO: 2204560 - RNA, 21 nt, Human
cagugagacagcucugcauac

SEQ ID NO: 2204561 - RNA, 22 nt, Human
auaucuuuuuuuuaauaaacca

SEQ ID NO: 2204562 - RNA, 15 nt, Human
uaaaacuuuuccaau

SEQ ID NO: 2204563 - RNA, 18 nt, Human
acaccucagcugccuccc

SEQ ID NO: 2204564 - RNA, 15 nt, Human
ucuuauaauuuaaaa

SEQ ID NO: 2204565 - RNA, 16 nt, Human
uucugacacuaaaaca

SEQ ID NO: 2204566 - RNA, 17 nt, Human
ggauacuccauggggug

SEQ ID NO: 2204567 - RNA, 12 nt, Human
aaaaaaacguau

SEQ ID NO: 2204568 - RNA, 11 nt, Human
uuuuuuuucaa

SEQ ID NO: 2204569 - RNA, 20 nt, Human
caccgcagggugaacugcag

SEQ ID NO: 2204570 - RNA, 19 nt, Human
uggcaagcucuaucaccaa

SEQ ID NO: 2204571 - RNA, 21 nt, Human
augugcauauuuuauuauagu

SEQ ID NO: 2204572 - RNA, 19 nt, Human
cuagaguuuagcuggaaaa

SEQ ID NO: 2204573 - RNA, 12 nt, Human
gacgagaaaaca

SEQ ID NO: 2204574 - RNA, 18 nt, Human
ggcuccggacgcugcugc

SEQ ID NO: 2204575 - RNA, 17 nt, Human
uguaaaggaauuuaaaa

SEQ ID NO: 2204576 - RNA, 21 nt, Human
cuauguucuaagaagugaaaa

SEQ ID NO: 2204577 - RNA, 16 nt, Human
uucccaacuccagaaa

SEQ ID NO: 2204578 - RNA, 19 nt, Human
cugagcccggaaacuccac

SEQ ID NO: 2204579 - RNA, 14 nt, Human
cucccucccuuggg

SEQ ID NO: 2204580 - RNA, 15 nt, Human
ccucccggccgcgcu

SEQ ID NO: 2204581 - RNA, 21 nt, Human
cugccccggggaggggcgcuc

SEQ ID NO: 2204582 - RNA, 13 nt, Human
cucagaaaacaag

SEQ ID NO: 2204583 - RNA, 15 nt, Human
ucuggcuccagcugg

SEQ ID NO: 2204584 - RNA, 18 nt, Human
uguacuuuauuuucuaua

SEQ ID NO: 2204585 - RNA, 15 nt, Human
agucaccucauggaa

SEQ ID NO: 2204586 - RNA, 22 nt, Human
agaagagccggagccuccagcu

SEQ ID NO: 2204587 - RNA, 17 nt, Human
uugggguugggggggag

SEQ ID NO: 2204588 - RNA, 14 nt, Human
cauccugugggacc

SEQ ID NO: 2204589 - RNA, 18 nt, Human
auuuuuagugaaauauua

SEQ ID NO: 2204590 - RNA, 21 nt, Human
uacaugagguacugagaguga

SEQ ID NO: 2204591 - RNA, 17 nt, Human
aaacaccucagcugccu

SEQ ID NO: 2204592 - RNA, 15 nt, Human
aggauggcaggaggc

SEQ ID NO: 2204593 - RNA, 15 nt, Human
agaaaacaauaacga

SEQ ID NO: 2204594 - RNA, 14 nt, Human
uaaauaguuuauga

SEQ ID NO: 2204595 - RNA, 19 nt, Human
uauuuuaauaauguuucaa

SEQ ID NO: 2204596 - RNA, 22 nt, Human
caugaguaacugauuuguaaca

SEQ ID NO: 2204597 - RNA, 22 nt, Human
uacugagagugaacaaauuuac

SEQ ID NO: 2204598 - RNA, 22 nt, Human
cagcccuggugggcagagaggu

SEQ ID NO: 2204599 - RNA, 22 nt, Human
ggccggcgcgcucaucccaccc

SEQ ID NO: 2204600 - RNA, 15 nt, Human
agccucagucucccu

SEQ ID NO: 2204601 - RNA, 21 nt, Human
aaaaacguauugcauuuaauu

SEQ ID NO: 2204602 - RNA, 21 nt, Human
ccuggugccucaccccuugcc

SEQ ID NO: 2204603 - RNA, 22 nt, Human
ccacagcuguaugauucccagc

SEQ ID NO: 2204604 - RNA, 17 nt, Human
gauaaaagacagugaaa

SEQ ID NO: 2204605 - RNA, 19 nt, Human
auagucauucugccugccc

SEQ ID NO: 2204606 - RNA, 12 nt, Human
ggggugggggug

SEQ ID NO: 2204607 - RNA, 22 nt, Human
gaugcaguuguugcccacagcu

SEQ ID NO: 2204608 - RNA, 21 nt, Human
aauuuuuauauuugaaauauu

SEQ ID NO: 2204609 - RNA, 13 nt, Human
cgagccccaggcg

SEQ ID NO: 2204610 - RNA, 19 nt, Human
cuggacucaccucccccau

SEQ ID NO: 2204611 - RNA, 23 nt, Human
ggucuaucuuugagcgcccacua

SEQ ID NO: 2204612 - RNA, 13 nt, Human
cggauugagaagg

SEQ ID NO: 2204613 - RNA, 14 nt, Human
aauauuauguuaaa

SEQ ID NO: 2204614 - RNA, 23 nt, Human
aacuuguaaaggaauuuaaaaau

SEQ ID NO: 2204615 - RNA, 17 nt, Human
cccccugcaaagcccag

SEQ ID NO: 2204616 - RNA, 22 nt, Human
gacucaccucccccaucucuuc

SEQ ID NO: 2204617 - RNA, 19 nt, Human
gacagucaccucauggaau

SEQ ID NO: 2204618 - RNA, 13 nt, Human
cacaacuauauug

SEQ ID NO: 2204619 - RNA, 19 nt, Human
uccuagucucuaucauuaa

SEQ ID NO: 2204620 - RNA, 12 nt, Human
caugggaaguga

SEQ ID NO: 2204621 - RNA, 15 nt, Human
gcacagccucuuaga

SEQ ID NO: 2204622 - RNA, 13 nt, Human
ucuaagaagugaa

SEQ ID NO: 2204623 - RNA, 21 nt, Human
ggcgcuggcugcgcucggccu

SEQ ID NO: 2204624 - RNA, 16 nt, Human
ccuccuuuuaaaguaa

SEQ ID NO: 2204625 - RNA, 21 nt, Human
aggacagcccuucuuuccaca

SEQ ID NO: 2204626 - RNA, 17 nt, Human
uauauuguagauaauac

SEQ ID NO: 2204627 - RNA, 14 nt, Human
uacuaauuuuaaaa

SEQ ID NO: 2204628 - RNA, 18 nt, Human
auaauccuaaacauauga

SEQ ID NO: 2204629 - RNA, 17 nt, Human
augaauaucaguuauuu

SEQ ID NO: 2204630 - RNA, 14 nt, Human
caugggccccagau

SEQ ID NO: 2204631 - RNA, 12 nt, Human
cuggcuccagcu

SEQ ID NO: 2204632 - RNA, 20 nt, Human
ccgcagggugaacugcagcg

SEQ ID NO: 2204633 - RNA, 15 nt, Human
caaauccaaugaaau

SEQ ID NO: 2204634 - RNA, 19 nt, Human
gccugaucaccugcccugc

SEQ ID NO: 2204635 - RNA, 16 nt, Human
ccucaaaacuucagac

SEQ ID NO: 2204636 - RNA, 16 nt, Human
uccuguaauggaagca

SEQ ID NO: 2204637 - RNA, 13 nt, Human
ccccagcccuccu

SEQ ID NO: 2204638 - RNA, 15 nt, Human
cauucugccugcccu

SEQ ID NO: 2204639 - RNA, 20 nt, Human
aacaagccuccuuuuaaagu

SEQ ID NO: 2204640 - RNA, 20 nt, Human
aaugaauacuuuauaaagga

SEQ ID NO: 2204641 - RNA, 17 nt, Human
augccccgucccccucu

SEQ ID NO: 2204642 - RNA, 20 nt, Human
caaauauaaauaaaaauaau

SEQ ID NO: 2204643 - RNA, 19 nt, Human
guccaggucuaccaaaaau

SEQ ID NO: 2204644 - RNA, 13 nt, Human
auuggacaguaaa

SEQ ID NO: 2204645 - RNA, 14 nt, Human
ccugccccugagcc

SEQ ID NO: 2204646 - RNA, 18 nt, Human
gcgcgcccucuggcugcu

SEQ ID NO: 2204647 - RNA, 20 nt, Human
uggaauaauccuaaacauau

SEQ ID NO: 2204648 - RNA, 17 nt, Human
acucaccucccccaucu

SEQ ID NO: 2204649 - RNA, 16 nt, Human
cuucacuguaaaauaa

SEQ ID NO: 2204650 - RNA, 18 nt, Human
uaaguuuuuuuuuaaaaa

SEQ ID NO: 2204651 - RNA, 17 nt, Human
uaaaagacaaggaaaaa

SEQ ID NO: 2204652 - RNA, 19 nt, Human
agcagcuuauucacaagac

SEQ ID NO: 2204653 - RNA, 22 nt, Human
cggagccuccagcugccccggg

SEQ ID NO: 2204654 - RNA, 15 nt, Human
cacuuggucugugag

SEQ ID NO: 2204655 - RNA, 16 nt, Human
aaaauaacaauaaaag

SEQ ID NO: 2204656 - RNA, 17 nt, Human
ucgggauuaguacacac

SEQ ID NO: 2204657 - RNA, 17 nt, Human
ugagcggaccuucccag

SEQ ID NO: 2204658 - RNA, 21 nt, Human
agagccggagccuccagcugc

SEQ ID NO: 2204659 - RNA, 11 nt, Human
augggacaggg

SEQ ID NO: 2204660 - RNA, 15 nt, Human
uucacauuuaaauaa

SEQ ID NO: 2204661 - RNA, 16 nt, Human
ucuugagguaaaagca

SEQ ID NO: 2204662 - RNA, 17 nt, Human
acaaaugcauuucuaaa

SEQ ID NO: 2204663 - RNA, 22 nt, Human
cccacuuccucccggccgcgcu

SEQ ID NO: 2204664 - RNA, 12 nt, Human
agacagugaaag

SEQ ID NO: 2204665 - RNA, 23 nt, Human
uacaaaugggaaacaaaaggaua

SEQ ID NO: 2204666 - RNA, 16 nt, Human
cggggagcgagcccca

SEQ ID NO: 2204667 - RNA, 15 nt, Human
aguaugugcauauuu

SEQ ID NO: 2204668 - RNA, 19 nt, Human
uuuccugaaaacccuugcc

SEQ ID NO: 2204669 - RNA, 22 nt, Human
aaacauccuacaagacacagug

SEQ ID NO: 2204670 - RNA, 19 nt, Human
uugagaaggagcucccagg

SEQ ID NO: 2204671 - RNA, 16 nt, Human
aaaauccauacauuug

SEQ ID NO: 2204672 - RNA, 16 nt, Human
agccucagucucccuc

SEQ ID NO: 2204673 - RNA, 18 nt, Human
uaaauugacacuuaaaaa

SEQ ID NO: 2204674 - RNA, 15 nt, Human
uuuaauaauuuuuaa

SEQ ID NO: 2204675 - RNA, 17 nt, Human
gcaagcucuaucaccaa

SEQ ID NO: 2204676 - RNA, 24 nt, Human
ccccugagcuugcagagaugaggc

SEQ ID NO: 2204677 - RNA, 15 nt, Human
uugacacuuaaaaau

SEQ ID NO: 2204678 - RNA, 23 nt, Human
ggaacaguuaccucugccucaga

SEQ ID NO: 2204679 - RNA, 20 nt, Human
gacauuugcucauggaauug

SEQ ID NO: 2204680 - RNA, 15 nt, Human
cucccuuggggccua

SEQ ID NO: 2204681 - RNA, 23 nt, Human
aucgugucuggcguuguggggau

SEQ ID NO: 2204682 - RNA, 15 nt, Human
ugagguaaccucauu

SEQ ID NO: 2204683 - RNA, 16 nt, Human
ccacuuggucugugag

SEQ ID NO: 2204684 - RNA, 20 nt, Human
ugaaaaucuuauaauuuaaa

SEQ ID NO: 2204685 - RNA, 16 nt, Human
aaugaaagcagggacu

SEQ ID NO: 2204686 - RNA, 15 nt, Human
gccccauucaacauc

SEQ ID NO: 2204687 - RNA, 22 nt, Human
cucuggucaagaagcaucgugu

SEQ ID NO: 2204688 - RNA, 15 nt, Human
ccuugccaugugcua

SEQ ID NO: 2204689 - RNA, 14 nt, Human
gaaugauuaugaau

SEQ ID NO: 2204690 - RNA, 16 nt, Human
gugagacagcucugca

SEQ ID NO: 2204691 - RNA, 16 nt, Human
ccugaucaccugcccu

SEQ ID NO: 2204692 - RNA, 23 nt, Human
gaaaaucuuauaauuuaaaauau

SEQ ID NO: 2204693 - RNA, 20 nt, Human
ggccuaugcagagguccaca

SEQ ID NO: 2204694 - RNA, 15 nt, Human
gcaagcucuaucacc

SEQ ID NO: 2204695 - RNA, 18 nt, Human
gacauuugcucauggaau

SEQ ID NO: 2204696 - RNA, 18 nt, Human
uuuauguuuaauucugaa

SEQ ID NO: 2204697 - RNA, 16 nt, Human
augaauacuuuauaaa

SEQ ID NO: 2204698 - RNA, 13 nt, Human
gggaggggcgcuc

SEQ ID NO: 2204699 - RNA, 14 nt, Human
cccugccccccagc

SEQ ID NO: 2204700 - RNA, 16 nt, Human
guuccuuccucugagc

SEQ ID NO: 2204701 - RNA, 18 nt, Human
aaauauaaauaaaaauaa

SEQ ID NO: 2204702 - RNA, 22 nt, Human
ugaccauacuaauuauaccccc

SEQ ID NO: 2204703 - RNA, 19 nt, Human
aaacaccucagcugccucc

SEQ ID NO: 2204704 - RNA, 18 nt, Human
cucuggccuucggccucc

SEQ ID NO: 2204705 - RNA, 23 nt, Human
uagacacacaugaaguccaagca

SEQ ID NO: 2204706 - RNA, 20 nt, Human
ccaggcggguccgggucgca

SEQ ID NO: 2204707 - RNA, 22 nt, Human
uagacacacaugaaguccaagc

SEQ ID NO: 2204708 - RNA, 18 nt, Human
aguucuccacuagcuaug

SEQ ID NO: 2204709 - RNA, 15 nt, Human
uccaagccucauguc

SEQ ID NO: 2204710 - RNA, 15 nt, Human
acuuuauaaaggauu

SEQ ID NO: 2204711 - RNA, 16 nt, Human
gugcugcagccccugg

SEQ ID NO: 2204712 - RNA, 16 nt, Human
aucaauuuaaaaaaaa

SEQ ID NO: 2204713 - RNA, 16 nt, Human
acggagccgggaaaga

SEQ ID NO: 2204714 - RNA, 14 nt, Human
agaugcuagaacuc

SEQ ID NO: 2204715 - RNA, 23 nt, Human
auaaaguaugugcauauuuuauu

SEQ ID NO: 2204716 - RNA, 22 nt, Human
gaaaacaauaacgauaaaagac

SEQ ID NO: 2204717 - RNA, 18 nt, Human
acuuuaugcuaagugaaa

SEQ ID NO: 2204718 - RNA, 21 nt, Human
gcuccgcgcagcucaggcugg

SEQ ID NO: 2204719 - RNA, 16 nt, Human
auaacuggaaacuuca

SEQ ID NO: 2204720 - RNA, 21 nt, Human
caagacccaaaaggcagaagc

SEQ ID NO: 2204721 - RNA, 21 nt, Human
aaagaaaauaacgauaaaaga

SEQ ID NO: 2204722 - RNA, 19 nt, Human
gacggagccgggaaagaag

SEQ ID NO: 2204723 - RNA, 18 nt, Human
cggagccuccagcugccc

SEQ ID NO: 2204724 - RNA, 21 nt, Human
aauaauguuucaaacauauau

SEQ ID NO: 2204725 - RNA, 22 nt, Human
ccauuucuugagguaaaagcau

SEQ ID NO: 2204726 - RNA, 14 nt, Human
cacaagaaaugaaa

SEQ ID NO: 2204727 - RNA, 17 nt, Human
ccccagaaugaccuggc

SEQ ID NO: 2204728 - RNA, 15 nt, Human
cgcgcugcgcgccgc

SEQ ID NO: 2204729 - RNA, 21 nt, Human
accagagccugaguguugccu

SEQ ID NO: 2204730 - RNA, 23 nt, Human
aaguauccuucagccugaaagag

SEQ ID NO: 2204731 - RNA, 23 nt, Human
gcccuggugccucaccccuugcc

SEQ ID NO: 2204732 - RNA, 18 nt, Human
auggcuugaguuuaaauu

SEQ ID NO: 2204733 - RNA, 15 nt, Human
acaaggaaaaaauaa

SEQ ID NO: 2204734 - RNA, 13 nt, Human
cgaguacuucccg

SEQ ID NO: 2204735 - RNA, 18 nt, Human
cagugaaagaaaauaaca

SEQ ID NO: 2204736 - RNA, 16 nt, Human
cagaagcaacccaaau

SEQ ID NO: 2204737 - RNA, 22 nt, Human
ugauaguuguaccgcaauguga

SEQ ID NO: 2204738 - RNA, 20 nt, Human
uuuaaauaaaguguuugaaa

SEQ ID NO: 2204739 - RNA, 15 nt, Human
ugguuuagaaagcuu

SEQ ID NO: 2204740 - RNA, 21 nt, Human
gaccaggcacccccagaauga

SEQ ID NO: 2204741 - RNA, 17 nt, Human
cggccgcgcugcgcgcc

SEQ ID NO: 2204742 - RNA, 16 nt, Human
ggagccuccagcugcc

SEQ ID NO: 2204743 - RNA, 13 nt, Human
cuaugaaauauua

SEQ ID NO: 2204744 - RNA, 12 nt, Human
acacuaaaacac

SEQ ID NO: 2204745 - RNA, 12 nt, Human
acuauaaaacua

SEQ ID NO: 2204746 - RNA, 13 nt, Human
ggcacccccagaa

SEQ ID NO: 2204747 - RNA, 23 nt, Human
uuuuauagcuacuaauuuuaaaa

SEQ ID NO: 2204748 - RNA, 19 nt, Human
uauacugugugcuaaaaca

SEQ ID NO: 2204749 - RNA, 20 nt, Human
cggagccuccagcugccccg

SEQ ID NO: 2204750 - RNA, 15 nt, Human
ggccuucggccucca

SEQ ID NO: 2204751 - RNA, 23 nt, Human
auuucugagcauuuaauauggau

SEQ ID NO: 2204752 - RNA, 16 nt, Human
agguugcagugagccg

SEQ ID NO: 2204753 - RNA, 17 nt, Human
uauuuguacauuuuuuu

SEQ ID NO: 2204754 - RNA, 15 nt, Human
caaauugagcuaggg

SEQ ID NO: 2204755 - RNA, 17 nt, Human
cgccuccgcuacuucca

SEQ ID NO: 2204756 - RNA, 21 nt, Human
ucuucaacucccugcccccca

SEQ ID NO: 2204757 - RNA, 20 nt, Human
ugauuauaugucacuuugcu

SEQ ID NO: 2204758 - RNA, 14 nt, Human
gacaugggccccag

SEQ ID NO: 2204759 - RNA, 17 nt, Human
ugcccugaaagucccag

SEQ ID NO: 2204760 - RNA, 16 nt, Human
cagggcucacagaauu

SEQ ID NO: 2204761 - RNA, 20 nt, Human
agcccucuucugacacuaaa

SEQ ID NO: 2204762 - RNA, 17 nt, Human
gacacaugggugcuauu

SEQ ID NO: 2204763 - RNA, 23 nt, Human
caauccaagaacuuauuuguaca

SEQ ID NO: 2204764 - RNA, 14 nt, Human
auuucuaugaaaua

SEQ ID NO: 2204765 - RNA, 22 nt, Human
uuaaaaaaaaaacguauugcau

SEQ ID NO: 2204766 - RNA, 21 nt, Human
cgcccacuuccucccggccgc

SEQ ID NO: 2204767 - RNA, 22 nt, Human
cggggagcgagccccaggcggg

SEQ ID NO: 2204768 - RNA, 13 nt, Human
acacacaugaagu

SEQ ID NO: 2204769 - RNA, 14 nt, Human
aaaacuucagacau

SEQ ID NO: 2204770 - RNA, 20 nt, Human
aauaauuuuuauauuugaaa

SEQ ID NO: 2204771 - RNA, 12 nt, Human
accaggcacccc

SEQ ID NO: 2204772 - RNA, 14 nt, Human
ccuuaucaaaggac

SEQ ID NO: 2204773 - RNA, 22 nt, Human
ugggcacuguggguagacacac

SEQ ID NO: 2204774 - RNA, 13 nt, Human
caccaaggagcca

SEQ ID NO: 2204775 - RNA, 19 nt, Human
gcugccccggggaggggcg

SEQ ID NO: 2204776 - RNA, 22 nt, Human
aggcuccacuuggucugugaga

SEQ ID NO: 2204777 - RNA, 17 nt, Human
cuggcugcugguggcgc

SEQ ID NO: 2204778 - RNA, 13 nt, Human
aacucccugcccc

SEQ ID NO: 2204779 - RNA, 15 nt, Human
gagccuccagcugcc

SEQ ID NO: 2204780 - RNA, 19 nt, Human
auuaaguuuuuuuuuaaaa

SEQ ID NO: 2204781 - RNA, 17 nt, Human
cugggaccaggcacccc

SEQ ID NO: 2204782 - RNA, 12 nt, Human
aagaaaauaacg

SEQ ID NO: 2204783 - RNA, 12 nt, Human
uaauuccacagc

SEQ ID NO: 2204784 - RNA, 16 nt, Human
agugucaaugcagccc

SEQ ID NO: 2204785 - RNA, 17 nt, Human
uuuuuaauuauauggcu

SEQ ID NO: 2204786 - RNA, 22 nt, Human
agucuuucacauuuaaauaaag

SEQ ID NO: 2204787 - RNA, 19 nt, Human
uaguuuaugauuccaccua

SEQ ID NO: 2204788 - RNA, 20 nt, Human
cacccccagaaugaccuggc

SEQ ID NO: 2204789 - RNA, 16 nt, Human
auaauccuaaacauau

SEQ ID NO: 2204790 - RNA, 17 nt, Human
gcaaauugucacaggac

SEQ ID NO: 2204791 - RNA, 16 nt, Human
ugcauagguuuaauaa

SEQ ID NO: 2204792 - RNA, 16 nt, Human
ucugcagauaaacagu

SEQ ID NO: 2204793 - RNA, 15 nt, Human
aaacauaugaauuau

SEQ ID NO: 2204794 - RNA, 17 nt, Human
aauaugcucuaaacaug

SEQ ID NO: 2204795 - RNA, 15 nt, Human
ugggacagggaggac

SEQ ID NO: 2204796 - RNA, 16 nt, Human
cugcugagucccaggc

SEQ ID NO: 2204797 - RNA, 21 nt, Human
agucucccucccuuggggccu

SEQ ID NO: 2204798 - RNA, 16 nt, Human
ccugagcgacagugag

SEQ ID NO: 2204799 - RNA, 12 nt, Human
aaggaugccccg

SEQ ID NO: 2204800 - RNA, 17 nt, Human
gcaugguuuagaaagcu

SEQ ID NO: 2204801 - RNA, 15 nt, Human
ugucaauaaaaucca

SEQ ID NO: 2204802 - RNA, 14 nt, Human
cugcaaagcccagc

SEQ ID NO: 2204803 - RNA, 17 nt, Human
aagacagugaaagaaaa

SEQ ID NO: 2204804 - RNA, 18 nt, Human
gaggcuccacuuggucug

SEQ ID NO: 2204805 - RNA, 22 nt, Human
uucaauaucuuuuuuuuaauaa

SEQ ID NO: 2204806 - RNA, 18 nt, Human
caagccucauguccacug

SEQ ID NO: 2204807 - RNA, 22 nt, Human
caaauuuacagagacagaaagc

SEQ ID NO: 2204808 - RNA, 19 nt, Human
gugacuuaaugccacuaaa

SEQ ID NO: 2204809 - RNA, 15 nt, Human
aagugaaaaucuaca

SEQ ID NO: 2204810 - RNA, 23 nt, Human
acgaggauugggaaaaaguaauu

SEQ ID NO: 2204811 - RNA, 19 nt, Human
gucaaucagccuaguugau

SEQ ID NO: 2204812 - RNA, 14 nt, Human
gcuccgcgcagcuc

SEQ ID NO: 2204813 - RNA, 15 nt, Human
caggauggcaggagg

SEQ ID NO: 2204814 - RNA, 15 nt, Human
uugcucauggaauug

SEQ ID NO: 2204815 - RNA, 18 nt, Human
ccgggccgacggagccgg

SEQ ID NO: 2204816 - RNA, 19 nt, Human
acagugauuaccagggacu

SEQ ID NO: 2204817 - RNA, 16 nt, Human
aaaugggaaacaaaag

SEQ ID NO: 2204818 - RNA, 17 nt, Human
cauuuguauaaaauaau

SEQ ID NO: 2204819 - RNA, 18 nt, Human
agcugccuccccagcucu

SEQ ID NO: 2204820 - RNA, 24 nt, Human
cauaugaaaaggcuaagcuucacu

SEQ ID NO: 2204821 - RNA, 14 nt, Human
cacuuggacauggg

SEQ ID NO: 2204822 - RNA, 21 nt, Human
caaagcccagcuugaaaccuu

SEQ ID NO: 2204823 - RNA, 17 nt, Human
cugcacuccagccugag

SEQ ID NO: 2204824 - RNA, 18 nt, Human
uauaacaaugcuguauuu

SEQ ID NO: 2204825 - RNA, 21 nt, Human
gccaaauauaaauaaaaauaa

SEQ ID NO: 2204826 - RNA, 19 nt, Human
gagccugaucaccugcccu

SEQ ID NO: 2204827 - RNA, 13 nt, Human
cuuaucaaaggac

SEQ ID NO: 2204828 - RNA, 18 nt, Human
ccugcccugaaaguccca

SEQ ID NO: 2204829 - RNA, 22 nt, Human
gaaauaagccagacaucaacag

SEQ ID NO: 2204830 - RNA, 19 nt, Human
cuggccuucggccuccauc

SEQ ID NO: 2204831 - RNA, 18 nt, Human
uguauuauuuuuuaaaaa

SEQ ID NO: 2204832 - RNA, 11 nt, Human
uucacagggga

SEQ ID NO: 2204833 - RNA, 13 nt, Human
agaaguaaaaaca

SEQ ID NO: 2204834 - RNA, 20 nt, Human
aaggaugccccgucccccuc

SEQ ID NO: 2204835 - RNA, 16 nt, Human
uuucacauuuaaauaa

SEQ ID NO: 2204836 - RNA, 13 nt, Human
agacagcucugca

SEQ ID NO: 2204837 - RNA, 14 nt, Human
ccaaauauaaauaa

SEQ ID NO: 2204838 - RNA, 21 nt, Human
auucauagcagcuuauucaca

SEQ ID NO: 2204839 - RNA, 18 nt, Human
ccggggaggggcgcucgc

SEQ ID NO: 2204840 - RNA, 16 nt, Human
aaauauuauguuaaaa

SEQ ID NO: 2204841 - RNA, 18 nt, Human
cgcgagcgcgcgcgcccu

SEQ ID NO: 2204842 - RNA, 17 nt, Human
uuaauaauuuuuaauua

SEQ ID NO: 2204843 - RNA, 17 nt, Human
aggcuagaaccaccugc

SEQ ID NO: 2204844 - RNA, 15 nt, Human
uugacccacaagaaa

SEQ ID NO: 2204845 - RNA, 16 nt, Human
ucaaaagaaagaaaau

SEQ ID NO: 2204846 - RNA, 17 nt, Human
agccgggaaagaagagc

SEQ ID NO: 2204847 - RNA, 14 nt, Human
cucaggcuggcacc

SEQ ID NO: 2204848 - RNA, 23 nt, Human
uaggauggcuaguaucaaaagaa

SEQ ID NO: 2204849 - RNA, 14 nt, Human
ugcuggagcucugc

SEQ ID NO: 2204850 - RNA, 16 nt, Human
acuaaacaaagaguga

SEQ ID NO: 2204851 - RNA, 16 nt, Human
gacauuugcucaugga

SEQ ID NO: 2204852 - RNA, 14 nt, Human
ucccacccgcccac

SEQ ID NO: 2204853 - RNA, 12 nt, Human
agugcagccccg

SEQ ID NO: 2204854 - RNA, 14 nt, Human
cggagccuccagcu

SEQ ID NO: 2204855 - RNA, 18 nt, Human
guuaguauuguccagguc

SEQ ID NO: 2204856 - RNA, 19 nt, Human
gccauagucauucugccug

SEQ ID NO: 2204857 - RNA, 20 nt, Human
cuucaacucccugcccccca

SEQ ID NO: 2204858 - RNA, 19 nt, Human
auuuucaguuauuauauuu

SEQ ID NO: 2204859 - RNA, 15 nt, Human
gcgcgccuccgcuac

SEQ ID NO: 2204860 - RNA, 14 nt, Human
uugggaaaaaguaa

SEQ ID NO: 2204861 - RNA, 22 nt, Human
agcucuaucccaaccucuccca

SEQ ID NO: 2204862 - RNA, 21 nt, Human
cacuaaaacaccucagcugcc

SEQ ID NO: 2204863 - RNA, 15 nt, Human
ucugucucaguccau

SEQ ID NO: 2204864 - RNA, 23 nt, Human
ggccugagaccaaggcccccggg

SEQ ID NO: 2204865 - RNA, 15 nt, Human
cauguccacugguuc

SEQ ID NO: 2204866 - RNA, 22 nt, Human
acagauuugagcucagcccugg

SEQ ID NO: 2204867 - RNA, 20 nt, Human
uaacgauaaaagacagugaa

SEQ ID NO: 2204868 - RNA, 17 nt, Human
uucucuaggaaauauuu

SEQ ID NO: 2204869 - RNA, 16 nt, Human
uggggaugaacuuuuu

SEQ ID NO: 2204870 - RNA, 18 nt, Human
acucuuaagaagacugca

SEQ ID NO: 2204871 - RNA, 13 nt, Human
aucauuaaaguuc

SEQ ID NO: 2204872 - RNA, 21 nt, Human
agggugauauuaaccaggggc

SEQ ID NO: 2204873 - RNA, 16 nt, Human
cagucucccucccuug

SEQ ID NO: 2204874 - RNA, 17 nt, Human
guuuaauaauuuuuaau

SEQ ID NO: 2204875 - RNA, 12 nt, Human
gauaaaagacag

SEQ ID NO: 2204876 - RNA, 18 nt, Human
caaggcugauuaaaccaa

SEQ ID NO: 2204877 - RNA, 15 nt, Human
ucauaauaaguugca

SEQ ID NO: 2204878 - RNA, 15 nt, Human
aauucugaaagcaac

SEQ ID NO: 2204879 - RNA, 14 nt, Human
cucccugcccccca

SEQ ID NO: 2204880 - RNA, 15 nt, Human
caguuauuuuuaaac

SEQ ID NO: 2204881 - RNA, 19 nt, Human
guacugagagugaacaaau

SEQ ID NO: 2204882 - RNA, 20 nt, Human
cagcugccccggggaggggc

SEQ ID NO: 2204883 - RNA, 22 nt, Human
gugucuggcguuguggggauga

SEQ ID NO: 2204884 - RNA, 20 nt, Human
cugagcggaccuucccagcu

SEQ ID NO: 2204885 - RNA, 14 nt, Human
auucugccugcccu

SEQ ID NO: 2204886 - RNA, 16 nt, Human
caggaaguagaggagg

SEQ ID NO: 2204887 - RNA, 22 nt, Human
agcacagccucuuagaugcagu

SEQ ID NO: 2204888 - RNA, 15 nt, Human
auccuagucucuauc

SEQ ID NO: 2204889 - RNA, 16 nt, Human
auugucuagugaaacu

SEQ ID NO: 2204890 - RNA, 16 nt, Human
ccauuuuuagugaaau

SEQ ID NO: 2204891 - RNA, 18 nt, Human
cuucucacauuuauauuu

SEQ ID NO: 2204892 - RNA, 13 nt, Human
caagccugccuca

SEQ ID NO: 2204893 - RNA, 23 nt, Human
gggagccugaucaccugcccugc

SEQ ID NO: 2204894 - RNA, 17 nt, Human
acacuaagagagaauga

SEQ ID NO: 2204895 - RNA, 12 nt, Human
cgcgccuccgcu

SEQ ID NO: 2204896 - RNA, 17 nt, Human
auccugugggaccuggg

SEQ ID NO: 2204897 - RNA, 14 nt, Human
ggaccaucccggcc

SEQ ID NO: 2204898 - RNA, 22 nt, Human
aaagacagugaaagaaaauaac

SEQ ID NO: 2204899 - RNA, 16 nt, Human
ccucagucucccuccc

SEQ ID NO: 2204900 - RNA, 21 nt, Human
uccuucagccugaaagaggaa

SEQ ID NO: 2204901 - RNA, 22 nt, Human
cugcucaauaaaguacaagagc

SEQ ID NO: 2204902 - RNA, 18 nt, Human
acuggacucaccuccccc

SEQ ID NO: 2204903 - RNA, 21 nt, Human
aucuuguaaagguccuggcaa

SEQ ID NO: 2204904 - RNA, 21 nt, Human
gacagaaagcagaacagugau

SEQ ID NO: 2204905 - RNA, 17 nt, Human
agcuacuaauuuuaaaa

SEQ ID NO: 2204906 - RNA, 21 nt, Human
agccucuuagaugcaguucug

SEQ ID NO: 2204907 - RNA, 16 nt, Human
agggagggaaggggga

SEQ ID NO: 2204908 - RNA, 18 nt, Human
guuucaaacauauauaac

SEQ ID NO: 2204909 - RNA, 19 nt, Human
uggaacaguuaccucugcc

SEQ ID NO: 2204910 - RNA, 20 nt, Human
uauaugcuaagucuuauaua

SEQ ID NO: 2204911 - RNA, 14 nt, Human
cucuggcuccagcu

SEQ ID NO: 2204912 - RNA, 18 nt, Human
aaguugauaugccuuuuc

SEQ ID NO: 2204913 - RNA, 22 nt, Human
auauauaacaaugcuguauuuu

SEQ ID NO: 2204914 - RNA, 23 nt, Human
ccuuuguugcuaucaauccaaga

SEQ ID NO: 2204915 - RNA, 17 nt, Human
uaugcuaagugaaauaa

SEQ ID NO: 2204916 - RNA, 14 nt, Human
uaaaagacaaggaa

SEQ ID NO: 2204917 - RNA, 22 nt, Human
gaauuaaguuuuuuuuuaaaaa

SEQ ID NO: 2204918 - RNA, 22 nt, Human
gugccucaccccuugccauaau

SEQ ID NO: 2204919 - RNA, 17 nt, Human
agaacucccuuucaaca

SEQ ID NO: 2204920 - RNA, 22 nt, Human
uggacgagaaaacaauaacgau

SEQ ID NO: 2204921 - RNA, 21 nt, Human
cuucucaccugugagaccaaa

SEQ ID NO: 2204922 - RNA, 20 nt, Human
auucccagccagcacagccu

SEQ ID NO: 2204923 - RNA, 16 nt, Human
uuucuauaauuuaaau

SEQ ID NO: 2204924 - RNA, 13 nt, Human
uggacgagaaaac

SEQ ID NO: 2204925 - RNA, 15 nt, Human
aaaagacaaggaaaa

SEQ ID NO: 2204926 - RNA, 14 nt, Human
aaagagaacuucca

SEQ ID NO: 2204927 - RNA, 14 nt, Human
aaaggaauuuaaaa

SEQ ID NO: 2204928 - RNA, 11 nt, Human
cgauaaaagac

SEQ ID NO: 2204929 - RNA, 14 nt, Human
uacccccugggagc

SEQ ID NO: 2204930 - RNA, 20 nt, Human
augcaguuguugcccacagc

SEQ ID NO: 2204931 - RNA, 19 nt, Human
ugcucgcccacuuccuccc

SEQ ID NO: 2204932 - RNA, 16 nt, Human
agcggaccuucccagc

SEQ ID NO: 2204933 - RNA, 13 nt, Human
acuguaaaauaau

SEQ ID NO: 2204934 - RNA, 11 nt, Human
agccagguacc

SEQ ID NO: 2204935 - RNA, 13 nt, Human
ccugccccccagc

SEQ ID NO: 2204936 - RNA, 13 nt, Human
uauuuauuuuaau

SEQ ID NO: 2204937 - RNA, 15 nt, Human
uaggaaauauuuauu

SEQ ID NO: 2204938 - RNA, 14 nt, Human
uucccgcuguuccu

SEQ ID NO: 2204939 - RNA, 17 nt, Human
auaaaguacaagagcuu

SEQ ID NO: 2204940 - RNA, 16 nt, Human
ggcagagagguaggga

SEQ ID NO: 2204941 - RNA, 15 nt, Human
uaucaauuuaaaaaa

SEQ ID NO: 2204942 - RNA, 18 nt, Human
cagcugcucaauaaagua

SEQ ID NO: 2204943 - RNA, 14 nt, Human
agagguccacaaca

SEQ ID NO: 2204944 - RNA, 14 nt, Human
aagaagugaaaauc

SEQ ID NO: 2204945 - RNA, 19 nt, Human
gugaacuugguuuuaauua

SEQ ID NO: 2204946 - RNA, 12 nt, Human
gucccaggcuga

SEQ ID NO: 2204947 - RNA, 21 nt, Human
cauuuucuucucacauuuaua

SEQ ID NO: 2204948 - RNA, 22 nt, Human
cacuuggacaugggccccagau

SEQ ID NO: 2204949 - RNA, 17 nt, Human
auauuugaaauauugac

SEQ ID NO: 2204950 - RNA, 15 nt, Human
cugggaccaggcacc

SEQ ID NO: 2204951 - RNA, 16 nt, Human
caggcugagccucagu

SEQ ID NO: 2204952 - RNA, 21 nt, Human
guuguaauuuuuuugugggaa

SEQ ID NO: 2204953 - RNA, 17 nt, Human
cuggcugcgcucggccu

SEQ ID NO: 2204954 - RNA, 23 nt, Human
caacggggugaaacccugucucu

SEQ ID NO: 2204955 - RNA, 21 nt, Human
cuccacuuggacaugggcccc

SEQ ID NO: 2204956 - RNA, 23 nt, Human
aagagccuuuuuuugaaaaaaag

SEQ ID NO: 2204957 - RNA, 14 nt, Human
auuuauguuuaauu

SEQ ID NO: 2204958 - RNA, 21 nt, Human
acuuuuccaaugacauuuugu

SEQ ID NO: 2204959 - RNA, 14 nt, Human
cacuuauaggaauu

SEQ ID NO: 2204960 - RNA, 20 nt, Human
uuacaaauccaaugaaauga

SEQ ID NO: 2204961 - RNA, 19 nt, Human
cagaaagcagaacagugau

SEQ ID NO: 2204962 - RNA, 19 nt, Human
ccccugagcuugcagagau

SEQ ID NO: 2204963 - RNA, 21 nt, Human
uuuguauaaaauaauuuuuau

SEQ ID NO: 2204964 - RNA, 14 nt, Human
uugcuggagcucug

SEQ ID NO: 2204965 - RNA, 13 nt, Human
cccuccuuaucaa

SEQ ID NO: 2204966 - RNA, 17 nt, Human
uucacuguaaaauaaua

SEQ ID NO: 2204967 - RNA, 15 nt, Human
auauaaauaaaaaua

SEQ ID NO: 2204968 - RNA, 18 nt, Human
cauagguuuaauaauuuu

SEQ ID NO: 2204969 - RNA, 15 nt, Human
acagugaaagaaaau

SEQ ID NO: 2204970 - RNA, 18 nt, Human
cagauuugagcucagccc

SEQ ID NO: 2204971 - RNA, 17 nt, Human
agccagguaccuucuca

SEQ ID NO: 2204972 - RNA, 16 nt, Human
cagccagcccucuucu

SEQ ID NO: 2204973 - RNA, 13 nt, Human
ccagaucaagccu

SEQ ID NO: 2204974 - RNA, 19 nt, Human
acucugucucaguccauga

SEQ ID NO: 2204975 - RNA, 20 nt, Human
acuucuuaggguuaugauua

SEQ ID NO: 2204976 - RNA, 19 nt, Human
aaaauaacgauaaaagaca

SEQ ID NO: 2204977 - RNA, 17 nt, Human
agugagacagcucugca

SEQ ID NO: 2204978 - RNA, 23 nt, Human
aaagaugaucaguaugaaaaugu

SEQ ID NO: 2204979 - RNA, 23 nt, Human
aucacagcuacuugggaggcuga

SEQ ID NO: 2204980 - RNA, 16 nt, Human
uuauaauuuaaaauau

SEQ ID NO: 2204981 - RNA, 20 nt, Human
cucgcuuccgcauccuaguc

SEQ ID NO: 2204982 - RNA, 15 nt, Human
ccacaagaaaugaaa

SEQ ID NO: 2204983 - RNA, 16 nt, Human
aacaauaaaagacaag

SEQ ID NO: 2204984 - RNA, 21 nt, Human
gaaagcagggacuugaaccca

SEQ ID NO: 2204985 - RNA, 20 nt, Human
ggagccugaucaccugcccu

SEQ ID NO: 2204986 - RNA, 19 nt, Human
uuggcaagcucuaucacca

SEQ ID NO: 2204987 - RNA, 21 nt, Human
uauaaaauaauuuuuauauuu

SEQ ID NO: 2204988 - RNA, 19 nt, Human
uguuggacgagaaaacaau

SEQ ID NO: 2204989 - RNA, 22 nt, Human
aaagagugaaggauuuauguuu

SEQ ID NO: 2204990 - RNA, 19 nt, Human
ugcagcgaguacuucccgc

SEQ ID NO: 2204991 - RNA, 17 nt, Human
uaucaguuauuuuuaaa

SEQ ID NO: 2204992 - RNA, 14 nt, Human
aacaccucagcugc

SEQ ID NO: 2204993 - RNA, 20 nt, Human
aauucuugccaaauauaaau

SEQ ID NO: 2204994 - RNA, 19 nt, Human
cucauggaauuggagcucg

SEQ ID NO: 2204995 - RNA, 23 nt, Human
cugaaaucauacuucuuaggguu

SEQ ID NO: 2204996 - RNA, 14 nt, Human
ccucuucugacacu

SEQ ID NO: 2204997 - RNA, 12 nt, Human
gcgagcgcgcgc

SEQ ID NO: 2204998 - RNA, 16 nt, Human
cuuccucccuggaauc

SEQ ID NO: 2204999 - RNA, 19 nt, Human
ccugagcggaccuucccag

SEQ ID NO: 2205000 - RNA, 15 nt, Human
ccaucccggccggcg

SEQ ID NO: 2205001 - RNA, 20 nt, Human
ccaaauguucaucaaugaau

SEQ ID NO: 2205002 - RNA, 15 nt, Human
gagcgcgcgcgcccu

SEQ ID NO: 2205003 - RNA, 13 nt, Human
aguguuugaaagc

SEQ ID NO: 2205004 - RNA, 18 nt, Human
uaauuuuaacucuauaau

SEQ ID NO: 2205005 - RNA, 16 nt, Human
cccacuggacucaccu

SEQ ID NO: 2205006 - RNA, 12 nt, Human
aaacuccacauc

SEQ ID NO: 2205007 - RNA, 22 nt, Human
cugagcggaccuucccagcuag

SEQ ID NO: 2205008 - RNA, 14 nt, Human
aagcaucacaugaa

SEQ ID NO: 2205009 - RNA, 15 nt, Human
acucaccucccccau

SEQ ID NO: 2205010 - RNA, 24 nt, Human
uuugugggaaauccacacugagcu

SEQ ID NO: 2205011 - RNA, 19 nt, Human
ccgggcgugguggugagug

SEQ ID NO: 2205012 - RNA, 20 nt, Human
cuaggggggucagccagccc

SEQ ID NO: 2205013 - RNA, 17 nt, Human
aauucuugccaaauaua

SEQ ID NO: 2205014 - RNA, 13 nt, Human
aagcauuccaacu

SEQ ID NO: 2205015 - RNA, 19 nt, Human
cucggccugcucgcccacu

SEQ ID NO: 2205016 - RNA, 22 nt, Human
gggccugagaccaaggcccccg

SEQ ID NO: 2205017 - RNA, 17 nt, Human
ugaacuugguuuuaauu

SEQ ID NO: 2205018 - RNA, 16 nt, Human
cacuaguauuucuaug

SEQ ID NO: 2205019 - RNA, 19 nt, Human
caauucuugccaaauauaa

SEQ ID NO: 2205020 - RNA, 22 nt, Human
agacucugucucaguccaugaa

SEQ ID NO: 2205021 - RNA, 23 nt, Human
caugcugucuacacuaagagaga

SEQ ID NO: 2205022 - RNA, 13 nt, Human
aguuguaauuuuu

SEQ ID NO: 2205023 - RNA, 14 nt, Human
ugguauguuuucag

SEQ ID NO: 2205024 - RNA, 15 nt, Human
cuggguuccuuccuc

SEQ ID NO: 2205025 - RNA, 14 nt, Human
cagaaugaccuggc

SEQ ID NO: 2205026 - RNA, 11 nt, Human
uuauuuuuaaa

SEQ ID NO: 2205027 - RNA, 19 nt, Human
caugaguaacugauuugua

SEQ ID NO: 2205028 - RNA, 20 nt, Human
augcuucuguuuuauaauuu

SEQ ID NO: 2205029 - RNA, 19 nt, Human
aaguugcauagguuuaaua

SEQ ID NO: 2205030 - RNA, 18 nt, Human
agccugaucaccugcccu

SEQ ID NO: 2205031 - RNA, 18 nt, Human
cauggaauuggagcucgu

SEQ ID NO: 2205032 - RNA, 20 nt, Human
gauugugccccugcacucca

SEQ ID NO: 2205033 - RNA, 13 nt, Human
agggggaacauga

SEQ ID NO: 2205034 - RNA, 22 nt, Human
uuugaaacgaggauugggaaaa

SEQ ID NO: 2205035 - RNA, 20 nt, Human
ucaagucuuucacauuuaaa

SEQ ID NO: 2205036 - RNA, 13 nt, Human
aaaugggaaacaa

SEQ ID NO: 2205037 - RNA, 15 nt, Human
cucgcccacuuccuc

SEQ ID NO: 2205038 - RNA, 15 nt, Human
auuauagucacuagu

SEQ ID NO: 2205039 - RNA, 14 nt, Human
ccacccgcccaccg

SEQ ID NO: 2205040 - RNA, 18 nt, Human
ugccauaauuacuauguc

SEQ ID NO: 2205041 - RNA, 14 nt, Human
cuaagcauuccaac

SEQ ID NO: 2205042 - RNA, 13 nt, Human
ugagcgacaguga

SEQ ID NO: 2205043 - RNA, 16 nt, Human
gcugcgcgccgcgcuc

SEQ ID NO: 2205044 - RNA, 19 nt, Human
aguauuucuaugaaauauu

SEQ ID NO: 2205045 - RNA, 14 nt, Human
ucuaggaaauauuu

SEQ ID NO: 2205046 - RNA, 21 nt, Human
aaauaauuuuuauauuugaaa

SEQ ID NO: 2205047 - RNA, 14 nt, Human
cacaacacacagau

SEQ ID NO: 2205048 - RNA, 14 nt, Human
ggaaagaagagccg

SEQ ID NO: 2205049 - RNA, 21 nt, Human
acaggauggcaggaggcaucc

SEQ ID NO: 2205050 - RNA, 18 nt, Human
ccuucggccuccauccug

SEQ ID NO: 2205051 - RNA, 12 nt, Human
acagagacagaa

SEQ ID NO: 2205052 - RNA, 15 nt, Human
cccugcaaagcccag

SEQ ID NO: 2205053 - RNA, 17 nt, Human
cccaggcugagccucag

SEQ ID NO: 2205054 - RNA, 23 nt, Human
ugucaauucuugccaaauauaaa

SEQ ID NO: 2205055 - RNA, 20 nt, Human
guauuauuuuuuaaaaaaau

SEQ ID NO: 2205056 - RNA, 17 nt, Human
agaaucacuugaacccg

SEQ ID NO: 2205057 - RNA, 15 nt, Human
ccggggaggggcgcu

SEQ ID NO: 2205058 - RNA, 19 nt, Human
cccauggcacucuauguuc

SEQ ID NO: 2205059 - RNA, 16 nt, Human
ccuagucucuaucauu

SEQ ID NO: 2205060 - RNA, 17 nt, Human
cuaguuguaauuuuuuu

SEQ ID NO: 2205061 - RNA, 15 nt, Human
cuacuaauuuuaaaa

SEQ ID NO: 2205062 - RNA, 14 nt, Human
gagccgggaaagaa

SEQ ID NO: 2205063 - RNA, 13 nt, Human
uuuaaaaauccua

SEQ ID NO: 2205064 - RNA, 16 nt, Human
caauguucccccucuc

SEQ ID NO: 2205065 - RNA, 13 nt, Human
cugggucgccggc

SEQ ID NO: 2205066 - RNA, 21 nt, Human
uuacaaugcauucugagguaa

SEQ ID NO: 2205067 - RNA, 12 nt, Human
ucaauaaaacuu

SEQ ID NO: 2205068 - RNA, 23 nt, Human
uuuauaugcuucuguuuuauaau

SEQ ID NO: 2205069 - RNA, 18 nt, Human
auuaaguuuuuuuuuaaa

SEQ ID NO: 2205070 - RNA, 22 nt, Human
ucaacuccaaacugacucuuaa

SEQ ID NO: 2205071 - RNA, 12 nt, Human
ucugcacacagc

SEQ ID NO: 2205072 - RNA, 23 nt, Human
uggcuugaguuuaaauuguaaua

SEQ ID NO: 2205073 - RNA, 21 nt, Human
cuggcugcgcucggccugcuc

SEQ ID NO: 2205074 - RNA, 15 nt, Human
uaacaauaaaagaca

SEQ ID NO: 2205075 - RNA, 14 nt, Human
caggaggggcuucu

SEQ ID NO: 2205076 - RNA, 21 nt, Human
aguuguugcccacagcuguau

SEQ ID NO: 2205077 - RNA, 16 nt, Human
caugguuuagaaagcu

SEQ ID NO: 2205078 - RNA, 15 nt, Human
acaggguuuauguuu

SEQ ID NO: 2205079 - RNA, 16 nt, Human
uaaaagacaaggaaaa

SEQ ID NO: 2205080 - RNA, 14 nt, Human
ccccugagcuugca

SEQ ID NO: 2205081 - RNA, 22 nt, Human
aaauguugacaugggacauuug

SEQ ID NO: 2205082 - RNA, 20 nt, Human
uguaaagcuuugugcagauu

SEQ ID NO: 2205083 - RNA, 22 nt, Human
ggguggaaaaacagaccggggu

SEQ ID NO: 2205084 - RNA, 15 nt, Human
cuccacauccugugg

SEQ ID NO: 2205085 - RNA, 15 nt, Human
ccaugaugcugagcc

SEQ ID NO: 2205086 - RNA, 20 nt, Human
ucgugucuggcguugugggg

SEQ ID NO: 2205087 - RNA, 20 nt, Human
uccagccugagcgacaguga

SEQ ID NO: 2205088 - RNA, 14 nt, Human
cucccuuggggccu

SEQ ID NO: 2205089 - RNA, 19 nt, Human
uuauggcacuaguauuucu

SEQ ID NO: 2205090 - RNA, 17 nt, Human
agcugccccggggaggg

SEQ ID NO: 2205091 - RNA, 18 nt, Human
uaaaauccauacauuugu

SEQ ID NO: 2205092 - RNA, 23 nt, Human
uaauuuguaguguuggagaagaa

SEQ ID NO: 2205093 - RNA, 16 nt, Human
cugaucaccugcccug

SEQ ID NO: 2205094 - RNA, 15 nt, Human
aaucucaauauuuca

SEQ ID NO: 2205095 - RNA, 16 nt, Human
acauccuacaagacac

SEQ ID NO: 2205096 - RNA, 15 nt, Human
cucccugccccccag

SEQ ID NO: 2205097 - RNA, 14 nt, Human
ucaagccugccuca

SEQ ID NO: 2205098 - RNA, 13 nt, Human
cgggaggcagagg

SEQ ID NO: 2205099 - RNA, 16 nt, Human
cuucuggguuccuucc

SEQ ID NO: 2205100 - RNA, 15 nt, Human
aaaaacguauugcau

SEQ ID NO: 2205101 - RNA, 21 nt, Human
caagacugcacaucaaaauau

SEQ ID NO: 2205102 - RNA, 17 nt, Human
cccacuggacucaccuc

SEQ ID NO: 2205103 - RNA, 20 nt, Human
uauacugugugcuaaaacaa

SEQ ID NO: 2205104 - RNA, 20 nt, Human
ugccccccagcccuccuuau

SEQ ID NO: 2205105 - RNA, 14 nt, Human
cgcucgcuuccgca

SEQ ID NO: 2205106 - RNA, 18 nt, Human
uuuugugggaaauccaca

SEQ ID NO: 2205107 - RNA, 20 nt, Human
acuaaaacaccucagcugcc

SEQ ID NO: 2205108 - RNA, 16 nt, Human
ggggagcgagccccag

SEQ ID NO: 2205109 - RNA, 21 nt, Human
ccaggaggggcuucugggcag

SEQ ID NO: 2205110 - RNA, 15 nt, Human
ugauuucauucaaua

SEQ ID NO: 2205111 - RNA, 23 nt, Human
uauguuaaaacugggacagggga

SEQ ID NO: 2205112 - RNA, 22 nt, Human
cgcgcuccgcgcagcucaggcu

SEQ ID NO: 2205113 - RNA, 16 nt, Human
cagaucaagccugccu

SEQ ID NO: 2205114 - RNA, 13 nt, Human
acaagagcuuaac

SEQ ID NO: 2205115 - RNA, 13 nt, Human
aaaguguuugaaa

SEQ ID NO: 2205116 - RNA, 18 nt, Human
cugcagccccugggacca

SEQ ID NO: 2205117 - RNA, 21 nt, Human
ugccuguaaucacagcuacuu

SEQ ID NO: 2205118 - RNA, 14 nt, Human
acccgcccaccgca

SEQ ID NO: 2205119 - RNA, 16 nt, Human
ugaauuaguuuuauau

SEQ ID NO: 2205120 - RNA, 13 nt, Human
gcgcucggccugc

SEQ ID NO: 2205121 - RNA, 16 nt, Human
ccacuuauaggaauug

SEQ ID NO: 2205122 - RNA, 14 nt, Human
aguuuuuuuuuaaa

SEQ ID NO: 2205123 - RNA, 16 nt, Human
acuaggugcugcagcc

SEQ ID NO: 2205124 - RNA, 15 nt, Human
ugagaaggagcuccc

SEQ ID NO: 2205125 - RNA, 13 nt, Human
aggggcgcucgcu

SEQ ID NO: 2205126 - RNA, 13 nt, Human
cggccgcgcugcg

SEQ ID NO: 2205127 - RNA, 18 nt, Human
ggaggacgcucucuggcc

SEQ ID NO: 2205128 - RNA, 23 nt, Human
agcuaggggggucagccagcccu

SEQ ID NO: 2205129 - RNA, 19 nt, Human
cugcaaagcccagcuugaa

SEQ ID NO: 2205130 - RNA, 22 nt, Human
accuaacgaaguauccuucagc

SEQ ID NO: 2205131 - RNA, 23 nt, Human
augucaauucuugccaaauauaa

SEQ ID NO: 2205132 - RNA, 23 nt, Human
aggcuuuaaaacuuauccuccau

SEQ ID NO: 2205133 - RNA, 13 nt, Human
cugccuccccagc

SEQ ID NO: 2205134 - RNA, 21 nt, Human
gcccauccugccccugagccc

SEQ ID NO: 2205135 - RNA, 14 nt, Human
agaaaauaacaaua

SEQ ID NO: 2205136 - RNA, 12 nt, Human
cgcucggccugc

SEQ ID NO: 2205137 - RNA, 18 nt, Human
uuauuauauauauauauu

SEQ ID NO: 2205138 - RNA, 23 nt, Human
cagaccgggguucccgugugccu

SEQ ID NO: 2205139 - RNA, 22 nt, Human
ccaaacauccuacaagacacag

SEQ ID NO: 2205140 - RNA, 14 nt, Human
cuuggucugugaga

SEQ ID NO: 2205141 - RNA, 11 nt, Human
caucuagugag

SEQ ID NO: 2205142 - RNA, 18 nt, Human
uuuauggcacuaguauuu

SEQ ID NO: 2205143 - RNA, 17 nt, Human
ccgcgcagcucaggcug

SEQ ID NO: 2205144 - RNA, 12 nt, Human
caagccugccuc

SEQ ID NO: 2205145 - RNA, 18 nt, Human
guauuauuuuuuaaaaaa

SEQ ID NO: 2205146 - RNA, 13 nt, Human
gcuggagcucugc

SEQ ID NO: 2205147 - RNA, 15 nt, Human
gccucuuagaugcag

SEQ ID NO: 2205148 - RNA, 18 nt, Human
uuuguuaaaugauuucau

SEQ ID NO: 2205149 - RNA, 12 nt, Human
acaagacacagu

SEQ ID NO: 2205150 - RNA, 11 nt, Human
gguuuuauuau

SEQ ID NO: 2205151 - RNA, 14 nt, Human
cugccccccagccc

SEQ ID NO: 2205152 - RNA, 14 nt, Human
auuguccaggucua

SEQ ID NO: 2205153 - RNA, 14 nt, Human
guaacugauuugua

SEQ ID NO: 2205154 - RNA, 21 nt, Human
aauuuguuuucccuucuuaca

SEQ ID NO: 2205155 - RNA, 16 nt, Human
aauugacccacaagaa

SEQ ID NO: 2205156 - RNA, 21 nt, Human
acaguuaccucugccucagaa

SEQ ID NO: 2205157 - RNA, 15 nt, Human
acuuuuccaaugaca

SEQ ID NO: 2205158 - RNA, 18 nt, Human
ccucuggcuccagcuggc

SEQ ID NO: 2205159 - RNA, 14 nt, Human
ucccuugaugaaga

SEQ ID NO: 2205160 - RNA, 12 nt, Human
gugggaccuggg

SEQ ID NO: 2205161 - RNA, 18 nt, Human
cuccauuuuuagugaaau

SEQ ID NO: 2205162 - RNA, 20 nt, Human
acuuuauuuucuauaauuua

SEQ ID NO: 2205163 - RNA, 13 nt, Human
uggcuccagcugg

SEQ ID NO: 2205164 - RNA, 21 nt, Human
gcaucgugucuggcguugugg

SEQ ID NO: 2205165 - RNA, 19 nt, Human
ccugccuaagugcagcccc

SEQ ID NO: 2205166 - RNA, 14 nt, Human
aguacuucccgcug

SEQ ID NO: 2205167 - RNA, 22 nt, Human
cugggacaggggagaaccuagg

SEQ ID NO: 2205168 - RNA, 13 nt, Human
auaaauaaaaaua

SEQ ID NO: 2205169 - RNA, 17 nt, Human
uuuaaaaaaaaaacgua

SEQ ID NO: 2205170 - RNA, 20 nt, Human
auuuauugaggcuuuaaaac

SEQ ID NO: 2205171 - RNA, 16 nt, Human
uguucuaagaagugaa

SEQ ID NO: 2205172 - RNA, 17 nt, Human
cuauccuacuuccccuu

SEQ ID NO: 2205173 - RNA, 14 nt, Human
gcgagcgcgcgcgc

SEQ ID NO: 2205174 - RNA, 18 nt, Human
ugaacuugguuuuaauua

SEQ ID NO: 2205175 - RNA, 18 nt, Human
uuacaaaugggaaacaaa

SEQ ID NO: 2205176 - RNA, 16 nt, Human
caugggacagggagga

SEQ ID NO: 2205177 - RNA, 13 nt, Human
uacuuuauuuucu

SEQ ID NO: 2205178 - RNA, 18 nt, Human
aggaaaaaauaacaauga

SEQ ID NO: 2205179 - RNA, 21 nt, Human
caacacacagauuugagcuca

SEQ ID NO: 2205180 - RNA, 14 nt, Human
cugaggcuccacuu

SEQ ID NO: 2205181 - RNA, 13 nt, Human
cuccagcugcccc

SEQ ID NO: 2205182 - RNA, 22 nt, Human
ccgcgcagcucaggcuggcacc

SEQ ID NO: 2205183 - RNA, 19 nt, Human
aaagacagugaaagaaaau

SEQ ID NO: 2205184 - RNA, 16 nt, Human
acuaguuucccuugca

SEQ ID NO: 2205185 - RNA, 13 nt, Human
aaaauaacgauaa

SEQ ID NO: 2205186 - RNA, 17 nt, Human
uuauauuugaaauauug

SEQ ID NO: 2205187 - RNA, 12 nt, Human
uauaauuuaaaa

SEQ ID NO: 2205188 - RNA, 16 nt, Human
aaaagcaucacaugaa

SEQ ID NO: 2205189 - RNA, 14 nt, Human
uuccgcauccuagu

SEQ ID NO: 2205190 - RNA, 23 nt, Human
caucucuucuggguuccuuccuc

SEQ ID NO: 2205191 - RNA, 21 nt, Human
ccggggaggggcgcucgcuuc

SEQ ID NO: 2205192 - RNA, 13 nt, Human
ucuacuaaaaaua

SEQ ID NO: 2205193 - RNA, 23 nt, Human
ugcagagguccacaacacacaga

SEQ ID NO: 2205194 - RNA, 22 nt, Human
gaggggagcaugggaagugacg

SEQ ID NO: 2205195 - RNA, 14 nt, Human
cauagaaguaaaaa

SEQ ID NO: 2205196 - RNA, 21 nt, Human
aaaaaguucugcagauaaaca

SEQ ID NO: 2205197 - RNA, 21 nt, Human
cacaugaacuuguaaaggaau

SEQ ID NO: 2205198 - RNA, 18 nt, Human
acaaaaggauaaugaaua

SEQ ID NO: 2205199 - RNA, 12 nt, Human
cucauggaauug

SEQ ID NO: 2205200 - RNA, 22 nt, Human
agcuuguauuccuuuuucucuc

SEQ ID NO: 2205201 - RNA, 19 nt, Human
cggccuccauccugaggcu

SEQ ID NO: 2205202 - RNA, 14 nt, Human
uaaaauccauacau

SEQ ID NO: 2205203 - RNA, 23 nt, Human
gaccccugagcuugcagagauga

SEQ ID NO: 2205204 - RNA, 21 nt, Human
ugaugcuacaggauuugaaau

SEQ ID NO: 2205205 - RNA, 15 nt, Human
ggccuccauccugag

SEQ ID NO: 2205206 - RNA, 18 nt, Human
ugcauagguuuaauaauu

SEQ ID NO: 2205207 - RNA, 21 nt, Human
acaugagguacugagagugaa

SEQ ID NO: 2205208 - RNA, 14 nt, Human
gaaagcagaacagu

SEQ ID NO: 2205209 - RNA, 19 nt, Human
auagcuacuaauuuuaaaa

SEQ ID NO: 2205210 - RNA, 16 nt, Human
ccugcaaagcccagcu

SEQ ID NO: 2205211 - RNA, 18 nt, Human
aggcggauugagaaggag

SEQ ID NO: 2205212 - RNA, 19 nt, Human
ugcacacagcacgggggcc

SEQ ID NO: 2205213 - RNA, 17 nt, Human
caggaggggcuucuggg

SEQ ID NO: 2205214 - RNA, 10 nt, Human
ccugagcccc

SEQ ID NO: 2205215 - RNA, 20 nt, Human
uaacaagccuccuuuuaaag

SEQ ID NO: 2205216 - RNA, 18 nt, Human
acagaaagcagaacagug

SEQ ID NO: 2205217 - RNA, 13 nt, Human
aggagcucccagg

SEQ ID NO: 2205218 - RNA, 11 nt, Human
auuuuugaagc

SEQ ID NO: 2205219 - RNA, 17 nt, Human
agacacacugaagaagc

SEQ ID NO: 2205220 - RNA, 18 nt, Human
gcuccgcgcagcucaggc

SEQ ID NO: 2205221 - RNA, 13 nt, Human
aaaugaaagcagg

SEQ ID NO: 2205222 - RNA, 17 nt, Human
agcucuaucccaaccuc

SEQ ID NO: 2205223 - RNA, 11 nt, Human
aauuuaaauau

SEQ ID NO: 2205224 - RNA, 22 nt, Human
ugugccugagcggaccuuccca

SEQ ID NO: 2205225 - RNA, 22 nt, Human
cgcuggcugcgcucggccugcu

SEQ ID NO: 2205226 - RNA, 16 nt, Human
uacauuuguauaaaau

SEQ ID NO: 2205227 - RNA, 20 nt, Human
acaugagguacugagaguga

SEQ ID NO: 2205228 - RNA, 13 nt, Human
gaagaacugaaau

SEQ ID NO: 2205229 - RNA, 13 nt, Human
uuggacgagaaaa

SEQ ID NO: 2205230 - RNA, 19 nt, Human
gcacuaguauuucuaugaa

SEQ ID NO: 2205231 - RNA, 16 nt, Human
acaggauggcaggagg

SEQ ID NO: 2205232 - RNA, 21 nt, Human
cgacagugagacucugucuca

SEQ ID NO: 2205233 - RNA, 17 nt, Human
acccacuggacucaccu

SEQ ID NO: 2205234 - RNA, 20 nt, Human
uuaacacaugauccugcaau

SEQ ID NO: 2205235 - RNA, 22 nt, Human
cuaccuguucgcgcgccuccgc

SEQ ID NO: 2205236 - RNA, 16 nt, Human
gucccagaucaagccu

SEQ ID NO: 2205237 - RNA, 22 nt, Human
agccugccucaaucaguauuca

SEQ ID NO: 2205238 - RNA, 20 nt, Human
cacuguggguagacacacau

SEQ ID NO: 2205239 - RNA, 13 nt, Human
cuccccagcucua

SEQ ID NO: 2205240 - RNA, 17 nt, Human
acuugaacccauauuug

SEQ ID NO: 2205241 - RNA, 21 nt, Human
ccagggcuacgcgcgcuccgc

SEQ ID NO: 2205242 - RNA, 18 nt, Human
cuccgcgcagcucaggcu

SEQ ID NO: 2205243 - RNA, 15 nt, Human
cgcgccgcgcuccuc

SEQ ID NO: 2205244 - RNA, 15 nt, Human
aaaaaagaaacauuu

SEQ ID NO: 2205245 - RNA, 14 nt, Human
ugcuagaacucccu

SEQ ID NO: 2205246 - RNA, 22 nt, Human
cugaggcuccacuuggucugug

SEQ ID NO: 2205247 - RNA, 22 nt, Human
acaugagguacugagagugaac

SEQ ID NO: 2205248 - RNA, 12 nt, Human
ugagagacacac

SEQ ID NO: 2205249 - RNA, 13 nt, Human
guggcgcuggcug

SEQ ID NO: 2205250 - RNA, 14 nt, Human
aaaagacagugaaa

SEQ ID NO: 2205251 - RNA, 17 nt, Human
gggaaauccacacugag

SEQ ID NO: 2205252 - RNA, 16 nt, Human
aagacugcacaucaaa

SEQ ID NO: 2205253 - RNA, 18 nt, Human
caaggcuagaaccaccug

SEQ ID NO: 2205254 - RNA, 23 nt, Human
gcgcuggcugcgcucggccugcu

SEQ ID NO: 2205255 - RNA, 19 nt, Human
uguaguguuggagaagaac

SEQ ID NO: 2205256 - RNA, 14 nt, Human
caaaugcauuucua

SEQ ID NO: 2205257 - RNA, 20 nt, Human
gcagagaugaggccgccaug

SEQ ID NO: 2205258 - RNA, 15 nt, Human
agagacagaaagcag

SEQ ID NO: 2205259 - RNA, 19 nt, Human
uggaaguaaauguuguuuu

SEQ ID NO: 2205260 - RNA, 20 nt, Human
uaggaauugacccacaagaa

SEQ ID NO: 2205261 - RNA, 20 nt, Human
auuacuguaagaaaauauca

SEQ ID NO: 2205262 - RNA, 12 nt, Human
cuugguuuuaau

SEQ ID NO: 2205263 - RNA, 22 nt, Human
augcugagcccggaaacuccac

SEQ ID NO: 2205264 - RNA, 13 nt, Human
auugucuagugaa

SEQ ID NO: 2205265 - RNA, 16 nt, Human
ucucuaggaaauauuu

SEQ ID NO: 2205266 - RNA, 13 nt, Human
auuuuuuaaaaaa

SEQ ID NO: 2205267 - RNA, 19 nt, Human
cugccccccagcccuccuu

SEQ ID NO: 2205268 - RNA, 14 nt, Human
auuauuuuuuaaaa

SEQ ID NO: 2205269 - RNA, 14 nt, Human
uauaauuuaaaaua

SEQ ID NO: 2205270 - RNA, 15 nt, Human
cccugccccccagcc

SEQ ID NO: 2205271 - RNA, 22 nt, Human
aaauaacaaugaaaguugauaa

SEQ ID NO: 2205272 - RNA, 14 nt, Human
ucugccugcccuga

SEQ ID NO: 2205273 - RNA, 21 nt, Human
gacagugaaagaaaauaacaa

SEQ ID NO: 2205274 - RNA, 12 nt, Human
ggcugaugcagu

SEQ ID NO: 2205275 - RNA, 13 nt, Human
ucucccucccuug

SEQ ID NO: 2205276 - RNA, 16 nt, Human
ugugcauauuuuauua

SEQ ID NO: 2205277 - RNA, 14 nt, Human
cgcugcgcgccgcg

SEQ ID NO: 2205278 - RNA, 13 nt, Human
uucuauaauuuaa

SEQ ID NO: 2205279 - RNA, 17 nt, Human
uaauuccacagcugcuc

SEQ ID NO: 2205280 - RNA, 21 nt, Human
ccaaagugugacucauuaaau

SEQ ID NO: 2205281 - RNA, 19 nt, Human
auaaaagacagugaaagaa

SEQ ID NO: 2205282 - RNA, 19 nt, Human
uacaaaaaaaaaaaaaaau

SEQ ID NO: 2205283 - RNA, 21 nt, Human
ugcucaauaaaguacaagagc

SEQ ID NO: 2205284 - RNA, 15 nt, Human
gccccugcacuccag

SEQ ID NO: 2205285 - RNA, 13 nt, Human
acggggugaaacc

SEQ ID NO: 2205286 - RNA, 19 nt, Human
uuugccaaguucuccacua

SEQ ID NO: 2205287 - RNA, 12 nt, Human
cggccggcgcgc

SEQ ID NO: 2205288 - RNA, 22 nt, Human
uacaugagguacugagagugaa

SEQ ID NO: 2205289 - RNA, 19 nt, Human
cgcucugggucgccggcau

SEQ ID NO: 2205290 - RNA, 17 nt, Human
caaauccaaugaaauga

SEQ ID NO: 2205291 - RNA, 13 nt, Human
ugauuauauguca

SEQ ID NO: 2205292 - RNA, 15 nt, Human
ucagucucccucccu

SEQ ID NO: 2205293 - RNA, 17 nt, Human
agaagagccggagccuc

SEQ ID NO: 2205294 - RNA, 14 nt, Human
acuggacucaccuc

SEQ ID NO: 2205295 - RNA, 18 nt, Human
cccaagccuggcaaggga

SEQ ID NO: 2205296 - RNA, 16 nt, Human
aagcuucacuguaaaa

SEQ ID NO: 2205297 - RNA, 18 nt, Human
cagccucuuagaugcagu

SEQ ID NO: 2205298 - RNA, 20 nt, Human
agaagagccggagccuccag

SEQ ID NO: 2205299 - RNA, 13 nt, Human
ucauucugccugc

SEQ ID NO: 2205300 - RNA, 21 nt, Human
ggguucccgugugccugagcg

SEQ ID NO: 2205301 - RNA, 16 nt, Human
ucuuggucucaguguc

SEQ ID NO: 2205302 - RNA, 12 nt, Human
gagcucccagga

SEQ ID NO: 2205303 - RNA, 17 nt, Human
augauuaaguaaugaua

SEQ ID NO: 2205304 - RNA, 19 nt, Human
ccccuauccuacuuccccu

SEQ ID NO: 2205305 - RNA, 22 nt, Human
gcgcggcgggagggcgcggggc

SEQ ID NO: 2205306 - RNA, 23 nt, Human
aagagccggagccuccagcugcc

SEQ ID NO: 2205307 - RNA, 18 nt, Human
gcuaucaauccaagaacu

SEQ ID NO: 2205308 - RNA, 17 nt, Human
agcgacagugagacucu

SEQ ID NO: 2205309 - RNA, 16 nt, Human
gaauggcuaagcaaaa

SEQ ID NO: 2205310 - RNA, 15 nt, Human
aaaauacaaaaaaaa

SEQ ID NO: 2205311 - RNA, 18 nt, Human
cuccauccugaggcucca

SEQ ID NO: 2205312 - RNA, 20 nt, Human
ccauacuaauuauacccccu

SEQ ID NO: 2205313 - RNA, 20 nt, Human
cggcccugugcggccugguc

SEQ ID NO: 2205314 - RNA, 14 nt, Human
auacaaaaaaaaaa

SEQ ID NO: 2205315 - RNA, 15 nt, Human
cauuccaagccucau

SEQ ID NO: 2205316 - RNA, 18 nt, Human
gccccugcacuccagccu

SEQ ID NO: 2205317 - RNA, 18 nt, Human
gaaaauaucacuugucaa

SEQ ID NO: 2205318 - RNA, 22 nt, Human
ugaagcaaaauuuuuucucuag

SEQ ID NO: 2205319 - RNA, 18 nt, Human
auuuguauaaaauaauuu

SEQ ID NO: 2205320 - RNA, 18 nt, Human
gcugcugccgugggccug

SEQ ID NO: 2205321 - RNA, 21 nt, Human
cccccauuguggucacaggaa

SEQ ID NO: 2205322 - RNA, 14 nt, Human
uucuaugaaauauu

SEQ ID NO: 2205323 - RNA, 13 nt, Human
cgcgagcgcgcgc

SEQ ID NO: 2205324 - RNA, 21 nt, Human
auuuuccugaaaacccuugcc

SEQ ID NO: 2205325 - RNA, 18 nt, Human
cucccuuggggccuaugc

SEQ ID NO: 2205326 - RNA, 18 nt, Human
ggaccaucccggccggcg

SEQ ID NO: 2205327 - RNA, 13 nt, Human
aggcuagauguau

SEQ ID NO: 2205328 - RNA, 20 nt, Human
gccuaauuuguuuucccuuc

SEQ ID NO: 2205329 - RNA, 11 nt, Human
auuuaaaaauc

SEQ ID NO: 2205330 - RNA, 13 nt, Human
aucuacacuccag

SEQ ID NO: 2205331 - RNA, 22 nt, Human
aauuuaaaaaaaaaccugagcc

SEQ ID NO: 2205332 - RNA, 16 nt, Human
uuuuagugaaauauua

SEQ ID NO: 2205333 - RNA, 21 nt, Human
cagcucaggcuggcaccgcug

SEQ ID NO: 2205334 - RNA, 21 nt, Human
gucucagugucaaugcagccc

SEQ ID NO: 2205335 - RNA, 12 nt, Human
ucuuaagaagac

SEQ ID NO: 2205336 - RNA, 15 nt, Human
cgggagccugaucac

SEQ ID NO: 2205337 - RNA, 17 nt, Human
guccaaagggcaugggu

SEQ ID NO: 2205338 - RNA, 20 nt, Human
cacagcacgggggccaagga

SEQ ID NO: 2205339 - RNA, 21 nt, Human
aucuuuuuuuuaauaaaccau

SEQ ID NO: 2205340 - RNA, 17 nt, Human
ccacugcagaagacagu

SEQ ID NO: 2205341 - RNA, 14 nt, Human
ggccgggagccuga

SEQ ID NO: 2205342 - RNA, 14 nt, Human
gacggagccgggaa

SEQ ID NO: 2205343 - RNA, 22 nt, Human
gaaaaucuuauaauuuaaaaua

SEQ ID NO: 2205344 - RNA, 18 nt, Human
acauuugcucauggaauu

SEQ ID NO: 2205345 - RNA, 17 nt, Human
caaggcccccgggccga

SEQ ID NO: 2205346 - RNA, 19 nt, Human
acagucaccucauggaauu

SEQ ID NO: 2205347 - RNA, 24 nt, Human
ucucuaucauuaaaguucuaguga

SEQ ID NO: 2205348 - RNA, 12 nt, Human
gucauuguucuu

SEQ ID NO: 2205349 - RNA, 21 nt, Human
uguauaaaauaauuuuuauau

SEQ ID NO: 2205350 - RNA, 18 nt, Human
caugaagauguagaggag

SEQ ID NO: 2205351 - RNA, 14 nt, Human
auuuauuuuaauaa

SEQ ID NO: 2205352 - RNA, 17 nt, Human
aauaacaauaaaagaca

SEQ ID NO: 2205353 - RNA, 16 nt, Human
aauuccacagcugcuc

SEQ ID NO: 2205354 - RNA, 21 nt, Human
uuguaauuuuuuugugggaaa

SEQ ID NO: 2205355 - RNA, 15 nt, Human
cggagccuccagcug

SEQ ID NO: 2205356 - RNA, 16 nt, Human
agcuugaaaccuucac

SEQ ID NO: 2205357 - RNA, 20 nt, Human
uugaacccgggaggcagagg

SEQ ID NO: 2205358 - RNA, 17 nt, Human
aggccaugggacaggga

SEQ ID NO: 2205359 - RNA, 20 nt, Human
aagaugguaccaccagucug

SEQ ID NO: 2205360 - RNA, 23 nt, Human
gauauuaaccaggggccaugaau

SEQ ID NO: 2205361 - RNA, 17 nt, Human
uaucuuuuuuuuaauaa

SEQ ID NO: 2205362 - RNA, 22 nt, Human
agaccaaauugagcuagggggg

SEQ ID NO: 2205363 - RNA, 14 nt, Human
acuuggucugugag

SEQ ID NO: 2205364 - RNA, 17 nt, Human
gauacuccauggggugg

SEQ ID NO: 2205365 - RNA, 19 nt, Human
gaggcagagguugcaguga

SEQ ID NO: 2205366 - RNA, 15 nt, Human
aucaauuuaaaaaaa

SEQ ID NO: 2205367 - RNA, 17 nt, Human
cacuuggacaugggccc

SEQ ID NO: 2205368 - RNA, 19 nt, Human
cagagaugaggccgccaug

SEQ ID NO: 2205369 - RNA, 17 nt, Human
aacaguuaccucugccu

SEQ ID NO: 2205370 - RNA, 13 nt, Human
ucagccagcccuc

SEQ ID NO: 2205371 - RNA, 21 nt, Human
ccuccagcugccccggggagg

SEQ ID NO: 2205372 - RNA, 14 nt, Human
cguguccccuaucc

SEQ ID NO: 2205373 - RNA, 16 nt, Human
aucaagccugccucaa

SEQ ID NO: 2205374 - RNA, 18 nt, Human
gcugagcccggaaacucc

SEQ ID NO: 2205375 - RNA, 19 nt, Human
caaggaugccccguccccc

SEQ ID NO: 2205376 - RNA, 10 nt, Human
ggggaggggc

SEQ ID NO: 2205377 - RNA, 22 nt, Human
accauuucuugagguaaaagca

SEQ ID NO: 2205378 - RNA, 23 nt, Human
augaauaucaguuauuuuuaaac

SEQ ID NO: 2205379 - RNA, 16 nt, Human
ucaguuuuugugaaaa

SEQ ID NO: 2205380 - RNA, 16 nt, Human
caauaacgauaaaaga

SEQ ID NO: 2205381 - RNA, 18 nt, Human
agagaaugagagacacac

SEQ ID NO: 2205382 - RNA, 17 nt, Human
ugaaauauuauuuuaua

SEQ ID NO: 2205383 - RNA, 22 nt, Human
cagcuagaauucacuccacuug

SEQ ID NO: 2205384 - RNA, 17 nt, Human
uguucuaagaagugaaa

SEQ ID NO: 2205385 - RNA, 18 nt, Human
cuucacuguaaaauaaua

SEQ ID NO: 2205386 - RNA, 16 nt, Human
cuagaaccaccugccu

SEQ ID NO: 2205387 - RNA, 20 nt, Human
agccuuggggcugaugcagu

SEQ ID NO: 2205388 - RNA, 23 nt, Human
auaauguguucauucuggaauaa

SEQ ID NO: 2205389 - RNA, 18 nt, Human
uacuuuauuuucuauaau

SEQ ID NO: 2205390 - RNA, 14 nt, Human
cagaccgggguucc

SEQ ID NO: 2205391 - RNA, 16 nt, Human
ugcuguauuuuaaaag

SEQ ID NO: 2205392 - RNA, 13 nt, Human
gagccggagccuc

SEQ ID NO: 2205393 - RNA, 16 nt, Human
uucuauaauuuaaaua

SEQ ID NO: 2205394 - RNA, 17 nt, Human
gccgggaaagaagagcc

SEQ ID NO: 2205395 - RNA, 23 nt, Human
uagauaggucagugcaaauacuc

SEQ ID NO: 2205396 - RNA, 17 nt, Human
ucuauaauguguucauu

SEQ ID NO: 2205397 - RNA, 17 nt, Human
cgcgcugcgcgccgcgc

SEQ ID NO: 2205398 - RNA, 22 nt, Human
aaacauguuuaucguauuugau

SEQ ID NO: 2205399 - RNA, 22 nt, Human
gucucuacuaaaaauacaaaaa

SEQ ID NO: 2205400 - RNA, 17 nt, Human
ccaaaaaucucaauauu

SEQ ID NO: 2205401 - RNA, 15 nt, Human
gagccggagccucca

SEQ ID NO: 2205402 - RNA, 17 nt, Human
uuauuacuguaagaaaa

SEQ ID NO: 2205403 - RNA, 21 nt, Human
auccccaagccuggcaaggga

SEQ ID NO: 2205404 - RNA, 14 nt, Human
cuccugagacacau

SEQ ID NO: 2205405 - RNA, 17 nt, Human
acaaaugggaaacaaaa

SEQ ID NO: 2205406 - RNA, 21 nt, Human
aggguuaugauuaaguaauga

SEQ ID NO: 2205407 - RNA, 17 nt, Human
uccucugagccuuggga

SEQ ID NO: 2205408 - RNA, 18 nt, Human
cugagggcauagaaguaa

SEQ ID NO: 2205409 - RNA, 20 nt, Human
caccucagcugccuccccag

SEQ ID NO: 2205410 - RNA, 21 nt, Human
ccucuguucugcacacagcac

SEQ ID NO: 2205411 - RNA, 15 nt, Human
caagcucacagaccu

SEQ ID NO: 2205412 - RNA, 22 nt, Human
gcacagccucuuagaugcaguu

SEQ ID NO: 2205413 - RNA, 16 nt, Human
acaugaaguccaagca

SEQ ID NO: 2205414 - RNA, 20 nt, Human
gccgggcgugguggugagug

SEQ ID NO: 2205415 - RNA, 15 nt, Human
uuauagcuacuaauu

SEQ ID NO: 2205416 - RNA, 14 nt, Human
aaaagaaacauuug

SEQ ID NO: 2205417 - RNA, 16 nt, Human
ucuucaacucccugcc

SEQ ID NO: 2205418 - RNA, 16 nt, Human
ccacuuccucccggcc

SEQ ID NO: 2205419 - RNA, 19 nt, Human
cucacauuuauauuuuugu

SEQ ID NO: 2205420 - RNA, 20 nt, Human
acaagacacagugaccauac

SEQ ID NO: 2205421 - RNA, 21 nt, Human
cuaaauugacacuuaaaaaug

SEQ ID NO: 2205422 - RNA, 20 nt, Human
aagucuuucacauuuaaaua

SEQ ID NO: 2205423 - RNA, 14 nt, Human
aaauauuauuuuau

SEQ ID NO: 2205424 - RNA, 20 nt, Human
cugauauuggacaguaaaau

SEQ ID NO: 2205425 - RNA, 16 nt, Human
ugcacaucaaaauaug

SEQ ID NO: 2205426 - RNA, 18 nt, Human
auuugcuggagcucugcc

SEQ ID NO: 2205427 - RNA, 23 nt, Human
aguacucauacauguuacaacac

SEQ ID NO: 2205428 - RNA, 17 nt, Human
gaaaaucaggcuggcca

SEQ ID NO: 2205429 - RNA, 18 nt, Human
uuuugugaagcaaaauuu

SEQ ID NO: 2205430 - RNA, 17 nt, Human
aagcuuuuuuugaauca

SEQ ID NO: 2205431 - RNA, 15 nt, Human
ccgugugccugagcg

SEQ ID NO: 2205432 - RNA, 15 nt, Human
agucucuaucauuaa

SEQ ID NO: 2205433 - RNA, 17 nt, Human
cgcgccuccgcuacuuc

SEQ ID NO: 2205434 - RNA, 15 nt, Human
cacuuccucccggcc

SEQ ID NO: 2205435 - RNA, 13 nt, Human
ugaaaaucuuaua

SEQ ID NO: 2205436 - RNA, 16 nt, Human
ccagaucaagccugcc

SEQ ID NO: 2205437 - RNA, 15 nt, Human
agaauaccacaggaa

SEQ ID NO: 2205438 - RNA, 21 nt, Human
ugaacaaauuuacagagacag

SEQ ID NO: 2205439 - RNA, 21 nt, Human
auauauuuuuuuuuuuaaaaa

SEQ ID NO: 2205440 - RNA, 13 nt, Human
ccucccccaucuc

SEQ ID NO: 2205441 - RNA, 18 nt, Human
cagucucccucccuuggg

SEQ ID NO: 2205442 - RNA, 21 nt, Human
cucaguccaugaagauguaga

SEQ ID NO: 2205443 - RNA, 21 nt, Human
uagggugauauuaaccagggg

SEQ ID NO: 2205444 - RNA, 18 nt, Human
agcuuugugcagauucuu

SEQ ID NO: 2205445 - RNA, 23 nt, Human
cauuuuuuuuuucaauaaaacuu

SEQ ID NO: 2205446 - RNA, 14 nt, Human
augaacuuuuuguu

SEQ ID NO: 2205447 - RNA, 22 nt, Human
ccugggaccaggcacccccaga

SEQ ID NO: 2205448 - RNA, 13 nt, Human
uguauauuuuaua

SEQ ID NO: 2205449 - RNA, 23 nt, Human
agcccuccuuaucaaaggacacc

SEQ ID NO: 2205450 - RNA, 18 nt, Human
ccugccuaagugcagccc

SEQ ID NO: 2205451 - RNA, 19 nt, Human
ccauccugccccugagccc

SEQ ID NO: 2205452 - RNA, 18 nt, Human
uguaaaggaauuuaaaaa

SEQ ID NO: 2205453 - RNA, 23 nt, Human
uguugcccacagcuguaugauuc

SEQ ID NO: 2205454 - RNA, 22 nt, Human
gcugguggcgcuggcugcgcuc

SEQ ID NO: 2205455 - RNA, 15 nt, Human
aguucugaagaagau

SEQ ID NO: 2205456 - RNA, 17 nt, Human
aauguuguuuuaggaau

SEQ ID NO: 2205457 - RNA, 15 nt, Human
uacuaauuuuaaaau

SEQ ID NO: 2205458 - RNA, 14 nt, Human
ggugcugcagcccc

SEQ ID NO: 2205459 - RNA, 13 nt, Human
aagacaaggaaaa

SEQ ID NO: 2205460 - RNA, 16 nt, Human
uaacaauaaaagacaa

SEQ ID NO: 2205461 - RNA, 14 nt, Human
cugucucaguccau

SEQ ID NO: 2205462 - RNA, 12 nt, Human
aaaagaaagaaa

SEQ ID NO: 2205463 - RNA, 22 nt, Human
gcucuaucccaaccucucccaa

SEQ ID NO: 2205464 - RNA, 17 nt, Human
agccuccagcugccccg

SEQ ID NO: 2205465 - RNA, 15 nt, Human
ccucucuuccucccu

SEQ ID NO: 2205466 - RNA, 14 nt, Human
acagaauuuuaugc

SEQ ID NO: 2205467 - RNA, 16 nt, Human
cagauccccaagccug

SEQ ID NO: 2205468 - RNA, 19 nt, Human
ugcccugaaagucccagau

SEQ ID NO: 2205469 - RNA, 13 nt, Human
gacaaggaaaaaa

SEQ ID NO: 2205470 - RNA, 19 nt, Human
ggcugcugguggcgcuggc

SEQ ID NO: 2205471 - RNA, 20 nt, Human
aauaagccagacaucaacag

SEQ ID NO: 2205472 - RNA, 16 nt, Human
accucugccucagaaa

SEQ ID NO: 2205473 - RNA, 15 nt, Human
ggugcugcagccccu

SEQ ID NO: 2205474 - RNA, 13 nt, Human
auugauuauaugu

SEQ ID NO: 2205475 - RNA, 14 nt, Human
auaccaugaugcug

SEQ ID NO: 2205476 - RNA, 20 nt, Human
gccugagcggaccuucccag

SEQ ID NO: 2205477 - RNA, 22 nt, Human
uaauaggcguaacuaauuuuaa

SEQ ID NO: 2205478 - RNA, 12 nt, Human
cuccauuuuuag

SEQ ID NO: 2205479 - RNA, 20 nt, Human
aagacagugaaagaaaauaa

SEQ ID NO: 2205480 - RNA, 23 nt, Human
gagguaccagccuuggauacucc

SEQ ID NO: 2205481 - RNA, 15 nt, Human
cuggacucaccuccc

SEQ ID NO: 2205482 - RNA, 11 nt, Human
ggggaggggcg

SEQ ID NO: 2205483 - RNA, 19 nt, Human
cuccgcuacuuccagggcu

SEQ ID NO: 2205484 - RNA, 16 nt, Human
agggaggacgcucucu

SEQ ID NO: 2205485 - RNA, 16 nt, Human
acaugaacuuguaaag

SEQ ID NO: 2205486 - RNA, 15 nt, Human
guuuuucuuuucauu

SEQ ID NO: 2205487 - RNA, 14 nt, Human
ccucuccucucuuc

SEQ ID NO: 2205488 - RNA, 19 nt, Human
ccccucuggcuccagcugg

SEQ ID NO: 2205489 - RNA, 21 nt, Human
acagugauuaccagggacuga

SEQ ID NO: 2205490 - RNA, 15 nt, Human
ccucuucugacacua

SEQ ID NO: 2205491 - RNA, 23 nt, Human
aaauuuacagagacagaaagcag

SEQ ID NO: 2205492 - RNA, 23 nt, Human
uuuccaucaaggguacacugccu

SEQ ID NO: 2205493 - RNA, 19 nt, Human
aaaacguauugcauuuaau

SEQ ID NO: 2205494 - RNA, 13 nt, Human
aacaauaaaagac

SEQ ID NO: 2205495 - RNA, 23 nt, Human
ccucagcugccuccccagcucua

SEQ ID NO: 2205496 - RNA, 23 nt, Human
cuuaagaagacugcauuauauuu

SEQ ID NO: 2205497 - RNA, 16 nt, Human
acauuuauauuuuugu

SEQ ID NO: 2205498 - RNA, 13 nt, Human
aacucuauaaugu

SEQ ID NO: 2205499 - RNA, 12 nt, Human
auuuuaaaagaa

SEQ ID NO: 2205500 - RNA, 19 nt, Human
gcuccgcgcagcucaggcu

SEQ ID NO: 2205501 - RNA, 14 nt, Human
cucagucucccucc

SEQ ID NO: 2205502 - RNA, 14 nt, Human
agcgcgcgcgcccu

SEQ ID NO: 2205503 - RNA, 20 nt, Human
ccagaaugaccuggccgcag

SEQ ID NO: 2205504 - RNA, 20 nt, Human
cuaaaugucaaucagccuag

SEQ ID NO: 2205505 - RNA, 12 nt, Human
aucguguccccu

SEQ ID NO: 2205506 - RNA, 13 nt, Human
uuaugcuaaguga

SEQ ID NO: 2205507 - RNA, 13 nt, Human
ccaaauugagcua

SEQ ID NO: 2205508 - RNA, 17 nt, Human
agugauuaccagggacu

SEQ ID NO: 2205509 - RNA, 15 nt, Human
auaaaguguuugaaa

SEQ ID NO: 2205510 - RNA, 17 nt, Human
aaauauaaauaaaaaua

SEQ ID NO: 2205511 - RNA, 23 nt, Human
cucauguccacugguucuucuug

SEQ ID NO: 2205512 - RNA, 15 nt, Human
gcccugugcggccug

SEQ ID NO: 2205513 - RNA, 19 nt, Human
auuucuucaacucccugcc

SEQ ID NO: 2205514 - RNA, 15 nt, Human
augaauuaaguuuuu

SEQ ID NO: 2205515 - RNA, 22 nt, Human
auauauauuuuuuuuuuuaaaa

SEQ ID NO: 2205516 - RNA, 20 nt, Human
cccugcacuccagccugagc

SEQ ID NO: 2205517 - RNA, 19 nt, Human
auauauuuuuuuuuuuaaa

SEQ ID NO: 2205518 - RNA, 14 nt, Human
aauaguuuaugauu

SEQ ID NO: 2205519 - RNA, 16 nt, Human
aagaaaauaacaauaa

SEQ ID NO: 2205520 - RNA, 18 nt, Human
gccuuggggcugaugcag

SEQ ID NO: 2205521 - RNA, 23 nt, Human
acucuauguucuaagaagugaaa

SEQ ID NO: 2205522 - RNA, 17 nt, Human
uccugccccugagccca

SEQ ID NO: 2205523 - RNA, 17 nt, Human
ccaugaugcugagcccg

SEQ ID NO: 2205524 - RNA, 23 nt, Human
agccuugggaccccugagcuugc

SEQ ID NO: 2205525 - RNA, 18 nt, Human
gaaacaaaaggauaauga

SEQ ID NO: 2205526 - RNA, 21 nt, Human
auuuuuucucuaggaaauauu

SEQ ID NO: 2205527 - RNA, 15 nt, Human
aaggaauuuaaaaau

SEQ ID NO: 2205528 - RNA, 22 nt, Human
cugccuccccagcucuauccca

SEQ ID NO: 2205529 - RNA, 18 nt, Human
acauuuauauuuuuguga

SEQ ID NO: 2205530 - RNA, 17 nt, Human
uuauuuguacauuuuuu

SEQ ID NO: 2205531 - RNA, 19 nt, Human
aauuuuuauauuugaaaua

SEQ ID NO: 2205532 - RNA, 18 nt, Human
acugacucuuaagaagac

SEQ ID NO: 2205533 - RNA, 19 nt, Human
ccacuuggacaugggcccc

SEQ ID NO: 2205534 - RNA, 23 nt, Human
ucuaccaaaaaucucaauauuuc

SEQ ID NO: 2205535 - RNA, 22 nt, Human
ccccuuccuaauuccacagcug

SEQ ID NO: 2205536 - RNA, 22 nt, Human
cccaugauguuuagaaacacaa

SEQ ID NO: 2205537 - RNA, 15 nt, Human
gcaacccaaauguuc

SEQ ID NO: 2205538 - RNA, 22 nt, Human
cccuauccuacuuccccuuccu

SEQ ID NO: 2205539 - RNA, 23 nt, Human
guaauuccguagguuauuuucag

SEQ ID NO: 2205540 - RNA, 15 nt, Human
aaauaauuuuuauau

SEQ ID NO: 2205541 - RNA, 16 nt, Human
ugugagaugcuagaac

SEQ ID NO: 2205542 - RNA, 13 nt, Human
ugccuaauuuguu

SEQ ID NO: 2205543 - RNA, 23 nt, Human
gccagguaccuucucaccuguga

SEQ ID NO: 2205544 - RNA, 20 nt, Human
cuugccauaauuacuauguc

SEQ ID NO: 2205545 - RNA, 14 nt, Human
cucagcugccuccc

SEQ ID NO: 2205546 - RNA, 18 nt, Human
caugaauuaguuuuauau

SEQ ID NO: 2205547 - RNA, 18 nt, Human
cuggaaacuucagcgguu

SEQ ID NO: 2205548 - RNA, 14 nt, Human
uaguaucaaaagaa

SEQ ID NO: 2205549 - RNA, 20 nt, Human
gcccauccugccccugagcc

SEQ ID NO: 2205550 - RNA, 22 nt, Human
auaaaguaugugcauauuuuau

SEQ ID NO: 2205551 - RNA, 20 nt, Human
cugagaccaaggcccccggg

SEQ ID NO: 2205552 - RNA, 14 nt, Human
gauuaguacacacu

SEQ ID NO: 2205553 - RNA, 17 nt, Human
auuuucuauaauuuaaa

SEQ ID NO: 2205554 - RNA, 16 nt, Human
uggggauagugaggca

SEQ ID NO: 2205555 - RNA, 21 nt, Human
caucccacccgcccaccgcag

SEQ ID NO: 2205556 - RNA, 13 nt, Human
ccuccuuuuaaag

SEQ ID NO: 2205557 - RNA, 21 nt, Human
cugggaccaggcacccccaga

SEQ ID NO: 2205558 - RNA, 20 nt, Human
ccacuuggacaugggcccca

SEQ ID NO: 2205559 - RNA, 16 nt, Human
uucaauaaaacuuuuc

SEQ ID NO: 2205560 - RNA, 22 nt, Human
aauuuuuucucuaggaaauauu

SEQ ID NO: 2205561 - RNA, 20 nt, Human
ugggccccagauaccaugau

SEQ ID NO: 2205562 - RNA, 14 nt, Human
augggccauaugaa

SEQ ID NO: 2205563 - RNA, 17 nt, Human
agcucccaggaggggcu

SEQ ID NO: 2205564 - RNA, 15 nt, Human
cucgugggacaguca

SEQ ID NO: 2205565 - RNA, 17 nt, Human
ccucagucucccucccu

SEQ ID NO: 2205566 - RNA, 15 nt, Human
auagucauucugccu

SEQ ID NO: 2205567 - RNA, 16 nt, Human
cuguucgcgcgccucc

SEQ ID NO: 2205568 - RNA, 15 nt, Human
aauacuuuauaaagg

SEQ ID NO: 2205569 - RNA, 23 nt, Human
cuagacccacuggacucaccucc

SEQ ID NO: 2205570 - RNA, 14 nt, Human
acauagugaggagc

SEQ ID NO: 2205571 - RNA, 17 nt, Human
cggcccugugcggccug

SEQ ID NO: 2205572 - RNA, 21 nt, Human
gccacgcucugggucgccggc

SEQ ID NO: 2205573 - RNA, 19 nt, Human
gucuuucacauuuaaauaa

SEQ ID NO: 2205574 - RNA, 16 nt, Human
ccuggugggcagagag

SEQ ID NO: 2205575 - RNA, 20 nt, Human
ugauuucugagcauuuaaua

SEQ ID NO: 2205576 - RNA, 18 nt, Human
aagaccucauuuugaagg

SEQ ID NO: 2205577 - RNA, 22 nt, Human
aaagggcauggguuuuauuaua

SEQ ID NO: 2205578 - RNA, 14 nt, Human
aucaaaagaaagaa

SEQ ID NO: 2205579 - RNA, 18 nt, Human
ccggagccuccagcugcc

SEQ ID NO: 2205580 - RNA, 18 nt, Human
acuguaaagcuuugugca

SEQ ID NO: 2205581 - RNA, 19 nt, Human
uccugugggaccugggcca

SEQ ID NO: 2205582 - RNA, 16 nt, Human
ggggcuucugggcaga

SEQ ID NO: 2205583 - RNA, 20 nt, Human
auuuucaguuauuauauuua

SEQ ID NO: 2205584 - RNA, 18 nt, Human
uguggucacaggaaguag

SEQ ID NO: 2205585 - RNA, 17 nt, Human
ugaaggauuuauguuua

SEQ ID NO: 2205586 - RNA, 18 nt, Human
acaugaacuuguaaagga

SEQ ID NO: 2205587 - RNA, 20 nt, Human
ccaaccucucccaacuauaa

SEQ ID NO: 2205588 - RNA, 17 nt, Human
cauauuuauagccaggu

SEQ ID NO: 2205589 - RNA, 14 nt, Human
ugagcuugcagaga

SEQ ID NO: 2205590 - RNA, 20 nt, Human
agcugccccggggaggggcg

SEQ ID NO: 2205591 - RNA, 15 nt, Human
aagcacuaaacaaag

SEQ ID NO: 2205592 - RNA, 21 nt, Human
aaaauuuuuucucuaggaaau

SEQ ID NO: 2205593 - RNA, 17 nt, Human
guucgcgcgccuccgcu

SEQ ID NO: 2205594 - RNA, 13 nt, Human
uacagagacagaa

SEQ ID NO: 2205595 - RNA, 15 nt, Human
agccugaaagaggaa

SEQ ID NO: 2205596 - RNA, 20 nt, Human
accgcuguacgcgagcgcgc

SEQ ID NO: 2205597 - RNA, 15 nt, Human
uuuagugaaauauua

SEQ ID NO: 2205598 - RNA, 19 nt, Human
agagccuuuuuuugaaaaa

SEQ ID NO: 2205599 - RNA, 22 nt, Human
caucucuucuggguuccuuccu

SEQ ID NO: 2205600 - RNA, 13 nt, Human
cagcucaggcugg

SEQ ID NO: 2205601 - RNA, 15 nt, Human
gacaguauggcagcu

SEQ ID NO: 2205602 - RNA, 16 nt, Human
gcauccuagucucuau

SEQ ID NO: 2205603 - RNA, 20 nt, Human
ugagucccaggcugagccuc

SEQ ID NO: 2205604 - RNA, 16 nt, Human
aaaagcuccauuuuua

SEQ ID NO: 2205605 - RNA, 23 nt, Human
ucggccuccauccugaggcucca

SEQ ID NO: 2205606 - RNA, 20 nt, Human
augggccccagauaccauga

SEQ ID NO: 2205607 - RNA, 14 nt, Human
ccucggacggcucc

SEQ ID NO: 2205608 - RNA, 14 nt, Human
auuugaaauuguau

SEQ ID NO: 2205609 - RNA, 19 nt, Human
cuguacgcgagcgcgcgcg

SEQ ID NO: 2205610 - RNA, 18 nt, Human
cccacuagacccacugga

SEQ ID NO: 2205611 - RNA, 18 nt, Human
aaauaacgauaaaagaca

SEQ ID NO: 2205612 - RNA, 23 nt, Human
cucuacuaaaaauacaaaaaaaa

SEQ ID NO: 2205613 - RNA, 14 nt, Human
gauaaaagacagug

SEQ ID NO: 2205614 - RNA, 15 nt, Human
gcgagcgcgcgcgcc

SEQ ID NO: 2205615 - RNA, 23 nt, Human
ucuuagaugcaguucugaagaag

SEQ ID NO: 2205616 - RNA, 12 nt, Human
acccccugggag

SEQ ID NO: 2205617 - RNA, 12 nt, Human
cagauuuuccug

SEQ ID NO: 2205618 - RNA, 20 nt, Human
cugcucgcccacuuccuccc

SEQ ID NO: 2205619 - RNA, 18 nt, Human
auucuugccaaauauaaa

SEQ ID NO: 2205620 - RNA, 16 nt, Human
uggcgcuggcugcgcu

SEQ ID NO: 2205621 - RNA, 13 nt, Human
cauuuguauaaaa

SEQ ID NO: 2205622 - RNA, 13 nt, Human
cccggccgcgcug

SEQ ID NO: 2205623 - RNA, 16 nt, Human
cuccacauccuguggg

SEQ ID NO: 2205624 - RNA, 15 nt, Human
ucaguuuuugugaaa

SEQ ID NO: 2205625 - RNA, 21 nt, Human
gcacuguggguagacacacau

SEQ ID NO: 2205626 - RNA, 16 nt, Human
agugagacagcucugc

SEQ ID NO: 2205627 - RNA, 19 nt, Human
agaugcuagaacucccuuu

SEQ ID NO: 2205628 - RNA, 19 nt, Human
aaaaucuuauaauuuaaaa

SEQ ID NO: 2205629 - RNA, 23 nt, Human
agggaagggggaacaugagccuu

SEQ ID NO: 2205630 - RNA, 21 nt, Human
gaagugaaaaucuacacucca

SEQ ID NO: 2205631 - RNA, 19 nt, Human
cuucuggguuccuuccucu

SEQ ID NO: 2205632 - RNA, 17 nt, Human
uccagcuggccgggagc

SEQ ID NO: 2205633 - RNA, 14 nt, Human
auggaaguaaaugu

SEQ ID NO: 2205634 - RNA, 12 nt, Human
gguauuuuaauc

SEQ ID NO: 2205635 - RNA, 15 nt, Human
agugacaagcucaca

SEQ ID NO: 2205636 - RNA, 18 nt, Human
uucaauaucuuuuuuuua

SEQ ID NO: 2205637 - RNA, 18 nt, Human
guuuaugguuguauuauu

SEQ ID NO: 2205638 - RNA, 14 nt, Human
uaguuucccuugca

SEQ ID NO: 2205639 - RNA, 21 nt, Human
cugcccugcugagucccaggc

SEQ ID NO: 2205640 - RNA, 14 nt, Human
ugagcuaggggggu

SEQ ID NO: 2205641 - RNA, 13 nt, Human
cugagacacaugg

SEQ ID NO: 2205642 - RNA, 13 nt, Human
acacuuaaaaaug

SEQ ID NO: 2205643 - RNA, 16 nt, Human
guucugcacacagcac

SEQ ID NO: 2205644 - RNA, 14 nt, Human
auuuucuauaauuu

SEQ ID NO: 2205645 - RNA, 17 nt, Human
aaagcagggacuugaac

SEQ ID NO: 2205646 - RNA, 13 nt, Human
aaguucuagugac

SEQ ID NO: 2205647 - RNA, 17 nt, Human
ccugccccccagcccuc

SEQ ID NO: 2205648 - RNA, 18 nt, Human
cucuauguucuaagaagu

SEQ ID NO: 2205649 - RNA, 20 nt, Human
gaaacauuugguaaggggaa

SEQ ID NO: 2205650 - RNA, 22 nt, Human
uuuauagcuacuaauuuuaaaa

SEQ ID NO: 2205651 - RNA, 17 nt, Human
acuuccagauccuggaa

SEQ ID NO: 2205652 - RNA, 17 nt, Human
cguaaucguguccccua

SEQ ID NO: 2205653 - RNA, 18 nt, Human
agccggagccuccagcug

SEQ ID NO: 2205654 - RNA, 23 nt, Human
ugaauuauguuugcauguucacu

SEQ ID NO: 2205655 - RNA, 18 nt, Human
cccacuggacucaccucc

SEQ ID NO: 2205656 - RNA, 15 nt, Human
ggggcuucugggcag

SEQ ID NO: 2205657 - RNA, 16 nt, Human
auacauguuacaacac

SEQ ID NO: 2205658 - RNA, 18 nt, Human
acauguuacaacacggac

SEQ ID NO: 2205659 - RNA, 14 nt, Human
uuuguauaaaauaa

SEQ ID NO: 2205660 - RNA, 14 nt, Human
cuaucaauccaaga

SEQ ID NO: 2205661 - RNA, 19 nt, Human
accucagcugccuccccag

SEQ ID NO: 2205662 - RNA, 17 nt, Human
ccaaaagguauuuuaau

SEQ ID NO: 2205663 - RNA, 15 nt, Human
aaagaaagaaaauca

SEQ ID NO: 2205664 - RNA, 22 nt, Human
ugagacucugucucaguccaug

SEQ ID NO: 2205665 - RNA, 16 nt, Human
aauauaaauaaaaaua

SEQ ID NO: 2205666 - RNA, 21 nt, Human
auuuacaaaugggaaacaaaa

SEQ ID NO: 2205667 - RNA, 15 nt, Human
auauugacuuuuuau

SEQ ID NO: 2205668 - RNA, 16 nt, Human
cgcuuccgcauccuag

SEQ ID NO: 2205669 - RNA, 23 nt, Human
aucucuucuggguuccuuccucu

SEQ ID NO: 2205670 - RNA, 14 nt, Human
uauauauauauuuu

SEQ ID NO: 2205671 - RNA, 15 nt, Human
ugcaauuccacuuau

SEQ ID NO: 2205672 - RNA, 17 nt, Human
caauaacgauaaaagac

SEQ ID NO: 2205673 - RNA, 14 nt, Human
cuguaaucacagcu

SEQ ID NO: 2205674 - RNA, 19 nt, Human
auuuacagagacagaaagc

SEQ ID NO: 2205675 - RNA, 20 nt, Human
ccauuguggucacaggaagu

SEQ ID NO: 2205676 - RNA, 19 nt, Human
agucaaauugugugaaagg

SEQ ID NO: 2205677 - RNA, 21 nt, Human
uaaaagacagugaaagaaaau

SEQ ID NO: 2205678 - RNA, 14 nt, Human
uugugauugauuau

SEQ ID NO: 2205679 - RNA, 21 nt, Human
gccugagaccaaggcccccgg

SEQ ID NO: 2205680 - RNA, 22 nt, Human
ggcauuuaggccaugggacagg

SEQ ID NO: 2205681 - RNA, 19 nt, Human
aagcuuguauuccuuuuuc

SEQ ID NO: 2205682 - RNA, 18 nt, Human
auagggagggaaggggga

SEQ ID NO: 2205683 - RNA, 17 nt, Human
guguccccuauccuacu

SEQ ID NO: 2205684 - RNA, 17 nt, Human
ucuuauaauuuaaaaua

SEQ ID NO: 2205685 - RNA, 15 nt, Human
ugccccgucccccuc

SEQ ID NO: 2205686 - RNA, 15 nt, Human
uaacgauaaaagaca

SEQ ID NO: 2205687 - RNA, 16 nt, Human
cuuuaugcuaagugaa
